United States Patent 12,275,987 (EGG-TYPE CHICKEN WHOLE-GENOME SNP CHIP AND USE THEREOF) - sequence listing, part 2

SEQ ID NO: 14492 - DNA, 121 bp, Artificial Sequence
  Synthesized
  misc_feature (61): n=a or g
gtgccaattgacgaatgagacagaaaaccgtagtgatgaataactggatgatttggaagcntggactgaactatcagactcagagcagcagttcaatccttggctggtgagtatacttcac

SEQ ID NO: 14493 - DNA, 121 bp, Artificial Sequence
  Synthesized
  misc_feature (61): n=a or g
aaagaaaacaacaaatctgatgtctgcttcaaaatcttgacaatgtcctggggacaggagnaaaaaaatgacatggtgaagctaacacagcatccgtattttttttttttctccaggaatc

SEQ ID NO: 14494 - DNA, 121 bp, Artificial Sequence
  Synthesized
  misc_feature (61): n=t or c
acacattcagaaagcagttgtaatgataatgaggtagcaagggaaaactcacttaacttantcactttaaaacatcaaaatctaaaagctttactatactctttcttattccatctccttt

SEQ ID NO: 14495 - DNA, 121 bp, Artificial Sequence
  Synthesized
  misc_feature (61): n=t or g
cttacaaaacagtctgatcatgtttccttttcctccaccctgtctggcccattggcatagnctgcaaggtcttcaaggaaggatcgctctcttgcagagcgtagtctgtggagacagaata

SEQ ID NO: 14496 - DNA, 121 bp, Artificial Sequence
  Synthesized
  misc_feature (61): n=a or g
gtatgctggtcacaaactgttactttctgtccatggagtaaaggaagtgaaatcacaagangttcctggagcaactcagatgtctggagcagtattagtgttcttcctgtagatctgggaa

SEQ ID NO: 14497 - DNA, 121 bp, Artificial Sequence
  Synthesized
  misc_feature (61): n=a or g
ttagtaagaaagtacaaagttggtagcaaaggcaactttggtcatcatttataaaattacnttgtgttctgcacttactttaattattaccttctgcatgaatgtgacaaaaaaacatgtt

SEQ ID NO: 14498 - DNA, 121 bp, Artificial Sequence
  Synthesized
  misc_feature (61): n=a or g
ctcaattccccctatgttgtactgttatatcccaggatattgcctttcttaggaagtgcantaattcactgcaaagtgctcacccttattgttaaaggcagaaaaaaagcacatgtggttt

SEQ ID NO: 14499 - DNA, 121 bp, Artificial Sequence
  Synthesized
  misc_feature (61): n=a or c
tcccagccagcaatcttgggcagaagctgtgatgtgaatgtataagtacactcaagcatgntttcctattactgctgggaaatcaagttctacaagaatcagaccaagttttaaagacaac

SEQ ID NO: 14500 - DNA, 121 bp, Artificial Sequence
  Synthesized
  misc_feature (61): n=a or g
ttatttggactaaccgaacatttttagctctttattatggatcagtgcttcattgattagnaatttcagaggacaagataattcttttttttattattattttccagtatttctattgaca

SEQ ID NO: 14501 - DNA, 121 bp, Artificial Sequence
  Synthesized
  misc_feature (61): n=a or g
cccacacacagccttccccagtgcagcagcttggctgaggtttccacctctccggactccngttggtgttggtgacttaacacatctcatttgctgcctgctgccagaaaagactcacatc

SEQ ID NO: 14502 - DNA, 121 bp, Artificial Sequence
  Synthesized
  misc_feature (61): n=a or g
atgtgacaatgccatgcaatgtctcacacccaggctgggaagttttgtcatccaaagtcantctgagagcacacacggaatgacaaaaggcaggtggaatgtgaaatgctggtttggagac

SEQ ID NO: 14503 - DNA, 121 bp, Artificial Sequence
  Synthesized
  misc_feature (61): n=a or g
ctcccctgtctcagtttataaccattccccctcatcctatcactatccctaacgaagccanctcaccagcaaggagaccgactcatccccatctctaaaccactacaactccaccaacaaa

SEQ ID NO: 14504 - DNA, 121 bp, Artificial Sequence
  Synthesized
  misc_feature (61): n=t or g
tgtgagagagagggaggactgctgttcttggtggctgtatactatacctgttcctacactngctgcgtatcatttatttatttgcacaatcagttaaagcagacttcaggatggtgttctc

SEQ ID NO: 14505 - DNA, 121 bp, Artificial Sequence
  Synthesized
  misc_feature (61): n=a or t
ggtgtcctttcttacatctgacaacagtgcctcactggcaccaaggctgtctgcatattcngcgtgtaaagtcctgcttttcccctgggaactgcaaagatatgctgaaggttgtctaacc

SEQ ID NO: 14506 - DNA, 121 bp, Artificial Sequence
  Synthesized
  misc_feature (61): n=a or g
gataaaacacattctaaactcattacgtaacagtagaaggttaaaaggtaagtgagagttnggggatcggatgaaatttaggtcagtaaatacaaccctgttttgaatggcagcagagaga

SEQ ID NO: 14507 - DNA, 121 bp, Artificial Sequence
  Synthesized
  misc_feature (61): n=c or g
tgttttgaggaagctgcttctttcctcttcccaccttccatctacttgaagtgggagcatntgtccctgtgtcagcattaggctcatactatctaatgagagatcttttagctggcagtgg

SEQ ID NO: 14508 - DNA, 121 bp, Artificial Sequence
  Synthesized
  misc_feature (61): n=t or c
ttgcttatccagattttccagcagcaaacatcgctcttaaaagccgatcactgactttatnttgtgatccccttttctcttatgctggccagaaatttcattagctttagtctcactttct

SEQ ID NO: 14509 - DNA, 121 bp, Artificial Sequence
  Synthesized
  misc_feature (61): n=t or c
gaagaaaaaaatcttagaaatgtttattgcaaatgctcgagaacttacactgcatgagtgncatctcctacaattgaaaagatagcactgatgtgtgaagggaccatagatgtggtactgc

SEQ ID NO: 14510 - DNA, 121 bp, Artificial Sequence
  Synthesized
  misc_feature (61): n=c or g
aagcaaatcacaagtctcacagttaggaacaagaatctgttccttctacctacatcttganatctcttaatacaaatgtttccagctgggagtctctggaagagaagtatttaattttaat

SEQ ID NO: 14511 - DNA, 121 bp, Artificial Sequence
  Synthesized
  misc_feature (61): n=a or g
tgcctatttaaactttatgtatgcttaccttgttctattgaactggctccacgcaagtacnaagtgtttttggaactgcatttcacgttgtcttttctgttgttctagaattaacaagaat

SEQ ID NO: 14512 - DNA, 121 bp, Artificial Sequence
  Synthesized
  misc_feature (61): n=t or c
ccctgtgtcctgcaggtcaaggcccatttggcctcagttaggcgatgttgcctttactggngctttgctcttagtggaccagagggatcttctgactcctacttcaattctgagctgcctt

SEQ ID NO: 14513 - DNA, 121 bp, Artificial Sequence
  Synthesized
  misc_feature (61): n=a or g
gtccaaggcaagtgagtgaagacagtaatccactcctttcttgtcactgaaacctctattncaacaaggagccaggctctactgcactgaccctgaatgcagctggatgttctgctcagct

SEQ ID NO: 14514 - DNA, 121 bp, Artificial Sequence
  Synthesized
  misc_feature (61): n=a or g
atcacatttactcttcaaactgtattccagatagtaacagaagtctaggaaactttttcantgtgcttatatatacaaataatgtgattggtatatgaaatgtagcaaaaattttcacttc

SEQ ID NO: 14515 - DNA, 121 bp, Artificial Sequence
  Synthesized
  misc_feature (61): n=a or g
aaaaaaaataaaaataaaaataaaaaattacatccagtgggaaaagctcagaacagaaatntcatgtggaattatcacagcaaaacttaaggaaaattaactatggtatgaaagaacgtga

SEQ ID NO: 14516 - DNA, 121 bp, Artificial Sequence
  Synthesized
  misc_feature (61): n=a or g
gttgatgatttttttttatcagcatctgccttccaaagatgatgctggttggaaggacttngatcctttcagggtggtctctagagaagccagaccctatgctccagttttttttcaggtt

SEQ ID NO: 14517 - DNA, 121 bp, Artificial Sequence
  Synthesized
  misc_feature (61): n=a or g
gcaggaaatgtattccaagtatccagacaacacaggaaaatatgcacacagtgctctaacnataatgagaacattgagacacggcagtaagggtaaatcaagtactgttattagacaaaca

SEQ ID NO: 14518 - DNA, 121 bp, Artificial Sequence
  Synthesized
  misc_feature (61): n=a or g
acctgaaatcgtgaccaagtatgcccagagcaaaatgcaccactgtttttatggcagagtnggggtttgtaacggctcagcaccccacagggagctctgctggctcctgaagttaaaatca

SEQ ID NO: 14519 - DNA, 121 bp, Artificial Sequence
  Synthesized
  misc_feature (61): n=t or g
gttggatgggcagaatgaacagcagcgctcagggtgggtaacaagacagaagggtgctggnggctggtgtctacatcagcctccaggacacaggttttcaagcaccatcacaggccaggac

SEQ ID NO: 14520 - DNA, 121 bp, Artificial Sequence
  Synthesized
  misc_feature (61): n=t or c
acgaacagcactgacaaaacgcaacctgtgatgtgccagtaggaaagggtggcacacctcnattaatcacttgttatgaattattcaagtaaaaaggaagcagaaggcaaactcagaaacg

SEQ ID NO: 14521 - DNA, 121 bp, Artificial Sequence
  Synthesized
  misc_feature (61): n=t or g
cagatgggttttttatcgcacaggatttccccttgtgatgccttgtgcctatatgagattntctactagaggttctcagagcaaaccaacaaatctttatagaattaaataataaaattgt

SEQ ID NO: 14522 - DNA, 121 bp, Artificial Sequence
  Synthesized
  misc_feature (61): n=t or c
tagaagctttgtgtactcactgtaccaagcagcatttcatgcaatgtagaacacgctctgntcatcatttcataacagatcacatgacttgtatcacatcacaactttgtgccagagcctc

SEQ ID NO: 14523 - DNA, 121 bp, Artificial Sequence
  Synthesized
  misc_feature (61): n=t or c
cacacccacagttcacaatgccccattcccaggggctcagtgctgctgcttctgttgcagncatgtccctttcctaccccaagactactctgggatctctgctttgtcgcacctccccatc

SEQ ID NO: 14524 - DNA, 121 bp, Artificial Sequence
  Synthesized
  misc_feature (61): n=t or c
tgctctgttttgatggcaagcagatttctgctgctctttggtaatctgtcctaatgctctnggtgctgcacatttcactgctgtttaagtagcttggcagcccactgcaccacctttcatg

SEQ ID NO: 14525 - DNA, 121 bp, Artificial Sequence
  Synthesized
  misc_feature (61): n=a or t
aaaatataaatagattttggaagcctgacagtaggctgagcttggagaggtggaagtttgncagagctgattccatgttaacatgtgtttgcccattagtaactgtcttcatatacagaga

SEQ ID NO: 14526 - DNA, 121 bp, Artificial Sequence
  Synthesized
  misc_feature (61): n=a or g
tcaggagaagttacatgacttcttccggagactgttaacactgctttaaaggccgcttctngggaactctactgcccttgacccaagagcaccttcttcctgagttcaggaaagagtttgc

SEQ ID NO: 14527 - DNA, 121 bp, Artificial Sequence
  Synthesized
  misc_feature (61): n=a or g
ctcagaataggatgctggctgtcactgttgcagcctgaggacagctcttacttctcagaanaagaatttgggatgatctttccttaaattcagctccattcattagagacttatgaacact

SEQ ID NO: 14528 - DNA, 121 bp, Artificial Sequence
  Synthesized
  misc_feature (61): n=t or c
atgaaattcttaaacctcccacagagctgccactctaaaagaagaactgcctaaactagcngccccactttcatccagtaattttctacatacctaggccatataccatagaggtacagac

SEQ ID NO: 14529 - DNA, 121 bp, Artificial Sequence
  Synthesized
  misc_feature (61): n=c or g
ttcctggtgggactctgacaacacagacctacaaacatctacactaaatcagtgttgtcancgagttactattattcacttccgtatttatgtgaaaccaaagggaatttgccttgaactt

SEQ ID NO: 14530 - DNA, 121 bp, Artificial Sequence
  Synthesized
  misc_feature (61): n=t or c
ataaacagacctatagcttagctcagagaaggtgacttataaactcttgcaggtgctcagnaacttgcagaacaaatgtgcaagcccagcactgtgataaacattagcacagaaaagcagc

SEQ ID NO: 14531 - DNA, 121 bp, Artificial Sequence
  Synthesized
  misc_feature (61): n=a or g
caaaatttactgtaaaaaaaatacgttttttacttttattttaaattggcagacttctgcnttgttcttatagagcttcaactgcagaaattttccaggcttcagttcaggaagacactta

SEQ ID NO: 14532 - DNA, 121 bp, Artificial Sequence
  Synthesized
  misc_feature (61): n=c or g
ccagcaaataacaagaataccaccatcttggaatctgccttgcaagactacggggaatttnaaagcaatgcagtatcgttctctacagatatttagctgttatgaagttactaaccagttg

SEQ ID NO: 14533 - DNA, 121 bp, Artificial Sequence
  Synthesized
  misc_feature (61): n=t or c
tttatgaaaatagccttatgcagggttcactgtccttttcttctgttcagaccaatgctcncctttcaccttatcacgtatcagactttattgctcttcttcctgcaggcctcattgacct

SEQ ID NO: 14534 - DNA, 121 bp, Artificial Sequence
  Synthesized
  misc_feature (61): n=t or c
ctgcaacatggcctaaatagaaaagaaataatctgattctaactgatgctgattctgtccngtaaagaggcaacatcactgaagacttgatcaagattcaggctgaagctttgaatctcca

SEQ ID NO: 14535 - DNA, 121 bp, Artificial Sequence
  Synthesized
  misc_feature (61): n=a or g
gaatgtgcagtgttggagaaatattttgaagtacctactgattttctttctgattatggcnaagtgtctagtggaaatattgcgagaatagcttttagagcagaactttcaaccaagtcta

SEQ ID NO: 14536 - DNA, 121 bp, Artificial Sequence
  Synthesized
  misc_feature (61): n=t or c
tgcctgacctcgcagaagggagaagggcaactaatggggagctccatttctaatcgccatnggggatgcattacagacagcggggatttatcaacccacagcactgttgcaaaatgcacat

SEQ ID NO: 14537 - DNA, 121 bp, Artificial Sequence
  Synthesized
  misc_feature (61): n=t or g
actaacataatactagtaccttggtaatgtgaactatgctgaaagaatcaactacagtcancttacaaacgagaaaagtcaatgacctaggagcagagatactccattttatgcagtgaca

SEQ ID NO: 14538 - DNA, 121 bp, Artificial Sequence
  Synthesized
  misc_feature (61): n=t or c
agcatgctacttctccagatttctttgcaattgaacactgctcctcctatccaaacatccntatcaatgagccatcactgatgctgaaggccacgtgggaagagtttaagacccaaggcaa

SEQ ID NO: 14539 - DNA, 121 bp, Artificial Sequence
  Synthesized
  misc_feature (61): n=a or g
agagcagactctggagactcacccattgtgtcttggactcctttaactcaagggccctttntctcatgccatgctgatagcctgagctcagcaagttgcagggttatccagagctcttgaa

SEQ ID NO: 14540 - DNA, 121 bp, Artificial Sequence
  Synthesized
  misc_feature (61): n=a or t
tatacgacaaataacaaacactcttagatccttagtctttttagctgtcaagaacagaaanttagtaatatttcagtagcttgttttacgggccttggaaaatgccttgaaagtgtcacaa

SEQ ID NO: 14541 - DNA, 121 bp, Artificial Sequence
  Synthesized
  misc_feature (61): n=c or g
cttcccttaaaccatgatttttgtgtagagagttgagatcaggtgagtgtggagtggaganaagtgaagcaaagcttccttttaggatttaggattcaaaatttttaaagtagcattatct

SEQ ID NO: 14542 - DNA, 121 bp, Artificial Sequence
  Synthesized
  misc_feature (61): n=c or g
ctcttattcaaacgtgtgttcatttgatcagtatttaactaagttctagctgataattaantttagatgttagtgtatgaagctccagcaaaggaaaatgctgctttggtaaactgtaaca

SEQ ID NO: 14543 - DNA, 121 bp, Artificial Sequence
  Synthesized
  misc_feature (61): n=a or g
gctttgccaagaacttctagcttgcaaattaagaaaaggaaccagaaataccatcaaaatntaagagtatacgatctataaatgttactgcagttttactaatcaaagaatagatctgatc

SEQ ID NO: 14544 - DNA, 121 bp, Artificial Sequence
  Synthesized
  misc_feature (61): n=a or g
ctttttttttaaatcctgaagtggagcaacagccgtagacattgtgcatatggatgaacangacagagagacataaatcagtgttgataattttcttttaagcagcaccattaattcctgt

SEQ ID NO: 14545 - DNA, 121 bp, Artificial Sequence
  Synthesized
  misc_feature (61): n=a or g
agccatttgtctcaacaaaactcccatatcacttgtacttcagagacaaagacagccccanatcagcacaaatcacagaggacgtaggcctgaaagagcagcccttgctccggttggtttc

SEQ ID NO: 14546 - DNA, 121 bp, Artificial Sequence
  Synthesized
  misc_feature (61): n=t or c
ctcctcatcagcgtaaacttccgtacaagatccctcagacagttttacatattttctaacnctttgggaatcttcagtttttgattggaggatactgcagaaaccacagggattttcattt

SEQ ID NO: 14547 - DNA, 121 bp, Artificial Sequence
  Synthesized
  misc_feature (61): n=c or g
ggaaggccaggaaggaaagcaatgggcttgagtatcttggtcttcctactccaatgtgganacatctcttctctgagcaatgtttacattagcaatcagtgctgaatgttgcaaatatttg

SEQ ID NO: 14548 - DNA, 121 bp, Artificial Sequence
  Synthesized
  misc_feature (61): n=t or c
gtgaatctaattcattatagggaaatggcgcttggaattggactggttttccatatgttangtgtattccttgtgtgaaagttattgtgcaaatatatcatcaactgtggcattaggtcat

SEQ ID NO: 14549 - DNA, 121 bp, Artificial Sequence
  Synthesized
  misc_feature (61): n=a or g
ttttattcctcatttcactccaaggccaagtgctcaacacaggattctcgattctaccagntacttaactccaggtcccactgctcctaagcacccacaggcactcctctccctactcaca

SEQ ID NO: 14550 - DNA, 121 bp, Artificial Sequence
  Synthesized
  misc_feature (61): n=t or c
cctaacacttgggatatgtggccatactctagtagtaaggaacttagaagagcaactgcantgtagtagtatcactcagatgttattggtttaactgaaaaattcttagggatctgcaaaa

SEQ ID NO: 14551 - DNA, 121 bp, Artificial Sequence
  Synthesized
  misc_feature (61): n=c or g
tgatatttaggtttcaaagtttactttggctgacccactcacgctgtgctctgctaatcangcttttggaaagcccacctgtaccatgctttaatgattcttagcacttggcttttgctcc

SEQ ID NO: 14552 - DNA, 121 bp, Artificial Sequence
  Synthesized
  misc_feature (61): n=t or c
agcccaatgcaatgagaagcacaagaaataccactattatgattcctacttgaattcctcnccagcagtaagtagactacaaaggtatttagtttttcaactaaatagcttttgtaatgct

SEQ ID NO: 14553 - DNA, 121 bp, Artificial Sequence
  Synthesized
  misc_feature (61): n=a or g
tttgcacagctgatgcaatgctttctgaagcgttggttccctgggcacttcaatggctgtntcctaagctgtgtattaactttggcatttacaatacagcacggggaagccccagaaacca

SEQ ID NO: 14554 - DNA, 121 bp, Artificial Sequence
  Synthesized
  misc_feature (61): n=t or c
gggtgggaacaggaggagtgaggacaggagacagagcacatgcagccattgctcttggaantggggctgatgtaagggaaataactccatactattactttgaggaggcaagccttttttg

SEQ ID NO: 14555 - DNA, 121 bp, Artificial Sequence
  Synthesized
  misc_feature (61): n=t or c
tgcataatatacacaagctcttaactgttgatgttgcacacaggaaaagacagaatgattngtttagatccatttgatgtgcagatataagaaacacatttcagacgtagcattgtctaca

SEQ ID NO: 14556 - DNA, 121 bp, Artificial Sequence
  Synthesized
  misc_feature (61): n=t or c
taatttatgttttcacaactttgttccgcaggattctctgatataacactgactagatatntctatcaatcctgtctctttatatgcaatgccatctttaagatgaatttaaaattaacat

SEQ ID NO: 14557 - DNA, 121 bp, Artificial Sequence
  Synthesized
  misc_feature (61): n=a or g
acagtgagaaggaactaacactgcaagctgtgtaacacccctcagttcatgcacacgtctntcctgtgttcacaaagctgaaggagaagaaatatcaaaagagcctcacaacgcccctgac

SEQ ID NO: 14558 - DNA, 121 bp, Artificial Sequence
  Synthesized
  misc_feature (61): n=a or g
gaaagaagagatctgcaagaaaatgagaaaagaaaactgcttgccccataacctccctgtntatatcacacgcatatggcatccagcaagaagccagctgggaattgtgttctcagctttt

SEQ ID NO: 14559 - DNA, 121 bp, Artificial Sequence
  Synthesized
  misc_feature (61): n=a or t
catttaataaaggcaacatgttaaaaaaaaatccacagatgtgtaaaatgttcaagtggcnagtcatttccaaataagttgttggagactaaaaggtaccgtgagtggagggtcaactgaa

SEQ ID NO: 14560 - DNA, 121 bp, Artificial Sequence
  Synthesized
  misc_feature (61): n=t or c
cttcttctgccttgctaggacgcaaccctgtgcactgcagaacacgacctgcagagtcagntctgtaaaacactcggtgatttggttctagcatttcagttcagtcttctctcactggtga

SEQ ID NO: 14561 - DNA, 121 bp, Artificial Sequence
  Synthesized
  misc_feature (61): n=a or g
tacttcagagggtaacagttcttgttaatggtgtctctccatctgtttgtggtgtctcacncgagagcggtggtctgcaaatatttcttcatggttgaaagcttttgtgtaggtaatcttg

SEQ ID NO: 14562 - DNA, 121 bp, Artificial Sequence
  Synthesized
  misc_feature (61): n=t or g
tgacagaggactaagtttgaaggtgtctcaggtaaggaagtgccaaactctgaaatgctcngtgctgactaagcccctgaaagtctgaacttgctctggattacatgaacctcaagcgcac

SEQ ID NO: 14563 - DNA, 121 bp, Artificial Sequence
  Synthesized
  misc_feature (61): n=a or t
taagttcccactgaaatcagataaacctttgtgttcattatcgctttcagtgagatcgaantgcactcactattggtttttgccatccaaaatggaacaaagggatggatcactggaaaac

SEQ ID NO: 14564 - DNA, 121 bp, Artificial Sequence
  Synthesized
  misc_feature (61): n=a or g
tgccttacttacgattccactaatttaagagaaactcttactttacagaatgtccattcantgacttttggaaacttctgatcacctgcaagttgtccttactagtagtaggagatcctcc

SEQ ID NO: 14565 - DNA, 121 bp, Artificial Sequence
  Synthesized
  misc_feature (61): n=a or g
tttcaggccaacctgaaagagatggggtagcatcaggtgacctcagagcactgtgcagagnaagcacacccatcaaatgggaacacacaaacgcgctgaatgtccacgaaaaaagatctgc

SEQ ID NO: 14566 - DNA, 121 bp, Artificial Sequence
  Synthesized
  misc_feature (61): n=a or g
gcaacaaggaaatattaaaaaaattgtcagtcaggaaagtaagacagtacaagagacaagngggaccttttacacagctagacagcaaaagcagcctccttctccacaaggtagtccggaa

SEQ ID NO: 14567 - DNA, 121 bp, Artificial Sequence
  Synthesized
  misc_feature (61): n=a or c
gctgactaacggtaccctcatttcttgctacatgtaggtcaggcatgggaggtggtcaaancctctgctacacagccctacccagctgttgtcaagctggtagagttacactggtatatgt

SEQ ID NO: 14568 - DNA, 121 bp, Artificial Sequence
  Synthesized
  misc_feature (61): n=t or g
tattttgcacacagtgctgggcaaatgtgggcagtgatctgggatgtaataaaccagtctnaagtcttgcgtactggtgagtactcctggaaaggtaatggtagggcacagtggcaataat

SEQ ID NO: 14569 - DNA, 121 bp, Artificial Sequence
  Synthesized
  misc_feature (61): n=t or c
agagctttccaacagcatggtggggaagagcaggatgttgagaatgggattgggtaccaangaagagagcagatccctcatatatgacccctaaccttccaccaacacccacctgctcctc

SEQ ID NO: 14570 - DNA, 121 bp, Artificial Sequence
  Synthesized
  misc_feature (61): n=t or c
tatgctaaaatttgcactgtttctgcctgaaaagaaattatcaaaaggcataaaaaaccangattcaaaagtaattcacaagtaattaacaataattttgttgtagatatcactccccaca

SEQ ID NO: 14571 - DNA, 121 bp, Artificial Sequence
  Synthesized
  misc_feature (61): n=c or g
ccttcctaactcaggaaaaaaataaaacacaaagatatttcagtgttttgatgaacaaaancagatggaagcacacaatttgtttgcaaaatgtgcatccaaggcctgctccagaagtctt

SEQ ID NO: 14572 - DNA, 121 bp, Artificial Sequence
  Synthesized
  misc_feature (61): n=t or c
aaagaggctcgtaagtagcatcctgccatttgagcactcttatgtctttcaaaaaccacangctaaatcaaactctatcttgaacaggctccttagctacattgctgaagttaggcctcag

SEQ ID NO: 14573 - DNA, 121 bp, Artificial Sequence
  Synthesized
  misc_feature (61): n=a or g
gtgtgacagaaaataaacaggtcttgttggatccttctgaaagatggattactactggccnttttcagtccacattcattaactcctccatatctgtgcaccaaaaggaaaataaagaaga

SEQ ID NO: 14574 - DNA, 121 bp, Artificial Sequence
  Synthesized
  misc_feature (61): n=t or c
tttataaaggtcaatttgctactatttctgtgaaagacaacaatttttcatttgctgaaangaagttgtactgctagaaaatttcccaaaaagcttgccactcaagcaattgagaattgtc

SEQ ID NO: 14575 - DNA, 121 bp, Artificial Sequence
  Synthesized
  misc_feature (61): n=a or g
tatcactaagcaaggacaggactgaaattctgacctactgcagatcttctaactagcgttnctttaccttagaaaacattgcttcataagccttttgtagcacctgaccagataatttatt

SEQ ID NO: 14576 - DNA, 121 bp, Artificial Sequence
  Synthesized
  misc_feature (61): n=t or c
aatctctgaaagcacagcaaattttcactggtgaggattctgactagttatttctaccccngtgctgttgtaaatgacagttgaatctggccaccttagctccatggcttgaatagcatct

SEQ ID NO: 14577 - DNA, 121 bp, Artificial Sequence
  Synthesized
  misc_feature (61): n=a or g
ctctttttcaacatcaaagatgggatgctgtggcagagcctattcatatacatcactgatncaattttacagaggtctatctttgtggaaatcgctgtgctgaagtacagtgtacaatctt

SEQ ID NO: 14578 - DNA, 121 bp, Artificial Sequence
  Synthesized
  misc_feature (61): n=a or c
cacaccaattctcaagagcattcattacgtctgcactgtatgcaagtgctctagcaaaacnttttctattcaaaaggcaagtcagcatgtccttgctttgttatgaaggtcattagtgtta

SEQ ID NO: 14579 - DNA, 121 bp, Artificial Sequence
  Synthesized
  misc_feature (61): n=a or g
aagatcgatcagaacttctgagttctctaactctattctgttgcaggatgctaggaaagcntgtgcagatgccaccttggctcaggtaagcagttaagagtttaacatgaattacaaaagc

SEQ ID NO: 14580 - DNA, 121 bp, Artificial Sequence
  Synthesized
  misc_feature (61): n=a or g
ggtgaaatgtgatttcagacgtgaaaatactgggcttctcatgattgttaatgcgctcttngaagacaaagagctgagatttattttttgtttcagtttccaattttgtcacctacatcta

SEQ ID NO: 14581 - DNA, 121 bp, Artificial Sequence
  Synthesized
  misc_feature (61): n=t or c
aaggaaaaatcaaaaggaagaaatacaattttccactgaaacagagcaggaaagaagtggnacatctcatccacaactggatgaccagaaagtgggttttttgtttgtttgtttgtttgtt

SEQ ID NO: 14582 - DNA, 121 bp, Artificial Sequence
  Synthesized
  misc_feature (61): n=a or g
atgggacactgctggatcctgccgttagcaaagcagttgtcagaaagcaaaagcacggccntgaaaaatgccttcgtgctccccctcaaaaccagacagaagtaaggaagcataaaagcac

SEQ ID NO: 14583 - DNA, 121 bp, Artificial Sequence
  Synthesized
  misc_feature (61): n=t or c
ggaagatctacgcagtcatctaacgctccagtatcatggggtgccaagccatgtgttgtgncagctggtactagccaactcacttaagaactccacaaacttgtacatagaaccaactcca

SEQ ID NO: 14584 - DNA, 121 bp, Artificial Sequence
  Synthesized
  misc_feature (61): n=t or c
ttttttgtttttgatcatttgggcactctgaagctccctgtatgccataaaagtagagtcngaactagatgagatgatttcaaagactcctctcagttatctcaaagcatctggggtggcc

SEQ ID NO: 14585 - DNA, 121 bp, Artificial Sequence
  Synthesized
  misc_feature (61): n=a or c
ctcagggaaaatctctgactgaatatcttgacaaagtatctcctaaggctgcaggttttgntgatgcacagaaatgtggaaatttcttataaaaaaataaaagttttgaatttttatttgc

SEQ ID NO: 14586 - DNA, 121 bp, Artificial Sequence
  Synthesized
  misc_feature (61): n=a or g
aatgaacaaagaataaaaatgctggagcatctccacttagtctgaatcacttggaaaatantaaaaatggccaaaatgcgtgtggcttgtcacaagccatacaaattcagcttctaaaagg

SEQ ID NO: 14587 - DNA, 121 bp, Artificial Sequence
  Synthesized
  misc_feature (61): n=a or g
tgcttgcattccaacaagccacagtgttttccctataaaacagtttagttttccctccatncagaaattcctgcatctctccattcagtgtgactcaagacaatgaatcatagattcatgg

SEQ ID NO: 14588 - DNA, 121 bp, Artificial Sequence
  Synthesized
  misc_feature (61): n=a or g
ctgcgtgtttccatccaagacaagcacaactgttaaacgagcactgttcacatatgaaggnatccaaagggcagggttgctttaggaaattcatgactcagagttctcagtttctggagat

SEQ ID NO: 14589 - DNA, 121 bp, Artificial Sequence
  Synthesized
  misc_feature (61): n=a or t
gtaaaataacctattgctaattaaagtagactcacttagtgagaaacaaaggacgttgttntcaatgtctttctcctttcttagacttgacctcatcactccagagtgcagcacaggtgga

SEQ ID NO: 14590 - DNA, 121 bp, Artificial Sequence
  Synthesized
  misc_feature (61): n=t or g
caattttcaaatagtacgagtatttacaggagacacgtttcagcaaaatggaggcagaganagtttttgatagatcagtcctaggcagctagttactgaattatggagattggtgttctat

SEQ ID NO: 14591 - DNA, 121 bp, Artificial Sequence
  Synthesized
  misc_feature (61): n=t or c
tctcaagtgatctctcgtgtatataggttaaataataatgccatgatgcttctagaatacngctacccagagtctagacataggcaaacacttaaaaaagatcaaaagactttagttgact

SEQ ID NO: 14592 - DNA, 121 bp, Artificial Sequence
  Synthesized
  misc_feature (61): n=t or c
catgtccttaacagcaagtacattttccttccttttgtgaactgctcctcagtgcacatangtggcagtagaatacgtgacaccgcgtacaaacaaacttgttcccagcaggctctttcca

SEQ ID NO: 14593 - DNA, 121 bp, Artificial Sequence
  Synthesized
  misc_feature (61): n=a or t
atgagtgagcagcagtgaagaatgttaattttcttgttactgagggtaggagaacaaatgngcaggctcgcttcctcctgctagcaccacagttaaagatcagtatggtttacaagatact

SEQ ID NO: 14594 - DNA, 121 bp, Artificial Sequence
  Synthesized
  misc_feature (61): n=t or c
atttttttctgcccactgagagacactcagggtccgtttttccctatttgtagcatgagtnctatgtttacagtgagaaggattcagtgggctctccctcctactgtaacctttcttcctc

SEQ ID NO: 14595 - DNA, 121 bp, Artificial Sequence
  Synthesized
  misc_feature (61): n=t or g
tgggctgctagggcttggggcgtgcttctccagagacctcaactgggaagtgaggcttacntctccagtgttactgttcatatgtgtccggaagcactggaacatacctatccagggagta

SEQ ID NO: 14596 - DNA, 121 bp, Artificial Sequence
  Synthesized
  misc_feature (61): n=c or g
ctgaagtctggtgcacaaaaggacatgggaatgtggtgcaccaacagctgctgggacgggntatttaacaactcagtttttatccttttcaaaaaaatgattagcaaacaaaacattgttt

SEQ ID NO: 14597 - DNA, 121 bp, Artificial Sequence
  Synthesized
  misc_feature (61): n=t or c
ctttaaaaggaaaataagcaccatacctgagatatgggttggttaacaaatatccagccantagtgggattaatttgtaaataatctgtttcctcatttgctatggagtatgtgatgacag

SEQ ID NO: 14598 - DNA, 121 bp, Artificial Sequence
  Synthesized
  misc_feature (61): n=a or g
gaaacggtaacttctttaaaattaaccatgctgattaatgaatagagagtgctgaggcacnggcagcacactgctgagatgtgtggtctctaccttgacacgttccttttgattcccccga

SEQ ID NO: 14599 - DNA, 121 bp, Artificial Sequence
  Synthesized
  misc_feature (61): n=a or c
ggacaccaccatgcagcaccgggttcctgcacgcactgccttctaatggctgaaggtgganagatctgactggatatggcattgtgaggtctgctgaagagctcagtctcttccccatctc

SEQ ID NO: 14600 - DNA, 121 bp, Artificial Sequence
  Synthesized
  misc_feature (61): n=t or g
tcagactgcagagaggacaaatacagcttctgcctatttttcctctaacttccctgctctnaacagataataatacttctttgcttcaaagcatctactcctaggagtaaattttgtggaa

SEQ ID NO: 14601 - DNA, 121 bp, Artificial Sequence
  Synthesized
  misc_feature (61): n=t or c
ttgggaacatctcagaagacatctactcagctgttacagagccagtgaaaattgctacagnacctctatgaatcccccccgactcccgtaagtgcacccccaatctcctcacacctctgct

SEQ ID NO: 14602 - DNA, 121 bp, Artificial Sequence
  Synthesized
  misc_feature (61): n=a or g
gttccagctcagaaggagaaaatgccaagtagcagtaagagtggggtatagggagactgancaagggaaggaagccaacgggaaagctgtccgtctgcgcaaggagcagggaaatgggtct

SEQ ID NO: 14603 - DNA, 121 bp, Artificial Sequence
  Synthesized
  misc_feature (61): n=a or t
tatgtgactttatgctagttggctttatgctatacactctaagtaattgcttactctgctnatatggttgtaagccagaaaattttcatgttgctcttacagaagaggtcctgtctgaaat

SEQ ID NO: 14604 - DNA, 121 bp, Artificial Sequence
  Synthesized
  misc_feature (61): n=t or c
tgtatatgtttcatgtgacaagcaagtatcaagcccgatgacttcctcatgattttggcanatattgtgtgccaaaggacaaaataaatcagcactaacccatgtaaatgggagatacaag

SEQ ID NO: 14605 - DNA, 121 bp, Artificial Sequence
  Synthesized
  misc_feature (61): n=a or c
tgctcccacctgatttattttattacttaagctggtggttttcaattgcacttatagcagnagcagagtttaactctcacttcttaatgaaagagccaaatcaagagctgagtaatatctg

SEQ ID NO: 14606 - DNA, 121 bp, Artificial Sequence
  Synthesized
  misc_feature (61): n=c or g
tcaggtgctaattagattagtctctttcctttaaagggggaggcaccaagtcctgttagtnttgatgaggggccttgatttgcagggctttacagctgtgagttccagcctgccctgagct

SEQ ID NO: 14607 - DNA, 121 bp, Artificial Sequence
  Synthesized
  misc_feature (61): n=a or g
ccctctcttctccattcagtggaattatgccacaaggttataaccaacagaaagaagagcntaaatacaagagaatgctcaaatgtaatttcaacagcattgtattgcagtcacagttata

SEQ ID NO: 14608 - DNA, 121 bp, Artificial Sequence
  Synthesized
  misc_feature (61): n=a or t
tggaaggtggattacacacttaagtctcgatacttggaatttaattaaatgtattaagacngtatgaatgaaatatgaatagagttcctgtgtctatgtgtgtttgtcagtgaaagcacca

SEQ ID NO: 14609 - DNA, 121 bp, Artificial Sequence
  Synthesized
  misc_feature (61): n=t or c
tatagctaatttgtgtcataagctttgttcaagtatgaataaaaccctgtcctacaataanttcttccattgtaaacgtcaaatatactttaggaaatctcattctcaattcctattttgg

SEQ ID NO: 14610 - DNA, 121 bp, Artificial Sequence
  Synthesized
  misc_feature (61): n=a or t
aaatcctcacccgaatgctgccatcataacttcctgaatagcactattttctttctgattntactaagttgcttttcctacataaggaaacaagatgtagggctgaggctggccttaagga

SEQ ID NO: 14611 - DNA, 121 bp, Artificial Sequence
  Synthesized
  misc_feature (61): n=t or c
gtaaagcagtaatgtttacaacctctcttctgtttgcctaatcctattatgtaaacattanaacattccacagcacagccctctaaaaaacttatctgccatagatgtcagtgaggtagtt

SEQ ID NO: 14612 - DNA, 121 bp, Artificial Sequence
  Synthesized
  misc_feature (61): n=a or c
atagggaaagcagagcattaacccccacatggctccagaataaatagttgggaggtacagntgtgctggagttgtgtgactgggtggtatttgcatggttagctccatcttttggctatag

SEQ ID NO: 14613 - DNA, 121 bp, Artificial Sequence
  Synthesized
  misc_feature (61): n=t or g
gcagtagcagatagtaaaatgtgcagcaggtatagctttaaagtgatggcagcaaaatggnccgcttctcagagaactgcctagactttaattcaaaccccaaaaacatatggaagcctgt

SEQ ID NO: 14614 - DNA, 121 bp, Artificial Sequence
  Synthesized
  misc_feature (61): n=t or c
acttatttattataggcaagaattgagatgtgggaaattgctggaggctttgtgtgagtgngcatgtactactgacttgccaaagagctattggatgaaatcattaatgtggaaagacaga

SEQ ID NO: 14615 - DNA, 121 bp, Artificial Sequence
  Synthesized
  misc_feature (61): n=t or c
tctctccgttgtgcaacgtcccaagggcaatgacagcagtgcttacgtggagcggtgatantgggaaagtatgcagtcattttgaactgttctccttgtggctcccctcccttaaggtggt

SEQ ID NO: 14616 - DNA, 121 bp, Artificial Sequence
  Synthesized
  misc_feature (61): n=a or g
tctgaggtggacagccatgactatttcaattgttacaacatcactgacttggaattccaangtctgattttcagatttctacatattaagggtttcttatgtaactcccagataagtaact

SEQ ID NO: 14617 - DNA, 121 bp, Artificial Sequence
  Synthesized
  misc_feature (61): n=t or c
tatctcagcctggaatctatctattggtatagttttcagattaccctgtgtcagcttcctntgttactaggacacaaataactagttacacttcttgcttgtgttgattattaagtttaat

SEQ ID NO: 14618 - DNA, 121 bp, Artificial Sequence
  Synthesized
  misc_feature (61): n=a or g
ggaatggacccctgctgatatccaagcccattttacacagtggaacaataaagcaaagttntattcctaaacaggcagaaaaacagtcataacttcttattatgccagtttcttgtgagtc

SEQ ID NO: 14619 - DNA, 121 bp, Artificial Sequence
  Synthesized
  misc_feature (61): n=a or t
gtttctgaatacagagattgggtttcccttgaaaagcagtggtggtagttctgaggtgcanggaagtgcaacaagaagctaaactccctcttcctcctatttacttgaagagttggtcact

SEQ ID NO: 14620 - DNA, 121 bp, Artificial Sequence
  Synthesized
  misc_feature (61): n=t or c
catttatgaggcagggtaaatgaagcacacagacaagtgacagtaatcgatttttcagcgngcatttttatatttagacagggagtgccaagctaatgaaatgaactaggaaagtacaaaa

SEQ ID NO: 14621 - DNA, 121 bp, Artificial Sequence
  Synthesized
  misc_feature (61): n=t or c
gatggacatcagggatcccaaattctgcatctctgctcccagagaggatgggtgttagcanctatagacaccattcccttgggccagtggccagtgtgtctccatctcctcaaacttgcac

SEQ ID NO: 14622 - DNA, 121 bp, Artificial Sequence
  Synthesized
  misc_feature (61): n=t or c
gcaagtattttagttgtttacttccaatccacttacctacttgcctctgaattaaaagtgnggttgtcaattttggaactagtgtctgaaaagctctgcgtatctgagtcttagttctggc

SEQ ID NO: 14623 - DNA, 121 bp, Artificial Sequence
  Synthesized
  misc_feature (61): n=a or c
gcctgagatccttagagactgcactaaacactggacgcagaaatgaactcagccctaagcntgatggaaaatgcaaccgaagataaaaaggggaacaccaaataatttcctgtgggcattc

SEQ ID NO: 14624 - DNA, 121 bp, Artificial Sequence
  Synthesized
  misc_feature (61): n=c or g
gatgtttcagtgcttccagaatttgttcatgacctgacccaatatcttttgagtgtagttntgagttagtattccaaactgtagagagttagagatcacaccagtgtgggtctctgccata

SEQ ID NO: 14625 - DNA, 121 bp, Artificial Sequence
  Synthesized
  misc_feature (61): n=t or c
gaaccataagagcaacacttaaggaacaattacaaattctcctcagtatctgcttaacttntcttctttttcagaggctttactttctgttttcttgcaaagcagtttggaaacctggggt

SEQ ID NO: 14626 - DNA, 121 bp, Artificial Sequence
  Synthesized
  misc_feature (61): n=a or t
catctacagactgatgaaatacacatcagctgctcgactcttgcacttgctgataatccanagtaaggagcaaaacgctctgtgggtgctggtccagcctgcaggaggtttacaaggggga

SEQ ID NO: 14627 - DNA, 121 bp, Artificial Sequence
  Synthesized
  misc_feature (61): n=t or c
taatttagttcaaagtattgttactgtttttctttatatatcatgctgtgaataatgcttntcctttttctattcacatatttcacttggctactttgtatgccaattggtgttgtgaggt

SEQ ID NO: 14628 - DNA, 121 bp, Artificial Sequence
  Synthesized
  misc_feature (61): n=t or c
aaagaaatataagtcgaagttatttcaagaacgatattttttttttgcatctcatatgtgnttgtctttcctgaacactactaggcatcaatcttttgtaacaaacagtggtagaaaatga

SEQ ID NO: 14629 - DNA, 121 bp, Artificial Sequence
  Synthesized
  misc_feature (61): n=t or g
gggctcactcgctcctccctggcctcataacatggataactccaacatccgtgcaatgttntgacctttcaatcttaactccattattccatggtttagcatgtacgaatccctttgactt

SEQ ID NO: 14630 - DNA, 121 bp, Artificial Sequence
  Synthesized
  misc_feature (61): n=t or c
tccagcattacatgttctgaatagtttccaaaagtcttctctcccaaaactctgccatatnatcttcttttctataccttaaactgtcatgatttgatccaaacaaaaataaaattcagca

SEQ ID NO: 14631 - DNA, 121 bp, Artificial Sequence
  Synthesized
  misc_feature (61): n=a or g
ctagctttgttatttggatttaatttattcttggggcaattctgttgatttaaatcagaantgaatttggccatgagttttcaagaagctgtgtttttcctttgagcattgcatattgcgt

SEQ ID NO: 14632 - DNA, 121 bp, Artificial Sequence
  Synthesized
  misc_feature (61): n=t or c
catcttttcagacagaatattgcatttataatcatgagcacttcactctgttaagaaaggngtgctgatgctcacatagtttgtcctgagtgaaaaaaaaaaaaagaagagtgaaagctga

SEQ ID NO: 14633 - DNA, 121 bp, Artificial Sequence
  Synthesized
  misc_feature (61): n=c or g
tttatgagaaatatgttcatcgttacttaaacagatgctcatttctgtaagcatcacgaantcttctactactttccaacctttggatttatgctattaactagaggtggaaaaactgaag

SEQ ID NO: 14634 - DNA, 121 bp, Artificial Sequence
  Synthesized
  misc_feature (61): n=a or g
cctgtcagatttccagtacacactgaaatgcaacagtgccatacaatttttctgaaagacngtttgtttggcattttagacagacatccaacacaacaaaatgtactttattacatagaga

SEQ ID NO: 14635 - DNA, 121 bp, Artificial Sequence
  Synthesized
  misc_feature (61): n=t or c
agttggtttgggtttatattcaaataacacacattatttacatattttgcattatccgtgncttcattttaccttctctgagagatagatgcagggatactcctgagtctttgtctttttg

SEQ ID NO: 14636 - DNA, 121 bp, Artificial Sequence
  Synthesized
  misc_feature (61): n=a or g
taatgccatgaaaaatgcataatcagctttcttcactctcctttacagttggaagaattgnaagtgagcagggcagttttcagtcccaagaatagctatagaaataacctaaatcagttgt

SEQ ID NO: 14637 - DNA, 121 bp, Artificial Sequence
  Synthesized
  misc_feature (61): n=t or c
caccacatccaagtggattttaaacacatccagggatgttgcagttgtatagattgtctanctacaattgaaggtttgtaatgataaaagtaattactgctcagtaccactgtttcttttg

SEQ ID NO: 14638 - DNA, 121 bp, Artificial Sequence
  Synthesized
  misc_feature (61): n=a or g
gcaagaacccacggcactgaaatatgctctgctacaacagtggcatgacaggcaaatgganaaatgacaaaactaatgttcttcataaccagattctaagagagactagcaacaaaggagt

SEQ ID NO: 14639 - DNA, 121 bp, Artificial Sequence
  Synthesized
  misc_feature (61): n=t or c
ttatctcctgataagtactgcactggtaatgtgccagtctgttatatatgtgttggattgnatgggggaagattacttacaaaaaatttcattgtttttaatttggctaagacagtaaatt

SEQ ID NO: 14640 - DNA, 121 bp, Artificial Sequence
  Synthesized
  misc_feature (61): n=t or c
aaatgaggcagctccatcagactctgatgtggttgctaccagagcatggaaaccttacatnagagcatgaggatttttaaggcaaggagaaacacacggtgaagagatacagttgcagacc

SEQ ID NO: 14641 - DNA, 121 bp, Artificial Sequence
  Synthesized
  misc_feature (61): n=a or g
atttggaaagtactttgggcataagattaatcatcgtgcaattccagctggatgtgctgtntaactgggttctgtctgcagctgctggagcaggaggtggatgtcagagctagcatctggg

SEQ ID NO: 14642 - DNA, 121 bp, Artificial Sequence
  Synthesized
  misc_feature (61): n=a or c
aaaatgcaggtgcaacagcaacatcaattaagatgtcattcacttggcataaagcagtgcngacagacccagcagagctttctaggcaaacaaaatttacctgtgagttctattctgcttg

SEQ ID NO: 14643 - DNA, 121 bp, Artificial Sequence
  Synthesized
  misc_feature (61): n=a or g
cagttaaatcttaagaactcaagcacatgaagtagtagtttagttgataaacccagtgaanagacaaagattcattctgtaatattaacaataacagctggaaaattatgaaacaacaggc

SEQ ID NO: 14644 - DNA, 121 bp, Artificial Sequence
  Synthesized
  misc_feature (61): n=a or g
gaaggcatgtaaaaatgaccaattaagaaaactatgataatattttcccagtatttttctncgttagggaaataagttaaaaatggagatcagctataaaaagctttaactgtgaaagatc

SEQ ID NO: 14645 - DNA, 121 bp, Artificial Sequence
  Synthesized
  misc_feature (61): n=a or t
tcttacattcatttcctatcagcaacaaaattttacatgtctatatatggaactgagcttnattaactgatgagaaaggtgatatgcttttgccatatgagtttgtattccttcatttttt

SEQ ID NO: 14646 - DNA, 121 bp, Artificial Sequence
  Synthesized
  misc_feature (61): n=a or g
gaagactgggcaagtggtttgagatacggtgggaccaaagtcatcagctttccaaacaatntggtgcctctgctatgcatgttctgcactgagaactaggaagagaaaatgcccttgtctg

SEQ ID NO: 14647 - DNA, 121 bp, Artificial Sequence
  Synthesized
  misc_feature (61): n=t or c
agtttctgctgagcagacattgaagagtatgaactccataacaataggaagagtagaaagnacttttagaacatgccatgcaattgctaaatctgttcagccctttacagacctggactgg

SEQ ID NO: 14648 - DNA, 121 bp, Artificial Sequence
  Synthesized
  misc_feature (61): n=c or g
gagctcgatggcttgtctctctcttctgcacatacacacaaagagagaaaccaggactcanagggaatgtatttatcaccttcaactatccgggttcaaacatctcttccaagtctttcgt

SEQ ID NO: 14649 - DNA, 121 bp, Artificial Sequence
  Synthesized
  misc_feature (61): n=a or g
aatgcgtattgctaagtgaagtgatgtgatttcattgccctggtgccttcgaagaaatgcnggatggacacaaacaccatcctgaaatagtctgtgagacattggatatttgagctttcaa

SEQ ID NO: 14650 - DNA, 121 bp, Artificial Sequence
  Synthesized
  misc_feature (61): n=a or g
gctttagcccccatacatcacttcattacaaccttatttcagatctaatggtttagaaaantaattgtcaacaataaagacttactgagctacattaactgaattctgcataatcccagag

SEQ ID NO: 14651 - DNA, 121 bp, Artificial Sequence
  Synthesized
  misc_feature (61): n=a or g
atgaagccaggtgattcaaggtgtaagtaataagttactgaaaatgtttcccatcatctgnttcagtagtagccaaagttactgtcatataggtgttggacttggctcatttcccactaga

SEQ ID NO: 14652 - DNA, 121 bp, Artificial Sequence
  Synthesized
  misc_feature (61): n=a or g
aagtacattaagagaaagccacgacagatttctatattcttaattgaaaccgtttgttggnaagttctttgtgtctgacttctcccatactgtcatgatggctgttggttcatattcatgg

SEQ ID NO: 14653 - DNA, 121 bp, Artificial Sequence
  Synthesized
  misc_feature (61): n=a or g
tgtgacagcactacaaaactctgatctctgctggaaaacctcagaacatgctctggctttntgcattccatgtgctcagttgcatgtcaagtaagctttcttcatctggtttaaagaaaac

SEQ ID NO: 14654 - DNA, 121 bp, Artificial Sequence
  Synthesized
  misc_feature (61): n=a or g
aacgtcggggtatctgagctggagcttcctcgattgaaatgagtgaagaaaataagggccnagtgttggcatactttgaaagctgttgccacctggtcttacaatgcctcctctcaatctg

SEQ ID NO: 14655 - DNA, 121 bp, Artificial Sequence
  Synthesized
  misc_feature (61): n=a or t
ttttgcaaaagcttactctgaactcttacaattggtttgatccagtattgcaaattttgcngattaaagatgttcctggtttatgcaccaaattagattagctaaaatacatgagaactct

SEQ ID NO: 14656 - DNA, 121 bp, Artificial Sequence
  Synthesized
  misc_feature (61): n=t or c
tgaaaatctgtaacagtttgctgtggtttatcctgcaggtagctaagcaccgcacagtcangtgctcgctcctaacctcccagcaagatgaggaagagaatgaaaaaaaaagaggttgaac

SEQ ID NO: 14657 - DNA, 121 bp, Artificial Sequence
  Synthesized
  misc_feature (61): n=t or c
ctactgtaatttgaggaaatgatgggatttccttagcccactaagtcaaactatcagaaangtagatctaaggtaccttacatcttgtgcagcaaatatggttgttaaatacaaaaaatct

SEQ ID NO: 14658 - DNA, 121 bp, Artificial Sequence
  Synthesized
  misc_feature (61): n=a or g
cttgtgctgtcctctggaatcagagaagaatataggaaatagcgttaaaataacttctgcntttttcaagtttttgttatgttgaaagctgatgagtgtttgcaatttcaaagagcttttg

SEQ ID NO: 14659 - DNA, 121 bp, Artificial Sequence
  Synthesized
  misc_feature (61): n=t or c
ataactattatctgtaatcaccagaatatgctgaaattattgctttatttagtgaaagatnaagccacctgttcttaaaaacacaggctaggtatgtgtttactgctaccctcagcaccaa

SEQ ID NO: 14660 - DNA, 121 bp, Artificial Sequence
  Synthesized
  misc_feature (61): n=t or c
ggatgtgagatatctctaagcaactccagtgctgaaaacatgcaactcgagcactgatccnttgtgggaaaccaatgagattggtgaagtatcaaagggcagtcaccaactgatagattca

SEQ ID NO: 14661 - DNA, 121 bp, Artificial Sequence
  Synthesized
  misc_feature (61): n=a or c
tagaccaatcagcatttggctgtcactgtgacaaacataagatagacgtctactaagcagnctttagaacattcttaaatgtgagatgcatcagcattttgaatctcagctaaattaaagc

SEQ ID NO: 14662 - DNA, 121 bp, Artificial Sequence
  Synthesized
  misc_feature (61): n=t or c
tttgaattgaatttctgctgggaggagacagatctgtattatccttctgatccataccagnccttaaccagagggagttcatttaaacagacaacacatgttctaaaaacagatatgcatg

SEQ ID NO: 14663 - DNA, 121 bp, Artificial Sequence
  Synthesized
  misc_feature (61): n=a or g
gaatgcaaagtattaaagagactgtatcaactttcatgtatgatagcacatgaactcaacnttaaaaacatattttcaaaagtttaaaaaacaaacaagcaaatacacaaaccaactaatg

SEQ ID NO: 14664 - DNA, 121 bp, Artificial Sequence
  Synthesized
  misc_feature (61): n=c or g
ctaaaatcaaggaaccaaggccaaattcttagatgaggtaaaaagacagaaatacttgaangtgtgaggtaagatcagggtgccattttgtcaagttacgtagttctcatgaaaagatgtt

SEQ ID NO: 14665 - DNA, 121 bp, Artificial Sequence
  Synthesized
  misc_feature (61): n=a or g
agtctaaattacaagtgagagattacatcttgtctctgtctactgaattaactactaacanctatagataggtaatttgcttatttggaaagcttttctcaagtttgcttctgtttgatgt

SEQ ID NO: 14666 - DNA, 121 bp, Artificial Sequence
  Synthesized
  misc_feature (61): n=a or g
tgttaaagctcttgagtgtgatttgagcttcactgagttaaatcaaatatttatgctggtnaggatgactcactttgtggacagcagtccctcctaccttcttcatgtgagtgaaagagca

SEQ ID NO: 14667 - DNA, 121 bp, Artificial Sequence
  Synthesized
  misc_feature (61): n=t or g
gagaggaaattctcaaaggttaatttttttcacgaggaaagaagttatccttagtcatcangtagagacaaaagggaaaaagcagcttctcctcagggtctttcttgcttgtcacagctct

SEQ ID NO: 14668 - DNA, 121 bp, Artificial Sequence
  Synthesized
  misc_feature (61): n=a or g
agggctgtcagaaatcagccttgatttacttacacagaacacagattatttgtacagaatntaacggaaatcaatggctaaacctcacagatgaattaccaagccaggtagacctcctgcc

SEQ ID NO: 14669 - DNA, 121 bp, Artificial Sequence
  Synthesized
  misc_feature (61): n=a or g
atgttgggcttcttttctatacatagttagcacctttctttccaatttagtgtttactcantgccagcggtcaggcattctgtttcttcattctcttctaattcttgctctttgctgaagt

SEQ ID NO: 14670 - DNA, 121 bp, Artificial Sequence
  Synthesized
  misc_feature (61): n=c or g
caagtgtttatgaattattcaagaagatgaataaaatctgatgttctctgatccttctctnaggaagttttaagtatgaaaattcccccggtttctcagagtcactcatctttcctttgct

SEQ ID NO: 14671 - DNA, 121 bp, Artificial Sequence
  Synthesized
  misc_feature (61): n=t or g
catgtgaattagttcaggagtgtagccaggtgaccgtaccatccaagtgaccctatcagcnaagtgaccctagtgctgctttgtagaaatatcatatttttctcaatctttttgcttttta

SEQ ID NO: 14672 - DNA, 121 bp, Artificial Sequence
  Synthesized
  misc_feature (61): n=t or g
tggtaattacgcctgaaagctggagatttaattattgctgggagggtgatacccttgcaangactgcagcggtcccatcattggagatgtatcagcgctaacccagctctctgcacatcaa

SEQ ID NO: 14673 - DNA, 121 bp, Artificial Sequence
  Synthesized
  misc_feature (61): n=a or g
aggcacaggaaggtaggggtggaaagcagcattgttccctttaaatcccttgcagctttgngtctagcacagggaagggaagtttatcttaaaatcgctctttggttcgttgtgttattat

SEQ ID NO: 14674 - DNA, 121 bp, Artificial Sequence
  Synthesized
  misc_feature (61): n=a or g
acccacctgattttgacaattaacctagcagagcagagaagcaagtggggagacccatccnctgatgcagcaggttccaattcccccctgcagcctgtccttgggcaggttttatttcctg

SEQ ID NO: 14675 - DNA, 121 bp, Artificial Sequence
  Synthesized
  misc_feature (61): n=t or g
tacaacatgaggaaaagctgtcattaacagttgcttccccatgatcagaatgtgttgttgntgttgttgtttttttactactaccagtggcaaggccagaaaggttgctactgcattatga

SEQ ID NO: 14676 - DNA, 121 bp, Artificial Sequence
  Synthesized
  misc_feature (61): n=t or c
attctccccgtagcctctctatgaaggctggttccttgctctctacaacgttttctacacngcctaccccgtgctttccatgggtcttctggaacaggtatgggaccaccaggctgcacca

SEQ ID NO: 14677 - DNA, 121 bp, Artificial Sequence
  Synthesized
  misc_feature (61): n=a or t
acttgtctgatagcagcagcctagtaaatctctttcttgacttttccaagcgtcaaagtcngcagaggtagaaggtccctaggtatccctgttccctgatagggaagatatggcctgtgtt

SEQ ID NO: 14678 - DNA, 121 bp, Artificial Sequence
  Synthesized
  misc_feature (61): n=a or g
aaggctgatggatggcatggatggctggtgggatgtgataacaccaaggacacaggagccngcatgcagcggaggagcagcaaccagagcctgtctcccacctctacctggggagaaggcc

SEQ ID NO: 14679 - DNA, 121 bp, Artificial Sequence
  Synthesized
  misc_feature (61): n=a or g
aacatatataaaggagccttagaaggagcctgtaatgttcacgtaaacatgaaagaatctngagccagtgaaaagaatggcaactacacattagatttcattggaaacaggattgaaccct

SEQ ID NO: 14680 - DNA, 121 bp, Artificial Sequence
  Synthesized
  misc_feature (61): n=a or c
aagtgttctttttccaaaataagtagtaattattatgtgaattttggaggggtaccataantgttctatagctctcactgctgcagcttagcatgaagtatgtctttgtttaaatctgcac

SEQ ID NO: 14681 - DNA, 121 bp, Artificial Sequence
  Synthesized
  misc_feature (61): n=t or c
aatagtgtttgctccctttacctcgccatacttctcactacaatgcagtaattacaggaanctactcctgttttaagccttacagtaagctctttccaaatttaaggccagcaaccaaccc

SEQ ID NO: 14682 - DNA, 121 bp, Artificial Sequence
  Synthesized
  misc_feature (61): n=t or g
agtgcaccctcttggttgacagaggaagacacaaaaactgtctatttcgggaccgttctgngccattcccattctttaaatctgagagtaattatttttctttgaatcaggttcatgatgt

SEQ ID NO: 14683 - DNA, 121 bp, Artificial Sequence
  Synthesized
  misc_feature (61): n=t or c
tattggaaggtaagggaacccaagagagctggtcaacacttaaatgtcacttctttgaagntcaagatcggtgtatccctgagagtataaaattagggaaaggtagcaggagacctgtatg

SEQ ID NO: 14684 - DNA, 121 bp, Artificial Sequence
  Synthesized
  misc_feature (61): n=a or g
taagcattgcagtttcctctatagaggcagaaggaatgtttccatttcagtaactaattcncactgaggaaccagaagtgcaacgaaacaggaaaaccaaacctgtttcctttttccaata

SEQ ID NO: 14685 - DNA, 121 bp, Artificial Sequence
  Synthesized
  misc_feature (61): n=a or g
tttctaccattatttattcacctgaatcaaatctttgactgtggcctactagatttctccntatatctagtgccaataaagggattttttctattaggagtgtgggagtttggcaggttta

SEQ ID NO: 14686 - DNA, 121 bp, Artificial Sequence
  Synthesized
  misc_feature (61): n=t or g
tgtgagttgtatcttgcaagagagggtagtgcataaaagaatctcatttctgcgtcttcanttctatatggagacttcaacactgaagtctttatagatttttgtactctctgaattggtt

SEQ ID NO: 14687 - DNA, 121 bp, Artificial Sequence
  Synthesized
  misc_feature (61): n=t or c
ggccacacaattgcatctcagggctgcaaaacccacacagcaatgaactcagtaaggattncttaaccaaaacatatttattgaagaggctgcatgcagtcagcactgacagtctgatctt

SEQ ID NO: 14688 - DNA, 121 bp, Artificial Sequence
  Synthesized
  misc_feature (61): n=t or c
attttactggtcatgacagatttgttaccagataagttctgctagtgaccagacactaccntgctgatacatggctggagttagacacaggaactgctttatttaatagacaacagtgctg

SEQ ID NO: 14689 - DNA, 121 bp, Artificial Sequence
  Synthesized
  misc_feature (61): n=a or g
gctaattttcatttatgctgacattctccataagctgaacatcattctctgaaaaagccantgtgtcacttttattagcccagtttgcactttaacaccaggagaattaattcaagataca

SEQ ID NO: 14690 - DNA, 121 bp, Artificial Sequence
  Synthesized
  misc_feature (61): n=t or c
aacagatctgggtttttcatactggaaaaattctgacaagagacacaagttagaatgcccntcttagatatcacgaatttggtgaacagtgttcaaattggcaaaattatttccaaaacta

SEQ ID NO: 14691 - DNA, 121 bp, Artificial Sequence
  Synthesized
  misc_feature (61): n=a or c
atcactctggcagtttgcaagagtacccttataatgcaggaaaaaggccagtttggggagnctttgtgtaagtaagatattatgactgaaagatacctcatagctctttgtcttcacaaaa

SEQ ID NO: 14692 - DNA, 121 bp, Artificial Sequence
  Synthesized
  misc_feature (61): n=t or c
gcatcaagaaaatgtctgtttatcaaacagcgtgttttagtattgcctgatatacttcagnactgaactcaaaaacctaatcggaaattgcattaaaatacaaatttatctgcccatgtca

SEQ ID NO: 14693 - DNA, 121 bp, Artificial Sequence
  Synthesized
  misc_feature (61): n=c or g
caggcagagcccagccctctgtctgtgccggagggcgatcccggtaagcgcaccaaggagnaggagatcagcgtctggaaccccaatttccaccctgtccttcctaacgattcgggctgta

SEQ ID NO: 14694 - DNA, 121 bp, Artificial Sequence
  Synthesized
  misc_feature (61): n=a or g
gacggagaggaacacagtatgagggagagcctgtgcctgctgcccagcagtgcttgatggncagcagtcagtgacagacagggtgtcactcactgggtatgtgagggcttggtcctcctgg

SEQ ID NO: 14695 - DNA, 121 bp, Artificial Sequence
  Synthesized
  misc_feature (61): n=a or g
cccattctgttttaacataagaaacatttttgtaccaagagcacagatactttatcaaaanccaagtgatgactggtgttaatcttgagcaggattagtactgttttagcgtgtgctggac

SEQ ID NO: 14696 - DNA, 121 bp, Artificial Sequence
  Synthesized
  misc_feature (61): n=a or g
gctctatttgaagtgcctagagtgagtttaaacaccaatccctgcactctttctcttgcanagtctcttgctcatctgtcttggttggggtcatcttttctctctcagctttttaatagaa

SEQ ID NO: 14697 - DNA, 121 bp, Artificial Sequence
  Synthesized
  misc_feature (61): n=a or g
tctgctcaagcagataattgtgatagctagatagtaaatgaaattaagaactaggaaaggngtcagcacctttgaagtgtcaggctttggggcttccctaccttacactctagctgaggct

SEQ ID NO: 14698 - DNA, 121 bp, Artificial Sequence
  Synthesized
  misc_feature (61): n=a or g
ccctggagatcagttttggaatcactaaaaaaaacatatggaatccaccgtcccaaaagancccaccactcttcttgtggtggggaccactgtaaatgaccgcaatgataaggacagtggc

SEQ ID NO: 14699 - DNA, 121 bp, Artificial Sequence
  Synthesized
  misc_feature (61): n=t or g
aatgttgctcttggagattgattcttctttgttttgcccttcctgatgacttcagagatgnccagttgaaaaaatttatcatcctgtctagacaattatttcttaaacatgctaatgatga

SEQ ID NO: 14700 - DNA, 121 bp, Artificial Sequence
  Synthesized
  misc_feature (61): n=a or g
atcaatgctgaaaacaaaggctactaaatttttcgggcacgatttgcccttcatgaagccntgctgctgtcaccaatcacttgttttccatgtaccttagcacagtttccagaataatctg

SEQ ID NO: 14701 - DNA, 121 bp, Artificial Sequence
  Synthesized
  misc_feature (61): n=t or c
gacttaagtaagaatggtgaaagtctgggttttctaggtaagccaactagatgctcttgtntaccaaactaaatcctggagtaagtcaatcaattagtttcctagcacactggttgtacca

SEQ ID NO: 14702 - DNA, 121 bp, Artificial Sequence
  Synthesized
  misc_feature (61): n=a or g
aagagatgaaatcagcagctcccacacactttgctctttccacatctaatgcttcgcaccntgtgccaagtgaaagcctcacgcaggaagaggcccaattcacagggagacaacaccagtg

SEQ ID NO: 14703 - DNA, 121 bp, Artificial Sequence
  Synthesized
  misc_feature (61): n=a or g
ccatggcacaatggctcatctcactgtcttgatgccaagttggcagggtccagctgttccntcagatgtgttcacatctagaaatcagacctaaagtttgatgcgcttgacgtgcaacctt

SEQ ID NO: 14704 - DNA, 121 bp, Artificial Sequence
  Synthesized
  misc_feature (61): n=t or c
taaactcaaaacagagcagatttgtattaactgattacaagaactgagatcgactcgtaangttttttggaggggcacacagtataatgatggggctctctcctttaaaataagttaataa

SEQ ID NO: 14705 - DNA, 121 bp, Artificial Sequence
  Synthesized
  misc_feature (61): n=a or g
aaaagaaatcttcctgtctttcttttagtttttaatactctacacccttattaacatgacngtatttacatacaaagataaaacttattatgttactaataatttcaagtatgtcacaatc

SEQ ID NO: 14706 - DNA, 121 bp, Artificial Sequence
  Synthesized
  misc_feature (61): n=c or g
ttgctatcattgctataggagtatcatttctacaatgacttttcaatgtcagtgaagtcantgagttattcctgagtttaaatcctgttttacgaaagcatacaagtttgcccttaagcct

SEQ ID NO: 14707 - DNA, 121 bp, Artificial Sequence
  Synthesized
  misc_feature (61): n=a or g
gaggataagcaggaaaggtggaggatgaacccagggagtgaaaggagaaattgaggctggnaatgggtgtctggaatcacgctaaaagcaaagcgttttggaaggagaagttgctgaaaat

SEQ ID NO: 14708 - DNA, 121 bp, Artificial Sequence
  Synthesized
  misc_feature (61): n=a or c
aagcacttagtgcatattacaggccttagtgtagagagaaaggtaattgttttatcactgntgcttactctaaaggaatcagatacagtggtatgctcaggttcctgtgtcataatccagt

SEQ ID NO: 14709 - DNA, 121 bp, Artificial Sequence
  Synthesized
  misc_feature (61): n=a or c
taattaccgaagcataattttcatttccgtagtccaaggctgtaaaaaagccaagaacctnttctgccattgctggaaagctagcagaagagaaggtcgtgtccctgactcttctttcaca

SEQ ID NO: 14710 - DNA, 121 bp, Artificial Sequence
  Synthesized
  misc_feature (61): n=a or g
gacccctctgccagccccccgctgtgggagcacagggccatcccagcccacactaacaccngattatttaaactggaaaactgaacaggcagaacatgagacttccccgaaccaaaaaaaa

SEQ ID NO: 14711 - DNA, 121 bp, Artificial Sequence
  Synthesized
  misc_feature (61): n=a or g
tcttctctctcattgaacaaggcagtcactgtagtccttctccatgcagttctctgcaacntgattcaaaaatggttatctaaaaccttcattgtagcattttctaatgatgtgtattttg

SEQ ID NO: 14712 - DNA, 121 bp, Artificial Sequence
  Synthesized
  misc_feature (61): n=a or g
cttaacttgcatgccaagaagctgttaattttgtatcacagctttacatctaggccagatnacagagcgcccgtcctctgacatcatgttgctcagctttgccactgacatcctgaggaat

SEQ ID NO: 14713 - DNA, 121 bp, Artificial Sequence
  Synthesized
  misc_feature (61): n=a or g
ggggctgcaggaatctcccttggcccttctttaattgcttaggaaagttgtcacttttccnttaggagctgtatagctgaaactcacatcttcacgcaccgaattgagcgtgagcccctgg

SEQ ID NO: 14714 - DNA, 121 bp, Artificial Sequence
  Synthesized
  misc_feature (61): n=t or c
acaataaaaagaaatgctgtttagctgttacacagcacttctagttcatagatttcaaagnggtttgaagagaaaccacaatccttgttttactgctggggaagaccaactacacggaagt

SEQ ID NO: 14715 - DNA, 121 bp, Artificial Sequence
  Synthesized
  misc_feature (61): n=a or c
gagcctgttgggttactaacacaactaaagatgaactaaacactgttcagctgcacacaanaaattttgtaatcagaagcatcttgaccattgcccagtaactggagaataacatagacta

SEQ ID NO: 14716 - DNA, 121 bp, Artificial Sequence
  Synthesized
  misc_feature (61): n=a or g
gacaatggaagatcacattatatttagacaaatgtttctcttaccctatacgaaagaaaangctataggaatatggcacctaaaatatagatacggttgtccctaacttctagccactaag

SEQ ID NO: 14717 - DNA, 121 bp, Artificial Sequence
  Synthesized
  misc_feature (61): n=t or c
ttccctaattttctgttatcagtgcagaaagtaaatatgtagagacaattgcttggaagantataaatgctaggagcatactatgcaacttcctaattatagtttcatttccccagcattc

SEQ ID NO: 14718 - DNA, 121 bp, Artificial Sequence
  Synthesized
  misc_feature (61): n=t or c
caagtgaaggtcattactccagccacacagcccagggctgggcttggttcccttattcttnggcagcaaaacatttgaactaggactgaaagtcaaagcacagtttaagtgtttccatgag

SEQ ID NO: 14719 - DNA, 121 bp, Artificial Sequence
  Synthesized
  misc_feature (61): n=a or g
cagtataagagatgagatgtcaagaaataacctgactgtaagactaaaccattttgtaccntatctgttgacatagtaacctcttagaagtggaccatgactttaccatgtagcagaatga

SEQ ID NO: 14720 - DNA, 121 bp, Artificial Sequence
  Synthesized
  misc_feature (61): n=t or c
catcacacctgtggctcagcagtaattctgtttgcattcaaatccattgtggaaatacttngttacgtgtttacttgcaaagtctgggaataacggggtgtcttttccaatagtcaccccg

SEQ ID NO: 14721 - DNA, 121 bp, Artificial Sequence
  Synthesized
  misc_feature (61): n=a or g
tgctagtaccaggcctcctctatttcaaggtgttgagtaaatagtgttgcagattatttcnttttttgaatgcacattttgtttcccttgagtgtccagattaaaatggttggacatctac

SEQ ID NO: 14722 - DNA, 121 bp, Artificial Sequence
  Synthesized
  misc_feature (61): n=t or c
gtgattgcctgcaaagctgtaattccccataagcatatgtaaacttctctcactgctttcncaaagaaaatatgccctctctgaaatagctttccaaactgaataagccatactttctata

SEQ ID NO: 14723 - DNA, 121 bp, Artificial Sequence
  Synthesized
  misc_feature (61): n=t or c
aatttagggcccggtaacaagtcctacaaatagtctttctgtgaacacttactcttcctgngttgaatttcaatgaactggagctaatatgactttgcacatgaaggaagctacccgtgag

SEQ ID NO: 14724 - DNA, 121 bp, Artificial Sequence
  Synthesized
  misc_feature (61): n=t or g
tcagtaaatgtccatagtatagcattttcttcctttctctttgttttacataccaaagttnctctccgagttggaagcagagattcctcttagttctcttctgcttctgagcttcttttcc

SEQ ID NO: 14725 - DNA, 121 bp, Artificial Sequence
  Synthesized
  misc_feature (61): n=t or c
aaagcccagtggaaggttgcgtgcacagatattccagcctaccagccaagaactataattntgtatagtgagtggcactactactgttttctaatacttaaggcctttaggtgactaagca

SEQ ID NO: 14726 - DNA, 121 bp, Artificial Sequence
  Synthesized
  misc_feature (61): n=t or c
cttttaaaaggcaccaaaccatcagagaataattggtgtcgcacctcagcctccggcctgnggagagatgatgatggcacgagcaaatttccactgctcctatggcagaggaaggtgacct

SEQ ID NO: 14727 - DNA, 121 bp, Artificial Sequence
  Synthesized
  misc_feature (61): n=t or c
caaagtaaaggcaacatgaagaatattcaaagatgaaaaggactatgttgcatttatttcngtgtgactcagtgtggcaggttaattcacccgcagctacctgctctttggggaaaatgtt

SEQ ID NO: 14728 - DNA, 121 bp, Artificial Sequence
  Synthesized
  misc_feature (61): n=t or c
gtttagctttccatctgtcttagcaccatttcttctgagctcatttccatctgtatgtctntacttgttgctgcattgccaagactgcttcttttttccccccctaaacataacttcctaa

SEQ ID NO: 14729 - DNA, 121 bp, Artificial Sequence
  Synthesized
  misc_feature (61): n=t or c
tcttgagttgcataattggcctttaggaagagtaggggataaaatttccaaagacaatcangtagcgtatgaaatctatgcccagctgaaagtttctcaatcagattttccaattgatcta

SEQ ID NO: 14730 - DNA, 121 bp, Artificial Sequence
  Synthesized
  misc_feature (61): n=t or c
caaagaccttgttttcatacctaaacctgtcaaatgacaccttttgtggcaccaagtacanattttggttctggctgagactcaagtgaaagaataacatttgttacaacacatcagaatc

SEQ ID NO: 14731 - DNA, 121 bp, Artificial Sequence
  Synthesized
  misc_feature (61): n=a or c
ccctgatttgcaacagtattcagcctgcatataccaaagaaatctcatctgatgttcctanttctaggcaaagtactacttcattctaagaaggcaaatcacctcattgcattgtatcata

SEQ ID NO: 14732 - DNA, 121 bp, Artificial Sequence
  Synthesized
  misc_feature (61): n=a or g
ccctatggcaacccttacacatggtgggtttagagttagagggttagacctgtttctcagnagaagcaccggaagcaatcagtaggatttagacctagcagagaggttctactcttgtatg

SEQ ID NO: 14733 - DNA, 121 bp, Artificial Sequence
  Synthesized
  misc_feature (61): n=c or g
ggcagggcacatcaaatgagctgatgaaaaagataagactagggaaacagaatatgtgttntaagtccaggaaagtttcaaaatagagaaagcagaagatggatcgaggaactgtttggag

SEQ ID NO: 14734 - DNA, 121 bp, Artificial Sequence
  Synthesized
  misc_feature (61): n=c or g
gccctgttttcttttgttactgttactttatagattacaatcaaggaaagtgttgtggcantgaaacttctctccatttttgttctttgtgcttcatctgccctatatttgattaatagac

SEQ ID NO: 14735 - DNA, 121 bp, Artificial Sequence
  Synthesized
  misc_feature (61): n=a or g
gccacagctatatcagcttaccatccctttgatgctgttgtaaggaaatccttggaggctngggaactaaatattccagaagacatcaaaatattctattaaggttaaaacacatttaaaa

SEQ ID NO: 14736 - DNA, 121 bp, Artificial Sequence
  Synthesized
  misc_feature (61): n=t or c
atatgagtgaatctgaactccttctcctatagattttttttatgcaaaaaggacaggctgnttaggagtctggatgcatccatgtaagctcaacttgtctacacttgatgaaagttagtct

SEQ ID NO: 14737 - DNA, 121 bp, Artificial Sequence
  Synthesized
  misc_feature (61): n=t or c
gtagtttaaggtgaagtgtgtgcaaagcacgcaactagaataagtcacttgaaaagatggngtgcctcagttcagccgtttttctgtctgaattcagtaccagattttgttgcgtggctgt

SEQ ID NO: 14738 - DNA, 121 bp, Artificial Sequence
  Synthesized
  misc_feature (61): n=t or g
cttcttgatagtgtagaattgcctcagtggtaagcagaaattattttgctaagggatgttntcaaggtaggcttaataggttaaaaactctccttctgttgctacgtatatagtctattac

SEQ ID NO: 14739 - DNA, 121 bp, Artificial Sequence
  Synthesized
  misc_feature (61): n=t or c
gcacaatctctgagcaaaagagagatgctccatattgaggagattgtcagtagctatgaanggaggatacatgactcagaggttttctgttttatttaagtaattcatccatatgaaggaa

SEQ ID NO: 14740 - DNA, 121 bp, Artificial Sequence
  Synthesized
  misc_feature (61): n=a or g
ggtgtgtgctgtcctgcaggcaagctgctggagcgttgcttccgaaagcttcaccataccnctccccgtccattcaaagcaagtcttcaaagcctgatgtgcctctggctggagacggggc

SEQ ID NO: 14741 - DNA, 121 bp, Artificial Sequence
  Synthesized
  misc_feature (61): n=a or g
atattatcctaaacacgttctgatgttgtaaacatcagcatatgaatagaaaagcagggtnaaggtatctgtcatattttgaaatgctgttttaattcaaaggaaggggcttgactgatgt

SEQ ID NO: 14742 - DNA, 121 bp, Artificial Sequence
  Synthesized
  misc_feature (61): n=c or g
catggagggaactgaactgaaccaacaaacaggtgatcggttctgtttaccccgagagganttctcattccttaattgtaactccagatataaacgatgtggggaagataaactaatgatt

SEQ ID NO: 14743 - DNA, 121 bp, Artificial Sequence
  Synthesized
  misc_feature (61): n=t or c
gccaggaattacgcctgacatgaaatggttgtatcaatccccattacactggtgcaatacnagaaatgggaggtgatttcacaagtttagactgaaaagtttattttcctcaaactgttgc

SEQ ID NO: 14744 - DNA, 121 bp, Artificial Sequence
  Synthesized
  misc_feature (61): n=a or g
atcaaagtttctaatgaaccaaattacttattatagtgctgaaattggactgcttgaaaancagaataaagagctactaaattacactcatattatagtctataaatttttctatagggaa

SEQ ID NO: 14745 - DNA, 121 bp, Artificial Sequence
  Synthesized
  misc_feature (61): n=t or c
ttcaaattagctgtttttgttggactcatcttgaattgttctttctatgaatagttgcctnttccatccaaaatcaggtgttgtatacgcatgagcagatatagatctatgcagatagaag

SEQ ID NO: 14746 - DNA, 121 bp, Artificial Sequence
  Synthesized
  misc_feature (61): n=t or c
agaaagacaggtcagggagaagttggaattaactggatgagaggactgagtaaaagcccangggaggcagcaggctgaatcaaggtacagaattaaacttctttagaagtggaggatcagc

SEQ ID NO: 14747 - DNA, 121 bp, Artificial Sequence
  Synthesized
  misc_feature (61): n=a or g
aattccctccccacgttatgaaggcaggtgaatccgtttatagaggaagtcatttgaaatnggagtaaatccttatgatccttacccttcctttccacctcccatctccaataaaaaatat

SEQ ID NO: 14748 - DNA, 121 bp, Artificial Sequence
  Synthesized
  misc_feature (61): n=a or t
cccaattcataaacaggctgttttagagacaaaagcagtagttgctcttggtatccagggntgatagtgtactcagcaatggtcttgtattgctacaagagaaacgtgtatttttctcatc

SEQ ID NO: 14749 - DNA, 121 bp, Artificial Sequence
  Synthesized
  misc_feature (61): n=t or c
cagagctgagcagtatggcctgactatgccctaacataaagctcctgatgcccaaggctgngtccaggtgccaaacaacatcttggtgatatagaaggcacagaattgcagaatcgcaggg

SEQ ID NO: 14750 - DNA, 121 bp, Artificial Sequence
  Synthesized
  misc_feature (61): n=t or c
tttattttacaaagctgtgtattatagggaagctgcatatttgcactgacatttcattctngtcattctagcaccaggctaaagtagagacaactgcagaagttagtgtccaggctgctat

SEQ ID NO: 14751 - DNA, 121 bp, Artificial Sequence
  Synthesized
  misc_feature (61): n=a or g
cagctcagcacatcaaatcagacacttccagctgagcagacagcaagcagcctgaccaaanacttgggtgcaatcggactcagtgcagctgagagctgaaggcttggaatcgggtcatgtt

SEQ ID NO: 14752 - DNA, 121 bp, Artificial Sequence
  Synthesized
  misc_feature (61): n=t or c
tccattgactttcatgagtttttaggcgtactcctgtgctgcaggttgcaaggtaagatcntctgtgactggtaatacaggataaaaatagataatttattacccttaaaaaaatctgatt

SEQ ID NO: 14753 - DNA, 121 bp, Artificial Sequence
  Synthesized
  misc_feature (61): n=a or g
tctacatagggcactggaaaggggaacgtaggaattttgtggtgggatctgccttcttacnaaactccatatgcccatgttgaagctccagaatcaaaatctgctggtttgtctggctagc

SEQ ID NO: 14754 - DNA, 121 bp, Artificial Sequence
  Synthesized
  misc_feature (61): n=a or g
gatgtgagctttgctagaaaagtctttcgttggaactgagtaacgtcttaagagactttcngttcttctgaaaatgttaagccctaaacagctgatttttttctgggatcattttctacaa

SEQ ID NO: 14755 - DNA, 121 bp, Artificial Sequence
  Synthesized
  misc_feature (61): n=t or c
tagagggatctgcaaaatgccattgggaatattctcctacttgttatatgacgttttgagnatgaggcatttgttcttaattgcttgttactgaacagtgttttatagctgtcatgtttta

SEQ ID NO: 14756 - DNA, 121 bp, Artificial Sequence
  Synthesized
  misc_feature (61): n=t or c
ggctgtacatttttaatgattcccttctccttctgaacttgaaacatgcccactgtgtccngtagctgctgaaggtgcagctcagcagcttacggaggagctgctcttccagtgctgctct

SEQ ID NO: 14757 - DNA, 121 bp, Artificial Sequence
  Synthesized
  misc_feature (61): n=a or g
atgccttgatgcagtatgggaggtttgttgggcacagaacggagaggtcaggattgatgcngaggtgttgagatggctacaatgggcacacgtgggggtgctgggtgatagggaggactgt

SEQ ID NO: 14758 - DNA, 121 bp, Artificial Sequence
  Synthesized
  misc_feature (61): n=a or g
gagcataaaatgaacggccagattcagtaacaacttacatcctttgtgggtctggcataangaaagcgtagcatgcagctattggtgctttatggtatgaaacacatttttcaagtccacg

SEQ ID NO: 14759 - DNA, 121 bp, Artificial Sequence
  Synthesized
  misc_feature (61): n=a or g
caactaattggtctagatatcacttgtaaaaatgtcagttgccatcttcagttagcagacncactgaaaattaagctaagaagctacatattttttaaaacagcaaaaattacagctttat

SEQ ID NO: 14760 - DNA, 121 bp, Artificial Sequence
  Synthesized
  misc_feature (61): n=t or g
ctgagatccggatttgcttagtgggtcagtagcaagcagtctggtagtttgaaatctctgngtttgatttgctaaaggtaacacaaacaagagagatttatcattattagtgttagcagat

SEQ ID NO: 14761 - DNA, 121 bp, Artificial Sequence
  Synthesized
  misc_feature (61): n=t or c
attaatctattgattattttctcccgtccataggcaatagtagcataagtaaaagtcaatnttttagatggcttgccacttacgaccgggcttggtcttacaggtgttgaactgattgggc

SEQ ID NO: 14762 - DNA, 121 bp, Artificial Sequence
  Synthesized
  misc_feature (61): n=a or g
cctaagcacagtgcctgcacaaggactgcttgcagagacaggctgagatttatacaaactnaagaacagagaagtcagaaatgtctttctttcagtgtgtggcgtaggcacccagcaaatc

SEQ ID NO: 14763 - DNA, 121 bp, Artificial Sequence
  Synthesized
  misc_feature (61): n=a or g
atgcctgatagagaatcatcttagctatgcttaatgtttcaaaatgggaaggtggctaatnattaagactaatgattaagattaatgattaattttgattgataaggtggtaaatttaccg

SEQ ID NO: 14764 - DNA, 121 bp, Artificial Sequence
  Synthesized
  misc_feature (61): n=a or g
acaaacatgagtatggatggaataaattagcaggaagtgcaggtagtgtggaattgtcagnctgtacaaatccagctgcaaatggtagctgatttgtttgatatttaccagtccactgtca

SEQ ID NO: 14765 - DNA, 121 bp, Artificial Sequence
  Synthesized
  misc_feature (61): n=t or c
ctaaaggccctgccttatgctgttttctttgctcctgttgtagctcggtatgacctgatanaatttacacagcagagggattgaaattgtagccaggctactacttaagtcagctgagtag

SEQ ID NO: 14766 - DNA, 121 bp, Artificial Sequence
  Synthesized
  misc_feature (61): n=a or g
catgcaattatcaggaatttattgaagatggattgaaataggctggcaccattcatggcantggcaaaattaggagtagaactgtaggtagtaaaggaaagatcagagctttatatagtca

SEQ ID NO: 14767 - DNA, 121 bp, Artificial Sequence
  Synthesized
  misc_feature (61): n=a or g
taaatgtcattttctgtaacagttgacctatgactgaccaaaaacagagatgctggacttnctgaactctccatattgtcagttccttaaaaactaattcttggtcatctgcctgtactaa

SEQ ID NO: 14768 - DNA, 121 bp, Artificial Sequence
  Synthesized
  misc_feature (61): n=a or g
gattcagcaaacactcaaattatcaagctggctcagcattatagctctgaccttcctcaanacaatattttgcacaatactttaaagctctcttcagaagggaaaataagatgttgtacag

SEQ ID NO: 14769 - DNA, 121 bp, Artificial Sequence
  Synthesized
  misc_feature (61): n=t or g
cttccagagcatttttgtcctaaatagcagacagggcaggctattcaacaaccagatccanctgcgaagcctggaactgcgaaagcctggtactggggtcagaagatggctgttctcaatt

SEQ ID NO: 14770 - DNA, 121 bp, Artificial Sequence
  Synthesized
  misc_feature (61): n=a or g
acagaaaaaaggaccttttcaaatcactgtagagtcactgagataattctttgaaaagctnttaatatgctgaccttatagctacctctaataagttatagaaagctgtgtgaaagctatt

SEQ ID NO: 14771 - DNA, 121 bp, Artificial Sequence
  Synthesized
  misc_feature (61): n=t or c
attgtgtgcagccatttccattccagttctgtattaagctgagtagtttcctttcagagcnacaagtcactcctgattttcctttgcagtctctatgggccagagttggataaactgaaga

SEQ ID NO: 14772 - DNA, 121 bp, Artificial Sequence
  Synthesized
  misc_feature (61): n=a or g
ttttctcttttttccaaaacaattatttttacatagaagctgcaatagttcatgtagcagnaacagaatagctccagtgaatcttgttttcataaattaagcactttggtgagacatcagt

SEQ ID NO: 14773 - DNA, 121 bp, Artificial Sequence
  Synthesized
  misc_feature (61): n=t or g
attagatatgcctgagacatcacatctgggatgttgtgatccctgcccaaggccacagttngagggaaacaggccacacttttgacttttgactctacatgttcctgcttagaaaagtgtg

SEQ ID NO: 14774 - DNA, 121 bp, Artificial Sequence
  Synthesized
  misc_feature (61): n=a or c
aacaggtacagactcggcctactttggtcttttcaaaagtcttccctcaacattaaaaaancaatctttgcctacatgtgcttatggatgcatgcccttaacgtgactttatcatccatga

SEQ ID NO: 14775 - DNA, 121 bp, Artificial Sequence
  Synthesized
  misc_feature (61): n=a or g
tctggctcaaattctgttatcgttaagctttgtgatccctaaaatagggagacaagtatgnagttagttaacattgcctactgacttgttgttctttacagtgaaaaaaaagaaagacaat

SEQ ID NO: 14776 - DNA, 121 bp, Artificial Sequence
  Synthesized
  misc_feature (61): n=t or c
gagtatctctgcagaggagttgccacacttgacaacacatcagtgtggcgttatgctcctngaggagctgaatgcgtgctagatggaaaacgctcttcaattttctacttgcatctgtgca

SEQ ID NO: 14777 - DNA, 121 bp, Artificial Sequence
  Synthesized
  misc_feature (61): n=a or g
aaccggctgggctcaggtgcagctttcagcggggacttagcgactgcagaaaagcaccgantggttccgcctttcccagggcccagagcctgacctttctccaccacagcccaactgtggt

SEQ ID NO: 14778 - DNA, 121 bp, Artificial Sequence
  Synthesized
  misc_feature (61): n=a or g
tgcaaagggagtgcaaacgggatgttagaccactgcaggtcaggagagagcaatgctggcnttggtttggtgtggcaggaaggaagagtggagcgagagctggcacggcagccaatcctta

SEQ ID NO: 14779 - DNA, 121 bp, Artificial Sequence
  Synthesized
  misc_feature (61): n=a or g
acacaaatatggaatcaatacacaacttctggaagcaggaaaaatttaaacacggtttgtncgagaaacaaggcaaaacagttaaacatacttgactactgatggaactgaacacagaact

SEQ ID NO: 14780 - DNA, 121 bp, Artificial Sequence
  Synthesized
  misc_feature (61): n=c or g
tcatatggtgactgaaacacagataaggaatggactctagattatggcaaccagccccgantatgagacacaaaccttcattcatggtgtaaccattgctctcatgcttgaaaagaaattt

SEQ ID NO: 14781 - DNA, 121 bp, Artificial Sequence
  Synthesized
  misc_feature (61): n=t or g
cacacttacatcaccttttggagcctgttgatttttttctcactcaaaccaagtgcaactngggatagagcagcgggcacagtgctacctctgccctaccagctcccggtggttgtttgaa

SEQ ID NO: 14782 - DNA, 121 bp, Artificial Sequence
  Synthesized
  misc_feature (61): n=c or g
tcctatgcctttaagaacctttaatgtttatttttataaactctaacatcttgcatcttanacctttaacacatatcttcagcagctctgtctccagtgccatttctgtcctttcagtaaa

SEQ ID NO: 14783 - DNA, 121 bp, Artificial Sequence
  Synthesized
  misc_feature (61): n=t or c
atgaagacggtctctgtacaaggtgcagtctaagcaggactgtgtctccagtgtcgcatcnacttgacacactggaaataactcagccaccttcagtgtgggtatctgcagtgattcagct

SEQ ID NO: 14784 - DNA, 121 bp, Artificial Sequence
  Synthesized
  misc_feature (61): n=t or c
tgcaagcaaacagaagtgatttttttttccccttttaccaaaaatagtgtctttaatgccngagcttattttgtgggagatgacaaaaacatagtcaccatttggcagcagcccctttctt

SEQ ID NO: 14785 - DNA, 121 bp, Artificial Sequence
  Synthesized
  misc_feature (61): n=a or g
aactctgccacagccgtactttggatgacccaacaccagaggatggaaaacacactaaccncatcatgttgcttgatttttcactcctcctccactgcaagacactgctttattcatttct

SEQ ID NO: 14786 - DNA, 121 bp, Artificial Sequence
  Synthesized
  misc_feature (61): n=a or g
tatcggagagacacaaattggaaagatcacccgtttatcccagtaattttagcagcttcanttacactaacaaaaatgtacagtaattattatttatcaaaaccagagaggcattcagctc

SEQ ID NO: 14787 - DNA, 121 bp, Artificial Sequence
  Synthesized
  misc_feature (61): n=a or g
attcctcaccccaactgttacattacattactttcactttcagagcattgtgtccacacantgaccactcaccaagagctcttcatggccaacgtgaacctctaaactgtgtttgatcatt

SEQ ID NO: 14788 - DNA, 121 bp, Artificial Sequence
  Synthesized
  misc_feature (61): n=t or c
tactgagctctccaaagcttgttagaatccaggtacttttgtacagtgaaacagttctaangctgccaatactgcagaggctattgatgaatgggtcctgtcagtttacctaagaatttgg

SEQ ID NO: 14789 - DNA, 121 bp, Artificial Sequence
  Synthesized
  misc_feature (61): n=a or g
tctcttcctagataagcaattacatcctccagatctactcagcttttcatagaagtcttgngaacacttgaaagacctctgtctgacctccgtagcgtagacttacttgatccttatctga

SEQ ID NO: 14790 - DNA, 121 bp, Artificial Sequence
  Synthesized
  misc_feature (61): n=a or g
gtagggagctcttcgtgatgctagcacataaatcaatctgttaagtttaaagattgaccanatgtcaaaacatacattaagatacaagaccctaaggttgcctgcactgatgcattttggc

SEQ ID NO: 14791 - DNA, 121 bp, Artificial Sequence
  Synthesized
  misc_feature (61): n=t or c
agccactaccactcaggtgctgtcccaaagccaagcacaacacccagcaagcagtctttcncatgctcttcccatgagtttcaccaagccttagggctgcagctcgtacctgtggtgcttg

SEQ ID NO: 14792 - DNA, 121 bp, Artificial Sequence
  Synthesized
  misc_feature (61): n=a or g
cagataggaaacaaagaggaactcatgccaattactgaaaccacaggaatcattctccttncagctcctccctgcttttcttccgttcttcccagtcatactcagatattcaacttcagag

SEQ ID NO: 14793 - DNA, 121 bp, Artificial Sequence
  Synthesized
  misc_feature (61): n=t or c
atgaatttgttaaaggaaaagcctacagtcaggggatattaagattaaatttgcagttcangggagggtaagcaggctttttctaagcctgtgcaactaccagccctatgcacatagaatt

SEQ ID NO: 14794 - DNA, 121 bp, Artificial Sequence
  Synthesized
  misc_feature (61): n=t or c
agcatcaggataagctcagtgctggtgctaggagcaggaattgaagttcctttggtctatnctcctgtggcgttgcatatgtcgggtgctcccctggggcagtgctgcagcctgggaagga

SEQ ID NO: 14795 - DNA, 121 bp, Artificial Sequence
  Synthesized
  misc_feature (61): n=a or g
tgtgcttacattatctcagaggtagaacagaaattttcatcactgttgccaaaaattaatntgctgcactaaaaaggaggttcgcgttttgactggcctgaggcaactcctgccaaaggaa

SEQ ID NO: 14796 - DNA, 121 bp, Artificial Sequence
  Synthesized
  misc_feature (61): n=t or g
aaggggtcatctagctctcagttctcagatacttcatgcatggtgggtgtgctaaagccangagcattttattgcttcacatagggtgcattcttcggccataagcagagaaagaacagtc

SEQ ID NO: 14797 - DNA, 121 bp, Artificial Sequence
  Synthesized
  misc_feature (61): n=c or g
tctgcacaaaatattccagttttattcagttccccaaaagggcacactagcagggatgcanttcatatttataattgtaagcttaattctgccaaagggtcacctctttttacctttggct

SEQ ID NO: 14798 - DNA, 121 bp, Artificial Sequence
  Synthesized
  misc_feature (61): n=a or g
ttttttcaataggagtcttatgggtctgtggttcattttgatcattgccctacaaacacangaagggaagcaacaaacacgtctgaagagtaatcaaagaaactgtatttctaaagtctct

SEQ ID NO: 14799 - DNA, 121 bp, Artificial Sequence
  Synthesized
  misc_feature (61): n=t or c
tttatgtgtatgtgcatcatgggaaatgctgaaatttttcatcatctatattggccttaanggtaggttttatcagttccagctcgaaataccgtgcttaattttcatgttgcttcaggtg

SEQ ID NO: 14800 - DNA, 121 bp, Artificial Sequence
  Synthesized
  misc_feature (61): n=t or g
aaaaatatgaaggcctcactactgacacgtcttacagatgccctgctacagaacttgctgnaaaaaaaaggaaatctgcccaggtgactgcctctgtcacaggaagtgctttctgcccatt

SEQ ID NO: 14801 - DNA, 121 bp, Artificial Sequence
  Synthesized
  misc_feature (61): n=a or g
ctgagcagggctgcctttgctgggaggcactgcaggatgcagccctgagccctgagatccnggcatgaaggtgttcctatttaaagagcccagtgggatctggaggcgtctatgagagcca

SEQ ID NO: 14802 - DNA, 121 bp, Artificial Sequence
  Synthesized
  misc_feature (61): n=a or g
gagatttggcagtgaaacttatgaggaacacaggctagatcagatctttcttggtctaatnctgtgttttcaggagtggaataggaatttcagaaaactatgcactaaattaatactggat

SEQ ID NO: 14803 - DNA, 121 bp, Artificial Sequence
  Synthesized
  misc_feature (61): n=t or c
tccaaatgtacttccttgtttctgcacagaaatgtgtagtcagctgcctcaaggtgaaacntgtcagaggaagggctagaaaagtaactagtgtgctttattttgtaatttgtgattgtta

SEQ ID NO: 14804 - DNA, 121 bp, Artificial Sequence
  Synthesized
  misc_feature (61): n=t or c
tgacgttgcaggaataatatacaggaaatttaccctaatgcgggtaatgcataaaccaaancaaaataaattccaagatttccaaccccgtacctctaaacttgtctaagctgacctcagc

SEQ ID NO: 14805 - DNA, 121 bp, Artificial Sequence
  Synthesized
  misc_feature (61): n=t or g
gtatacatagagagagaacacgagttcagaaatacgtggagaccacagtctctggcatgtnccatcagtcatccagggaggcaaaaatggagctggaagacatctggtgagggagatgtcg

SEQ ID NO: 14806 - DNA, 121 bp, Artificial Sequence
  Synthesized
  misc_feature (61): n=t or c
caatataagaagaaaataaaactattggagagtctccagtaagggctgcaaaaatggtgangggtacagagagcaagacatatgagaagcagatgagatctctgggtgtgttttgcccaga

SEQ ID NO: 14807 - DNA, 121 bp, Artificial Sequence
  Synthesized
  misc_feature (61): n=t or c
tgagccgtgtcacatgaggggctggggagtcactttccttcccagtttgtgccttgacccngtggtagcatcactgctgggcaccgcacagggagatgtgctgtcctctccccaaagccag

SEQ ID NO: 14808 - DNA, 121 bp, Artificial Sequence
  Synthesized
  misc_feature (61): n=a or g
aagcatatagaatagagatgtaaagaggttgccagctttggactgcttgctgtgcagccantatttgctacaactgtgatcttggaaggaataggtattgataaggaaggtggtgtgtaca

SEQ ID NO: 14809 - DNA, 121 bp, Artificial Sequence
  Synthesized
  misc_feature (61): n=t or c
tacaagtgtgaaagttactgacagatttttatcaggatgcagactttgctagcttgctcantgaatggtattatttcaggaccagtgtactatgtagctccatgtgtaagtctgatatttt

SEQ ID NO: 14810 - DNA, 121 bp, Artificial Sequence
  Synthesized
  misc_feature (61): n=t or c
ctaagaagtaaatcctcctaccaaagatgggttaatctaactcaatttaaaaaaccctctnggaaacttaccaggactttcaattttacctccataaatgtttgaaagttttggatcctac

SEQ ID NO: 14811 - DNA, 121 bp, Artificial Sequence
  Synthesized
  misc_feature (61): n=a or c
tactctttttcatgcttttttaggataagaatttgccaagggcatcaacagcagttttccnaggcttcagaacaaggattatagagtcaatccacaaatgactcaaatctgaaaaaatgga

SEQ ID NO: 14812 - DNA, 121 bp, Artificial Sequence
  Synthesized
  misc_feature (61): n=a or g
gacaagtgagcagagagactttcaatacaacatcagccgtcaggaaagtggaagagccaanggctaactgcagatagcaggcagaggttgtttttagggtctgctgtgtaaatggaaaaac

SEQ ID NO: 14813 - DNA, 121 bp, Artificial Sequence
  Synthesized
  misc_feature (61): n=a or g
acagccacaccagcagaagtgttctcctgtcctaaaccccagggaattttacactgaaagntgttttgaagggcagaaaactcagacgtaacagcaagcaatgaaatcaactgctgtctgt

SEQ ID NO: 14814 - DNA, 121 bp, Artificial Sequence
  Synthesized
  misc_feature (61): n=t or c
tatttcgacatctattaaactttacacttgcctacaaagctatgattttaagtccatattntcactgctttgctgcataaagaaacattcaatttgcttcccataaggattccttagtctc

SEQ ID NO: 14815 - DNA, 121 bp, Artificial Sequence
  Synthesized
  misc_feature (61): n=a or c
atcataacattacagaactattatctcaaggtttccagttttccactaactggaacctctnttctcccctttcaacaattctgagcaaagaaaattcattcaccaacacatctcactacat

SEQ ID NO: 14816 - DNA, 121 bp, Artificial Sequence
  Synthesized
  misc_feature (61): n=a or g
agtagatcatatctataacagcaatcagtaaatgctttagagcagtttctatcacgtccantaagttattgtcttatgattgtaattatcaaatgaaatacttgaagtcaaaatgagattt

SEQ ID NO: 14817 - DNA, 121 bp, Artificial Sequence
  Synthesized
  misc_feature (61): n=c or g
ctgaagaacccccagaacaatgacttgtttcagctgtttgctatacctaacttgcagaacnaaggaaaatttctcagttctttaatctggtgaatccagtactggatgagacttttttccc

SEQ ID NO: 14818 - DNA, 121 bp, Artificial Sequence
  Synthesized
  misc_feature (61): n=t or g
ctaacatgggaagccaatgtatctgcttgtcctgatctgagtagtggaactgttacaatcnaccttaaacattttgcctgttgtaaagagaagctacttcaggtgagtgcataaagaaaat

SEQ ID NO: 14819 - DNA, 121 bp, Artificial Sequence
  Synthesized
  misc_feature (61): n=t or c
ttgttcagacctgtcatgtaaggctgagagctgataattcatatcccagaatccttttatntgagtggagtgatgtctccagtacgtgtacttctggcaaaggagttgcagtgcttttcaa

SEQ ID NO: 14820 - DNA, 121 bp, Artificial Sequence
  Synthesized
  misc_feature (61): n=c or g
tgggtctcaggtactacaggatcccactctcgtgctgtttgattagccaactcctgctctngaggctttccagtcgcctctccccttactgcacgcgtcccagaaacaactgggatgaaca

SEQ ID NO: 14821 - DNA, 121 bp, Artificial Sequence
  Synthesized
  misc_feature (61): n=t or c
aaattacttttaaggcacatcagccattccatacatattttacctccactttaaacctgtnagttaaatttcttttgactccttgaattttatgaaaacgaaggggaaggactgcgcttat

SEQ ID NO: 14822 - DNA, 121 bp, Artificial Sequence
  Synthesized
  misc_feature (61): n=a or c
ttccagtagccagctggactgttctgatatgagtgagtgagactgctcaactcatttgcancaggacagatccaaacatgttctctgaaaataaactacaggcatcaccaagtactgatgt

SEQ ID NO: 14823 - DNA, 121 bp, Artificial Sequence
  Synthesized
  misc_feature (61): n=a or g
tggaagatatcctttaaagaatctttcattatatctgagtaatagaacaacaaatttgtcnctgaaaactctccataaaacatggagaaagtacaatctagtcagtatgtcaatgaagcaa

SEQ ID NO: 14824 - DNA, 121 bp, Artificial Sequence
  Synthesized
  misc_feature (61): n=a or t
cccaaatacagaacattggtccagtgctgtacatttttgtgggtatctgtgatacaagatncaagcttccactttagatggctgatttgacagggtagtggcatgcatttaaaataattcc

SEQ ID NO: 14825 - DNA, 121 bp, Artificial Sequence
  Synthesized
  misc_feature (61): n=c or g
tgctgtcccagtgctgcagctgtttggaaggacttgggagcttgttgggttgggtcttgtnatatgagctccccagtgctcgcagtgcagtttgtatgatgcttgagcaccagtggcagcg

SEQ ID NO: 14826 - DNA, 121 bp, Artificial Sequence
  Synthesized
  misc_feature (61): n=t or g
ccttcgatgaccagggaaaatcagaactgaaacatctcatggggcctttgtgtgctccacntctatgctcctttgcacagcatttttactcacgtgggcacccattctcctgtacgttccc

SEQ ID NO: 14827 - DNA, 121 bp, Artificial Sequence
  Synthesized
  misc_feature (61): n=t or g
ggtgttaccccaatggttagggccattgcctgctggtctctgtaattacagcactgacagnaaggggaactgaaatcatctgtaagaggcagtagtaaaataaaaaataaataaaataaca

SEQ ID NO: 14828 - DNA, 121 bp, Artificial Sequence
  Synthesized
  misc_feature (61): n=t or c
aaacattttgtctttctttcatgagtggggtgacatttgaatatgcaaacagtgtcaaagnctgccctccggatgttttcctgaaccatgatttatgagggctggctattgtattttctat

SEQ ID NO: 14829 - DNA, 121 bp, Artificial Sequence
  Synthesized
  misc_feature (61): n=t or g
cacaataggataccattctcagttagggcatcaatgtgttaatactgtcaatctaataaanagctgaatatatattctctatattttaaagagtagtaattatatatttttcataaagctg

SEQ ID NO: 14830 - DNA, 121 bp, Artificial Sequence
  Synthesized
  misc_feature (61): n=t or c
tagagaaacactgaaaggaactgcttggttatgagaagcccttaaactcgtacttgaaaangtgattgagcagatttaccacagaagggtaaattctgtggcacttagaagtgcacaaatc

SEQ ID NO: 14831 - DNA, 121 bp, Artificial Sequence
  Synthesized
  misc_feature (61): n=a or g
aagatttgtacaatttattttcaggaaataacaatttttggcttaaagggaaatactgaangtatatagaaattaattacatgtttatcattgagcagggaaccctacgaaaacttttgct

SEQ ID NO: 14832 - DNA, 121 bp, Artificial Sequence
  Synthesized
  misc_feature (61): n=t or g
tctttctttttttccttttattttttgccacaacaacccctcacgttctcttttttgttcnttccttttaatgaaacgaatggcaccacggagctgcgtttccgaaaggacaccgcacctt

SEQ ID NO: 14833 - DNA, 121 bp, Artificial Sequence
  Synthesized
  misc_feature (61): n=c or g
ctgcctgaaagccagagggggaagctggatgttacgagatgataatctccgcacaagatanggctccattccttggaaagactcttcctcctcactacggtgatggagtacttcttctgaa

SEQ ID NO: 14834 - DNA, 121 bp, Artificial Sequence
  Synthesized
  misc_feature (61): n=a or g
taaagaagtagctagccaagaacgatgtaagagttgagaagtttcgcttatatttttggcntgagtcacagacatctaggattaattacagcctgcacccgacgtatcttaaaaaatgcat

SEQ ID NO: 14835 - DNA, 121 bp, Artificial Sequence
  Synthesized
  misc_feature (61): n=a or g
cactatcccaggtgtgtggcctcacaagtgcccacactcatctttctgctagagtggtacnaaggtaagttggtgaaaacgtgagttatgtccattacatgaacagtacacagataatgaa

SEQ ID NO: 14836 - DNA, 121 bp, Artificial Sequence
  Synthesized
  misc_feature (61): n=a or g
taacagaagtaatctatcgatggaacggctaaatcttagctcagattcagagaagtcatcngaaggagaggaaaagccagttgtcatcacgtcctctgccctgggactgcttgcacgacac

SEQ ID NO: 14837 - DNA, 121 bp, Artificial Sequence
  Synthesized
  misc_feature (61): n=a or g
tttgctttgtggcagttaattctatgttttcgtgttcttgccattttattatacaccagangctgaatctcagttgtgctgaaaagtggcaaaatctttttcaaattgggcagctcaatat

SEQ ID NO: 14838 - DNA, 121 bp, Artificial Sequence
  Synthesized
  misc_feature (61): n=a or g
attatctaggttaattctgtgcagacaggtttcttttggaaatacctagttgctgattttngtaataaatagcaggttgttgaatctcctgtttgcttcccccctccatcagttccagtgt

SEQ ID NO: 14839 - DNA, 121 bp, Artificial Sequence
  Synthesized
  misc_feature (61): n=t or c
acagatatgtacatagctagtaagaagaatttggtgccatagcaattttagtaaaggaagnataggctctggaagactcagttttgatagtgtttttgtgactgctagcattgtcttgaaa

SEQ ID NO: 14840 - DNA, 121 bp, Artificial Sequence
  Synthesized
  misc_feature (61): n=t or c
agaaagagccctttcgtaaatagcttcagcaattgtcttgtttttattcaaagctcacttnattatcttgctttgcttactgtggactgatgctttgtttgcattaattctatgtttgcag

SEQ ID NO: 14841 - DNA, 121 bp, Artificial Sequence
  Synthesized
  misc_feature (61): n=t or g
gctaaaggccggatgcaaacacaggcagaacttgtctctgatgcggattgaatgctgtccncaagtcgtgagagcaacagtactgacaaaatgtcccccacttgggaccagcctactatac

SEQ ID NO: 14842 - DNA, 121 bp, Artificial Sequence
  Synthesized
  misc_feature (61): n=c or g
ttgcataatgaatacttattttggccctctcaggttcttcatgtcatctggtggatgtagntgcctacgtaaaagtggtactctgcatacacagagatggttttggaactatttttgtcaa

SEQ ID NO: 14843 - DNA, 121 bp, Artificial Sequence
  Synthesized
  misc_feature (61): n=a or g
ttactttgtatacataacggatgccagtacagttaacgatgtggctttcctctattgaatntagtatcttccattttcttctagatatcttacttcattcattaattttgctgttatccac

SEQ ID NO: 14844 - DNA, 121 bp, Artificial Sequence
  Synthesized
  misc_feature (61): n=a or g
ttggcatcatagtaaatacagtgatgttaatttcctcgtgtgaattatcatctgaaaccancaagaccaatttaggggaactttcccattggaaatgcttttgcagaaagtaaaatactgt

SEQ ID NO: 14845 - DNA, 121 bp, Artificial Sequence
  Synthesized
  misc_feature (61): n=a or g
actgtataacaaggatgtgctttcacaggtggtggcttttagtcagtaaagaagaaaaaanttctgataagaattgctggtaaaaacagtttgggaaagacccatcaggcagcccaccatg

SEQ ID NO: 14846 - DNA, 121 bp, Artificial Sequence
  Synthesized
  misc_feature (61): n=a or g
tcctttgtgtaacgtttttatttccaattccacttgaaggattccttggcattttcatccngcttcactgggctatggattcccttacactcaccagcactctctggggtggctttccttt

SEQ ID NO: 14847 - DNA, 121 bp, Artificial Sequence
  Synthesized
  misc_feature (61): n=a or g
ctgttcctgggtgggtctttgaactccagaaaactgctgacttctgctattaaaccccaanaagtagttacagacattttttaatcctctagcggagttttgtcctgaaggagctacattc

SEQ ID NO: 14848 - DNA, 121 bp, Artificial Sequence
  Synthesized
  misc_feature (61): n=t or c
ttgtcattcaggagttgctgacgcagtgaaagagcagagccctttcttctgttttttctancttaattttactatatttagggctaactcatgttgaatctcctgtgaggatgtaaaaaac

SEQ ID NO: 14849 - DNA, 121 bp, Artificial Sequence
  Synthesized
  misc_feature (61): n=t or c
ccactctgtctttgtaatctatgtcttaggactttctgttctagaggctccatttttgtanttgatagtccttagaagccttttcttccatgaatttgcttaatagcttataaaatcaaat

SEQ ID NO: 14850 - DNA, 121 bp, Artificial Sequence
  Synthesized
  misc_feature (61): n=t or g
ttagtggtctctgtttctttaccactatgtgtgtgagatgcggctgagatagagaccactnagaggagtaaacctttttctccactgtttttccacatggccttctaacaaccatgcagat

SEQ ID NO: 14851 - DNA, 121 bp, Artificial Sequence
  Synthesized
  misc_feature (61): n=a or c
tgcttcctgaagggagtggagtgggttatgagagagaagacctcagattagcattttctgnatctattcagtggtggaaagcatgctatacattttttaaaagcattttttttaatcccaa

SEQ ID NO: 14852 - DNA, 121 bp, Artificial Sequence
  Synthesized
  misc_feature (61): n=a or g
aatactcgcagaaatacaaagtgtgcttaacatttctttgattggtctgcaatattttcantatatttgacagttcaagatacatactgaacccctacagaattcctgaagatctgtctat

SEQ ID NO: 14853 - DNA, 121 bp, Artificial Sequence
  Synthesized
  misc_feature (61): n=t or g
ggctgcagtgcacagtgggcatttggaaatggcaggtgttgtcattaaatcctagtctcanctttgaggaagggaaaataaacccccttctgggaaacgaggggcagggcagccccccagc

SEQ ID NO: 14854 - DNA, 121 bp, Artificial Sequence
  Synthesized
  misc_feature (61): n=t or g
ttattcatgtatttcactttattggctgacagtgccctgaaaattctacaattatccaaanatattttacatctcacatctgtaacgtttatttttgcaaacccgatatctctgcatgttc

SEQ ID NO: 14855 - DNA, 121 bp, Artificial Sequence
  Synthesized
  misc_feature (61): n=t or c
aggaatacaaaaagtctgaattgagaatgcattcactgatgtgcattaaattcctgaatgnaaaaggttggttcgaattctagtgtcttaaatactgtctgacacacagtgtgaaactaat

SEQ ID NO: 14856 - DNA, 121 bp, Artificial Sequence
  Synthesized
  misc_feature (61): n=t or c
gggtgtgcctgaaatagttgccttgttcagctctgtgatgaagtgacagcgtggacccatngaattcatgtcagcccacctgaaacgctagccatgcttcccaggcatgcaggttgctctg

SEQ ID NO: 14857 - DNA, 121 bp, Artificial Sequence
  Synthesized
  misc_feature (61): n=a or t
atccctaaaacagaaaaatcatctttaaattaagaagtcatgtctctctcttagatacagnaatagttttctagttgctatgcgttacaaatggcatgactcagtatgtaaccagcccagc

SEQ ID NO: 14858 - DNA, 121 bp, Artificial Sequence
  Synthesized
  misc_feature (61): n=t or c
gaagtctttctggccctttgtgtaatcaggaaaaaactggctgtcttgtgaacacatcttnctggacagtctcatattcctcagtacatcatcaagggctcgcatttggaagatgcattgt

SEQ ID NO: 14859 - DNA, 121 bp, Artificial Sequence
  Synthesized
  misc_feature (61): n=t or c
tatgttcaatatttttgtacctgtctctgtgattgaatattgagggtgcatatttacagtnaatacagaatcaaggaggaccttcaagtagactggaagacagagctgaagttcagaatgg

SEQ ID NO: 14860 - DNA, 121 bp, Artificial Sequence
  Synthesized
  misc_feature (61): n=t or c
agttatcagttgagttagttttgttcaagtttgatgaaaattagtattcaggtatagaaangagcttccaactcagtctcccactgggagaaaagccatcagatctccatgtgaaacatcc

SEQ ID NO: 14861 - DNA, 121 bp, Artificial Sequence
  Synthesized
  misc_feature (61): n=a or g
gacctgacaacaaaaagcatattctgtagctcacagtgggaagttcttttcaaatccaagngatggcatggagcacattttaaagcacttttttgaattaacaacatgtgagtaatgaaga

SEQ ID NO: 14862 - DNA, 121 bp, Artificial Sequence
  Synthesized
  misc_feature (61): n=a or c
tcaacatttaactgtgctttgttcttgtagttaataaataaaattatcctgtcttcagacngaagtgtggtgagatgttaagagatgaagtgaattctgctgacaataggagttaagtatc

SEQ ID NO: 14863 - DNA, 121 bp, Artificial Sequence
  Synthesized
  misc_feature (61): n=a or g
gtgaaaattaatcaaaatcttcttaaaggaaactatcagctgagattgaatctgaactctnttttggtgtctctttctgttagaaaataaaaattcctaaataaaattacttagcttgggg

SEQ ID NO: 14864 - DNA, 121 bp, Artificial Sequence
  Synthesized
  misc_feature (61): n=a or g
acgggtttagttgcttacgtactttgtgcttttcattaatttgtgctttctgtgcaaggcngatttgtggtctatgaatgatatagattacatctagaactttgcttttgtggaagttgcc

SEQ ID NO: 14865 - DNA, 121 bp, Artificial Sequence
  Synthesized
  misc_feature (61): n=a or g
taattgggcattctggttggcagcaatcaaaatccagtcaattcagtcaattttcacgcanttaatttaacatcagccagcatattaaaagcttgtatcaactggaagaaatagtagcact

SEQ ID NO: 14866 - DNA, 121 bp, Artificial Sequence
  Synthesized
  misc_feature (61): n=t or g
atagtaccctttcagacactttcataagactggaatacaattttccccaccagatttttcngatatttctaaactaattgaaatgaaggaagtgaaaaattaatttatgagatgttctcat

SEQ ID NO: 14867 - DNA, 121 bp, Artificial Sequence
  Synthesized
  misc_feature (61): n=a or g
gtcctgtaatccctttaaaaaaaaacaaaacactaatgtagatagctttacaactactccntgccttttgatgtgaaatggcaatgttctaatgatgttttgtttgtttttttttttaacg

SEQ ID NO: 14868 - DNA, 121 bp, Artificial Sequence
  Synthesized
  misc_feature (61): n=a or g
ggtacgaggaaaatgtaatgagggtactacaggctcagaagacaagcactcacgtagcctngatttgagctatcaagcagctggaggcaaatgccagctgatgagagctgctctgtaaaca

SEQ ID NO: 14869 - DNA, 121 bp, Artificial Sequence
  Synthesized
  misc_feature (61): n=t or c
aaatgcactgtcaacaacttcgcagatgacactaagctaattggtgaggttgatgtcttgncgagaagagatacaatccagaaggactttggtagtcttcagatgtggacctatatgaatc

SEQ ID NO: 14870 - DNA, 121 bp, Artificial Sequence
  Synthesized
  misc_feature (61): n=t or g
tccacctatttcctgcttaattttgacccaagtcttttttgcagttgaaaaaaataggtanacatctgttctttgttaattctagaagcaattacaggtttactgtatggattttgacctt

SEQ ID NO: 14871 - DNA, 121 bp, Artificial Sequence
  Synthesized
  misc_feature (61): n=a or g
acaaattcagacgtgctcagtcagtcatgaactgcagagtatcacccagtgattaccatanaatctttacacaaagcagctgactttatatttcctacaacatggagagaccatatatgtg

SEQ ID NO: 14872 - DNA, 121 bp, Artificial Sequence
  Synthesized
  misc_feature (61): n=t or c
aacaggaacataagtacttccctgacattttaaaaggacaataaatttcagtgcctgaaangttagatatatgatgcataaaggactggctgaaatgcagcagtgcaggctaagtggcccc

SEQ ID NO: 14873 - DNA, 121 bp, Artificial Sequence
  Synthesized
  misc_feature (61): n=a or g
gaagatacgatgtagaaagaggaatgctgttgcttttaggtctagatgagtaaagaaaacntaaccgtatttcagagcactcagctcagtttggtatactttggaaattgtgggatattag

SEQ ID NO: 14874 - DNA, 121 bp, Artificial Sequence
  Synthesized
  misc_feature (61): n=t or c
agttgaatgctaacctcagttcattgcctagatacaggtaatacgaagagtcagggatctncagccccttcctttcttaaaggaggcgttgaatacactgtcatccaaactgaggtttacc

SEQ ID NO: 14875 - DNA, 121 bp, Artificial Sequence
  Synthesized
  misc_feature (61): n=t or c
cacaacagagagacagcgatgaccgccttctcttcctgtaaacggacaaacggtgctgttngcaggctttcatatctgcttcgaggtgcttctttttgtagtcaataaaacgtttacgccg

SEQ ID NO: 14876 - DNA, 121 bp, Artificial Sequence
  Synthesized
  misc_feature (61): n=t or c
actgtgccccagcacagtgaaactttctgtcaagactgttggagtttgagttctctcatanctgagtcataaaaaggaatatgagtacagttcctgagagatgatcctagacatttagtcc

SEQ ID NO: 14877 - DNA, 121 bp, Artificial Sequence
  Synthesized
  misc_feature (61): n=t or c
tcagcatccgttggctgcagttgtgatgtgcgtatctagattttataggctgttcacttantgtgctgtgttctagtaaaagttctcttgtgtgctgttagcatcctaaatatgcattgag

SEQ ID NO: 14878 - DNA, 121 bp, Artificial Sequence
  Synthesized
  misc_feature (61): n=a or g
ttaaaaatcaaagaatggtaaagaaaaatatcacttgttctgctgacaaagtggacgctcnatcccacacagccatattttagtctgcattagacttcaggtcataagtttataaaacatc

SEQ ID NO: 14879 - DNA, 121 bp, Artificial Sequence
  Synthesized
  misc_feature (61): n=a or c
actgaatttatgctgatacacgaggtttctcttaatttctgaagtgagcaatttcatggangccactgaaaatcagtctaagcatcaaatatgtgtattttgaaatattacttgtagtagt

SEQ ID NO: 14880 - DNA, 121 bp, Artificial Sequence
  Synthesized
  misc_feature (61): n=a or g
gataaacagcggagagggaaaagaagcacttcagctggaggacagtgttggtggaagcacngatgtgtgagagccttgagaacatcagagtcaggtctggaacagctgcacaggggtgcag

SEQ ID NO: 14881 - DNA, 121 bp, Artificial Sequence
  Synthesized
  misc_feature (61): n=t or c
ccagagctgctgggagcaaccggagtttcagggaagtccggggactgactgacacacatgntattctcctccagcattcacctggagcctcttccctgtacagcagcaggagcaatggaac

SEQ ID NO: 14882 - DNA, 121 bp, Artificial Sequence
  Synthesized
  misc_feature (61): n=t or c
ggaaagttggctgtaatagtgcctttatttttattgttagaataagcatttatatctctangagcttttagctgaggatctctgaagtcatcagaaatctcttccagtgaaatagggaaac

SEQ ID NO: 14883 - DNA, 121 bp, Artificial Sequence
  Synthesized
  misc_feature (61): n=t or c
agctagagctaaattggggacaattaaaggaagtacttgagctcttcttcctacctgcaanacagcaaaaggccaggctctgaacaaattttgtggccaaagccaggtaaggcaagaacac

SEQ ID NO: 14884 - DNA, 121 bp, Artificial Sequence
  Synthesized
  misc_feature (61): n=a or g
cttgcagtttgtgtgtcatggagagagctgtgcgtctggtggtcagtgcaaatcttttctnggatgactgagtactcaaggagtgggatggtttttgcagttgtggtgttgttttgttgtt

SEQ ID NO: 14885 - DNA, 121 bp, Artificial Sequence
  Synthesized
  misc_feature (61): n=a or t
atttttagccaatcttttcttcctactctcctcatcagacaaggcttggtgttccagattnaatgcaggtgtttctccctgattcagtcagggagtcagactcatttgggcaaccgagttg

SEQ ID NO: 14886 - DNA, 121 bp, Artificial Sequence
  Synthesized
  misc_feature (61): n=t or c
ccaccactcatgttattttgcacttcaaaatgtcgttgctgttgtctgaaataggacttanggaataaacatatcaaagcacaaaaaaagaaacccctctttcttttcttttctttttttt

SEQ ID NO: 14887 - DNA, 121 bp, Artificial Sequence
  Synthesized
  misc_feature (61): n=t or c
catcaggcatggtcacttgtgatcctgaactttgggggaagctcagaagccaggtgcaganctactcaggatatctcacaacgtgtgctaggacataccgtcctagcttgtaaagccacgc

SEQ ID NO: 14888 - DNA, 121 bp, Artificial Sequence
  Synthesized
  misc_feature (61): n=a or g
ttctgcatgccaccttccctcacagtcctctgcctgacaacccacaggctggtattctctnaacatcaagtagctttacaagactgttgtaggtagctgcttcttatcctgtcatacatat

SEQ ID NO: 14889 - DNA, 121 bp, Artificial Sequence
  Synthesized
  misc_feature (61): n=a or g
gaaaaaaacaaacaacccagcactaaggaaacataaatactgggtgaaatagccatggganagcatcacatagatcactcacctactcctctgcaggggcagtcctaccccagccctccag

SEQ ID NO: 14890 - DNA, 121 bp, Artificial Sequence
  Synthesized
  misc_feature (61): n=a or g
tgaaaaattacatttacatatttttgttatcaccaagttcttctccaacaagcaacttaanttgaaatcatgattctagtaagcctgatcaattcattcttggtaaaggttgctttccaca

SEQ ID NO: 14891 - DNA, 121 bp, Artificial Sequence
  Synthesized
  misc_feature (61): n=t or g
ggcacacaatctgagtgtatgtttgccttcctcatgtcctcctttgcatttgtttcaaatntctatctagcatttctacaagaaagaatgaaaaagaaaagagagaaaggaagaaggaaag

SEQ ID NO: 14892 - DNA, 121 bp, Artificial Sequence
  Synthesized
  misc_feature (61): n=a or g
ttgctttatgtaaaatacacaatatttttaagtatggaatgtcttgacacaaccacaatcnttatgctttcctatggatgaaacacaactttacggtctgaatagaattagtattcatatg

SEQ ID NO: 14893 - DNA, 121 bp, Artificial Sequence
  Synthesized
  misc_feature (61): n=t or c
cagtgtctgttggtgctacacagacgtttcctttagaattattaggtcctgtgtttggtgngtgttccttattttacgcagtgtttgcattgatggattttgtaaccgagtgagtatttgg

SEQ ID NO: 14894 - DNA, 121 bp, Artificial Sequence
  Synthesized
  misc_feature (61): n=t or c
tgtcctctggtcctgcttgaaatggaagctttgatcactggtagggctataaagcaacaanaaaactgcactcaaactcttccaaaaaaataccaaaccaccaaaaccaacaccatcagtg

SEQ ID NO: 14895 - DNA, 121 bp, Artificial Sequence
  Synthesized
  misc_feature (61): n=t or c
acagcactgagggatgtgcctcctcaagaggtacagtgactgagggatgcctcctcaaganaaatagcttctgctcaggcttcgaagcggaatttcatccgtctcacttcgtggaactgag

SEQ ID NO: 14896 - DNA, 121 bp, Artificial Sequence
  Synthesized
  misc_feature (61): n=a or g
gcagatagcacataccactgtctctatgtcacttgcaagtatatcaccttagaaaaaacanaaacacaacaaaatccaccctcaccccaaatcagtagccctccacagtgtctgagctatc

SEQ ID NO: 14897 - DNA, 121 bp, Artificial Sequence
  Synthesized
  misc_feature (61): n=c or g
agcacagccccacagccagctctatcagcatacatgtgggggaagcgcagcggggaggaanaaacgagctgcctgagctgcagaagcagaaacttcattgccgaagtcatgttgcatgcac

SEQ ID NO: 14898 - DNA, 121 bp, Artificial Sequence
  Synthesized
  misc_feature (61): n=a or g
tgaggattttggtagccacattgccagtgcactccatgtgaagagaagctgtgtgtgctcngtagttttgaagctatttcgactccaaagctttaaaagaagcagataaagatccagactg

SEQ ID NO: 14899 - DNA, 121 bp, Artificial Sequence
  Synthesized
  misc_feature (61): n=t or c
caaaaaagctgaagagcatgaaatgaaagggtgaagaaaacacgctcagtaggtcacccanaccaattaaggaggccaaagaaaggttaccctaggcaccatcttgcccaactttcgagtt

SEQ ID NO: 14900 - DNA, 121 bp, Artificial Sequence
  Synthesized
  misc_feature (61): n=a or g
caaccttgttattaatattttatcatttaaattatgagagattacaagtactacaacaccngttacattttccaagggtttgtatcactgtaatggatccgtgcatctgtgtataaaagga

SEQ ID NO: 14901 - DNA, 121 bp, Artificial Sequence
  Synthesized
  misc_feature (61): n=t or c
aaaacatgctgtgttgtaaagatttttggggaacagacccaaatgtgaagcccaagtcctntcctagctgccccttcaatggcacaagtgctgtctgacctggcacttcccacatctgggc

SEQ ID NO: 14902 - DNA, 121 bp, Artificial Sequence
  Synthesized
  misc_feature (61): n=t or g
gtagatgtaccaaacatccagactgcaggcttagtctgtgcaagcagtttctcagacttgngagaggatgtttgaatgttagtcctggaagtttactgagtatttttttacgagggctgaa

SEQ ID NO: 14903 - DNA, 121 bp, Artificial Sequence
  Synthesized
  misc_feature (61): n=t or c
ttattttatgattaacaagctactatatctgctgagagatgaccggtcattattgctaagngttttggaatacaagatccataaccttcaaaagtgcttaagtaaatcatgatatgcatca

SEQ ID NO: 14904 - DNA, 121 bp, Artificial Sequence
  Synthesized
  misc_feature (61): n=a or c
acttgtgaaggcaaactaaaatactatgggttacttaatttaaacccttggttaaatatgnagtcagagcaaatgtggaacacaaaaagcaattgaaaacacatggcaggcaaaaatgttc

SEQ ID NO: 14905 - DNA, 121 bp, Artificial Sequence
  Synthesized
  misc_feature (61): n=t or c
cagagttttctgagggactttagtacttaaatacacttacatcttcaagagtagtataacntctgtgttttcgccttgtaaaaagcctaacaattgaacttagaagaaggtggagatatta

SEQ ID NO: 14906 - DNA, 121 bp, Artificial Sequence
  Synthesized
  misc_feature (61): n=c or g
ggaaaagtgggtgcacagatgctcagcgagctcttcccaagtgaactttggctaaaagtgncttttgtcacttcctagtgatttttctttccttttttttttttcctcctgtgttcttagg

SEQ ID NO: 14907 - DNA, 121 bp, Artificial Sequence
  Synthesized
  misc_feature (61): n=t or g
catatcttcacatgggtcggcagctcattttgctttgagaatgaagtctgtggctcgaggngcgacctgaacacacaacgcagctgaataatgcccggttttgaatgagtcagcaagcaat

SEQ ID NO: 14908 - DNA, 121 bp, Artificial Sequence
  Synthesized
  misc_feature (61): n=t or c
ctaaatttaacaagtaatttcttgctaaagcctcaaggttctgaactgtggtctgttacangtgtaaatcaatatcctgaacgaataattgcaggaaaggaacacatttgttttcctgtta

SEQ ID NO: 14909 - DNA, 121 bp, Artificial Sequence
  Synthesized
  misc_feature (61): n=c or g
gctccaaaatagtggtgaatgaggtaatatatctgtaaagagaatcaatataatcactganttgagttctgcatgcagcaattgagaatagtcttgtacataactgttttttactccagtg

SEQ ID NO: 14910 - DNA, 121 bp, Artificial Sequence
  Synthesized
  misc_feature (61): n=t or g
tttctgttctgttgttaaaggagtcttcctggaagtgtcaccttctgtttggtgaattatnctgcagtgggattagtgagagatgcacaacaaaatagtaagcagcacgtacaataataac

SEQ ID NO: 14911 - DNA, 121 bp, Artificial Sequence
  Synthesized
  misc_feature (61): n=a or g
ttatttggtgaccagtgcaagccaacgagagcagcagaatattgaatatataaaattgctnttaaagaaggttaaggctgtgtcataaaccatctaaaatgttattattatttcaagcgca

SEQ ID NO: 14912 - DNA, 121 bp, Artificial Sequence
  Synthesized
  misc_feature (61): n=a or g
gccccgttctgcatgccaattttacagatttcagcttagtgaggccaaacagaattcagcntacagttttgcctgttccttcagatgcttctcccttcccagtacagccagcaggcacacc

SEQ ID NO: 14913 - DNA, 121 bp, Artificial Sequence
  Synthesized
  misc_feature (61): n=a or g
gaccaggcattgaaggcaaattctggctgaatgatcccaagcactgcacccacttccagcnctgaagactgtaccccctaaacctggcactctgatcagctgcacctgtgccagtgggcca

SEQ ID NO: 14914 - DNA, 121 bp, Artificial Sequence
  Synthesized
  misc_feature (61): n=a or c
agcccctgccctaatacttcatcccagcgtggccagaggagtcctaggtaagaatatgtanatccccggaatcccgtataaaggaaagactttcagactttcatataaatatagcacattt

SEQ ID NO: 14915 - DNA, 121 bp, Artificial Sequence
  Synthesized
  misc_feature (61): n=t or g
actgccttgcaccaggaagatgacatgactgctgaggcagtctgtaatattcctatgcagnatggggagctttgctgccacacacagtgaatcatgcattagtccaggactctgaaggcag

SEQ ID NO: 14916 - DNA, 121 bp, Artificial Sequence
  Synthesized
  misc_feature (61): n=a or g
cagggtctggtgacctgttactggaagaggctgatacagcttctggaaaaacagattccanacatcctacctatgtcatagggaatggagccaccatttaaaactggttgtccaaagagta

SEQ ID NO: 14917 - DNA, 121 bp, Artificial Sequence
  Synthesized
  misc_feature (61): n=a or c
aaccaccaccagagcttagctgcagctacttgcagatgcaagagcagttatcaaatcctgnacacgccagtgctcctgccacgcatccacgcgcagggtcagcgcacatttgcctgctggg

SEQ ID NO: 14918 - DNA, 121 bp, Artificial Sequence
  Synthesized
  misc_feature (61): n=a or g
acacacggttaatggttccaaccatctcattatgttctggccacagccatttctcccttcntgtctgtagttttctttggacctcagagcaccactcagatgcaccatggtgctacaaagg

SEQ ID NO: 14919 - DNA, 121 bp, Artificial Sequence
  Synthesized
  misc_feature (61): n=a or g
aaaagtgataaaaagatgacaagtaattcaaaatctgacatatgaatgcagctgtgctttntaagaacgtcattaacatgtcttgtacatcttcaagtaaagttatactctttttccttaa

SEQ ID NO: 14920 - DNA, 121 bp, Artificial Sequence
  Synthesized
  misc_feature (61): n=t or c
gttgtcaataatcagtcaaattcatgatgtgccttttttgatgctttcactctaaattttngtattagcgcatgggaaccatgaaaaattctacctggtaacaaaaaaaaaaggcatatag

SEQ ID NO: 14921 - DNA, 121 bp, Artificial Sequence
  Synthesized
  misc_feature (61): n=c or g
aagcaaaaaataaaaaataaaaaaatccacacaagaacccccaaaaccaaagcaccaaaancaacccacccatggagggtgagggagaatgagattaatgtcactgtctgtagattgagct

SEQ ID NO: 14922 - DNA, 121 bp, Artificial Sequence
  Synthesized
  misc_feature (61): n=t or c
caagtgctgtaattaggacagtgcgctgcattttaaaacaaaggtttcctctaaacctccngcaaactggcaagcagaattaccacgcgtagctcctggctctcagtaagcccatctgtct

SEQ ID NO: 14923 - DNA, 121 bp, Artificial Sequence
  Synthesized
  misc_feature (61): n=a or g
tgtcattgaagggactgaagggtgccagcagactgtctttgaatgaagtcctaatgagacnaagccacagctgttagagagggcactttgtattttgtcaggaacttgagctgcttttgga

SEQ ID NO: 14924 - DNA, 121 bp, Artificial Sequence
  Synthesized
  misc_feature (61): n=t or c
ttagcttttcaaaacctacatacttacacatcacttagtatagcaactgatggacaagcangtctgggagaaacaaagtctggaagaggttcaggagtcagtaatcttatgcagtgacctc

SEQ ID NO: 14925 - DNA, 121 bp, Artificial Sequence
  Synthesized
  misc_feature (61): n=t or c
gtcatttttagtggtaagttatagcaatgcagccagcacaatactgttctggcatagagtnaccgttcagtgctctgtcttatggaaaatgtttccaaggtaagagcagaaacaccagtga

SEQ ID NO: 14926 - DNA, 121 bp, Artificial Sequence
  Synthesized
  misc_feature (61): n=a or g
ttaggtgacttgtggaattaacctcttattacttctgcttataaacaagaacggtattcantgtgttcctccctccctgggtgttgtcttctgtgagcatattatagatgtctctatctga

SEQ ID NO: 14927 - DNA, 121 bp, Artificial Sequence
  Synthesized
  misc_feature (61): n=a or g
cacttcttttcaaaattctccatataatcacttgaactggtgcaaacaaggtgattttgtngcttcatagatgtttccacagctctttattactgcacacacagtatgctggtaagggatt

SEQ ID NO: 14928 - DNA, 121 bp, Artificial Sequence
  Synthesized
  misc_feature (61): n=t or g
taacaacatttagaattctgcatctagactcttaaaccatgcaagaccaatgttctgagangtgctgttgtaaaatacttttggtaaaacttaaccataatgcctcttttgtgtataaata

SEQ ID NO: 14929 - DNA, 121 bp, Artificial Sequence
  Synthesized
  misc_feature (61): n=t or g
agtgtattttctgctctaattgtgttttgtttgttaatcatgaccttgtgatctttttgtntttccagtaaattacttggacttgtttaggatgtacttttgatctgcaatcgaggcagtg

SEQ ID NO: 14930 - DNA, 121 bp, Artificial Sequence
  Synthesized
  misc_feature (61): n=t or c
aacagctgttggaagtgttgggagagtgtcctgtgtgttgcatttatctggaccatgtccntaagttattaggacaagtatatagcacagaactggatgagcacgtgtgagacagcctgga

SEQ ID NO: 14931 - DNA, 121 bp, Artificial Sequence
  Synthesized
  misc_feature (61): n=a or g
aaaacaactgcatgcatgtgagcaagactgtatactctgacttgttcattcttgttatccngggatgaaaggagaacagatgagcaggtttctacaagactgaagactcaacaaaagaaaa

SEQ ID NO: 14932 - DNA, 121 bp, Artificial Sequence
  Synthesized
  misc_feature (61): n=a or g
cttcagaaggaatgggaagagatgagatagggggtgtaagtgaggaaaacttaattgagtngatgtttggtaggcagaaggatgtaagttttccagacaagtggccatattaacctggagg

SEQ ID NO: 14933 - DNA, 121 bp, Artificial Sequence
  Synthesized
  misc_feature (61): n=t or c
tgtgtttctggtgaagttcaatgaagttggttattgttagtgtgaaaggtagtaagagacnttttccagacatctaatctgttttcctacagctctaaaataatattttcggacggaaatg

SEQ ID NO: 14934 - DNA, 121 bp, Artificial Sequence
  Synthesized
  misc_feature (61): n=c or g
gacgttagggcgatgcgctgcttatggcacgcactgcttacagtgcctgtgtgggtggtanagctgatcacacaggtgttggtataattcagctgttacaaagtgacagagcaaaagtatg

SEQ ID NO: 14935 - DNA, 121 bp, Artificial Sequence
  Synthesized
  misc_feature (61): n=a or g
actaagccccgagtgctgcctcactctgctttgtgcattacagaccaccttcccttgaatntaacctttctggagatgcagagaaggcaggatctgcctgagctgctcggatgagtcctag

SEQ ID NO: 14936 - DNA, 121 bp, Artificial Sequence
  Synthesized
  misc_feature (61): n=t or c
attctctctaagacagtgatctgcaatacgagttcagaatttggtctcataagttgcaggnaggcagcagccaatgcatttatgaaagcacagaattaaaactcaaaggactgaggaaaaa

SEQ ID NO: 14937 - DNA, 121 bp, Artificial Sequence
  Synthesized
  misc_feature (61): n=a or g
ctattaggccttccatttaagattttaaaagcacataccttatcttgaagagctgcaaaanggcctggaaaggaacagacacacatgcagcagtcaggagcaagactgatctagatgtgac

SEQ ID NO: 14938 - DNA, 121 bp, Artificial Sequence
  Synthesized
  misc_feature (61): n=t or c
cctacagactacgggagctttggttcttgaaggattttagtgctgtatattttgtgatggncacattatatcaaaagcaaaaaggtaatgccatgagaatgtaatgtgtaattagcagcag

SEQ ID NO: 14939 - DNA, 121 bp, Artificial Sequence
  Synthesized
  misc_feature (61): n=a or g
cttctcatttctaagaaaatgtaaaatccattttttattccacaaatgcttttgagcactnatctcaccacagttttaaatgaaataacacaggaagagaaatgctactccgaggagactg

SEQ ID NO: 14940 - DNA, 121 bp, Artificial Sequence
  Synthesized
  misc_feature (61): n=t or g
tctgcctttctgatgcgtaacaattcagttgctaatttcacatgttacacatgaggtaatnaaaagacaagtatgagcttttgagggcttactgcctccctgtccttcattacacattcta

SEQ ID NO: 14941 - DNA, 121 bp, Artificial Sequence
  Synthesized
  misc_feature (61): n=a or g
gtgccttaatgttcaggaggaagggctcagactgaagcaggtattccttggatgaagaacnaacgtgttgtatggtaggaagcataacgagtttgggatgggaaggagtgattttattttt

SEQ ID NO: 14942 - DNA, 121 bp, Artificial Sequence
  Synthesized
  misc_feature (61): n=t or c
aaaccttgacagagccaaaactcagtgtatcctgaacagcatactgtacacaagccctccnggtactcctttggctcctctctgccttaagcttcatctggaattatcagcaggatttgaa

SEQ ID NO: 14943 - DNA, 121 bp, Artificial Sequence
  Synthesized
  misc_feature (61): n=t or g
gctaacaatttactgatttagtagttaataaccggagaaataacagcccatgtaaagttantgggttggacaatctgacttcctcctgctctgataccaaagaacaagtataggtgatgtt

SEQ ID NO: 14944 - DNA, 121 bp, Artificial Sequence
  Synthesized
  misc_feature (61): n=t or c
cttattaaaagccttggcttgccttctgactgataggatccacgtttctatatcagatgcngaaattgccttgttacacccacatgtacgtgtctgttttgcattgctgctgaattgacat

SEQ ID NO: 14945 - DNA, 121 bp, Artificial Sequence
  Synthesized
  misc_feature (61): n=t or c
gttgttctcaagtatcccctccacaaaactaatagcacaccatcagcatcgatatcacacngacagctcaaacacagccaagctcctgtctgttgtggagctgtgtgacgctgccataccc

SEQ ID NO: 14946 - DNA, 121 bp, Artificial Sequence
  Synthesized
  misc_feature (61): n=c or g
tgatgtttgtgatgacctattttcctgtttccaatttctgcaggatgttagcccagttttnttaattttactacagattatcagaatacggaaaaaacaaaacaaaacaaaacaaaaatat

SEQ ID NO: 14947 - DNA, 121 bp, Artificial Sequence
  Synthesized
  misc_feature (61): n=a or g
ttaaaatagcttcataatatgcttctgatatgtaattcttgagttttcaaatctgtctccntatagttctgtgtctgctaaaaaatgaatgtaggtgtacaactaagtagggaatttgaag

SEQ ID NO: 14948 - DNA, 121 bp, Artificial Sequence
  Synthesized
  misc_feature (61): n=t or c
gggaagataagatctgagctgctgtatgtaaagagaaaaaaatgtatgaactgagtacacnggttttgttttttcaggttctgaagagttaggaagtggaagttacggacatcattacatc

SEQ ID NO: 14949 - DNA, 121 bp, Artificial Sequence
  Synthesized
  misc_feature (61): n=t or c
ggttatggatgctttaaaaatgtctttgtgattgtacaggaatacttcagcacactatgantgagtcaatgcgtaagctccttattttcactttcttaatggcaatctgatgctaataatt

SEQ ID NO: 14950 - DNA, 121 bp, Artificial Sequence
  Synthesized
  misc_feature (61): n=t or c
catgcaaggttttcttgcaggatctgtagagtgctatcaggagccatcaccactccctgcncctttgtcactgtaaggtgaatgttaatagcttccctggctgatttcccacacttatttc

SEQ ID NO: 14951 - DNA, 121 bp, Artificial Sequence
  Synthesized
  misc_feature (61): n=a or g
tttccagaaatgcatcgctgcccagggcagagtacctgtgggtcagcagatgggatgtgtnttgctgcatacctttagaagcaacaccagaaccccccagataatgatctggggcacgctg

SEQ ID NO: 14952 - DNA, 121 bp, Artificial Sequence
  Synthesized
  misc_feature (61): n=t or c
tgcccggctttcatcatatagtccaggaaagttcaaggttttcatagctctgcaccagcancatacaggtaattttgacagcatgaaatatccaaaactggcacatagcacaagtgtttcc

SEQ ID NO: 14953 - DNA, 121 bp, Artificial Sequence
  Synthesized
  misc_feature (61): n=t or c
tctgggttcataaaccttccagtgttgggatgttgttcagatgcatggcaggcagcagctnctttctacccaaaatggtccattatagagcataaggtctttttcctgtcagacataaata

SEQ ID NO: 14954 - DNA, 121 bp, Artificial Sequence
  Synthesized
  misc_feature (61): n=t or c
actgaaaaagggatatgtgcctgtgaataacaatcacatactgaactattccaagtctaangtaggttgtgttttggatctcaactctgaattattagacacaggagatgccacgtacttt

SEQ ID NO: 14955 - DNA, 121 bp, Artificial Sequence
  Synthesized
  misc_feature (61): n=t or c
tgccagactaatgatgagcaatgggaagcctaaaatccaacttcaaaagagctcctcttangaacattggagaagtgaatcctcccttctgatggcctacagaaggccctcagatttgtca

SEQ ID NO: 14956 - DNA, 121 bp, Artificial Sequence
  Synthesized
  misc_feature (61): n=t or c
taagtaagcagcaacatcttagggtggaaaaaaggtattcttactatcgtgaagtagaacngcagcacctcccctcagatacagcaggtttctctccttctcccacctctctccatgaagc

SEQ ID NO: 14957 - DNA, 121 bp, Artificial Sequence
  Synthesized
  misc_feature (61): n=a or g
tgcatcttcacagctaatcacatcacaggcacaggttaggaataaatgcccagggctaacnagaaagttcattcatctgatctagcacagaagtgctttcccctccatctcacagcaacgc

SEQ ID NO: 14958 - DNA, 121 bp, Artificial Sequence
  Synthesized
  misc_feature (61): n=a or g
catctgtctctgtgttaaacagacttaattgtccctagtattagtatgtaaaaaacctctnacctatgtgattaatgcaaagaaaataaatggtaggatatttatagttcttttgtttttg

SEQ ID NO: 14959 - DNA, 121 bp, Artificial Sequence
  Synthesized
  misc_feature (61): n=t or c
actgtctcacgcaaaaacttttgtgtgatcagaaagagagaaatggagaagcccatgctcntcaagacctgcagagcctgaacttcctccccacatgctgcaaggagtagctgggagattg

SEQ ID NO: 14960 - DNA, 121 bp, Artificial Sequence
  Synthesized
  misc_feature (61): n=a or g
cataggccactcaccttcaccagattctccagatccagattctctgtgtttaggtctgctncacttttgcacctcttctctgaagccctctctttgcttgccaagatcccagtaacacagc

SEQ ID NO: 14961 - DNA, 121 bp, Artificial Sequence
  Synthesized
  misc_feature (61): n=a or g
caagatgatatcgtctcagtctttcctgaatccccaggtttttttttgaaggacagtaacngggggaacaaaagggtgagattctctacaagtttctgaattaagctgcggttgttgcaca

SEQ ID NO: 14962 - DNA, 121 bp, Artificial Sequence
  Synthesized
  misc_feature (61): n=a or c
ctgtattatgatgagtaatatcatgtttctctttcagtgagaaacaatccatctacatccnaaactctaaaactcacgtgaaattttctggggttgtacaaggaattttactactttactt

SEQ ID NO: 14963 - DNA, 121 bp, Artificial Sequence
  Synthesized
  misc_feature (61): n=t or c
cttctacagtaaatacaactcactagcagaacagttagcaagcaatctgtttcttgagtanatctgcactgaagtggagagacagctaatgccatgctagagaaggatgtatgtaaatctc

SEQ ID NO: 14964 - DNA, 121 bp, Artificial Sequence
  Synthesized
  misc_feature (61): n=t or c
tctggaaaggaaaataattgttattttaaatttataaatattgaatgcaacgtggacttgnacataagcatttagcctgtctacctctgaaattttacacacatgcatagagaagactttg

SEQ ID NO: 14965 - DNA, 121 bp, Artificial Sequence
  Synthesized
  misc_feature (61): n=c or g
ctgccgtgctgctgggccagcataaaccctcctttgtaagaacatacagagatcaaacccnaatgcttaagctgctattacgcaaccgacagctctttcaagttctgatttgcaaagacgg

SEQ ID NO: 14966 - DNA, 121 bp, Artificial Sequence
  Synthesized
  misc_feature (61): n=t or g
ctcatgtctcgggctttagaccagtaaaatgataggtgcaccacaaagtttttgtgaggantattggatgggactgccagaggaaaacacaaatgatgtgaaaaaatacaattaaaataac

SEQ ID NO: 14967 - DNA, 121 bp, Artificial Sequence
  Synthesized
  misc_feature (61): n=t or c
ttttatagtttgatgaaaggaataaaaaaactctttgattaaaaaggcaaatttgttaggngtcacttctaagttttatcaagccttcagtggtctgtaggaagtcaaatatttgttttgc

SEQ ID NO: 14968 - DNA, 121 bp, Artificial Sequence
  Synthesized
  misc_feature (61): n=a or g
ggaagccacaggacttctccattgactctgcttcgtggcccatgcaaacagtgccatgtgngcacatgtacaagtgcacaactacatgcacacacactactacctcccagtgtcttaccca

SEQ ID NO: 14969 - DNA, 121 bp, Artificial Sequence
  Synthesized
  misc_feature (61): n=t or c
attgaaaaggtgactccaaattttggaattggagtttcggaaagacctagactgttagagntatggcatggcttgaaatacagaagaatctttgaataaagctctaatgcttaccttcatg

SEQ ID NO: 14970 - DNA, 121 bp, Artificial Sequence
  Synthesized
  misc_feature (61): n=a or g
ctgctttgggtgacagtgcaaagctggtggtaaagccttccttgaggtaggctgatgcaancaagataattcccatgttcaaagcctgttttctgtgataattagataagtttgcatggga

SEQ ID NO: 14971 - DNA, 121 bp, Artificial Sequence
  Synthesized
  misc_feature (61): n=a or g
aaaggggagatacttggcagacacaagtatctttaggaacctgaagttataggatatgtanggtgtcagacaaaagagaactaacactcctttgagagaagatagcaaaaaaaaaaaaaaa

SEQ ID NO: 14972 - DNA, 121 bp, Artificial Sequence
  Synthesized
  misc_feature (61): n=a or g
aataactagtagtttctgagaccctgacacatatatcttgataacaaaatatttctgtatntgactgagttggcatgccttaacagtggtaggctaacaacactcaactgtatcctgaaga

SEQ ID NO: 14973 - DNA, 121 bp, Artificial Sequence
  Synthesized
  misc_feature (61): n=t or c
gagaacttcattttaaagtgtaacacggaaggttacattttactgggagtatctagtctgntcctcccaccttgggatttcattttaaaacttgttatcttcactgtgcacctacaagtag

SEQ ID NO: 14974 - DNA, 121 bp, Artificial Sequence
  Synthesized
  misc_feature (61): n=t or c
tgaaatgtataggagatatgctgtcttaaagcctaaattaaaaatcatggaactaaaatcnactacaggaaagctgcagaactactgtatttatactcaggagccttaaaacaagctatgt

SEQ ID NO: 14975 - DNA, 121 bp, Artificial Sequence
  Synthesized
  misc_feature (61): n=a or g
tggctcctcttcgtgctctggaggggaagaggcgacatctcactcaaagcccatctgtgcnctacagcccagcccacttctcacagacatcactgaatctgtctacttcttgctacatact

SEQ ID NO: 14976 - DNA, 121 bp, Artificial Sequence
  Synthesized
  misc_feature (61): n=a or c
ttgaagcattgtactgaatcattcctattcaaaattatctgttagtgctctgcagggcctnagactgaactcctttgatccacccatttcaagattagatggatgacagaaccttaactct

SEQ ID NO: 14977 - DNA, 121 bp, Artificial Sequence
  Synthesized
  misc_feature (61): n=a or g
ctaaggcatggaaaaatcaaaatgacttctcactgcacacttagtggaggcattggcaatngtgttcagataaacaaagtgttgcatcccggatattacattcaaagacaaaggactgact

SEQ ID NO: 14978 - DNA, 121 bp, Artificial Sequence
  Synthesized
  misc_feature (61): n=a or c
gttatctgcgtttatttaccagaaagtatcatgcatttgtctctaaatggaagctgcaggntttggagtctgtagatgtcctaaatcctagcattatatggtgacatgcttgttttctctg

SEQ ID NO: 14979 - DNA, 121 bp, Artificial Sequence
  Synthesized
  misc_feature (61): n=a or g
tggattagtgacatgagaagcagcatctgaatgctacggatcgttgccatccagatagatntctctcaaggctctttcaaagcctcttagctatgattgcttaatgtgataatggaatttg

SEQ ID NO: 14980 - DNA, 121 bp, Artificial Sequence
  Synthesized
  misc_feature (61): n=a or g
tttgaagaaatccttgccactggtaaatggaagcactcctgtcatgtgagactgagggaancagctgaactttgagctttgggtaaagaatggagaagactttgggattttagagttggtt

SEQ ID NO: 14981 - DNA, 121 bp, Artificial Sequence
  Synthesized
  misc_feature (61): n=t or c
tccccagaataggggggactcaaaagtcctgaaaaccatcgtaactcctcctagtatttcnactaggatctccatctgaagaagtttgtttaaaaaaacaaccaccaccaccacccaataa

SEQ ID NO: 14982 - DNA, 121 bp, Artificial Sequence
  Synthesized
  misc_feature (61): n=a or g
ctctgcctcccaacttctgttcaggtgcagcccagaggagctattaaaaaagcagccctcntatgcacacagccctgtgcaggcttcagagtcagcagaaccaacccgaccagggtcccac

SEQ ID NO: 14983 - DNA, 121 bp, Artificial Sequence
  Synthesized
  misc_feature (61): n=a or t
tctcttgacatacagagagaatttaaccacgatcaggattatgagctatttgatgcaagcngcgtaaaataactcaacagctcttatttagtgtatttcatctgaaacttattacctaact

SEQ ID NO: 14984 - DNA, 121 bp, Artificial Sequence
  Synthesized
  misc_feature (61): n=a or c
gcagcagaacctgctgcaattgtttacttgtctttgggccaaaggcaaaactggacggagnaatctgcaaggacttgttggccatgatgcatggcagaagcatgttcagcaaaatatttag

SEQ ID NO: 14985 - DNA, 121 bp, Artificial Sequence
  Synthesized
  misc_feature (61): n=a or g
cacaccatttcctgtaaaagcttctggtgtgctgtttcttctcatctcatgtgggagagantaattttcagtgcttttcctgtattcagtgtgaagtacaagatgaatacaaaagtcacca

SEQ ID NO: 14986 - DNA, 121 bp, Artificial Sequence
  Synthesized
  misc_feature (61): n=a or c
gaacatctgtgccagacacgtactttgggagcaccagctggagtcccagtaagacatacanattgtgtggggaaatggctaaagtccttctcctgtctgtacctcagtctctcacccaaga

SEQ ID NO: 14987 - DNA, 121 bp, Artificial Sequence
  Synthesized
  misc_feature (61): n=t or c
tatatttccttttttagctgttacaaaaggttatggaaaaattatcctaattgcaaaaccncctaatattcctttctcttggaaataccacctcttcctttccctgagggcaatggacagc

SEQ ID NO: 14988 - DNA, 121 bp, Artificial Sequence
  Synthesized
  misc_feature (61): n=t or g
tagcattgagctaatgtcatctggttctaaagagtatactaagtacaagctgtatgtaatntcaggaggaaggcaggaaaaatgcatctggaaacaaggattttcatttgtgtattctcat

SEQ ID NO: 14989 - DNA, 121 bp, Artificial Sequence
  Synthesized
  misc_feature (61): n=t or c
tattttttgtggtgctcacttttccccccctggaatttgaacctcctcacagaaacccatnttgaaacatcccttgcttcaaattatcaagttttaatatgtaaacagggaaacctctttg

SEQ ID NO: 14990 - DNA, 121 bp, Artificial Sequence
  Synthesized
  misc_feature (61): n=a or c
tacctgctcccttcttttactctgacctaaagaactgtttatgagtaacactaggcattantggctgattctcagattaattagtgtttcagtggagagtcaagacatcaagcaactgtca

SEQ ID NO: 14991 - DNA, 121 bp, Artificial Sequence
  Synthesized
  misc_feature (61): n=a or g
ttgttgcagaaaggagcatttcaattggtatgcagcacagcagaggtattagagccacccntattaactgtgaggagtgagcaattaagtgaacttcagttacacaagccagcagatctct

SEQ ID NO: 14992 - DNA, 121 bp, Artificial Sequence
  Synthesized
  misc_feature (61): n=t or c
cctgaggcacaatttctcatgttaaactctgtgacccttacaacagttttagatgagactnggtaatctgggactcttcagcccagaacctccccacaaacagttatgttccattgatttc

SEQ ID NO: 14993 - DNA, 121 bp, Artificial Sequence
  Synthesized
  misc_feature (61): n=t or c
attccaaattaggaaaatatttaaactgagcagctattcagaagagggattatattttccngtgcttcaagaatctcctgttcattttttggcattttgtacattcattgtacaaagatct

SEQ ID NO: 14994 - DNA, 121 bp, Artificial Sequence
  Synthesized
  misc_feature (61): n=t or g
actgaaattggagagcagggttttacctttgaatcaccagattaagaaaaggatgtatctntcagtgaaacctgcacaacagatcatcttacggttgcgtgctgtcagagggccttcaagg

SEQ ID NO: 14995 - DNA, 121 bp, Artificial Sequence
  Synthesized
  misc_feature (61): n=a or g
tgatagcatttgcaacagtggtaacactggtcaatctctggcagtatgcaaaatggggcantaaaaatggcctcagctgaacaaatttatggcttatcaccccactaaatatacagtgggc

SEQ ID NO: 14996 - DNA, 121 bp, Artificial Sequence
  Synthesized
  misc_feature (61): n=a or g
gttttagagctcagggtgctggcagcagcatcctcagccagttatcaaagagcagattcanagcagcctaacctccacctcagtccctctgtcttgcattttctgtgagcttggcactagt

SEQ ID NO: 14997 - DNA, 121 bp, Artificial Sequence
  Synthesized
  misc_feature (61): n=a or g
gatctatggatgaatcttcaggaagaaagcacagaacacagcaaaggagcaatagtatctntgtgggaaacttatttaggcatcactggcttgtattaaactaaagaaataatatagcaag

SEQ ID NO: 14998 - DNA, 121 bp, Artificial Sequence
  Synthesized
  misc_feature (61): n=t or c
cactaagtggaaatacaaaaagaaacacttaccgatgggtctggatccccagtaaggctgnttaagcctattccatttggggatactttgacatgctggatcatcccatggaagtcaactt

SEQ ID NO: 14999 - DNA, 121 bp, Artificial Sequence
  Synthesized
  misc_feature (61): n=a or g
ctatcttgaagctattaagaataaaaataatttcttgtgaagcaggactcacgttaactanctgtgaagactggtaaggaacagttaaatacattgaattcgtctcctagtaaagtaaaga

SEQ ID NO: 15000 - DNA, 121 bp, Artificial Sequence
  Synthesized
  misc_feature (61): n=a or g
gaatccctacttttgccttggtctgtgatagaaataagttcctatgggccttctgccgacntggctcactgtctgctccaccccacctcttctagtcagtggtagagggaatagagctttt

SEQ ID NO: 15001 - DNA, 121 bp, Artificial Sequence
  Synthesized
  misc_feature (61): n=a or g
acaggaaagacggagacaggttgttcaccgccctgcgtaatataagaaccaagtcaacacntaaagttaaaaagcactaagaaaacattaaaaaaaagtagtgattctcaatgtgctgagg

SEQ ID NO: 15002 - DNA, 121 bp, Artificial Sequence
  Synthesized
  misc_feature (61): n=a or g
cttttagatatcttaagcaagaatgactatgtacactcctttctaggtcagcattgtgcanactgtatccatttaaataataaacccctcacaattcactgaactatatttttcagaaccg

SEQ ID NO: 15003 - DNA, 121 bp, Artificial Sequence
  Synthesized
  misc_feature (61): n=a or g
agaccagaagaaaaaagaaagaaaaaaaaaattaagtgaagaagctctgcttcattcagcncacacatgataaaacttcataagcacattgtcctctgagccccagcaaaacaagcacgca

SEQ ID NO: 15004 - DNA, 121 bp, Artificial Sequence
  Synthesized
  misc_feature (61): n=a or g
acattggaaatagaaaggacttccatagttcctaatcattataattcatctgtgcgcactntttaacagcagtgcaaaacaacacttccttaaaaatcaaaaagtgtctacacaacactac

SEQ ID NO: 15005 - DNA, 121 bp, Artificial Sequence
  Synthesized
  misc_feature (61): n=a or c
cagcagccttctcttttggcttacttggtgcctactctcagctttccatttcctcaaatcntggtcttcccattctgatagctcctgtttcattaatcaccattcttcttcctctccaggt

SEQ ID NO: 15006 - DNA, 121 bp, Artificial Sequence
  Synthesized
  misc_feature (61): n=a or g
agcggcaggcctagcattggcttgcacaaggagagttcatagtgggtggactctgtggccncttgttttgcacagggtgggtgtcagtgaaatcctgcctacattatgaagcagggatttc

SEQ ID NO: 15007 - DNA, 121 bp, Artificial Sequence
  Synthesized
  misc_feature (61): n=t or c
tcagatacaccaaactcattcataaaaccttcagttctaccgctgtgaatacttttcaggngcattgtcgttatcgagttactttcttagcagctatttctgatctgactcctttaatatt

SEQ ID NO: 15008 - DNA, 121 bp, Artificial Sequence
  Synthesized
  misc_feature (61): n=a or g
tcacacttaacaaagttttacttaatggagaagatgatttttgctaggtgatgtagtgtanacaattagaatgctcaatttcctagtaattcccttttttgactagatatcaatgttgatt

SEQ ID NO: 15009 - DNA, 121 bp, Artificial Sequence
  Synthesized
  misc_feature (61): n=a or g
ttgaaatttactctctccaaatacagagaaattccagcagcagatatcttgggtttaagcntcacttcagaagatcagatattttgtttttgaagagcatcagattgcagcagtctcagag

SEQ ID NO: 15010 - DNA, 121 bp, Artificial Sequence
  Synthesized
  misc_feature (61): n=a or g
tgaggacacttcccgttgttttggactgcagtttggagctgtggaatactctggaagcccntctgttcttgtcctaccgcagagaacggcctggttagttttccatttattagcagatgta

SEQ ID NO: 15011 - DNA, 121 bp, Artificial Sequence
  Synthesized
  misc_feature (61): n=t or c
ggagggagagagcacagtggacactctttctgccttttatttatgcaagggtagtcagtgngtctttgggagctgccagaattttctcaatgtatttgttgttcagaatttttcatgaact

SEQ ID NO: 15012 - DNA, 121 bp, Artificial Sequence
  Synthesized
  misc_feature (61): n=a or c
ctgaaggccttatttctataagacgacaaagtgggcatgtctgcatggatatgtggcgacnttcaaatgtgcatatgtgtgaccctcttctcatcactgtcccagcaatgccaaaggcaga

SEQ ID NO: 15013 - DNA, 121 bp, Artificial Sequence
  Synthesized
  misc_feature (61): n=t or g
gcaagcagtacccctgattctgttttccttaccaatataattcttgtacactgaagtacanctgtctgtgacaagtttccacatttgtaagatggtgcagagagctggcatgtagtccatt

SEQ ID NO: 15014 - DNA, 121 bp, Artificial Sequence
  Synthesized
  misc_feature (61): n=a or c
ataacctacagggtgaagataaaaggtcctcaaagcatcccataatgcttccattaagtgntctttggtggttcttgcagcctcctgctgacagaagggccatgaagggctgctcgaccca

SEQ ID NO: 15015 - DNA, 121 bp, Artificial Sequence
  Synthesized
  misc_feature (61): n=t or c
tgtagagcaggctatgtatgcctaggcagatggaatcatggtatgctttacaataagtaangaaaatgcaatattgaatagcggaaatgtatactggactactatgaaaaaatcctgcttt

SEQ ID NO: 15016 - DNA, 121 bp, Artificial Sequence
  Synthesized
  misc_feature (61): n=a or g
gctcggggcaagctaccccaaaagcttgatggaacacagcaagaagacgtgttacaactcnagtccaaacttggattcctgaccaccatctaacacaatgtacccatgtaagaacagagca

SEQ ID NO: 15017 - DNA, 121 bp, Artificial Sequence
  Synthesized
  misc_feature (61): n=c or g
tttgcagttaccagtgctttacataccatgtactgataggaagcagaatagaagacccaangttttggaatagatctagaggagttcagactggataatctgtgacagacagatggatgtg

SEQ ID NO: 15018 - DNA, 121 bp, Artificial Sequence
  Synthesized
  misc_feature (61): n=t or g
tattgctctatcacaaagcacagagaatcttacaccattactttaaaaactattttcaganaaagtttcctttagttcatcaggaatttagaagaattgaccaaaaagaaataacaaaaat

SEQ ID NO: 15019 - DNA, 121 bp, Artificial Sequence
  Synthesized
  misc_feature (61): n=a or g
tgtttgaggaaaataaatggtagaaaataaaatattccatgcctggggctccttcttaatngagacataaagatggctttgacattcccagaaccgcagcgccccgggaagacatgggatt

SEQ ID NO: 15020 - DNA, 121 bp, Artificial Sequence
  Synthesized
  misc_feature (61): n=t or g
tatgattcctttttaaccaactatttctctttagatttcttcacatctttgtattaagcantccaaggaaggcaacaggtcagtatggagaataagtcaactttaggctctaaatcttgtt

SEQ ID NO: 15021 - DNA, 121 bp, Artificial Sequence
  Synthesized
  misc_feature (61): n=a or g
tcaacgtgctctgactaggcatgaagggagctgctgcaaaggctgttttatattcctagantagtgccagtatggccatgacatacaagaatcaagccctgaggacccgttttcaaaggct

SEQ ID NO: 15022 - DNA, 121 bp, Artificial Sequence
  Synthesized
  misc_feature (61): n=a or c
ctcttctttaaaaagaagtcacaaaataagaaggaatttaaatgacatagcagttagaagnggaaagcacagcaagtcagacatcagatggaacaaactcgtgcagacactcaggcttctc

SEQ ID NO: 15023 - DNA, 121 bp, Artificial Sequence
  Synthesized
  misc_feature (61): n=t or g
tgcattcctgattaaaaactttgtgttcattcaacatgcccacagttattttctacaaatngttcataccaaagtctatcctctttatatataatagtcttcaccttgacaaaagtgctgc

SEQ ID NO: 15024 - DNA, 121 bp, Artificial Sequence
  Synthesized
  misc_feature (61): n=a or g
gtttcactatgacagaacagactctttgtcttgattgttgacttcttgcccactatcctgntttatcatgttggcaggagttctaggcgccagtgggcctagagcccacaaacatctttgg

SEQ ID NO: 15025 - DNA, 121 bp, Artificial Sequence
  Synthesized
  misc_feature (61): n=a or g
tggggacaaaggctgtacaagctaagaaaaaaacaaccaccctgtaagctgtcatctaccngagtaatccacattcatgtagcccagagggcagagaccagttatttgcacctatcagaat

SEQ ID NO: 15026 - DNA, 121 bp, Artificial Sequence
  Synthesized
  misc_feature (61): n=a or g
ctgttagggttgaaaatatggaaggaatttatacctgctaatctgacagaagagcatgtcntagatttaatgccagaagccaccacgataatcagcagtgtgataaactttgacccaagat

SEQ ID NO: 15027 - DNA, 121 bp, Artificial Sequence
  Synthesized
  misc_feature (61): n=t or c
aaatgctctactggacaaggagcagttggtggtgcatactatatgggcccactatattccnattgtaggaagcagaggttgcatcagtggaaattaaaataccttatacatttcatataca

SEQ ID NO: 15028 - DNA, 121 bp, Artificial Sequence
  Synthesized
  misc_feature (61): n=a or g
tgtttattgatgaaataatacctatgctgttcttgatctttctctaggcatctagcagtgnaagaaatgaactatgcagacctttagtgtgacctatatttcatatactaaagatttcctc

SEQ ID NO: 15029 - DNA, 121 bp, Artificial Sequence
  Synthesized
  misc_feature (61): n=t or g
gctgtaatctgactatatatcaggaagtagacacatccaaaggagtttgatgaccacccantgagagaggctgaagaagatgcacaactgtaaatgttacagaaaatgaaattctagaaga

SEQ ID NO: 15030 - DNA, 121 bp, Artificial Sequence
  Synthesized
  misc_feature (61): n=t or c
gtcctgggcagcctaagctggtggcacatggctggggaaggactagatgttatttaagttncctcccaaactaaactattctatgattacccattgagaatagctactgctgacacagggc

SEQ ID NO: 15031 - DNA, 121 bp, Artificial Sequence
  Synthesized
  misc_feature (61): n=t or c
ttacgaaatgccagtgttttcccctgcctgccaaaagccctcctttgatgagatgagaggngttatcagaagcaaaaatcgaaggggctgaagaacccgaggcaggttccatagggtggga

SEQ ID NO: 15032 - DNA, 121 bp, Artificial Sequence
  Synthesized
  misc_feature (61): n=t or c
atcccctaaaaccatccagtttcataaacaccattctgtgaagcaaacaaaaaggttaggngagagaaaaccagacaacttcctaaatcccatagcttcttcccttcccccccccccccca

SEQ ID NO: 15033 - DNA, 121 bp, Artificial Sequence
  Synthesized
  misc_feature (61): n=a or g
agatattggaaacaaggagaaatcaaagcaactcttatttacctttatggatcccttcctntgcccctcgttgccacttgaaaatttgcatatttcatattttttaatggtggtttggacc

SEQ ID NO: 15034 - DNA, 121 bp, Artificial Sequence
  Synthesized
  misc_feature (61): n=t or c
ttcaagtcagcactgtaccctaaagtagtttcagtgtatggtgcctagtgcattgaggtgnatttggcagtagaacttaattttaaaaggcaaatgtttagtgtaggagttatttcagtgt

SEQ ID NO: 15035 - DNA, 121 bp, Artificial Sequence
  Synthesized
  misc_feature (61): n=a or g
gatttagcttgtttctgtctcttttggtgggctagcaggatgcatatgtgataatctgacncttctgaagcctgtgacctcaaatatgttgagtttcaagagctaatgaaatttatttggc

SEQ ID NO: 15036 - DNA, 121 bp, Artificial Sequence
  Synthesized
  misc_feature (61): n=a or g
tttctttcagaaccatcttccactcccggaggaagtgctgttttgctgatggaaaaaatangttgctgtttaccttgacagggagcatcttctgttgtgataaacatacacccctaggtcc

SEQ ID NO: 15037 - DNA, 121 bp, Artificial Sequence
  Synthesized
  misc_feature (61): n=c or g
actgtgtcaggctttcattgctcttgaaaataatgcaagttttagttcccccttttattanttttgaagtacctgaagctgaatttgttcttggccttttttaaaccgaaatgcctgctat

SEQ ID NO: 15038 - DNA, 121 bp, Artificial Sequence
  Synthesized
  misc_feature (61): n=t or c
ctgttttattgtttttctatttcttttttttttttaatctagatccaatgtacttttttanctggttctctggatgctgttgttccacttacaaaagtggaatatttttactgtctcctat

SEQ ID NO: 15039 - DNA, 121 bp, Artificial Sequence
  Synthesized
  misc_feature (61): n=a or g
gtgggggagggaagggaagagcctctgcacttgctgtcattctagatgcttacatgataanataaatcagcaagtcatcaaagcttccaagcagcagcttttctctccaaaaaccaacgga

SEQ ID NO: 15040 - DNA, 121 bp, Artificial Sequence
  Synthesized
  misc_feature (61): n=a or g
tccctccccatcaaaggaaatcaagggattcccttgccaggaacatggggacctggcagcnaatccccaccccaggcagaggttttgtagactcacagaattctttgggttggaagagacc

SEQ ID NO: 15041 - DNA, 121 bp, Artificial Sequence
  Synthesized
  misc_feature (61): n=a or g
ccatggaagctctgtggatcctggatccatcccaggatcacccacagaacatctcataatngaagacgtgtctcacagcagatagagcatctcaaaagtgatggacgtgtatcgcgactga

SEQ ID NO: 15042 - DNA, 121 bp, Artificial Sequence
  Synthesized
  misc_feature (61): n=a or g
ataaactatctgggctgaaagcaagagtgttctttcaaaggatgcggcatgcggaagtggngaagccatgggctgactgcatcttcaccctcccattgggcagcttggcaggaagcaataa

SEQ ID NO: 15043 - DNA, 121 bp, Artificial Sequence
  Synthesized
  misc_feature (61): n=a or c
cccggcgccttgttttgtaatgccttgcatttgtgtgctttctatttctgtaattcatttnattcaaaatattggaatggctttgtgagtatttctagcatctcttccttccgacaggagg

SEQ ID NO: 15044 - DNA, 121 bp, Artificial Sequence
  Synthesized
  misc_feature (61): n=a or g
tgtgatggttttttttttccctcttacttgtgtccaactgggctaagcagcttttctggancttgaattatctagatgaattaggaaaaaaatgaggaaatgacctccccagaatataatg

SEQ ID NO: 15045 - DNA, 121 bp, Artificial Sequence
  Synthesized
  misc_feature (61): n=t or c
gtgtctaagagaaactgcatataaaataggccaagtgatttagttcagtgtttgtcccacnaaacgctccccccaaccactacatctcttttaattgtgaaatgaatttgctctgccagca

SEQ ID NO: 15046 - DNA, 121 bp, Artificial Sequence
  Synthesized
  misc_feature (61): n=t or c
ttgggacggtgagctaatagagagataattcattctggtgatggcacttttttctcaaccnattcagcatggtttacagtctttgctatggaagagccatgcattctggcctgtttcaaga

SEQ ID NO: 15047 - DNA, 121 bp, Artificial Sequence
  Synthesized
  misc_feature (61): n=c or g
gccttcgcctctcctcctggggagattgaaattctgagtaacttcggttcacaggggtctngaaacattcctccatttacttgtatgtgttagttcacttcagacattgtagatatgagtc

SEQ ID NO: 15048 - DNA, 121 bp, Artificial Sequence
  Synthesized
  misc_feature (61): n=t or g
tcagcatgatctgaaggtggcactgttgcatttcagaagcatgatagtacagtgtcagctntacaaaggtattatgaactgtagataaaataagtcattaggtttatatttccttctttat

SEQ ID NO: 15049 - DNA, 121 bp, Artificial Sequence
  Synthesized
  misc_feature (61): n=a or g
tgggtttcttgaaccagtttggctgtgccgtcatggcatttctgcttaggcttggaatgantacctatttgaaagcttatctgcatgtctggttgtgtgtcagctgttccctcctactgaa

SEQ ID NO: 15050 - DNA, 121 bp, Artificial Sequence
  Synthesized
  misc_feature (61): n=a or c
tgcaaggggaggaatggaggtttctgtgcagtggaggtgatggtgacccagcagctccccnagatagcacaaaacacaacccaaccatttcctcactgcatatacctcccctgtattcaga

SEQ ID NO: 15051 - DNA, 121 bp, Artificial Sequence
  Synthesized
  misc_feature (61): n=t or c
actatttctttctggagaacaaaagcacagagaagaatcacccctttctgttaacttcctnctttctctgtatctcctttaacagcccatgacacacttcgcctgctgaatcacatgctgg

SEQ ID NO: 15052 - DNA, 121 bp, Artificial Sequence
  Synthesized
  misc_feature (61): n=a or g
agtacttttatgattctgtgagtctatgactcactgtcctgcaatatggaaacacatgtgntagaccacaacactgctttcacagtgtcccagagactctgagagggaaaaatgcacagaa

SEQ ID NO: 15053 - DNA, 121 bp, Artificial Sequence
  Synthesized
  misc_feature (61): n=a or g
gtagagctcaactgtcctgcccttggacagaaatgctctgggactgcacctagagggaccncagagtggatctgggagtctttgggaacactgttcccaaattaaacatctctacaaaagc

SEQ ID NO: 15054 - DNA, 121 bp, Artificial Sequence
  Synthesized
  misc_feature (61): n=a or g
gcccctgctgctgccagggcgtaatcaccaggctggagtcttcttaataacagcatcaagncacctgatggctcccagctgcatggatgagggcattcaggttgcccaaggaggctgtgga

SEQ ID NO: 15055 - DNA, 121 bp, Artificial Sequence
  Synthesized
  misc_feature (61): n=t or c
aaactcagttcatccggcactgtcttcctcacgctgaagctcgtacattggtgaaacgtcntgatgaaagccgaacggacgtgtttgctgtgagatttgctgttgcacagagagtctttgt

SEQ ID NO: 15056 - DNA, 121 bp, Artificial Sequence
  Synthesized
  misc_feature (61): n=a or g
tgcattatgtcactcttttcagacatcagatgctagaaagcaaaagcaagctttccagaangcagactttgaagtacagtacctaaaaaaggacaagaggctactgcagcattgttagggg

SEQ ID NO: 15057 - DNA, 121 bp, Artificial Sequence
  Synthesized
  misc_feature (61): n=a or g
atgtcttctatgcattttgacttcagaaattgcttaactctttgtagtccatcacagtttntatctcaattgagcagaacaaaatgttctcattatgatgtttaatcttcttaaagtcata

SEQ ID NO: 15058 - DNA, 121 bp, Artificial Sequence
  Synthesized
  misc_feature (61): n=c or g
tcatagaagttaccaaaggcaaaggaggaagaggggttaatgaaatctgtaatgagttcanagcatgtctagtgcttgccatatgcttctattgtctttccttcctttacgcagatagcaa

SEQ ID NO: 15059 - DNA, 121 bp, Artificial Sequence
  Synthesized
  misc_feature (61): n=c or g
cccacagccccaaaccaacacctcttctttctcttttccttgctgatggattgggcaaggnaagaagagccagtaaccttagattgcctcttaacctcacctgagaaattaattctgcttc

SEQ ID NO: 15060 - DNA, 121 bp, Artificial Sequence
  Synthesized
  misc_feature (61): n=a or g
ctgaatgctgaagacaacttgagtgcaaccaacacataaatgaaggtaacagcactaacancctccataagactgacaccatcctatgcaggccaaccacatgctgtacccatagcccatc

SEQ ID NO: 15061 - DNA, 121 bp, Artificial Sequence
  Synthesized
  misc_feature (61): n=a or c
tccacttcccatatttttgtcatagaagagaggctattgtctatccaacataatgtgtttntgcaggaggtggtgttgctttttgttttggccagtgcatcttaatgacacctgtttaata

SEQ ID NO: 15062 - DNA, 121 bp, Artificial Sequence
  Synthesized
  misc_feature (61): n=t or c
ctagaccaggctgttcagagaagaagaagcacaagtactcgtggttccattgaaatgccanagcttctgctgtcctgcttccaatgctttgtagcatcactggtgcttgtatgaccattat

SEQ ID NO: 15063 - DNA, 121 bp, Artificial Sequence
  Synthesized
  misc_feature (61): n=t or c
atgaaaattacacagggaaaaccacttgcctttgctgtggagatgccagcagtgttttccngtcctaaacttcttagtgaagaggtgaagttagtcagtgtacaccttcccctttcagctg

SEQ ID NO: 15064 - DNA, 121 bp, Artificial Sequence
  Synthesized
  misc_feature (61): n=a or g
ataagatcttatgtaaaactgtatctgcttgtttttgacaagaaaactcttcttatatgcntgaaaaaacatgcaggaaaggaagcataactgtattttatgtccacacaatgccacgact

SEQ ID NO: 15065 - DNA, 121 bp, Artificial Sequence
  Synthesized
  misc_feature (61): n=t or c
gtaatcttaaatgtttttgaatagtattgctgtaaatgtgctttatgatgagagcaaacanggatttttgagtaacctctttggcagttagtgattcagttgagacttactatttatatat

SEQ ID NO: 15066 - DNA, 121 bp, Artificial Sequence
  Synthesized
  misc_feature (61): n=t or c
ttcttgtgtacttaacacacagaaagatggtgttgctactcatcttgatttatgcagtctnctacacaatgtacattattcaaaaaaaattcagaatacttctactcaattttaatccaac

SEQ ID NO: 15067 - DNA, 121 bp, Artificial Sequence
  Synthesized
  misc_feature (61): n=t or c
acaatatcccagaagggaaagccacagggcaaagtgggaaaaatgttaatgtcagctaacnaaattcattgaaacaaagcagcttcctgctgtttatgttcttcatcattgtctgtagtgt

SEQ ID NO: 15068 - DNA, 121 bp, Artificial Sequence
  Synthesized
  misc_feature (61): n=t or c
agcctgaacacaaatattagcattgttccagccttgtgattgccagatatttctaagcttngggaaaacaaatacagcaaaacaccaccatcagccaacttgtaatactttgcgtccaact

SEQ ID NO: 15069 - DNA, 121 bp, Artificial Sequence
  Synthesized
  misc_feature (61): n=t or g
tcatttgactgtggaagccacaggtgtaagttataatcagcctaagcaaggatttatttgnggtgggtggtggcagcagccttaatctggtgtgaagaattaaaggaatacatctacaggg

SEQ ID NO: 15070 - DNA, 121 bp, Artificial Sequence
  Synthesized
  misc_feature (61): n=a or g
aggtgtgggggcagatgacctatctcaaagaccttctacctcacatcacgtcaggaaccantctttaatggtgatagagaaagaactgcacgagcctattcactgtacttactgccaggca

SEQ ID NO: 15071 - DNA, 121 bp, Artificial Sequence
  Synthesized
  misc_feature (61): n=t or c
ctatcttgctctggtgcttacacctccccatgggctaaagtccttcacattaagcctatanggtctgtggttccttcaggaaatacttacctgctccagcatgaggtcctccacaggcttg

SEQ ID NO: 15072 - DNA, 121 bp, Artificial Sequence
  Synthesized
  misc_feature (61): n=t or g
gaaattatatcatgattacgtccaaatggtcaaaaaagtcctcagagaagtgacaagatancggctttcttccagtttacaaacaaagcattatctgctgaggtgaggagaaatctcaagc

SEQ ID NO: 15073 - DNA, 121 bp, Artificial Sequence
  Synthesized
  misc_feature (61): n=a or g
gttccttgagagcctttattccccagtgtgagagaggagatcgcaagcacttggagacatnttaaaatgacatctatcagtccatagcaatgaaatatcaatgaaggtcttttcaaggcta

SEQ ID NO: 15074 - DNA, 121 bp, Artificial Sequence
  Synthesized
  misc_feature (61): n=t or c
cataattatcaggcacagaatcctgttgggcagcccaggcttgcctgtgtttgacatagcnctattggtttagctttgcttcttgaatgtttcttgtgacaatcttgagcttcaccctttt

SEQ ID NO: 15075 - DNA, 121 bp, Artificial Sequence
  Synthesized
  misc_feature (61): n=t or c
agctgctgcccatgccctctccctcccttcactttaagagctcactcaggttaacaacagngacactgcaaaaggccacagcctccatctgcagacagcgggctgcttggccaggtctgca

SEQ ID NO: 15076 - DNA, 121 bp, Artificial Sequence
  Synthesized
  misc_feature (61): n=a or g
ccacgctgcaacacgtataatagaggaaggcatcttattgcagtgccacagcagtcatcangaagcagatgaccccgagaacctgaagaaaactttttacctcacttgtctgctgaggtga

SEQ ID NO: 15077 - DNA, 121 bp, Artificial Sequence
  Synthesized
  misc_feature (61): n=a or g
ggctcactgctgtgtttgtgctattttttggtgtgtgcattcacaatagcacaagaaaaanaaaagatgttatgctgtatccacgcagcaaaaaatggtgcgaaaacagaagataacaaaa

SEQ ID NO: 15078 - DNA, 121 bp, Artificial Sequence
  Synthesized
  misc_feature (61): n=a or c
acacaaacttcatgatctgaagatatttcttccagatttattttctgttactgcgtgcttntagtccttcttcctagcaggaaaagatagacctgatcctcatccattttctctcaaagcg

SEQ ID NO: 15079 - DNA, 121 bp, Artificial Sequence
  Synthesized
  misc_feature (61): n=t or c
gacacctcccactagagcaggtttgttcttcacaaatttgttattcacaaatccatacagngttggttttatggttcagtattttgtagtttggttgggttttttttaatcacttcatcat

SEQ ID NO: 15080 - DNA, 121 bp, Artificial Sequence
  Synthesized
  misc_feature (61): n=a or g
atgctccatccaggaggcgtaagtgttggaagaagttatcatactctgcagctccagccancagtaaggagcggatctttttcaactgttggcatgacaaaacaaagcagtggctgttaat

SEQ ID NO: 15081 - DNA, 121 bp, Artificial Sequence
  Synthesized
  misc_feature (61): n=t or c
gaatacaaccttctacccagcttattgctgctttagcaagtgatacattagatatttctcnctatcagagaagagtttaaaggtcatttctagcaaaaaacatttcttatagaagtaggca

SEQ ID NO: 15082 - DNA, 121 bp, Artificial Sequence
  Synthesized
  misc_feature (61): n=t or c
acaggtgatctttgaaccgctgtgagaatctgctgttcccgtgatcccacttgatgtttcngcttcatataagtaaacatattttctaaggcttttaaatcgggccgcatcttctgcaatt

SEQ ID NO: 15083 - DNA, 121 bp, Artificial Sequence
  Synthesized
  misc_feature (61): n=a or g
ctcctgagattccaggtgtttacctcaacagagccattggatagtgctattcaattaccanagtggatcttacttatatttaattgatgatgatgaggttgactgtcagtgtattttcact

SEQ ID NO: 15084 - DNA, 121 bp, Artificial Sequence
  Synthesized
  misc_feature (61): n=a or g
ttttttagacttaaggtttcttaggggaaatgctgtatccaagggctgtttcatgagctgngagcactgttctaaacctctggggcaaatgttttcattgaattgtcgaaagagcctgaga

SEQ ID NO: 15085 - DNA, 121 bp, Artificial Sequence
  Synthesized
  misc_feature (61): n=a or g
ttattttttctgggcctcccattacatctgcatgaactgcagacttcttaagcaataactnttcgttacttctaaaccttacgaggaagctggagagcagtttgggatgtaactgagtctt

SEQ ID NO: 15086 - DNA, 121 bp, Artificial Sequence
  Synthesized
  misc_feature (61): n=a or g
ctctgtggccagcacaacataggtgtttcatggaattactcaatggtattaagaaatactnctcacagatgcaacttgagtacgctttcctttctctccaaaggtggggtaccagactgac

SEQ ID NO: 15087 - DNA, 121 bp, Artificial Sequence
  Synthesized
  misc_feature (61): n=t or c
agacaaccgaccaatttttggagaaggataatatttcaatttctacttcagtattcgcttngttgacaaaccttttattgctttctttatgtacttgactatgaagtctttagacaaacta

SEQ ID NO: 15088 - DNA, 121 bp, Artificial Sequence
  Synthesized
  misc_feature (61): n=a or t
ctgtttataagctttatacatttgacagttcaagaagaagcaattcatttatacaaaaaantatttcctacaagcaaagcagaccatgcccacagccatctacagaagtgttttggtggac

SEQ ID NO: 15089 - DNA, 121 bp, Artificial Sequence
  Synthesized
  misc_feature (61): n=a or g
tcggcctggcaggctctgatactgacttttctttgggcccaagctggctgcagacaagcantgttgctgggctgtgagagccttcaagtccaaaatggtattttgactgcagctgttttct

SEQ ID NO: 15090 - DNA, 121 bp, Artificial Sequence
  Synthesized
  misc_feature (61): n=t or c
gtgtcctatttgttttagtcatctacagccttgtgagtagtttgctaccaaggccaaaaanggtgtattttaatgtggattcatcttagcattctcagacagtacataaagtgttaacatc

SEQ ID NO: 15091 - DNA, 121 bp, Artificial Sequence
  Synthesized
  misc_feature (61): n=a or g
gttttattattattatttttttagttagaaattttacggctatggaagaagctttgtggtnctatcaaaagcatacaagacactgtgctcagataaaggtgcagatgctcactgttgtctc

SEQ ID NO: 15092 - DNA, 121 bp, Artificial Sequence
  Synthesized
  misc_feature (61): n=t or c
taatttctccttagattacagaatgaaacagaagaaaagcaatattgtccctataggaatngtcttaaaagtattccagattttacatcttgaaatttataagcatttataacactgttta

SEQ ID NO: 15093 - DNA, 121 bp, Artificial Sequence
  Synthesized
  misc_feature (61): n=a or g
catcttcagttacaacacagaatgaataataaaaggctcatcactttaaaaaagtccaatntactaattcacaagcaagctataggctttcaccaaagaattttggataattacacatctg

SEQ ID NO: 15094 - DNA, 121 bp, Artificial Sequence
  Synthesized
  misc_feature (61): n=a or g
aggagctcaggaagggtggaggatgaggccaagcagtgctcacagtacttaaataactctnaaagtctgtatgatctcctgtgggattggagttttgccatattggtatgaaattcctgtc

SEQ ID NO: 15095 - DNA, 121 bp, Artificial Sequence
  Synthesized
  misc_feature (61): n=t or g
acagaaaagatgtgacagttgctttgccattggcaagttgaacagaatcttcttttacatnaaatcccatacaaaactacaatatttagggtaaagagccaagtactaaacaacctgcctt

SEQ ID NO: 15096 - DNA, 121 bp, Artificial Sequence
  Synthesized
  misc_feature (61): n=a or g
gggagggaataacttctagcagcagcagtgctaaattggcagtgccatctgcattggaacngggtttgtgctttcacgggagagagtaatagggaccaatgtgcctcaaaggttccgtgag

SEQ ID NO: 15097 - DNA, 121 bp, Artificial Sequence
  Synthesized
  misc_feature (61): n=t or g
tagaaataagccctaaattaccaatgcaaagtatggagctataaatgtgcattggtttctntgacagaacttgcctctgtctttccatcaactcatcagcaggaagccatttgaatcgcat

SEQ ID NO: 15098 - DNA, 121 bp, Artificial Sequence
  Synthesized
  misc_feature (61): n=a or g
agcaaagaaaacatctgcaaacttaaggaaaaaaaaatccaaaaatttacttatttaccantaatttaccaatacttggctcagtggaaagccaggtattctcatgctttatgcttcctgc

SEQ ID NO: 15099 - DNA, 121 bp, Artificial Sequence
  Synthesized
  misc_feature (61): n=a or g
aataattacttaaataacaggaagacgtgacgtgtctctgcagggcaggctggagcagcangacgtggctgcagaaggctgggagctgttctcttgcctacaggcaggcggttgcaggatt

SEQ ID NO: 15100 - DNA, 121 bp, Artificial Sequence
  Synthesized
  misc_feature (61): n=a or g
tcatgtacagcccggcagggcactggtagcaaaaggtgaagagaagaaagatacctgcatnctttgagttacagcaggaaaagtcagtgataatgctgtcagatatactcattttaaataa

SEQ ID NO: 15101 - DNA, 121 bp, Artificial Sequence
  Synthesized
  misc_feature (61): n=a or g
aaccctgctgttaattcacaccctcagtataaggcttcaccaccctgaaatcacaggagcntttgctgtcattttccaacagcgtggtcagccagcacaacaacactcaggtgtaagaact

SEQ ID NO: 15102 - DNA, 121 bp, Artificial Sequence
  Synthesized
  misc_feature (61): n=t or c
ggaagcaatctgctttcaagcttttccattttcccttgcaaaaactttgagatcccccacngctatcagatgtagagacgcactccaaaataaacaaaatattctggttcctttaacctga

SEQ ID NO: 15103 - DNA, 121 bp, Artificial Sequence
  Synthesized
  misc_feature (61): n=a or g
ttgttaattggaatacaaatgaaatctgtcactcaataattgaggtacacaatgacatgcngagaacagtaagcattcatcatatctatataattatgtggcaacgtttagactgttgagc

SEQ ID NO: 15104 - DNA, 121 bp, Artificial Sequence
  Synthesized
  misc_feature (61): n=t or c
ttaagaaagcagtaaactgaaaaatcaacatctggcaggggacttgcaatacaaagtacgntccgtgttttcttaacagttgcggacatttaaaaataataataataattagcactctttg

SEQ ID NO: 15105 - DNA, 121 bp, Artificial Sequence
  Synthesized
  misc_feature (61): n=t or c
gctaacccaccaagtagcagtttacttgctgcccctcactaccagcatacaggaattgtgncttaagaaatctggttgttcagacacagctcaggtccaagcatcctggtgatcagcgtaa

SEQ ID NO: 15106 - DNA, 121 bp, Artificial Sequence
  Synthesized
  misc_feature (61): n=t or c
gtatttactggcatatccttggtgtgataatgttagtcattaaggcaattactatacctgnggaacgcccaattttttacaagcatccagaaagttctcaacatttcttcggcactttgcc

SEQ ID NO: 15107 - DNA, 121 bp, Artificial Sequence
  Synthesized
  misc_feature (61): n=a or t
ttttctgggaaaagactatgctttagcatcaaactagttagcagcttaggaaatagaaacncttgttagatgacactctgacttttgtattcacatcgagaaaaaagcttttaaattttct

SEQ ID NO: 15108 - DNA, 121 bp, Artificial Sequence
  Synthesized
  misc_feature (61): n=a or t
ttggaacacacatgatcttcaggggaattggattgtagtcatattcatctacatggtatangcaagatttaagaatttgggaaggaattgggttagagttggtaaattcagcaagataaat

SEQ ID NO: 15109 - DNA, 121 bp, Artificial Sequence
  Synthesized
  misc_feature (61): n=a or g
gtgagtgggcgcagcgggatgggccggtggttggatgtgggggccttggagttctccctgnggactctgagaaagcctgcactcctctgagcactggctgggctttaggaacgatgtgcca

SEQ ID NO: 15110 - DNA, 121 bp, Artificial Sequence
  Synthesized
  misc_feature (61): n=a or g
gtagggatacctcccctaaggagggtccttcttctgagatcctgtaacgtcgtcacctccncctggaggtactgccttgtttccaaatcttcatacggttctggtccttctgaagaaaagg

SEQ ID NO: 15111 - DNA, 121 bp, Artificial Sequence
  Synthesized
  misc_feature (61): n=t or c
ccagctttctttccattaccctgtccagaacaacaaacttctttgcctttaggaaaagttnttttgggggctgcgttctttccataacagttagaatctgggattctactccaaacaacat

SEQ ID NO: 15112 - DNA, 121 bp, Artificial Sequence
  Synthesized
  misc_feature (61): n=a or g
ttctgcctttgcggggctctaatggacctctgttgctctcaacacagtattgataacatcncagacagcattacacagttttgcttagcctgtgctatgctttttttttgtattcgcttgc

SEQ ID NO: 15113 - DNA, 121 bp, Artificial Sequence
  Synthesized
  misc_feature (61): n=t or g
tggggagtgttgattataggaggtgaaagtgatccagtaagcttgaaattgcattcttaangctggctcttggaagggctggaatgagaacacgttgcagagctatcattgcacaaagtgg

SEQ ID NO: 15114 - DNA, 121 bp, Artificial Sequence
  Synthesized
  misc_feature (61): n=a or c
gcaaaaatgactccacatttttttttcccatcctaccctttcccatctcaaccttctcatngcagtaagagttaaaatacagttaaaataagccggtggaaagaaacacacacgcataaaa

SEQ ID NO: 15115 - DNA, 121 bp, Artificial Sequence
  Synthesized
  misc_feature (61): n=c or g
gaggtgggagaccgggctatgctgatgatgcaacttgaatcattttcttcctctcagttgntcttgcttcactgagaatgggcaaaagcagagttacccaactctggatgaaagggttagt

SEQ ID NO: 15116 - DNA, 121 bp, Artificial Sequence
  Synthesized
  misc_feature (61): n=t or g
tttttttttttttcccctttcaaatattgagtatttagtatttatcaaagtgacagcttantcttcttttccaaggctcctatttctcctgttcgttctgtccatacagtctcattaaaat

SEQ ID NO: 15117 - DNA, 121 bp, Artificial Sequence
  Synthesized
  misc_feature (61): n=a or g
acaaatacacatataatacattcattgcaggcagtgtccagggtgttgtggttcaggcacnatagtgcttgcttcaatctatgaagttcagttgcatctgtgcctctcatttaaagctgat

SEQ ID NO: 15118 - DNA, 121 bp, Artificial Sequence
  Synthesized
  misc_feature (61): n=a or g
ttatgcatgttggaacaaagacaggcttactgctggcttgcacagtgtggatgcagatagncagattgttcttactgtcatgaaaactattggatttgactctgtaccttgtaggcgagtg

SEQ ID NO: 15119 - DNA, 121 bp, Artificial Sequence
  Synthesized
  misc_feature (61): n=t or c
ggaacaagctcacagcacctcacctgacgtcctatacttgttttgatggtaaggacttacncagcatccatagacctgcaggtgacatttccaggctgtattaataaggaacgctttaaga

SEQ ID NO: 15120 - DNA, 121 bp, Artificial Sequence
  Synthesized
  misc_feature (61): n=t or c
agcaatgtagcaagctgtctctctccctctggagagaataattctgctattagtgatagcnatgggcagttttctgctcatcctcaaagcattttgttgttttgtgttggtgaggatgctg

SEQ ID NO: 15121 - DNA, 121 bp, Artificial Sequence
  Synthesized
  misc_feature (61): n=t or g
ttcagagcatttttgttacatcggccacttgaagcatcgcagtgtactttccaagcccacnagttccttgctggagacagagaacagctgagcaatagcaagcaccttgaccacacctctc

SEQ ID NO: 15122 - DNA, 121 bp, Artificial Sequence
  Synthesized
  misc_feature (61): n=a or g
tgttagtgtaaactgagggatgctactcttcaaaacacaaaaagaaatggagacagacacntttggtgcccttgaacttgtgttttttgaggtggttgctaattgtacacttacctttttt

SEQ ID NO: 15123 - DNA, 121 bp, Artificial Sequence
  Synthesized
  misc_feature (61): n=t or c
cgaaaagttgacaagctctccattcagatgagaagagtcaccaaatcatacgccaattccncacacacctccagacatcgctgtgactggtgaggccacttaacagtttttccagtgcgct

SEQ ID NO: 15124 - DNA, 121 bp, Artificial Sequence
  Synthesized
  misc_feature (61): n=t or c
aaacttcatttgggggctctgttgtccaaatctgaaaatgcaataagaatgtggtcttcanccaatgtttgtttgttactgacagtcttttgcaaatgacaataataagagcccttttgct

SEQ ID NO: 15125 - DNA, 121 bp, Artificial Sequence
  Synthesized
  misc_feature (61): n=t or c
taattattatttctaagttttgtggccaacttatcatcatgtatgattattgttgtttttncttataacgtggctgataaagagtactagcactaggagatatgtaaattctgccatgttc

SEQ ID NO: 15126 - DNA, 121 bp, Artificial Sequence
  Synthesized
  misc_feature (61): n=t or c
atctctgtctctcttctttgacgatacacagttttaaacacctagtgaagaattcagtcanctttacactgcaggtaactttagtgcaaaccctaaagttactgctctagagatcctcaga

SEQ ID NO: 15127 - DNA, 121 bp, Artificial Sequence
  Synthesized
  misc_feature (61): n=t or c
caacagaatcgttctgctccacagcagttctcttccctcctgcccctccaaaaatgcctcnatctaaaatcaaccaagtgtctgtgggcctctttcttgagcttcctggagcctgttgata

SEQ ID NO: 15128 - DNA, 121 bp, Artificial Sequence
  Synthesized
  misc_feature (61): n=a or g
aaaaccagaggttggaacatcagtgggaaaaagcacatatctgttctactttttcatacangacatccacttttggatgctggcaataagttatgaggttatttgacttttatctgaccca

SEQ ID NO: 15129 - DNA, 121 bp, Artificial Sequence
  Synthesized
  misc_feature (61): n=a or t
taataaaaaaacaaatttctaaatacatattatttttcttgcaaatgcaaaagataacctnaagtgatgagttgccttgcgtgtttcataatctgcaatatttgtggttatttttaaataa

SEQ ID NO: 15130 - DNA, 121 bp, Artificial Sequence
  Synthesized
  misc_feature (61): n=a or g
gcaccacgtcctggccgggatccagcacctccacagggaagcagcgctgtccttccctccntagagacagccatcggtagaagcagaacgcacaccctgtgtgcagctcctcgcacacaga

SEQ ID NO: 15131 - DNA, 121 bp, Artificial Sequence
  Synthesized
  misc_feature (61): n=c or g
ttcaaggcaagattgagtgtggaacaagaaaagttgaaatcatgtttgatcccagcttacnttatgccacctagcactgaattaggacagatctgatagtgttccaaaaataaaaacaaaa

SEQ ID NO: 15132 - DNA, 121 bp, Artificial Sequence
  Synthesized
  misc_feature (61): n=t or g
ccgaagctaaaaaaaaacaacaaccaaccaaccctaaacgtacacccaacccctcgcaaanaattaaagtgctacatccagcatcactgtgccgtcttttacttctagcttgtgtcttatt

SEQ ID NO: 15133 - DNA, 121 bp, Artificial Sequence
  Synthesized
  misc_feature (61): n=t or c
gccggagttctcagggccctggggctttacctggcagccaaacctctgcaaaatgcttganggcaacagatggaagagactctccaagggctccttgctgtcctgctcaatgggcttgcag

SEQ ID NO: 15134 - DNA, 121 bp, Artificial Sequence
  Synthesized
  misc_feature (61): n=t or c
agagcaacatgaattctttcagctgactgtgttgttggaccagccatgaagctgttattcnggctcatgaaaagttatgtaaacctgttataaaatacatttaacattccactgatatata

SEQ ID NO: 15135 - DNA, 121 bp, Artificial Sequence
  Synthesized
  misc_feature (61): n=a or t
ataatgcgtctttatttagccatagtaacttagttatggtttgaggcaaccatgagaacanaggttggcaggatctataagggcttgcttgttcaacttcatcaaatatattcttttcctc

SEQ ID NO: 15136 - DNA, 121 bp, Artificial Sequence
  Synthesized
  misc_feature (61): n=a or t
ggcccaaagggaagcagcccaccaagaagaggatgcagcatctcctgtttcaagctaacancatcatctgcagggcagaggagtggcacaaaacccagcactgccacccagcaccacgtct

SEQ ID NO: 15137 - DNA, 121 bp, Artificial Sequence
  Synthesized
  misc_feature (61): n=a or g
tcttgtagttcccagttttcccttttcctctggcaacacagttgtagtcatttggtgaggnatctgaggcactgtatgtatttaactctctgtctttgtaattcatagtccaatggccatg

SEQ ID NO: 15138 - DNA, 121 bp, Artificial Sequence
  Synthesized
  misc_feature (61): n=a or c
aagaaagatttgcatatttgcatgcttttttggacatgtaaaggtctaaaaaaaccattcngttggtggtctgaagtccttacattgaacttcggtctgccaataaaaatcccatttcagt

SEQ ID NO: 15139 - DNA, 121 bp, Artificial Sequence
  Synthesized
  misc_feature (61): n=t or c
gctctaagaaatatagcattaggataaataatgtatttttcatatgacagaacaagacaancagatactccagtctaggaggcataggcccaaaatacagatccttatcctgctatcttag

SEQ ID NO: 15140 - DNA, 121 bp, Artificial Sequence
  Synthesized
  misc_feature (61): n=a or g
taagtgtcgtgctctgctctgcaaagctgcagcaggtgagtgctgcttgttgcttttgctnggagtcctctgctggatactgggagggcattgaggattcattcacccagcagctttttgc

SEQ ID NO: 15141 - DNA, 121 bp, Artificial Sequence
  Synthesized
  misc_feature (61): n=t or c
aagtgtgcctgaatgatttcaaaggcaaaatgtgtcacaatttttctaagatagatcaagnttacaagacagcagagaattgttttaaataaaaatctccttcctgtaagcattccccagt

SEQ ID NO: 15142 - DNA, 121 bp, Artificial Sequence
  Synthesized
  misc_feature (61): n=t or c
gggggggggataagggggggcctgcagagctccccacactgctgggggatcccactgatgntggttggtaggaatggagtgaaacagcactgccaacgctgcttgttttggagcagaggag

SEQ ID NO: 15143 - DNA, 121 bp, Artificial Sequence
  Synthesized
  misc_feature (61): n=c or g
ctactacaaaagttgctaggaggattctttacaccagagacaatgcattttctgacctctntgagaaaaggtatcaagagtattgcaattttacattggttcaaacagaactccacaagta

SEQ ID NO: 15144 - DNA, 121 bp, Artificial Sequence
  Synthesized
  misc_feature (61): n=a or g
ttataaaacacagaagcagacagaacacagaaaccaagactataaataccagaggtgaacntgtgtggtgcaagtgtatgtgaggatcatgaatagaattatcagtattctgtctggtatt

SEQ ID NO: 15145 - DNA, 121 bp, Artificial Sequence
  Synthesized
  misc_feature (61): n=t or c
agcatagcacagcaatgagggagaagatctctcttctttatggtagtgcagtgagcaacanggtcagtacttctctccctcttacttgtttatagctggagaagaggaagaggaagaaata

SEQ ID NO: 15146 - DNA, 121 bp, Artificial Sequence
  Synthesized
  misc_feature (61): n=a or g
gtcagctcgtgtgggagcacaggcgtacatacaacagcaacaaatgcatcacaggccttcnggctcctcttccaagacaccctggaaactctggtctgccttctccttggatctccatctg

SEQ ID NO: 15147 - DNA, 121 bp, Artificial Sequence
  Synthesized
  misc_feature (61): n=t or c
aagttggtttagcatctcagctgaaagaaggcatcttcttaatagctttcattcatcaaangcagctcatcattttaagctctaggagaagtaagggtggctgaagttcagctttcatacg

SEQ ID NO: 15148 - DNA, 121 bp, Artificial Sequence
  Synthesized
  misc_feature (61): n=a or g
ctgtcccggtgacgactcctctcgtccccacagtcatcttcagagcggctgtgccctaagngacaaaccagtgccatcagggatgagaagctcggaaaagctgtctgcccaaagtatcgaa

SEQ ID NO: 15149 - DNA, 121 bp, Artificial Sequence
  Synthesized
  misc_feature (61): n=a or g
tttcattcaactaactaaatcgctcagacatacttaactttcctccttagcaggtcctttnctgtagtgccacaatttcctagcaataattacataagatatctgacttctaattaacatt

SEQ ID NO: 15150 - DNA, 121 bp, Artificial Sequence
  Synthesized
  misc_feature (61): n=t or c
cagtcagtgctttccatctaatgcaccttgggaaagtgatctcagccttcttacagaaaangtttcaatgaaggaaagcaatgggctctccctgtgtgaagaagagcagacataactagta

SEQ ID NO: 15151 - DNA, 121 bp, Artificial Sequence
  Synthesized
  misc_feature (61): n=t or c
aagcgatagcttccccccagaggacaacctggagcatttcccatgccctgcccttctgatntgcccatacagcatccctggcttcccatccgctgttgtgatgctggtgtagagttgcaga

SEQ ID NO: 15152 - DNA, 121 bp, Artificial Sequence
  Synthesized
  misc_feature (61): n=t or c
gttacctggtagttaactatggagagtggtctctggttttctcctccttttctcaactccngattccctgaaaagttgagttgcagcccatgctgctgctgagggcttctgcaaaaccttt

SEQ ID NO: 15153 - DNA, 121 bp, Artificial Sequence
  Synthesized
  misc_feature (61): n=a or g
tggttagtccactttaattattgcatttaactgtgctttattcttttcttcgatcagaccngcagcgatcgctgagagcattcaactagaacagtctcagtaaaagctaatcagaagctcc

SEQ ID NO: 15154 - DNA, 121 bp, Artificial Sequence
  Synthesized
  misc_feature (61): n=a or g
aggtggaagacagtgctcctgggggttcctctggggactctgcttgggctgggtgtaggtncacagcaaatcatgacctgcagagctgcaatagggtggggagagcggttgtgtctgcccc

SEQ ID NO: 15155 - DNA, 121 bp, Artificial Sequence
  Synthesized
  misc_feature (61): n=t or c
agttacctatgcttagcaagagcaaacgctgaggatatgttgtgtgctttaaggactacantattttcaggctttagctgcctctgataccaggaaaatcttccttctatttaggatttgc

SEQ ID NO: 15156 - DNA, 121 bp, Artificial Sequence
  Synthesized
  misc_feature (61): n=a or c
atcggtcccacaggacacgctgtccctgtctgaatcactgtttctgcactgtgctgaagcntttaggtgctctgggaagaaaaggactgctcgtctgtccctgggagaggaggatctacaa

SEQ ID NO: 15157 - DNA, 121 bp, Artificial Sequence
  Synthesized
  misc_feature (61): n=t or c
tgcccaccgccatcccaagaagagacacacctccctgcagcctcatgatcctcctgcatgncaccaagcagctcagttttgctctgcattcaaatgcaactcctgagagcccgaagtgcag

SEQ ID NO: 15158 - DNA, 121 bp, Artificial Sequence
  Synthesized
  misc_feature (61): n=t or c
ttagcagctcctgatcaggaatgactgcgaccagcttgcaaacgatttccggacagctacngtgaggttacattgagctgtcagaattatctttgctttaacaacaacaaaaaagtcgccg

SEQ ID NO: 15159 - DNA, 121 bp, Artificial Sequence
  Synthesized
  misc_feature (61): n=c or g
tgggaagaaaatgtatgcggtttaaagttctttcaggctgacggaagagtgtttgagtatnagtgtaaatgagaagcaggtcctatgagaatcaggtacttacaaattctgtgtgggtatc

SEQ ID NO: 15160 - DNA, 121 bp, Artificial Sequence
  Synthesized
  misc_feature (61): n=c or g
ggctgagacgagcctgagaggagcagccaggcactgaagatcaagcatgacactgtgtcangcttcagttctgagtgggggagcccagcctcaccaggggacagcgtaggaatggatgagt

SEQ ID NO: 15161 - DNA, 121 bp, Artificial Sequence
  Synthesized
  misc_feature (61): n=a or g
accttaattttgattaaattgggtaaatcagatattaatctagatttctacatgtgagcanaattcacttatctgcttgcataacttgtagctgtacatctattaggtcatatttggaaca

SEQ ID NO: 15162 - DNA, 121 bp, Artificial Sequence
  Synthesized
  misc_feature (61): n=t or c
ctgttggtgctgaaataaaactttctacatacagaatatcactgaccgtaacaaaaaagcnccaacaacagtttgtaaatgtaactactttcttacatttttacattatttctaaaaaaaa

SEQ ID NO: 15163 - DNA, 121 bp, Artificial Sequence
  Synthesized
  misc_feature (61): n=a or g
cagagggattacagtgtataaggcttcaactgatcactggaactaaaatctccagaactcnctttctcaaagtgcatcatgtgaaacttatcttttttggctaagatgcagcaaccagagg

SEQ ID NO: 15164 - DNA, 121 bp, Artificial Sequence
  Synthesized
  misc_feature (61): n=a or g
tgacgttaaaagatggctccgctctaacaaagcggtgtgcatccacagctggaattggcantcagctaattaggtcagctcttggcctgggtggttggacaaagaggaagcatggaagggg

SEQ ID NO: 15165 - DNA, 121 bp, Artificial Sequence
  Synthesized
  misc_feature (61): n=t or c
atgaatgcaaaaagaagtgttggaagtataagactcaagattaacatggtagaaaaaatantaatgtgttttctgattactgccttctggtattcaccaaaatgtatatttgttgtttgcg

SEQ ID NO: 15166 - DNA, 121 bp, Artificial Sequence
  Synthesized
  misc_feature (61): n=a or g
gcaaatagcccccaaaatggtgaatttcccactagtgacaaaacaacagccaaaatgttcngatagcccttgaagttcacatcaacatcacagtcatgaatctgattgtaatgcaagtagc

SEQ ID NO: 15167 - DNA, 121 bp, Artificial Sequence
  Synthesized
  misc_feature (61): n=a or c
ctgtgcaggtaaaaactcttgttctgaaaggtaaaggtaatatttctccctctcctcctcntccttcctaggagttgttgattcttcttcccatctagaaataagtagtataatgagacca

SEQ ID NO: 15168 - DNA, 121 bp, Artificial Sequence
  Synthesized
  misc_feature (61): n=a or g
tcacccaaggtgatgaatttccatttgaaatcaaatccaagcaatttccaagtaacatggntgtgcttcattcccttgtactcgctgggttaattgaggtggatctcacctggaaaaaacg

SEQ ID NO: 15169 - DNA, 121 bp, Artificial Sequence
  Synthesized
  misc_feature (61): n=a or c
gtgtccatttattagttgcttttatatgacttcatggcttagtatgaactgtatatgtccntttctcacttctctctcatgtatacccctcttggctgctttagccattccgatcatggaa

SEQ ID NO: 15170 - DNA, 121 bp, Artificial Sequence
  Synthesized
  misc_feature (61): n=a or g
tacagtttattttataagcccacttttttttatggctgttagttggaatgactaaatatgnggttttgtcagaaggagttgatttcacggagaccaacttcaccttatttttttgagttgc

SEQ ID NO: 15171 - DNA, 121 bp, Artificial Sequence
  Synthesized
  misc_feature (61): n=t or g
tatttttcacgctatttgtgatggtatggatgataagatgaattgagcacacagacaaacnataaagctttaacatgggaggtggaaacaggtatgaagaggaagctgcaaagttttgtgt

SEQ ID NO: 15172 - DNA, 121 bp, Artificial Sequence
  Synthesized
  misc_feature (61): n=t or c
aaggagagatgctgacttgtttttgatgtcagtgggaaaaatgacctcagaaggaggaganagactgacctgtccacgttgcccattaggtttggcttgggttttggtaaggggctgtctt

SEQ ID NO: 15173 - DNA, 121 bp, Artificial Sequence
  Synthesized
  misc_feature (61): n=a or g
acattcgtgactataacgaaaccacgtaaggcacgaaaatgaagtcttggaagcaaatccntatcagctgacttgtatttactacctcaggactaacctctaggccaaagatgctttagaa

SEQ ID NO: 15174 - DNA, 121 bp, Artificial Sequence
  Synthesized
  misc_feature (61): n=t or c
ttcccaaggtctttcagcctcttctctgctcagttgctgtactcatccataccctaagccnctccggaaacagctgaaatcatccatctttagcgacaacactgataaaacaatattaact

SEQ ID NO: 15175 - DNA, 121 bp, Artificial Sequence
  Synthesized
  misc_feature (61): n=a or g
actggactatatctcctacagctgatagcccaggatgcagtttaacacctgggaggactgnttgtttgctgaccattgtgatcattgtcagaagtctgttctggaaccttatttctctgta

SEQ ID NO: 15176 - DNA, 121 bp, Artificial Sequence
  Synthesized
  misc_feature (61): n=t or c
tggggaaagcatttaggaatacgcttggaaaaagagcaacaaaatgtcaaatccaggagantgagtcatttggaattcttatgaagaacatgtggaaattcggcagatattacttcagtct

SEQ ID NO: 15177 - DNA, 121 bp, Artificial Sequence
  Synthesized
  misc_feature (61): n=t or g
caaacagagaaataaagaaaagcaggacagctgtgatgaaattgctgttctgtccccacgncaggttccagcccccatccagataatttgatgattgctgctcagacaatggatcagtgca

SEQ ID NO: 15178 - DNA, 121 bp, Artificial Sequence
  Synthesized
  misc_feature (61): n=t or c
tgttatactggaaatattgggacctaactttgtttgaagttattcttcaaaaccaaaccangttaagctgtaaaagttcaacagaactagctcccctctccttcttcttttttcttgcagt

SEQ ID NO: 15179 - DNA, 121 bp, Artificial Sequence
  Synthesized
  misc_feature (61): n=t or c
agtaacatacaattttattacaacacatctacaggttgggaatactgctcgtacttctcangacaacactgtcatttgatatgtaatgcagaacctggtacaacctccagcttcttctctt

SEQ ID NO: 15180 - DNA, 121 bp, Artificial Sequence
  Synthesized
  misc_feature (61): n=a or g
gaaatagtatgtgtttaatgacagattatgaaacaagactattattttcatgatagcagancatagaagtaatcccagcaggggagcattttgactgataaaacaattattttgtagcttt

SEQ ID NO: 15181 - DNA, 121 bp, Artificial Sequence
  Synthesized
  misc_feature (61): n=t or c
ttctttaaaaatttccagtagacaaaaaaaatacatatattttcccaaatatcaattcagnatcgaaatctgttccaagagtttcctgtttacaggatttttagttaggaagaaaaacaag

SEQ ID NO: 15182 - DNA, 121 bp, Artificial Sequence
  Synthesized
  misc_feature (61): n=a or g
cacagtctttacctgttctttccaagaagataagctattagccctaattactgcacaaacnctgccagaactttacttcagctacagccatgttagacttcattgtttccagatgtgaaat

SEQ ID NO: 15183 - DNA, 121 bp, Artificial Sequence
  Synthesized
  misc_feature (61): n=a or g
gaggttatattactgctgtttaaaatcattaaggtaagacgctaggagtttacaagaatanacagtaggatgattattagaaagatactgctgattttagacccaacttagttttgtaata

SEQ ID NO: 15184 - DNA, 121 bp, Artificial Sequence
  Synthesized
  misc_feature (61): n=a or g
agcccccagcttctgccagctcattcactgcagcattctgtgcacattattgcagctcagngacagaaacagctgctttccagagcagtgcactgctagcagtgagagagagaaggagctg

SEQ ID NO: 15185 - DNA, 121 bp, Artificial Sequence
  Synthesized
  misc_feature (61): n=a or g
aggtgacagaaagtagatcttcataaaagttgagtagctcctgtcaaggtctagtgatganagtatcatggaaaactctgtcaagaaatggaaatttctatattctctgcagagaaaagag

SEQ ID NO: 15186 - DNA, 121 bp, Artificial Sequence
  Synthesized
  misc_feature (61): n=t or c
cagtcacagtttacatcgcacttactgctactgcataaccctggtacttatcagcaagcantgtcctaaggagaaacctgcttaatgatgtaagaggtcagacaacggacatatgtcaaca

SEQ ID NO: 15187 - DNA, 121 bp, Artificial Sequence
  Synthesized
  misc_feature (61): n=a or g
gacaatactgtattgagaattcagacaagaacatgaacagttatgtaaatggtcgcagacnctagatgaaaataatcaccaagatttagacatgaaccaaatgtgaagaactgtttacaat

SEQ ID NO: 15188 - DNA, 121 bp, Artificial Sequence
  Synthesized
  misc_feature (61): n=a or g
gtgggcactccaggtctgtacccttcagcccaagggtgcttcctaatcctttgttatttgncagtatgtatatgacccatggatcccaccccttggagactctgtctccttgcataacctt

SEQ ID NO: 15189 - DNA, 121 bp, Artificial Sequence
  Synthesized
  misc_feature (61): n=c or g
tattagcatccagagtgattcatctcccagaacaaaaggggtgagggagcagagtgactgnaggaaaggaggttacttggaattgtttgcaggtgtgcaaaggagggactgctgagagatc

SEQ ID NO: 15190 - DNA, 121 bp, Artificial Sequence
  Synthesized
  misc_feature (61): n=c or g
ggaggttacttgcccattctttcttacctacgtaatgtgtctggaccattaaggcactcanatgcaaatgatcagcgaaaaataacatatccatgtgctggaatagccttaagaaatgtga

SEQ ID NO: 15191 - DNA, 121 bp, Artificial Sequence
  Synthesized
  misc_feature (61): n=a or t
gtgcagggatggtcctacaaggacagtcacacatcatggccatctcttcccatggtttaancaggaactcctgcaggccccaaatcatccaagtctcccatctcctctgggaaagaaaaaa

SEQ ID NO: 15192 - DNA, 121 bp, Artificial Sequence
  Synthesized
  misc_feature (61): n=c or g
aaatgtgactgaagcagtgcgcatgataaatgcctggaaaagggagcttatgccagctccntgccagaggatgaaattttaatgaacagctttatttagttgtaatacatgggcaaataga

SEQ ID NO: 15193 - DNA, 121 bp, Artificial Sequence
  Synthesized
  misc_feature (61): n=t or g
tttttaatggatggattttttaatggatttgaaggaggcagggaactgactggataatagncagatctttgcctttataaattagcataagctttttagtaggtcaaatgcagtaaatatt

SEQ ID NO: 15194 - DNA, 121 bp, Artificial Sequence
  Synthesized
  misc_feature (61): n=a or c
cacttcaggtatggtccagattttagaaagttaggtttgatcagagatgttccatgcaaanttaaagcaagtccagggtaagagcagaagtccctgctatttgcagggtaggatccatgca

SEQ ID NO: 15195 - DNA, 121 bp, Artificial Sequence
  Synthesized
  misc_feature (61): n=t or g
gtgttggcagccagcacatctgtcgggaaaggcatcggcaaattcaccttttctggcctgnatccgggacacaaatacctgctggaggtggtgtccatggcggggccctacgcagcctctg

SEQ ID NO: 15196 - DNA, 121 bp, Artificial Sequence
  Synthesized
  misc_feature (61): n=a or g
ctttatcctaaactctaggaggtattcaaagtgctcagtaatttccttccctctaaagtanaagagaacacaataaaaattattgtaaagcactcaagtgaattaagaacttcaaagattt

SEQ ID NO: 15197 - DNA, 121 bp, Artificial Sequence
  Synthesized
  misc_feature (61): n=a or t
gtaagcatgcttggataattttctgagacacatttttagttccaatacatcagcttagagnattccttagttaatacttatattgaagttaagagaagaggatcacagtgatccctttcta

SEQ ID NO: 15198 - DNA, 121 bp, Artificial Sequence
  Synthesized
  misc_feature (61): n=a or c
gattaaaaaaatgaaggtagattttgtccgtgcattgtgaactcagtaattcctgtccctnatgcagtcagtgggaattgagaaaggcgcactgcaaagactgagccctccggaatgtgag

SEQ ID NO: 15199 - DNA, 121 bp, Artificial Sequence
  Synthesized
  misc_feature (61): n=a or c
atctttgtggtgttcttgataactcatctcttaggagcagaaatatatccatatagtttcntaaaggccacttatgtctttcagaaataatttcagtagttgttcttttatattaagggca

SEQ ID NO: 15200 - DNA, 121 bp, Artificial Sequence
  Synthesized
  misc_feature (61): n=a or g
gcgccattcagccacactgtgcaggtgctgctttcatttgtgatgctttggcgtgtgaccntcacccatgctctgtgaggtgctttcagagggcactgagcttcaggcaggtgggagcttt

SEQ ID NO: 15201 - DNA, 121 bp, Artificial Sequence
  Synthesized
  misc_feature (61): n=c or g
ttatatatatatgaagtctggatgtgcatatattccaggcacccatcatccagcataaggncaatgaaccagatttctcttaactcccactaatcatcgctgatatcatttgaatctgatg

SEQ ID NO: 15202 - DNA, 121 bp, Artificial Sequence
  Synthesized
  misc_feature (61): n=a or g
tgaggtctcttttttgggtgcaagtgttgcctataactctttttgtcctctttgaattcgngtggtaagctggtccctgtaaagtgtcttcgtgtttatcttcagagcatttaatgccaga

SEQ ID NO: 15203 - DNA, 121 bp, Artificial Sequence
  Synthesized
  misc_feature (61): n=t or c
cataaccttttaaaaactatcaccacgtctatactgaagtttccttcaatgtaaaagttangccttaaaactagcagcctggaggatgcatattacaacacgacgtggttttctctattga

SEQ ID NO: 15204 - DNA, 121 bp, Artificial Sequence
  Synthesized
  misc_feature (61): n=a or g
gattgaagctggaaaacgggctgaagctgtagctacagttgttgcagccgttgatcaggcncgtgttagatcaccttgggagacagagcaagtagatgaaacttatgtcaagaagaaaact

SEQ ID NO: 15205 - DNA, 121 bp, Artificial Sequence
  Synthesized
  misc_feature (61): n=t or c
aggacaacggcaggagaaatctgagcagtgagttccacagcttatgcaacttcgttcttcnctgaaggttaagctataaatatgaagatgtggaattttgttttggtcttgttgcttctag

SEQ ID NO: 15206 - DNA, 121 bp, Artificial Sequence
  Synthesized
  misc_feature (61): n=a or g
accccgctatccaggactggcagaatctcagcacttctcatcttccagggtttgggcctcntccccctgatccaattcacgtgaggagaagcaggatggctggctccaaggcacggcctcc

SEQ ID NO: 15207 - DNA, 121 bp, Artificial Sequence
  Synthesized
  misc_feature (61): n=a or g
gtagtgctaacttcttggtttaatcctgcaaaagcatgactttaatttgtcctacctaacnggacatgaggatctcaggattttatagttatgctgactccctactctagtgaccgaaaca

SEQ ID NO: 15208 - DNA, 121 bp, Artificial Sequence
  Synthesized
  misc_feature (61): n=t or c
gagctttccctgccatcccatccagccggcacctctcccagatgtctgcacacactcacgngcctgaagggttttgctctggtccagcgtttccaagggctcaggtttggcagtgggaacc

SEQ ID NO: 15209 - DNA, 121 bp, Artificial Sequence
  Synthesized
  misc_feature (61): n=a or g
tttagaaacaacttgaagataagcttgaagaaaattctgaagagatttcaagatttactgnggagattatatgaattcagaaagagcttctttattgcaagtggagtcagagccagtaaga

SEQ ID NO: 15210 - DNA, 121 bp, Artificial Sequence
  Synthesized
  misc_feature (61): n=a or g
actcaaatgaatcacgagggtacattctagacttactgagatgttccaaggtgaacgggtnctttggggggccgaagaaatggagatgcaagttgagaatgtttgaaagtcataaatcttt

SEQ ID NO: 15211 - DNA, 121 bp, Artificial Sequence
  Synthesized
  misc_feature (61): n=t or c
tgcccctggagctgcaaggagatgtcagtcagaaagagaacagtgggactttcatctttgncttgtaattgatgtctgcagggtttccaaggagtgacaggctcccggggcagcagcggag

SEQ ID NO: 15212 - DNA, 121 bp, Artificial Sequence
  Synthesized
  misc_feature (61): n=t or g
ctctcctagggtagaggaggcagatgaagggcaaccttacctaccttaccctctctcctcnctctttttgttggccattggaaggaatgggtggctgccatagagctgggagacaagctgt

SEQ ID NO: 15213 - DNA, 121 bp, Artificial Sequence
  Synthesized
  misc_feature (61): n=t or g
gtagagtactcttgtagaaattagacttttgtgctatgtttcttcagtatttccagaaatngacagctatataaatggacagtatataacatgatattcaccactaacacaagtgaaattg

SEQ ID NO: 15214 - DNA, 121 bp, Artificial Sequence
  Synthesized
  misc_feature (61): n=a or g
gaaagggcagagtcatttgagaatgacgttgaaattgcccctgcttggagtaatgaaaagnagcaggacaatgtgaaaactcagttgatcatactgtctatcaataattatggggcttagc

SEQ ID NO: 15215 - DNA, 121 bp, Artificial Sequence
  Synthesized
  misc_feature (61): n=t or c
catcagttgtggcttcagagcaagagggaaggcttccatctttggtcctggctgaggcgtnaccttcccacctgtttggaattcagaagacgtttctggggatccctgccaaccccatcct

SEQ ID NO: 15216 - DNA, 121 bp, Artificial Sequence
  Synthesized
  misc_feature (61): n=a or c
tgcccacatacccactgctgcacattgctctgctccagctgaccaagacctatgctggttntaattgttgacgatacctttaagattcagacatcctctctgaccagacatgaggtatggg

SEQ ID NO: 15217 - DNA, 121 bp, Artificial Sequence
  Synthesized
  misc_feature (61): n=a or g
acaaaaggtattaaaaaaaatcaactgaaatcctcttttggaaataaaacagattgtgttngttaaaaaggcttggtttagatttaagtcaaccttcctacccctgcatcatgggcaacac

SEQ ID NO: 15218 - DNA, 121 bp, Artificial Sequence
  Synthesized
  misc_feature (61): n=a or g
gcccagtgtgctgaaacagtacagcaaacatcacaggcagtaacaggaaacaggacccagngaactgtggagcagggctgggatgatggtcatcatcagggaatgattaccacattattcc

SEQ ID NO: 15219 - DNA, 121 bp, Artificial Sequence
  Synthesized
  misc_feature (61): n=t or c
gtgtgttctacacgtaggtcttttctttaccttagtaaccttttgcacctgcactgatttntaaagctaatacttacaataaactttcccaaaactaggctccactgggattaggtttgct

SEQ ID NO: 15220 - DNA, 121 bp, Artificial Sequence
  Synthesized
  misc_feature (61): n=t or g
ctctgcatttaccatttctttttttaagaaggtctcttatagtcctttggtggttgtgganggccatcccttgctgctgccatcagccatcccttgctgccttaactttggctgtagctct

SEQ ID NO: 15221 - DNA, 121 bp, Artificial Sequence
  Synthesized
  misc_feature (61): n=a or g
taatatgtaaatactattttgatcaatggaaacgtacatatatctatgtgaaatcccattnttattctactgtaaaattctgttgtatctacaagggctgctcatagtaccaaacaaaaca

SEQ ID NO: 15222 - DNA, 121 bp, Artificial Sequence
  Synthesized
  misc_feature (61): n=t or c
aaaaaatatgctctttaaattgggtcttcagcaagcatctcaagtgaactgaatcaactgnccagatttgaaatgttatttgataggtaacaacaaaatagtagaccatttaaataaggta

SEQ ID NO: 15223 - DNA, 121 bp, Artificial Sequence
  Synthesized
  misc_feature (61): n=t or c
gctatcttctcaactattcttgctcctcttttgctttaacttctcgctcttcatgcctttntctcctcctgtgttctgtgtatcttcccttcttatttactccatgtcttctctaccccag

SEQ ID NO: 15224 - DNA, 121 bp, Artificial Sequence
  Synthesized
  misc_feature (61): n=a or c
atgtgtgctggagagctgcggagtgtttatggccttctgagctgaattaaggggcaattanggctgattccaaaaccataggtgttactggctgtccactgtatagtgcctatagtggtgc

SEQ ID NO: 15225 - DNA, 121 bp, Artificial Sequence
  Synthesized
  misc_feature (61): n=t or c
ggctgtcctgccacctccaaggtctccactctgacaggaaaaatacggacctccatgaagnggcatccaaagggatgcccaggaggccttcaaggagaccagacctgtccccagagaagcc

SEQ ID NO: 15226 - DNA, 121 bp, Artificial Sequence
  Synthesized
  misc_feature (61): n=t or c
tgaggatgcacgtctccagccaaaacctccttgagaaaggccagctttccactgatgcccngcgcaaagagcttggcttttgttcagcattttgttgctttctttttctttccattcaatt

SEQ ID NO: 15227 - DNA, 121 bp, Artificial Sequence
  Synthesized
  misc_feature (61): n=t or c
gggttctcaagaaaaaccacccgccaacacagcttgtaaggctaaacatcactctgcgaangaaaacaagtcggccattggaagccagcacattccagctctatattctgctgcagaccat

SEQ ID NO: 15228 - DNA, 121 bp, Artificial Sequence
  Synthesized
  misc_feature (61): n=a or g
ttctcaccacttccttaataccattttgaattacctttttaaaaacaggtactggatttcnggatagaatttataagacctggtccatgagcaggcctttcagacaagaaatcttcccagg

SEQ ID NO: 15229 - DNA, 121 bp, Artificial Sequence
  Synthesized
  misc_feature (61): n=t or c
ggaagatctcttaattttgctcaaaatgcactggagtcgaagagattataggaggtcaganggaggtcactgctcctgatgcatgcgtgaggcatcacagggcagcttgggcagccctgag

SEQ ID NO: 15230 - DNA, 121 bp, Artificial Sequence
  Synthesized
  misc_feature (61): n=a or c
aacaaatggcgaatttcatctctaggagaaataagtgactgttacacttacctgcaagtgnttttcttggaaagtccagtcgttcatgctcacatacttcagtttaacacgactgttagat

SEQ ID NO: 15231 - DNA, 121 bp, Artificial Sequence
  Synthesized
  misc_feature (61): n=t or c
atggtattttgaggctctgacttaatgctggtgccccttgttttgcaagaaagctgtcaangggaggaaagaatcatggatatgaataaatcagattcgcctttaaattagggacaaatcc

SEQ ID NO: 15232 - DNA, 121 bp, Artificial Sequence
  Synthesized
  misc_feature (61): n=t or c
cttcaaaagctcaagtgcaatgcaagaaggccaatgtaccaagcaatctctccttgattcntctacaaatacgtatgacaccacaaagttctgttttcaaccactttttcccacgtttaga

SEQ ID NO: 15233 - DNA, 121 bp, Artificial Sequence
  Synthesized
  misc_feature (61): n=a or g
attcaagcttcagttggtagagctaactgcatgatagcagtttcctctaagtccagtatgnagtcccccatgcacagctacctgtaggctgagttctctctacccagcaagcattaacctc

SEQ ID NO: 15234 - DNA, 121 bp, Artificial Sequence
  Synthesized
  misc_feature (61): n=a or t
tagttgactcatcttggccctatgtggggtgagttgatagtctcattacagtcacaagagncaaggtttcctaaataggaatccacttgaatccggttccctgatcattagacctcacata

SEQ ID NO: 15235 - DNA, 121 bp, Artificial Sequence
  Synthesized
  misc_feature (61): n=t or c
tgattatttcttaatatattcccctctaaagtattgtagtattaaatacaggtagtgatgntactgctgtcacactaactgtggtcatcatcagaccttaattactcatattaattattaa

SEQ ID NO: 15236 - DNA, 121 bp, Artificial Sequence
  Synthesized
  misc_feature (61): n=a or g
tcatgtgcttagttagagcgtgtatggagtcatcatgaatagaaccctgtttcacatcccnagctgctgcttctcattttattgatacaactataagctaatttatggctcatttagaagg

SEQ ID NO: 15237 - DNA, 121 bp, Artificial Sequence
  Synthesized
  misc_feature (61): n=a or c
taacatgaaaattaaattctcttctccggacaatagactctttcatctatgtcatctcttnggctgtgattttaaatactgcatcgaataatgtaatatgttcataaaactatatttcctt

SEQ ID NO: 15238 - DNA, 121 bp, Artificial Sequence
  Synthesized
  misc_feature (61): n=a or c
gaagctgtgagacaggcagaccacaagtgccagtgccagatgacagcctgctgtcaggcantgaaggatgctgaacagggtagccaagaatcaggtacttcgaacccagtcctgtaagtga

SEQ ID NO: 15239 - DNA, 121 bp, Artificial Sequence
  Synthesized
  misc_feature (61): n=a or g
tcctacagtgtcccttaatgtaaggtcataaccataaaaagctcataaacaaagttctggngtaaacattcagcacaacaattaaatctcctccagaaaaaaaaaaaaacaaactttaatt

SEQ ID NO: 15240 - DNA, 121 bp, Artificial Sequence
  Synthesized
  misc_feature (61): n=a or g
ttgttttccatatcagacatgtgactgaaaaaagtaatccaagagggataaaacataattntgagctatttgtgaataactaggtatctgaaggttatttgaatgacatcagtcacttgct

SEQ ID NO: 15241 - DNA, 121 bp, Artificial Sequence
  Synthesized
  misc_feature (61): n=a or g
caactcagtctcagctattaccatagaggataggaaacacctgtctcatctcagataaacnaagattttaaatcacaatttcatctcgtctacaaagctctacagcatcttaccatggtcc

SEQ ID NO: 15242 - DNA, 121 bp, Artificial Sequence
  Synthesized
  misc_feature (61): n=t or c
catgcttggaaaatgtgcctctcactatactttacctgtaattaacaccactgtcatagtnggaaagctatcatgcacatgcaccgtgtctgttgatacctccaacacaactaccttgttc

SEQ ID NO: 15243 - DNA, 121 bp, Artificial Sequence
  Synthesized
  misc_feature (61): n=t or c
cagcttgtaaacacatggtggaacatttctacacagacttcaaaaccacaaatgattttcncacaagatgagataaaagtactgagagaagcaactggtcagaatttactgggatgtttgt

SEQ ID NO: 15244 - DNA, 121 bp, Artificial Sequence
  Synthesized
  misc_feature (61): n=t or c
tcctaaactgtcatttgcttgccctccagccgagggaagttcagcatccagtaggaattangaaagctctgtgatgaatgctgaaagctctacagcaacatgcaaacatttaatatccctt

SEQ ID NO: 15245 - DNA, 121 bp, Artificial Sequence
  Synthesized
  misc_feature (61): n=a or g
agtaaataccttttttactaaaataaaagtaatgtaggctgatttaaagccttgtcttacngtagatttaactgcaggaacagcacagcatgtactgcagttaccgacattcattcagaga

SEQ ID NO: 15246 - DNA, 121 bp, Artificial Sequence
  Synthesized
  misc_feature (61): n=t or c
aaatccctgagcagaagggatgctgtcagttcctgggagtcaggctccagctcctgatgtncccactcaaatctacaggacaggaggcagcacaggagacaaccactgagcagtctacttg

SEQ ID NO: 15247 - DNA, 121 bp, Artificial Sequence
  Synthesized
  misc_feature (61): n=a or g
gtagctaccattttaaaaaacatgaatctattttgatctgatgttctgctttcacttcacngtatcacattgtttggtgtgttttagtacctgcagacgtgcagtattccagtccgttccc

SEQ ID NO: 15248 - DNA, 121 bp, Artificial Sequence
  Synthesized
  misc_feature (61): n=a or g
taagtgggtcttcatataaccgcacacagtaggacctagcattaatgatacaaagccgtgntaacagtagaggaagaattcctgtaagatgtagtggttatgcatgcatgtaatttctcac

SEQ ID NO: 15249 - DNA, 121 bp, Artificial Sequence
  Synthesized
  misc_feature (61): n=c or g
ttcctcaggtataccactgttaagaagttaggttttttgtaattgtcacagcaaaacactntttgaaagaggagtttaaagaggacttgaataaattgcatttccagaactccggctgtat

SEQ ID NO: 15250 - DNA, 121 bp, Artificial Sequence
  Synthesized
  misc_feature (61): n=a or t
agaacagcaaacaacacaacggttccacctgtgttttcccagctggttgctctcactcatntggaaaccaacccgctctctcaggacatcagctctccaacacatcttttcctcgtgtagc

SEQ ID NO: 15251 - DNA, 121 bp, Artificial Sequence
  Synthesized
  misc_feature (61): n=t or c
agagaaacaagtagaagcttgtgtgtgttagagagaatgatgcatgcatacacacgatatntatttacacttgacttaagagatgtcatttgaaaaatcataagatttcaaagacaggtta

SEQ ID NO: 15252 - DNA, 121 bp, Artificial Sequence
  Synthesized
  misc_feature (61): n=c or g
ggtgaagcttcccagcatgtttcaacacaggtttttagttctgtgcaagaaagagggtcangatcagacagaacaagatggagatggagtgagaagagggctgggggtcctgggctttcct

SEQ ID NO: 15253 - DNA, 121 bp, Artificial Sequence
  Synthesized
  misc_feature (61): n=a or g
aaggaggtgaaggcaagctcccagcgaactaacagcctccacagatgatcctttatgaacnttttgcattcggtgtactttcccttaaggcagcgtgatgtatcccatcacacacgtgtat

SEQ ID NO: 15254 - DNA, 121 bp, Artificial Sequence
  Synthesized
  misc_feature (61): n=a or g
atgcgcacagctgatgaaatattcatgctttcatgaggaatgcagtagagagcgtgacccnggaatcaccgctaagtaccacagtatgacaaatgctctcagtcacatggcagtcttctca

SEQ ID NO: 15255 - DNA, 121 bp, Artificial Sequence
  Synthesized
  misc_feature (61): n=a or g
aagcaccaggtaagtaatgcaaataaagcaaacattgcatggtgaaagcctatttctttgnactggtttaatgaagattctctacccattactgttatacatatgtataatcaacaaatag

SEQ ID NO: 15256 - DNA, 121 bp, Artificial Sequence
  Synthesized
  misc_feature (61): n=a or g
atggcaacctgctttagctgaccctttattttagcatcatggttggactagctgctctccngtggtgctttccaaaatcagctattgtgtgaaactgtgattctgtattaagtgtgaagag

SEQ ID NO: 15257 - DNA, 121 bp, Artificial Sequence
  Synthesized
  misc_feature (61): n=a or c
tcccatccctctcccagccgtatcacctgcacatggagaggaacttcccctgccacagtcnatatctttctggcatccaggtgagcaggcccaaggggaacccagaaaactcatcaggcct

SEQ ID NO: 15258 - DNA, 121 bp, Artificial Sequence
  Synthesized
  misc_feature (61): n=a or g
tttccttgtgcagtcaaaaccccctctgaattttgtgttgtttgggccttccagaatgccncttttgccccagaactcgttaattgtacttttccttttgtgtgaaatttccttgactgcc

SEQ ID NO: 15259 - DNA, 121 bp, Artificial Sequence
  Synthesized
  misc_feature (61): n=t or c
ggactctgctccactttatacgaatagtcaaatgctcactgtccaaagatgatggctgttnttcagaagtatagggcaacagagtgcaatatgggaaattctgtgtgtaaggggagcttgt

SEQ ID NO: 15260 - DNA, 121 bp, Artificial Sequence
  Synthesized
  misc_feature (61): n=a or g
actggtaacactgttagcattattcttgttagctggtagctctgctgtggtagtttttcantgcttagagcagcaaaatgaggccagcataccaacactgtggcacttgctctaattactc

SEQ ID NO: 15261 - DNA, 121 bp, Artificial Sequence
  Synthesized
  misc_feature (61): n=t or c
aatgaggctacatctcacttgcttcctctaggtagactggtcttgttcatacagcacaacncttagcctgaagttcctgtgggtcttacttggcctgccttaaaatgaagagtgaaaaagg

SEQ ID NO: 15262 - DNA, 121 bp, Artificial Sequence
  Synthesized
  misc_feature (61): n=a or g
gtttagttctgaatctttcagtccataaccatgaaggttttgcaacacagagaatggagangctaaacagtcagtaaagcctttccctttcgctatgctgttacaagttacattgtgacca

SEQ ID NO: 15263 - DNA, 121 bp, Artificial Sequence
  Synthesized
  misc_feature (61): n=c or g
attggggttccctcacttgccattgtacatctgttctttctgcacgaagatgaactttctntcatatagcataatgcgcaccaatgcttatctgcttcacatgaatgtttctcccaggcat

SEQ ID NO: 15264 - DNA, 121 bp, Artificial Sequence
  Synthesized
  misc_feature (61): n=a or g
gctcttctgtgcacactgcaagaaatatctgctcaatgagtgcttggtaatatacttcccntgaagcagaagtgcagcaaagcttttgtaacttctttaagatcctgtatgatattcacct

SEQ ID NO: 15265 - DNA, 121 bp, Artificial Sequence
  Synthesized
  misc_feature (61): n=a or g
ggctgcgtttacaaaacttggccctttttcctaacaaaacgtcctgtttctctcagcccangcagacccttccttccatgacctcagcaaagctccccaacaaaaaccctccctgaaacac

SEQ ID NO: 15266 - DNA, 121 bp, Artificial Sequence
  Synthesized
  misc_feature (61): n=t or g
ttcatgatagccttttcagtgattctgatagcttttgttttttgttgcagtgtaactgccnttgtatgtcattcactttagtacgtcatagtctccaggataaaacagtaagttcaacaaa

SEQ ID NO: 15267 - DNA, 121 bp, Artificial Sequence
  Synthesized
  misc_feature (61): n=t or g
aatggccatgcttcagctgggagctccacagagctgtatgagatcttgtacaccacaccancactatttgttcttgcctactccaggactgtgcagcaaaacaggattctgctcttccagc

SEQ ID NO: 15268 - DNA, 121 bp, Artificial Sequence
  Synthesized
  misc_feature (61): n=t or c
atgcatggacagggaactgtaaggaaacatcccttctaagcctcttcccttctcagccaangtctaacccatcgcacaggggtgcacttcaggtatacgttgctggtcagtcattgctgca

SEQ ID NO: 15269 - DNA, 121 bp, Artificial Sequence
  Synthesized
  misc_feature (61): n=t or c
tgagacccccacaaatcatccccaacgtcctataaggctgagacccccaatgtccctccanacagtgccattaagcagagcccccccaagcccctaccatgatcccatagagcagagtctc

SEQ ID NO: 15270 - DNA, 121 bp, Artificial Sequence
  Synthesized
  misc_feature (61): n=a or g
gctgtcagaggagttgctaagcatcaaagaattcataagaaagacactgattattaaaccnaaaagctgatggtagcagttagaacacatggtcttgcttgctcgtggagttactgccccc

SEQ ID NO: 15271 - DNA, 121 bp, Artificial Sequence
  Synthesized
  misc_feature (61): n=a or g
ggcaggaacacctgatctgtatcactgaacctgtgttctgagtcatccacatccactgttntgtggatcagactttttgcctacataattccagagaagctctgaaacaccctggctcttc

SEQ ID NO: 15272 - DNA, 121 bp, Artificial Sequence
  Synthesized
  misc_feature (61): n=t or g
tctccaccataagctgcaagcttacaggaaaccagtggcttactacaacataagtacaatnaaacactttacattataatgtttaagatccaagaaagttctgcaaaattaaattgagtga

SEQ ID NO: 15273 - DNA, 121 bp, Artificial Sequence
  Synthesized
  misc_feature (61): n=t or g
acagaagctgacaccctttttgtgtcccaaataaaccagaatacaccaatacttactatgntttttttctccaaagctctaattgtcgagtatttaactcaaccctgagcagctgctcact

SEQ ID NO: 15274 - DNA, 121 bp, Artificial Sequence
  Synthesized
  misc_feature (61): n=t or g
ctgtattacaaaggccacttgcttgtattaaacactgcatgtaatctggttcaagaggccntggggacaccagaaataattcagatctcccactcaggagcattagttttgtgactgtgaa

SEQ ID NO: 15275 - DNA, 121 bp, Artificial Sequence
  Synthesized
  misc_feature (61): n=a or g
ctgaattcttggatccacggaagagtaaacatgtgttgcatattcttgtctcctcttgccntacttttttccggagatgcacagaaaaacctcttctgtctgactctgttttgctcacctg

SEQ ID NO: 15276 - DNA, 121 bp, Artificial Sequence
  Synthesized
  misc_feature (61): n=t or c
atctccggtttgctgggttttgggagtctgagatggaagtcctgcagtccctttgtggaangtgtggtttgctcagtgtgaaggcattgtgcttcttgctgcctgtccaagggtttgatcc

SEQ ID NO: 15277 - DNA, 121 bp, Artificial Sequence
  Synthesized
  misc_feature (61): n=a or t
aagaagaaggggaaaataaaggtgaaaagcacttatttcaagagctatactcactctgacngtgacttcagctgtgtcttgacaaaaattgatgccagatattcacgctaccattcatttg

SEQ ID NO: 15278 - DNA, 121 bp, Artificial Sequence
  Synthesized
  misc_feature (61): n=a or g
ttattctgtcctctgcaagctctccttggaatctcagcagggtccctgcaagtttccaccnttcttgtcaacccccactttgtgaggtggaacaagcctgtgtcagcagcactgtgaggag

SEQ ID NO: 15279 - DNA, 121 bp, Artificial Sequence
  Synthesized
  misc_feature (61): n=t or g
ctggaggcaggatcataagcacgtctgtgcctgataatgcagaaaaatacattttgttagnttctctagtgaagagagacaacaacacttctgagaaagtgaagaggactgcaggctgaaa

SEQ ID NO: 15280 - DNA, 121 bp, Artificial Sequence
  Synthesized
  misc_feature (61): n=t or c
gaaaaagcgttgggaatctgtgaggtagttctgctactttaactttctaccttcagcaatnggtagcagagggatctgccctcctgaatcagagtttctgtctatctgttcctttgttcaa

SEQ ID NO: 15281 - DNA, 121 bp, Artificial Sequence
  Synthesized
  misc_feature (61): n=a or g
tcagtcatggatcctctcttagaggggcacacaatcagtcttggaagacagtactgggttntaatatggccaagctacgggtgagcgttggtgcattgtgcatccaaagtgcagctgaggt

SEQ ID NO: 15282 - DNA, 121 bp, Artificial Sequence
  Synthesized
  misc_feature (61): n=a or g
tctctgaaaactcattaacttcccctggcaacagttatgctcgttgcttaattgctactcntgattaaaccaggccgtgtgttaaaactttacagctacgaagtccttggaactgggcagg

SEQ ID NO: 15283 - DNA, 121 bp, Artificial Sequence
  Synthesized
  misc_feature (61): n=t or c
ttaaattaaaatgaaggacccctggattgctacatcataaatatctacaataggtttacangataagattcagcaccatattcagactcttgtgtttgtctatacatatttaactatacat

SEQ ID NO: 15284 - DNA, 121 bp, Artificial Sequence
  Synthesized
  misc_feature (61): n=a or g
accccacacaacacccggcgaccaacacggtggtgttggagggtcccggccctgctgtgcntggctcccattcttccacaggtgccttctttgggatttcccccttgtctcactctttcca

SEQ ID NO: 15285 - DNA, 121 bp, Artificial Sequence
  Synthesized
  misc_feature (61): n=a or g
atgacctgcactgaaaagcaagccataatctgtttgggatgaagacgttcaataggcagcntgcatccccagcacatactttgttcccagaaagcccttagttggaatggcaggtatgcat

SEQ ID NO: 15286 - DNA, 121 bp, Artificial Sequence
  Synthesized
  misc_feature (61): n=a or g
ataaaccactcccatattagtccaagatcagaactacataagaaaagacaacatcttaacntctgaaagcacagacaaataagtcagcatggctcataccatacttccagctgtactgcgt

SEQ ID NO: 15287 - DNA, 121 bp, Artificial Sequence
  Synthesized
  misc_feature (61): n=t or g
agtattgcagatcactgctgaacctctgcagtcttcaatgaatatgtcaacaggaacaaantggggctgcgtatgtaactccagttctgacccttatgaacttctgggtgtaagctgtgta

SEQ ID NO: 15288 - DNA, 121 bp, Artificial Sequence
  Synthesized
  misc_feature (61): n=a or c
tttgctgcagtatgagataactacattcttgcctttgccgttgaaattgtttgcactattnaactctactcaaatgtgaagcttaagcgaacaactgtatagtgtacaaaacagaaggttt

SEQ ID NO: 15289 - DNA, 121 bp, Artificial Sequence
  Synthesized
  misc_feature (61): n=a or g
ttttttgctgagtctatagccacatatgctgagagaacatgaaaggagaagtgctcttgcntatgtattttgtaaacattgtgctacacaaatacatgtttctgcacaacgtagtataaga

SEQ ID NO: 15290 - DNA, 121 bp, Artificial Sequence
  Synthesized
  misc_feature (61): n=t or c
gcaattctccatattccttttcttggctataagctgtgatctcaggctgtggtcccttcanaggttaaacttctgtgaattgtagataacgagaggtcctcatgaaaacgagacaacaaga

SEQ ID NO: 15291 - DNA, 121 bp, Artificial Sequence
  Synthesized
  misc_feature (61): n=t or c
gacacagatctgcaaaaggtaggccaatggaaataatagggtaaatatgtattacaatttngtagctaactagatatgaaaggttgtaaaagtgactatatcccattgctagtcagttcac

SEQ ID NO: 15292 - DNA, 121 bp, Artificial Sequence
  Synthesized
  misc_feature (61): n=a or g
cccccccccccccccccccctgcttttttttagaagactgtcctaattgtttttcctcaantaaaatcacaaccaagaaagactcaaaatagctggttcctatgagtatgaaaagacattc

SEQ ID NO: 15293 - DNA, 121 bp, Artificial Sequence
  Synthesized
  misc_feature (61): n=a or g
ctttctgaactttctgatttatgccaatataagtgagatccactcctgaaaactatttagncagtaaactcttcctcttgaattagtaagattccactagctaaacagtagtttgttttct

SEQ ID NO: 15294 - DNA, 121 bp, Artificial Sequence
  Synthesized
  misc_feature (61): n=t or c
acttaatttttcatatgatgcagcattgtgaagtcagtttattgtttccaggagattgatnaggaacatttctgtgagcagacttgattttgatatttgagttatgtcaggttgctctgaa

SEQ ID NO: 15295 - DNA, 121 bp, Artificial Sequence
  Synthesized
  misc_feature (61): n=t or g
ttgatgccatatcagagtacttaatgttcacgttgtgaggcaaaggcacttctaagaaagnctgatggataatgaacaagaattccctcaacagctgtgtgggaaaagtgcatctacccaa

SEQ ID NO: 15296 - DNA, 121 bp, Artificial Sequence
  Synthesized
  misc_feature (61): n=c or g
tgttatggccaggaactgcatactgctgggatgataaatatactaaagaaatttatattanggaagacatgaaaaggtagttacagttttaaagctaaatatttaaggtattcttcataaa

SEQ ID NO: 15297 - DNA, 121 bp, Artificial Sequence
  Synthesized
  misc_feature (61): n=t or g
agaagcacacaggttgctaaatcacctgaaacagagaaatctcactgcgtggctctgactntgcatcatgtgtggttggttgagatggtgctgggagggagcagagctgccctgcaggaag

SEQ ID NO: 15298 - DNA, 121 bp, Artificial Sequence
  Synthesized
  misc_feature (61): n=a or g
tttcctggatagttgatcactcccggcaaaggcacagcaaacgtggtgatcatactggtgntatacatctgacatcatctcacagtctttggcttctggagagaagaaaaggacctcagct

SEQ ID NO: 15299 - DNA, 121 bp, Artificial Sequence
  Synthesized
  misc_feature (61): n=t or c
tccagattgagcaggagagcaaattcctgctggaagcactgggcttcttcccaaagaaggnggaggtgatgctggctctggaagtcccagtgggtttccctgcccagccactgccgggatg

SEQ ID NO: 15300 - DNA, 121 bp, Artificial Sequence
  Synthesized
  misc_feature (61): n=a or g
gggtgggaaaaagtgaatagaaaaagggagattcttgaatcactggcaatcacaatccatnggaaagctgacaaagtaatctaaggttttgcagggtcagggttaggagaacagtgcaggg

SEQ ID NO: 15301 - DNA, 121 bp, Artificial Sequence
  Synthesized
  misc_feature (61): n=t or c
ctggtgactttgatatgctgagaattacttgcatttagcaagtgttctcttatttgttggnaacccagaattgctgtttaacttattctccactgtgcttaatagaaacgtctttgaacct

SEQ ID NO: 15302 - DNA, 121 bp, Artificial Sequence
  Synthesized
  misc_feature (61): n=a or g
tcacctagtttgagaacttgagtattttctattatgtcatactcgttatgaactgcaggcnactgttcacctattgctaaatggccatcttcaatatgtgtataaagtgcaagtctggtgg

SEQ ID NO: 15303 - DNA, 121 bp, Artificial Sequence
  Synthesized
  misc_feature (61): n=a or g
tttgagcttatcatttaatccataatgagacatggtaaatggattttagaggagtattcanatttgacacgtgtatcttagcatctgtcaaaggcttagccatattgttggctatatttaa

SEQ ID NO: 15304 - DNA, 121 bp, Artificial Sequence
  Synthesized
  misc_feature (61): n=a or g
tcccattccatagcgtaaaatggataatgatatgccctagtggccttaattctacattcancactccagggcattcctcatgccctaaatggatcccactgaccagttcttggctataaca

SEQ ID NO: 15305 - DNA, 121 bp, Artificial Sequence
  Synthesized
  misc_feature (61): n=t or c
agagtcagtgcgtttctgtagttcagcatagtggtaagggaaatgttgctgcttgggatanttgataaataagaggtgaaccaaagttacttcagctcattaacaacatcataaaacagac

SEQ ID NO: 15306 - DNA, 121 bp, Artificial Sequence
  Synthesized
  misc_feature (61): n=c or g
caccttctgggtttcacccaaagatgggtgccactaacaaacatgggcttggatcttgccntgaattctacacaacctttcaggacacaatagaaatctcccctccattctgtccagaacc

SEQ ID NO: 15307 - DNA, 121 bp, Artificial Sequence
  Synthesized
  misc_feature (61): n=a or g
catttcacagtgaaagcagatgaaatggagccttaaatttcttgcaggctttggtgcatcngagctgagagctgctgtggagtgtgcagtgagctgcctgcactccagcagactgagcatg

SEQ ID NO: 15308 - DNA, 121 bp, Artificial Sequence
  Synthesized
  misc_feature (61): n=t or c
aaagtcccaggataactcagattctccacaaggtttcccaactgactacatcaacagcttncccttctcctgccatgttttgtgaacttcccatggcagctgccatgcagaccaatgaggt

SEQ ID NO: 15309 - DNA, 121 bp, Artificial Sequence
  Synthesized
  misc_feature (61): n=t or g
acactcactatgctcctaccaggaaatctgacttaaaccttaacagtcacttaatcaaaancacattatgctaccaaatgttgccagagaagaggcctcttgccacatctcttgcttgttt

SEQ ID NO: 15310 - DNA, 121 bp, Artificial Sequence
  Synthesized
  misc_feature (61): n=t or c
ttcatacagctctgaaaatgcacttcacctgacaccaggaaggtgttggacttacttgccngtacgatcaggtataacaaatttgatgagcaaataaagagctgatatcattgcatggttt

SEQ ID NO: 15311 - DNA, 121 bp, Artificial Sequence
  Synthesized
  misc_feature (61): n=a or t
caggctgagttttcattcttcctgatatcttctgctcttgtacagaaaagttcaaggaagncactatcacattgtacttcttactggtttggggtatcttgtcctatctactagtggattc

SEQ ID NO: 15312 - DNA, 121 bp, Artificial Sequence
  Synthesized
  misc_feature (61): n=a or g
cgaggaagaggagagcctactttttttctcacatgtaaagccttcttcctggttcaaacancatcttcctaatcataggaaaattactgggactcttctggggcagcacttaaaacgaata

SEQ ID NO: 15313 - DNA, 121 bp, Artificial Sequence
  Synthesized
  misc_feature (61): n=c or g
gggagaaatctgtggtcaacacaatcagtaaacaaaacaatgttactcagcctcaagtaanttcttaggtgctgttgttgatgtgagatcaattagtttattgtagtgttataggaggatg

SEQ ID NO: 15314 - DNA, 121 bp, Artificial Sequence
  Synthesized
  misc_feature (61): n=t or g
tttggctattaattacctggcaaaggactgtaaggaatgtatgaggaactgaataaatcgnctgggaaaatgctgtactagaaatcagccagtgctaatattgcccatttcagacgatagg

SEQ ID NO: 15315 - DNA, 121 bp, Artificial Sequence
  Synthesized
  misc_feature (61): n=a or g
aggtcacttattgtgaggctggctatgaaatgcaagagaggattccagaacaaaattcagnatttgatgtgaggggatagataaacccagatgactgcaaaacgcatgaacatgtgtgaat

SEQ ID NO: 15316 - DNA, 121 bp, Artificial Sequence
  Synthesized
  misc_feature (61): n=t or c
tgtggttgctctgagcattgtgacagaccctgttgtcactccaaccctcatggtgagcccngaggttgctcctgttatggatcccgtgtctgtttcatgcactgtgatgagaaaaaagaaa

SEQ ID NO: 15317 - DNA, 121 bp, Artificial Sequence
  Synthesized
  misc_feature (61): n=t or c
agcactctcctccccataatcacagccacactgcaaacatgatgctctaccttttctgcangttgcctgaagcagacaaactctgcctagtttgcatctaggtaatggtgcgtgctgagat

SEQ ID NO: 15318 - DNA, 121 bp, Artificial Sequence
  Synthesized
  misc_feature (61): n=a or g
gtcaagccgtaagtcaacaaatcaacttcctctaataaagtgtcatcacagaccacaaaancactgctgtcatcaaacaaagcatcccaggtatcatcttcctgttaaagagaatggacta

SEQ ID NO: 15319 - DNA, 121 bp, Artificial Sequence
  Synthesized
  misc_feature (61): n=a or g
caaagcatgctttatttcctcatgtaatctcacatcacagcacattctgctctaacgaccnaacgtgcttgcaggcgtttgtttagcacaaagttcattctgcaaaagcacggtgcttttg

SEQ ID NO: 15320 - DNA, 121 bp, Artificial Sequence
  Synthesized
  misc_feature (61): n=a or g
tttttttgtaatcccaagaacattgttggcagtgaggaatctataactggacattttctcnccactataagaaaacttactcatggcaaactggaaaacagaactctaaaataaatataag

SEQ ID NO: 15321 - DNA, 121 bp, Artificial Sequence
  Synthesized
  misc_feature (61): n=c or g
tggtaagtattacagcacagaggagagcagtgctgacgctgacggtgtgctgctaagaagncccctatttcggctgtcaccttccccaaaccgggccttcccaccccaaccccaaccaaat

SEQ ID NO: 15322 - DNA, 121 bp, Artificial Sequence
  Synthesized
  misc_feature (61): n=a or g
atcagcgagtccaggggaaaacaggaacatgcaccagatatgtacagtgataacaaccgtnaaggtgcaatgtagaagaggcaagtttagctccatggtgtggtcctcttgctgagtgcgt

SEQ ID NO: 15323 - DNA, 121 bp, Artificial Sequence
  Synthesized
  misc_feature (61): n=t or c
taatggaaaaatactatggatagagacctgcaaccataacaccactatttccctgactcangatatccagaatatgccatacatcatctaaacaggtcttggggtttattctcataaaaca

SEQ ID NO: 15324 - DNA, 121 bp, Artificial Sequence
  Synthesized
  misc_feature (61): n=a or g
taaaaacatctaaataattatagtgttcatgtgggcaaatttcagaaaagataaataccantgctacatatatgctgtacttagaatatttttaccttctaaagaaggagccaaaaaagga

SEQ ID NO: 15325 - DNA, 121 bp, Artificial Sequence
  Synthesized
  misc_feature (61): n=c or g
gatactgggtgtagttcagctctgaatctaggcgtagcagcaggcagtagtgcaagtcagnaggtccattctgagccagaactgaggatgtgctatgggaaatcaaacacttggttctggg

SEQ ID NO: 15326 - DNA, 121 bp, Artificial Sequence
  Synthesized
  misc_feature (61): n=a or g
acaatcatagtggggcctaaaaatgagtgctgaactttacttctgaaacaccactgccacnaagttaacttaaaattgatctccagatgttagaaatgcctgttgtgctatgggaatcagt

SEQ ID NO: 15327 - DNA, 121 bp, Artificial Sequence
  Synthesized
  misc_feature (61): n=t or c
actcggctgcactttccaaaagctattttcagcctatggatcccaaacaactcattccttnctccctccaaattttagcatagattattaaagcgctttccccgcagtctctgtccgccag

SEQ ID NO: 15328 - DNA, 121 bp, Artificial Sequence
  Synthesized
  misc_feature (61): n=a or g
tttcgctcactggcctgggaaggtatacagcagttgaacttgctaagagcagtacagagancagcctgtgctgggctttgcagctcttccaactgaagacagtgagaatcactagtaattg

SEQ ID NO: 15329 - DNA, 121 bp, Artificial Sequence
  Synthesized
  misc_feature (61): n=c or g
atattaataacattctatctccagatagtacattcagttctgaaagatgatcagccactgnagaagtatggcaagtgtccattcactagtcctgaagaattgtgatttaacttgtttagca

SEQ ID NO: 15330 - DNA, 121 bp, Artificial Sequence
  Synthesized
  misc_feature (61): n=a or g
tggtctcaaacagctgtggaggctatctgcatgaaaacggacagttggcacgatgttcctnccatgcaaaaatctgccagtaagtacactgcaaagacttttgatctcctgtaatgtagtg

SEQ ID NO: 15331 - DNA, 121 bp, Artificial Sequence
  Synthesized
  misc_feature (61): n=t or c
ggattacaaatgccagaactcaagcttctgtattgcacagttcaccagctggtggacaggnctggctgagtaacaaagcattaatgtttatggtcgcaagagcaaggagctgggctagatg

SEQ ID NO: 15332 - DNA, 121 bp, Artificial Sequence
  Synthesized
  misc_feature (61): n=a or g
ctgtaattaatttaaattatgttcttagatatatattttctgaatgcaaaacattgccctntcactgcattccatttagttaattgaggatagttcacgcattaaaaataattttaagata

SEQ ID NO: 15333 - DNA, 121 bp, Artificial Sequence
  Synthesized
  misc_feature (61): n=t or c
taaatttctagttaaacaggaaacttagcttaaaattttgtattctctgcagtctcctgcngcttggtgtccagcccagaagtaagctgttcagaggagatacttgttttctgtgagtgat

SEQ ID NO: 15334 - DNA, 121 bp, Artificial Sequence
  Synthesized
  misc_feature (61): n=a or c
caaaatgatctggcaatggaagcctaggtggaactgcctacactaacaacttctccagagnaaaacagacacttcacagcttttctatttctcttaaggtgattcagagcttgaaaggaag

SEQ ID NO: 15335 - DNA, 121 bp, Artificial Sequence
  Synthesized
  misc_feature (61): n=t or c
agcccctaaacccaccattcttctgggtgcagatcagcccagtaaatggcatgtaggtctnagtgtccctaagttgttcgagtgacaggagggcccccagataaggcaagctgctcaaaat

SEQ ID NO: 15336 - DNA, 121 bp, Artificial Sequence
  Synthesized
  misc_feature (61): n=t or c
caaattatttggatcactttgctttactcttcaatcacctgtttctttactgttagtcaanagtctcattttcgtgtatcatttgcatttgcgcacgtacatatttactgaactgcattgt

SEQ ID NO: 15337 - DNA, 121 bp, Artificial Sequence
  Synthesized
  misc_feature (61): n=t or c
gagcagcagcatacatgtgtctggactacatcagtctctggaagctatccacgtgtaatgntttatggcatagaactccagtgcttataaggtctgctaaggtcactgactcacagaggtc

SEQ ID NO: 15338 - DNA, 121 bp, Artificial Sequence
  Synthesized
  misc_feature (61): n=t or c
aggtacaataaggtttatagaacttaaaggtttacaattccatgctagttaatcaacgttnagatgttctttcagttgccacgcaacacaatattttaaacagaactcatcattacaaata

SEQ ID NO: 15339 - DNA, 121 bp, Artificial Sequence
  Synthesized
  misc_feature (61): n=a or g
cttttacagctagaaaatgaaaatgcaattgcagatagtgtatagacctcctttcacaagntaggaacactagagcatttgactttcaagcagaggagcttgctgttgtcactaaatgtga

SEQ ID NO: 15340 - DNA, 121 bp, Artificial Sequence
  Synthesized
  misc_feature (61): n=t or c
agcagtaaggtatcagttcaaaaaattcacaagagatttcctatgcacttggaaacatgancactaaagcaataaccccggtgagttcagatgaaatatagctgggatagaaaaaaaaaac

SEQ ID NO: 15341 - DNA, 121 bp, Artificial Sequence
  Synthesized
  misc_feature (61): n=t or c
gaagagagttgtattctgaaattctgcaactcttctttcactgggaagcacaatcaattcnttagctcttctgtctatacatttcccattgaaatattgattgcagattataccaaggaat

SEQ ID NO: 15342 - DNA, 121 bp, Artificial Sequence
  Synthesized
  misc_feature (61): n=c or g
cacacacacaaaaaaaatgtacttataaagcatcagtgaatcatgaacatcatttagatanaagtaatcagactttttggggcttgcttatatttggtatttgtaacaagctggttcttta

SEQ ID NO: 15343 - DNA, 121 bp, Artificial Sequence
  Synthesized
  misc_feature (61): n=a or t
ccctattttctaacagtggtacttaagatcagtgtatgcagtctgtattcaacatcaatgntactgttaaagttttgagaagaagtttgtgtggacagcaaagtcccttttgattattttt

SEQ ID NO: 15344 - DNA, 121 bp, Artificial Sequence
  Synthesized
  misc_feature (61): n=a or g
gccatcagccatgttccaagcccatgccactagtgttgcactcctaacaccagctgtgccnccatgctatagctgttagatgttctgccatgttgcacttttaaaaatgtgcgacttctgc

SEQ ID NO: 15345 - DNA, 121 bp, Artificial Sequence
  Synthesized
  misc_feature (61): n=t or c
gcccttaaagatcccttccaaaccaagccattctgtaattctagggcctttcaggaccacncttttctctaagcaatgcatatattatgagtgagcatctataccctgaagaaagttcaga

SEQ ID NO: 15346 - DNA, 121 bp, Artificial Sequence
  Synthesized
  misc_feature (61): n=t or c
ctccacagtacctccgcacttaaacagagcaagttgtactcggtgcacagcctgcttgtgnccgctgtccctgtttgcatggaatggacagcccagcacaggaggggcttggagggtgagc

SEQ ID NO: 15347 - DNA, 121 bp, Artificial Sequence
  Synthesized
  misc_feature (61): n=t or c
ggagagtgtcttgtttgcaaatgtatggatgtagttattgtagaaacacggatttgacagnacgatggaaatgtgttggttactaacctggataaatggtggaactgtatttaaaggtgat

SEQ ID NO: 15348 - DNA, 121 bp, Artificial Sequence
  Synthesized
  misc_feature (61): n=a or c
tctcttcttcttcttcttctttttttttttttttttttttgtctataaggtaattaactgntaccattgttttgtagaactgggagctgagaatgtgggaagcatcacttctgtatcagtt

SEQ ID NO: 15349 - DNA, 121 bp, Artificial Sequence
  Synthesized
  misc_feature (61): n=t or c
ctgccaccgcccatcaaacaaacaggataccctgggcctgaagcagtgtaataccccactnaaaattcattctcctgctccagtttagattcatttccagcagctctgcctgaaaatatcc

SEQ ID NO: 15350 - DNA, 121 bp, Artificial Sequence
  Synthesized
  misc_feature (61): n=a or g
gttcattttctcaaacagacatagattaactagtaggaaggttacagtttccctgaacaancagttacctctgtctccattgtttcctttggtatcttcaatggactccaggcagtctata

SEQ ID NO: 15351 - DNA, 121 bp, Artificial Sequence
  Synthesized
  misc_feature (61): n=t or c
cttttggagctatgaggttggtgtagaatgggaagatccactggggacatggctggaacangcagtccatgtcacaggatgctgagctctatcctgcaggtgatggagagctattcccagc

SEQ ID NO: 15352 - DNA, 121 bp, Artificial Sequence
  Synthesized
  misc_feature (61): n=a or g
aaaacagcttccaaaagtatgtttcgaacaaacgtaagaggacaaatcaaaaatgtccacnctaacaaaacaaagactataagcaaaactacaaaatgtttaacaaatagcatgaaaaatc

SEQ ID NO: 15353 - DNA, 121 bp, Artificial Sequence
  Synthesized
  misc_feature (61): n=a or t
tctcctaaataccacatagggctggccagacaacaaagaacttctctcagccttatctccntcaaactcaggatttttctaaggtgtactcggtctccagactaagtatcattgcctggca

SEQ ID NO: 15354 - DNA, 121 bp, Artificial Sequence
  Synthesized
  misc_feature (61): n=a or g
tcctattgtttactaaatctcagcagaaacactacagagtctgtacactgcaggaagcacngggaagtcaaatgtacctgcggtgggtcaatctgctctcagatatgggcagaagagcagg

SEQ ID NO: 15355 - DNA, 121 bp, Artificial Sequence
  Synthesized
  misc_feature (61): n=t or c
ctgagtgtgggccactgagtttcaatagtaaattagttaagcagatgactgggtacctaantggttaattattccactgtaccagtatccccccccacttggaagaaactcagtcaccatc

SEQ ID NO: 15356 - DNA, 121 bp, Artificial Sequence
  Synthesized
  misc_feature (61): n=a or g
agaagaaaggtatgtggatacacacagtatagcatgcaactatacagtctctattactacngttgctaattaaagcgtagggataaatggaaatttttatttatccaggcctttatctcag

SEQ ID NO: 15357 - DNA, 121 bp, Artificial Sequence
  Synthesized
  misc_feature (61): n=a or g
gtttttttccactaattttgaagtcttaccccctatggctacatgcaagacagatgaggangtgaaccgtgtgtgaaggcgtatggagatgttccagtaaatttggaataacagccagctc

SEQ ID NO: 15358 - DNA, 121 bp, Artificial Sequence
  Synthesized
  misc_feature (61): n=a or g
ctattgcttgtctcctgagaaaagagatcaacacccatcctgcttcatcccccttttaagnagccatagaaaagagaagaatctctcctcagcttcctcagagtaaacaaacctaattcct

SEQ ID NO: 15359 - DNA, 121 bp, Artificial Sequence
  Synthesized
  misc_feature (61): n=t or c
tggagttaggaagcccagtttacaagcacagtgtgttatataaactgacccaaggcactgnggaggccaccagtaatctccttctgaccacacagcagcttctaaatgaagttgatttcaa

SEQ ID NO: 15360 - DNA, 121 bp, Artificial Sequence
  Synthesized
  misc_feature (61): n=t or c
ttttgtttataatttagccataattggtacatttgtcaactaaactatttaggatacattnggaatccagaggaagcaatctatacttagggcagcattcactttgtgccaacaaatgcat

SEQ ID NO: 15361 - DNA, 121 bp, Artificial Sequence
  Synthesized
  misc_feature (61): n=a or c
tccctcttcttccacttcctaactatttcttctgcaaatttcaacatcattcctagcattncactttacagagtagatatttgggctgcagatatttaaaaaaccctcctatccagagaat

SEQ ID NO: 15362 - DNA, 121 bp, Artificial Sequence
  Synthesized
  misc_feature (61): n=a or t
tttagagaaagaaaaacaagtggggatgataaactgtgaagttttatggccaaaacacgtnattttctcctgtggctcatttaagttttgattatctttctacctgtcttgtatgttttca

SEQ ID NO: 15363 - DNA, 121 bp, Artificial Sequence
  Synthesized
  misc_feature (61): n=a or g
acttccttctaccctacagccactttttctgtctcattcagactctgttgactggagattntgtgtattaccatctgatagctgttatcctcctatcctttctagagcttcttgggattct

SEQ ID NO: 15364 - DNA, 121 bp, Artificial Sequence
  Synthesized
  misc_feature (61): n=c or g
aatggaaagaacacgtaatctcatccatggagtgctctaggggaattcagaaatcaaggtnagcaaagtgtgtggtcatctacagatctacggggtttgaagagtgccacgtaactttaaa

SEQ ID NO: 15365 - DNA, 121 bp, Artificial Sequence
  Synthesized
  misc_feature (61): n=a or g
atatactgtactacccttggagttcaagggatttgaaagaagccatgcatgtaaaggaatngacaggaaggattgcattgtccactaatgcttctctaatttaaaaaagttaacctgaaaa

SEQ ID NO: 15366 - DNA, 121 bp, Artificial Sequence
  Synthesized
  misc_feature (61): n=t or g
taaagggatgctaacaataagtgaataaaaggcagtagagttctgggctcttaaatttctnctacaaaagcatatctctaaatccaaatcaatgcgtctaataaaatcacatctagaatct

SEQ ID NO: 15367 - DNA, 121 bp, Artificial Sequence
  Synthesized
  misc_feature (61): n=a or g
cagtagaagaggtataaaatcaagtcagaatgctacaagtataaagcaaaacgcttatgtnttggttgcattaattggtaagaaagtcaagctgaatctacccatctctttgcttcagaaa

SEQ ID NO: 15368 - DNA, 121 bp, Artificial Sequence
  Synthesized
  misc_feature (61): n=a or g
agccccgctcgtcctgaaatcctgcccagcttgggaaccagggctcacttctccctgctgngcagccctgtttgctcacagtttcccctcaacctttgcaggctgtttcaggaagcagcac

SEQ ID NO: 15369 - DNA, 121 bp, Artificial Sequence
  Synthesized
  misc_feature (61): n=a or c
ctttcgtagtggaaaggatactgacactggccattggcaggaaagttcaaattacactatnatttttaaccatataggcctgttttcccaatatttccctgtgaataaatagcaggagtag

SEQ ID NO: 15370 - DNA, 121 bp, Artificial Sequence
  Synthesized
  misc_feature (61): n=a or g
acagtcggtttaatcttgcaatcagaaggctttgtccttctcacagcatgttcttgattantataaactaataattacaagcactagagcatgcagaattgtaacaacacaagtgattgac

SEQ ID NO: 15371 - DNA, 121 bp, Artificial Sequence
  Synthesized
  misc_feature (61): n=t or c
gaggcatctcccctgcttccattgggggaagggaggggaaaacccgttggtatcacccatnggtgcccaccatgcatctgagcgccgcagcgaggcagaaggaacgcaggagcgccgtgtg

SEQ ID NO: 15372 - DNA, 121 bp, Artificial Sequence
  Synthesized
  misc_feature (61): n=a or g
gcctatggccaaattgtgatgttaatgtatagttgtatattgtgttagatggggagctttnctgctcaagcagattattggagtgggattatttctgtaaaggggacatttcttctctgaa

SEQ ID NO: 15373 - DNA, 121 bp, Artificial Sequence
  Synthesized
  misc_feature (61): n=t or c
caaacctcttgcatgaatctcacatcaagcgctcaaagtaatgatgaaaaacagtcaccantgctgctaatgatagcacagccctctgcctcctgcatgctcctttgacaagtgtgcacag

SEQ ID NO: 15374 - DNA, 121 bp, Artificial Sequence
  Synthesized
  misc_feature (61): n=t or c
gataagaattgattaccccagaagttacaacaattatctgtaccatattcatcttttcttncttctgttaagaaagtcagcattacaagactgcattccacagtcactgtagtaaacagtg

SEQ ID NO: 15375 - DNA, 121 bp, Artificial Sequence
  Synthesized
  misc_feature (61): n=a or g
ctgaagtatttatgatttattccaccaacttaaaacttaaactgagggtgcaaatgcatgnctataattactgataagtgcagggtgggttgttctgcataccaggtgcatttacctattg

SEQ ID NO: 15376 - DNA, 121 bp, Artificial Sequence
  Synthesized
  misc_feature (61): n=t or c
ccacagaaccatctgctggtgtcaccactcctggtcccttggaaatggccttgcagagcangaggtccatcctggctgagggctgaaatctgctgcttgaggtgatgggaaggagctggag

SEQ ID NO: 15377 - DNA, 121 bp, Artificial Sequence
  Synthesized
  misc_feature (61): n=a or g
ttctacctgaggcagcacactgtggggagactggctcccagcagtcctgctccgctcatgntgctttgctcacgggtttctgcgtgcacacaaacacacacaacctgaaaatgtggctttg

SEQ ID NO: 15378 - DNA, 121 bp, Artificial Sequence
  Synthesized
  misc_feature (61): n=t or c
agcatcaccaaagagcaaaaaggaatctagtaacacattgagggctatcagccatgtgaanctcactgggttatattccctaacatagaaatctaagatcttctcagcaagtgctaaagaa

SEQ ID NO: 15379 - DNA, 121 bp, Artificial Sequence
  Synthesized
  misc_feature (61): n=a or c
gttaatcaatctatcataattaaaaatattctgttgtatttaataaatgatttctaattantgtatgaatgataaagaggactctaagctgtacattcagaagtcagacgtatgagtgcag

SEQ ID NO: 15380 - DNA, 121 bp, Artificial Sequence
  Synthesized
  misc_feature (61): n=t or c
tgtgcacctatttctgaacagcaaaacatctttatgaatgtatggatttcagttaaagggngtgtttcaaatatacctaagtgggaacaataaatagtgacaatgggaattaagttgtttc

SEQ ID NO: 15381 - DNA, 121 bp, Artificial Sequence
  Synthesized
  misc_feature (61): n=t or c
acctccttctgcacttaaagtacttgagcacagagacaaaattagggtattttgtaactgnttttgcaagcatatacatatatttcacatttagaatttgaaaattcttacttagaaattc

SEQ ID NO: 15382 - DNA, 121 bp, Artificial Sequence
  Synthesized
  misc_feature (61): n=a or g
ccctaacttccagtttcggtgatacatcaagatggagaacagataaatccaagagctcctnaagttgattgttcagattttgaaagctatctcattccagaaagcagcacacgcttatgct

SEQ ID NO: 15383 - DNA, 121 bp, Artificial Sequence
  Synthesized
  misc_feature (61): n=t or c
tctaaatggctgcgtatcacgtctgagacacgacagagaaaatttcccaacctctttctcnctaagactttttcctttttaatagaaaatgccacaaccgaagagcaaccaccaaccaaac

SEQ ID NO: 15384 - DNA, 121 bp, Artificial Sequence
  Synthesized
  misc_feature (61): n=a or g
ggaacaagacaacttctaatgaatatttttctggttctgctcaacgtcactgtgggtggcngtgataggatgaagaacctcttagagacgacaaagcactggggctggctgtggtccccat

SEQ ID NO: 15385 - DNA, 121 bp, Artificial Sequence
  Synthesized
  misc_feature (61): n=t or c
aaatgaattatggtatacacaccatatgtattaaatgttaacaataagaatttaataagantttcggattttctcaaaaaactctcgtcatacgttcagtagttttttttatagtcatata

SEQ ID NO: 15386 - DNA, 121 bp, Artificial Sequence
  Synthesized
  misc_feature (61): n=a or g
tgaaaaaaaaatggtattgtttctccagcaaatactcttgattttcttttggagggattgntcgtcgtggtctcacagtggttttcctggatggaaaggaaaatggaaaaagcagtttgct

SEQ ID NO: 15387 - DNA, 121 bp, Artificial Sequence
  Synthesized
  misc_feature (61): n=a or c
ttctctagttgtctcataatcatctgatatccactcctagacaagagatgcagacaggcantcctggaccataattcactggagtcctcagatgtctaaaaatgtaaacatttgaactctg

SEQ ID NO: 15388 - DNA, 121 bp, Artificial Sequence
  Synthesized
  misc_feature (61): n=a or g
tggcaccccagggactcttttccacatcagaataaaaccaaatgtcagatctctttgtagngaggcactaaatagctggatcctggcagtctggccactgagcatgagtgtgctcaggtcc

SEQ ID NO: 15389 - DNA, 121 bp, Artificial Sequence
  Synthesized
  misc_feature (61): n=a or g
attatgaagtctgaaaatccctgttcttttcccatgtagacaagtaccttatcataagacnttccttaaatgaatttgtgtcagttttagttttagctcagtgaattatgagcagacttat

SEQ ID NO: 15390 - DNA, 121 bp, Artificial Sequence
  Synthesized
  misc_feature (61): n=a or g
aatagatgtattcaagggaggagggagggggcagaagcaacaacagaacgctcaaaaggancaaatggattcaggtacagctggtctcaaattctgcctgtacttaggctttctaaaatgc

SEQ ID NO: 15391 - DNA, 121 bp, Artificial Sequence
  Synthesized
  misc_feature (61): n=t or c
gccatcacaccaagcatcccccctccttctttaaccagcttctcttcctgaacatgacatngtgttgcacggaacactcctttggtcactctggtcagctgttctgacagtgccccctccc

SEQ ID NO: 15392 - DNA, 121 bp, Artificial Sequence
  Synthesized
  misc_feature (61): n=t or c
agtcctccctccatttctgttgcctttaactgcaacaatataaggcttgcaatttgccagnacacagcagcacagtaacatccctgaagacaatgagaacggttttgagagaaaaattaaa

SEQ ID NO: 15393 - DNA, 121 bp, Artificial Sequence
  Synthesized
  misc_feature (61): n=a or t
tatgtgtggcaggacgttaccactctgaaaatacaggtttaatggaatatatgtctttttnaaattctcttattttgaggaatgcaattttaaatgaacaactgctttgtctatgtattta

SEQ ID NO: 15394 - DNA, 121 bp, Artificial Sequence
  Synthesized
  misc_feature (61): n=t or g
gctttcaaagcattgtgaaaaattaacttgacttgttaagataattactcagtgagctccntcaagcttttggctttcaattacctggacccactgatttgagaatgcttgttattagcag

SEQ ID NO: 15395 - DNA, 121 bp, Artificial Sequence
  Synthesized
  misc_feature (61): n=t or c
aatattcacattctgtttccagcagtcaggactgatttggcctcaaacacttatctgttantagctacttctgcaggcagttcaggggaaaaaaaagcccagcacatttagctcaaacact

SEQ ID NO: 15396 - DNA, 121 bp, Artificial Sequence
  Synthesized
  misc_feature (61): n=t or c
acagctagtaagagtataaacaagaattgccatcttcactttacattgaaatcaccagctncatgtatctataatttttcagtaatttttttgaaatgaagaaaaacctcctgtaggaact

SEQ ID NO: 15397 - DNA, 121 bp, Artificial Sequence
  Synthesized
  misc_feature (61): n=t or c
tcaaccagactcgaaaaaatctcgcttgaaatgggactttttcttctggtgaaacagacgnccttgtgattaggcactcatttaagaatccttgcactgacacagtaactccctgaatcat

SEQ ID NO: 15398 - DNA, 121 bp, Artificial Sequence
  Synthesized
  misc_feature (61): n=a or g
attaactctgtctctgctgttttgttcactagaagtgtagagatggttatactattacagnacaacatagctctgtatgttacaaacatgaatgaacagccttggattctcttgcaaaaca

SEQ ID NO: 15399 - DNA, 121 bp, Artificial Sequence
  Synthesized
  misc_feature (61): n=a or c
ttaggcctctcgactttttctacttgctgaatgctctgtgacactgcattgcctggtcagnagctccaataagtgctttggagcacttcatgagctggcagcagctctgctcccaatgaat

SEQ ID NO: 15400 - DNA, 121 bp, Artificial Sequence
  Synthesized
  misc_feature (61): n=t or g
atttagtatttcagtcattgaagatgacacgacagaatatatctctccgtgataaaagcancaagttctgtctcccagcagaaaacatttgtagcagggatggcagatgggcatctgctcc

SEQ ID NO: 15401 - DNA, 121 bp, Artificial Sequence
  Synthesized
  misc_feature (61): n=a or g
tgctccaatcattcttgctaccctcttcttcctaagttctagccatagtacacagctaacntatagggaaagctggaaaaaaagcccacaaaggtaacaaaagcaagaacacaagtttgct

SEQ ID NO: 15402 - DNA, 121 bp, Artificial Sequence
  Synthesized
  misc_feature (61): n=c or g
attcttgcagtctgtactataaatggcaggctattaaaagacagtctccatgttgtcatgnatttgtgctctctaattgggcttttcaatttgaactacagatccaacagtctctgcgttt

SEQ ID NO: 15403 - DNA, 121 bp, Artificial Sequence
  Synthesized
  misc_feature (61): n=a or c
gtgcagagttctgtccatggtcttggtagcaatcctcaacttgacactaaagcagaacctngggagctgagaatcaagttcatcttcaaggccaggcagaccataaggtaactgacagaat

SEQ ID NO: 15404 - DNA, 121 bp, Artificial Sequence
  Synthesized
  misc_feature (61): n=a or g
gtccatgcagtgcaggcattgtagaaatctaagaaactgtgctttcattcatctcagaatngacactgttaatctgagcactttacaaatatggaagaggctatggcccaaaatacagccc

SEQ ID NO: 15405 - DNA, 121 bp, Artificial Sequence
  Synthesized
  misc_feature (61): n=a or t
ttctgaaagaaagaaagaaaaagaaaagaaaaactgtagaataatcttatattgaagaagngtcttgaagaatctacgtgcagtctgtgcctctaactaggtagaatgaacctttactgtg

SEQ ID NO: 15406 - DNA, 121 bp, Artificial Sequence
  Synthesized
  misc_feature (61): n=c or g
ggtctgcaaaagcacccaatgacttcaacctccaagagtgtaagtgctgtctcactttgtncatctctcccggctgcctccaaaactcagcactgagcacacatccatggaccatgcgacc

SEQ ID NO: 15407 - DNA, 121 bp, Artificial Sequence
  Synthesized
  misc_feature (61): n=a or g
ggccggacttcaaacagaaaatcggagatcacagaaggatcaatcggttttctgcactgcnagtattaatctcttctgcttaacctcctcctctgaagccctccccttcctcttccccagg

SEQ ID NO: 15408 - DNA, 121 bp, Artificial Sequence
  Synthesized
  misc_feature (61): n=t or g
tgcaggattcccagggatgatgacaatgtagagctgtggaggaggtggtcaaataccaatntaagcatgtgttctcatcaggcatgggaaatgagctcaattaagatggtttctgtagcag

SEQ ID NO: 15409 - DNA, 121 bp, Artificial Sequence
  Synthesized
  misc_feature (61): n=t or g
aaaaccatattgctcaaagtagaaacaccaaaacaaataaatgaatgtgcaagaattgganaattctaactccctccagaatacctagttagaatggaaaggctccctttccttgtctgca

SEQ ID NO: 15410 - DNA, 121 bp, Artificial Sequence
  Synthesized
  misc_feature (61): n=t or c
agttggatacagtggtaagaattccaccttgtctgaaaagtaatagtcacatctctcagcnttttctcctcatcatatgtttcagccccctcataatcttaatggccttccactgtactca

SEQ ID NO: 15411 - DNA, 121 bp, Artificial Sequence
  Synthesized
  misc_feature (61): n=t or c
gttgtattcaggttagatcctaatttgagatacaaagcaccagtagtgcaaagcaggtatngtaccagcttatctaggcagtggaggacaatcctcctgcataggacagtctcactggaaa

SEQ ID NO: 15412 - DNA, 121 bp, Artificial Sequence
  Synthesized
  misc_feature (61): n=t or c
tatttgaacatctaaaatattgttaatagaaaaagtatttcagtaaaaagtgtgttaacanacttcaagttctcattatatacagtggaagccataaatgctgaggaatttacactgctta

SEQ ID NO: 15413 - DNA, 121 bp, Artificial Sequence
  Synthesized
  misc_feature (61): n=a or c
gaattcatctaatgagatatcattaaaatcagtatgttgctgcacaggaaattaaagtaanaccagaggacatggagtttttatcagaggaattatagggcatgtaaggaacaaatgaaat

SEQ ID NO: 15414 - DNA, 121 bp, Artificial Sequence
  Synthesized
  misc_feature (61): n=t or g
gcagtgaatgcagagctgtgacttctgcattgcatttaagcctgtgcacacttacagagtnactgcatttggcttttctaatgataatacagctttctaaagttcactcttctacaagtac

SEQ ID NO: 15415 - DNA, 121 bp, Artificial Sequence
  Synthesized
  misc_feature (61): n=a or g
gcaatggagtcttcttaaggaaaatggcctacagagaccaaaccttacaggagctcaatgnaaatggtattcccagttcacacaatttgcttcagaaaagcctagcttcttgtcatctggc

SEQ ID NO: 15416 - DNA, 121 bp, Artificial Sequence
  Synthesized
  misc_feature (61): n=t or g
acgtaagagggagaagccaaaactgtccctttcagcttcaaagctgacctcagcttcaaanatctgtcctaatttccgttcgctgtgtgtctggatcttatatcatcccaacactgacaac

SEQ ID NO: 15417 - DNA, 121 bp, Artificial Sequence
  Synthesized
  misc_feature (61): n=t or c
tatagtctgctcgttgttactttaacagtctcacaccatactatcacatttttttggtgtnactgctcttttgctcatcccatagttttccagtgccagtaaaatcctataaatgaagagt

SEQ ID NO: 15418 - DNA, 121 bp, Artificial Sequence
  Synthesized
  misc_feature (61): n=a or g
ataactcgccagggctggtgctgtttgcagcttgtgatggagctcctagcaattagagacngcatatgcgcaaatatttgaacatataaaagagttcacagcctgactgtgagaagctgtt

SEQ ID NO: 15419 - DNA, 121 bp, Artificial Sequence
  Synthesized
  misc_feature (61): n=a or g
aggtcccttccaacccaaaccgttctatgattctgcgtaataagtaattgctcttataatntggcaactcaagtaaaatctgtacagcagcacaaaggaaacgtgtgtatcatagaaacaa

SEQ ID NO: 15420 - DNA, 121 bp, Artificial Sequence
  Synthesized
  misc_feature (61): n=t or c
gtttgtttttgttgctgcttttaaataaaaagaaaaatctacagaagaaccacatccagcngcccagagttacacatcactgaccaatggtcttaaagatacagtaacaagcaaaacattt

SEQ ID NO: 15421 - DNA, 121 bp, Artificial Sequence
  Synthesized
  misc_feature (61): n=a or g
caaccatcctgaacagaggggaatgaagtgttgtgtttcagagatggttcatttgctgacnttggggatggaggggtatttttaaaaaaaaaaaaagtaagaactggaaactcaaattgaa

SEQ ID NO: 15422 - DNA, 121 bp, Artificial Sequence
  Synthesized
  misc_feature (61): n=t or g
agcagggccccatgcaagttccagcttgtttctgactggtagaggagtttttcaatttgtncagaaagatttcagctctttgtgctctctccattttacagtttactcaggaacttttaac

SEQ ID NO: 15423 - DNA, 121 bp, Artificial Sequence
  Synthesized
  misc_feature (61): n=a or g
caacagactctgtagacaggttggagagacagagagagacttaatttgcaaagttaagccntttcattcatggagctgctctgcagcacttgcagtattgacatgagcagacagtaattgc

SEQ ID NO: 15424 - DNA, 121 bp, Artificial Sequence
  Synthesized
  misc_feature (61): n=a or g
ctatcagactccaagattgcagaatgtttgctaactgttaaaggaatagaatacatggggnaaaggttaaaaccctgtctcaatatcaacttcagatagctactgttgcttttaatctcct

SEQ ID NO: 15425 - DNA, 121 bp, Artificial Sequence
  Synthesized
  misc_feature (61): n=t or g
tccttatcacttccttcttgcctttaaaatctcccctggcatgactccacctgtataaatnctatacagcatccctgctactattatgcctatgtatgggataataaaagatgagaggatg

SEQ ID NO: 15426 - DNA, 121 bp, Artificial Sequence
  Synthesized
  misc_feature (61): n=a or g
gatgaaccccatggcaccttatagcacttagggtgtttctcctcctgtgcagcagcaggtnacctcatagtgtgcagtgtctaatcctttctttacggcaaaaaggatattgcttggacag

SEQ ID NO: 15427 - DNA, 121 bp, Artificial Sequence
  Synthesized
  misc_feature (61): n=a or g
agcctctctggagaggactggggcacagagcatacagaactggtaacaagcctcctccacnccacaggacagggtatttgcaaactcctctgttaggaggggagagctctgccaaaccctt

SEQ ID NO: 15428 - DNA, 121 bp, Artificial Sequence
  Synthesized
  misc_feature (61): n=a or g
tatgagtaccagcttctgatttcatgatgataaaagatacaggtaaaaatgacctttatangcactttgagaaatctttctgtgacttgatgtaagactatcacaaaattatttgttggag

SEQ ID NO: 15429 - DNA, 121 bp, Artificial Sequence
  Synthesized
  misc_feature (61): n=t or c
gaaagtgaaacaggtgtgatccctttcttgagctggtgatggtccaaaatttgtgcgtcangcagctagacaaaaatcgaaccaaattattctgatcgtgactgagctgggaagactacgg

SEQ ID NO: 15430 - DNA, 121 bp, Artificial Sequence
  Synthesized
  misc_feature (61): n=t or g
tgagtacttcatatggcatgtgcacataaaatagaatgaaaactggtcacctggggtgaangtttcagtgatggctttctctgtctgcagatacataggatacatttgcgatctaatagca

SEQ ID NO: 15431 - DNA, 121 bp, Artificial Sequence
  Synthesized
  misc_feature (61): n=a or t
tgtttatgctgagcctggaagcacaaagagcagtgtaaagactaatacactaccttcctgnatattcttcctcagaactcttctgctgagacatggtaagatctatcctgctaccgcactg

SEQ ID NO: 15432 - DNA, 121 bp, Artificial Sequence
  Synthesized
  misc_feature (61): n=a or t
acagaaatacacgttacattctttcactacaaagggaaaacaaatagctgcaaatgcttanggtgatgctggtgtttccagaaagtctgtatcgtgaggtttcagtaaagtatctggcaca

SEQ ID NO: 15433 - DNA, 121 bp, Artificial Sequence
  Synthesized
  misc_feature (61): n=t or c
gaagaggaatgtgagaataaggatcagaggggcaagaaatagcagacagcttcaaataagngaaaggtgtttacatttttttcagaagcagtgcaaataatgaataaagaaatcaagatgc

SEQ ID NO: 15434 - DNA, 121 bp, Artificial Sequence
  Synthesized
  misc_feature (61): n=a or g
ctacagtcttacaggcagattattgtaagttatctgtatagcagctgttttcaaaatagancaggattcttgaggcttctcttcccaggcagtttcttaattatatgttctctgagacatc

SEQ ID NO: 15435 - DNA, 121 bp, Artificial Sequence
  Synthesized
  misc_feature (61): n=t or g
ctccaaccaatctcaaccagtgaaaggcttacatgcccattattaataccaaaatggattntgtcaaccaaacgttctatttcagcttcaccagctgcgtcgcatcagaggcttccagtgc

SEQ ID NO: 15436 - DNA, 121 bp, Artificial Sequence
  Synthesized
  misc_feature (61): n=t or c
aatttccaggcagattcaccatgctacttggcttcttttgccaattgtattttctttactngacaaggctcacaaaatgcaccaaggacattcctaggtccagtttgcctccatttactta

SEQ ID NO: 15437 - DNA, 121 bp, Artificial Sequence
  Synthesized
  misc_feature (61): n=t or c
tgaagtcttcaatcattctcttgtcccaccgttatctttcttatgtgttgttcgtacatanggtttcctaggaaaaatccacgtggggaaaaagcaatgctagggcactttgtgtaatgtt

SEQ ID NO: 15438 - DNA, 121 bp, Artificial Sequence
  Synthesized
  misc_feature (61): n=c or g
gggtggaggtgaaaaaccactcccaattctgccctttttctatgaccacaggttttgcctntgacaaaagtaatacaggtacttatgtctccttaaacagtttcacctttatacctccgat

SEQ ID NO: 15439 - DNA, 121 bp, Artificial Sequence
  Synthesized
  misc_feature (61): n=t or c
caatgctacgaacaatgcactcagcaatcgttttctcagtgaaggtaaaatcttcagtggngcaaatcttgtaaaaataaacgatattttatataaatgctgggtgaatacacaaaagcta

SEQ ID NO: 15440 - DNA, 121 bp, Artificial Sequence
  Synthesized
  misc_feature (61): n=t or c
ccatccagtttgtcctaaaacaaacaagagtgaagatcacttaagcagtacaattacccantactgaagcttactttattccaggaaaaaaaaaaaaggcagcaataaaccttggttgttc

SEQ ID NO: 15441 - DNA, 121 bp, Artificial Sequence
  Synthesized
  misc_feature (61): n=t or c
atcagtattaatcattacgtcacaacattttattatccctttccttctagaactctttagnagacattccttcagctcccagaggattactagcgcttgtgttgtgctgaagcttacttta

SEQ ID NO: 15442 - DNA, 121 bp, Artificial Sequence
  Synthesized
  misc_feature (61): n=a or g
aaactaaactttttcaactttatgcagtggacttcatgcatcagatgagacactgattcancctggtggatggtgatgcagcttacaaaattctgtaaattaattttaatccttaaaagag

SEQ ID NO: 15443 - DNA, 121 bp, Artificial Sequence
  Synthesized
  misc_feature (61): n=a or c
cctctgtttagaccagatcacattttgcatccaggaggttttctggactttacattatgcngccgttaggttaaactagaaatggaggagtgcaagctgaggtaagtccctcctcttgaag

SEQ ID NO: 15444 - DNA, 121 bp, Artificial Sequence
  Synthesized
  misc_feature (61): n=a or g
aggaagtttagatattaagatcttcagtgaggttctaaaatgtgaatggaagcagcactantttagaggacaaaggaaaaatgccactactgaagaggatgatcttttccttttcccttcc

SEQ ID NO: 15445 - DNA, 121 bp, Artificial Sequence
  Synthesized
  misc_feature (61): n=t or c
tgagaatacatttgatttattccacagcatcagtagaatctggccaaaaattaccttaaancccttcaactactttcacattgtttgaaacacagcacatatagtgcacaacttcacattc

SEQ ID NO: 15446 - DNA, 121 bp, Artificial Sequence
  Synthesized
  misc_feature (61): n=a or g
aggcatgaagaaatcattttaattctgagaaactccaatccaattatttgttgctacctcngtcctataatattgaaaaccttaacaaaataatacatattttttaaactgaataatcttc

SEQ ID NO: 15447 - DNA, 121 bp, Artificial Sequence
  Synthesized
  misc_feature (61): n=t or g
atatgtttctatctgccgtctgtaacttttaatcttcaaatagaaataagccttccttgcngaaacaggctgctttttcagatgttctcagaaatgctgatgttgtgccttggttgatctg

SEQ ID NO: 15448 - DNA, 121 bp, Artificial Sequence
  Synthesized
  misc_feature (61): n=a or g
agttaaagaaacaaaacaacacaacaaaaagctccatgcactgaaactccaatccttaccntggtagctaagaagggaaaattcctgctgttgacatttttgttcatactaatgcttacat

SEQ ID NO: 15449 - DNA, 121 bp, Artificial Sequence
  Synthesized
  misc_feature (61): n=t or c
acctcaattgcgttacattattagactttctgtagattcttgtggtaacacacaggaaatntcccctacacatcttgcacacacacacttaaaaaaaaatgtttttaagacagggcactag

SEQ ID NO: 15450 - DNA, 121 bp, Artificial Sequence
  Synthesized
  misc_feature (61): n=t or c
ggactatgccaattgcctcccctgaattgtttggtgagtatttttgaagacaaaggatagngcaaggagcagatatgcaaaactaatatgttatcagtgaactgtcacaggtagaaactca

SEQ ID NO: 15451 - DNA, 121 bp, Artificial Sequence
  Synthesized
  misc_feature (61): n=t or c
ctctgatgcaagtaggtcagtttggatggagaagctcctggttgttttggggtgaagcgcnagaaaaccccatagcaacaaaccagcacgagctcagaggagatcatagagtcacagaatc

SEQ ID NO: 15452 - DNA, 121 bp, Artificial Sequence
  Synthesized
  misc_feature (61): n=t or c
ggaagctcatgacattattcctctcagctacctctatcagcccatggaatgggctgtactngcataacagtgctgattaaaggtaactgaaatctttatgaaccattaattaccaagagtc

SEQ ID NO: 15453 - DNA, 121 bp, Artificial Sequence
  Synthesized
  misc_feature (61): n=a or g
tgtttctctttttggaatgtaatgaatgctggccagcaaatattgtaaaaggcactttgtnacattgaagtcaacacagtaattatattcaatatcctgtgtttttgtcaggctttcttct

SEQ ID NO: 15454 - DNA, 121 bp, Artificial Sequence
  Synthesized
  misc_feature (61): n=a or g
ttatacaaagcatagttaacatagtcaccgtgaggtttggtttcattactctttcaacccnttgcaattagtgtcttgtgccagacgttttacatgagttggcttctgtttcatctttact

SEQ ID NO: 15455 - DNA, 121 bp, Artificial Sequence
  Synthesized
  misc_feature (61): n=a or g
ccagtgtttttatttgcactcatattttttcattgcctttcctttacacctcaaggacacntttatgatctcctcccggtatttcacttctgaggtgatggtgatgccttgagaaaaaaca

SEQ ID NO: 15456 - DNA, 121 bp, Artificial Sequence
  Synthesized
  misc_feature (61): n=a or g
tcactggtcagtgttaggctttggtaggactggagatggaattcaggattcgggtaggganatttggatagggagatattagggtagtatggttaggttgtggttgggcttgatgatcttt

SEQ ID NO: 15457 - DNA, 121 bp, Artificial Sequence
  Synthesized
  misc_feature (61): n=a or g
gcacttgtggctttgccagttggaagctgtggtggtacccaagcatccctgtcactaagtnctctgctgctgcttcctgcctgctggaatgtcagctcttgggaaacaaagagaaggtaag

SEQ ID NO: 15458 - DNA, 121 bp, Artificial Sequence
  Synthesized
  misc_feature (61): n=a or g
gaagtcaagtgggtctggcagtggaaagaagataagagccagagaggacaggatcagggcnaatttgaagaacaaaaagtaaatataatgaacaaggaactgctaagtcagtggagtgaaa

SEQ ID NO: 15459 - DNA, 121 bp, Artificial Sequence
  Synthesized
  misc_feature (61): n=t or c
aatcaatcacgccgctcccactgccttttgcagtctcttgttttctcctggatccaccatngtgcatttcagcaggtagtaaaattttgcaaaatgtaggtgccatttactgcatctgctc

SEQ ID NO: 15460 - DNA, 121 bp, Artificial Sequence
  Synthesized
  misc_feature (61): n=a or g
cttcaagccctgctcacagtcaggaggttgggagccccagtttgcagatgcagtgcacacntaccagccgcatgccttgtaatggttttcccagtccctccactaaatgtaacattatggt

SEQ ID NO: 15461 - DNA, 121 bp, Artificial Sequence
  Synthesized
  misc_feature (61): n=t or c
tcctagaaatgtgtgcaatgaaaatatgtttatatcgtgcatttcattaagttttttccangggtatccaaccttctagtgtggctgggctccactgagagaagaccaattgtcttaggcc

SEQ ID NO: 15462 - DNA, 121 bp, Artificial Sequence
  Synthesized
  misc_feature (61): n=t or c
acgcttacagcatcactgccaagaggtgagcgccttctgccgcctgtagtccttttttttncccttcatttttacatcttttgctcttcaaaattagcgtgttcttttttttccccagctt

SEQ ID NO: 15463 - DNA, 121 bp, Artificial Sequence
  Synthesized
  misc_feature (61): n=a or g
tccgagctccattatcacaactcttcaccatttttttctgcttcccagttactttcacacngctgtcacacatccccaaaatgatcaacagtctgttaagactgcaatggaaagtcagcag

SEQ ID NO: 15464 - DNA, 121 bp, Artificial Sequence
  Synthesized
  misc_feature (61): n=a or g
agagattaattatgggaaagtaacactgtccagtgataaagtagtaatgatgttcaggagntgaacaagatgttgttcaagtctgacactgccagttcattggtatctagaacagctgtta

SEQ ID NO: 15465 - DNA, 121 bp, Artificial Sequence
  Synthesized
  misc_feature (61): n=a or g
ccaggtgaggatgtaacaaacgttaaagacaatgatttcactcagtgactgaggccaaccncacttctactcaagggggtcctggtccactatctcctaaacctgcaggcagcaaaattaa

SEQ ID NO: 15466 - DNA, 121 bp, Artificial Sequence
  Synthesized
  misc_feature (61): n=a or g
atcacagagctgtaaagctgatcagaaatgagagctgtatggttttgctttgggcatttcngggtgtaaatcagcacaaagctccttgggaagttgcacaggctgctgcatccatgacact

SEQ ID NO: 15467 - DNA, 121 bp, Artificial Sequence
  Synthesized
  misc_feature (61): n=t or c
ccagtttgttagtgaagaggacacataggtatagaccatctaccatactgctctttctctntagttatttcactatgtttaagtgcctgttgcagacaaatcctgtacaaaatttctcatt

SEQ ID NO: 15468 - DNA, 121 bp, Artificial Sequence
  Synthesized
  misc_feature (61): n=t or c
tgctcacacgttggagtgcggatggacgcactgcctctaattctcactttctctccccaangagagtgatctatgggtgctcggagtcggaactacattagcagggaagaccctgcagcga

SEQ ID NO: 15469 - DNA, 121 bp, Artificial Sequence
  Synthesized
  misc_feature (61): n=t or c
acacaaggaatagtacaacatgcagtacatgaggttgcagtacacaacctcagtggctgcntcctattgtaagtttaattatttaaggccaataaaataccctgatagaagcctgctggct

SEQ ID NO: 15470 - DNA, 121 bp, Artificial Sequence
  Synthesized
  misc_feature (61): n=t or c
tttttaaggtctagatgtaatggataataaaaagggatgttcccaacttaggatggttgcngtacttgataaaacactagaaacatgacatgatttagtgcagctattaatcaagttggtg

SEQ ID NO: 15471 - DNA, 121 bp, Artificial Sequence
  Synthesized
  misc_feature (61): n=t or g
actagaagtgtataattctcttcattgagtgcctcagtaaggatacaatttagggtgtttnggactttacattcaaatgactatagaagtccttttgtcctcagacctggttatagtactt

SEQ ID NO: 15472 - DNA, 121 bp, Artificial Sequence
  Synthesized
  misc_feature (61): n=t or c
agaaagggctgtctgacaggaaaaaaaattcccaagccaaatgtgtgccattaagcactgntgagtagtttctgtctttctgatggggagctcagataaggccctgtagggttttatgctg

SEQ ID NO: 15473 - DNA, 121 bp, Artificial Sequence
  Synthesized
  misc_feature (61): n=a or t
gagtagtaagctgcactggacatgtctggtgctatgcctacagtactaattaatttgccanatcatccttggcagggtcttccagatgttcacttaccaccccagtaagctctacgaccaa

SEQ ID NO: 15474 - DNA, 121 bp, Artificial Sequence
  Synthesized
  misc_feature (61): n=t or c
atgcttttaaggacaagcttcctatagtggtttttaccagaatggtgggagagaaaaatcnatgtgaatttaggagatttcattaggccctttgacagctgttgtaaagttctggcattct

SEQ ID NO: 15475 - DNA, 121 bp, Artificial Sequence
  Synthesized
  misc_feature (61): n=t or c
tgataaataatgataatgtgaatggaatgaatgatagcaatgaatggtgagttttaaaacntgcaaaatatttccaagccattattgttgatgtgtcaagaagctctaccaaaaagcctca

SEQ ID NO: 15476 - DNA, 121 bp, Artificial Sequence
  Synthesized
  misc_feature (61): n=a or g
tgcagtggctgcagccataagtgcagggtggctctccaatagcattttgaagtgctaaaanaaatgcagtaaaaattaagacccttctataagtctagccacactgtgtcactgacaaaaa

SEQ ID NO: 15477 - DNA, 121 bp, Artificial Sequence
  Synthesized
  misc_feature (61): n=a or g
cagcgcgcagattcacatgtgccaaaattgtgacttctccatttagatcatggggttcccnagcgctgctcatagccatcaggaagcagaaattgtgctgcccgtcaggcctggaggcagc

SEQ ID NO: 15478 - DNA, 121 bp, Artificial Sequence
  Synthesized
  misc_feature (61): n=a or g
gttaagaaagcacttcctgccgaagtagtataaaaatggctcagctcagctcattgaaacntctgtaatatcgcaccctggatattttattgcaactgcgttctgatttctgcctgttttg

SEQ ID NO: 15479 - DNA, 121 bp, Artificial Sequence
  Synthesized
  misc_feature (61): n=t or c
tgttggggaacatttccctcccactgcctccccattctttttgctgcttagtttattcctngggacgtgtgcaatgctcgtgaaagaaactggagtcactgtgtttggtgtgtgcttggta

SEQ ID NO: 15480 - DNA, 121 bp, Artificial Sequence
  Synthesized
  misc_feature (61): n=a or g
caacaaacttctagccaaaagagttttgcacagtgaactggttggtgaaaaaacagccatntgaatatcagcaagaattctcaagcaataatgatcagaagttagaatctgttgaagttct

SEQ ID NO: 15481 - DNA, 121 bp, Artificial Sequence
  Synthesized
  misc_feature (61): n=a or g
gatccagtacatgcctgtgttttccttgtatccgacgttccacagagtaatgatgtttgcntgatgtaggaagagttttttgcagtgtgttctttgtttgtttttgtttttttttttttcc

SEQ ID NO: 15482 - DNA, 121 bp, Artificial Sequence
  Synthesized
  misc_feature (61): n=t or c
atttgcacaatctacttccatgttgtgtgggcaaggcagactaaaagtgtttttaaattantcttactccttttcagtgctactaccatgtgttttcccatgctgcagatttgcagactgc

SEQ ID NO: 15483 - DNA, 121 bp, Artificial Sequence
  Synthesized
  misc_feature (61): n=a or g
tcaggtagacttctcagtccccagaccctgttatttcagcgttatctgttcgtttgccatncggtggatggtgttggttcctgttagcctcacagagctagctgacatctgtcaggagggt

SEQ ID NO: 15484 - DNA, 121 bp, Artificial Sequence
  Synthesized
  misc_feature (61): n=t or c
ctgctgcatcagttcttcacaaaaacttttccagtagcaaaacagtagtggcatataatgnacagatagggactcatccactaagaagtaattattacttttagatttagttttattgttg

SEQ ID NO: 15485 - DNA, 121 bp, Artificial Sequence
  Synthesized
  misc_feature (61): n=a or g
gttagactgttggcaattaaatgatccccttctctctatatatattccacacacacaaacncacacaagtgcacatatttacagtcatcccttctccctgtgcagtgagtgccagaaacac

SEQ ID NO: 15486 - DNA, 121 bp, Artificial Sequence
  Synthesized
  misc_feature (61): n=a or c
gccagagaagcctgcaggcagccttagcgaggccctgagctctggcagagagccaacagcncagccaatagtgtgcccaaagccatgccctgctgcctgcatcagaagccagagaatgctg

SEQ ID NO: 15487 - DNA, 121 bp, Artificial Sequence
  Synthesized
  misc_feature (61): n=a or c
gagagagaatctacagatgcagttttcctgctgacacacagcaagctgctgaaaccgctgngtgttacatcaaatctagcgctcatagctttattctcaagaccagaaaacactacctaac

SEQ ID NO: 15488 - DNA, 121 bp, Artificial Sequence
  Synthesized
  misc_feature (61): n=t or c
ctctctagtttctgtccagggagctgtctcgtttatgatgagtccagctttccaatatacncatatcttccctgattttattagcagaagaataagatgcagttgtaggctaacttacatt

SEQ ID NO: 15489 - DNA, 121 bp, Artificial Sequence
  Synthesized
  misc_feature (61): n=t or c
agttatatggccgtagtagaggacagaactctagcaatgactgtaactacaccacagaaanctcacttgctgaaaactgtagcagctcagtcagagttcacagcttctaggacagtattat

SEQ ID NO: 15490 - DNA, 121 bp, Artificial Sequence
  Synthesized
  misc_feature (61): n=a or g
attaaacattaatgcagacaagtcatttttcaggtgcaattatcacatagcagcaacagcnagaaagcactgtgaaaacagttactttctattagtaaattaatgccataaccatgccatc

SEQ ID NO: 15491 - DNA, 121 bp, Artificial Sequence
  Synthesized
  misc_feature (61): n=a or g
ttactgtgctcactgactcagttgaagtttctgtaaaaatgaagaggagacataactttcngggagacttacatgtatgtggctcaagacaattcctctttaatcaacatggcccaggcaa

SEQ ID NO: 15492 - DNA, 121 bp, Artificial Sequence
  Synthesized
  misc_feature (61): n=a or g
atactatttttgttatcactgggctgtcaaactcctacattgcagaatgtaaaaagagccnctgtatcctgttgtgttttgttagttggttttttggatagaaagagaacacatacttgtg

SEQ ID NO: 15493 - DNA, 121 bp, Artificial Sequence
  Synthesized
  misc_feature (61): n=a or t
atgctcctgaattcagtaatcatcacaaaatgacagcgaaaatgttataaactcacatccnaagaactgctaaaccatgaaaattagcatggttgggtcaacaaaattaatctttatctcg

SEQ ID NO: 15494 - DNA, 121 bp, Artificial Sequence
  Synthesized
  misc_feature (61): n=t or c
agcctgaataaggcccacatattgtagcaagatccacttctctctcatgtttccccctctntagcataatggaactctgcatggtagggttggctccacctaggctgctccagctttgtgc

SEQ ID NO: 15495 - DNA, 121 bp, Artificial Sequence
  Synthesized
  misc_feature (61): n=t or g
gtgcaatgcagcatggaaatgtttcttttactgcttttgcacaatatgtagaattaagcancaattccgacaaaaataaacaggacaaaaaaaaacatgagaagcctgttattatttgaaa

SEQ ID NO: 15496 - DNA, 121 bp, Artificial Sequence
  Synthesized
  misc_feature (61): n=t or g
ctaaagcatttttgtaataatatctgtaatttgctcttcgcttacatgattaaatattatntgtagggtagtttattctttcttaaaaccttaaaagctcttgagttccagtatttcaccc

SEQ ID NO: 15497 - DNA, 121 bp, Artificial Sequence
  Synthesized
  misc_feature (61): n=a or g
cttggcaagaaagctgtttacgcagctttgctctgttagtgccaacctaggcacaaacacntccttctcaatcaaaagtaaccatcttcaggttggaaactgccttgtgcactggcccaca

SEQ ID NO: 15498 - DNA, 121 bp, Artificial Sequence
  Synthesized
  misc_feature (61): n=a or t
acgtagaatcacttttaatgaccagaatccaactacgtctgactctgccccagatttctantgtttcagagactgactccacccatgattccaacatcaactggaacaactgatcaaagtc

SEQ ID NO: 15499 - DNA, 121 bp, Artificial Sequence
  Synthesized
  misc_feature (61): n=a or g
atgcagtgtcttacacgagtcacctgaggatggcgattatcactgaggcttctgcttctcnagctccttcccatcttccttccaaaggctcagctttggccatattggccacaggacctgg

SEQ ID NO: 15500 - DNA, 121 bp, Artificial Sequence
  Synthesized
  misc_feature (61): n=a or c
atcccttgagcatgccattgaccctgctgggagctcagcatgggttattccgtatattctnttgatgaaaaacccacttgaagggaactgtggatgtcttccagcaccttcacagcaaaca

SEQ ID NO: 15501 - DNA, 121 bp, Artificial Sequence
  Synthesized
  misc_feature (61): n=a or g
aggagggtggcccaaatcgatctttcccttccaatgaaagtgtggcaaatcccagtcttancctgaattaatgttttaaatagcagcagcatccttctcagttgctccttgtggcacggtg

SEQ ID NO: 15502 - DNA, 121 bp, Artificial Sequence
  Synthesized
  misc_feature (61): n=t or c
attcatagtagtgaatttcagtagcagtgtcctaatgcacagctaaataacgttaccaccnggcaagaagcacacatggaaagtacaaacctaaaataccacttaaaaaaagagctggtta

SEQ ID NO: 15503 - DNA, 121 bp, Artificial Sequence
  Synthesized
  misc_feature (61): n=a or t
gcgcatagcaagcaacaaccagagcactcctgacgaataccaacattagaagagaataacngaagacatggggaaggaagcaaccccttactcctgcagcagtttgatttattcccattaa

SEQ ID NO: 15504 - DNA, 121 bp, Artificial Sequence
  Synthesized
  misc_feature (61): n=a or g
cctgatgcagtatgaacaaccatgtggagatgtgctgaaatctaatgttgcacgcacaganggcttctgaaatcaaaagacgctattagataattagagtgaattggtgacttgttagaga

SEQ ID NO: 15505 - DNA, 121 bp, Artificial Sequence
  Synthesized
  misc_feature (61): n=a or g
cacgctgcctgaatgtatttttgcctttgtctcccactcccagctgagatggggtgtgagnagagaaggatgccttgtctcctccgcatccagctctcaccatgccagcatccccacctcc

SEQ ID NO: 15506 - DNA, 121 bp, Artificial Sequence
  Synthesized
  misc_feature (61): n=a or g
ttacatggatgtttttcttctgtttacaacactcttttgcttttgatttcaaacctttacngtttcaaggttgtcaggtatcaatcttctttttgatcaatacattaaggctatttgtagc

SEQ ID NO: 15507 - DNA, 121 bp, Artificial Sequence
  Synthesized
  misc_feature (61): n=a or g
atgtctattgcacacaactggttctaattctggtgtacgcagactagttctggatctaccnaggcagaaatctaaatggaagtaaaatgttaaacaccttgaggaaccacacaagctagca

SEQ ID NO: 15508 - DNA, 121 bp, Artificial Sequence
  Synthesized
  misc_feature (61): n=c or g
aatatgaaccaaatccttccatatctctcttcatttcagcttgaaatcgaaagcttcacantgatttaaatgaaaaagctttttcgtggatgaagagaaatttcatttcatgaggaatgtt

SEQ ID NO: 15509 - DNA, 121 bp, Artificial Sequence
  Synthesized
  misc_feature (61): n=t or c
aagtcaaacaagagaagaggccaagaagaaatgagcactgtatgacagcactggcactaanaccagcagatggactacagcagtctccccaaatctccccagtaatgtggatccttctagg

SEQ ID NO: 15510 - DNA, 121 bp, Artificial Sequence
  Synthesized
  misc_feature (61): n=c or g
aagtgaaagcttttgtgttggctgaaagacaaagtttgagaagaggagaagctggaaaagnaatttgaaccatctgaaggtgccctagaccattaagacaagacagggcagggccctaagg

SEQ ID NO: 15511 - DNA, 121 bp, Artificial Sequence
  Synthesized
  misc_feature (61): n=a or t
aactaagcaaaatcatatctgttggtcacttcaaattcttttttctgagatgagaaatgantggtttgggtcactaatcctgcagcctctgaaaaacagagttcttgactttgagccccct

SEQ ID NO: 15512 - DNA, 121 bp, Artificial Sequence
  Synthesized
  misc_feature (61): n=t or c
tactcaaagcttagtataacaggatacagaaaacattgatttgttatatggttcacagganatcttgttttcctccaatctctcctttgcctttccagccctcttcacctcagcaactcca

SEQ ID NO: 15513 - DNA, 121 bp, Artificial Sequence
  Synthesized
  misc_feature (61): n=a or g
actagtagaaagctaaaaagaaatccatatttacaatatctacaactaaaatacttactgnataatatagaaattggatgttcccacactcctattagtaaaagaagcaacctaaacattt

SEQ ID NO: 15514 - DNA, 121 bp, Artificial Sequence
  Synthesized
  misc_feature (61): n=t or c
cagcttcacagtaacacctaacgtttcatgcatttatacttcaaatgtgaagttctgtatngtaaagaagcacacagatgtggtgtgctttgaaatctgacctcagcaggctccttacatg

SEQ ID NO: 15515 - DNA, 121 bp, Artificial Sequence
  Synthesized
  misc_feature (61): n=c or g
agctaccataggcagtgagaagaggatgtacaacactgcactacaaccactgcacatcagnctcattgcaggctggtttggtctctggtcccgttttccatggttcagatgagggctgaca

SEQ ID NO: 15516 - DNA, 121 bp, Artificial Sequence
  Synthesized
  misc_feature (61): n=t or g
ctccgggctgcatgggcagaatgcagcatgaggctgactcacacgtgggaatcacacaccnttcagatctgaacggctccagaggtgggtcagaggctctgaaccagctggctgcagcacg

SEQ ID NO: 15517 - DNA, 121 bp, Artificial Sequence
  Synthesized
  misc_feature (61): n=t or c
ttacctctgtgccagctgtgggatgctgccccactgagtcccatacagtggccatgcttanacctgtgggacatgcaccatgaaaatgactgtggggtgcaagcatgcaggcatttctatt

SEQ ID NO: 15518 - DNA, 121 bp, Artificial Sequence
  Synthesized
  misc_feature (61): n=t or c
taattaggttctttcataaactcctccaggttcatccgcacagctttagttacaaaaatcnctccactaagcgtgtcccaagtccttgtctgaaaagagtgctcagagctccctggataga

SEQ ID NO: 15519 - DNA, 121 bp, Artificial Sequence
  Synthesized
  misc_feature (61): n=t or c
ctgaacaaactgctgaacttggtcagcaccaagaaatccccatcagaacagcatttgcagnttgtttcctctggcacctcacatcacttgggtcaaacttccttgtcaaaacttcagaagt

SEQ ID NO: 15520 - DNA, 121 bp, Artificial Sequence
  Synthesized
  misc_feature (61): n=t or c
tcctccctccaaacctgctcaggggacaccgcttttcaagcggttctgggttgcagcgganggcccaagctttgttctgacatcccagtgccacgatcacgatgcacgaaacccaactaag

SEQ ID NO: 15521 - DNA, 121 bp, Artificial Sequence
  Synthesized
  misc_feature (61): n=t or c
ccctgtgaatccagcctggcctggtgttttacatgggcatgtgaacctctagacagcctgnccagctatagtgagggtttccatttgcctccttttctgctgctgtcaactcttcattgtt

SEQ ID NO: 15522 - DNA, 121 bp, Artificial Sequence
  Synthesized
  misc_feature (61): n=a or c
gctgtcattgtttctgatttttgcagtaaaatgttaagcacaaagctcagagagagccaantatatagctagaagattctgaactcatatacagtaaagagaatctttaaagaatcatatt

SEQ ID NO: 15523 - DNA, 121 bp, Artificial Sequence
  Synthesized
  misc_feature (61): n=a or c
cagaattccaaacaagatctctaagggttcaggacccatcactgtcctgcattcagcatantgaaaaattcaggaaacacgacaacatctggtagacctgtatagtccttactcataaatg

SEQ ID NO: 15524 - DNA, 121 bp, Artificial Sequence
  Synthesized
  misc_feature (61): n=c or g
cattcccaaagggtttcattatctaaattgcaatatctttgtctgtcttcagtgttctgantgggtaaggaagttgtatgcaaaatgaggcaaaaaaacagttttagatgagtttgtctca

SEQ ID NO: 15525 - DNA, 121 bp, Artificial Sequence
  Synthesized
  misc_feature (61): n=a or g
aaatgtaagtttcaagcatgattgtcaatggactaaataatgaaataggaagctaaggaantctggaaatcaaaaaaagggggagagtctgatcacaaggagaagaaggataagctcacac

SEQ ID NO: 15526 - DNA, 121 bp, Artificial Sequence
  Synthesized
  misc_feature (61): n=t or c
ttcctatggttattctgggtgataaactcaatataagatgaagctattgaaaacagattgntttaacccttttcagcggggcatgattccctggtacaaaaagttacctgtgagtggtgcg

SEQ ID NO: 15527 - DNA, 121 bp, Artificial Sequence
  Synthesized
  misc_feature (61): n=a or t
ggccaagttattcagttcctaacagcacctatctttttctttaccatggactaatacaggnaatttgtagtcagatatggacctgaacctgtatccacttctttcccctccattgcagcag

SEQ ID NO: 15528 - DNA, 121 bp, Artificial Sequence
  Synthesized
  misc_feature (61): n=a or g
gaatcttgtaatgtcaaaaagaaaagctgtttcagaagcaggaattctaaggagggagagnggggctgaagaggctcaggaaggctggcacccataggaaaggctgcaggaggtttcaatc

SEQ ID NO: 15529 - DNA, 121 bp, Artificial Sequence
  Synthesized
  misc_feature (61): n=a or g
tacggagaggtatacgcaagtacataggagtggaattgcacatgcttgcttatgaacagcnttttcattgcagagcagtgcaaatcgtgttgttgggagataggcagtgagaatgaagagg

SEQ ID NO: 15530 - DNA, 121 bp, Artificial Sequence
  Synthesized
  misc_feature (61): n=t or c
caactgaggattttgcagatttaggtcctgtttatctgacttgttgtaggtagctgtgacnaaccaaatcttaatcaatttttgggttggaaagcatgccaaaagctagtacttttgtcat

SEQ ID NO: 15531 - DNA, 121 bp, Artificial Sequence
  Synthesized
  misc_feature (61): n=t or c
accttacaagctaattatgtgcaaaggattttaatggttctgtgggacccatttcccaccncactttccctagtcaatcttctcatcgttagctaggaatgagaggacatggatgaattgg

SEQ ID NO: 15532 - DNA, 121 bp, Artificial Sequence
  Synthesized
  misc_feature (61): n=a or g
acataaaaaaaataataaaattatttatcttcaagcgtgcatgctattatttaaactaganttgtttcatgctgcgattgttttattacttgttcagtactgctgtcttgtagatgttctc

SEQ ID NO: 15533 - DNA, 121 bp, Artificial Sequence
  Synthesized
  misc_feature (61): n=a or g
aggcatgtgggctgcagacttgggggaattaatgattaaccccaggctgaattctgaacanagctgtggaggtaggagaagacaatccaagctcacgtgctggctgctgaatgagaactca

SEQ ID NO: 15534 - DNA, 121 bp, Artificial Sequence
  Synthesized
  misc_feature (61): n=a or g
tcccactgcagaaataaggagggtaaagggaattaaaaaaagtgttaatgagcagtaggtncagtggagttaatagatattcaagtaaagagtactgacatcctaaagctgtgtctggtac

SEQ ID NO: 15535 - DNA, 121 bp, Artificial Sequence
  Synthesized
  misc_feature (61): n=a or g
gattttatttaatatagatgcagtttcagcaacatctttcatctacaaggattcagcaganatcagtcaaggaactgcaggctctgatgtgcagcctcacactaactgcttaacatagcat

SEQ ID NO: 15536 - DNA, 121 bp, Artificial Sequence
  Synthesized
  misc_feature (61): n=t or c
cacttctgctttagcagcattccagagtggttgtaaggctttgaaacatgacctgtggtgnagtagctgctttcctttcagttgttgttatttcctagggaaaaacatactgtctcgtgtc

SEQ ID NO: 15537 - DNA, 121 bp, Artificial Sequence
  Synthesized
  misc_feature (61): n=a or g
gaaggctgtggtactgctcatctgtggggatgtgtggctgtggtttgccttcgaggaggcnctcggtgcttttaagcttccccagagagagttcccatccctaaagaaccccgtggtggga

SEQ ID NO: 15538 - DNA, 121 bp, Artificial Sequence
  Synthesized
  misc_feature (61): n=a or c
tttttttcttttttctttttttttttttctgtgaactatctttgcccttgctgatatgttntaaaccttggcaaaaaagtaaaagtatgcagaaacaagctgacctatggaataataagag

SEQ ID NO: 15539 - DNA, 121 bp, Artificial Sequence
  Synthesized
  misc_feature (61): n=a or c
tctgcaactacagcaatgcaaagtgccccccagcctctgcttacagcccgctagccactgnctgtgccagaactgagtcaagcaagagcagcgcaggttcaatgtgttttgctatagtgac

SEQ ID NO: 15540 - DNA, 121 bp, Artificial Sequence
  Synthesized
  misc_feature (61): n=t or c
atagtgtacattaaaagtcattaatgccgaagtgaaaggcgaaatttctcatgggctgttngtcattgcttggcgatagaggtggaaggccagacttgtgtccagacaaatgcatgtccca

SEQ ID NO: 15541 - DNA, 121 bp, Artificial Sequence
  Synthesized
  misc_feature (61): n=t or g
tgcctgggcccaagatgctgcagatgctaatgggaatggaaaggactggggtgtatccctngtgagcaggccctggaaagagcgttctttgttcactcccattggtaagctgttctgagta

SEQ ID NO: 15542 - DNA, 121 bp, Artificial Sequence
  Synthesized
  misc_feature (61): n=a or c
caaatattttactcccaaatgccttttgttcaaacaccagaagtgtgaatgcactgaaatntgcactgcattcatccatccgactcagctcctgttcaagactgaacagagcacaggagct

SEQ ID NO: 15543 - DNA, 121 bp, Artificial Sequence
  Synthesized
  misc_feature (61): n=t or c
aaaggcccatggatgccatccttccccagctgatccagcatgcccaggtctctcatggagngagagaaaacacagtgggagacaaaggcagaactagaatttatccagccttcaactatct

SEQ ID NO: 15544 - DNA, 121 bp, Artificial Sequence
  Synthesized
  misc_feature (61): n=t or c
agctgccaccttctcacagaatttgtgatgcctgtgttctgactgaatatatcaaaatgcncccttagatgaagtaagtttgcaaataaaaaacgtaaacacacaccttacgccataaact

SEQ ID NO: 15545 - DNA, 121 bp, Artificial Sequence
  Synthesized
  misc_feature (61): n=a or c
acgatgctaacaacacattttagctgacaaccttgcatttaatacttccaatgggcaacantgaatattttgttatgctctattactttcctaagttcaagttttcacttggaccctaaca

SEQ ID NO: 15546 - DNA, 121 bp, Artificial Sequence
  Synthesized
  misc_feature (61): n=t or c
caggagcttaccacttgcaaatctgcaggtgatgcagaactgtgaggagtggctggtacantgagtggctgctcttcctatcagaaggatgaatggttagagacatgggacagcaggagtt

SEQ ID NO: 15547 - DNA, 121 bp, Artificial Sequence
  Synthesized
  misc_feature (61): n=a or g
tcaaagggtaattagcctcgtattagcataaacatgtaaaatcgcacatcagctgaaggcnttccagacagcacaaaagacacgttatgtcttaaggtgtgtaatactcaaaaacagaaga

SEQ ID NO: 15548 - DNA, 121 bp, Artificial Sequence
  Synthesized
  misc_feature (61): n=t or c
tccttccagaatctgcattcagtggaaatcccacgtacactgtggagctgccatccaaccnctctgatctggaaagacacatcctgtcttacctaggggagtgctgtccctgtcacagcag

SEQ ID NO: 15549 - DNA, 121 bp, Artificial Sequence
  Synthesized
  misc_feature (61): n=t or g
ttgttgtgagctgttaaaatcttcatctttttgtgactcaaacaaggtaagttactgctgnctaacactaaatttttctaattccttgcattatgcttttgaacaatttttgaagttccca

SEQ ID NO: 15550 - DNA, 121 bp, Artificial Sequence
  Synthesized
  misc_feature (61): n=t or c
ccccacataaccaagcttctaccagcagcctggtggtgttacttccatgcagacaggacangtgagctcaccttgtcatcaatcactgctgagaaaaaggtcccaaagtcctggacaggct

SEQ ID NO: 15551 - DNA, 121 bp, Artificial Sequence
  Synthesized
  misc_feature (61): n=c or g
aggattatatctgtattcttttgtctgcaggttgagagctgtggataattggagcccactntcagatgagtgatgttctgcctgttctttgtcaaatccccaagtgatttcagatacctga

SEQ ID NO: 15552 - DNA, 121 bp, Artificial Sequence
  Synthesized
  misc_feature (61): n=c or g
gcagtcctccagagttattttgagacaactctagattgaaaatcagcccatttggttaggnaccaggtggttgcttaatgtaggcgcatgacttcaaaatttcagatgtctagcttctttt

SEQ ID NO: 15553 - DNA, 121 bp, Artificial Sequence
  Synthesized
  misc_feature (61): n=t or c
cagccaagctgtggagcgtatgagccagcctaaaacgcacagaacataacctgcttactgnggatccatcatccatgctgtgtgtgctattgcataatgcctgcaaggccctgcagcacgt

SEQ ID NO: 15554 - DNA, 121 bp, Artificial Sequence
  Synthesized
  misc_feature (61): n=a or g
ctgcaatgtcaatagatgagtaatatagggggaattttatataaaccaaatagctcccacnttgctggataaagtggatatgatcctgaaaaactgtcatgcgaaaaacaacctcaaacac

SEQ ID NO: 15555 - DNA, 121 bp, Artificial Sequence
  Synthesized
  misc_feature (61): n=a or g
attagcatctttccaaacatctggcttgcactcaaatcagagtatgcacattgtaaatccnttttataagatgaagtgccagcacatcttttcttaggaagaagagatggatatcagtata

SEQ ID NO: 15556 - DNA, 121 bp, Artificial Sequence
  Synthesized
  misc_feature (61): n=t or g
ggctgatgcttcttagtgtaagtcagtgtggtacaaagtgcaggaagaggaaggttgtttngacaacagctgcattttgggaaggcacaatggatgcacacttgttcatcacagaaacatg

SEQ ID NO: 15557 - DNA, 121 bp, Artificial Sequence
  Synthesized
  misc_feature (61): n=a or g
tgctgaaagtctaaaagactttaaagcctttggaaatgtctatgcagcaaaataaaggacntgaaatagaatggcaaacctcaacaggcttttatctttctattacagataacaaaagcag

SEQ ID NO: 15558 - DNA, 121 bp, Artificial Sequence
  Synthesized
  misc_feature (61): n=t or c
cattcacaaacgtcagggatgcgtccagtgcctttatttctgcacacgagcagaaacctangggtggaaaacagtctccttttaggaaaggggcagtcacacaaattctgcagaatgtttt

SEQ ID NO: 15559 - DNA, 121 bp, Artificial Sequence
  Synthesized
  misc_feature (61): n=a or t
tttactaaaggagcaataacagatacaccataaacacagtgctagatctgcgagtctctcnttaggatctgcacagtagagagagagttttctgctgctcctcatggcaaagagaatggca

SEQ ID NO: 15560 - DNA, 121 bp, Artificial Sequence
  Synthesized
  misc_feature (61): n=a or c
tcctgcagcagcagcaggaacagctccagggctgaatctgccatgccaatgttctcctaanatctaggaaagagcaagggggttttgtgtccccccttttccctatgggctaccgaagtca

SEQ ID NO: 15561 - DNA, 121 bp, Artificial Sequence
  Synthesized
  misc_feature (61): n=a or t
gtctttttttcctaaaaaggtacaattagtactccagctatcagagcgatcattaacaaangctccattttgtttcagttaaccagattttactgttacttcttatattaaccgtgtgtgc

SEQ ID NO: 15562 - DNA, 121 bp, Artificial Sequence
  Synthesized
  misc_feature (61): n=t or c
acagaagctgcacgcagcccagcgtcccccagacgtgcttacacatccgtttgctcacagngctgaatgttctgccccacacgcctgctcatctgctctgttcaaggcctcatatgcctct

SEQ ID NO: 15563 - DNA, 121 bp, Artificial Sequence
  Synthesized
  misc_feature (61): n=t or g
gattctatgattctatgatttacattgttacgtacatgtgcacattattatctttcacatnatgatttaacaaggctcttttagacttgtaagctgtgaagctatgtatctagaaccaaat

SEQ ID NO: 15564 - DNA, 121 bp, Artificial Sequence
  Synthesized
  misc_feature (61): n=t or g
tgttatgggcaggtttaccttacactacgtttatgcaaggtttctcttgtctaacacctcngaccttcacttgctgacaaggcataagagaagaatacgtgatgcaaagtgagattctagg

SEQ ID NO: 15565 - DNA, 121 bp, Artificial Sequence
  Synthesized
  misc_feature (61): n=t or c
gttgtgtggttcccagctgtggatgagttggtttgagctgaactgctcttcactgtggtgntcctggaccaggagaagtccaggcacagactgaccatggaaacggttttctgtgcaccac

SEQ ID NO: 15566 - DNA, 121 bp, Artificial Sequence
  Synthesized
  misc_feature (61): n=t or c
tacttacaaggacaaggctttttaactgggtgtttccttcatttgtcatcattaagaaaangacagttggagtgaaaattaaatactcgggggaaaagaaaacaaaacaacatcacaaacc

SEQ ID NO: 15567 - DNA, 121 bp, Artificial Sequence
  Synthesized
  misc_feature (61): n=a or c
tcaatgtaagatatcgaatcaactgccttggaaatcttctcttgctgttgacacacggatncccgtgctcagttctcagctccactcctttagcagggatgtgccatttccctcatgtctc

SEQ ID NO: 15568 - DNA, 121 bp, Artificial Sequence
  Synthesized
  misc_feature (61): n=t or c
ctgtccatgctgggtttgggcagcctgctgtccttcagtaatgctgaaacattgtccttgngagggattctgtctgctcctgaagtcaccagccagtgctgggcaagggtgtggaggctcc

SEQ ID NO: 15569 - DNA, 121 bp, Artificial Sequence
  Synthesized
  misc_feature (61): n=a or g
gtgtgtgtgtgaagtcagcagaacaactcatttccttctataataaggctccagcccctgnttgggatggctggttgcatgaagaaatgactttcttaagaatggaaacacacaattgctt

SEQ ID NO: 15570 - DNA, 121 bp, Artificial Sequence
  Synthesized
  misc_feature (61): n=a or g
acacatgtagctgatagaaaacttaaaaacagctctagatccactatctgtatctcccagntctgttaataatgtccacagcgtgaagcagtggggggggactgcaacagtctgctgtagt

SEQ ID NO: 15571 - DNA, 121 bp, Artificial Sequence
  Synthesized
  misc_feature (61): n=t or c
aactgttcaagttttctgactacagagctagttctatccttggatatagcacattattttnccaccaaataagacatgaaagtaaacgtttcttagaaataaataacattcaacctgaaga

SEQ ID NO: 15572 - DNA, 121 bp, Artificial Sequence
  Synthesized
  misc_feature (61): n=a or g
ccaaactgggtcggtgagaggggaagacgtggtgggatccaaaacaacacctccaccgccncgcacctcgtggagaaagggctgacagctctcctgctataggaaaacaacacacgaatct

SEQ ID NO: 15573 - DNA, 121 bp, Artificial Sequence
  Synthesized
  misc_feature (61): n=a or g
tggacttttttttaagactgtgagctgagcaaaaggagagggacacagtaacacaatgacnatacaatagagtcagtataaaaagaatggaaggaatagcaagataggaataggaagaagg

SEQ ID NO: 15574 - DNA, 121 bp, Artificial Sequence
  Synthesized
  misc_feature (61): n=t or c
tcaaaagcagctgttagagttaacccatccaccctctagctcctgggcaccttgggacaanaggatcagatcattcactatggggcttccctgctttggcagcacttccagtgggacttga

SEQ ID NO: 15575 - DNA, 121 bp, Artificial Sequence
  Synthesized
  misc_feature (61): n=t or c
agtgcattaattttatgtgtcctgctgaggtttgctttattttcacgtgccaatatcaacnactcaggaaaattttgtatcagtattatcaagtttgcaatatagtgtggaatatctggtg

SEQ ID NO: 15576 - DNA, 121 bp, Artificial Sequence
  Synthesized
  misc_feature (61): n=t or c
acaagaagccagcccacatgtagcacagggtatgactgctccccaaacagaaagcacctcngcaggaagggtttctgctccatcagcatccagaggtttttaattgtccatctcctgccaa

SEQ ID NO: 15577 - DNA, 121 bp, Artificial Sequence
  Synthesized
  misc_feature (61): n=a or g
catcaaaatctaattactgttcatttttattaaacccgactatgtggtataacaataaacnctattgtctcacagtggttcaagtctcatgtttcacagtagatttatctcattatgtgtc

SEQ ID NO: 15578 - DNA, 121 bp, Artificial Sequence
  Synthesized
  misc_feature (61): n=a or g
ttggaagcacacttctcttcctcacgcaaactttcattacagccatacaaaggatgctganttccacctgtaccagctgtcctttctgacagcacatgggtgtatagcagtgtatggggcc

SEQ ID NO: 15579 - DNA, 121 bp, Artificial Sequence
  Synthesized
  misc_feature (61): n=a or t
tgttggtgctagaaaaggacagtcagtgctgtccaagtatgaacctcaaagctgaagaagnggatttccagcattatgctgactctgtcaaacttgtaccattgcaaccagctcagatata

SEQ ID NO: 15580 - DNA, 121 bp, Artificial Sequence
  Synthesized
  misc_feature (61): n=t or c
gtggtggaaatctgaaactgcagagttcaaaagcagagagttttaccaaactcatcagctnaggaattttaatgagtatttccccaaccagtaatcagttttataccgtacaacttggttc

SEQ ID NO: 15581 - DNA, 121 bp, Artificial Sequence
  Synthesized
  misc_feature (61): n=t or c
gtcaagccttcagaaaggaggaagactgggacatgtgtgttcttgctgtgtgctccatgtntgatgtgcaaacacctgacttgctcgggaaaggagcagtataacctaccttctctcattt

SEQ ID NO: 15582 - DNA, 121 bp, Artificial Sequence
  Synthesized
  misc_feature (61): n=a or g
ctagatgacctcttgcccaggcactgccttcagaagcatttgcttcccttccctgaggacnaattatcataaataattatcattatctatgatcatgatcattatcattattataaatctg

SEQ ID NO: 15583 - DNA, 121 bp, Artificial Sequence
  Synthesized
  misc_feature (61): n=a or g
ttctcctttttctgtagtcttctgcaaccatggggctcaaaggtttggataaagactgacnttttaccctttagtaataaaaaactaagaataaccaatttattttcattttgttaccacc

SEQ ID NO: 15584 - DNA, 121 bp, Artificial Sequence
  Synthesized
  misc_feature (61): n=t or c
agttagagctgtgtaaggcagaggatttccacacgtagttcatctgagttccactactggnagtgttacagcttcaaaaaccatgcacgtttgctgtttagctcgctaagttgagatgcct

SEQ ID NO: 15585 - DNA, 121 bp, Artificial Sequence
  Synthesized
  misc_feature (61): n=t or c
gaaaggtatccgtggaggtgtctgtcctcatcagctgacccaagcagagaaggaatttcanggcactatagacaaacctgcttgttcgagttatgtttgcatttagttctggtgcctttct

SEQ ID NO: 15586 - DNA, 121 bp, Artificial Sequence
  Synthesized
  misc_feature (61): n=t or c
tagtgatagattgttgctaagaaaagatgaatggaagaatggatgttttattttactacangtcctgggaaaagctgtcctttgttttcagactacaaccctgcttttttagtacaatcca

SEQ ID NO: 15587 - DNA, 121 bp, Artificial Sequence
  Synthesized
  misc_feature (61): n=a or g
ggtaaatattaaaactgaagtccagctggatcacaataatcaaacatataattttcaatantacaaattttaatttcattagtagggagccacaaacttcatgaaaatcagaaacttaacc

SEQ ID NO: 15588 - DNA, 121 bp, Artificial Sequence
  Synthesized
  misc_feature (61): n=t or c
actttacaggattgaaatatagttctagttggcaaaacaacaaactctgaacccagatttngaagtatgtattaacaaagaaaatgaagagaggtacctacagggaggatggctgaagaat

SEQ ID NO: 15589 - DNA, 121 bp, Artificial Sequence
  Synthesized
  misc_feature (61): n=c or g
tctgaaactgatggctgcggtaaccaatacatatcagaataactaaggatgcaacttcttnccatgttaggtccttctgatggatccttttgactttcagacaccgtcagtaaaatgggaa

SEQ ID NO: 15590 - DNA, 121 bp, Artificial Sequence
  Synthesized
  misc_feature (61): n=a or g
tccttccaaatcctttctgattgttcaaattctcaaaaacattctgactccactcattccngtgaacttataaatgcatcatggagaaaaaaagtgctgtgttgtcaggttgagcctgatg

SEQ ID NO: 15591 - DNA, 121 bp, Artificial Sequence
  Synthesized
  misc_feature (61): n=a or c
tgccctatatcaagatgatacaaacactgttagagagaaagaagaacaaaggataataatnataattcatcaaggcattagtgcagttctcattcctacaatatttcagtggctatccaga

SEQ ID NO: 15592 - DNA, 121 bp, Artificial Sequence
  Synthesized
  misc_feature (61): n=a or g
tccatggcaacttctgagatgttatttcttatgctaacaacacattcttggctggcaaacntaaggcaagagatgtttacagctgccaagatttcatacacaggttctaaatacagaacag

SEQ ID NO: 15593 - DNA, 121 bp, Artificial Sequence
  Synthesized
  misc_feature (61): n=a or g
gctttccttctatcactcgtggtgtgcgtttttatgatgggaaaggctatccttaggagcnggagctgttacctcatcaggaagatgttaggtggatccggcttttgatcactttgttagc

SEQ ID NO: 15594 - DNA, 121 bp, Artificial Sequence
  Synthesized
  misc_feature (61): n=a or g
aagaaaaagaaagaattcaaacattcagacttctgaaaatcaactagtaatacagctgacnagtcccattttcaagcagttttttgcagccgcaagggactgaagcatgcgtttctaaatg

SEQ ID NO: 15595 - DNA, 121 bp, Artificial Sequence
  Synthesized
  misc_feature (61): n=a or g
tctaaaacctttttatttactacaaacacctctaaggagtttatttaccagaataagttcnatgctttgggtgacagagctttaaaactgtagctttaacacattcaccttgggatgacca

SEQ ID NO: 15596 - DNA, 121 bp, Artificial Sequence
  Synthesized
  misc_feature (61): n=a or g
cagttaatgtatttttacatatacatataaacaggggacaagattctgatatcagctcccngagggtaaatacaatgttgttataataaaaacaatgcaacagaccactattatgaacaat

SEQ ID NO: 15597 - DNA, 121 bp, Artificial Sequence
  Synthesized
  misc_feature (61): n=t or c
ttcctgcaaaagtatatagcaaacagcttttgaatgaaaactgactgaaggtgggaaatangaaaacattttcatctcataaacgagtttgaattgttttgctcttctaactctgaagaga

SEQ ID NO: 15598 - DNA, 121 bp, Artificial Sequence
  Synthesized
  misc_feature (61): n=t or g
cttctatagatcaagaatgcaagacacaaaaaatctatttctcaaaggaaaaactgtttgnttgtaaatggattccaatgtgcaggtgcattttattatttatttatttatttattttggc

SEQ ID NO: 15599 - DNA, 121 bp, Artificial Sequence
  Synthesized
  misc_feature (61): n=t or c
gtgatgtcttcttggcttcttgtcaaacctggcacaaccctaccttttgcagcatccagantgaattgatgactgagacaacttacatgattgagtagaagtacacttactggaactgacc

SEQ ID NO: 15600 - DNA, 121 bp, Artificial Sequence
  Synthesized
  misc_feature (61): n=a or g
acagcaggcttagtgtgtcccgtggtgatgcagctgctgctgcattgccacttctgggaanttcttactaattcttcatgccagtcttcacatggtagtaaagacaaacaaaacagaaatc

SEQ ID NO: 15601 - DNA, 121 bp, Artificial Sequence
  Synthesized
  misc_feature (61): n=t or g
aacttaccttgactcagctgaattgtgctataattttcctgccatatttccataatttttnaattgttcattatcattagccataggctagacatctgtttggataagaactccagtgcat

SEQ ID NO: 15602 - DNA, 121 bp, Artificial Sequence
  Synthesized
  misc_feature (61): n=a or c
gcctcttgatttttgcaaaatgcctctcattttccccagcttgcaggacaaaacttatacncatgcttaacattcgctcattttgctttttatatctttcatatatttgcagcacaaagcc

SEQ ID NO: 15603 - DNA, 121 bp, Artificial Sequence
  Synthesized
  misc_feature (61): n=a or c
tatatgaattgaagttctgtactctggagtcttgtaaactttgtataacaaataaaaaaancatcagaatagtggttttgccgtggccactgtcccttgagttcaactttagatgtttttt

SEQ ID NO: 15604 - DNA, 121 bp, Artificial Sequence
  Synthesized
  misc_feature (61): n=a or g
caaaattatgtccctgaactagccgggaaactttgaaattcttactcctatgaaaacactntggaattaatattaatacagtagaccagtgaaatctgaggtaactattcaacatctgcat

SEQ ID NO: 15605 - DNA, 121 bp, Artificial Sequence
  Synthesized
  misc_feature (61): n=t or c
cagaaaacattagttccccccttgagttttttcacattttcaaatttgagtaaaatatgcngtaacccatctgatcagattggttgtcactaatgtcttcactattatctcagacatccaa

SEQ ID NO: 15606 - DNA, 121 bp, Artificial Sequence
  Synthesized
  misc_feature (61): n=a or g
ggagagcatgttttgctggaataaccaagcagattatgaccaagacacttaactgcttccnttatatcaaatcgagatttaaaataaagataagacatgagaggaatgtcatgattttcat

SEQ ID NO: 15607 - DNA, 121 bp, Artificial Sequence
  Synthesized
  misc_feature (61): n=t or c
gaagtcatagggaaagcagcatggggtgatgaatttcagtctgtgtgagttcatgttctcnttaagagttttaggaaaaaggaacactgcctacagtcaaatcaagtatagttcagctgtt

SEQ ID NO: 15608 - DNA, 121 bp, Artificial Sequence
  Synthesized
  misc_feature (61): n=a or g
gcatggtgggcatctgcccacggcatgcggtctggcctgggaagggaacgggacctttccnttgggcttgtggatgtgaaagtagaaataatctcatcactacgtgcagtaagtcccatat

SEQ ID NO: 15609 - DNA, 121 bp, Artificial Sequence
  Synthesized
  misc_feature (61): n=c or g
aattatctttttgagagtgtgatttcagaattacatttattgtggttttccctggcagaantccatcctcttctgcaagtggctaacactgaacgctattcaggcttcagctagatcagaa

SEQ ID NO: 15610 - DNA, 121 bp, Artificial Sequence
  Synthesized
  misc_feature (61): n=a or t
ctggactgacgtgatctgatctttgtttatgagaaaattccattaactgttcaagagctantatcgattattgttaaaggaaacaaatattggagataagaagcaagatgattataaatat

SEQ ID NO: 15611 - DNA, 121 bp, Artificial Sequence
  Synthesized
  misc_feature (61): n=a or g
ttctgcacaaacaaacaaacaaaaaacttgtgcacatcatgtaaaagtaaataagataaantatcccaaaaccttaataagaggaatgatagtacttgataatgtccttgggaattgcaat

SEQ ID NO: 15612 - DNA, 121 bp, Artificial Sequence
  Synthesized
  misc_feature (61): n=a or g
aatactgctgtccagtcacccaaagtggaatccgcttcattacatgtgcaaggaaaacacnatccattctgtgggttttagtttgtattctaacatttgcaattattaatgaaagaaaaag

SEQ ID NO: 15613 - DNA, 121 bp, Artificial Sequence
  Synthesized
  misc_feature (61): n=a or g
ctgctcctttgtacctgaaaaaacatctcagtctactcttcctgtccatgatagatgggcntactagatacgctgccctacctgatgataaatatgatattaaactctcagaatagcaacg

SEQ ID NO: 15614 - DNA, 121 bp, Artificial Sequence
  Synthesized
  misc_feature (61): n=a or g
gctaagcccttatgcgaatcaagaaacatcagctatggtctattatgtctaaaggagtatngtgaaataggagaaaaggatttctgaaggatacttatgatttggaagacagcttcattat

SEQ ID NO: 15615 - DNA, 121 bp, Artificial Sequence
  Synthesized
  misc_feature (61): n=a or g
tgaaatgtttttgctggatttggtttctgcttgataggcaagggaacaagcaacatccacncgattgcaacctgtgtttgtgtttggatcctagcataacaaaacttggtgcttatagaca

SEQ ID NO: 15616 - DNA, 121 bp, Artificial Sequence
  Synthesized
  misc_feature (61): n=t or c
atcagctttccaaacattcccttaacagcagtgcgttagagaaatgtttggggttgaattntggcctgtacggtaacacgaggctgtgctgtttgagcaatacaaaatttgaggtttctca

SEQ ID NO: 15617 - DNA, 121 bp, Artificial Sequence
  Synthesized
  misc_feature (61): n=a or g
ccccgtggctcccattgtaagtattccagtcctaactgggacagctggaactacgctgatncagaactcagtgacggacctcacttgatgctgaagatggcatagagagacttcagctaag

SEQ ID NO: 15618 - DNA, 121 bp, Artificial Sequence
  Synthesized
  misc_feature (61): n=t or c
caagtgcctttgcttacgagagccacagactgactatatggaaagaaccttgaagttcatnttacttatgccttcacccccttaaaactgttcccagtggtatataagtgctccactcagt

SEQ ID NO: 15619 - DNA, 121 bp, Artificial Sequence
  Synthesized
  misc_feature (61): n=a or g
cccttagctgagcactcagagcacagcacctaattattttaatgactgcaaatgaactgcnaatttcttaagagcaaaacgttttcggtcaatctcaccacattaataccagactgttaga

SEQ ID NO: 15620 - DNA, 121 bp, Artificial Sequence
  Synthesized
  misc_feature (61): n=a or t
attttcttacttgccaaacaacttcttgtactcaaagaattaactgagtcaatcatagagnccttacaggactgatgatgctattgttcagacaacaaataagacatttatcccgtttaca

SEQ ID NO: 15621 - DNA, 121 bp, Artificial Sequence
  Synthesized
  misc_feature (61): n=t or g
aagctatcgatgcttgtttgcaaagaacagtactgtttctgacagtacattttactaggangaggaatgcccattaaaagggtactgtttgtctgggactgtctttcattattcactggca

SEQ ID NO: 15622 - DNA, 121 bp, Artificial Sequence
  Synthesized
  misc_feature (61): n=a or g
attttattggtttcaaatgattatgaatttgccatagttctctgctagttgttctgtcagntaagtgtattaaaaatgtatctagtttttagctttcagcagctgatgatgctcaatgtgt

SEQ ID NO: 15623 - DNA, 121 bp, Artificial Sequence
  Synthesized
  misc_feature (61): n=t or c
caataaacttgacattattgaagaacattcataaattttgatgaaattcaattactgtaanaattggttcttgcagtgtcctcactgagccactgctgtaagtatgaggattacatattct

SEQ ID NO: 15624 - DNA, 121 bp, Artificial Sequence
  Synthesized
  misc_feature (61): n=t or c
cattagaagaacaatactgcaaacactgagttaaaacacctcagggaccttagcacgtgangtgtagaatcataggtttaaaattcagtcatttttaaagctaaacatggtcacaatctct

SEQ ID NO: 15625 - DNA, 121 bp, Artificial Sequence
  Synthesized
  misc_feature (61): n=t or c
tttctgcctctctccctgttgttcaaaagtagtttacattaagttcttaaagcttatttcntttcatactttggaaatttttcactctcagcgttatgttgttgggttttttttgtttgtt

SEQ ID NO: 15626 - DNA, 121 bp, Artificial Sequence
  Synthesized
  misc_feature (61): n=a or t
tcctgtataaaaaaaaaaaaaaaaaacaaacaaacagtggagagatcttggttccattacntcaaaactgaaaatctttatttacctcagggcagcagattacatgccaaatgtatttaca

SEQ ID NO: 15627 - DNA, 121 bp, Artificial Sequence
  Synthesized
  misc_feature (61): n=t or c
agtatgaattgagcttgttacaaaatacgtaaatgtagttgtgaggttggcctaaatctantcctgttggggaccctggtaaacttctcctaagctaagttagtcaggcaatgagaatttt

SEQ ID NO: 15628 - DNA, 121 bp, Artificial Sequence
  Synthesized
  misc_feature (61): n=a or c
ccatatctatccaatcagaatgagggaactgaaggatatggggagcaaaaaatggacttcntcaatcaatacatacaaaggagagtcttgcaacctactccaccatagacagcttcttgtt

SEQ ID NO: 15629 - DNA, 121 bp, Artificial Sequence
  Synthesized
  misc_feature (61): n=c or g
ctttttggctctaagaatactccccattacctatgtctgtttcctctcagcaagacagctnctgaatgacaaaggcaatacttccatttcttcataaccaagctctggtgtccatgcacag

SEQ ID NO: 15630 - DNA, 121 bp, Artificial Sequence
  Synthesized
  misc_feature (61): n=a or g
cgggggcagcacgagagagcgcggaccggccgaagaaggaaggcggggagaaggaaagagngtgcaataagaaaagatataaccgtgccagcgttcagctcggcgccttcccgccccgctc

SEQ ID NO: 15631 - DNA, 121 bp, Artificial Sequence
  Synthesized
  misc_feature (61): n=a or g
atcccattcttccgacaaatatacccacaaatattcgggtcaacatccgcccggccacacngcatgcacactgcaaaggagagagcaaatgtgagcagtggtgaacaccctgtgggaccag

SEQ ID NO: 15632 - DNA, 121 bp, Artificial Sequence
  Synthesized
  misc_feature (61): n=t or g
cacaagccattcagtgaagctaccttctagcactcacctgctgcacgacagttcttcctgngggtatattgcactggaagtaagcaagtcatagagctatctgaaaaggtacaaacatctt

SEQ ID NO: 15633 - DNA, 121 bp, Artificial Sequence
  Synthesized
  misc_feature (61): n=t or c
agccacggctcctgccagcactgcccttaccctgaccgctgtagggatggtgctcctgtangcttcctaagacagcatcagcatagcacagctcggctggtccgttcagctcatgttccag

SEQ ID NO: 15634 - DNA, 121 bp, Artificial Sequence
  Synthesized
  misc_feature (61): n=a or t
aattaaatgggtttcctgttcagggagtttcaaatacatgcttggtattacatactcttgnagtaagaaaggtgttttcaggaatgaaagccaatgaacagatgctgagcattcccaagac

SEQ ID NO: 15635 - DNA, 121 bp, Artificial Sequence
  Synthesized
  misc_feature (61): n=t or c
gttgctgcctctgccctgggctcatttctagtgttgtatttaactctttgttacactgaangaatgcacaggtaggcagagggagagccaaggaggggatctgtgctgcaccaggcttcaa

SEQ ID NO: 15636 - DNA, 121 bp, Artificial Sequence
  Synthesized
  misc_feature (61): n=a or g
actaatttaaagaaaaaggagtcaaaggagtcggatgtaaatctgtgctagaaggaaagcntagtgctattttcctaagtgaaaaggacaaggaggaaattttgttaaaatgtagcgctca

SEQ ID NO: 15637 - DNA, 121 bp, Artificial Sequence
  Synthesized
  misc_feature (61): n=t or c
ctccacctcttggctttgcctttccatccccgaggcacttatttgggatatctgtagcagntggaaaagacacgtttgtatttcctctttcactctcaaacatcactacaggggaaactgg

SEQ ID NO: 15638 - DNA, 121 bp, Artificial Sequence
  Synthesized
  misc_feature (61): n=t or g
ctcataaagtaataattgtaacaaatctgaaaatcgcaccaggagttaaattttaatgagnatctccctcccccaatgatttagtaaagtaattaagaatgcaacagtattgttagcttgc

SEQ ID NO: 15639 - DNA, 121 bp, Artificial Sequence
  Synthesized
  misc_feature (61): n=a or c
gataatcccaggtggtcccttccaacatcaaccatctgcaattctgtggtaattatatctnaatgtcacttaagtttagttttgggttccaaactttcctatctagaagtgcccagtaaat

SEQ ID NO: 15640 - DNA, 121 bp, Artificial Sequence
  Synthesized
  misc_feature (61): n=a or g
cctctaggactacaccccatggaaaagacccatgatggagcagttcttgaattgcagaccntgggaagaccatactggaacagctccagaaggactgtatcccatgagagggacttcaccc

SEQ ID NO: 15641 - DNA, 121 bp, Artificial Sequence
  Synthesized
  misc_feature (61): n=c or g
aatttagctgcaccactacaatcattgcaaagatgaaacactacagcaggtgaaatgactncattaatgtctgtctgtaccaaatgggagtatcttgttttaatcaagtctgtctaaataa

SEQ ID NO: 15642 - DNA, 121 bp, Artificial Sequence
  Synthesized
  misc_feature (61): n=t or c
agaaggttcacttcaaaagcatattttcagtctgggagaatctatgttcgtacttcagaangtctgcctggcccagtcttccttacagacaccactacaatacaataagtaggaaaatctc

SEQ ID NO: 15643 - DNA, 121 bp, Artificial Sequence
  Synthesized
  misc_feature (61): n=a or g
tccagagctgtcatggctgtacacaacctgattcccctaccatgtttgacagcatgtgatngaaaatgctgcataagtcgaggctggctgagtgtaagggtttatgcagctgtgagaaact

SEQ ID NO: 15644 - DNA, 121 bp, Artificial Sequence
  Synthesized
  misc_feature (61): n=c or g
atctgctcttggcacatctgagcttggtgaataagccagaggattgggaattagctgcaancctccgtgctccatccctttgaacgctcagttaatgtgacagtgtgggcacgagcgcagc

SEQ ID NO: 15645 - DNA, 121 bp, Artificial Sequence
  Synthesized
  misc_feature (61): n=t or g
tttggactcaatgatctccagaagtcccttccaacccctgtgatcccgtgactctgtgatngtagcgtacaagagaactgggactcactaaacaacagtcatcttttacacacatctgcaa

SEQ ID NO: 15646 - DNA, 121 bp, Artificial Sequence
  Synthesized
  misc_feature (61): n=a or c
gcatagagatgcaaattgttcccagtcagaggaaataggtgagacgggaattgaacccctntgttctcaattccagatagcgtctcaagctccacgctgtttttgacctgctagcacaggt

SEQ ID NO: 15647 - DNA, 121 bp, Artificial Sequence
  Synthesized
  misc_feature (61): n=t or c
ttgcaacttgctggagatgcagaaggaagcagaacactgcatggcacagaacgccttttcnatgcatccctcttgacccactgggccctaccacaccccccccctcagcagttcagatagc

SEQ ID NO: 15648 - DNA, 121 bp, Artificial Sequence
  Synthesized
  misc_feature (61): n=t or c
agatacagaataaatccagtgtctcttttctactagcccatttgcgcttccaacaagaaanagtgagaaaatcaggtgaggacagaacagagttggcagacccattgccattccagcagcc

SEQ ID NO: 15649 - DNA, 121 bp, Artificial Sequence
  Synthesized
  misc_feature (61): n=t or c
aacatcaatagcttctcacagtttggttggccccaggagtgccaagtataccatagcacanagaaatctgagacctttaatattgtttgtaagaagaaagctaattttctcaacatcaaat

SEQ ID NO: 15650 - DNA, 121 bp, Artificial Sequence
  Synthesized
  misc_feature (61): n=c or g
gaaatgagatttcagggttagagtcacaggaatgtgctactgaaacctaatcatcagactnctgctcatccagtcaggaaatttaacaggactgtctgatctgaacagcatgctcttcagt

SEQ ID NO: 15651 - DNA, 121 bp, Artificial Sequence
  Synthesized
  misc_feature (61): n=a or g
atgcttattcaggagacaggacaagcacacacaaaacaaaattaaagttgcctgggcaatncttagtatagtatatcaagaatttaaactaaattatctgtacaaaaaatgtgctgaatct

SEQ ID NO: 15652 - DNA, 121 bp, Artificial Sequence
  Synthesized
  misc_feature (61): n=a or t
tttgcttgaacagggaacgcaaagaagtctatcatacatataccaaatgtcaataacgtgnaattttttgttagaacagcccaattacagcacagaaaagggattctcatgcagctcagga

SEQ ID NO: 15653 - DNA, 121 bp, Artificial Sequence
  Synthesized
  misc_feature (61): n=a or g
ctgcatgtgggtatgtgtgtgttcaaccaatccctgggtgggcttgtcttcccaaggaccnagggaatgtttgtggtgagagctctgccagggagctgaggaagcgctgaccttgagccag

SEQ ID NO: 15654 - DNA, 121 bp, Artificial Sequence
  Synthesized
  misc_feature (61): n=t or c
ataataggaagaatgaaaaataattaaggttggcagtacgaagggaagcattaggggaganttagagcaagtctcagcatttatgcttcttcctacctaaaataaagtcctcgaagtcctt

SEQ ID NO: 15655 - DNA, 121 bp, Artificial Sequence
  Synthesized
  misc_feature (61): n=t or c
tggcatatcagaacgctttgtaatacgtttctaccatgaaattggtttcaagacccaccanatcctagttttcaaactcttttcagagactatttatacaaacgtaatgccttaggttaaa

SEQ ID NO: 15656 - DNA, 121 bp, Artificial Sequence
  Synthesized
  misc_feature (61): n=t or c
cattgtgttgcttattctaaattggaagcttcgattacctctaatcttctttacttggtanagcagcatgtatgtgtttcttgtctcagctgtgttttctgagcttcactccttgactagt

SEQ ID NO: 15657 - DNA, 121 bp, Artificial Sequence
  Synthesized
  misc_feature (61): n=t or g
acaagaacagggttgaaaatcaagccctgggccatgggctcctagctcattctccttattnctggagaatagtttagaatcatgctttacttgctgatatgctctgtggcctttccatagg

SEQ ID NO: 15658 - DNA, 121 bp, Artificial Sequence
  Synthesized
  misc_feature (61): n=a or g
ccattaggacctgaagttcagcttatagatgactctggagaacttacttgtggctcagctngaccgtgactgacaacaaacagaagacaaatcagctccctctctgtgcaagtctcattct

SEQ ID NO: 15659 - DNA, 121 bp, Artificial Sequence
  Synthesized
  misc_feature (61): n=a or g
gggagtagggcatatagagatttctttcctcatctggaaatggcatggcccttattgaatntctgcccttggtaggttaaggattctttcttccttctaatgagactgtcttcagagggct

SEQ ID NO: 15660 - DNA, 121 bp, Artificial Sequence
  Synthesized
  misc_feature (61): n=t or c
attcagcaacagctctttctaaagcttcctcctctgcctgcaggtgggcctgcctacagtncaactgactctcaccctgcatgtctgcttgttttcactcaaacccaacagtatattgtcc

SEQ ID NO: 15661 - DNA, 121 bp, Artificial Sequence
  Synthesized
  misc_feature (61): n=t or c
gagtaataccaacacctaaaggaaacatatcaaaaatttcataccaagctgacacctattncatcagcatgcaaataggtgcactgatcattaatcatgccagaaaaattctataagcaac

SEQ ID NO: 15662 - DNA, 121 bp, Artificial Sequence
  Synthesized
  misc_feature (61): n=a or g
gtaaaaatctgctttggaacggggacaggaaaagagaggagttggtcacaatcattagacntagactcatctatctgtgttctgttgctttctagatattatacaacagagaaaaaaagat

SEQ ID NO: 15663 - DNA, 121 bp, Artificial Sequence
  Synthesized
  misc_feature (61): n=t or c
catacaagcttagtgaaaactctggcaggttaaaagtaaaatccatgctgcacattatagntgtaaaccatgctgatgaagactcctgaattatagtattttcacagacatcagagaatca

SEQ ID NO: 15664 - DNA, 121 bp, Artificial Sequence
  Synthesized
  misc_feature (61): n=t or c
atgtgtttggttttgttttttgttttttggtttttttaatattttgacaaaaacctgtaanataattacaatgggaacactcttctgacctaacttcaagaaatcagttcaagaaactaat

SEQ ID NO: 15665 - DNA, 121 bp, Artificial Sequence
  Synthesized
  misc_feature (61): n=a or g
gacattttgtcttggcttttcattttgtttgggcactttgctcagtcagggataggagganaggacaaacaaggcttgttcaaactgcagtagctcagagaagtgctaaagttcgttggtt

SEQ ID NO: 15666 - DNA, 121 bp, Artificial Sequence
  Synthesized
  misc_feature (61): n=t or c
agccaagaattcttcactccttctgtaagaaacaaaccccagactgatgcatcttcctcancagttcagctactgcccattggaaagagtcaaagaagctaaataactgctgcccttaaaa

SEQ ID NO: 15667 - DNA, 121 bp, Artificial Sequence
  Synthesized
  misc_feature (61): n=a or g
gaactctgcagcgtacatgtttaacgtgacagcggcatgtatggaggtgtcactccatcantgcatatgctgtgttgggtgggctgttctcagaggctgagatagtgagaactgtcagaaa

SEQ ID NO: 15668 - DNA, 121 bp, Artificial Sequence
  Synthesized
  misc_feature (61): n=t or c
aaactgaactgcatttcacagtcagcagtagaaatgtgccagtggttatcctgtaacttcnaaaggcatcttgtacaacgcaacaaagagatgatttaaaagactgaaaaattcccagccc

SEQ ID NO: 15669 - DNA, 121 bp, Artificial Sequence
  Synthesized
  misc_feature (61): n=a or g
gactgtagttttccaaaggccctgaggtctcacaccgacatcattacgtgtacttgtgaanatgtggatacacggttttaaaataacacgatgcttatcagtaataaatcgcctttcacgg

SEQ ID NO: 15670 - DNA, 121 bp, Artificial Sequence
  Synthesized
  misc_feature (61): n=a or g
tggctcaacatgcaaaccttctccatgctgaggaaatggctgctgtgctatggggacaagnagatgaacacaccaaattcaggtatgaatcaaagggctacagataagggcgggtttgcac

SEQ ID NO: 15671 - DNA, 121 bp, Artificial Sequence
  Synthesized
  misc_feature (61): n=c or g
ttcctggtgttatttgcagttaagattaattgacattgcaacagtttacctataaccaganagctgtgctccatcccaaaatcagtccacagaggagcaaagcatagaacctatcacatct

SEQ ID NO: 15672 - DNA, 121 bp, Artificial Sequence
  Synthesized
  misc_feature (61): n=a or g
tttccacaattttttttttctattcctgttttctgctgaaggagcacctagagccatgagntgtcactttatgggcactgtgctcatccctgaaagtggtaaagattccaaacaacgagtg

SEQ ID NO: 15673 - DNA, 121 bp, Artificial Sequence
  Synthesized
  misc_feature (61): n=a or g
aggctctccttctcgggatagttcttttggattacagcaggaagccagaaagaataggaancatctggctaagatggatgtactagaccagctggcaacagcagagcacaaagacattggt

SEQ ID NO: 15674 - DNA, 121 bp, Artificial Sequence
  Synthesized
  misc_feature (61): n=t or c
tcgtcataatgcagccagtaagaatacttttcaacttcttcttaacactattactattccnattccaatacagctgcttgaaattgtatgtctgttttgttttagcaaaacgaagtgatat

SEQ ID NO: 15675 - DNA, 121 bp, Artificial Sequence
  Synthesized
  misc_feature (61): n=a or g
atgttctcagaacagatagtattggtgatctctcaggctgtgctaagcagcagacagcaangtgaactgtaccaaaaatcgtattcttctatatctggctcttgtgattagctatgttctg

SEQ ID NO: 15676 - DNA, 121 bp, Artificial Sequence
  Synthesized
  misc_feature (61): n=t or c
ttgcagctgcatttcatttcacagaggttctctcattgggctttattgtttcaggacctgnagtctgtgttgattgtgtaactaaaaagctttactttttcaccactctctcaaaaaattc

SEQ ID NO: 15677 - DNA, 121 bp, Artificial Sequence
  Synthesized
  misc_feature (61): n=a or c
gctctaaaaaatatagtagatagattgatggagtgtgaaccaagctactgctagcctagtnatagactcaatgaaaagagaatggaagggatttcatgaaattatttagtccaccatgccc

SEQ ID NO: 15678 - DNA, 121 bp, Artificial Sequence
  Synthesized
  misc_feature (61): n=t or c
aagctactggatgctgattcctattcttttgcccctttacgggcatcctgacaggagatantagattattccttgcattttggcaaggaaatgtatgggtaattacaactgtacttttgaa

SEQ ID NO: 15679 - DNA, 121 bp, Artificial Sequence
  Synthesized
  misc_feature (61): n=t or c
cacctcacctatgccagcctcccctagactgtgcattctcgctcttctaacagtatgcatnactgaaaaccagcatggaaaccctgtgtgtcatccgattgcaactctttagatgccttta

SEQ ID NO: 15680 - DNA, 121 bp, Artificial Sequence
  Synthesized
  misc_feature (61): n=a or t
tgctttcctaggtattctgcctttgcaaaaaggagttccttgtttgtgtgtactgacatanattgataaaatgtgcatgggggctttgtttaaaggaacaaattgaaactgcacctgtgaa

SEQ ID NO: 15681 - DNA, 121 bp, Artificial Sequence
  Synthesized
  misc_feature (61): n=a or g
tcggtgcattttgcatcaccgggctcttaaaggaagacctggagctggatgaatcctatcnatttcccttgccttgttgggtaactcttgagataaggcttcccacctgaagagagaagtt

SEQ ID NO: 15682 - DNA, 121 bp, Artificial Sequence
  Synthesized
  misc_feature (61): n=c or g
aataactagggcggaacaaaatgctgaaggaaggtggaattgctactactgaagctgtcanacttcactggaatagaaatatatggtaggtgcaatttatactgtgcaggcaaggaattaa

SEQ ID NO: 15683 - DNA, 121 bp, Artificial Sequence
  Synthesized
  misc_feature (61): n=t or c
taattaacattgcccagcatctacttcaggatcaaatctgttttcgtgtatgacagccctntaaaaatacactatactgcctgggctgtagcgataaagcagtgaagcagggttgtttgga

SEQ ID NO: 15684 - DNA, 121 bp, Artificial Sequence
  Synthesized
  misc_feature (61): n=t or c
ttttcattatattatcagtattggaatctttctacatcttcctatggatcatgttgtgtangtccattaatgtgattgtatactacggattctacaagtctgctaaaaataactgcccata

SEQ ID NO: 15685 - DNA, 121 bp, Artificial Sequence
  Synthesized
  misc_feature (61): n=a or g
tgagtttacagagccatgccatttgactgaagggaggttgaggaagatactctttctgctncagtggtgctaatgctgttcatcaacatttgcataactggaattaataacttacaaagag

SEQ ID NO: 15686 - DNA, 121 bp, Artificial Sequence
  Synthesized
  misc_feature (61): n=a or g
ccaagcttggagtttgactgctggaaggtgggaagctgtactggactccttttgtggatgnctttcatgggggaagctggtgtctctggcatggacatatgttcaatctgcagttggccaa

SEQ ID NO: 15687 - DNA, 121 bp, Artificial Sequence
  Synthesized
  misc_feature (61): n=a or t
acattaaaagtaagttttacctgttgtgttctcccctaactccagccccagagagggattngttaagattaactggaacttctcatcaccttcaggagtctcatcatcaaaaatcacgaca

SEQ ID NO: 15688 - DNA, 121 bp, Artificial Sequence
  Synthesized
  misc_feature (61): n=a or g
ctgccataatcctgccgtgtctctgcacatttccttattgtctttttgccaaaattactcnttgactggtacttgaaagaagcttctgaagaggagggagagcaactttttacatgagcag

SEQ ID NO: 15689 - DNA, 121 bp, Artificial Sequence
  Synthesized
  misc_feature (61): n=t or c
ccagtctccacacaataaaaaagtttatcctatatatacttgttgtcatctgttacaccanggagaaccaataccttccagttttgatcctctgatttccctttaaagagaaagaaaagct

SEQ ID NO: 15690 - DNA, 121 bp, Artificial Sequence
  Synthesized
  misc_feature (61): n=a or g
aaaattttctaattttaagggaagaagccagaacttttaatgtgaaaagtcataagtattntgaggagcatttattgcagaacaaagggaacagcagaaaaaaaaactgcagttgaagtta

SEQ ID NO: 15691 - DNA, 121 bp, Artificial Sequence
  Synthesized
  misc_feature (61): n=a or c
cacagcctccccagcccaaaagccagagctcctctcccactgctcagccaccgacttctantgaaagagaggagcacacatcacatcccacacaaaaccaaattgacaaggcaggtgtcag

SEQ ID NO: 15692 - DNA, 121 bp, Artificial Sequence
  Synthesized
  misc_feature (61): n=t or c
tgatatcagcaaaagccccaaactagagcacctttacagcaggcattagcaactattctgncacacagatacaagttcaacagcagcctttggggaggttttgcaaggacacctccaaacc

SEQ ID NO: 15693 - DNA, 121 bp, Artificial Sequence
  Synthesized
  misc_feature (61): n=a or g
ccttcctcgccctcctcctgagtccatggttcttaatgaacaactcccaaggagttggtcnggagaaatatgactctatctgacaaagttggtatagatcctttcatgggcaagattgttg

SEQ ID NO: 15694 - DNA, 121 bp, Artificial Sequence
  Synthesized
  misc_feature (61): n=a or g
actgtttcagtgatattcagcaaggtatttcaacgaatattttctaaaacttaattttgcngcttatttcttttggtcatagaatccaaatgtgtcttcagagctgcacaatatctgtgca

SEQ ID NO: 15695 - DNA, 121 bp, Artificial Sequence
  Synthesized
  misc_feature (61): n=c or g
ctgcaggatggtgaaattctccaggacgctgttcatcatgtacttctccgggagatgcttnagtttgtggatgaagttaatcatgtattcgcacatgggggagcggtgaatgcggtagaca

SEQ ID NO: 15696 - DNA, 121 bp, Artificial Sequence
  Synthesized
  misc_feature (61): n=a or g
ttgtttgctagaagccatgtgcaagtcactagaattaacgctagcatttgggagcgcaccnaggctgcacgctgcaatacaaacctcaattattcccaaatcctggtgcgatggtgtgaaa

SEQ ID NO: 15697 - DNA, 121 bp, Artificial Sequence
  Synthesized
  misc_feature (61): n=c or g
gctttaaaagaattgaagtacattataaagattcaacggctctctctaaaatgagttactnccagcactgatcaggaaacatgatcctttgaaaatgatcttggagaagatgctgctattt

SEQ ID NO: 15698 - DNA, 121 bp, Artificial Sequence
  Synthesized
  misc_feature (61): n=t or c
ctacaggacaggcaaagttcaggagcagctatctcaggctattaaagactacctcatcacnattaaacagaagagctggactgacagtttggcatcaccacataagttcaattgccacttg

SEQ ID NO: 15699 - DNA, 121 bp, Artificial Sequence
  Synthesized
  misc_feature (61): n=a or t
tataacatactaacagtaaatccttctgtttccttcctgaaggatttgttgggcaacagcnataatatactgcgcactcatcttattcagatgacatcttattcagatgggcagcacgact

SEQ ID NO: 15700 - DNA, 121 bp, Artificial Sequence
  Synthesized
  misc_feature (61): n=t or c
tccatctaaagaatcagtgccttgattatttcgactcaaagcagcacttaagctgcctccncccaactgagagctggttttatagggtgggtgagatgcagtctccaccatggatgacgga

SEQ ID NO: 15701 - DNA, 121 bp, Artificial Sequence
  Synthesized
  misc_feature (61): n=t or c
aaaacagaaacccactctgggggaaagcagtgagggcagctcagaaggagtgggataagtngtagcagctttggaaagtgtttgacctaaaaggagctgagaaatccttaaaaaacacgga

SEQ ID NO: 15702 - DNA, 121 bp, Artificial Sequence
  Synthesized
  misc_feature (61): n=t or c
tagaaaacacagcatttatcaaaacaaaagcgtccacatccttgttctcacagaatgtagngcatcgaactgctaaacctaggagaagcgatgtgtttttctgcagagctgtgtgtattcc

SEQ ID NO: 15703 - DNA, 121 bp, Artificial Sequence
  Synthesized
  misc_feature (61): n=a or c
cgtttcttagctaagtgtaaaggtaagccaaccttttgaggtcacagattggcagaggccnctgaaagtattttgctttgcaaattctgttcagacacatcataaccatcttaatcatgtt

SEQ ID NO: 15704 - DNA, 121 bp, Artificial Sequence
  Synthesized
  misc_feature (61): n=a or g
tacagcaaggacattcaacccatgcctctatcttttcatatgtggatcccataacaggaancctagaaagtggcagaagaggtcaagacaagatggtgattgcctaggtagagaaaatcgc

SEQ ID NO: 15705 - DNA, 121 bp, Artificial Sequence
  Synthesized
  misc_feature (61): n=a or c
tcaacacagtatatcccatcaatttcaaggacttcaagatcaggtactttgcgtacactgnatgactccctccaagtaacgcaaccactcctaaacagggaagatttgatagcccaaggaa

SEQ ID NO: 15706 - DNA, 121 bp, Artificial Sequence
  Synthesized
  misc_feature (61): n=c or g
gtgcctgtgcactgcctgtgctaaaagtgagatgtgacatcaagtgatcagttagcctgtnagcaaggcacacgcctggggagagtttggtctaaccgtaggttctcttaggcaacagcaa

SEQ ID NO: 15707 - DNA, 121 bp, Artificial Sequence
  Synthesized
  misc_feature (61): n=a or g
tgtctacagtcccattgagaagctgagcaaacagttgtactaaacttctgacaaaatgatnacatggagcacctcttgctgtaggtcactcaactctaggaacaattttcttcccaaaaaa

SEQ ID NO: 15708 - DNA, 121 bp, Artificial Sequence
  Synthesized
  misc_feature (61): n=a or g
cccatttcaaaagctctccataaggcccgggtgccattagctgacacagttttgccaaggngcatctctaggggacgggccagaactgattctacacaaagcccacacagcaacgagcctg

SEQ ID NO: 15709 - DNA, 121 bp, Artificial Sequence
  Synthesized
  misc_feature (61): n=t or c
atgtctgattgcagatgacaatcctcttgactgccatggagcagttgcagttgctcagggnactgatggtacctgttacatgccatcaaagctgagtcatctctaggatgaagcagcccgt

SEQ ID NO: 15710 - DNA, 121 bp, Artificial Sequence
  Synthesized
  misc_feature (61): n=a or c
aatgctgtccccctccccctcctccccaccaagtctatcgatcttgcaacggatgaacagnatcattctttcttgggattcccttccctcctctttgcaaagatgttgctgctgctcccat

SEQ ID NO: 15711 - DNA, 121 bp, Artificial Sequence
  Synthesized
  misc_feature (61): n=c or g
tcttcttggcactgctgaccatcacttttgtattgcaaagccagttgcaatctgactgatntgtgtaaaacaaatgaggttcacccctctagctctgctaagactcaagcatagccctgag

SEQ ID NO: 15712 - DNA, 121 bp, Artificial Sequence
  Synthesized
  misc_feature (61): n=a or g
ccatgtatgtatagtagaggtattccagatcttctgattaggacttccttccattttgggnatcatgatgatgtctgtggcttggattttgagatttatatagcagtgtatatgcattttt

SEQ ID NO: 15713 - DNA, 121 bp, Artificial Sequence
  Synthesized
  misc_feature (61): n=a or g
agcagctcccctgctgcagcaggagctccttgggatgctcagtgctccggagaaacacatntcacactaatctgcacactccagaagccccagctcttgttctcctcctgaagccagggtg

SEQ ID NO: 15714 - DNA, 121 bp, Artificial Sequence
  Synthesized
  misc_feature (61): n=a or c
catctcagcccctcattgctgagtgctttgggtcactgctctcctttgggtcaccgctccnttcagttgtttcacaggagtgactttgccgttcagttctgcaggaggagataccaaggaa

SEQ ID NO: 15715 - DNA, 121 bp, Artificial Sequence
  Synthesized
  misc_feature (61): n=a or g
tgaaaacacacgtaggatgaaatctaggggtctgttcatctaaggaaactactggctaccnttctgtgcttgccatagaagtgtattcctgcagtgtaatgcaagataagccccttagtca

SEQ ID NO: 15716 - DNA, 121 bp, Artificial Sequence
  Synthesized
  misc_feature (61): n=a or c
agacttccttatttagctcacccaaagtaagttaagtaagcatttttggttgtcttggacngagagtaaaaaacaagcagaaggagatagggtcagtctactgttagtcaatcaaactaag

SEQ ID NO: 15717 - DNA, 121 bp, Artificial Sequence
  Synthesized
  misc_feature (61): n=a or t
tccgactttttaattgtgaatgagacggaagaaaaagaggagaatctctatgaaccatctnttattcagaggatttataaaagctgcaagcaggagaagtgagccccacttaatctcttgc

SEQ ID NO: 15718 - DNA, 121 bp, Artificial Sequence
  Synthesized
  misc_feature (61): n=t or c
actcactgagcccagtctttccttttcttgtccccacatttattctcaaggacttgttagnattagctggattaaggttccagtggggtaacatgtcctgcaacgcaggcttctgttctac

SEQ ID NO: 15719 - DNA, 121 bp, Artificial Sequence
  Synthesized
  misc_feature (61): n=t or c
ttttgtatgataggtgatctgaatcacacagtatactttccttgttttcaatgactgaaangcattgatggcaagaaaattcattttatttgcttggaagagttttgaatgaaaggctgct

SEQ ID NO: 15720 - DNA, 121 bp, Artificial Sequence
  Synthesized
  misc_feature (61): n=a or g
taatactagtgtagatgctattggaacaagcatataaatgacaaatgataagctgaaactngttatatatgggtgtagcatttatggtttctaaattcaaagcaccactgcattattgtat

SEQ ID NO: 15721 - DNA, 121 bp, Artificial Sequence
  Synthesized
  misc_feature (61): n=t or c
catttacacgattatgtgatgaaagaacctagaaagattaggctctttccattttgcttgntgacatataatattcccagtaagaaactgcacattaagactgtctgttgtttgtgcaatg

SEQ ID NO: 15722 - DNA, 121 bp, Artificial Sequence
  Synthesized
  misc_feature (61): n=t or c
ccaaaattagggaaactgttttaatctgttttctggtacaacatatttcctgacaaaccanggccactgaagtagtatatgcctactatatatctactagcagtctatgagaggagttaag

SEQ ID NO: 15723 - DNA, 121 bp, Artificial Sequence
  Synthesized
  misc_feature (61): n=a or g
tttgatgtattaagaacgtccatcaaaatctctgcagctacagccattataaagcaccccnatatttacatggctttgtatcaaaagaagaattctcacctccctcccccccccccaaaaa

SEQ ID NO: 15724 - DNA, 121 bp, Artificial Sequence
  Synthesized
  misc_feature (61): n=t or c
gtacactactgtttaagcagcttgattcaagcacagctctggtatgtgatctactctgtcntccttctatataacttttctataataaagctacttttacatcaagtaggcagcaaattca

SEQ ID NO: 15725 - DNA, 121 bp, Artificial Sequence
  Synthesized
  misc_feature (61): n=a or g
cctaccagaggcaccttaatcgttttagccactccactttttaagaaaggataacttaagnaaggataccactatagtaaccaacaggttagatgttcaaaataactcagctctgttaacc

SEQ ID NO: 15726 - DNA, 121 bp, Artificial Sequence
  Synthesized
  misc_feature (61): n=a or g
agaacttaatagctgagaccttctaaaagatttgggaacccggatcagggaattgtggtgncggcacttctggatcacttcaaagagtgcttataaagaaatgtaggtgacggaactcaaa

SEQ ID NO: 15727 - DNA, 121 bp, Artificial Sequence
  Synthesized
  misc_feature (61): n=a or g
tgtggcagtttctattcatttgcatttactaacagaaagcaaactcaagatgtgcatttgntgtgatattagcacaagtgaaaagataactcgtttgttagtccttacagtttcattttgc

SEQ ID NO: 15728 - DNA, 121 bp, Artificial Sequence
  Synthesized
  misc_feature (61): n=t or c
gaggatgcacaatagtgctgcaatgtcaccgagtgtaaaaatggagtttttcaggtcaggngaggtggaaagctgggatttatccatctgtcttcacattgcatttgaaggatgtcaagcc

SEQ ID NO: 15729 - DNA, 121 bp, Artificial Sequence
  Synthesized
  misc_feature (61): n=a or g
ctgagggtgaggggaacaaatgcctgtctgcaaagctttttgaagtactgctctgacatgnagctcagctgaagacatatcctggtgagaattcatttatgcaggaacagtgagcctggtg

SEQ ID NO: 15730 - DNA, 121 bp, Artificial Sequence
  Synthesized
  misc_feature (61): n=a or g
aaattatcgtaagcacatctcctatttgcccccacttaccatattcagtttacattactgncatcactgtcagagtacacaatctgtgtgcttttcaggtgaaaataagccaaagataaac

SEQ ID NO: 15731 - DNA, 121 bp, Artificial Sequence
  Synthesized
  misc_feature (61): n=a or g
tatcactgttaaaatatcccattttaacagtagcgatatgagaacattatgacatagcatnacaagttctttagggcattccaatgatctccacatgtactgtggcactgacccataccac

SEQ ID NO: 15732 - DNA, 121 bp, Artificial Sequence
  Synthesized
  misc_feature (61): n=t or c
aaagagcgtacaagaaaacagtggtgtgagctgtaaactgcaaatgccaccttgtaaatgntcttgctcgggcctcagaactgagacttcctctccacaaaggagaccatcgactcctgat

SEQ ID NO: 15733 - DNA, 121 bp, Artificial Sequence
  Synthesized
  misc_feature (61): n=c or g
agaaaatggtgcaaccgttacacacagacaggccctgattcagttctcctcttgctctgcntgagggaagcacaacctccaccacctggccctcactgtggagaactcaggcactgctacc

SEQ ID NO: 15734 - DNA, 121 bp, Artificial Sequence
  Synthesized
  misc_feature (61): n=a or g
cctgattgcagagattagtacactggtgtggctcttctttgcaaagatctgcaagacctgnagagctcttccaattgtcatgagctgcagtgcactcaaagcagtactcaactccagcaca

SEQ ID NO: 15735 - DNA, 121 bp, Artificial Sequence
  Synthesized
  misc_feature (61): n=a or g
cagcacaacacagttagaggctggcattgttgtcagaatttagagagctttgaaaatcagngttaaactaaatcttatttatggggctacatcatcctttggcaggttgatttgtgctaga

SEQ ID NO: 15736 - DNA, 121 bp, Artificial Sequence
  Synthesized
  misc_feature (61): n=t or c
aaatacctccatgtgtgcaggcaaggactgaggcaacactcccatatcttcccattgcagnaggcagtgaaataggcaggtggcatggctccagtcatgcttcccacccctatcacctccc

SEQ ID NO: 15737 - DNA, 121 bp, Artificial Sequence
  Synthesized
  misc_feature (61): n=a or g
tgattcactgcatctttgggtcatctcacccttccgtagcatgtatgacgaagttattatnggaagctttaaaataggagcctgtctgtgtaaaatgtttgcaaataagagcaacttggga

SEQ ID NO: 15738 - DNA, 121 bp, Artificial Sequence
  Synthesized
  misc_feature (61): n=a or g
tctaaggtccattgaacttgaggaatgtacaaggtacaggtggtaaagaaacttccttatncagtcccaatgctcactcttctctcatcctgcaaatgtagatgctcacattgtctcagat

SEQ ID NO: 15739 - DNA, 121 bp, Artificial Sequence
  Synthesized
  misc_feature (61): n=a or g
agtaacttttctaataaaaatacgagacatctcacgacatacatacttcttccttaagtcnggatggtctaaagagggagagaagatagaagcttcttattagcctaatggcaaagaactt

SEQ ID NO: 15740 - DNA, 121 bp, Artificial Sequence
  Synthesized
  misc_feature (61): n=t or c
aggagcataaaaaatggggagaaaaaaaaaaccaaggcacaaatgaatgcctgatctgtangcacaattacacaactggtgagtggaagcaaccaaaacgatgagtggtcgtttaaaatta

SEQ ID NO: 15741 - DNA, 121 bp, Artificial Sequence
  Synthesized
  misc_feature (61): n=a or g
gtgaagtacagtgttatggctcagttttattcctactcattactatatgtctaattttccntgaatattttcctatctccttgaaaattccagtaggtgtggtcaaaatcagacataaaaa

SEQ ID NO: 15742 - DNA, 121 bp, Artificial Sequence
  Synthesized
  misc_feature (61): n=a or g
actgctctttcatgatggccatcggctttgggaagcatgaattctgtgatcttctgcttcncttctggttcagtgcttcttgcctttttgacttcttaggctgtgaacaagtcatcagcag

SEQ ID NO: 15743 - DNA, 121 bp, Artificial Sequence
  Synthesized
  misc_feature (61): n=a or g
caaccagatttcctaatggagtttaaatcatctttcactgtcatacattctcaaagaactncaacaggagggtaaagagtgtataagtttctgctgatatgtaggggaatttaagaaataa

SEQ ID NO: 15744 - DNA, 121 bp, Artificial Sequence
  Synthesized
  misc_feature (61): n=t or c
tcagtcatgaggattctatctaaactcctgtatctcaaggttttttggaccatctgttccnctctggcttctcagagatgagaggggaaaatgatgaaggacgtttcccagatgtgtcaat

SEQ ID NO: 15745 - DNA, 121 bp, Artificial Sequence
  Synthesized
  misc_feature (61): n=t or c
gtggcacatactgggaggaaaaaaacagatagttgttatcctcacgcgccaaacagaggtntatgttgtggtattcacagttacctatatattgggcctatgcaggaaggttttggtagta

SEQ ID NO: 15746 - DNA, 121 bp, Artificial Sequence
  Synthesized
  misc_feature (61): n=a or g
gtttttgtgtctgtgtatcatctttcagtgaaatctacatatggaggataattttgtaganaagacagaagttttggaggctcttgccaaacatgcttcttttccaatagaactcacaggt

SEQ ID NO: 15747 - DNA, 121 bp, Artificial Sequence
  Synthesized
  misc_feature (61): n=a or g
gcaacagccaggaagtacaggtctgcaatcggaactaagtgctttccctgccatagctgcntgtttgggatttggaggacttgggcagaacccgggctactgtttctgttctttctcatgg

SEQ ID NO: 15748 - DNA, 121 bp, Artificial Sequence
  Synthesized
  misc_feature (61): n=a or t
accgatgaagcgtggccaacacgtgaagccttaacgaattcttggctgaagagctggaaangtggggactctgagaaatgagacctgtggtgcacggagagccccacacctactcggggtc

SEQ ID NO: 15749 - DNA, 121 bp, Artificial Sequence
  Synthesized
  misc_feature (61): n=a or c
tgttgagactagtcattatctactacacataggagaatctgcaagcgtttggcatgctttngtatcttctagagggaggtgattttgaagacatgcaagttccatttttaaataagaaaat

SEQ ID NO: 15750 - DNA, 121 bp, Artificial Sequence
  Synthesized
  misc_feature (61): n=t or c
ttctgctcaggatggatagatgcaggtgaaaaacagccctaaaaatgcataaggattaagnttataatttggcttatcttcttttcatccttgtttatttattaggctttaagcacatcta

SEQ ID NO: 15751 - DNA, 121 bp, Artificial Sequence
  Synthesized
  misc_feature (61): n=t or c
gcagccagagagcacaaagtaaatttctacagtatggtaagtgttgctgatagtgagtaantgtgtattgtttcactccagtgctatcttgccctggccaagggcggcctattacctgatc

SEQ ID NO: 15752 - DNA, 121 bp, Artificial Sequence
  Synthesized
  misc_feature (61): n=a or g
tttcaaaagtaggtgttcaaatccatggacttgaactgaaaaaccataaactgaagaactnatatccagatgtgaaagggaaatattccttggctctactttccccgccattcattagtcg

SEQ ID NO: 15753 - DNA, 121 bp, Artificial Sequence
  Synthesized
  misc_feature (61): n=a or g
aaagctcatttccttagaaaactggtaagaaaataccccaaatcctctcagcttttggacnttggaattatatctggcctggtgtgcctatacccagctgccaaagctgtggagttaggaa

SEQ ID NO: 15754 - DNA, 121 bp, Artificial Sequence
  Synthesized
  misc_feature (61): n=c or g
ggatttaatgtctttttttggaccttttccataaaaagtcaacttgttcagtttgaaaatngtacttcagaaataagactacacataccacgtttttgtgcctcctcttcatcactatcac

SEQ ID NO: 15755 - DNA, 121 bp, Artificial Sequence
  Synthesized
  misc_feature (61): n=a or g
gggctaaaccaaagccttggaaataaaacagtaactggttggttgtagaggttttcagaantagggattaacctcattttctttgtctggagccatctaaaacctgagctgtttgctgaca

SEQ ID NO: 15756 - DNA, 121 bp, Artificial Sequence
  Synthesized
  misc_feature (61): n=a or g
atcatcagatagagaagccagtaggaagctgttctagctgcatgaatctccaagatctctncctccaacaacttgaggagaccaaagcaaaagcttgcaaagtaatgcagaacttctgttc

SEQ ID NO: 15757 - DNA, 121 bp, Artificial Sequence
  Synthesized
  misc_feature (61): n=t or c
gtgcattgactgcctcaaaaatgctcaagtccactcgttctgatcagaaccaacatttcanttcttatgtagatgctggacagggaacagcattcttcacctcctttttcatgctccgaaa

SEQ ID NO: 15758 - DNA, 121 bp, Artificial Sequence
  Synthesized
  misc_feature (61): n=t or c
tctgaaggctgccacgctgcccccaaaaggagtgtgccccagtgttgtcatggctccagtntgctggaatgtcatcttggctcttgcaacaagcagaagtgagtggcaatttccaaaacac

SEQ ID NO: 15759 - DNA, 121 bp, Artificial Sequence
  Synthesized
  misc_feature (61): n=a or g
gatcctgtggccacaacaatcaatgactgaagggagggtcatgcttacgtgattctagtangtaagttgtgtaaaatttatttagtaattccttgtaaaagcctgtggtgagagttaattt

SEQ ID NO: 15760 - DNA, 121 bp, Artificial Sequence
  Synthesized
  misc_feature (61): n=a or g
tgtttaggagcagaattgtatgtgaaatggcattgtgcccttctttaaatacactatcaantagaaggggacaaaatccagtagatgcagattctaaaattccgtattcagtgccctttaa

SEQ ID NO: 15761 - DNA, 121 bp, Artificial Sequence
  Synthesized
  misc_feature (61): n=a or g
ctcacagggcttttccaacctcaacgatactacgacagtaaagacactgttgttgcctatnttaactttcagcaacaagacacagtgaagaagagcaagaatcaaacactaatctcacagc

SEQ ID NO: 15762 - DNA, 121 bp, Artificial Sequence
  Synthesized
  misc_feature (61): n=t or c
ctacttcagaagactcaacacatgggaaactgtttgttatctacgttaaactaagaaatantccaatgaaacgtatcctgtgctccacctacagcagtccgacagtcttttaaggacattt

SEQ ID NO: 15763 - DNA, 121 bp, Artificial Sequence
  Synthesized
  misc_feature (61): n=a or g
gtccagagaaatgaaagcatttggacaagttctgctttccaagagatgatgaacatcaggntgaaggcaattcttcttgcaggactcttttttattttattttattttatttgcatttttt

SEQ ID NO: 15764 - DNA, 121 bp, Artificial Sequence
  Synthesized
  misc_feature (61): n=t or g
gtgggttgcagatacagaagatttaactgaacttcgtggtgtgtaaatttgtgccatgaanattgttgcccctaatgtatgtttactgctcctgctctggctagtgggagaggaacaagct

SEQ ID NO: 15765 - DNA, 121 bp, Artificial Sequence
  Synthesized
  misc_feature (61): n=t or c
ttcatagtgttgccatgttaaaacagtaataccatttgactgacagctgtagtggtccctncatgttacagaatagtttcaagccatggacaacatctgtacccatgctcagtaattctgc

SEQ ID NO: 15766 - DNA, 121 bp, Artificial Sequence
  Synthesized
  misc_feature (61): n=c or g
tctgcttcttaagttttgaacttctgaccagttgttgtggcaagttgaaggcttgcatggncttcagtgttttcactcctcttccctgcatgtcattaagaatgatgagtatagtacaagt

SEQ ID NO: 15767 - DNA, 121 bp, Artificial Sequence
  Synthesized
  misc_feature (61): n=t or g
gttgcgttctgcagtaacctcctaatatcatatcaatagtaacctcctaatatcatgagantgttagagtggtgtaatgtagaaataaagttttaatattttttaacactgtttttaattc

SEQ ID NO: 15768 - DNA, 121 bp, Artificial Sequence
  Synthesized
  misc_feature (61): n=a or g
agaaaagtcaaaagacaaagaaagcactgaaacctcaggataaaatgagaaataaaatacntgaggttagcctgaactatggcatggattctgaaatgttcacatttctatttccagaaat

SEQ ID NO: 15769 - DNA, 121 bp, Artificial Sequence
  Synthesized
  misc_feature (61): n=a or t
atgctgaaaaaaactgctgcttgtttcacacagtcctagagtttatcacagtataggaagntatcattccagtagagacagaaatgtagtctgctgtacgtatgacagactctgtcctaaa

SEQ ID NO: 15770 - DNA, 121 bp, Artificial Sequence
  Synthesized
  misc_feature (61): n=a or g
gttggctagcacataccgtcaggtgtcttttatgagtaatttctaatactaatagtccacntatagtctttatcaggattcaatccttgtttaatgcttcaaatttcttaaaaagattctt

SEQ ID NO: 15771 - DNA, 121 bp, Artificial Sequence
  Synthesized
  misc_feature (61): n=a or g
catgccctgtcactattcttaagcccactgcgtacccacaacagtaaatacatgacattcnttatactagggtattcttacttctgcaaagtttcaaattggcttagtgcttgttaattat

SEQ ID NO: 15772 - DNA, 121 bp, Artificial Sequence
  Synthesized
  misc_feature (61): n=a or t
acatccagtttcaaacacgaaaaacgatttattgcttaccttttcaaatgtgaagaatganttgttctaaattgtgtttccactgtcactgtaatctgttgtgtataatgctgggcagtgg

SEQ ID NO: 15773 - DNA, 121 bp, Artificial Sequence
  Synthesized
  misc_feature (61): n=t or c
gaaagagtggaaattgtgtctcactaccagcagtcctggccaaacacaagtcaagaaagantgaaaaaagtattttggtcaaaagagcgtaacagcaggagaacatggctgactatgtatg

SEQ ID NO: 15774 - DNA, 121 bp, Artificial Sequence
  Synthesized
  misc_feature (61): n=t or c
aattaccatggcaatggtctccatttatagatgacctctaaatatctaaggtacctataanctttagaaatagaaataatcacataccagtcactataatacagctgtgcaaagttgtaaa

SEQ ID NO: 15775 - DNA, 121 bp, Artificial Sequence
  Synthesized
  misc_feature (61): n=t or c
actgagatggaagctcagcagatatgaactccacattttgtcaaggcttctctgtaacttngattacacgcggaaagaaagcaatttgtgaatgaattaaacctagtgatagcatgaaagt

SEQ ID NO: 15776 - DNA, 121 bp, Artificial Sequence
  Synthesized
  misc_feature (61): n=t or g
acaaacactttttagcccaacaaacttatgttcctgcagtgcaatagctgattttcctagngtagtaactagccaggagtgtctttacacccttgattggttgcttccacaggttagaagt

SEQ ID NO: 15777 - DNA, 121 bp, Artificial Sequence
  Synthesized
  misc_feature (61): n=t or c
ttctgagtatgggcacactgcacaagacagcttgttcatcagccatgtggatgtccatgtngtaacagacagcaaaggtcaaaagagttggtcagagtgagcaagagcaaggccttcacaa

SEQ ID NO: 15778 - DNA, 121 bp, Artificial Sequence
  Synthesized
  misc_feature (61): n=a or g
cctacttacgcagggccatgtagcacgtctagcagcaaatgagatattataaatctattcnaaatgtttctaaagcacaagggaaacaaaaatcaaatagccttttcctggcaagtccttc

SEQ ID NO: 15779 - DNA, 121 bp, Artificial Sequence
  Synthesized
  misc_feature (61): n=a or g
tacatgtaggtaaacgcacatatgtatatatagttcatatgtaccaaataattcatttttntgttcctcttgcagaacaggagaaaacccctgaggggcaaatggagctgtaaagcaacag

SEQ ID NO: 15780 - DNA, 121 bp, Artificial Sequence
  Synthesized
  misc_feature (61): n=t or c
tcagcatgtagggcatcttctctctgctgcagatatccaaaagttactggatttttttaanctttgtattcttttctccttccttacttcagcatatgccatgactgaaaaattgtgcctt

SEQ ID NO: 15781 - DNA, 121 bp, Artificial Sequence
  Synthesized
  misc_feature (61): n=t or g
gtctgaaatgtggaagtttcattgtgcaactccacagtatgccatcaaatttaactttgtnttacactggggaggatctagcctttcttgatgaaaatataggacgttggtatgtctatag

SEQ ID NO: 15782 - DNA, 121 bp, Artificial Sequence
  Synthesized
  misc_feature (61): n=a or g
tataatatcagaagataagccaattcattccctaaaatccctcctatccacttcttgtctngtttggttgccactaaaggatgcaagtaattttgcaaagcaatatgaagaaagacctgag

SEQ ID NO: 15783 - DNA, 121 bp, Artificial Sequence
  Synthesized
  misc_feature (61): n=t or c
ggaatgcgaaagcatttggttttagttcaactaggaccttcatcaaagaacacagttaaanttgttacttcctcagttgcagtcttagtttgctaattcctctaacctactgtttaaagga

SEQ ID NO: 15784 - DNA, 121 bp, Artificial Sequence
  Synthesized
  misc_feature (61): n=t or g
ggaaagaaggaaaagaagtgaatttgttttgtctgcagattgcaaaaattaggggagacanggaagaggcacactgagagatgcgaagcagaactgtatctattacagctatacctccata

SEQ ID NO: 15785 - DNA, 121 bp, Artificial Sequence
  Synthesized
  misc_feature (61): n=a or g
tttatctggtgcagggttgggcattatttaagccattgtcactcagatacagccactgacnaactcctgcacggcaaaataaccaaaatgtaggtggggagaaatggtgtttaggaccctt

SEQ ID NO: 15786 - DNA, 121 bp, Artificial Sequence
  Synthesized
  misc_feature (61): n=t or c
cacaaaagtttataaaccaagcctgcaaaataatcaattacttcatcctaagtgttcaaancaatgtacatgggtcttagtgatatgatacctaaaagagtaaataggatttgatacatcc

SEQ ID NO: 15787 - DNA, 121 bp, Artificial Sequence
  Synthesized
  misc_feature (61): n=a or g
aatgccaagatcccctgtgggagaggaaggcgtgcagcttgctgctgtcaggaagaagcanggaccccatcaggtgatcttcatcatcttctgcagtgatggagaatgctgcatttccaaa

SEQ ID NO: 15788 - DNA, 121 bp, Artificial Sequence
  Synthesized
  misc_feature (61): n=t or c
gggaataatcagggagatgagcagcacaataaaccaaagagcagcgatgatcagtttcagncaaggtataaagccttagcagcagagtactgtagatctgaggaggacaaggagaagcatt

SEQ ID NO: 15789 - DNA, 121 bp, Artificial Sequence
  Synthesized
  misc_feature (61): n=t or c
acctaagctttctgaatcacagagggcttatgcttcctttctcaccttcatctaacaaaancagtgtaggggtaagtatttgttcttctccttctacagactgaaactttagtctagtaag

SEQ ID NO: 15790 - DNA, 121 bp, Artificial Sequence
  Synthesized
  misc_feature (61): n=t or c
aaggatggaaagtcttgagtgtatgtcattccctctcttattaaccattatactctcatcngaagcagcaagcacattttctgtttattcatacatgttgttacccctttatttaaaagca

SEQ ID NO: 15791 - DNA, 121 bp, Artificial Sequence
  Synthesized
  misc_feature (61): n=a or g
taaccagagaagaatgtcattacatatttgtttctgacactgtcgtttaaattggaatgtnttatttgtaagcaatctatctcctgtgaccgttttgtttccttttcaggagaattagatc

SEQ ID NO: 15792 - DNA, 121 bp, Artificial Sequence
  Synthesized
  misc_feature (61): n=t or c
tcccaacacactccttagtatttctatcctgccagttctccaatctaatgcaccatgcagnccaaagagcagcaacaaggggatgctacacaagactgttctggcctctactttagtgtgc

SEQ ID NO: 15793 - DNA, 121 bp, Artificial Sequence
  Synthesized
  misc_feature (61): n=c or g
acatgagtaaaaacccaagaagaataaatgttgtagtagttgaaaacttgcatatcctaanaagtacctctagttttgatctgcaagtaaatcaagagagggatcaaagtattggtgtttc

SEQ ID NO: 15794 - DNA, 121 bp, Artificial Sequence
  Synthesized
  misc_feature (61): n=a or g
cagggcatgcatgtaaatccagagactgggaactaataggtgatctcagtggagcaacacnagttgacagtgggaactgagagcacgcagtttgaggcagtgaggattgcaggagggcatg

SEQ ID NO: 15795 - DNA, 121 bp, Artificial Sequence
  Synthesized
  misc_feature (61): n=t or c
tttcctcacggtgaaaagaatagtgccatccttatctgtcagtcaaaaatagtataatganataacttcctttgtcctgtccatccattctttttttttcttttctgtctttcacggacag

SEQ ID NO: 15796 - DNA, 121 bp, Artificial Sequence
  Synthesized
  misc_feature (61): n=a or g
atccatgtgtgagaggaagtacacctcgtggtgtcacgcttcttcctctctgatctcccantaaacacataacttcattaacacattgcccagcttccaaacaatacaacctgtagcctgt

SEQ ID NO: 15797 - DNA, 121 bp, Artificial Sequence
  Synthesized
  misc_feature (61): n=t or c
gatgaaattttacacaagcaaattattagtcacctgtaatgttttcttctattttatccanggtaggaactattagtaacgtttcatacttttgatcataacatctttcctgcttgtttcg

SEQ ID NO: 15798 - DNA, 121 bp, Artificial Sequence
  Synthesized
  misc_feature (61): n=c or g
atgttctgttttcaaaggaagcaattgtctccttacttaggcctgtttctaggaagtaaantgttgtgatctactagagggtttcacagagaggatgcccatgtgggatcatggcatgtcc

SEQ ID NO: 15799 - DNA, 121 bp, Artificial Sequence
  Synthesized
  misc_feature (61): n=t or c
aaaggccataggagctctggaatgtttcggatgggggaatatgacattaattgggtagaanggtgattttgtaacaagctgcagccctgcatggatggtctctccggccctgcagcactca

SEQ ID NO: 15800 - DNA, 121 bp, Artificial Sequence
  Synthesized
  misc_feature (61): n=a or g
aattagtaggccaataatagcattagtagtagtaatgaagtctttgtcaaaagataccacncatctttcactttatgtgaattaatttggtaaacaagcaaatctacagaaataatgcaca

SEQ ID NO: 15801 - DNA, 121 bp, Artificial Sequence
  Synthesized
  misc_feature (61): n=a or g
ggctcctattttgccacgtaaatggctgatttcatgccaaacatctgttcatgtggagtcnctacctcatcatcttccccattagtgaaatttctgaactggtcttgcactgctgccacgt

SEQ ID NO: 15802 - DNA, 121 bp, Artificial Sequence
  Synthesized
  misc_feature (61): n=a or g
attttctatctgcattattaagagaataactgcttttgttgttaaaatatttctagattgncacagggggagcaaacacaactcttcctctaatgttaacattacacagcttcaaaccaga

SEQ ID NO: 15803 - DNA, 121 bp, Artificial Sequence
  Synthesized
  misc_feature (61): n=a or g
ctgtattcccacaccttaaacagatcactgggtctttctggggagatgctaaatgtgcctngtgggcagcaggtcacgtgcctactgaatgcctctgggaatcaagaaatgctggagattt

SEQ ID NO: 15804 - DNA, 121 bp, Artificial Sequence
  Synthesized
  misc_feature (61): n=a or g
tgttgacgtggtgacccaaagcatcttgtttaatgtgtgacatagcctcactcctgacctntacagcagtcagcttaggggcagctgtttagaggctgtacaaactgcgcaactgcagatg

SEQ ID NO: 15805 - DNA, 121 bp, Artificial Sequence
  Synthesized
  misc_feature (61): n=a or g
gtctgtcactgatattaaggcataagagtgcagcagattttaagtagttgctatggtaacnaaaccatcacacttcttaagagatgagtattggtggcaataacttgtaagtcacagccct

SEQ ID NO: 15806 - DNA, 121 bp, Artificial Sequence
  Synthesized
  misc_feature (61): n=t or c
tagcagaagtgttaagctacacggctctcattcatctcaacatcgtgtcagcctccaaaangtgtagtctgaaacatttgccacagggccctttctgtgaactggcagcatccacaacttg

SEQ ID NO: 15807 - DNA, 121 bp, Artificial Sequence
  Synthesized
  misc_feature (61): n=a or c
gacctcagatccacctcaggaacaccacctctaaacagacttctaactgcaggctggaacntgaattgcagctcacctgccctgtactggctctctctcactcatatacaacagtatcaat

SEQ ID NO: 15808 - DNA, 121 bp, Artificial Sequence
  Synthesized
  misc_feature (61): n=a or g
ccaaagtaacgttgaagcagttctactcagaataacgtccttgaaaagcttctctaacccnacctattagtttgaattcctaccctctgatgcatcgccctgctccctcctaatccaggga

SEQ ID NO: 15809 - DNA, 121 bp, Artificial Sequence
  Synthesized
  misc_feature (61): n=t or c
tattgcacttgtacatagtgctttttgtgagaagatttgcatgtttgtcttttgggttccnaaggactgatgacacagatctcagtatcagatatcttagatatcattgatctgttctttg

SEQ ID NO: 15810 - DNA, 121 bp, Artificial Sequence
  Synthesized
  misc_feature (61): n=a or g
ccctgagaactctatagaataagttacactaatagaattgaagagcagctggcaacgcatnttcaacaaagaagtaagatgtgacaacttcagttcagccaacagacagaatcacttgatt

SEQ ID NO: 15811 - DNA, 121 bp, Artificial Sequence
  Synthesized
  misc_feature (61): n=a or g
gtcaggggggttctcccttcacacgcgtgctcagcaggcaaagatacaattctgacttacngttatatatgaatgagttattttggagtattgaacacagaggaactcaagctttataaag

SEQ ID NO: 15812 - DNA, 121 bp, Artificial Sequence
  Synthesized
  misc_feature (61): n=a or c
aacaaaggccttcggtgttgaagtgacaaatattcccaaacttccctttctttgccacagngtgacttttgaactgctaccgatgtatttgtgttaacctcttccattgttttcatttatc

SEQ ID NO: 15813 - DNA, 121 bp, Artificial Sequence
  Synthesized
  misc_feature (61): n=a or c
aaacatccagaatttgggaagggctataaggactgtgtgtaacgcccagagctgacctggngtactgccagcaggctgggccaggcaccagcccctccaagaggaataaagctcattctgt

SEQ ID NO: 15814 - DNA, 121 bp, Artificial Sequence
  Synthesized
  misc_feature (61): n=a or g
gtgaaaaaaggagatacccggcttactgaattatttccaaatactacagtagttctctgtncctctctagtataaaggggaaaaaagtgaaacctaatcattaaaggaaaacctgtttgga

SEQ ID NO: 15815 - DNA, 121 bp, Artificial Sequence
  Synthesized
  misc_feature (61): n=a or g
tgcggttaaactgccgcaatacctcactaccttgtttagtaaatgacccttgatacctctntgcacaactacattgtgaaatggagtgagagagccagctggtgttatttccaactctgcc

SEQ ID NO: 15816 - DNA, 121 bp, Artificial Sequence
  Synthesized
  misc_feature (61): n=a or c
cttctaagccactatccatctagttttgcacgtgcaaacttggtcacaggcacccaggccnttgccaacaggaactgctggagatgacatttgtcagaatgggaatggcattgaggatctc

SEQ ID NO: 15817 - DNA, 121 bp, Artificial Sequence
  Synthesized
  misc_feature (61): n=a or g
agaaatggttatccccatgatcaacttgcaaaaagaggtttatgcaggaaatctgataaancctgagaaacaagaatctgcattcccaagcctgctaaaagacaagggtggagacagcacc

SEQ ID NO: 15818 - DNA, 121 bp, Artificial Sequence
  Synthesized
  misc_feature (61): n=t or c
ttctgagccctcccatgcggacaccaacaccacgcacagggattgttttcagcagctctgnatcagtaaaggggagcaaagtgcttatatctgaatgtagtgacttaaggataaaaactct

SEQ ID NO: 15819 - DNA, 121 bp, Artificial Sequence
  Synthesized
  misc_feature (61): n=t or c
gacatcctgggcttgctcatcttcagctggccaagaagacattgaggactggcccagaagnctgtgcccttgatgctaactccagtatgcagatttgctcacctttgagacatagcatggc

SEQ ID NO: 15820 - DNA, 121 bp, Artificial Sequence
  Synthesized
  misc_feature (61): n=t or c
agatctggcaagagatccactaaagcttagcaagaatgagtaccactggtgagaacagtcntatcccagctagagggagacaggagggacgcttccttttttggttgcaaaactcaagttg

SEQ ID NO: 15821 - DNA, 121 bp, Artificial Sequence
  Synthesized
  misc_feature (61): n=a or g
atttagaagtgtttgtgtgactgtaaatctttaagtgtgatcgtatcttgaatcccatttnctctgaagactgtgttccaataggaaacttgggtatgtgtttaacctgagaaatgcttgc

SEQ ID NO: 15822 - DNA, 121 bp, Artificial Sequence
  Synthesized
  misc_feature (61): n=a or g
agtaaaataggaagtctatttctatgcaaatgtttggaattcaaataacgttttctcagtntcaccaaactaacacagaaaacgagatgccccacatgtgaggagagcacttagcagagag

SEQ ID NO: 15823 - DNA, 121 bp, Artificial Sequence
  Synthesized
  misc_feature (61): n=a or c
cattaactaattaactgcattaactaagctgctcatctgcattaactgctagaaagccatnattagggataacgtgaaagccttaaagattttgccttttttgtttttaattattattatt

SEQ ID NO: 15824 - DNA, 121 bp, Artificial Sequence
  Synthesized
  misc_feature (61): n=t or g
tggctgcagcctaagcgagtttagatggttcataaaatattgtgggtaggccagataaatnaaagtatttaaattcagtatgcttagacattattattttcaagagtgcctaccactgcgt

SEQ ID NO: 15825 - DNA, 121 bp, Artificial Sequence
  Synthesized
  misc_feature (61): n=a or g
ggggcagtgtgccagcaatgtgcagctcgggaacctgctgtccttacactggggtttgtcnaacagggcaaagtgacacgtcaaggcagacataaacatgtttgggaaaagaaggctacgt

SEQ ID NO: 15826 - DNA, 121 bp, Artificial Sequence
  Synthesized
  misc_feature (61): n=a or g
agctcaggggtctgacaaatcatcatggtgcttttgctggctcctgagagccttgctgctnctctcagtgtgggctcctgcaccatgcccatccccagccccaccacatgcctcataccat

SEQ ID NO: 15827 - DNA, 121 bp, Artificial Sequence
  Synthesized
  misc_feature (61): n=t or c
aattttctcacctgtccagctgtcctcacacagctggccacgagaagttgcggttcaacangagggcttcacaggtaacaaccctgcaccacaaccgtgtggcttgttccagacagctctg

SEQ ID NO: 15828 - DNA, 121 bp, Artificial Sequence
  Synthesized
  misc_feature (61): n=c or g
aatctacaggtatctgtgtttaaataatataatgcctaattttacgaatacatgtaattcnagtaaatgattgttcccaaagcaatttcctcacattgtgtttcagttacaggaattaaaa

SEQ ID NO: 15829 - DNA, 121 bp, Artificial Sequence
  Synthesized
  misc_feature (61): n=a or g
tgaaatccaagagactgctagctcgcaatcctatcattaagtccgacccacttcagcagantgactccaactgcagaacaccgagtgcttcaataaacctgctgagcgtacaagcaggcac

SEQ ID NO: 15830 - DNA, 121 bp, Artificial Sequence
  Synthesized
  misc_feature (61): n=t or c
tgcgatgcatgctttgtacagcagtcttcactgctctgctgccaggtaagactttactgangcattcaggactttccaataaaataatatttgtgttctcacaactatctactgaagtctc

SEQ ID NO: 15831 - DNA, 121 bp, Artificial Sequence
  Synthesized
  misc_feature (61): n=t or g
aaacaaataaataaataacaacagttagaggacattgccatccgggatggaacaataccanttacagtagttttctcctgcctgtagacggctgtgaaggctgtttatgctctggcttccc

SEQ ID NO: 15832 - DNA, 121 bp, Artificial Sequence
  Synthesized
  misc_feature (61): n=a or g
gcatatagagatataatcagaaaagggattgcaaaatgacttgcaagaagcaaaggatgtncaaagaaacttgaatagtttttgcaaataaaagagagatatgaaaaagagaaaggaaagc

SEQ ID NO: 15833 - DNA, 121 bp, Artificial Sequence
  Synthesized
  misc_feature (61): n=a or g
ccgagtccaaccccaactcatccccaccatgaccagtaaccacgttcctcagtgctatagncgtagaacttcagagcctgagccaaagagaagcccctgaggcaggatccccaaggccatg

SEQ ID NO: 15834 - DNA, 121 bp, Artificial Sequence
  Synthesized
  misc_feature (61): n=a or g
tgagggcatctttgcttttgagatgtggagggctcatctacccctgaaaggtggcaatagngaaatacagggtgatattgtctgggctggtattagcactagcagatgtttccggattcac

SEQ ID NO: 15835 - DNA, 121 bp, Artificial Sequence
  Synthesized
  misc_feature (61): n=t or c
tttgtatgtactcctactgtaaaatatagatgagctgttctgttgaggtaagacagaaacnatgtgtaggtgtaggaatacatgctggctgtgcttccaggctcagagattgccctgtgac

SEQ ID NO: 15836 - DNA, 121 bp, Artificial Sequence
  Synthesized
  misc_feature (61): n=a or g
aagacttgtccctcggatatagttcctatactgacagacttgtagttgtgaacagctcagnagtatcagtcaaaggtagtgggttagagttccatctttgggctgagcaaagggggtgcag

SEQ ID NO: 15837 - DNA, 121 bp, Artificial Sequence
  Synthesized
  misc_feature (61): n=a or g
atgtaataggatgcaatctataatagtattttcccagggaaagccctcagctcattgtctncagaagcctcacacttattttcatgcaggacaaaccatacaatcaggaaatgcacagtgt

SEQ ID NO: 15838 - DNA, 121 bp, Artificial Sequence
  Synthesized
  misc_feature (61): n=a or g
ccttccacaggtgttggaatttattttgtctattataaccagtctacatttcaggtacacntcaacaacttgctgaattcttactgtaagactcaaatattctatgtaattcccctagcaa

SEQ ID NO: 15839 - DNA, 121 bp, Artificial Sequence
  Synthesized
  misc_feature (61): n=t or c
agcaggcagaggggtctgaactctctgaagctcctccatggaaggggaacgcctttctccnccttaccacttgtaagaaatacagtctcagatgggctagagaatccagtgctgatgtgtc

SEQ ID NO: 15840 - DNA, 121 bp, Artificial Sequence
  Synthesized
  misc_feature (61): n=a or g
cgtgggcatatttcatctgaataataggctgttcaaggaggtagatggagaagtttctctntggagtgctttatacgtgctgttgtccttgtggctcttgccttgtggttcatcgatacgc

SEQ ID NO: 15841 - DNA, 121 bp, Artificial Sequence
  Synthesized
  misc_feature (61): n=a or g
ctcaatgcactgaaaatgatcaaacaggaggaatgtccacatatcttgtccaagattctanccaaatccaagtttcagaagaaaggtagagtagtggaatgtagcaggagctgattaatat

SEQ ID NO: 15842 - DNA, 121 bp, Artificial Sequence
  Synthesized
  misc_feature (61): n=t or c
ctctgtaggtgtccaggcctcgttttattcctggctttaatcgtaggttggctgctgctgnggcctggcctccttcacgcacaatcatatcctgaattttagccatatatttaattcccag

SEQ ID NO: 15843 - DNA, 121 bp, Artificial Sequence
  Synthesized
  misc_feature (61): n=t or c
atctctctagaatacatatacttttttcttttaaaaagtcaacgatgttaaccatgtggtngctgaccacctgggaaataacacaacaaatctggagagatagtaaatgattttagtgatc

SEQ ID NO: 15844 - DNA, 121 bp, Artificial Sequence
  Synthesized
  misc_feature (61): n=t or c
gtacactatagtactttcattgtaactccttctaaaaatcccagtttctgcttatgaattngtaaggcaatttacctttgaatttgacaactattctctctgttttaatggaataaaggtg

SEQ ID NO: 15845 - DNA, 121 bp, Artificial Sequence
  Synthesized
  misc_feature (61): n=a or g
ccataggtaggtccttacattcccatctgatgcatttcaaaatttgtattacctcttgccntttgcctacttcatcgttctgcattacttgaacaatcaggagtagagtggaatctctttg

SEQ ID NO: 15846 - DNA, 121 bp, Artificial Sequence
  Synthesized
  misc_feature (61): n=t or c
gattccttttggacccttcagatcatacaactgccaatttcagacaaacaaaatttaagtncactttgatggaatatgttttttactttaaatcatgaagcgtcttccataaatttgcatt

SEQ ID NO: 15847 - DNA, 121 bp, Artificial Sequence
  Synthesized
  misc_feature (61): n=a or g
tttcccctttctgctctaccttgggtgcatttaagaaatttcactcttcaaaaaatgatcngcaatacaaatggttctcagctggtaaattcttactgcttttgaaaataaactgtttgta

SEQ ID NO: 15848 - DNA, 121 bp, Artificial Sequence
  Synthesized
  misc_feature (61): n=t or c
caccttgtagcagaattttgccaggtacgtatgtcaactagatattctttcttttggtagntcctcccgactgtcattgggatcagaaaagaaacctaaccactgacatggccttgtctaa

SEQ ID NO: 15849 - DNA, 121 bp, Artificial Sequence
  Synthesized
  misc_feature (61): n=a or t
atgcttaaactaatcatctctggaaagctttccctgcaccagatgcagctagtgaacaatntcattgctattctccacactaccagcatctaatccatgaagccaggaaagaatgtccaga

SEQ ID NO: 15850 - DNA, 121 bp, Artificial Sequence
  Synthesized
  misc_feature (61): n=t or c
acctttgtgttaggttcaggttttccccttgaagtgcaacgtttcaccatcttccaaaacngtaatccttgtaatgaatttaaagctgctgaaaatgtttgcatctgaagcactttttatt

SEQ ID NO: 15851 - DNA, 121 bp, Artificial Sequence
  Synthesized
  misc_feature (61): n=t or g
ctgtcccctgctgagagcgggctgcaaagcaatctctcctgcaagacttaaagaataaccntagagagggatttctccgtcccaagggagccgtgccatgacagccacagcaatgagaagg

SEQ ID NO: 15852 - DNA, 121 bp, Artificial Sequence
  Synthesized
  misc_feature (61): n=a or g
ttcaaaagttgttatggtccctatttgttcacttcccaaattgttccctttggaataactntatttctggattcattgaaacaactgcagtgagaaagctttggctggagttctacactct

SEQ ID NO: 15853 - DNA, 121 bp, Artificial Sequence
  Synthesized
  misc_feature (61): n=t or c
agatacttccacattttgagtcttcagaaggaaacttttgcaccactgagagctggtagcnatgatccagctgatgggaactgcccacgtccctggaagaaaaatttgatcatttgggttt

SEQ ID NO: 15854 - DNA, 121 bp, Artificial Sequence
  Synthesized
  misc_feature (61): n=t or c
tgctttttaaaagagaaaaaagataatacttaagttttgaagattcctgacctatctaaangacaaccttcccaggcagagacagggacaaacaaacattgccaacctggaggaaggatag

SEQ ID NO: 15855 - DNA, 121 bp, Artificial Sequence
  Synthesized
  misc_feature (61): n=t or g
caaaatgagcatgagatcttactccttgcattaaaagctgcaaatattacaagagcttacncggaggtaacaattcaccaatgcaagataatatggcataaaaagaaagaacaccctctgg

SEQ ID NO: 15856 - DNA, 121 bp, Artificial Sequence
  Synthesized
  misc_feature (61): n=t or c
tttcaaaggagttgagaggcaattgagtaaggaactgaaaagaatccatctgatattagtnattgcttgtaagatacacatctagaagcaaatgattttgattgatgcatgttagcctcct

SEQ ID NO: 15857 - DNA, 121 bp, Artificial Sequence
  Synthesized
  misc_feature (61): n=c or g
ttgggacataacaacctcttaaaagttggtttccagcagagtaaggggaatagaaaaaatnacatagggaaagttttctgatgtttgatcagtgttagatttcttgtgccttgctctgaag

SEQ ID NO: 15858 - DNA, 121 bp, Artificial Sequence
  Synthesized
  misc_feature (61): n=a or c
ctaaaaggaatttctcctcacctacaaaaagcacatatacaataaatcagaaattctacanaggtaccattttacatctgtaaacatacaatcacttcagaattacagttctatgaaaagt

SEQ ID NO: 15859 - DNA, 121 bp, Artificial Sequence
  Synthesized
  misc_feature (61): n=t or c
gaagtgcaaaaaatcactgacagaagtgctgtctaaaggttcctcttcggttgttaatatngtagcagcttcccaaatctttcttgatgcccttctgtgcctcagttatggcctcagtatg

SEQ ID NO: 15860 - DNA, 121 bp, Artificial Sequence
  Synthesized
  misc_feature (61): n=a or g
caagtcaatctgctcactcacagcaccatcaaagcaaatggttggccgggaactagcagcncatacttgaggctcctggaggcctgcggtcagtcagttctcttcacagtggtgggcactg

SEQ ID NO: 15861 - DNA, 121 bp, Artificial Sequence
  Synthesized
  misc_feature (61): n=a or g
ttttttgaacctctcctcttacttcttttgttagaaagcatccatatgctttctgtagacntatagacaccattagctagaaataaatttactatgtatactatttgagggtttttttttt

SEQ ID NO: 15862 - DNA, 121 bp, Artificial Sequence
  Synthesized
  misc_feature (61): n=t or c
attattcagttaatcctttgctttggtagaacaactgtgtgtaaagagaatgactgcgttntctacagaagtacactgtggcttacaactttattattacactattgaaaaataggtcagg

SEQ ID NO: 15863 - DNA, 121 bp, Artificial Sequence
  Synthesized
  misc_feature (61): n=t or c
atgtttgctgaggagacagtgttgctgttttcaaccacaatgcagtttccaggttagaaantttagaactcctgaactgataattacttttctcattttagacagagaaaacgcatacata

SEQ ID NO: 15864 - DNA, 121 bp, Artificial Sequence
  Synthesized
  misc_feature (61): n=a or g
actgcagttctgaatcttttgcctgccaatagacttactttttatcaaaaggtaataagcnagaagtttgtcagattcttaagatgcctagaaaattccatttgaaggacagattaagatt

SEQ ID NO: 15865 - DNA, 121 bp, Artificial Sequence
  Synthesized
  misc_feature (61): n=a or g
aaatgactatacttaaaatgaagattcacagctgcaacagctaagcaatccatggtcctgntgcagatactttcacctatgtgcacacatgtcctagtttgtaatagcaatggagaactat

SEQ ID NO: 15866 - DNA, 121 bp, Artificial Sequence
  Synthesized
  misc_feature (61): n=t or c
gcaatgcaaatttgggacaacagtgctaggactggagtatatttacctagatacaaagtantagaaggtctgaaaaggaacaggaatccattagtggagaatccattcttttgttccctgg

SEQ ID NO: 15867 - DNA, 121 bp, Artificial Sequence
  Synthesized
  misc_feature (61): n=c or g
caaacagaaaagttgatttttccttttgtcccagttctaattgttatgtggacatcaaganctttctgtaccatacgctgtttcttaactctagcactctgtgatgttgtattttggtgaa

SEQ ID NO: 15868 - DNA, 121 bp, Artificial Sequence
  Synthesized
  misc_feature (61): n=a or t
ctcctttaggggaagggtccccttccttggaaatatttactatttaagattactgtaaagnatcagacagttatatccatactaaaatgttactttttctttctgtagccttaatattttc

SEQ ID NO: 15869 - DNA, 121 bp, Artificial Sequence
  Synthesized
  misc_feature (61): n=c or g
ttgtaggcagcttacatggcagtctccacaagtcttgaatttcagaacttggtactttctnaaaatcagtttccagcaccaccagttactctcctgtggaaattctggttctaatggatac

SEQ ID NO: 15870 - DNA, 121 bp, Artificial Sequence
  Synthesized
  misc_feature (61): n=t or g
acaactgaagctgcgtcagagcagaaatgtcctgtggaaccagacacagcctctccttgtnttagaacctgaaattcccactcgtgacacaggacaggcttagaagctcacaggctttgaa

SEQ ID NO: 15871 - DNA, 121 bp, Artificial Sequence
  Synthesized
  misc_feature (61): n=a or g
gggttttgcctgagtttgaggagtagcttgtgtctgaactgtttgtctgctggtgtaaacntaactaattccagtggcactttgtactccttgtgcttcagtatgctgaaaaatactgtgt

SEQ ID NO: 15872 - DNA, 121 bp, Artificial Sequence
  Synthesized
  misc_feature (61): n=t or c
ggatatagtcaaactgggcataaagcagagaacaaacatattaatcagggcaggacagtcnctttgcctgggaaaagacagaaagcactaacagtatttaactgcatacttgctcacgtta

SEQ ID NO: 15873 - DNA, 121 bp, Artificial Sequence
  Synthesized
  misc_feature (61): n=a or c
gtccatgaagaacaccaatgtttggtcctattccagtggagacagggaggcaccctttganttttcagtaatgccttagagaaatgctgtgatatagctctttgattggccatgcacatcc

SEQ ID NO: 15874 - DNA, 121 bp, Artificial Sequence
  Synthesized
  misc_feature (61): n=a or c
gggaaacgccccagtaactccctgcctctctgtgtatcccaaatctgtctctaaatccccngatccctctattaaattgtctcacttctccacttacactttctcgacagccctctccccc

SEQ ID NO: 15875 - DNA, 121 bp, Artificial Sequence
  Synthesized
  misc_feature (61): n=t or c
gacaggaagactccaggcggaggtcaggggctgttggattgagcgccgttcctttgctgcnctttgggttctttcacttgaaagatgagaaaaatgaagaaaactctgtggagatgagaag

SEQ ID NO: 15876 - DNA, 121 bp, Artificial Sequence
  Synthesized
  misc_feature (61): n=a or c
gcagagccctcagctggtgtaaaagggtttagttccaccgatgtcaatacctgagtcaatnagctgctagaggaactagcctgcacttcacgcctcttttggaagattaattcatgcagcc

SEQ ID NO: 15877 - DNA, 121 bp, Artificial Sequence
  Synthesized
  misc_feature (61): n=a or g
tttggctgtccaacacaaagttctgaagactatgaatttgcaaatcacagtgtcaactttnagtggtttttgacactgtggtattaattactacaacagcttgctcaatttctgtataaat

SEQ ID NO: 15878 - DNA, 121 bp, Artificial Sequence
  Synthesized
  misc_feature (61): n=c or g
tgccggcgttcataaagagggagtatgttgtcaactctagagggattatgcttaggctttntttagcagaatacaggaagcctcaaagagcagagattttaccaccattctaatgttctct

SEQ ID NO: 15879 - DNA, 121 bp, Artificial Sequence
  Synthesized
  misc_feature (61): n=t or g
tcctttctaggttctgcagtgcaggagagtttcaagcttcaggatgtgttgtataggaacntcttgaaaatttcatctcctaaaacatgccctcctgggaaggtgtctggtgacaagctgt

SEQ ID NO: 15880 - DNA, 121 bp, Artificial Sequence
  Synthesized
  misc_feature (61): n=t or c
gaacaaaccttatttttgtctggaatgtgtctgttcattaacggtgaatgaagaccttcanaggaagaaattggtattgacttttttttcataatctgagtgtaaacttttggctttggtt

SEQ ID NO: 15881 - DNA, 121 bp, Artificial Sequence
  Synthesized
  misc_feature (61): n=a or g
agatcgagatgaggaccgtatatataagaatttgcttgcggtgattgattcaagcaactangctgctttcactataaatttgatccagaaagtgaagtttttgttgttgcttccttgctat

SEQ ID NO: 15882 - DNA, 121 bp, Artificial Sequence
  Synthesized
  misc_feature (61): n=a or g
acatgttaaaagggagataaaatatctgggaagaaaagggttgggaaaggtacaaactctnaaaatatcactggttctcctttgaaagaaaagtactggactgactgtcatgctctgatag

SEQ ID NO: 15883 - DNA, 121 bp, Artificial Sequence
  Synthesized
  misc_feature (61): n=a or g
taaattaattaaactaggcccactaggttagtagtattaattaattattaacataggcctncttttgtgaagcacgctcctcatgaatgctgctgctttgtgagctgtgctggcgtggtgc

SEQ ID NO: 15884 - DNA, 121 bp, Artificial Sequence
  Synthesized
  misc_feature (61): n=a or g
tgactttatgtggtacctcttgtcagatttattgaacaggtgcatgagagcatcaaagaantctttgaatctgtccatatgagctagggctgcttgaaggtgcattgggatgatgaccttt

SEQ ID NO: 15885 - DNA, 121 bp, Artificial Sequence
  Synthesized
  misc_feature (61): n=a or g
cttaaagtttacagaatgtttctaaaatattttatacccgatgtcaaacattgcacaaacnaatcgtttggagttggtaatgctttgttactcttttctagatcaataaaatttgctgccc

SEQ ID NO: 15886 - DNA, 121 bp, Artificial Sequence
  Synthesized
  misc_feature (61): n=t or c
gcaaatcacctggtgcttctatcaccattttctttctccaggtgtgtgacagagtattccnaaggtgaccacctgacagaagagctacctcgctagcaaatgtctgttcacttcagaaaaa

SEQ ID NO: 15887 - DNA, 121 bp, Artificial Sequence
  Synthesized
  misc_feature (61): n=t or c
gttttcctccccgtccccttagcatctcccatcctttcttaaccctgagacctctttgccnatttgtggagggagaagagatcagtgcgggatgcagcagctcagggaatggagcagttta

SEQ ID NO: 15888 - DNA, 121 bp, Artificial Sequence
  Synthesized
  misc_feature (61): n=c or g
gttctcagcatcaaggaaactgggaacacttataatattttgggccatgttcctcagctgncaaatgctaaggacaatgaggtaccagtgaatatgaattaggcttctgagataggaatta

SEQ ID NO: 15889 - DNA, 121 bp, Artificial Sequence
  Synthesized
  misc_feature (61): n=a or t
ggctgcatccctgttcttccgagcgttctcttaatgtctccatgtgctcctctttcacagngggaccaaggtgacatttttgtgctctagctgctggccaagccaagttataaagagctgc

SEQ ID NO: 15890 - DNA, 121 bp, Artificial Sequence
  Synthesized
  misc_feature (61): n=a or g
agtacagaagcggttaaaactcttccttcccatctttcacacgcacacacgtgcacaagancaaccaccactttacactatgtgtctgcttggcaacttgtgagagtattgctggcacttg

SEQ ID NO: 15891 - DNA, 121 bp, Artificial Sequence
  Synthesized
  misc_feature (61): n=t or c
ctgaacattttgccttcaatatttcctcagaagtagaggatgcagtgttagagagagcacnactcacttctgtgagctgtcaactcattctagcataaggaaagggaaaacagacagcaaa

SEQ ID NO: 15892 - DNA, 121 bp, Artificial Sequence
  Synthesized
  misc_feature (61): n=a or g
tcttccatccctggggggctctggcctaacaggaattagacctcagtattactatggaatnattgatctttttaacagtgaagctgcccagctggcactggggttaagaagtggatactga

SEQ ID NO: 15893 - DNA, 121 bp, Artificial Sequence
  Synthesized
  misc_feature (61): n=c or g
aatttaagagcaaaacatactttagtgcatgttaaatacatactaaaagttctttacaatnagagtgaagaataactaccattctgtgccttctggttcttactgagctctcatttcggta

SEQ ID NO: 15894 - DNA, 121 bp, Artificial Sequence
  Synthesized
  misc_feature (61): n=a or g
gttccagcctaaggaagagaagcctgggcaatgccgtgtatttttctgaggaaaggacacntcagtctcttcattccctgtgcacccttcagacagggtgcaagcagaaattcacctgaat

SEQ ID NO: 15895 - DNA, 121 bp, Artificial Sequence
  Synthesized
  misc_feature (61): n=t or c
aagattcacatccctcaggtaaaacacaaccatgcctgtgcgttagggtacaatgagacantttctggaaaaggaaggaaggtgatagtaaatacacactgtttgtgggtaaaggttataa

SEQ ID NO: 15896 - DNA, 121 bp, Artificial Sequence
  Synthesized
  misc_feature (61): n=t or c
gacatttaaatttaggcactaacaatgttagtggaatctacagttctgttctccatagatnggagactaatgacatttcaagtgacttaatgtatcctgcttctaggaaaactgaaatatt

SEQ ID NO: 15897 - DNA, 121 bp, Artificial Sequence
  Synthesized
  misc_feature (61): n=a or g
tcatctgtattagctgtctgattttcttctgagtgctaaaggagtactagagtggcttggnatggaaaggttcttagagagtactaaaaggacataaaacgatcaagtgtccaaaggaggg

SEQ ID NO: 15898 - DNA, 121 bp, Artificial Sequence
  Synthesized
  misc_feature (61): n=t or c
gctttttttggtggcctgctcatgtacatagttatttactgctcttgccactttgctcatngttagattctgagaagactacaaatgaagttcccagtgtagtattgcagcgtagtactga

SEQ ID NO: 15899 - DNA, 121 bp, Artificial Sequence
  Synthesized
  misc_feature (61): n=c or g
tagggttgaaaaaaaagcccatttcatgtagctgtgggagtaaaaaactggtgaatcacantcctgtattttctgtcctcttcatttctacctgttgttgctgttggtggtggtgtttatt

SEQ ID NO: 15900 - DNA, 121 bp, Artificial Sequence
  Synthesized
  misc_feature (61): n=a or g
acatttcaatcttatagagcatctgttgccttgaagagctgtttggagcaaagagctcacnttgaaactctaaatttctattagaataacaaaaaaaaaaaaattcagtgtaactgaattc

SEQ ID NO: 15901 - DNA, 121 bp, Artificial Sequence
  Synthesized
  misc_feature (61): n=a or t
ttggtctatcaggcatctaaagatgactgtgtagcgttccattaactcagtatgtaactcngagaccagtaccttgtgacacaaaagtagagataatattattcaataaggattctgaatt

SEQ ID NO: 15902 - DNA, 121 bp, Artificial Sequence
  Synthesized
  misc_feature (61): n=a or g
gcatgagtaaatgccactgagacctttcttttactggtgaacttgaaattactttcaaacntgtaaagccacattatggcagaaagtaatttcatcatcaacctttagaaaggcctttcca

SEQ ID NO: 15903 - DNA, 121 bp, Artificial Sequence
  Synthesized
  misc_feature (61): n=a or g
ctactgagcaaagtgacagtgtgcatgttatgacctataagtgactatctagcagcaatcnttaatgttgttgaatgtgcttgctgtgcatatgacctgcaagttactagtatagtctcac

SEQ ID NO: 15904 - DNA, 121 bp, Artificial Sequence
  Synthesized
  misc_feature (61): n=t or c
attgtgaaagtgtggtgggataaaacccagattgtttcacatccacgcagagcagcgtccnggggaagttctccttgcttggaacacatccacccagagctgggcaattcaaagggtgcaa

SEQ ID NO: 15905 - DNA, 121 bp, Artificial Sequence
  Synthesized
  misc_feature (61): n=a or t
gtgcccactgtgcgagagaacatgcagcgttagtgcagcttaccttcactgtgcctgcagnctgaggcacccataggcaagtattccttcacaggattcatgccacagattcctggggatc

SEQ ID NO: 15906 - DNA, 121 bp, Artificial Sequence
  Synthesized
  misc_feature (61): n=a or g
ccagtctgctgcagatccagaggggagtagtcagggcacagcgggtttctatcatggcacnctccacgccttgacagctggaggaagtctggcatgggagctgaatctattggcttcatgt

SEQ ID NO: 15907 - DNA, 121 bp, Artificial Sequence
  Synthesized
  misc_feature (61): n=a or g
catagtatcctctgattaacgctcgagaatttgattctcctctcactggtattgtgaatgnggcataaactggcatgtgccagatgagttaacagcaacaacaaaaaatacacaactaaat

SEQ ID NO: 15908 - DNA, 121 bp, Artificial Sequence
  Synthesized
  misc_feature (61): n=t or c
ggttgtgctgtgctgcaggcaggcactggaggaggacgaatcccagagtttgcagagattnatttgcaggcgctctgcttggagccctcaagccccagagaaagcaagatgctattttcag

SEQ ID NO: 15909 - DNA, 121 bp, Artificial Sequence
  Synthesized
  misc_feature (61): n=t or c
aactacggagctgctgaagtgaaggtaagataaggggcaacaactttcctagttatggcangatgggaaaggtttcccttttatttctcctctgtccctcatagtcagtccgaattttctc

SEQ ID NO: 15910 - DNA, 121 bp, Artificial Sequence
  Synthesized
  misc_feature (61): n=t or g
aagagattctggcataggaaccatgggataagaagacccccaatgcttcactaactctgtnagggccttctcctgcttccccatctggccattatcctttctcagacagtaaaccccaaca

SEQ ID NO: 15911 - DNA, 121 bp, Artificial Sequence
  Synthesized
  misc_feature (61): n=a or t
catggcctaactctgctcagcctttgctggattactgccttcctataagcagctaaaaacntgtgtagatattcctatcacttggcatgaaggaaagatgcttagaacgtgtagtgccttt

SEQ ID NO: 15912 - DNA, 121 bp, Artificial Sequence
  Synthesized
  misc_feature (61): n=t or c
atttctgatctgtacagatcacagaacattgagaataatttattttattgtcttccaaggnttattttttggggcgaaacagcagtgaattctgtcagatgcagaaatatgcaagagtata

SEQ ID NO: 15913 - DNA, 121 bp, Artificial Sequence
  Synthesized
  misc_feature (61): n=t or c
ttgctggcagctgggaagaatgctgtgtgagataagttcaacttgctggctctatagttanttgtgccttgtctttcttgtctctgtgtatggaatactttgtgctgctatcaaagccttt

SEQ ID NO: 15914 - DNA, 121 bp, Artificial Sequence
  Synthesized
  misc_feature (61): n=t or c
aagggtgtgtgcaatcatagtcttttctgggaacacctgctgctctctccttttgtatagngtatacagcagagtaatagatcctataaagtgctttccttaactgcctactttaagaaga

SEQ ID NO: 15915 - DNA, 121 bp, Artificial Sequence
  Synthesized
  misc_feature (61): n=t or c
ggcagagtagggtgagacaatcacctccctcacatctgtgaatgctggtccacaccagcanatacagtgaaccttccaatcacaatacatgtaggtcagctagtaaagaaaacaaacgagg

SEQ ID NO: 15916 - DNA, 121 bp, Artificial Sequence
  Synthesized
  misc_feature (61): n=t or c
gggaggagagaacaggaacaggggggagaacagccaccaggatccacatctgtgcccacancgtgctccactcattctcagccaggtcaacagatgaaagcccaaagcgcctcaaacccat

SEQ ID NO: 15917 - DNA, 121 bp, Artificial Sequence
  Synthesized
  misc_feature (61): n=t or g
gagaaagcagaaatctttttacacatggagttaaaaagatggataggaaaactggaaatgncacagtgaaaccatgaaaccctggaaattctagattaaaatttgtcctcagtctttgttt

SEQ ID NO: 15918 - DNA, 121 bp, Artificial Sequence
  Synthesized
  misc_feature (61): n=a or g
ggactgagttactcagccaaaacctactgcaaaaggtccttgtgatccttgataatgcaancaagggaatgaaaataaagtagcttctctttctaatgagtgttacatgaaagtaaagaaa

SEQ ID NO: 15919 - DNA, 121 bp, Artificial Sequence
  Synthesized
  misc_feature (61): n=a or g
ctgtgtatgcaaacagatgcacgcgtgtgcactccagcatgggggctgcttcctacagcanagccctgccaacagaagggagctcctccagaaattccccgtggctttatttgctttatct

SEQ ID NO: 15920 - DNA, 121 bp, Artificial Sequence
  Synthesized
  misc_feature (61): n=a or g
atgcagcatcaagtcagcctctatggcgaaaattaactccctctcagccaaagccatgaanctgatcaatgtgcataaaaagtggaatattctcatttgaatggatgaaatacaagttttt

SEQ ID NO: 15921 - DNA, 121 bp, Artificial Sequence
  Synthesized
  misc_feature (61): n=a or g
gagttgtgttaattgggtaaaatggatacattccggaatgggttttaacagcagtgcagcncatcaatgtttactggcatttagcattgaatatccctttatctgtaagcactttagagct

SEQ ID NO: 15922 - DNA, 121 bp, Artificial Sequence
  Synthesized
  misc_feature (61): n=a or t
acacaggtaaggatattgttgcatttgagaccattaaaacctctagtttcatctccagccnctactggacttagaagtcacttccttttagaaagtgctaagtgtattacagtagcactgt

SEQ ID NO: 15923 - DNA, 121 bp, Artificial Sequence
  Synthesized
  misc_feature (61): n=a or g
cagttcataagaattgacaaattatttaaaaatttgcctcaaaataggtgaatttgttatnaacaagtttgtcagtacctgtcaaccactacttccattttgtccagagttcttttgtcat

SEQ ID NO: 15924 - DNA, 121 bp, Artificial Sequence
  Synthesized
  misc_feature (61): n=a or g
tcatagccgctgtctgcacctgggggggggggagtgatatgaatgcagccagacctccccnagataacctgatgatttgaaggctttttaactctcttgtgacattctctgtgcagcctta

SEQ ID NO: 15925 - DNA, 121 bp, Artificial Sequence
  Synthesized
  misc_feature (61): n=t or c
gcactaaggtcacctactcttagttatggttctaatatgctaggtggacccactccagtantaagcacttactgatcacagctagcatagctatcccccacgcacgtgttctgtctgcttg

SEQ ID NO: 15926 - DNA, 121 bp, Artificial Sequence
  Synthesized
  misc_feature (61): n=t or c
actagaccagttcattctctgctgtcaagctgtctgctgttagaaagacagaggaaactgnttctatttttgaagcccaaaaagatgccaggtttattttcctggtggattttgaagttta

SEQ ID NO: 15927 - DNA, 121 bp, Artificial Sequence
  Synthesized
  misc_feature (61): n=a or c
cagttttgctgtcatcctcaccagtccacagtgacaatggaatgagctaaggtatttcacnaaatccaaaaatacccctcagatttatctcttgcaaacatttctgctggtttgacactta

SEQ ID NO: 15928 - DNA, 121 bp, Artificial Sequence
  Synthesized
  misc_feature (61): n=t or c
ggtgttcatccaaatgtgaattcttaaagaaaatgaagactcatgaatttcccagagttgntggtctctcaaagctttcttgagaacttggatagaaggtttgccttgtcacactctggtt

SEQ ID NO: 15929 - DNA, 121 bp, Artificial Sequence
  Synthesized
  misc_feature (61): n=t or c
tacttactcacttttaatcacagcagtgtagtggcaaatgcagcagctaaattatttgttntggccaaagcacactgtctatggtaattctcaaatgcaaaactaagccactcagtggcat

SEQ ID NO: 15930 - DNA, 121 bp, Artificial Sequence
  Synthesized
  misc_feature (61): n=a or g
tttaaaaccagtagaaattccacctgcttggggctatccagaggaacagtgctgctccctncaatggttcagctgggttaaatactgtaaaaattaagctgcaaagtagaaacaaggaact

SEQ ID NO: 15931 - DNA, 121 bp, Artificial Sequence
  Synthesized
  misc_feature (61): n=a or c
atatcaggggtccgaagggatactggttgagatagggaataccgaagcaacaaatgagggnggaggaatactgcagctgttcctcatttttttgttgttttccttaaaactggctttgctt

SEQ ID NO: 15932 - DNA, 121 bp, Artificial Sequence
  Synthesized
  misc_feature (61): n=t or c
aaaaagccaaaaaaacccccaacaaaacagaccttcagggtggcaacagaagatgatgacngtttgagtcaactgcttttcaggaaagaactcaagagtcccctattccaatacttgaagc

SEQ ID NO: 15933 - DNA, 121 bp, Artificial Sequence
  Synthesized
  misc_feature (61): n=a or g
cagtgaagaacctttccctgatatccaacctgaaagtgaaagcttggatatccaagatacnagcaagatagttaatcctccctcaggccagtgatactgggaccacagacacaaacctatg

SEQ ID NO: 15934 - DNA, 121 bp, Artificial Sequence
  Synthesized
  misc_feature (61): n=t or c
tcactgaaggaaatcctgagcaattgagccaccttccacgctgggctcctctaatgatggncccactcctctcttatcaacagagaagggagaacagaggcagcaggctgtggtacagtga

SEQ ID NO: 15935 - DNA, 121 bp, Artificial Sequence
  Synthesized
  misc_feature (61): n=t or c
ctgcattgtgctcttaaacactgtgcaatagtttggaacagaagagtagggcttacaacangtttacatcgatgtttgcctactccctcgcgtcagtagacatttccagacactaccaccc

SEQ ID NO: 15936 - DNA, 121 bp, Artificial Sequence
  Synthesized
  misc_feature (61): n=a or g
tttagatactccttgacagaaggacaaaaaaagtgtcttattaggaatctaccaatgtganagtataaggtaggaaagaaatcttctaaggcatgtcacgtgtgtgagaaatcctgttacg

SEQ ID NO: 15937 - DNA, 121 bp, Artificial Sequence
  Synthesized
  misc_feature (61): n=t or c
gttattctgccttccttttccctaggaaaagaacattgtgtgattttatattctatttctncctcacaggaatttctgagtttttggctgatttcaaatgcatttcagattaagtaatatc

SEQ ID NO: 15938 - DNA, 121 bp, Artificial Sequence
  Synthesized
  misc_feature (61): n=t or g
cgcttgcagtggttaaactgcccttacacacaaacattttattagtgtgtgaatatactanaagcctaaattagaaagataatgtaatttagcccacatgtttgaaatgagataaccagtg

SEQ ID NO: 15939 - DNA, 121 bp, Artificial Sequence
  Synthesized
  misc_feature (61): n=t or c
tgtgtgttcatgtgcttcactgccttcgttgaatcgcagtagggtctatgaaaagtgccangtgagacctcatagtggtgattgctgggcttgaggttttacagcatgctcctcctttttg

SEQ ID NO: 15940 - DNA, 121 bp, Artificial Sequence
  Synthesized
  misc_feature (61): n=t or c
ctaatatacatgcttttgacattagttctgtacctgtgcaatttgcgcctcaaaaatgttnagaacactatgcccctgtacatctgaatacagaaattgaggactgacttcctgaggaagt

SEQ ID NO: 15941 - DNA, 121 bp, Artificial Sequence
  Synthesized
  misc_feature (61): n=a or t
tctcttgctgcaaaaacagcaagtacagcctcttacatagtagtgtcacattcatcatacngctagataaggatttttttgtgtgctgaaaatgatacctattttgacccgtctcatgatt

SEQ ID NO: 15942 - DNA, 121 bp, Artificial Sequence
  Synthesized
  misc_feature (61): n=t or c
gagagaggagagtaagaaaaacaaacaaacaaacaacagcactgaatctcaaaaaattgtntgtgcaatagcttagaacacgtaagaccttgatggtataccctctgactaccgtgccatt

SEQ ID NO: 15943 - DNA, 121 bp, Artificial Sequence
  Synthesized
  misc_feature (61): n=a or c
acttcagtaaactttaaactggcctcaggggagctttactgagcttcggaagtttgccagnagatgagctgggctcattttcagaaggggagaaaaagcacattaactccagcaataatct

SEQ ID NO: 15944 - DNA, 121 bp, Artificial Sequence
  Synthesized
  misc_feature (61): n=a or g
tacggagaggcagacaagatattagtgtgtgacactactccttcagaggtttcaacctagnggaaaaatattcagtttggtattttaaatgacttttaaactgagatgtcaatagtgaaat

SEQ ID NO: 15945 - DNA, 121 bp, Artificial Sequence
  Synthesized
  misc_feature (61): n=c or g
ttgtgcagttgctgggaacagtcagtgctctttgtggcagtattacagctttgccatggtnctggaagaatgagttagagaagatggtccgagttaactaactttgggaaatggggaaaat

SEQ ID NO: 15946 - DNA, 121 bp, Artificial Sequence
  Synthesized
  misc_feature (61): n=t or g
agggaacagataggataatataattgctttacttacattatcaatcatgaaatgctgtatngtcaccaaatcatggtgtgatactgcatatcccttgcattatgacagaagcacgtggaat

SEQ ID NO: 15947 - DNA, 121 bp, Artificial Sequence
  Synthesized
  misc_feature (61): n=t or g
cctgcaacactgtactatgtcatttctctgtactaaactgttaagcacttgttcacaaatntgaactctgtattccattttactctgacaatgactaacattattttaaatgaggccaaag

SEQ ID NO: 15948 - DNA, 121 bp, Artificial Sequence
  Synthesized
  misc_feature (61): n=a or g
cctgttccggtgtctcaccacccacatcacatgtggtcagaggctaactagaactaaaacngccctcagggctcctggattatgatccctgtggtttcttgctgagagacacagctcagtg

SEQ ID NO: 15949 - DNA, 121 bp, Artificial Sequence
  Synthesized
  misc_feature (61): n=t or c
tatctattacagaacaaaattctcctatgctcccacaatagcaacctgttagaaactgtanaaggaacattgccaaaatccacgtaacaacagacagtaactggtcaggacccttgcacca

SEQ ID NO: 15950 - DNA, 121 bp, Artificial Sequence
  Synthesized
  misc_feature (61): n=t or g
ctgcatcttatagtagccatgtagaaagtgttggcgagataacaacgtgcacaatggaagnaaacaggtcactgggagcagaaaattaatattaagacaccccttacgggcaggctggcat

SEQ ID NO: 15951 - DNA, 121 bp, Artificial Sequence
  Synthesized
  misc_feature (61): n=a or c
tggcctcttcaaagcaggaagcatctttctgttagagactgttcatcttgccaagctattncttaccgtgacctataaataatactggtatgaaaatcctactagaaaaaccacacgaaaa

SEQ ID NO: 15952 - DNA, 121 bp, Artificial Sequence
  Synthesized
  misc_feature (61): n=t or c
ttctcagactttcactcactcaaaaatttcttattgtaatgaagattaggtcttaatgaangagtgatacattgaggtgtgctgtgttaactcttggttatgtgggctaactgccttcttg

SEQ ID NO: 15953 - DNA, 121 bp, Artificial Sequence
  Synthesized
  misc_feature (61): n=c or g
gctgcccatcttccccagcagggctctctaagtacttctgccagtaatcagcagcctcttnttttcggttcagtttccacaggacttgcacaaggtaagaggcagcagctgggtcatctac

SEQ ID NO: 15954 - DNA, 121 bp, Artificial Sequence
  Synthesized
  misc_feature (61): n=c or g
tttttctcctcttgtatttttcttcaaactgatagtaacaatgcaagactgaagacacaanccttgtgtggtttttatgcattttggtgtttgaaactgtatgaaatatgctttccagtgg

SEQ ID NO: 15955 - DNA, 121 bp, Artificial Sequence
  Synthesized
  misc_feature (61): n=a or g
tttcgccttagtcaaaggcaaatgtctactttcacctctaaactgaaatggaatagacttntgtttcaactacgctcacatctgaggcaaacatgaatgaaaagttagggctgttttgaag

SEQ ID NO: 15956 - DNA, 121 bp, Artificial Sequence
  Synthesized
  misc_feature (61): n=a or g
cagatctgatactttgcgtaatactatctcaaataaattaaatgacgtcttctttctatcncatttttttaccataagtctgtctaagctaagataaatattcagcagttggcctgatatt

SEQ ID NO: 15957 - DNA, 121 bp, Artificial Sequence
  Synthesized
  misc_feature (61): n=a or g
cattctgtgaggtgcaagctgtagaaagaaatttaaccttaacacaagccacagacatccngagagacaatactgttgagtccaaatccagtttgctaggcaaagtccatacatcatccct

SEQ ID NO: 15958 - DNA, 121 bp, Artificial Sequence
  Synthesized
  misc_feature (61): n=t or c
taaagggcttgccagtagggtctgtgaatgaaggagaagaccccaccaagtgggttgcagnctcatgtgcccctccacccccgacctgcatacagacgtcatgagtttgacatgtcccgtt

SEQ ID NO: 15959 - DNA, 121 bp, Artificial Sequence
  Synthesized
  misc_feature (61): n=a or c
tttcaccagcttaatctgccgcactggaaaacaacaaggagaggttggaggatctcacatnagcagctgagaaatagaatcactgaatgaatcatagaaaggtttgggttggaagggacct

SEQ ID NO: 15960 - DNA, 121 bp, Artificial Sequence
  Synthesized
  misc_feature (61): n=t or c
agtgctctgcccaaaaggataatacacgaacccactcactgctcactcaatttctgtgaanagcacctcagtttaacgctccatattcctccctttttggtaaacagtgaaaacacattta

SEQ ID NO: 15961 - DNA, 121 bp, Artificial Sequence
  Synthesized
  misc_feature (61): n=a or g
gcatttctaaggtctttatataaaacacttgtcaatggaagacattttaagtaaagttgcncaaaagtaacacctaatatagataatatggacaagcaatatttacaaagtaagcagtttg

SEQ ID NO: 15962 - DNA, 121 bp, Artificial Sequence
  Synthesized
  misc_feature (61): n=a or g
tagaaggccaactctggcttattacagtgctgtgtacatgggaatctctccacaaagcgtncactctctagagctaaatcactctaactatatacattttagacatgaatatttgtagaat

SEQ ID NO: 15963 - DNA, 121 bp, Artificial Sequence
  Synthesized
  misc_feature (61): n=a or c
cgtaggctgctcaacgtgagtagatactgctgaagcctgcatggttatagagtcacctgcntgatttttctgtcgggctttgttaaaattgttgtaagcatcagtcctcatatggcagagc

SEQ ID NO: 15964 - DNA, 121 bp, Artificial Sequence
  Synthesized
  misc_feature (61): n=t or g
acaaaaaatgctacaacaaaaggccaaacaaatatgcaaggaaaatgaaatacgatctttnttcagaattacattttataatttgttgtgagacagtaaagagcctggcactgaactacct

SEQ ID NO: 15965 - DNA, 121 bp, Artificial Sequence
  Synthesized
  misc_feature (61): n=a or g
aatagctcttgcactcactggctaatttcaaatatgtctttacagatcagcagaaatattnaactcaatgagaggagacagacttcttgtatttacagatggggctagaagtttcaggagg

SEQ ID NO: 15966 - DNA, 121 bp, Artificial Sequence
  Synthesized
  misc_feature (61): n=t or g
ataagtgctttacagcttgagcagttgcaagagagatgacaagtatgatgctgttgtgaanttataaattcagtaagttttcaatttcgactttttacagtgccattttaaactcatgagc

SEQ ID NO: 15967 - DNA, 121 bp, Artificial Sequence
  Synthesized
  misc_feature (61): n=t or c
atgacaaaagggccctgagataaagattctgtgtgacattgttaggctcttaatagcaganctgtaaaattcatgtctaagttatgcttgtaaagtctcttgaaacacttaaggagtaata

SEQ ID NO: 15968 - DNA, 121 bp, Artificial Sequence
  Synthesized
  misc_feature (61): n=a or g
gttttctagttccatccctagtagtccatctccataatctactgcaagcctcacttttccnctgtctttttaatgaccaaaaggcaaataatttgctcctgactagatctcaaagatgaag

SEQ ID NO: 15969 - DNA, 121 bp, Artificial Sequence
  Synthesized
  misc_feature (61): n=a or c
ttccttcgtatcttctaaaatgcctaatcaaaatcttcatagctcattgctaatcaccacntccattgtgttcatacattatttcattcctcctttctttggtcttttgtgcacttcctcc

SEQ ID NO: 15970 - DNA, 121 bp, Artificial Sequence
  Synthesized
  misc_feature (61): n=t or c
tggccacaggttcccagaccaccttcaaggcattcgtcaatatctgaaatgtggtttgaanagatcagggcaattcaactagaaacagcagtaacagacaaacagaaagaaaatccttcac

SEQ ID NO: 15971 - DNA, 121 bp, Artificial Sequence
  Synthesized
  misc_feature (61): n=a or c
atgcagagcactgacttgatctgagcatagcgcatggatttccattttcccagccatgctncatctctcctgtttataatttattttcccttatacatttatattctgcagctgcttgtaa

SEQ ID NO: 15972 - DNA, 121 bp, Artificial Sequence
  Synthesized
  misc_feature (61): n=t or g
cacaggtaggaagaggagcatgcttgcccatgcctcgtggactggtacaacagaaatttanaaggaccagttctgaaacatattctacaaagccaacatccacagacctcctccctccatt

SEQ ID NO: 15973 - DNA, 121 bp, Artificial Sequence
  Synthesized
  misc_feature (61): n=t or c
ctaagtggcgtaaatccacgcccagataattctctctttgcagagatgatgtgctgaatcnctttggtgaaacatacaggcaaccaagccgagggggaggaaaaggacagggcacacagcc

SEQ ID NO: 15974 - DNA, 121 bp, Artificial Sequence
  Synthesized
  misc_feature (61): n=a or g
tctgcctgaaatcttgggtgagttctgaattgcaattcacagccaaatgaggagttttgangaggaggtggctttacattaacagaaattatgggcacagtcttgagtgcgtcacttctgt

SEQ ID NO: 15975 - DNA, 121 bp, Artificial Sequence
  Synthesized
  misc_feature (61): n=a or g
tatggacttcgtacagatttgagcaaaaatgtgattcaattttaaatagagaagtatacantctacagaagagaactatgcagataagcttgaaattttcctctatgccatgcctctaagt

SEQ ID NO: 15976 - DNA, 121 bp, Artificial Sequence
  Synthesized
  misc_feature (61): n=a or g
ttaatagattatctcaattcaattcttgttcagatattaaaggtttccatttagacatacngacatgcgatgtgtgtgacatcagggtacggcaatttctgtactgagtggaaaaggcttt

SEQ ID NO: 15977 - DNA, 121 bp, Artificial Sequence
  Synthesized
  misc_feature (61): n=a or g
ttacattaattcccagctggcaaaagtagagaacattttacagatggttgcatttggggcnataaatctttgtagctggtggtcagatatgttcagcttgaccaggaatttatactgtgga

SEQ ID NO: 15978 - DNA, 121 bp, Artificial Sequence
  Synthesized
  misc_feature (61): n=a or g
gatatgaggtgatttaaaaattatgtccctttacagtggtgtagaaaagcagtgctcagtnttgaattaagatatgctggtattttacaacaggaaaggagcttttcaagccgttttcatg

SEQ ID NO: 15979 - DNA, 121 bp, Artificial Sequence
  Synthesized
  misc_feature (61): n=t or c
ttgctgctgctcttggctcctctaattcttagactctttttgctgcccaaccatactgtgnaacctatttgctatccagccataatttctgttatccagccataccatctctactgctata

SEQ ID NO: 15980 - DNA, 121 bp, Artificial Sequence
  Synthesized
  misc_feature (61): n=a or g
ctttctaactgttagtgcagagaaccgggctgccagaaagcacacttttctatgctagaancaccagatgaagatgggtacgccagagaagggaagaagggaagcgaggacagccactcac

SEQ ID NO: 15981 - DNA, 121 bp, Artificial Sequence
  Synthesized
  misc_feature (61): n=a or g
aagcctgtttgcagtcagtttatacatgcaagtgtgttttctagtcaaattctgtcacttncatgagtgaaggaacagaacactgtgtgtgtaccctgtgcattatcttttgaaggttagg

SEQ ID NO: 15982 - DNA, 121 bp, Artificial Sequence
  Synthesized
  misc_feature (61): n=t or c
caatttcaagattacagctggatcccatccgacccatactgagctcacgcaaagtctgtanccacctactaaatattaagctggcaaagcttgactcagactgtgattgaatgatgcagcc

SEQ ID NO: 15983 - DNA, 121 bp, Artificial Sequence
  Synthesized
  misc_feature (61): n=t or c
caagagacagcaactgtgagagaagccattaagctccatgcaaaaagaccttgttgcttanaggaaactttaaatagaaatcagttatttcatacaatttttgctaagtctgttaagtgag

SEQ ID NO: 15984 - DNA, 121 bp, Artificial Sequence
  Synthesized
  misc_feature (61): n=t or c
tgctaattgttttttccctctcccgtttctcgttgtaaaggctctttcgaggagggctgcngattgtgctcggagctctatgggaacacttagtctcttcctggttttgtttttagggcta

SEQ ID NO: 15985 - DNA, 121 bp, Artificial Sequence
  Synthesized
  misc_feature (61): n=t or c
cccccgtgccagaattcttgcagcacttcccagattgttgtcccacgtttcagcaggaagnatcccgtgttagcctgagcttttccccattccatgctctttcttcaagataagcttcttg

SEQ ID NO: 15986 - DNA, 121 bp, Artificial Sequence
  Synthesized
  misc_feature (61): n=a or c
caccatttccatggaatcattgactcactgaggttgggaaagaccaccaaggtcatcaagncaacccctgacccacccccaccgtgtccatagaatcaaaattgaagaagacgctccaaga

SEQ ID NO: 15987 - DNA, 121 bp, Artificial Sequence
  Synthesized
  misc_feature (61): n=a or g
tagcaggtgggtctgcaataacagaataaagatctggctgtcgtgaatgggattaaccacntcagcacaagctccacttgtttccactacgatctgctggtcattaagagtgaagacaact

SEQ ID NO: 15988 - DNA, 121 bp, Artificial Sequence
  Synthesized
  misc_feature (61): n=a or g
aagcgatatgttgacggagaagtcattttagtcaggcaaggtactcaagctaatgtatcantgctggcatgatagtttgtcaaatattatctacatttcctgaaggatttttgtacctgga

SEQ ID NO: 15989 - DNA, 121 bp, Artificial Sequence
  Synthesized
  misc_feature (61): n=t or c
gacatgctctttgcactaaagctatcctgagaatgaggaaatccggcagttaattcttcanacctcagagagctacaggggtgaaagcagcttgtttatatactccaaacccagtttgtac

SEQ ID NO: 15990 - DNA, 121 bp, Artificial Sequence
  Synthesized
  misc_feature (61): n=t or c
tactattgtgactgaaatgtaattctgtttgaatctggtttatatgacatttttatttgcnacctatgttgttacacaaacaacctttagacaaaagcttaatagggataaaccacagaat

SEQ ID NO: 15991 - DNA, 121 bp, Artificial Sequence
  Synthesized
  misc_feature (61): n=a or g
acaacaaaaaagccacaccaacccttaaaagctttggagttggcatttctcatggctgcantaatacttacaatatggactctagccgctttttatgtaactgctgctcttaatcagctca

SEQ ID NO: 15992 - DNA, 121 bp, Artificial Sequence
  Synthesized
  misc_feature (61): n=a or g
tatgacagacataacattgcttgaggcaaagtctcctggctctccatattgactgaatggnaggtcacaaagttatatgctacaaatgacatcttttttttatttttgtagtgtgtggtca

SEQ ID NO: 15993 - DNA, 121 bp, Artificial Sequence
  Synthesized
  misc_feature (61): n=a or t
tggtgtggagcatacatataagcatggaaaatgtgtatatattgtcaacactgctttcacncagtcttgagattctcccaactgtttgacaacgctgtccttccagaactgtaaaaaatgt

SEQ ID NO: 15994 - DNA, 121 bp, Artificial Sequence
  Synthesized
  misc_feature (61): n=a or g
catagacgttttgcttctttggcaagtgtgtgctttgttgctggaaactgaaaggcttgcnttcttcacacatcaggtctctgtagtcccatcagggtggaaatccagaaggagatttctg

SEQ ID NO: 15995 - DNA, 121 bp, Artificial Sequence
  Synthesized
  misc_feature (61): n=c or g
ctcacagtttgctcagaacacaggcaagacgtacgtgacttgtaccactacctgcacagtntctaaatagggcacattttgttcagggtgatggagccacacagcacagtgggagaagcag

SEQ ID NO: 15996 - DNA, 121 bp, Artificial Sequence
  Synthesized
  misc_feature (61): n=a or g
tggtgcccacgtgtgtttgagttgctgcagtggctggctggagcactacgacagccgctcnttcctgatgaacctagcaagccatgtgtcacacagagagaattctgaagcagagacataa

SEQ ID NO: 15997 - DNA, 121 bp, Artificial Sequence
  Synthesized
  misc_feature (61): n=a or g
ttgtcctttcctgaattccctctgccttgttgccaggcttagatgccacgtagaatacctntgtgaagcacgctactgttgtcttcttagctgtctcttgtttgtttctttttttcctcat

SEQ ID NO: 15998 - DNA, 121 bp, Artificial Sequence
  Synthesized
  misc_feature (61): n=a or g
acatattgtgtgtgcatacacattgcatactcagatacataggctggacaaaatacacccncacttgcatgcaggtgtagttacatcaacgcactcacaaatgcatgtgcaaacaatgtgt

SEQ ID NO: 15999 - DNA, 121 bp, Artificial Sequence
  Synthesized
  misc_feature (61): n=a or t
tggtattgttctaatgtaatttaggaatgccttctccttgttatagaatagtttatgatgnatccttctgttatgtctaccaaattcctagtatctgcagcttttttgttcagttcatctt

SEQ ID NO: 16000 - DNA, 121 bp, Artificial Sequence
  Synthesized
  misc_feature (61): n=t or c
gctccctctctcattcttgagacatatgcttctatgtttatttatccatttgttttgatcntttttggtcaaagagatattttcacatatacccaagtctgcctccattccaacacaccag

SEQ ID NO: 16001 - DNA, 121 bp, Artificial Sequence
  Synthesized
  misc_feature (61): n=t or c
gcgtgacaacatcttgctggaaatctgtaatcggcccaccttcctagatagggtttaatgngtcgtttgctctgggttattgacaaatagtggcaatttaatctgagcgttcaagttgtct

SEQ ID NO: 16002 - DNA, 121 bp, Artificial Sequence
  Synthesized
  misc_feature (61): n=t or c
aaaaagaattttccattgtgaacagttttctctagcttctgaccagacaagtagttgctgnattttctgtgacttctgactgttcctgctgtcattgtagatgctcaaagcaagcagcaat

SEQ ID NO: 16003 - DNA, 121 bp, Artificial Sequence
  Synthesized
  misc_feature (61): n=a or g
taaaatgtttaaaaattaaatactgactcaactcagtcacttaagtgacagtctttcaccnggcttgaacaaaagaacttgactgacttgtgaaattatcgttaaagaaggatttaatcat

SEQ ID NO: 16004 - DNA, 121 bp, Artificial Sequence
  Synthesized
  misc_feature (61): n=t or c
ggatactagtaaaatggagtcctaaaagctacagcacctactgtatttatatgaccagagngtgctacatctcttgatctggttttaggctgtatgtgagcacagcctccatctgtgcttg

SEQ ID NO: 16005 - DNA, 121 bp, Artificial Sequence
  Synthesized
  misc_feature (61): n=t or c
cttcagatccatccacaacttcctacagcacaacaactacagtgcttgtacctgggaccangtccgcctccaggctcgtgactgcttccgacacgtggacacactcatacaatggatgaaa

SEQ ID NO: 16006 - DNA, 121 bp, Artificial Sequence
  Synthesized
  misc_feature (61): n=t or g
cttcatgatgctcatcttccttggactagatagtcaggtatgaaataaacatacttcaaanattttgtcagagttccttgtatgtgtgtgtcatcatccttgctttgaacagcatttatcc

SEQ ID NO: 16007 - DNA, 121 bp, Artificial Sequence
  Synthesized
  misc_feature (61): n=a or g
agtttctgggtggatagtttatactggtcttcacatgctccctccaactggatatctgtanagcaacgtaaaacacttctatgctataatatttaacagtataatattaagagattctgat

SEQ ID NO: 16008 - DNA, 121 bp, Artificial Sequence
  Synthesized
  misc_feature (61): n=t or c
ctaaaggtctagttactaggtggcttctgtaacttaaacacaagggcctacataggtacanattgaattggattttaaaaggaaaattttcccaggttttttactgctgtaaactgtctgg

SEQ ID NO: 16009 - DNA, 121 bp, Artificial Sequence
  Synthesized
  misc_feature (61): n=a or g
tcctgaatcagacttgggcacatgattactcaattaagcaaagcctgcaaaacagcatgcntttcaggcttgtgtttgtgctggaatcagaggacagatagttcctaatctgaagtaatgc

SEQ ID NO: 16010 - DNA, 121 bp, Artificial Sequence
  Synthesized
  misc_feature (61): n=a or g
caccaacaccagaacagggttatgttttgttagattagtgcttcatctgaagaatgattcntcacctgctgatgtcagattcgttattgatgcaactgcaatgtggatttcttttcttctc

SEQ ID NO: 16011 - DNA, 121 bp, Artificial Sequence
  Synthesized
  misc_feature (61): n=t or c
tattccatgtcctcttcaaccacagagcagtaagaccctgatctcctggttttggatcagngagactacacttcatgggaaagcaagagagtggttttggaaaggggatccacacttaggc

SEQ ID NO: 16012 - DNA, 121 bp, Artificial Sequence
  Synthesized
  misc_feature (61): n=a or g
tatttgtatctatgaggatagtaggtgccatgctaaagctgattgctatggccctcaaccntgatgggcagcaccattacgcacataatgcagttcttgtgaaactgagggctagatcaac

SEQ ID NO: 16013 - DNA, 121 bp, Artificial Sequence
  Synthesized
  misc_feature (61): n=a or g
atattttcaaaaaatttaaatgatgtttttctcagaaaagttgcactcttgattcagaccnggaagaagccatctttgtttttgctttgggttcattcagacctcagattattcttgattt

SEQ ID NO: 16014 - DNA, 121 bp, Artificial Sequence
  Synthesized
  misc_feature (61): n=c or g
ctcagatctggccctgttgcctcgtgtcacttttccaagccttgttgcattccccaccttnagcacagcagctcacccagctgctcatgtgcacctgtgctgacccagggtggttgctact

SEQ ID NO: 16015 - DNA, 121 bp, Artificial Sequence
  Synthesized
  misc_feature (61): n=t or c
ggtgaatgagagaggaatgagctcccctttacaagataggtaaaactgtattgaacatganatattgcatgcaatgcaaagcagctatacaataaagcagaaatcaaaagcaattattctt

SEQ ID NO: 16016 - DNA, 121 bp, Artificial Sequence
  Synthesized
  misc_feature (61): n=t or c
gcctctaaaattggcgaggtaaatcatcccctgtgtgctttttacattactgagatgtatnggtaaatgtttgcaactgatggataggtatgggtagggaatggtggtcaaagccttttta

SEQ ID NO: 16017 - DNA, 121 bp, Artificial Sequence
  Synthesized
  misc_feature (61): n=a or g
acttgagcaattctgcaataagtcagtatctcatctctgtgtatgagatcatcttactggncaccgggtaactaatctgctttttggatgataaactaagagcagacatctggttcaacag

SEQ ID NO: 16018 - DNA, 121 bp, Artificial Sequence
  Synthesized
  misc_feature (61): n=c or g
gtttctattttaagttctattccaaggactgatgctcctggtaaatttactcactgagttncacttgtttccaaacactccacctcactgtcttggccttgttttcaagacagttgagcca

SEQ ID NO: 16019 - DNA, 121 bp, Artificial Sequence
  Synthesized
  misc_feature (61): n=c or g
acatataaagaaccaggacagtaggtcttggggctttggtatgtaatgcaccttatatttntatctaaaatccagagtacaaagcgcaggatcttattgttattgttattaaaattatttt

SEQ ID NO: 16020 - DNA, 121 bp, Artificial Sequence
  Synthesized
  misc_feature (61): n=t or c
ttatgcattttgaacttcctataatttaagtttcattttgaacactgctatggtttgaaanatagcacagataaatccatattcaccctgtaagagacacatgtttaagctatttaaatga

SEQ ID NO: 16021 - DNA, 121 bp, Artificial Sequence
  Synthesized
  misc_feature (61): n=t or c
cccatattttgaggttgtttttgtaagtctttactcaacagtgaattagaaaatgagtgtntacctgtaaaaatgtcacatttgtagctggcagtagggggcctgctcatcaggggggttg

SEQ ID NO: 16022 - DNA, 121 bp, Artificial Sequence
  Synthesized
  misc_feature (61): n=a or c
attgagggttattaggcaaaatgctcgagggagggagaaatagtagcttcatgttcacttnttaggaggcttagttcagccagtacaagccttcatgaattatgtggcatatatattgaat

SEQ ID NO: 16023 - DNA, 121 bp, Artificial Sequence
  Synthesized
  misc_feature (61): n=a or g
ggaagcatctcaagttttaaaaagccttttatttcttcacggctggttgtagtccagccancttgcttacctttggggttaagttcatcttgagattctgtagtggttagcagaggtggct

SEQ ID NO: 16024 - DNA, 121 bp, Artificial Sequence
  Synthesized
  misc_feature (61): n=a or g
ctggagctcgcattccattacattgttgctacagctccagacaggtggtatgtaggcagtngtggtaagctacttggtacctagaggacttacagtagcttttgcaagagctactagctat

SEQ ID NO: 16025 - DNA, 121 bp, Artificial Sequence
  Synthesized
  misc_feature (61): n=a or g
caaaattttcagaggattgaggcatgcttagttaattgtgctcagtttctctccggccctntgtcactgccttatactggcccttccccattcagctcgcatctcatcgaaatgcccaccc

SEQ ID NO: 16026 - DNA, 121 bp, Artificial Sequence
  Synthesized
  misc_feature (61): n=a or g
ctttaaactccaaaatgagtgtaatgggtggaaaactagtgtactgtttttcttgaaactnttctttatacataatttttattgctactacagatgctgtagtatttatatcactttttga

SEQ ID NO: 16027 - DNA, 121 bp, Artificial Sequence
  Synthesized
  misc_feature (61): n=t or g
gcagatgctgcttggccagcacacagttcccttcctgtttggtcctagtgccttgcagttnggtttcgaaagggcaccatcagatgctttagataggatccaaaaagctgtgagacccgaa

SEQ ID NO: 16028 - DNA, 121 bp, Artificial Sequence
  Synthesized
  misc_feature (61): n=a or g
ggattgtctgacctgcccatcttggcaagaaagatgtttcagtagggtctagtcctgtttnttttcagggactcatctgtgctctgcccattcccagtaaactctaaggcagagttcctcc

SEQ ID NO: 16029 - DNA, 121 bp, Artificial Sequence
  Synthesized
  misc_feature (61): n=t or c
cctgtagtcatatgccagtgggattcccagcgtgaaatccgccaaatccctgaggctccantgtcctcagcaaatatcgcattcccatttggtacccagcagggctaggttacgccagcgt

SEQ ID NO: 16030 - DNA, 121 bp, Artificial Sequence
  Synthesized
  misc_feature (61): n=a or g
acactcacacagaagagctggaattgaagagcacaggtgcatgaagaagcttgggacaggnaaatgtggcccttctgggaccacttctggccacctttacaagcagactaccatggtgtca

SEQ ID NO: 16031 - DNA, 121 bp, Artificial Sequence
  Synthesized
  misc_feature (61): n=t or c
ctttgaaatgcttctttcagactgctgcgatatatttgcaggagaaattttttagtaccanggcccatgcagtacctgctttaaaaatcagttcaacccactgaacaactgtcaaacacca

SEQ ID NO: 16032 - DNA, 121 bp, Artificial Sequence
  Synthesized
  misc_feature (61): n=t or g
agaaacagtattcattgactatattcatttccaaagtgaaagtctaggaggtggaaacttngtctgcatgtgagagatgagtgccttggaaaagaaagagacattcgggagaacaccaagc

SEQ ID NO: 16033 - DNA, 121 bp, Artificial Sequence
  Synthesized
  misc_feature (61): n=a or g
cacagattgcattgatggattaatgcaatattccgttgaatttaaactttttgcagacagnaactgcccaaacccttgagaagcagatttggtcttccccatgtgaacacagagcgtgcag

SEQ ID NO: 16034 - DNA, 121 bp, Artificial Sequence
  Synthesized
  misc_feature (61): n=a or g
cagatatttgagtacgtgggacaaacaagatagctctgtggtgaaaggccattgaaggagngagactgaaattaatgctctgaactgtatcaggagagatatcagctcttgtgtatatgag

SEQ ID NO: 16035 - DNA, 121 bp, Artificial Sequence
  Synthesized
  misc_feature (61): n=a or t
ttaaaaggaatttgcctactcagaaatcaggagttccaaccatagtgtaaattgctagttntaaattaggtattgagtgaaatagtaactggagtacaaatttcaaagaacaggattaaaa

SEQ ID NO: 16036 - DNA, 121 bp, Artificial Sequence
  Synthesized
  misc_feature (61): n=c or g
gggagcaatttacactgaaagactgaacggcagcaaggtgttgaagagcccattgcagggnataatcagatgaacatgtgctggagggaagcctctttctgctgcttccagccatgctttt

SEQ ID NO: 16037 - DNA, 121 bp, Artificial Sequence
  Synthesized
  misc_feature (61): n=t or c
ctgcactcatctcattctcaagagtgagggtccctcatcccttgcctaccttgacaccctnctccaaagccagcactgcacttccacccttacttgcagagcaagaggagttgcagctgct

SEQ ID NO: 16038 - DNA, 121 bp, Artificial Sequence
  Synthesized
  misc_feature (61): n=a or t
tcagtgatgcataacactgtcgtctgcatcaaggtgctaaatactcttcagaatttatacntctgttatttcactgaacccctgcagcagtcacagctccaggagaggcaccagaatctga

SEQ ID NO: 16039 - DNA, 121 bp, Artificial Sequence
  Synthesized
  misc_feature (61): n=t or c
aatcaggtacctggacttgtccagccctatttctttccctggggcagcagggggaaaaaanacaagaaaagtggagatttacaggtatagatggctttgggacagctgcttcttggtgctc

SEQ ID NO: 16040 - DNA, 121 bp, Artificial Sequence
  Synthesized
  misc_feature (61): n=t or c
ctcagctgcggttacactctgagcatcgtgctgccttcactgcaacaagggctccagcaangctggtgtgcagcagtgcccttggggaggctctgaccgccctcctcagctgcaggctggt

SEQ ID NO: 16041 - DNA, 121 bp, Artificial Sequence
  Synthesized
  misc_feature (61): n=a or g
cacacaacacagcgctgttccttcccagccacggcacagtgccagcaaagctgggatggtncaggaggcacaaacaagcacacatcatcagcatttatcagcacttttactacaaacaggt

SEQ ID NO: 16042 - DNA, 121 bp, Artificial Sequence
  Synthesized
  misc_feature (61): n=t or c
atctgactctaacgtcatgtattcttgtaagaaaacctggggtacagaactatgaaatcangactgattacggggaaaagggatgtaggatcttgcaggaagaaatacctttgttattctt

SEQ ID NO: 16043 - DNA, 121 bp, Artificial Sequence
  Synthesized
  misc_feature (61): n=t or c
tctagccacatgcagcacatccagctaatggtctgagctcacgatggacgcagggaccagncctctgccagccacatcctcaaaggaacgctttcccaataaagaaggtttcattcatgat

SEQ ID NO: 16044 - DNA, 121 bp, Artificial Sequence
  Synthesized
  misc_feature (61): n=t or c
cttttgtttcaagtccagttttatacactctggtttgaaggctacaccattctattttaanactatggagaggctgaaatggaacacatttaccttgatttctttgcagagaatgctttcc

SEQ ID NO: 16045 - DNA, 121 bp, Artificial Sequence
  Synthesized
  misc_feature (61): n=a or t
cttctctagtgttcaagtccttccactcattaaatcatttaaaatccacttctccaaaatnctgtgggactaatatgacattctgtgtctcttctagtaatgacagagatagaaagaagaa

SEQ ID NO: 16046 - DNA, 121 bp, Artificial Sequence
  Synthesized
  misc_feature (61): n=a or g
cgagcctttagctcacaggcaataatacttcattttaaccactgaaaatcttatctgttgngaaacaatgttatgtacaaactcagttatgaaaacactgatgcattcttcacaagtgtgc

SEQ ID NO: 16047 - DNA, 121 bp, Artificial Sequence
  Synthesized
  misc_feature (61): n=t or c
caaaaactgaatttctttccctcagtgccccatgatgctatctgggcatcatgggtaggtnctatgcactgcatttcagtggttttcctactaagcaacactgctcatgtccatagttgtg

SEQ ID NO: 16048 - DNA, 121 bp, Artificial Sequence
  Synthesized
  misc_feature (61): n=t or c
tacgttagaaccacatgagctgtgtatagttatggcagtcttaacagctctgtctaaaacntgaaaagcctgccctgaagttgtaggtggcataccagggttttgcattcagtaccatttt

SEQ ID NO: 16049 - DNA, 121 bp, Artificial Sequence
  Synthesized
  misc_feature (61): n=a or g
ttcatctgtacaaggccgtactgcggcactgctcacaaatgcgacgaaccctgaagagaancctgttatttcactgcagcattcctaaagcaccttgttcctaactcccccctttgagaag

SEQ ID NO: 16050 - DNA, 121 bp, Artificial Sequence
  Synthesized
  misc_feature (61): n=t or c
aagctgaacagaaatcagttgtgagtgatagacaatgaaaaacaaagctgaagcttgaggnatggggggtgtttaaaattaagcatattaaaaataaatgtcaatgttgataacaaattat

SEQ ID NO: 16051 - DNA, 121 bp, Artificial Sequence
  Synthesized
  misc_feature (61): n=a or g
gatcatgtttgtggccctcctctgaacccactccaaccttctttactgtgaggtcagcaantctcctcactgaaagcttcagggatcccaaacaaaggctaccacctctgtgcatccttct

SEQ ID NO: 16052 - DNA, 121 bp, Artificial Sequence
  Synthesized
  misc_feature (61): n=a or g
ttggcttttttcaagtgtatgactttggacaaacagttaatttcagtcactgtgctgctcngtgcttgagcatcacaaattgattctctatctgtttgcaatcaccgttgaatttgattat

SEQ ID NO: 16053 - DNA, 121 bp, Artificial Sequence
  Synthesized
  misc_feature (61): n=a or g
atccatgggaatgttttacaatttctctggagctcttagatatcacttgacttgcaatggnaataaggaaggtatagagacactacagttttgtttcaaacactataaaagcagaggaaaa

SEQ ID NO: 16054 - DNA, 121 bp, Artificial Sequence
  Synthesized
  misc_feature (61): n=t or c
tcttcaggctctttttagactgtgttctggttgctgtcttgtctttgtaggataattaganctcattatatgagacatgttgtatgagtgcttctccagaagtaatgcctcctaggtttac

SEQ ID NO: 16055 - DNA, 121 bp, Artificial Sequence
  Synthesized
  misc_feature (61): n=a or g
ttgtttaaatggtgaagctttaaaaatgcaagtcagttctgcgttctgctaccacataacncactgtacaaatgggagaagcaatgtgactggaaattgcagacaaattcagtatttcccc

SEQ ID NO: 16056 - DNA, 121 bp, Artificial Sequence
  Synthesized
  misc_feature (61): n=a or c
tctgaaagtcttgaatcctgcttatgtgaaattcaggaccttttcaaccatttgtcgccangctgattcccagccatcctgttctcattcttcatttctttcccggtcttcgttaagtggg

SEQ ID NO: 16057 - DNA, 121 bp, Artificial Sequence
  Synthesized
  misc_feature (61): n=a or g
atcttactctcttcaatcctttttaaagaaatgattgttattcacaggttactctgcacanaaataaggaacaaaattttcttatcatgctattgatcttttggatttgaagaactacatg

SEQ ID NO: 16058 - DNA, 121 bp, Artificial Sequence
  Synthesized
  misc_feature (61): n=t or c
tctatttgtgcactatgttttcatttgcgtcggtcttccttgcctgcagtgatagaacagngtctattgctttgaaaaacattagcagcttgtcagttgtatgttattttgtatttgattg

SEQ ID NO: 16059 - DNA, 121 bp, Artificial Sequence
  Synthesized
  misc_feature (61): n=a or g
caataaagaactgctggaattaaataatcattcttcatttgagtgaaaatcagggaaatancatactataaaaagaactatgttcaccatactttctaggctttgaaaccctaaaaagaga

SEQ ID NO: 16060 - DNA, 121 bp, Artificial Sequence
  Synthesized
  misc_feature (61): n=a or g
ctgaaataaatgctataaaaagttttacatcctgtgaaattttctacattttcaaacactncatttctgcaaacaccaatcacaaccaaaaagaggaaataaaaagttttctgtagtgttc

SEQ ID NO: 16061 - DNA, 121 bp, Artificial Sequence
  Synthesized
  misc_feature (61): n=t or c
taatgctggtgttagaaaaagtggagtgcttcctcaagtgacagtatagctcactctatgngtaaaatcattcttacttgtcaattctctgactagagcagaaatgaatgatccttgccta

SEQ ID NO: 16062 - DNA, 121 bp, Artificial Sequence
  Synthesized
  misc_feature (61): n=a or g
ctttcttttcctttgctatatttagcttttttttattttcccagaagctaagaaaggtggntttttgctctcgctcccatagacttgcagtcagaatttgctgccatagcagtttgctttg

SEQ ID NO: 16063 - DNA, 121 bp, Artificial Sequence
  Synthesized
  misc_feature (61): n=t or g
tcaaactgtcgtgtttcacttaaagtccaagtacataacactgacacatccttctagcttnatctttgtacaacacatcagtatcaaactgctcttagcagcatgaaggactgtttgtaag

SEQ ID NO: 16064 - DNA, 121 bp, Artificial Sequence
  Synthesized
  misc_feature (61): n=t or c
gcgtgtgctaaaccctgacagctgaagggaacctcctccaataactggaggcagctcaagnctctgaccaaccacatgctagctaatcacaaatgacagcagaagtttatttactacagag

SEQ ID NO: 16065 - DNA, 121 bp, Artificial Sequence
  Synthesized
  misc_feature (61): n=t or c
atctaaaaaattccaggaagaactgggtccagtggtgcaggatagcttccaaaactctctncacagtcacgttagctactgaaattaagctaaaatctaccagttttccatctatgctgac

SEQ ID NO: 16066 - DNA, 121 bp, Artificial Sequence
  Synthesized
  misc_feature (61): n=a or c
ggcagccccactggccgtggctgtgacagcagggaggagagcatttctgcactgctcaganacagaacagggaaaaatccagaagtgcccacggccaggagtggctccagagcggggcctc

SEQ ID NO: 16067 - DNA, 121 bp, Artificial Sequence
  Synthesized
  misc_feature (61): n=t or c
ttgcttccagaggttaagggtgagactttgtcaggtgaacacatctgatttgccagacctnaacttctgcccaccacatttggtagaaggacagagaaattcagcacacgatgtgattcac

SEQ ID NO: 16068 - DNA, 121 bp, Artificial Sequence
  Synthesized
  misc_feature (61): n=a or g
tgctgaaaaaatccatcctactgggagaggttgagaccatattctgttagcttacaccacntgctgagtagcagtcctgagggatctgtttcggtggagtcatttagggccatgaggagca

SEQ ID NO: 16069 - DNA, 121 bp, Artificial Sequence
  Synthesized
  misc_feature (61): n=a or g
caattacttgcaattcaggcccattccctctccttgacatttcaagaggattgccttgtangataaaagcttgggcactttgtgttttgcttgtactccatctgaacctgcactcttggga

SEQ ID NO: 16070 - DNA, 121 bp, Artificial Sequence
  Synthesized
  misc_feature (61): n=a or t
atcacaagcatccacgtctcttagtctctgtaactgcctatgtcttgttaccccagcactnttatctctccagcagaagtacagctgcatttgttggaataaaagcttctttgggttcttc

SEQ ID NO: 16071 - DNA, 121 bp, Artificial Sequence
  Synthesized
  misc_feature (61): n=t or c
tgaagccctgctttctccgtcattacggacgcaaagcgtggctgtgcgagctgagtagcgngaatcacagcgtggcactgcacacagcaggtcggggagcacctacttcccctgctgccat

SEQ ID NO: 16072 - DNA, 121 bp, Artificial Sequence
  Synthesized
  misc_feature (61): n=a or c
tctgtactgataatgtcctggctcattgcccaacaggtaatgaaatcactttacagacatnaaaaaaatacgttagactattttaacagcagtggtcgcaggtagttttatttagcattca

SEQ ID NO: 16073 - DNA, 121 bp, Artificial Sequence
  Synthesized
  misc_feature (61): n=a or g
aagcagcaaagtttgtgtcagtgctttgtgttttctgttctaatgcacacactgttatgancagaaagctactatatttatggggtttccgagattgtgaaaatatatgaaatgtattcct

SEQ ID NO: 16074 - DNA, 121 bp, Artificial Sequence
  Synthesized
  misc_feature (61): n=a or g
gctacattacttctgtcagactcagagtagagaatatcagcatgtctgaagttttatgaanttatcaacaataccatcagggatccaccagcttgtactaaggatctgggtcaaaatatct

SEQ ID NO: 16075 - DNA, 121 bp, Artificial Sequence
  Synthesized
  misc_feature (61): n=t or c
agcccccaatgaaattttatttttatcttctcactctggatttagttattcacaacttcanaattctccagagactaacaaagcacattaaggaattctgcctcaaatcagtcaggagatt

SEQ ID NO: 16076 - DNA, 121 bp, Artificial Sequence
  Synthesized
  misc_feature (61): n=a or g
aggtctactaccagatctacatgtggccacgtgactcttgtccatatctggtgagctgacngtaacttggagcagtgtgccggacattttgcaaacctcttagcccatcatctccacagct

SEQ ID NO: 16077 - DNA, 121 bp, Artificial Sequence
  Synthesized
  misc_feature (61): n=t or c
tcagtgtaccatagaaagataacacgctttgattatgttcataccaaacacctcagcttantgattacggcagtgaacacaatgttactttttaaactgctttgtgcagttcacacaaaca

SEQ ID NO: 16078 - DNA, 121 bp, Artificial Sequence
  Synthesized
  misc_feature (61): n=a or t
tgttctggtaataattgcatgttaaaataagaatgaagtgtcagacaatcacaggaggagntgcagccgcgttatgttactgctgagggttgggctgtgttacaggaagtgggacactgga

SEQ ID NO: 16079 - DNA, 121 bp, Artificial Sequence
  Synthesized
  misc_feature (61): n=a or c
caaggaagcacgtgggctgccggcaatggatgaacagtcaatgacttctgatccctacatnaaaatgacaattcttcccgagaaaaagcacaaggtgaaaaccagagtgctgaggaaaacc

SEQ ID NO: 16080 - DNA, 121 bp, Artificial Sequence
  Synthesized
  misc_feature (61): n=a or g
tgccttatttgggcatacaggtaaaatcacacaggattatctgtttgaggccatttctgcncccaaacttgttgaagctaaatatcaatgagacatttacatgtttctgacagcctccatg

SEQ ID NO: 16081 - DNA, 121 bp, Artificial Sequence
  Synthesized
  misc_feature (61): n=a or g
ggacagcaaacacagagagtcagctcaccccgtttgcactgctgtggtttgtacccacagnttgggttctcaccgtgtaaatttggctgctcctttgggatgaaaagttctcacctgggtg

SEQ ID NO: 16082 - DNA, 121 bp, Artificial Sequence
  Synthesized
  misc_feature (61): n=a or g
ctaaagctgcatttcccctggcactaatgatatcttagattgcaagaacatgctctcaganctttcttgagagcaaaaatttctccagattttttcaattcgctcatctttttcttagagg

SEQ ID NO: 16083 - DNA, 121 bp, Artificial Sequence
  Synthesized
  misc_feature (61): n=t or c
ctcttttgtaatctttcagaaaggtggttagcagatatcagccatttaaaacaacgtaagngtcagcaccaggcaagggttgtaactaattaacgagagaagcacccccaaccacatactg

SEQ ID NO: 16084 - DNA, 121 bp, Artificial Sequence
  Synthesized
  misc_feature (61): n=t or g
aaatgttggttcgttaagaatgcacgggcataattaccgattgctcatttctacatttaangggtcgactttaaaaatcggaagtgaatttacatgcattttgtcttctggtctgtaaata

SEQ ID NO: 16085 - DNA, 121 bp, Artificial Sequence
  Synthesized
  misc_feature (61): n=t or c
aacagtttcacggctgtgaataatcagttgtgtagtaatgtaacagtctattaatattagnagcttcatgattggttaattggagaacagattttatctgttagttggattactgattttg

SEQ ID NO: 16086 - DNA, 121 bp, Artificial Sequence
  Synthesized
  misc_feature (61): n=a or c
tggtctgccaaacacttttgtattctcttcacatcgcctcagaccttcttcatttatgganagaacctgcacaagaaaacagtctgtcttgagaagacagcctaacactcagtaggaagga

SEQ ID NO: 16087 - DNA, 121 bp, Artificial Sequence
  Synthesized
  misc_feature (61): n=a or g
tgattccaggaaagcttcccacttagcactgtagcaatgctgctgtagatattttggtccntgcatattctgaaaaagaacaaggaagagaaaaatgaggacaaatgggaagtgagcaatc

SEQ ID NO: 16088 - DNA, 121 bp, Artificial Sequence
  Synthesized
  misc_feature (61): n=t or g
tgctggaaagcaggtactgaggtacacctggacatgctgacaccatcgatgccctgtgggnaggtattgcacgtcgacttcagcactttctgcagccttaacagcaatggtggtctcagca

SEQ ID NO: 16089 - DNA, 121 bp, Artificial Sequence
  Synthesized
  misc_feature (61): n=t or c
gaagtgtccaggacatagcacagcatctagaatatcactgaatgtacttatgtttggaccncaaaacctgccttgagatgagattcagttcatctaaatcttgtaccaggtaagggtggga

SEQ ID NO: 16090 - DNA, 121 bp, Artificial Sequence
  Synthesized
  misc_feature (61): n=t or g
ctcccacagtaagtcatggaacatttcctaggattgctaaatgatgatgtcaggggtagcngaggcagccaaatatctcgaatgagacgttcaaaacttgtagcgtcaagcctcttccttt

SEQ ID NO: 16091 - DNA, 121 bp, Artificial Sequence
  Synthesized
  misc_feature (61): n=a or c
caccgtgtgattttactgcctgatttcaaagtctctcatgtgcctacacatcgaagaacancgtcagatgtgtttgctcaggtcctgctggtctcctggcagcagcactcctctgtttcat

SEQ ID NO: 16092 - DNA, 121 bp, Artificial Sequence
  Synthesized
  misc_feature (61): n=a or c
atgttcctcacggtgagataaaagtaatctgagggagagatctgagaccggtgcgactttnggagatccgtgatacgctcaaggttagaaattccaggggaacaaaaagatccataagcca

SEQ ID NO: 16093 - DNA, 121 bp, Artificial Sequence
  Synthesized
  misc_feature (61): n=t or c
ttcacctaatgttgaaactgattttttaatgtacttttataaatttgatttgttagttcantgaaatcaggaatgctcaggtatttggtgggtagttaactctgttgtgacatgagtcaga

SEQ ID NO: 16094 - DNA, 121 bp, Artificial Sequence
  Synthesized
  misc_feature (61): n=a or g
gcaaacatcacaaggaaagacttcacaatgcataaactaatatatgaagttctgaccctcnttacttattcttgtaattccacccaacattcctcagtgcatggctgcctggaacttggtc

SEQ ID NO: 16095 - DNA, 121 bp, Artificial Sequence
  Synthesized
  misc_feature (61): n=c or g
tattccattgcatttggtcaactaagtcagataggtcagtttcaactgaagggcacagagntgtgtaaatgttcatactgactcctctaagtgttgagcatgcaagttcagattactttca

SEQ ID NO: 16096 - DNA, 121 bp, Artificial Sequence
  Synthesized
  misc_feature (61): n=a or g
ccaaactatggataactgttccatcagaaaaaaacacatatcacatcactttcattagganttccacctaactgtacgtgtttcccgtctgtcagatttaactaatgaacacaagatatat

SEQ ID NO: 16097 - DNA, 121 bp, Artificial Sequence
  Synthesized
  misc_feature (61): n=t or g
atttaaaacctttcaagcttccacctttgagctctcctttgcaacagtgaggggcaaacanatactccttttcacagtgaaagatgatcatcttttctaagccacctgacacgaagagctg

SEQ ID NO: 16098 - DNA, 121 bp, Artificial Sequence
  Synthesized
  misc_feature (61): n=t or c
tcgccctgagttaaggtgaataaagctcaggcttttcccataaagccttttcccaaggaanaaagcttttcccaaaaagccttcctcctgcatggctgctgtcactgttttaaataacaat

SEQ ID NO: 16099 - DNA, 121 bp, Artificial Sequence
  Synthesized
  misc_feature (61): n=t or c
ggcccacaaattgccagaactacactcagcttccctttgtatgtacatcaccgccccagancttgtgtcatgctgggaaacatgtatgcacaccttgctgaagtagcctctgagcttatta

SEQ ID NO: 16100 - DNA, 121 bp, Artificial Sequence
  Synthesized
  misc_feature (61): n=c or g
ggaaatacaaattaaaatagctttgttttctgcatcagtaaaaatgattttctgttacaanctatttaattgtggctcttttctctgacattgtaacaggctgcttattgttccagtccaa

SEQ ID NO: 16101 - DNA, 121 bp, Artificial Sequence
  Synthesized
  misc_feature (61): n=t or c
ttttttaaacaaatgcagcaacatttatcttcccaaaagccataaatgacacacagtctanctgacatacagccctgatttcagtaagctgcgtttaaggacaaagcatgtaaagctcacc

SEQ ID NO: 16102 - DNA, 121 bp, Artificial Sequence
  Synthesized
  misc_feature (61): n=a or g
aggttccaagaaatgctgcatctttgcagaggtatgggtgtgtgtgggatgagctgcacgntattagtagcaagtctcaaaacagaaatgaaggcaggaagtagttaacttactgaggcag

SEQ ID NO: 16103 - DNA, 121 bp, Artificial Sequence
  Synthesized
  misc_feature (61): n=a or g
ccgagggcagaaaggttgccttgttcaaggtgggcaaaaagttaaacttcttcgccttcanactgaaatgggagatcatttactattgctttttgcacacgtttggtcttctttcagcaaa

SEQ ID NO: 16104 - DNA, 121 bp, Artificial Sequence
  Synthesized
  misc_feature (61): n=t or c
aatagcagagcagaagatactcatctgacattactttttgtccagcaccccatggcaatanctgaaggtatcactccactcccccctcagaaaggcaagcttcctgtggagaagcaccatt

SEQ ID NO: 16105 - DNA, 121 bp, Artificial Sequence
  Synthesized
  misc_feature (61): n=t or g
tgaatgtgcagggcatgattgtccctgaccttgaaggggattcatctgttgggactctgangcatcagcacttgcaggcatttgcagctgacctgtgcccatgtatgctgacttcagctgt

SEQ ID NO: 16106 - DNA, 121 bp, Artificial Sequence
  Synthesized
  misc_feature (61): n=a or g
gtggggctgggacagatgctggtgtccagaaggaccgcagaggaagagccatcccaccacncagggtagagacaagcactctttgccgctgtgttcttctcacccttaagccactccatcc

SEQ ID NO: 16107 - DNA, 121 bp, Artificial Sequence
  Synthesized
  misc_feature (61): n=a or g
cctgtgctcagtatcccctagtaactttgactgtccttcttatcagatgtcctcttctacntcttttcattttccaaccatgacacaggatatagttactttttcctataaaaatattaac

SEQ ID NO: 16108 - DNA, 121 bp, Artificial Sequence
  Synthesized
  misc_feature (61): n=t or c
cttcattgctggggagtcatacaagtcgagatacaagaataagagagtcacacaaaccaantgctttaccttaagtttgtatttctcaaggttttgcttttgtaactggctaattgcttgg

SEQ ID NO: 16109 - DNA, 121 bp, Artificial Sequence
  Synthesized
  misc_feature (61): n=t or c
tagcacacacccgaaatgctctgcaggcagaggacaggcggcataaggcagcagacaggcnggaaattcagagggacagctatgctacccgaatcctttctgctgtaacagtgacatggcg

SEQ ID NO: 16110 - DNA, 121 bp, Artificial Sequence
  Synthesized
  misc_feature (61): n=t or c
gcagcttgcaggtttgtactgcagatgtcaccaaaatacattgctccatttgttcagcagngccacctaatagcaaggggcacttcagacagcacatcctccttttagggcactggcagca

SEQ ID NO: 16111 - DNA, 121 bp, Artificial Sequence
  Synthesized
  misc_feature (61): n=t or c
aagcagtggagaagtgtacctcctctgtattttcctcaaaatcgctgcagcctccatcttnaccaattactgtcaatccagctgtgtcctctccatctccttgtattcctttacctcttct

SEQ ID NO: 16112 - DNA, 121 bp, Artificial Sequence
  Synthesized
  misc_feature (61): n=c or g
tttaaaattttcaggtatgacaaagtgcttgaaatcttgagagaagacaggtctccctgtnggaagtgggattacctataacaaaaacatgaagactgacatattttcccagtgctatcag

SEQ ID NO: 16113 - DNA, 121 bp, Artificial Sequence
  Synthesized
  misc_feature (61): n=a or c
ataggaaccaagatgcagtcagcagacacatctcgtgatgaaaaactggaagatgcaatgnatccctgtcatgagctgctgatgatctgcagtaattatcaagctactgagacgcttccta

SEQ ID NO: 16114 - DNA, 121 bp, Artificial Sequence
  Synthesized
  misc_feature (61): n=a or g
gcacgtggtggggaggcaccacatgtgtcagtgtggctcatatctgttaggcacctccctngaactttcagcttaccaactgtgagaaacccaaacagctttgcatcagtgaaagctgatt

SEQ ID NO: 16115 - DNA, 121 bp, Artificial Sequence
  Synthesized
  misc_feature (61): n=a or g
cttgtagagggggaacatttttatactgcaaatctgtgcaatttctgactaccttcacacnaactgaacagctcccatggtgtgacacatgactgtgtctcactggtgttcaagcacaagc

SEQ ID NO: 16116 - DNA, 121 bp, Artificial Sequence
  Synthesized
  misc_feature (61): n=a or g
agataacataacaatgacattgcttaaaaatatcatcttcctatcccacaggatatattangtttagccatccaaatgtttccttaaacagaaatctgatggaccatgcttagatacagct

SEQ ID NO: 16117 - DNA, 121 bp, Artificial Sequence
  Synthesized
  misc_feature (61): n=t or g
aagaaaaaaaagataataacatccaacctttagtaattccatgctgaggtgagtaactttngagagttactgtacattgttacatacctgctgttttacagttcagagctgtcgatatttt

SEQ ID NO: 16118 - DNA, 121 bp, Artificial Sequence
  Synthesized
  misc_feature (61): n=t or c
aaagcagattcacatggaagtgggtgccaggtgctcagcaatgagagctgaaagttgtttncatcagcagagctgacttcaagtttttgagtgcctgagcatctctgacaaggaaagagta

SEQ ID NO: 16119 - DNA, 121 bp, Artificial Sequence
  Synthesized
  misc_feature (61): n=t or c
tcagagaaggaaattctggctagtaaatctttagagacaaccgtggtggtaagaagttgcnctgtgttgcaacatgtttatagtgcatgaatattgaagacggtgagaagtatgttagcac

SEQ ID NO: 16120 - DNA, 121 bp, Artificial Sequence
  Synthesized
  misc_feature (61): n=t or c
acagcaatgaaattcttgtttcccatagttcaagacgaggttagagttctggaatgtttcntccaaacaatttctcatgctaaatattttcacttccagctataaaatcatatgatcctaa

SEQ ID NO: 16121 - DNA, 121 bp, Artificial Sequence
  Synthesized
  misc_feature (61): n=a or c
agcaacagaattgctcatctggcaaagtgagttgcagttagatttttatttatggcagcanaagaaaagtttgtcacgtgaatgtgtcctgaggcacagcaacccatgggaggggagaggg

SEQ ID NO: 16122 - DNA, 121 bp, Artificial Sequence
  Synthesized
  misc_feature (61): n=c or g
taacagagttttcatgcagcttgttttggaagagttagatttactctaccaccagacaccntccccccacacactacaaaaaaattgtactgacttcccttatcattgatgttttgagtct

SEQ ID NO: 16123 - DNA, 121 bp, Artificial Sequence
  Synthesized
  misc_feature (61): n=a or t
tgtgcagtgcaattccaatctgccttttctaggccatgaaaatagataagctctggaaatnagcaaccccttcctgtaacttctagttgccttagctgatttgcatgacctgctatggtgg

SEQ ID NO: 16124 - DNA, 121 bp, Artificial Sequence
  Synthesized
  misc_feature (61): n=c or g
ttctccaataataacaataataataataaggatcaggctaggtatttccacagggctattntgtttttcctttacgccttcccaaaccagaggccaagtacattaaaaccagtatgttttc

SEQ ID NO: 16125 - DNA, 121 bp, Artificial Sequence
  Synthesized
  misc_feature (61): n=a or g
ctcctcatgctgaaggactattttaggaggaggaggagggtggaaggaagggaggtacacngtgaagggaagggtctttgtcttgcaatcaatcagccatcttcctgttagcaacaagttc

SEQ ID NO: 16126 - DNA, 121 bp, Artificial Sequence
  Synthesized
  misc_feature (61): n=t or c
taggaatggggggttgcgtagtcgcctgcatccaggaataagagagagggattgtcccttncagggacagctctaaacctgatacattatgtgtattaaatatccttttaactctaatttc

SEQ ID NO: 16127 - DNA, 121 bp, Artificial Sequence
  Synthesized
  misc_feature (61): n=t or c
taatgaaagacttcttgtatggattacagaagaatatttatgacactagctaagagtctgngacaacttttgtggtaacttcccatttaaagttacatgtgattatatggcataacattaa

SEQ ID NO: 16128 - DNA, 121 bp, Artificial Sequence
  Synthesized
  misc_feature (61): n=t or c
ccactggcaggggccttctaaacagatttctctcttaatctcttgtttgcaaggactcacncttcagtaactcctgctagatcttcatttccagttttggtaacctagttcaagttcccat

SEQ ID NO: 16129 - DNA, 121 bp, Artificial Sequence
  Synthesized
  misc_feature (61): n=a or g
aagaaggatttagatttgcagttgtgaaagttaaacatttgttaaactcactttctctgtnacgaaaattaagacaggttgccgactttccagaaatgcttcactccacctaaaaacagaa

SEQ ID NO: 16130 - DNA, 121 bp, Artificial Sequence
  Synthesized
  misc_feature (61): n=t or c
gcagacccgtgagggaagggcctgtctgcagctctgctgctgctgatgttcataacccacntcactggcatttttgtgtggctggtaaccagagtgcttattcctgctatggcatcagggg

SEQ ID NO: 16131 - DNA, 121 bp, Artificial Sequence
  Synthesized
  misc_feature (61): n=a or g
aaatggaactgaaagtttttttcttaaaaaagaaaaaagagcaagcacaagaatataatanctaaagctctctatgttcttctcagtttactgtctcttttcaagcattttctgcagtttt

SEQ ID NO: 16132 - DNA, 121 bp, Artificial Sequence
  Synthesized
  misc_feature (61): n=a or g
gggtacagccatgatgtctaacacttaggcagggctgactttccatttgagacacactgcnggagttgttccaaagggaggatggagaagaaggaccaaacagatcattgaatggtactgt

SEQ ID NO: 16133 - DNA, 121 bp, Artificial Sequence
  Synthesized
  misc_feature (61): n=t or c
caataaaaaatttctgatcttgtcttccccttggatgaaaatattgatgatcagtcaatgnatgtcactctggaaaaaatcacatccttttattaatttttttttcttctgatgtttctgt

SEQ ID NO: 16134 - DNA, 121 bp, Artificial Sequence
  Synthesized
  misc_feature (61): n=a or g
ctcaaaatttcaatgcaaaagtactcactgacctcaacatagtccacatctttgttatctnagtgtagactgagcagtcatctgtcacaatgttcatgtattattctccgtttgcacaatg

SEQ ID NO: 16135 - DNA, 121 bp, Artificial Sequence
  Synthesized
  misc_feature (61): n=c or g
gcataaagggcagtggttttttttaagacagtgtagtgtcaaatttacttcatttcaaaantgggctcagcaaaggtgctgtgaatcttccttgataatttctaggactaccacttgaggt

SEQ ID NO: 16136 - DNA, 121 bp, Artificial Sequence
  Synthesized
  misc_feature (61): n=t or c
taaatactgctgctgctgctgctgctgctgctgctgctgctagtagtagtaagaataatangattaataataaggttagccatgttccagttaaactcgtcatctctgtcaacaacagcta

SEQ ID NO: 16137 - DNA, 121 bp, Artificial Sequence
  Synthesized
  misc_feature (61): n=a or g
tttcaaagtaatacacaagtgtaatgtgtggaaatagcatgtaaatctgcatgtgaaggtnctggaagtagaatttgcacggtggcgaggaagtaagcaacactgtatgtgtgacaaactc

SEQ ID NO: 16138 - DNA, 121 bp, Artificial Sequence
  Synthesized
  misc_feature (61): n=c or g
aaacaaaccaatgaggaagaccttatcttttgcaataatgttgtgggggggaacaaaacancacacacaagctctacaggtcctgcatttaaacagcagaagtgtcagagaaatcacttta

SEQ ID NO: 16139 - DNA, 121 bp, Artificial Sequence
  Synthesized
  misc_feature (61): n=t or c
gagccattgtctactcagattttgccgacatttaaaataatccactgaggttagtagagangatgtagaccaactcaagtattagatccagcgttttctgcatagtattaacatttatatc

SEQ ID NO: 16140 - DNA, 121 bp, Artificial Sequence
  Synthesized
  misc_feature (61): n=t or c
actcatgccaggttaagaataaaagcacaagtagaaaaacacagtgtgtaggggagagatntgattctgtgcagaagtcaactttgagtaagagaagcaactcgatgtctgaagctgggaa

SEQ ID NO: 16141 - DNA, 121 bp, Artificial Sequence
  Synthesized
  misc_feature (61): n=a or c
ctatgtgatatcacctaaactccaaggtctgttttgaggcctaaactatctccaatggcantttgtaaccaatcccatcccacacaaatatatacagcattttacttcccaacagcactaa

SEQ ID NO: 16142 - DNA, 121 bp, Artificial Sequence
  Synthesized
  misc_feature (61): n=a or g
taaagggagctgtcaatatatataagaaagggcactctgctgagcagttttacaagcaaangtccctcactgtctccagtgggaaatatcagctgagcgacattcgcaggagcggggtatc

SEQ ID NO: 16143 - DNA, 121 bp, Artificial Sequence
  Synthesized
  misc_feature (61): n=a or g
ataaacaaatatccaccagacgtgtccatagcatgcttgaagcaacctcctttaaatgggnaaaaagaaaagaatttctccaagtttcttccaggcccatatttctccatctccatagttt

SEQ ID NO: 16144 - DNA, 121 bp, Artificial Sequence
  Synthesized
  misc_feature (61): n=t or c
aatgtatcaactgatgccagtgaaattcaaccttgggcatcaagagttaatctcccatcangttttgatcttatcccattgctaacatggttggcttgtttggttccttagggtggggaat

SEQ ID NO: 16145 - DNA, 121 bp, Artificial Sequence
  Synthesized
  misc_feature (61): n=a or g
ttagtaacaaagagttatgcaagcagtatctttaccattatttacctttttgataagatcntatcagactaatacaaacatttttgaatgatatacactgaaagatatgctacactgcttc

SEQ ID NO: 16146 - DNA, 121 bp, Artificial Sequence
  Synthesized
  misc_feature (61): n=c or g
agcacaaaatggaccttaaaaaaagagtcccccaaaaggatttgccaaggaaaaaactttncattccttcaggattcaacatatgttttttcatttattggctctaacagctgactttatc

SEQ ID NO: 16147 - DNA, 121 bp, Artificial Sequence
  Synthesized
  misc_feature (61): n=a or c
caaaagcatcacttgctggtgagaggtgagagctcacacctagggcattcctggaacacanatgtacagtgctttgcctggggagcatgaaatggcagagctcctcctgcgcttcccagca

SEQ ID NO: 16148 - DNA, 121 bp, Artificial Sequence
  Synthesized
  misc_feature (61): n=t or c
ttagttgacaaaataactttctgtacatttttttccccacttttgctgtcatgtcatgtgncccttcttcgaacccaagaatgcttcacttctagcattgtgtggatagcatttgatatga

SEQ ID NO: 16149 - DNA, 121 bp, Artificial Sequence
  Synthesized
  misc_feature (61): n=a or c
agaatgacattatcaacattgttcacgtcacacattgtgttgaccatactttctttcatgngatatcaccttgttctacctgcagtttgtcactaattctcctttcattttcagttacaga

SEQ ID NO: 16150 - DNA, 121 bp, Artificial Sequence
  Synthesized
  misc_feature (61): n=a or g
catctgtgtgaaatacagagacaatgtccggttttgctagttaaaacccctgaaaaattcngtaaaagcaataatattagatgccgtgctatggcatacttccagttttgatgactaattt

SEQ ID NO: 16151 - DNA, 121 bp, Artificial Sequence
  Synthesized
  misc_feature (61): n=a or g
cacatttaacatctcctcagaaaaaactgcaacaaaacttctaatactcagtgaaatagantagtttggaccaaattcattgtccaaagacaggtagagagtaatataatcagcggtattc

SEQ ID NO: 16152 - DNA, 121 bp, Artificial Sequence
  Synthesized
  misc_feature (61): n=t or c
aggacccaaggaaccagtgagtattggggtcgtacgcagtacaaagatatgtatttgttcnatgtaagcccttcaaatgagactgaactaaagaagtgctgacagagcttttcttgttcaa

SEQ ID NO: 16153 - DNA, 121 bp, Artificial Sequence
  Synthesized
  misc_feature (61): n=a or c
ttagtggctaaagagcactagcacagggtttattagcatcagtgaaggctgttactttgtngtgactgttgtgccctaaatctttgcagactgccagatgattgttgtcaagtatagccat

SEQ ID NO: 16154 - DNA, 121 bp, Artificial Sequence
  Synthesized
  misc_feature (61): n=a or c
gcatttgtgtaggcatctatatgtgagaggctgggcttttccctctcctctttaatgaganttacactgctcatcctgggcatgaacttgtgctatttctgagtactgacagctctcttcc

SEQ ID NO: 16155 - DNA, 121 bp, Artificial Sequence
  Synthesized
  misc_feature (61): n=c or g
tttcattgtttatgtacctcacagaacatgtacgctaacatgtttaggctgtctagctganactgaaattactatcagctgacctcaggtagggaacagatgtactgctagtcaagatggc

SEQ ID NO: 16156 - DNA, 121 bp, Artificial Sequence
  Synthesized
  misc_feature (61): n=a or g
gtttgataaccatactgcaatttagtctgctttctactacctccctgcttctgcttatgcnttccttcaaaatctgttatgcagttttgcagaagctcaaagtcaagttcaaagacgtagc

SEQ ID NO: 16157 - DNA, 121 bp, Artificial Sequence
  Synthesized
  misc_feature (61): n=a or g
ctgttccaggcacagagaggaggtcaaacactggttttcttgtcagtgtcatccttcagtncatgcccatttttcctggccccatctaattccttttccccctttcctgcctaggctggct

SEQ ID NO: 16158 - DNA, 121 bp, Artificial Sequence
  Synthesized
  misc_feature (61): n=a or g
cacactccaggctttgcttacgtaatatctaaaaacacattgcccatgtactgtgaattgnaatcaatatcagtgcctatttactagtttaagacttgtactctaaagaatcagccaatgg

SEQ ID NO: 16159 - DNA, 121 bp, Artificial Sequence
  Synthesized
  misc_feature (61): n=t or g
caaaagaaacaatacgttctgattctttctcacctctccactctcctggaagccaagcctncactcaccaggatgtctctatagggcactgtctgtggttataggatcattacacccttgg

SEQ ID NO: 16160 - DNA, 121 bp, Artificial Sequence
  Synthesized
  misc_feature (61): n=t or c
agggaagagtatggtctcaagctctgacaatcatggtttgctttagataatgcacttaacngcttgaaatagcagagtgagacatctgagccatcgccatgcagcaaaccagcagaagaca

SEQ ID NO: 16161 - DNA, 121 bp, Artificial Sequence
  Synthesized
  misc_feature (61): n=a or c
tgttttaggatgtacttataaatcaaattaattccacttaatatttaaatgaggaacatgnccaaggtagggttaatttccttgatcaaatggagagacatagaccttcaaaaagcattta

SEQ ID NO: 16162 - DNA, 121 bp, Artificial Sequence
  Synthesized
  misc_feature (61): n=t or c
accaaacctatcacccttcccgagaagaagcatccaaacaataccatcatttaaatactanaggatagacatctgggtgtactagccctactggagcttgctcagctgcctttccttgagg

SEQ ID NO: 16163 - DNA, 121 bp, Artificial Sequence
  Synthesized
  misc_feature (61): n=c or g
aagccataagctcttccatgaaaacagctcactgaagcaatagcaccatccagccaaaaangtgggttcatatcaaggctcacatgaggacgtgtgaagctcccagggaatgtgcagagta

SEQ ID NO: 16164 - DNA, 121 bp, Artificial Sequence
  Synthesized
  misc_feature (61): n=a or g
cctacttgagctgttgctggtgattaacaatcttagcaatgcactgtaggaacaaagtatnttgtttcccctctgacagactctccataccacccagatttgaggaaacacctcagtattg

SEQ ID NO: 16165 - DNA, 121 bp, Artificial Sequence
  Synthesized
  misc_feature (61): n=a or g
gtgctttccttgtacaacagtgctgttgaaagctgatttactgtggtttttagtaatcagnctttccactgggtaatgtaatcttaccaaacgcagttacttgcatggagcagcaacttat

SEQ ID NO: 16166 - DNA, 121 bp, Artificial Sequence
  Synthesized
  misc_feature (61): n=t or g
tttggaaagatctcccaggacggaatacacaaaattgtagatacacaaaatggatgtctgnaagaattaagagcaatatgctctaacatacctctgaatccctttcttcctccaaaagaaa

SEQ ID NO: 16167 - DNA, 121 bp, Artificial Sequence
  Synthesized
  misc_feature (61): n=t or c
tagtggattggttaggtgagtatttcactctcatggaaatggggttaccaaaggagacatntctatttctagagtggactgcaacacaaaatgtttggctgcatcattcattctaatgtcc

SEQ ID NO: 16168 - DNA, 121 bp, Artificial Sequence
  Synthesized
  misc_feature (61): n=a or c
agtcggactgaaataaggtatgtttgtgctcataacagcatctcatagtgagcttagtganaacctatcagcaaatataggtggatctgtttttgtaacacaaattgtgctcttttaattt

SEQ ID NO: 16169 - DNA, 121 bp, Artificial Sequence
  Synthesized
  misc_feature (61): n=a or g
ctggttcctatatagtaaagagaaggaagtcaaacttgtcttacttttatacagatgggcngcctgtcttctgaaccaattgccttggacttgctttgtccatctgtgctgctatgaagcc

SEQ ID NO: 16170 - DNA, 121 bp, Artificial Sequence
  Synthesized
  misc_feature (61): n=a or g
tactgatctgtgcagtgccctgcaagctggtgctcgcctgcaaagccttctaccataaagntggagcaggcatagctgcacatgttgtccccgtggtccccgtccctcagcgttgaggtgt

SEQ ID NO: 16171 - DNA, 121 bp, Artificial Sequence
  Synthesized
  misc_feature (61): n=t or g
ttgtgggtgatcttccacttgttttcctttatgggtacttcagacagaccataaggaatgnctttttattgaataatcaagcagtgatcttttaaaggaagatctgtcatgctacttgatg

SEQ ID NO: 16172 - DNA, 121 bp, Artificial Sequence
  Synthesized
  misc_feature (61): n=t or c
tggcaaattatacgtttggtggaaacgccagacgacactctacagtcacaacaaaagcccngcatctcctttaatgaatcgggattgccaggtaagaggagctcgctccaaccattccaca

SEQ ID NO: 16173 - DNA, 121 bp, Artificial Sequence
  Synthesized
  misc_feature (61): n=t or c
cctgttagtgataaaacaaggaactgcagtccaaaatgactgacagcaccaggctaagtanttttgcaatttttactgaatgatgttataaataacacaaaacagaatacaactgagatgt

SEQ ID NO: 16174 - DNA, 121 bp, Artificial Sequence
  Synthesized
  misc_feature (61): n=a or t
gtgaggttcctaaaactcagtattagtcaacatgcttttaaatagtggcagtgaaccaacngaaggaaatgcataaaaagcactgctatgcaaaatatagcttccaatgaatggctgaaga

SEQ ID NO: 16175 - DNA, 121 bp, Artificial Sequence
  Synthesized
  misc_feature (61): n=t or c
aatttcatgaatcctacaacagttgagtacagcagcaaagagccaaagaatagtttcagtnggaggggaacttgagggatctttaatccaagccctgatcaaaccagttacctaagagatc

SEQ ID NO: 16176 - DNA, 121 bp, Artificial Sequence
  Synthesized
  misc_feature (61): n=t or g
atttcagaaaacactctgtaattgcctctcaccatctaaaactagaaatttcttccctaancctgtaatacgaaacaccttaggtttacctttaaacctttaaattttaactgtttcaaca

SEQ ID NO: 16177 - DNA, 121 bp, Artificial Sequence
  Synthesized
  misc_feature (61): n=a or t
tttaatatctccagagaagaagactccacaaactctctgagcacacagactgtgccagtgngctgcaatgaagaaagataaagcaaagaatgaattgtaagcatggaagattttaaaaagt

SEQ ID NO: 16178 - DNA, 121 bp, Artificial Sequence
  Synthesized
  misc_feature (61): n=t or c
gaagtgcctttaccaccattactacgtccaactgtttgcactgccagaagttggaagctgnctttaccattctattcctggaagagaccttgggtggtttcgctaaaatgcttcaggcaaa

SEQ ID NO: 16179 - DNA, 121 bp, Artificial Sequence
  Synthesized
  misc_feature (61): n=t or g
ccctgtgcaaaccccaggcacccgcctgctgggcagctgcccaggtacccaaaatcacccngatagaaacagggccacacagaaaaagccctgaactcctaaacattgcacttccctaaga

SEQ ID NO: 16180 - DNA, 121 bp, Artificial Sequence
  Synthesized
  misc_feature (61): n=a or g
acacaaaatttggcccactttcaaagtcagccgtgcttcgataaggagaggttgacccagntgaccttctgaagcctcttcaacccaaactattcaacgattctaaaagctgaaaataaga

SEQ ID NO: 16181 - DNA, 121 bp, Artificial Sequence
  Synthesized
  misc_feature (61): n=t or c
gggaacaaacctgcgtttgcatggttttgtaaaaggagtgctggaaaaagaatgggaagcnttcctgcaaagagcatatgctgcggcttcctgaaccaagagcccagctctggtgaggatt

SEQ ID NO: 16182 - DNA, 121 bp, Artificial Sequence
  Synthesized
  misc_feature (61): n=a or g
tactaagtctccaagaacttcaaaaacaagaagcttgaggactacatacacaaaagtttcncactgttgtcatattcgtcttctgcaaatacatgtatctgtggcagatttctaacttgca

SEQ ID NO: 16183 - DNA, 121 bp, Artificial Sequence
  Synthesized
  misc_feature (61): n=a or g
gacaaaactgtacatacatgaagactcactgtgtgttgagcatggcacatgaatggagggnccactttgaactacttttgcaacgagggattctgctcgactgataatgaaaccgtgggat

SEQ ID NO: 16184 - DNA, 121 bp, Artificial Sequence
  Synthesized
  misc_feature (61): n=a or g
ctgggaagatgtattttaggaggaaaggcaaaaagaaggaagatggtgatacctgcccggnggtcaagggcagcacctgcaggtcttgcacaggagcagcctggtgctgtgccctgccaat

SEQ ID NO: 16185 - DNA, 121 bp, Artificial Sequence
  Synthesized
  misc_feature (61): n=a or c
accattttgcacttgaattcatttgaagatacacgtagctgtcacatggacatcttaaaanaggagatcgagctattacacatgtaattaacatcaatatggaaaccaaaagaaagccatt

SEQ ID NO: 16186 - DNA, 121 bp, Artificial Sequence
  Synthesized
  misc_feature (61): n=t or c
tttgcactgtatttatgaataaggaattgttctttgactttaattctttcatttcagtctnctgttactgtaccttttccttgagggaacaacatattctaaattcatctcttttgtcttt

SEQ ID NO: 16187 - DNA, 121 bp, Artificial Sequence
  Synthesized
  misc_feature (61): n=t or g
tctcttaatagcaggacagactgtaacagtcaaaataacttctcaggtttgcctaattgtnattcatctacatgctaaatacaagccaaggagacattctctagattcttaaaaactgtta

SEQ ID NO: 16188 - DNA, 121 bp, Artificial Sequence
  Synthesized
  misc_feature (61): n=t or g
ctgcagaaaacaccggtgtctggaggtaacaagaatgtaatgacttattacaaaagacctngatggttcatggtctaaagccaatagctttgcttgaggtctgtgactgcagagcacgcaa

SEQ ID NO: 16189 - DNA, 121 bp, Artificial Sequence
  Synthesized
  misc_feature (61): n=a or g
taaactttcattaacatcctttaaaaatgtttttaatgaggtctctttgctcccatgtcancgttcttgggataagttgtctgcaacagtctccctagacccttcctggatctttgtgagc

SEQ ID NO: 16190 - DNA, 121 bp, Artificial Sequence
  Synthesized
  misc_feature (61): n=c or g
tcatctttttgtgaaggtgaataacaattagtggtgctttatgctggtgagcttattgcancaagtttatccaagtgcagcaggtctgcagcaagtcagaaaggtgggagaaagcagagac

SEQ ID NO: 16191 - DNA, 121 bp, Artificial Sequence
  Synthesized
  misc_feature (61): n=t or g
catcaaactgtatacttacttgttctgggcttggcacaaagcattaatgacaactgatttnccacctccagtaggcccaaccaccattgtagtgtgtctagttaacattgtctcatacatc

SEQ ID NO: 16192 - DNA, 121 bp, Artificial Sequence
  Synthesized
  misc_feature (61): n=t or c
ggtgctgtcatcctgtagtttattttaatggatctgtataacttagttaatgttttgtgantgataatcattctactgcttttagcaagagatttcagtgttatctctgattcacaaatca

SEQ ID NO: 16193 - DNA, 121 bp, Artificial Sequence
  Synthesized
  misc_feature (61): n=a or g
ttacattttccatcttccatttctttcatcgacacctatgagatggaaactttgttaagcntgctaatgaagacagctgtttttatcacatcatctggcagtactgagacagataaagact

SEQ ID NO: 16194 - DNA, 121 bp, Artificial Sequence
  Synthesized
  misc_feature (61): n=c or g
tgcaccttgactttattttccccagtgctcaatgccccgaatccctctgaggtcagcaganagttgtctctccagctgctgaaacttcagcaccagagatacaattctgttcacccaaccc

SEQ ID NO: 16195 - DNA, 121 bp, Artificial Sequence
  Synthesized
  misc_feature (61): n=a or g
aagcagagaaaatcacttgtgctttagttcttcattatctacgtactttagtgctgtcctntgttgtaacgttgaacaattaattttctgtatgctgacagttccataaatggagaagcaa

SEQ ID NO: 16196 - DNA, 121 bp, Artificial Sequence
  Synthesized
  misc_feature (61): n=t or c
cactttgcatcagtaaggacccttgggatcaaaggctatgcactggcctggtggaagaagnactcaggtgggaggcaggaagtcaggattacaatcccagctttgaggaaatatttaacac

SEQ ID NO: 16197 - DNA, 121 bp, Artificial Sequence
  Synthesized
  misc_feature (61): n=a or g
ccagtttttgaactaagttgtttattatggcatcttaaatctgcagtttctaccagttacnctaacgaaaacagtgtatttgttgttttgggattaaactaatataattttctattacttt

SEQ ID NO: 16198 - DNA, 121 bp, Artificial Sequence
  Synthesized
  misc_feature (61): n=a or g
ttaaaggtaagcgaggagagggtttgggtatgggtgacaaaacatccccagccaggattanggatttcagggataaacgtgagatcatagatttatctttcagagagctggaaaagattgc

SEQ ID NO: 16199 - DNA, 121 bp, Artificial Sequence
  Synthesized
  misc_feature (61): n=c or g
gaggagtgccagcccttccactggatttaatcagcatttttaattaggagggtgaggaggnagagaaatgagctccacggaactgggacgcacaccaccaccccctgcctcctgccccagg

SEQ ID NO: 16200 - DNA, 121 bp, Artificial Sequence
  Synthesized
  misc_feature (61): n=a or g
taggaagtaaacttaacgggactgtcagatgtcttgctctcgctgtgttgtctgcaagatnaggcttcgatctcttcccatcccgacacactgctctcatgagatcggctcacagagctga

SEQ ID NO: 16201 - DNA, 121 bp, Artificial Sequence
  Synthesized
  misc_feature (61): n=t or c
attaattggactaactagaaatctattatcacaaagacatcttgaaaattaggtagaagtnctacaagtcttgatacccagctgtggttaaaaataatacaaactaccagtaaacagctgt

SEQ ID NO: 16202 - DNA, 121 bp, Artificial Sequence
  Synthesized
  misc_feature (61): n=t or c
aattcagcttttgctacaggtgtggcagtttggaatttttatgtcacctgttaatacagantacctgcatactatgagaaagctcatctgatcctccaaggagtaaaaatgcaagccccta

SEQ ID NO: 16203 - DNA, 121 bp, Artificial Sequence
  Synthesized
  misc_feature (61): n=t or c
ttccattttaaacactagtttgatttagatagctccatgcaaagcttcagtactggtctgngtctgcttttgtatagagcaaattctggctttgtgaacctaagggcttgagtactgtaat

SEQ ID NO: 16204 - DNA, 121 bp, Artificial Sequence
  Synthesized
  misc_feature (61): n=c or g
gcagcaggcccatgacccaacaagcccaacctgtgccctgctcctttgtgtttggaggagnacagtcctcagaaattattagaataatttaccaagctattaatgagggcgagagaagtgc

SEQ ID NO: 16205 - DNA, 121 bp, Artificial Sequence
  Synthesized
  misc_feature (61): n=a or g
acaaagcacagatgggagcaccagcctcaaggagcgctggcctttgctgtacctttcttcntttgtgtctttcatttttgcagccaacattgcccagatacacgtttagccaacgctgaca

SEQ ID NO: 16206 - DNA, 121 bp, Artificial Sequence
  Synthesized
  misc_feature (61): n=t or c
ctgcacttctgcagtaaatgcagggctggagtaggtcttagagtaactacaaaaggtcccngcagtggaaaaatactgtggctttttgtgtgatagaaatcactatggatgtccacgatcc

SEQ ID NO: 16207 - DNA, 121 bp, Artificial Sequence
  Synthesized
  misc_feature (61): n=t or c
atcttgtgaaaagcagggcttatttctcttattttaaccatttcatgacttcatgattgangtggtttgtgtttctagtccctcattgtattagactgacacacttacagatatctaccag

SEQ ID NO: 16208 - DNA, 121 bp, Artificial Sequence
  Synthesized
  misc_feature (61): n=t or g
ggaggaaatccttcccatccctgccttctgcagtatcactcccatgataggctcttgctcncaccgccagaagcagagctgcccttttgctattgttcttttttgctccaatgctttttct

SEQ ID NO: 16209 - DNA, 121 bp, Artificial Sequence
  Synthesized
  misc_feature (61): n=a or g
gacacctaagtacatttttttaactattcatgttctactattttggatctgccatcattangctcaagatctgaaataacccttcaataataccctatttttttgttacagtcataacagc

SEQ ID NO: 16210 - DNA, 121 bp, Artificial Sequence
  Synthesized
  misc_feature (61): n=a or g
ttccttgcactagcttctagtgatatgaggtggatattaaattttgttaatggtcagctgncaatccttggtcatatctgctaatggttgttctcacagtattcctgtagtgaggatatct

SEQ ID NO: 16211 - DNA, 121 bp, Artificial Sequence
  Synthesized
  misc_feature (61): n=a or c
cagtaatatcaaacagataatggggcaggggctctttgtccttcagatattaacattttanaaagaaaattggaacagtgctaaaataatatccataaaacaacacaaaaagtgatggaga

SEQ ID NO: 16212 - DNA, 121 bp, Artificial Sequence
  Synthesized
  misc_feature (61): n=t or c
gcaaaccctcaagacacaggcatgatctgaactgcttaaggagtacagattcagcacatanaatatttataacttattactgaagctgaaaagctctgcatattagaattaaagctggtat

SEQ ID NO: 16213 - DNA, 121 bp, Artificial Sequence
  Synthesized
  misc_feature (61): n=a or g
tatattaaactgcagcaggtgaacatcatacaaagttctcttgttaataagaccgcattgntagatctacagactttacattacagagtgattatttcactgtctcatcagacctgtagat

SEQ ID NO: 16214 - DNA, 121 bp, Artificial Sequence
  Synthesized
  misc_feature (61): n=a or g
ttttcccaatactaaaaggatttgaagcaagtatatttattttcatgaaatgcagttgagnaagtatctttgcaagagctttttatcttctgtctagagcatgtttatataactgatatat

SEQ ID NO: 16215 - DNA, 121 bp, Artificial Sequence
  Synthesized
  misc_feature (61): n=t or c
gaccacctacgcctcacacaagtttgtcactgtagctccatcagctgcatctaggggcacngcggatacccacaaggggctgttttcagtggagcaccagtggcagatctggctttcacaa

SEQ ID NO: 16216 - DNA, 121 bp, Artificial Sequence
  Synthesized
  misc_feature (61): n=a or g
tgaaaaccatttcctacatcattatgaggtccttgatgtgcctctatgcagaagttttgcngctatgcagctggtcccaccatactgggatctattttgttcacatgcaagtagtatatct

SEQ ID NO: 16217 - DNA, 121 bp, Artificial Sequence
  Synthesized
  misc_feature (61): n=t or c
ttacaggatgctgtggtgttccttgatttgggctcaggtagggtcagatgctgagcaaatntgaactgaccacttgctttaatagaaagtgcatgatgctctgtgaggctctttctaaccc

SEQ ID NO: 16218 - DNA, 121 bp, Artificial Sequence
  Synthesized
  misc_feature (61): n=a or g
ggaagatggggaccagatgtggtgcttcacagaaggcattttgggatcaccaagcacatcnctgccacagccaagcactgcctgtccacattggctcttccatgcactgacacacctgggc

SEQ ID NO: 16219 - DNA, 121 bp, Artificial Sequence
  Synthesized
  misc_feature (61): n=a or g
tttttaataactacatacaattcaggaagacggtcaagtgccattatgttaaggacatccnatttcagtatctgtaagtattaatacagttttcagatacagttttcagtttgttttgatt

SEQ ID NO: 16220 - DNA, 121 bp, Artificial Sequence
  Synthesized
  misc_feature (61): n=t or g
tcaatggagagagcgaaagggatccagctgtgcttgccagatgttccattgattaccccgngcctcttgtcgtacctttgcacaaactttatccccggtgccccgggaactcccgggcaag

SEQ ID NO: 16221 - DNA, 121 bp, Artificial Sequence
  Synthesized
  misc_feature (61): n=a or g
atgcctgtagtagaaaaagggtatatttggaggcgtctttgttgtggaaatgatgatcacnctgtcttttcatacatttagtcattcttttcctctgcccagtaacagggtggttatgttg

SEQ ID NO: 16222 - DNA, 121 bp, Artificial Sequence
  Synthesized
  misc_feature (61): n=a or g
atagagagaacattgacctggtcacagcttaaagcatcagaaggttgtgctccatcctacnggcttggatggtttgcttaaaatgctgtaatggtaacagttccatctacactggcatgac

SEQ ID NO: 16223 - DNA, 121 bp, Artificial Sequence
  Synthesized
  misc_feature (61): n=t or c
tttgttcatacatattcctttttgaacgccattagactctttacagtgtgtccatgtcttncttgtattggtggagccagaattggatccatcactccaggtgcagccccaccagtgctaa

SEQ ID NO: 16224 - DNA, 121 bp, Artificial Sequence
  Synthesized
  misc_feature (61): n=t or g
ccttcttctgtagctgtgatcctcttcagcttgtcaattagcccaccaaatccactgctantggtgctctagaacactgttggcgtcctaaacctctcctgtacttcttgcataacatgat

SEQ ID NO: 16225 - DNA, 121 bp, Artificial Sequence
  Synthesized
  misc_feature (61): n=t or c
gttccaaacctccagattccttttccagtccttcctgttaatgagtctgcttcgaaaacgngtctaaggcttgcaaaaacatcactgaaaagccaaaacctaagtcaaaaaagggcacaag

SEQ ID NO: 16226 - DNA, 121 bp, Artificial Sequence
  Synthesized
  misc_feature (61): n=a or g
taaaccacgtctgaattctttacaagtgaaaaaaggtgatttataaagacttcagtgttcnaaattaacagctgattttggatttctatatttgttcacttatcttttttcttcctctttt

SEQ ID NO: 16227 - DNA, 121 bp, Artificial Sequence
  Synthesized
  misc_feature (61): n=a or g
ttaccacggaacatctgggttgctgctcactgcaggttgaggtaggtagaagttgaggtcngtgtgttgccacgtgtcctcacaagaggagtgatgcttcctcacaagttctggtgatgac

SEQ ID NO: 16228 - DNA, 121 bp, Artificial Sequence
  Synthesized
  misc_feature (61): n=a or g
catttggttagttaaaatatttacattgcacattcaaatgatgcactttcccagtgacagngctgtctgtggtatttcctcccgtacctactctgaagcagaaacagatgattgggataaa

SEQ ID NO: 16229 - DNA, 121 bp, Artificial Sequence
  Synthesized
  misc_feature (61): n=a or g
gcagaacgcattttggtagcccagttgagtgaagctggaacaaacaggactgattttttgnagataagcattagaaagcaccaacccaggagttgtttccactttggatatctgatcgagc

SEQ ID NO: 16230 - DNA, 121 bp, Artificial Sequence
  Synthesized
  misc_feature (61): n=a or g
ggcttctaaaagacaaatttttgtctttagaggagtttaattttgagtcttttaactttgngtactggctgcagtatatttctgtggggtaaggaagcatgagccgtacagaattcctata

SEQ ID NO: 16231 - DNA, 121 bp, Artificial Sequence
  Synthesized
  misc_feature (61): n=c or g
tttttgtgctgaaaccatgtaataaaacagcttctcttgaaactatgttaaaagcacaaanagaaaaactatctgttggtttactatcggccagtatgtttcaaaggcttaattcttctaa

SEQ ID NO: 16232 - DNA, 121 bp, Artificial Sequence
  Synthesized
  misc_feature (61): n=a or g
gattggctccaccccagaagcacacggggctcaggattagctgtgtcctgtcctgctcacntgaaatggggagcttccatgccacctgcatgtaatgagcaaagcacgtgtgtagctgcca

SEQ ID NO: 16233 - DNA, 121 bp, Artificial Sequence
  Synthesized
  misc_feature (61): n=a or g
atgtataaagagcaggagtggagtacttactagagccagcaaggcatttcacgctgtgggngtgctggggagctggaagggaatgtcaatatgaacttgtcagtggaaattcaagcaattt

SEQ ID NO: 16234 - DNA, 121 bp, Artificial Sequence
  Synthesized
  misc_feature (61): n=t or c
ttctgcatgttcagatagctcacttttctttttgttttccctacaaactgttcaatacacnctgtgaaatatgtgtcaaatgtgtgggtaatgcagcattacacagaaacaccttgaatca

SEQ ID NO: 16235 - DNA, 121 bp, Artificial Sequence
  Synthesized
  misc_feature (61): n=t or c
aaaatgcaaagagatatggaagatagggaagattgggctccattgtctccttttcagttgngcaacagaaacaaatatttctgttctccagtgaaactttcagttttcattttgaaaatat

SEQ ID NO: 16236 - DNA, 121 bp, Artificial Sequence
  Synthesized
  misc_feature (61): n=a or c
ggtctggggtctgctcgggggtcccagcacctcccagccctcacacaggtgctgccataanggttggttcttgggaagggaaagaaagtgattttcacaccctcctttccctggtgtctgc

SEQ ID NO: 16237 - DNA, 121 bp, Artificial Sequence
  Synthesized
  misc_feature (61): n=t or c
ttaaagcttctgttgaaaccactgtcctttgttttccatgtctgttttatcaccagccatngaaactgcattagtggtccatctgcacgtgacacagatcagcacttcagactgtagcagc

SEQ ID NO: 16238 - DNA, 121 bp, Artificial Sequence
  Synthesized
  misc_feature (61): n=t or c
caagagttctgaaaactaggaataatttagcatgccatcagagtaattgggaaggtagaangaactcaggcagggttaaaaggtgactttgctccagcttctgtttctcacttttttgtta

SEQ ID NO: 16239 - DNA, 121 bp, Artificial Sequence
  Synthesized
  misc_feature (61): n=t or c
cacgcacacaaaaataataataattaagcttttaaacgattgcaaggcaatttaagcaccnctcctgacagatgaatcttcagaggccttgttcttattgactgagggagaggcaggtgcc

SEQ ID NO: 16240 - DNA, 121 bp, Artificial Sequence
  Synthesized
  misc_feature (61): n=a or c
tcaccaggtacccatcccggaatacctgtgacaccgtatgggtttacccactgcacgaggngagcctcaattatttaacatcccactctgaaagcacggtttatttgcagccatctgcctt

SEQ ID NO: 16241 - DNA, 121 bp, Artificial Sequence
  Synthesized
  misc_feature (61): n=a or c
ggctggttaaaccccagcacttatgcatgcattctgataacagttttcagtgagaaaagtnattctggcactttccaggggcactcttgtctgtgagcagcaggacttctcaagtctccca

SEQ ID NO: 16242 - DNA, 121 bp, Artificial Sequence
  Synthesized
  misc_feature (61): n=a or t
tgtgtgaatacttctactgttttatttactatatcctctgtcctggctgtacagcttctanaaagaaatagcagaataacttcttcctttttcacttctctctcagaaagctccacagaga

SEQ ID NO: 16243 - DNA, 121 bp, Artificial Sequence
  Synthesized
  misc_feature (61): n=a or c
taatattatcagttgaacaattcttgatgcagagagcagggtctcccagagataacatatntgtacctgtttttaatattgtggttgggatccaagttaaaagatccatacatgagctaag

SEQ ID NO: 16244 - DNA, 121 bp, Artificial Sequence
  Synthesized
  misc_feature (61): n=t or c
aacctagaccaagggaactcctcccactgcaatctagttggtagcaagacaaaggaacatncaggccaggcacagaacatcacctaaagcccagagccacaagcaccagaaagacattagt

SEQ ID NO: 16245 - DNA, 121 bp, Artificial Sequence
  Synthesized
  misc_feature (61): n=a or t
ttgggtatgtctgtgctggataagtaaaaccagatttctgcactgcatattgcgtggtcantactaacagaatcctgccagacacatttagaggtaaagcgtctggaggaccttgtagaca

SEQ ID NO: 16246 - DNA, 121 bp, Artificial Sequence
  Synthesized
  misc_feature (61): n=t or c
acactacactttattttgatagtctgacaatgtagaaatctgcagtgattgcttctgctcnacgagcacattctcaaccaaacattagaagaggataccagtcacatacctgcattttact

SEQ ID NO: 16247 - DNA, 121 bp, Artificial Sequence
  Synthesized
  misc_feature (61): n=t or c
atgctttatgagactttttagaacaggcaaaacaatatgaaatctcacagtgtctggaaangtgcctttgtctttcgggaatttcccactgactttttgcattgaagcttcagtggaaagc

SEQ ID NO: 16248 - DNA, 121 bp, Artificial Sequence
  Synthesized
  misc_feature (61): n=t or c
ggctgtgcccccataggagccatctctgtacacggtgaaagctgtcatcatcctggataangatggcgatcggctctttgccaaggtgagggggggggtgggatgggggggggcgggggtg

SEQ ID NO: 16249 - DNA, 121 bp, Artificial Sequence
  Synthesized
  misc_feature (61): n=t or c
tgagagatgaccttttgcagccctcctgcccaacggttactgtgctctcctttaattctgnttgcagccccgaatagtggtttttcagattaagctcaggtcactgcatgaatcattttgt

SEQ ID NO: 16250 - DNA, 121 bp, Artificial Sequence
  Synthesized
  misc_feature (61): n=a or g
gatgttagattaagcagtgtgtggaagcacggacaattgctcgaaaggccagtgtctgtcnttaggacaaatagtacgaggtgcatgctcagactgacaaggaaactgtgctcgagtctgc

SEQ ID NO: 16251 - DNA, 121 bp, Artificial Sequence
  Synthesized
  misc_feature (61): n=a or g
ctgtgagcttgaaccagtttaagtactgtaaataactaattggcttaaaaacatactgccngtttctatacacaggtacttcaaaataggtttaaatttgggtgctgctcatattatagcc

SEQ ID NO: 16252 - DNA, 121 bp, Artificial Sequence
  Synthesized
  misc_feature (61): n=t or c
gctggctacgtagcagccaaaaataatttctaattgtcaaatgaggggggaagaaagaccncaaacaccgaacctctgaagcatataaatattggggaaaaaaaaacaaaagtgggaattc

SEQ ID NO: 16253 - DNA, 121 bp, Artificial Sequence
  Synthesized
  misc_feature (61): n=t or c
acgcgtaagtatttgcatgagcatggatcactcacagacagtaaaatgcagtcactctccntctcaatgcatcattatcctaaaaggtgataattaaaatgatttcaaagttcagacttaa

SEQ ID NO: 16254 - DNA, 121 bp, Artificial Sequence
  Synthesized
  misc_feature (61): n=t or c
tctataatgtttgaataagctctcgagttttttctagtatcccatatttttatacactatngcagtcctgctttcatagtacagtgatttggattttctggtgtttcccctcgaggctatc

SEQ ID NO: 16255 - DNA, 121 bp, Artificial Sequence
  Synthesized
  misc_feature (61): n=t or c
cacttcacacctccttttcctttacttcaagatgcaatgcaagctgcaaaccatgtcaaancaaagagcagctgtggcaaaaactccccacagtgcaaggttttaaatcccacctggatcc

SEQ ID NO: 16256 - DNA, 121 bp, Artificial Sequence
  Synthesized
  misc_feature (61): n=c or g
ttcagaaagttgacttaggtggaaataattctggactgatggacacttttccaaagacttntttagtttgagaatatacagatgtacaatatagtaataaaaaataaaaccaagagcatgt

SEQ ID NO: 16257 - DNA, 121 bp, Artificial Sequence
  Synthesized
  misc_feature (61): n=t or c
gcagtcagcagcagttctagaaattgaacctagccagcataaagcctggtcctgctgctcngggagggacaatgtgcattctgcctttcacagtgattgaaaacatttgccatcctaggca

SEQ ID NO: 16258 - DNA, 121 bp, Artificial Sequence
  Synthesized
  misc_feature (61): n=a or g
aaccagccgagcatatcacaccagcgtaacgacgacttaggttaccatctaaagcctcccnaagattaaagccaattatttctaggctcttaccctgttttccttactttcgcacagaggt

SEQ ID NO: 16259 - DNA, 121 bp, Artificial Sequence
  Synthesized
  misc_feature (61): n=t or c
gtgatatatacaatacagaaagataatgaagaaaattatgaatgtaacagaaactacatangaccatctcatgatacttcatatggaacagtatatgtataatgaacagattacacagaga

SEQ ID NO: 16260 - DNA, 121 bp, Artificial Sequence
  Synthesized
  misc_feature (61): n=a or g
ttaaatgatctctatggctcccagcaggaggatccctacctgcgcgatgccgatcaggaanctgcattggcacaaagggctgaagagccacacgaaggatttggggaagtcttccagcagg

SEQ ID NO: 16261 - DNA, 121 bp, Artificial Sequence
  Synthesized
  misc_feature (61): n=a or g
agttcatatatggaagaattggcaccgcttaattaagcaagaatgatgacagcctcaacantggcacttaggagctcaatgttcagatgctcagtgcttataatgggtccggattggaaag

SEQ ID NO: 16262 - DNA, 121 bp, Artificial Sequence
  Synthesized
  misc_feature (61): n=a or t
gtgaacaacacttcataggttggcttgctggttttccttaagcaagagcagggcatagaantatacattctaaataacttttatgagtaaacctttggattttatttaaaaccttagcaag

SEQ ID NO: 16263 - DNA, 121 bp, Artificial Sequence
  Synthesized
  misc_feature (61): n=t or c
ctttttaaatgctatcttgcaaactcaaacaaaataccagaactcttttttgtagctttanagaagatgcatagattcactaagaattaaggtgcattcacattctagctgaataaaattt

SEQ ID NO: 16264 - DNA, 121 bp, Artificial Sequence
  Synthesized
  misc_feature (61): n=a or g
aatctttcctttatataccataggattagcttggaagaaactggaatcattgaaactgttngcctgaaaaaggtcaaacttaaggaaggaaccatattttcttcaattgtttctcagacca

SEQ ID NO: 16265 - DNA, 121 bp, Artificial Sequence
  Synthesized
  misc_feature (61): n=t or c
aacatgtgcacgcagagctctgaaccgctctgcactgtctcctcattttgtatagttgtgntgaaatcgtgataagtgttgacatggagtaggaagaagtgcagaatgtaatggtgtgact

SEQ ID NO: 16266 - DNA, 121 bp, Artificial Sequence
  Synthesized
  misc_feature (61): n=t or c
aaccctggttgttcctttttttactcaaacatcaaatgcaggcctactggacatataaggntatgttcatagctggagtttgtgcagtatttataaggtatgaaaagctacagttcttctg

SEQ ID NO: 16267 - DNA, 121 bp, Artificial Sequence
  Synthesized
  misc_feature (61): n=t or g
tgtgtaaggcttggcttctgaacccttcctatattctatagtattatgcgttgctgatcancattggttatcctgctgcttcacaaagataagatgataatctcgcctcagaaagctttat

SEQ ID NO: 16268 - DNA, 121 bp, Artificial Sequence
  Synthesized
  misc_feature (61): n=a or g
gtgccaaagcaccatttccatgtgaaatcagcactgaataaatgtgtgcccacggacaaanccgggacttgagtaggacaacaggatgctaatcaaaggttccgtagtagtataaaggagt

SEQ ID NO: 16269 - DNA, 121 bp, Artificial Sequence
  Synthesized
  misc_feature (61): n=a or g
ttttacgggactttgtaaacttctgttattaagtataacttctatcttctggacagccacngttcctttggagtgggattgctgcacacaacgtgcttttcgttaagaccgagttcctgtt

SEQ ID NO: 16270 - DNA, 121 bp, Artificial Sequence
  Synthesized
  misc_feature (61): n=t or c
gcaggcaccggcacaccttggaccgtgaaggcatgctgcaaatcagcaatatcaaaatccngctgtcaactcaataaatgaaatgaaggcgatatagaagtgtgtcacctgatgggaggag

SEQ ID NO: 16271 - DNA, 121 bp, Artificial Sequence
  Synthesized
  misc_feature (61): n=t or c
ttctctaaaattctttgttgcatttaagtttcaattttctgatgtcttctatgactacagngacatcaaccacttcaaatgctagttttcatctaggaatagaaaaagaaaattagaaata

SEQ ID NO: 16272 - DNA, 121 bp, Artificial Sequence
  Synthesized
  misc_feature (61): n=a or g
tgctaaggagaaaaaaggcacataatcttgtatggaaatatgaaggcaaaactgtgtgtcntgacagtcatatttgtacattgtggcttttttaacctagatctgcatcgttctactattg

SEQ ID NO: 16273 - DNA, 121 bp, Artificial Sequence
  Synthesized
  misc_feature (61): n=t or c
accttgctctagggtacagaagcaatctccttatgatccgttataccaatgtagctgatantgattcaatgctctccagttataacaactacccaaactatgatgagatggaaatttggga

SEQ ID NO: 16274 - DNA, 121 bp, Artificial Sequence
  Synthesized
  misc_feature (61): n=t or c
agatgactgacgatgttaaaaatgctatttccacatgaactttatagtttttaagccatgnattgaaattatcatgtttgattttcttagtatcttccaagtttcagcttagagtttgatg

SEQ ID NO: 16275 - DNA, 121 bp, Artificial Sequence
  Synthesized
  misc_feature (61): n=a or t
acttaattactgacgttcgttttaagccctcgtcctccatcccagcgaatttcacccgtgnacgagaaatgagcaaagagcttttttaacaacttggccgttctgtcgaaataacaaaagg

SEQ ID NO: 16276 - DNA, 121 bp, Artificial Sequence
  Synthesized
  misc_feature (61): n=a or c
tagccacacacacacataattacatgtataatgacatacctgcatggtagacctaaccagnatggtttcatacagcccacagttgagcttcccctcctgaaagcagagaatctgcttcaca

SEQ ID NO: 16277 - DNA, 121 bp, Artificial Sequence
  Synthesized
  misc_feature (61): n=a or g
agtatcacagtcttaaattattcttacagcatgaaggggaagggaccaaaaatccccaccnctccgattttcaaatagaaattctcctgagaacccaaacaacgtcactttgcttttacac

SEQ ID NO: 16278 - DNA, 121 bp, Artificial Sequence
  Synthesized
  misc_feature (61): n=a or g
gagctacctgaaaccctcaggctttcagcagcctcttccctatgcatattagatgatgctnacaactgcctgtcatgttttcacctaacaggacagagcagggggatttcagaagaccaca

SEQ ID NO: 16279 - DNA, 121 bp, Artificial Sequence
  Synthesized
  misc_feature (61): n=t or c
catacttaaagtaactgaggtccttcatctacatttgctttatgaggaggaagtccctganttgaattttcccatcttcttgccaagataaagagcagccagcagttgttgtgactgttgg

SEQ ID NO: 16280 - DNA, 121 bp, Artificial Sequence
  Synthesized
  misc_feature (61): n=t or c
ctgaatttttcaagttagaggtggcttcaaaatgaagacagtttctactacactaaactcnagttgttggagaaaagacttaaaggtccacttacttcattttgtcttggagaaaacttaa

SEQ ID NO: 16281 - DNA, 121 bp, Artificial Sequence
  Synthesized
  misc_feature (61): n=t or g
cagggaatttttgaataattggagctgtataaatttgcataagtattgaattttcaaaggntcattttcctaggccagcagataccccctatattatgcatagtacatattccagtcctga

SEQ ID NO: 16282 - DNA, 121 bp, Artificial Sequence
  Synthesized
  misc_feature (61): n=a or c
gatagttggcttcaataatccctgcatagcttgtccagatcagggcagcatctgcctcatntctgagatgagaaaatcatcaggaatattttttccaataccctccccaatgccgtgaccc

SEQ ID NO: 16283 - DNA, 121 bp, Artificial Sequence
  Synthesized
  misc_feature (61): n=a or g
tacacagcctgtaccgaaacttagtaagttggattgggcttgggcatgtgatcttgaaagnaactataccagttgtgtggttctctaaagtgggtattaagttggactgcatgtgatggag

SEQ ID NO: 16284 - DNA, 121 bp, Artificial Sequence
  Synthesized
  misc_feature (61): n=a or g
aagggcagaagccagcaaatgggtgtgtttggagctgccagaagtgctccaagtcattacngaacattcagggctgggcgctgagctcgtgctcctattgcaaaagtccagacactctttg

SEQ ID NO: 16285 - DNA, 121 bp, Artificial Sequence
  Synthesized
  misc_feature (61): n=t or c
acttagtttagatattagtgttgtcatagcaatggtcttacgggaacacacagaaaataantgaggaaagggtttctggtggctgaagaaccaagtgctgggttttggttgggctcggttg

SEQ ID NO: 16286 - DNA, 121 bp, Artificial Sequence
  Synthesized
  misc_feature (61): n=t or c
tgtcccactgtggctctgtatttctacaaactgccgtatgtagataataacataacatganattcataaagaaataggtttctataaatacagaaaatgttaataaacctggtggtttcct

SEQ ID NO: 16287 - DNA, 121 bp, Artificial Sequence
  Synthesized
  misc_feature (61): n=t or c
gaaacaagccccacacaattcgtcagcataggagctggtgactttcagcatttttgctagncaggatgcagtttaagtgatagtgcaagcaggacatttctgatgatataagcaaaatgtt

SEQ ID NO: 16288 - DNA, 121 bp, Artificial Sequence
  Synthesized
  misc_feature (61): n=a or g
ttgaatctaccacgttgtgttaatggagtggatgagttgagcaggaagagaaaagggacantagcaaggcttgtgaactaatgtatgctttttcaggtggagagacattttaatatttttt

SEQ ID NO: 16289 - DNA, 121 bp, Artificial Sequence
  Synthesized
  misc_feature (61): n=t or c
aaacagagcacagctttggtctctctgctaggcatacacttacactacagttcagatccanctccagatttccaaaacaccccagatttctggagaactttgttgccaagttatctcatct

SEQ ID NO: 16290 - DNA, 121 bp, Artificial Sequence
  Synthesized
  misc_feature (61): n=a or g
caaatgtgggtaaataaaagtggggagggccctgcaaaggtcaggagcagagagagacccngctgcagtgtgtggctttgggcacgtggacggggggggggagatgtatgtgtgtgtgggg

SEQ ID NO: 16291 - DNA, 121 bp, Artificial Sequence
  Synthesized
  misc_feature (61): n=a or g
tccccccccacttgggcactctgagtctgttcttcctgccgtgttgaaatacacaaattanctggtactgcatccctaggatacaatagaaaaggctgctggcctcccaggctgctagcaa

SEQ ID NO: 16292 - DNA, 121 bp, Artificial Sequence
  Synthesized
  misc_feature (61): n=t or c
cgcttccgatagtgcctgcgttgtgaattcacagaacgaagatgagagtaaatttgagganagtttgcagggggaagagaggtttgtcatatctgcgtggataggacaaaagaattattta

SEQ ID NO: 16293 - DNA, 121 bp, Artificial Sequence
  Synthesized
  misc_feature (61): n=a or t
agttagctgtcagaaaatctcagaggtgagtcaggctcttactagggcttatgatcaggangtccttgactctgcccaactgtttccgcagtcaagtaccttgtgttggctagggaaaata

SEQ ID NO: 16294 - DNA, 121 bp, Artificial Sequence
  Synthesized
  misc_feature (61): n=t or c
tactattccctgtgtttcagtgtacaattaggactagtttcctgtataaaacaggactggntgactggagggacaaaccaaggtgctgctcgctgtatgctttttgaaagcaccttttcca

SEQ ID NO: 16295 - DNA, 121 bp, Artificial Sequence
  Synthesized
  misc_feature (61): n=t or c
catgataaatagttttaaaattctgtgctttatcttttgtctgtatttttacatggcacantattgtaaacgaatatagtgctttgctctgataactctattggaagaggatagtgctcct

SEQ ID NO: 16296 - DNA, 121 bp, Artificial Sequence
  Synthesized
  misc_feature (61): n=a or g
gctgcatgtggtgcatgcggctcttagtccgcagtttggctgcgctgctgatttcctcaantcccttaatttactcactttggtcgcctaaaactgaaacataaaagcacttctgtagact

SEQ ID NO: 16297 - DNA, 121 bp, Artificial Sequence
  Synthesized
  misc_feature (61): n=t or c
tgctgcacagaagtcttagtattaggctgtattaatcagatgcacaaagcaccagtggtgntgttacagcccagattaacatgaggccaagcagttaaatggtccatcagctgcaagtaaa

SEQ ID NO: 16298 - DNA, 121 bp, Artificial Sequence
  Synthesized
  misc_feature (61): n=t or c
aatgcacagaacttgtgctctgcacaggctgtcactccaggttaaggaagaggcaggctgntgtcttatttgtgaactgcatccactccactgctggcatatggcaccatgagaatctctg

SEQ ID NO: 16299 - DNA, 121 bp, Artificial Sequence
  Synthesized
  misc_feature (61): n=a or g
catattccattgaccacactgagacctagtctccccagggagtgttaccttcggctcagcnttcagtcctctgctgggtttgaacatccaagttaaacacacactttgctgaatatcaagc

SEQ ID NO: 16300 - DNA, 121 bp, Artificial Sequence
  Synthesized
  misc_feature (61): n=c or g
agaactattctgtcagtcagttttcctataaaagagatgactcaaatctttccagcttgtntccctccctccaacttctccgactgcagatttttgcattttctgaaagaagtacatcaag

SEQ ID NO: 16301 - DNA, 121 bp, Artificial Sequence
  Synthesized
  misc_feature (61): n=a or g
ctttagttctctgccgtacagtaatattgtattgattcataattcagcatcacaaaaactncaagttgataagatctgaatagtcttatttttagcacagctatatctcactgctgtcatt

SEQ ID NO: 16302 - DNA, 121 bp, Artificial Sequence
  Synthesized
  misc_feature (61): n=t or c
ctttttggtgctacctcttcctttcttgggagggatatattaggaaatgccataaacatangttcctagcattttaataaatgggagatcagtgttacatgctgacaaacagaactgtatc

SEQ ID NO: 16303 - DNA, 121 bp, Artificial Sequence
  Synthesized
  misc_feature (61): n=t or c
cggaaaaggtcacttgccactctgacaaatgggtttaccctgagctgtttatgttgggctngcagatagtgccttcatgcctgcttctcctctgccatgaaatgccagcgtctctgcggca

SEQ ID NO: 16304 - DNA, 121 bp, Artificial Sequence
  Synthesized
  misc_feature (61): n=a or c
tggagagctgtgaaaatacctgtgtactgattatatctgagccaaaaggggctgagctacngtttattcctaaattctgggaattttcaagctaagctgtaactcagtttcttgttcagca

SEQ ID NO: 16305 - DNA, 121 bp, Artificial Sequence
  Synthesized
  misc_feature (61): n=t or g
agttttgaaatgcagactgtgcttaagcaaagcagcttttttccactcagtttctcagctnggcaaccaccttaaagagccatacatcacacagccctggttgtagccccagtcccacaag

SEQ ID NO: 16306 - DNA, 121 bp, Artificial Sequence
  Synthesized
  misc_feature (61): n=t or c
tttctgctgcttgaatctgattctgcaagaccttgcacacatgaatagtctcactaaacangacaggactgctggaagagttggcaggtctggagccagaatgtgtcacagttacatgaca

SEQ ID NO: 16307 - DNA, 121 bp, Artificial Sequence
  Synthesized
  misc_feature (61): n=t or c
ctgtgtcaacagggggcatgaagatcagcaccaggcaaaggtgagcggagtgcacaagaangaggcagagacctttgggacaaagagttccccacccgtggggccatcgctgcatggacgc

SEQ ID NO: 16308 - DNA, 121 bp, Artificial Sequence
  Synthesized
  misc_feature (61): n=a or g
tctgcagtttttgctttttgttagtttcctgttacagtagcaagataatagataagcatangaattgaatacagtatagattaagagcaaattaaatcttaaaatgtaagtattatcttca

SEQ ID NO: 16309 - DNA, 121 bp, Artificial Sequence
  Synthesized
  misc_feature (61): n=a or g
tgtaaactgaattaccagtggagcaaaatcaaaagaccgataaaaagcactcaggaagaanaaactcaaataagaaattaacttgagtagttttcaagagtaaaacaagctttatgcattt

SEQ ID NO: 16310 - DNA, 121 bp, Artificial Sequence
  Synthesized
  misc_feature (61): n=a or g
aaagatatttgtagctggaccaaagatggagaaaatgcttatacaaaattggtgggtgcantgatgttcttggctgagcacaaatagacattaggattggattaggatcagcattttcatg

SEQ ID NO: 16311 - DNA, 121 bp, Artificial Sequence
  Synthesized
  misc_feature (61): n=a or g
attaactcaggtgaccttaactgggctgatggtaatgcctttgtgcagaagaaactgtacntaagggaaacagcttagtatttactagcatactgaagaaaagaaaaatgacctttcttaa

SEQ ID NO: 16312 - DNA, 121 bp, Artificial Sequence
  Synthesized
  misc_feature (61): n=t or c
ctactcttccatatatgtacacgtagctgtatgaaacatcagaaatgcactgagaaaatanagaaagttctgaaatccccactcacttcccaggtgaagcgccagaataagagagggcccc

SEQ ID NO: 16313 - DNA, 121 bp, Artificial Sequence
  Synthesized
  misc_feature (61): n=c or g
ggttaatggtgtggtttcagaaggagttctgcagtcatggaatgggtgagctgttctgtgnctgtttgctgcagtatgaggtgggagtgagaaacagcagggtgaaactgccctacagctg

SEQ ID NO: 16314 - DNA, 121 bp, Artificial Sequence
  Synthesized
  misc_feature (61): n=a or g
ttctggggggcatcacctgccatatcgttgcatgggattgctgcggcagcactgcagggangtggagtaggggttctgaaggttgagctgttttcactgggcagtgtttttcctctctgaa

SEQ ID NO: 16315 - DNA, 121 bp, Artificial Sequence
  Synthesized
  misc_feature (61): n=t or c
caacactgcgggaagaaattcatatgaaacactatggaaatgacaaataataccacacacnttaaaacagtggatctgtgctgtattcactgctttgttggtggttagtcataatgaaaag

SEQ ID NO: 16316 - DNA, 121 bp, Artificial Sequence
  Synthesized
  misc_feature (61): n=t or c
aattaaaatgatgcagattagttcagggcgcaccttcggtgaaaactctgttgtttagaanatgatggtgacatcagtgcagctaagcctttggtttaccaggctgaataaacaaaataaa

SEQ ID NO: 16317 - DNA, 121 bp, Artificial Sequence
  Synthesized
  misc_feature (61): n=t or g
ttcacattaattgtgcagaaaggatgataaagttatttttagcgttaggataatagagcanaagaattactaggtatttagaaaaaagcatgcaaaggaaagcaatttgttcatctatact

SEQ ID NO: 16318 - DNA, 121 bp, Artificial Sequence
  Synthesized
  misc_feature (61): n=t or g
ctggtaaaaccaggacacataaagatattcacaatgtgcttttctaaacagtattaagatnactttttctagtggtagattgcatacgtattttacatgggaattgaagagaagattaatt

SEQ ID NO: 16319 - DNA, 121 bp, Artificial Sequence
  Synthesized
  misc_feature (61): n=t or c
ggctgaatttgtaccactataaaggataagagaatctatattcagggaaggctatattacntaaatatgaaaattagaaagtcactcttcctatgatccctacctattcaatggaaaaaga

SEQ ID NO: 16320 - DNA, 121 bp, Artificial Sequence
  Synthesized
  misc_feature (61): n=a or g
tttgaaagtaactttaagtactgggcacttcctcactcaggaatgatcccattctttgcanagaaacacattgaagtttccagtgcagaagagatttcagagacatgaagtagctcatgct

SEQ ID NO: 16321 - DNA, 121 bp, Artificial Sequence
  Synthesized
  misc_feature (61): n=t or c
gataagaaaactttcttttccagtgaaacaaaacaactaccacagatgttctgaccaacangtagtcacaaaattaaaaggtaatgtaaaataattactataacacagctatgatacttaa

SEQ ID NO: 16322 - DNA, 121 bp, Artificial Sequence
  Synthesized
  misc_feature (61): n=a or g
tcccctttgtcccatgccacctgcccagtgtgtacaagcagtcctattgcctgcctttctnagcaggcccaagatcctcctcagtttctcctgctctgaaatgaaaatattgctgatatct

SEQ ID NO: 16323 - DNA, 121 bp, Artificial Sequence
  Synthesized
  misc_feature (61): n=t or c
tgtttacatgatgcaaagtaacttgctaggctgtgaccacctgatcacatggtcaaattcntttgcttatggtaacacccaattaattctacccctatgatgcactggtgttactaccttc

SEQ ID NO: 16324 - DNA, 121 bp, Artificial Sequence
  Synthesized
  misc_feature (61): n=a or g
agagattttgctttcaagttgacaggcttacaatgaacaagttatctgaccttcctgaaancaggaaactttgattcctggaataatcttagagaagtttcattttcttttggaaaagtga

SEQ ID NO: 16325 - DNA, 121 bp, Artificial Sequence
  Synthesized
  misc_feature (61): n=a or g
gaactcaaaagaagtccagaagtgcctatttgtaatcctgtacatctccatgacatatcanggtctgctgactgctaatctatgacccacagaaagatactcctcttacatttacagaata

SEQ ID NO: 16326 - DNA, 121 bp, Artificial Sequence
  Synthesized
  misc_feature (61): n=t or g
tatcatggatgttgcaagccctgccagaagacaggcaaatggtgacacggggagatgcacngtgagtgcaagaaggctcacagcatggaaaagaagagccccttgttgaaccaggactgga

SEQ ID NO: 16327 - DNA, 121 bp, Artificial Sequence
  Synthesized
  misc_feature (61): n=t or c
tttgagcactgcatgccaacggctcggctgcctgtcatggaaactacaggcagccaaaggngaccaaggaatgcttttttccctaacttctttcatatacaaaaatcccaggcacttctga

SEQ ID NO: 16328 - DNA, 121 bp, Artificial Sequence
  Synthesized
  misc_feature (61): n=a or g
tggtaggatattagagcattcttgcagagagcactggaagagctatggtgtttcaggcagnctaaaaaatagacagcaacttgaagtgttgcttactagcaaagtagctatggatgataag

SEQ ID NO: 16329 - DNA, 121 bp, Artificial Sequence
  Synthesized
  misc_feature (61): n=a or g
gaatagcttggggggtggtcattaaaaacatgtgtgtctatcttcagttctgagatttgtnattagcaagaatggacaggagagactttgtgaggctcttcattttcttactgtacacatt

SEQ ID NO: 16330 - DNA, 121 bp, Artificial Sequence
  Synthesized
  misc_feature (61): n=a or g
aattcatttaagaccttcctctttaaaaagatctctgcaagcaggaaaacgcagcatcctnatgttcataccagttcccaataaggaattaagtagcaaaaactgtgtaattagggaaaaa

SEQ ID NO: 16331 - DNA, 121 bp, Artificial Sequence
  Synthesized
  misc_feature (61): n=t or c
tcttttttgtctctccatgttggcaattactcctgcacacacacccacattgccagcagcnccaaacaatgttttttcccactatttcagttctttctttctgtgtcatgatatataccag

SEQ ID NO: 16332 - DNA, 121 bp, Artificial Sequence
  Synthesized
  misc_feature (61): n=a or g
gcagccagagaaatacaagtgacatacctaaacaaaatggccagttagtgaagggcatagngcaatctggtcaggcatttgacagacaatcagaaatacacacatgcacacaaaacactaa

SEQ ID NO: 16333 - DNA, 121 bp, Artificial Sequence
  Synthesized
  misc_feature (61): n=a or g
taatactattggctttaggagcaagataaagtctgatgaaatacttctggtcctcaacacncacaaaaagcttgctttaatcaataatggctcaatggactcatagtttctgtgaagtatt

SEQ ID NO: 16334 - DNA, 121 bp, Artificial Sequence
  Synthesized
  misc_feature (61): n=a or g
cagctaagctttagcctcatgcttagcttttgaataattgatgggattcataggccttcanctcatggctgccgtttaacatatgctttagcactgtttggaatgaaaggttaagactgtc

SEQ ID NO: 16335 - DNA, 121 bp, Artificial Sequence
  Synthesized
  misc_feature (61): n=a or g
aagaagaaaatagtattaccccttctggcaatgaaaagtgtgctggaatgtatttttgctntaaagaaaactaaataacagcaacaataatgatgagtagtaccaattaaacccaatcact

SEQ ID NO: 16336 - DNA, 121 bp, Artificial Sequence
  Synthesized
  misc_feature (61): n=a or g
cttgtctggtgctgtgctttggatatttgatgaaaatgaatcagtgggttagttgttactnagctgtacttacacagggccaagagcttttcagcttctcatgcagacctgcctggggagg

SEQ ID NO: 16337 - DNA, 121 bp, Artificial Sequence
  Synthesized
  misc_feature (61): n=t or c
accactcccaacgagccaagcataggaaatgtatattttaggaaaggaaaaaggatgcccnaatgcttttgtggattgaagtctagcaagttttcttacaattctgtgctggtgcctgtgg

SEQ ID NO: 16338 - DNA, 121 bp, Artificial Sequence
  Synthesized
  misc_feature (61): n=a or c
tgcagcgctcactccatccactgcgctgcacacaaactcatccctcggattgggcattggnccccattggaaatggcagcttcctgcagacttccagtaccttatgtatcatgaaacctaa

SEQ ID NO: 16339 - DNA, 121 bp, Artificial Sequence
  Synthesized
  misc_feature (61): n=t or c
ctgccactgatttctgagcatctcagcaacaagcagaacctttggaaagcatcctccagancccagcttcctcacccaatccctctttgctaagagacacatacttccatacacccacgcg

SEQ ID NO: 16340 - DNA, 121 bp, Artificial Sequence
  Synthesized
  misc_feature (61): n=a or t
ttaaaatttttgctctactgaactttatcagatatacgagcagcaaacaatgcagcctccngccatccaaatgctagatgctttcctgaactgtcaatgataacctacttctaatgtgatc

SEQ ID NO: 16341 - DNA, 121 bp, Artificial Sequence
  Synthesized
  misc_feature (61): n=c or g
tgaaaattccacacattcataggaaagcaggaagacctgtcacttattttgcacgtgtaanagcatacaaccccatggtaggagacacaggagaagactgcctagcttggagaagagaagg

SEQ ID NO: 16342 - DNA, 121 bp, Artificial Sequence
  Synthesized
  misc_feature (61): n=t or c
ctgcattggaaaaagcaaagtgttttcaagagctcacattggattggtcatgtttggaggngcgtgagatgcaaagacaaattccctccttcacttgggctctaagcagcagcatcgcttt

SEQ ID NO: 16343 - DNA, 121 bp, Artificial Sequence
  Synthesized
  misc_feature (61): n=a or c
aaggggcttcacagagcaagatgttctgagagcctcacaaagaaagggctttagaagaggncagaattcattcatgtgctgttcgggtatataacatggtctcagctctgggaattgaatg

SEQ ID NO: 16344 - DNA, 121 bp, Artificial Sequence
  Synthesized
  misc_feature (61): n=a or g
gggctgtagtgctaagggtgccaagacgagagtgtgtgggtgatgtggggctttgtccctncttggctgacagcgggctgtgaagaagtgttgaagtggcagcatgagaggtcaagttatc

SEQ ID NO: 16345 - DNA, 121 bp, Artificial Sequence
  Synthesized
  misc_feature (61): n=t or g
aacatgtccaactctgttccgccctaaggaagaatccctcttgttaatagactttgtccanctgggagctttaggaaatttgaagattcactttagtatctcttttaagaagagtttacta

SEQ ID NO: 16346 - DNA, 121 bp, Artificial Sequence
  Synthesized
  misc_feature (61): n=c or g
ttctcttaagaactcaaaaatctgcccaaataggtcatcatttgtccaacaggaaatctanagaatttaggaattagggattaggcatttcaagtccagtatttccctctcccacaagtgt

SEQ ID NO: 16347 - DNA, 121 bp, Artificial Sequence
  Synthesized
  misc_feature (61): n=c or g
tcgttttggcattgtgctgccacctgtgggcatgcacacatgtcctctctgcatttacctncccagttccaggctgtgatgatgtatgcattgactgatggtaaatcaggaggccttatga

SEQ ID NO: 16348 - DNA, 121 bp, Artificial Sequence
  Synthesized
  misc_feature (61): n=a or g
ctcagaggttgctgccaggggaaggagtcactctgcagctggcgtctcgtttgtaccgtgntgcaaagtcaggggagagcgaaatatagaatttatcacgttaacactgttgcgcttttca

SEQ ID NO: 16349 - DNA, 121 bp, Artificial Sequence
  Synthesized
  misc_feature (61): n=a or g
ctttgtcaccttgtaggcttcttaacaaaccccagaacaagcagggttctctcatcttgancttaggggtcctgaacttggctggaagcacggtgaggacaaggaatagctctgccctgct

SEQ ID NO: 16350 - DNA, 121 bp, Artificial Sequence
  Synthesized
  misc_feature (61): n=a or g
gctgatcactagcctgcttgatcggaaaattgtagttattaagtcacattcccatgggatncattaagtcttggcaaaggcagtagctgactgaagaacagccaaatcttattttggccac

SEQ ID NO: 16351 - DNA, 121 bp, Artificial Sequence
  Synthesized
  misc_feature (61): n=t or c
aaataccgaatgctttttaagagcgctgcttttgtgcaatagaaaggattttccaaatttngaacttagataatttctctggcatttgtggatattagtctttaaggatatgtttgagttg

SEQ ID NO: 16352 - DNA, 121 bp, Artificial Sequence
  Synthesized
  misc_feature (61): n=t or c
tacgtaacccagcaaatttctagtctttactgttgcaagtctcattttacacaggagattnttctgatttttcagggatgaatcagctcctatgtaagcaacatgacttcggcatgtgaca

SEQ ID NO: 16353 - DNA, 121 bp, Artificial Sequence
  Synthesized
  misc_feature (61): n=a or g
aaaaacaaaagcaaagtcttttgtgtcctggtaagaaaacagagctacatctgccattgangagatccatcgtccttagagaaagagaatcccagagtataaggctgtttatatgggttcc

SEQ ID NO: 16354 - DNA, 121 bp, Artificial Sequence
  Synthesized
  misc_feature (61): n=a or g
ccatgttggatttatgttctcaactatgatcacagattctagttcctatttacttaaggtncactgcgttgctcttagtgcatgctaatgtgcagtgagcattcttgtatgtgaagaaccc

SEQ ID NO: 16355 - DNA, 121 bp, Artificial Sequence
  Synthesized
  misc_feature (61): n=t or c
aacagaaaaggcaaaaaatgccaagaaatgtggttcttgctttcatcttccccacctccantaagttcttatagaagcacctgggatttcattcagcaggtatttaataaagtgaatgcat

SEQ ID NO: 16356 - DNA, 121 bp, Artificial Sequence
  Synthesized
  misc_feature (61): n=a or g
tgataggagctgtatgaagggatgtgtgcattggatcattttaacttctgatagttgtttngctttttctactttggaaccaaattgtacaaacatgtgatactgtttcatggatttttta

SEQ ID NO: 16357 - DNA, 121 bp, Artificial Sequence
  Synthesized
  misc_feature (61): n=c or g
ttatttttttattttgccctctcctttagttctgaaaagacaaatacagtgagctaatcantttcagctataagtatgcttatttgctctgtttgaagtgacataaaacgctgaagtatgc

SEQ ID NO: 16358 - DNA, 121 bp, Artificial Sequence
  Synthesized
  misc_feature (61): n=t or c
aagccaaatgttttcttcatcggtggttattttttaaatggttgtttacagaccacttccntgtgataagccctctccatgctgtagctgagtcacaatagccatgaagaggctgtggttg

SEQ ID NO: 16359 - DNA, 121 bp, Artificial Sequence
  Synthesized
  misc_feature (61): n=t or c
tatttatgttatcagacacaggtgcgtatctttaatgaatgtaaaactttcctcgagcacncatattgactgtgagttaagctcagaaaaaaatcctaaaaatataaaacaaacttcatgg

SEQ ID NO: 16360 - DNA, 121 bp, Artificial Sequence
  Synthesized
  misc_feature (61): n=t or c
tcccaaggatgcttttcccttgctgtgtgagtttgttgttgcacaggtccatatcccaccntgatgtgctgccctttagcatatggttgtatttccataaagcgatgcttgaggggaggaa

SEQ ID NO: 16361 - DNA, 121 bp, Artificial Sequence
  Synthesized
  misc_feature (61): n=a or t
caaagtcttctagtagcctagcactgcttctcaagtcagcttgattgtcctggctgggtgngttttcagcaccttcatttcaggaaaactcgacaaatttaatgagaactattggtgatgg

SEQ ID NO: 16362 - DNA, 121 bp, Artificial Sequence
  Synthesized
  misc_feature (61): n=c or g
acatccagggttcctgggtcttcaagtgatcatgattcaatggctgaaaatttaaatgaangtgcagtattcatggctgactgtgtaggtaaagagaactagaaagaaggaataagaagat

SEQ ID NO: 16363 - DNA, 121 bp, Artificial Sequence
  Synthesized
  misc_feature (61): n=c or g
tatttgcactggaggagcatcctgaaaccatctaactggaaggaccattgtcatgattttncatgagttctgtagcttctaatttccttaacgctaatgactgcagcctgctttggcattc

SEQ ID NO: 16364 - DNA, 121 bp, Artificial Sequence
  Synthesized
  misc_feature (61): n=t or c
tgttagatctacagactgcctaggcatgttaaggatatatagtataatgcatatttatggnactcagtcacaataaacagctggtttgcgtgcatggaatgtcattttgtgttcagtaatt

SEQ ID NO: 16365 - DNA, 121 bp, Artificial Sequence
  Synthesized
  misc_feature (61): n=a or g
agctatactgaaatattaaaataacaattaaaagaacccatctcattgaaatctgaaaccngactgatgcaatatgttgtacacagaatatttcttggacccttaatgtcactgacctgta

SEQ ID NO: 16366 - DNA, 121 bp, Artificial Sequence
  Synthesized
  misc_feature (61): n=t or c
acagtttttgatgattccttgtaaaagccacagtggtgcttttaaaaaatcttgttttaanagcagatttagtcattatgaagatctgtttttctattacttgtcctaggcagatatttta

SEQ ID NO: 16367 - DNA, 121 bp, Artificial Sequence
  Synthesized
  misc_feature (61): n=t or c
acttaacaacagtcctaaatgctgactgctgggcctgaactgatgcttctgtctggtcatntgcctgttagagaacatacaaatgtctttattctttcaaggaagctagtaggatctttgt

SEQ ID NO: 16368 - DNA, 121 bp, Artificial Sequence
  Synthesized
  misc_feature (61): n=t or g
acacataacctgatgttgcttacgttatccaaattaaagcaccaaacatgtgatgcactgntgagccagggtcttaatttctactttccatgtcagatttccaccaagccatctattatag

SEQ ID NO: 16369 - DNA, 121 bp, Artificial Sequence
  Synthesized
  misc_feature (61): n=t or c
cttcccaagatggaaaatatggattatgggctatatttgacctaccctgtattgttttttngctatctagatccttactatctggccattttcaattggacttggattttagaatgggaaa

SEQ ID NO: 16370 - DNA, 121 bp, Artificial Sequence
  Synthesized
  misc_feature (61): n=a or g
ttaacatcacctggttcacacactcggatccacaacatcttactgtacacattttcataangcaaaatttagactggtttactcgcatgcataaccagttccatgtccatatccacctatg

SEQ ID NO: 16371 - DNA, 121 bp, Artificial Sequence
  Synthesized
  misc_feature (61): n=t or c
ggctgcacaaggtcagggctcaggcagtagcagccaagggcagtggtataggatgtcctcnccactgtggcttggcacctcagctcactgtgagcagggagaagatcacacagactcacca

SEQ ID NO: 16372 - DNA, 121 bp, Artificial Sequence
  Synthesized
  misc_feature (61): n=a or g
gttgaagagcatcttttgtgtaatgtccacaaagccaagacagattgactctgtttacatngtttctagataggtaacattgttcaggttcttagtactgctcactttttgaaacaataat

SEQ ID NO: 16373 - DNA, 121 bp, Artificial Sequence
  Synthesized
  misc_feature (61): n=a or g
tttcttgcaaaatatctagtcttgaaaaccctctggatttggcacttgtcccctgaaaacnatgggaaagccaagagggagcctgagctgccattgtgtgagttgagcaagatcaaatggg

SEQ ID NO: 16374 - DNA, 121 bp, Artificial Sequence
  Synthesized
  misc_feature (61): n=t or c
tctctgcacgatgcagtgggatgggggacatgtaaattcgtgagccacctaaagtcttttntcagtttctgtgatggacccttaattcagtgctcccatcagaggtgatgtacatcaggag

SEQ ID NO: 16375 - DNA, 121 bp, Artificial Sequence
  Synthesized
  misc_feature (61): n=a or g
tactctttactcggacaaatttatattaggcttgtatatgtatcgtgcctcaagttataantgtatggggagaagatacatccatcaaattggaattaaatctcaaagcttctatgagaag

SEQ ID NO: 16376 - DNA, 121 bp, Artificial Sequence
  Synthesized
  misc_feature (61): n=t or c
tctcttgtgacagcaccagtccctgcactgctcagcaatgaaccatagcagggaactatcnggctgacaaacaagctgagcaagacaccaactatttcaggactcgtccatttctttgaat

SEQ ID NO: 16377 - DNA, 121 bp, Artificial Sequence
  Synthesized
  misc_feature (61): n=t or c
atttcctagaatctatccctgcgtcaagcccagtaggtgtggattacctgattttgtcacntttttaaatatctaacctcgcatttacatgtattaaaacaggcattcatgtgagctgact

SEQ ID NO: 16378 - DNA, 121 bp, Artificial Sequence
  Synthesized
  misc_feature (61): n=a or t
gccttatttttaatatttctgctgcctttctcaatgtcatattctaaaccttgccgacaantttgcaaaaatttagaaaaggaccatcccttcactgtaagaatcatttttttgctcattc

SEQ ID NO: 16379 - DNA, 121 bp, Artificial Sequence
  Synthesized
  misc_feature (61): n=t or c
cagcaaggcgcacgctgacagtcacaaggtcataatgcaacatccatcatttacacctcantgggagttactgagaaaacaggacatgcaggagccagcacgaggtgggatgtcttgaagg

SEQ ID NO: 16380 - DNA, 121 bp, Artificial Sequence
  Synthesized
  misc_feature (61): n=t or c
attcacataggggacaaatgcgtgctgtgctgaccatcactagctctacactcattgctcnccgatgagcacatgtgttctaggggtaatcttacacaaggtcacagaaggctgacactgc

SEQ ID NO: 16381 - DNA, 121 bp, Artificial Sequence
  Synthesized
  misc_feature (61): n=a or g
agatttggcacaactaagtaaggaaaggtggctcctttcagtctcccaggatgtcatgacnttttcatgggtttattcaactgctgcttatgctttgaagtacataataaaagctttttga

SEQ ID NO: 16382 - DNA, 121 bp, Artificial Sequence
  Synthesized
  misc_feature (61): n=a or g
ggctttgtgctgttgcagctcctgggatgggagctctatgccctcactgatgcccttcccnaaaactcctgtctgcgctgctttcggtgactttcctcacttgggcagccccacagcgcac

SEQ ID NO: 16383 - DNA, 121 bp, Artificial Sequence
  Synthesized
  misc_feature (61): n=t or c
ctcagtctctttctatctgcaggacttttcctacgatgactcaaaggtggagtttaatgtngatgccccaaatggagtggtgatggaaggctacctcttcaagagagccagcaatgctttc

SEQ ID NO: 16384 - DNA, 121 bp, Artificial Sequence
  Synthesized
  misc_feature (61): n=t or c
ggcagaggcatgaagaagctttcaacggcaacaccgagccagatcagctcagactcattgnaaagctgcagcctcactcatcccagagcaggaatctctcagggacctttcctaccaggat

SEQ ID NO: 16385 - DNA, 121 bp, Artificial Sequence
  Synthesized
  misc_feature (61): n=t or c
caaataatggtgtatccataacttgcctcatttgactctgttttacagagaacagtgctgngctacttattagtgctttgctgttatcccttccctgagtggaagaagctttaaatcatgt

SEQ ID NO: 16386 - DNA, 121 bp, Artificial Sequence
  Synthesized
  misc_feature (61): n=t or c
ctgcaagctgattgtgaagtttacagctaggttcttgaattttgatgtttttcctaaaccnattctatagaaatgaccttctgtttccattcaggattgatcaatttgagtataatttctg

SEQ ID NO: 16387 - DNA, 121 bp, Artificial Sequence
  Synthesized
  misc_feature (61): n=a or c
agaattactttacaacattgtcaccatgtcctttgcacactttagtgtcttttgtttgtanatcatctcaagggaactcacaaaggcacttctggcagtctctgatagaggcaggaatttt

SEQ ID NO: 16388 - DNA, 121 bp, Artificial Sequence
  Synthesized
  misc_feature (61): n=t or c
tctttggcttgctcctaatttataccaggagaagcacactcacgtatacattaattgcccncattaatactgagaacctccttgccgagagaccccatttcatattctgcagcttgaaggg

SEQ ID NO: 16389 - DNA, 121 bp, Artificial Sequence
  Synthesized
  misc_feature (61): n=a or g
atttttagtgttcctttgtttgcttttctttttatcaacttctttcactgaattgacagcnagtgttggctgttgcagttagctcttcgtggatctgtctacattgaaggactggctacag

SEQ ID NO: 16390 - DNA, 121 bp, Artificial Sequence
  Synthesized
  misc_feature (61): n=a or g
caaacatcctcctacaggctgatgccccagcagaaggtgcctcctgaaggggtgggaagantgcaagcaggaggaaccatctcttcctccaaaactttctggagttcaattaaagctgtaa

SEQ ID NO: 16391 - DNA, 121 bp, Artificial Sequence
  Synthesized
  misc_feature (61): n=a or g
gctatctcagctatgccaaatgaaccttttacttaaggttgcagaaggtaattcaccaggnccactgagacttatcccctgctaatacagatgtaaaaatcactcataaacccacctcagc

SEQ ID NO: 16392 - DNA, 121 bp, Artificial Sequence
  Synthesized
  misc_feature (61): n=a or g
aattaaatgcagtgtgcaacatatcagtgaattgtaaaagtacgtgtgaagctgttggaanctgtgttgccaaatggagaatgaaaagtagctccattttaattggagaagtaacacaagt

SEQ ID NO: 16393 - DNA, 121 bp, Artificial Sequence
  Synthesized
  misc_feature (61): n=t or c
tgaacattaccaaaccaggttgatttcacatctccacagcccatggaagtcatccctctgngaaccaaagacatattgtaaaatcaaacaccctaagaatagctcattaaatagaacaccg

SEQ ID NO: 16394 - DNA, 121 bp, Artificial Sequence
  Synthesized
  misc_feature (61): n=a or g
ttcagaaagctaataatgacgagtttgggaagtgattcttggggcagaaaagtggcaagangaaacttgggcatgcagtatatcttggtcataggaacagggcctgaaactgagggtgcca

SEQ ID NO: 16395 - DNA, 121 bp, Artificial Sequence
  Synthesized
  misc_feature (61): n=a or g
ttggagaaggccatttgccaaaaatcaaactatagtaacacatcttgtgtacgagacctcngagaagatgactgctttcccaacagttcaagctggttcacagcattagaacgtaccccaa

SEQ ID NO: 16396 - DNA, 121 bp, Artificial Sequence
  Synthesized
  misc_feature (61): n=t or g
ccatttgtggagaccttccacgctgatgttaaagtggagccatagagcaaaagacataacncagaacaccacagaaattcaaccaatctacttctagcccttcactgtttcacagggacag

SEQ ID NO: 16397 - DNA, 121 bp, Artificial Sequence
  Synthesized
  misc_feature (61): n=t or c
atctgtatataacttccccacagatacagaaataacccttgcttgtgttgcctgccacttnctgagggcagttcccagaatggatgcttggagccagaagctgctcacccactgcctccta

SEQ ID NO: 16398 - DNA, 121 bp, Artificial Sequence
  Synthesized
  misc_feature (61): n=a or g
ggcagaggcaactgcaatgcctttggctttccaagaaaatgctcttcagctataggtgtcntttaacagcttctagtttttggctcacagagcagtgtgccaggacctggcaaaatcccac

SEQ ID NO: 16399 - DNA, 121 bp, Artificial Sequence
  Synthesized
  misc_feature (61): n=t or c
ggttgttccgtctccaaggtccaggcttgcgtttctcttgcaagaaacacgttcccactcnctgactgcatgttattctcgaggcagcttttactcagcctttatgttgagaaatgaaccc

SEQ ID NO: 16400 - DNA, 121 bp, Artificial Sequence
  Synthesized
  misc_feature (61): n=a or c
gtcagctggtatctgcacacctgcactgcaccaagctaacaggttaaactgccagctctgncatgagcagctctgtgaccagaggctgtacccacgctccactgcaatgtgcaggggtgtt

SEQ ID NO: 16401 - DNA, 121 bp, Artificial Sequence
  Synthesized
  misc_feature (61): n=t or c
gctatttattttactgtattttcatgtttcttcatctaaacaactttctcatatttaactntacagatagcatcccagaattacatcagtgaactgaactatgatggtataaatatatcct

SEQ ID NO: 16402 - DNA, 121 bp, Artificial Sequence
  Synthesized
  misc_feature (61): n=t or c
aactcgcatgtgaagaactagttgtagagtggttttagagagtcagagaacaggtattggnagtggtctcagtaagtaacaaatggctggcagttacaggcaggaagattggcatttttct

SEQ ID NO: 16403 - DNA, 121 bp, Artificial Sequence
  Synthesized
  misc_feature (61): n=a or t
ctgaagttaacccttggttagtcttcattccgtgaaacagaggtatggttctccacatgangacatccctagagcagtaacctttcctctcctccccagcgagcagagctcacactgtgtg

SEQ ID NO: 16404 - DNA, 121 bp, Artificial Sequence
  Synthesized
  misc_feature (61): n=t or c
aaatggggtcttccagtaaggaaatatgaatcagatgaagaggtgatttcccctctcttgnctaacctgtcctatccctttccagcttctacccacttcagctactagattcatgctttaa

SEQ ID NO: 16405 - DNA, 121 bp, Artificial Sequence
  Synthesized
  misc_feature (61): n=t or c
gtgtttggccctaagctctagcagctggttgagcttctgaccatctctaattaccaaatanatgagaacccagcatttcttcttgcagctgctacacatggggttgcaatgctggcccttc

SEQ ID NO: 16406 - DNA, 121 bp, Artificial Sequence
  Synthesized
  misc_feature (61): n=a or c
atcaaccatatatttactaatactgaattatttgccatccaatccatcctcccaacccctncctctcccccccatgacaactttagtgaggggctaataactaggattatttctttttgaa

SEQ ID NO: 16407 - DNA, 121 bp, Artificial Sequence
  Synthesized
  misc_feature (61): n=t or c
atgataataacaaacgaaatgtagtccactagttgtaccaacacatctcatccttattcanaagaaattcacaccctaatgattatccttaaatataaatatatatgtatatatctgcttt

SEQ ID NO: 16408 - DNA, 121 bp, Artificial Sequence
  Synthesized
  misc_feature (61): n=t or c
aagccaaaacctttttgtgttgtgtgtgtgtgtgttactctgcttacagttggttttatcntaaagaaaaattaatgttacacccatctgcatgcacttagtcttgtcttccaaaatgttc

SEQ ID NO: 16409 - DNA, 121 bp, Artificial Sequence
  Synthesized
  misc_feature (61): n=c or g
tctgtggtttgctgcaatgcagcagcctcacggttcttccatttctttatggacttggttncctcaaacccttcaaaactgagggcagtcggttctgcaaatactagtagcagcacataga

SEQ ID NO: 16410 - DNA, 121 bp, Artificial Sequence
  Synthesized
  misc_feature (61): n=t or c
aactttctcatccgttttcatttgtgtttttatttctgcatgttctttctggctcatattnctccttcctttctcataacctgaaatcctattcagggcatcttgtgactttttcagagta

SEQ ID NO: 16411 - DNA, 121 bp, Artificial Sequence
  Synthesized
  misc_feature (61): n=a or g
atcacttggagcccaggtttgcagaacctgagatccgagaccttaaaagacatcggcatgngtattggaaaacacttgggcatgctgatgatgggttgatggttggactggatgatcttag

SEQ ID NO: 16412 - DNA, 121 bp, Artificial Sequence
  Synthesized
  misc_feature (61): n=a or g
tattacatttttcttgttttccctgaacagaaactcctttcatatattgactttattactntaaaatgcttttcttgttcacagcaagatgtgcctttcttatagcaaagagtaataatca

SEQ ID NO: 16413 - DNA, 121 bp, Artificial Sequence
  Synthesized
  misc_feature (61): n=t or g
cttaaccttttttccttctattccttctccttgcattttgcaccattattggtctcgagtnctaagcatctggctttgtccttccagcaactgaccttgtttcactggcttgtaaggaaat

SEQ ID NO: 16414 - DNA, 121 bp, Artificial Sequence
  Synthesized
  misc_feature (61): n=a or g
agaagccaaattagtatgtctgtcattcacccctgtgtaatctaatctgcagaaagcaatnctgcacaataatacaattaaaatattcagtcttctgttaacacaagaaaaaactcaaaca

SEQ ID NO: 16415 - DNA, 121 bp, Artificial Sequence
  Synthesized
  misc_feature (61): n=t or c
gacagcccgtgggcattcagcatctcactaggtgtgcacctcctctcatctcagctggctntgaaaatttggttcagtcagcagcagcttctgcagtggaagtgtctcgagcgtctgggag

SEQ ID NO: 16416 - DNA, 121 bp, Artificial Sequence
  Synthesized
  misc_feature (61): n=t or g
ctaggaacagaccaggaatttagggtccaccatggtcagagtagtattcaatgaccacctngagatcaccagtaatatagacgtcaccagccttacagtactgcacatggcaagtattaaa

SEQ ID NO: 16417 - DNA, 121 bp, Artificial Sequence
  Synthesized
  misc_feature (61): n=c or g
tgggagctgtcattgtgttccaatctggactgaattttcagctcacggaatctcaaaagcntgattttcaatcagctctttacagtctgatttgcaggttaatgagcacaggatgaagttc

SEQ ID NO: 16418 - DNA, 121 bp, Artificial Sequence
  Synthesized
  misc_feature (61): n=a or g
atatttaaacagcacgaaatctaaactatgtccaaagcatttatagacatctatgaccaantaccctccgtgtgcttcactgataaggaaccacaaggcctttgaagaatattcatgaaag

SEQ ID NO: 16419 - DNA, 121 bp, Artificial Sequence
  Synthesized
  misc_feature (61): n=t or c
tctcagagccttaacctgtgtccagctttcctttggaacagctctttactttctgaaacangtttcttgccatctttttagatcttttttccaatcgactttattttcccagttaatcttt

SEQ ID NO: 16420 - DNA, 121 bp, Artificial Sequence
  Synthesized
  misc_feature (61): n=a or g
tcagcaaggggatagtggttcctctgttcgtcaaacactctggctgctgagccatggaggngaagatgtcacctgaacaaaatgcagaggatgaggaccgtggtgttgtgggtggtgaaga

SEQ ID NO: 16421 - DNA, 121 bp, Artificial Sequence
  Synthesized
  misc_feature (61): n=t or c
agtctggggaatgaacattatattttgttaaaaaccactagtgtttctacagcacatattnaataaagataacttacgtctggctgaaggttaaataccttatagctctgcacttaagtgt

SEQ ID NO: 16422 - DNA, 121 bp, Artificial Sequence
  Synthesized
  misc_feature (61): n=t or c
cattatatcccacagagaaagggcaaatacagttcacccttcaagccaaggatactgctantgaaaattcagatgtggatctatcagtgtcagaaacttaaaaaacattgacttccatatg

SEQ ID NO: 16423 - DNA, 121 bp, Artificial Sequence
  Synthesized
  misc_feature (61): n=a or g
tgtccagagcattgctgaacaccagtacagcacatgtgaaacagcatatatctaaaaaagnttatgcattctcacatcagattttatgtctccaagatataggagcctgaaggaaggtctc

SEQ ID NO: 16424 - DNA, 121 bp, Artificial Sequence
  Synthesized
  misc_feature (61): n=a or g
aagagcacaggttcatttctctcctgcacaataaatattttcttgccttaagaaaacactntgtgtattgttccagacaaagtcttgactcattcttgtttgacctagttgagactttgag

SEQ ID NO: 16425 - DNA, 121 bp, Artificial Sequence
  Synthesized
  misc_feature (61): n=a or t
caaaaaccgctatgtgccctgcaactatcgggggaaaaataacaatttaacccaatgttcngggcaaataaacttgtacctccttctgtctctttgaagtttgtgagcacactgaagagcc

SEQ ID NO: 16426 - DNA, 121 bp, Artificial Sequence
  Synthesized
  misc_feature (61): n=t or g
aggccagcagccatgagtcaccatcaggtcatgaatttacactattttttgtttgctctgngtgtcattttaccttaactatttgcatttcttcagacattcttttcgcttggttaccaag

SEQ ID NO: 16427 - DNA, 121 bp, Artificial Sequence
  Synthesized
  misc_feature (61): n=a or g
gaccctaatcatgctagaaaacatatgccggtcccttaaaggcccataagcttggcagccnttggagggatataacatgcctgttgagtttgggagatagcaccaagttaatctctacagc

SEQ ID NO: 16428 - DNA, 121 bp, Artificial Sequence
  Synthesized
  misc_feature (61): n=a or c
caatgaatgtttccccagaaattcataaaatatatcagtattatttctgtgtactgggacncttgttcttccagctacgtggggtacagtagccatgagaagggcaaggttacccattgtg

SEQ ID NO: 16429 - DNA, 121 bp, Artificial Sequence
  Synthesized
  misc_feature (61): n=a or g
gatactgcttgaaataaaagatctgaaaataaatatctctctccacatcgtacctttctangttggttctcattttttcccattttgactttccaatcttgagtggcaaaattcagttctt

SEQ ID NO: 16430 - DNA, 121 bp, Artificial Sequence
  Synthesized
  misc_feature (61): n=t or c
gctgtgtggtgaacagaaaatacatctctagatgcagtccttagaactccaatccaatgtngcattcacactgagtggcgtggtttagtgatgatgagttgatgattggactgggtagtct

SEQ ID NO: 16431 - DNA, 121 bp, Artificial Sequence
  Synthesized
  misc_feature (61): n=a or g
gccttctatttaattttgtgcctcattccagcattaacactgtaatcatttcaaaagctanctgattcagtttcagccaaaccaccgtatgaaaataaaattaatttagatgtacattgta

SEQ ID NO: 16432 - DNA, 121 bp, Artificial Sequence
  Synthesized
  misc_feature (61): n=t or c
taggctgatgaagagacctaagtagagacagacccctcatgatgtacagggtaagatcttngacaaactaagcagaattagaaggaaaagtgaggaatggaggaccggggtctctgctttt

SEQ ID NO: 16433 - DNA, 121 bp, Artificial Sequence
  Synthesized
  misc_feature (61): n=c or g
cacatggcaagagtatcaaccactgccctgtaattatcttcaggtaacaggactggctgcntgaggaactgaaactgatacaatgagaagactgaagcagatacctaaatgcatgcatcac

SEQ ID NO: 16434 - DNA, 121 bp, Artificial Sequence
  Synthesized
  misc_feature (61): n=a or t
gcttgtgaaatcaggctgaggaagtctgtccttccgctcactcccttcacaagcagaaatnaaagagcctcaatttaaactcttccctgcaggatgtttcccataactccaaaagtggtcc

SEQ ID NO: 16435 - DNA, 121 bp, Artificial Sequence
  Synthesized
  misc_feature (61): n=a or t
actatactaaaaagtaatgcaactgcctgacatacggaagtgtttttcttgatactaagtncttattttgcatttcacctatttattccacatcacacttcatctcacttataaaaaaaat

SEQ ID NO: 16436 - DNA, 121 bp, Artificial Sequence
  Synthesized
  misc_feature (61): n=a or g
gcacagcacccagatgaacggccgcctccggccgtagctgctgtgccagtggtcactggcngatccaatcagtgggacaaaaaccaggccaaggacaggtcctatccctggagcagagaaa

SEQ ID NO: 16437 - DNA, 121 bp, Artificial Sequence
  Synthesized
  misc_feature (61): n=a or t
cagccatatttgatacatcaagataagccagtaaaactgcttttgaacaatttctgcagcntgctggttctgaacttttcggtgcttttgcacataccgccttatcaattgtttgctacac

SEQ ID NO: 16438 - DNA, 121 bp, Artificial Sequence
  Synthesized
  misc_feature (61): n=a or g
aattcagagccaaggggtagtgctgagggcaagaaaatttacaatgtaaacacttagtganctgcattggatactcagacctcttatctagcaaaaatgatttatagaaaacaacttgatt

SEQ ID NO: 16439 - DNA, 121 bp, Artificial Sequence
  Synthesized
  misc_feature (61): n=t or g
acagtggtatcgaccttaggtgcctataaaatattccctccttgcacaggttatgagtaantattgccattcattaacacttaccatttaactcatagactagttaaaaaccgtactagtc

SEQ ID NO: 16440 - DNA, 121 bp, Artificial Sequence
  Synthesized
  misc_feature (61): n=t or c
aactcctgagtaccatgagagccctactgttgtttttcgctacatcaagagcatgtggcgngtctcgagtaggaggcagccctattccacaacatggtgctctaattgtggttactgttct

SEQ ID NO: 16441 - DNA, 121 bp, Artificial Sequence
  Synthesized
  misc_feature (61): n=t or c
cactcagatgaactaacaaattaaaatgtaatatgaaatgataacacagaatattaagatnagtgcttttgatgtgagaaggaattaataaccagagaaaattttgccctttattaaaaca

SEQ ID NO: 16442 - DNA, 121 bp, Artificial Sequence
  Synthesized
  misc_feature (61): n=a or g
ctctcttcattaaagattatgtcagtatcatttccatatacacagaagaattgaaatactntcacgggcttcatactaaagaattattacaggtagaaactcagcattcagagaaactttt

SEQ ID NO: 16443 - DNA, 121 bp, Artificial Sequence
  Synthesized
  misc_feature (61): n=a or g
ccattatgttatcttcagaacaacaaacgtatcattttccaaactgctagattgactgcantctgcctccttctttttgaacctttatcccataaaaaacagtagtgctcatatgtgtcac

SEQ ID NO: 16444 - DNA, 121 bp, Artificial Sequence
  Synthesized
  misc_feature (61): n=a or c
tacaagcaagaagcactccaccaaaaataggggagttaagccaaaacagcctctagaaccnatcagcaatactctctctcctgagatctcagcacaacaatactactattttgaaagtgaa

SEQ ID NO: 16445 - DNA, 121 bp, Artificial Sequence
  Synthesized
  misc_feature (61): n=t or c
ttggcaccaacctctgcctttcatacatagaagacacattgcaaactaaattttccagttnaactcatatcagggcatatattagttagcactgattaatgcacatctgtgccaattaatt

SEQ ID NO: 16446 - DNA, 121 bp, Artificial Sequence
  Synthesized
  misc_feature (61): n=t or c
cataggagaatgttgtcatcttcttacccttagcaaaggcaccagaggcttggaaatgagngagcagtttaggagggctaccaaacgacatctctgcgtgctgaaataccgcattcagtca

SEQ ID NO: 16447 - DNA, 121 bp, Artificial Sequence
  Synthesized
  misc_feature (61): n=t or c
ccgcatcataccttataggtgggtaaggccacaactttcaccagttttatgcctattaagngaataaattctaggctacatgagcccagtagcacctaaactggattgattaagccaaacc

SEQ ID NO: 16448 - DNA, 121 bp, Artificial Sequence
  Synthesized
  misc_feature (61): n=a or g
caagcatttctaatcccacaagcacatccacagagtagacagaacatagaagtgtcccgantttgcaagaaacttcaaaggcagttcctgcgttgtgatcgacctacacatccttacagga

SEQ ID NO: 16449 - DNA, 121 bp, Artificial Sequence
  Synthesized
  misc_feature (61): n=t or c
aatccataaagccaatccaacagaagcccattaaagtccccactgaaaacacacagtatgntgccagattaaaagtgggaaaaatcttgatgattaactcatggcctcatcccagatatga

SEQ ID NO: 16450 - DNA, 121 bp, Artificial Sequence
  Synthesized
  misc_feature (61): n=a or g
cgctgcatcatcttgatgtcatcttttttcagatgagtttccatgtttagtggtgatttgnaaggagcccttgtgccaaatggtggtcactttttgcaacccaatggaaacctgtctaagt

SEQ ID NO: 16451 - DNA, 121 bp, Artificial Sequence
  Synthesized
  misc_feature (61): n=t or g
attttcgcttaaataggggattttcaaagcgcaaatgtgtgtctttcagaataaatttggnattttcaaatcaaaaatggatggttttcccttaaatttggattttcaaagggaaaatgca

SEQ ID NO: 16452 - DNA, 121 bp, Artificial Sequence
  Synthesized
  misc_feature (61): n=a or g
catgtgtatacagagctcaggtggggtatctcacaggaacttctgctggcagcgatgcatnatcagtaggagatagttactatatgtgtaaggaatcagtgtgaaaggattttcaagctga

SEQ ID NO: 16453 - DNA, 121 bp, Artificial Sequence
  Synthesized
  misc_feature (61): n=t or g
tcattgtgtcaatttcctctacttaataggaaaagagtgccttgtaggcaaatgttactgnctactgcatttaaaaggacggcttttcagggaaaaagacacatttctgaatcaatgtata

SEQ ID NO: 16454 - DNA, 121 bp, Artificial Sequence
  Synthesized
  misc_feature (61): n=t or c
agaaatattctgagctttttttttttttttttttgctatgcatttgtcctctgctgtttangtctgacacatttttctcttgcttccaaagagtcaggtttgattatctgtcattgtatta

SEQ ID NO: 16455 - DNA, 121 bp, Artificial Sequence
  Synthesized
  misc_feature (61): n=a or g
aaaaaacatgcacctctctattaaaaatacccttctttgtaaagcataataattatcaacnaaaaccgaccacgtgagtgcttctacaaagaaacaatctgctgttctgcagaagaagtct

SEQ ID NO: 16456 - DNA, 121 bp, Artificial Sequence
  Synthesized
  misc_feature (61): n=a or g
ttaaagcaagagaaccatagactatcaagaacaatgcttgtaccaagcacttgcaccttcntttctttatgaatgattctaaaattgaattgatacatgaaattgtgtgtaccataaatgg

SEQ ID NO: 16457 - DNA, 121 bp, Artificial Sequence
  Synthesized
  misc_feature (61): n=a or t
ggcccaagggttatcacactgatcaggggactgcggcttcaccttgagcgttgcatacagntccgagcaccacagagtaaggacatgaagctgtaagaaagcacccaaaggaaggctatga

SEQ ID NO: 16458 - DNA, 121 bp, Artificial Sequence
  Synthesized
  misc_feature (61): n=t or c
gagggaaaggtgactttgtcatctttgtcatgcccgttgtcatcgacacaaagaaagatanccacacagtgagtaaatagtctagaaaatggaggaagaaactgctgaaatagctgcacag

SEQ ID NO: 16459 - DNA, 121 bp, Artificial Sequence
  Synthesized
  misc_feature (61): n=a or c
tttatttttagaagtaaataatatgggaagaaaagaaaaaagtcccaatttcatctacatntacctatcagatactcttcagtttttataatctcctttgtcttcatattccaacactctc

SEQ ID NO: 16460 - DNA, 121 bp, Artificial Sequence
  Synthesized
  misc_feature (61): n=a or g
tatagtgaggttacaatatatctaaatctgaaggataaagattatcttattgaagcctttntgttaagagtgcatgcttcttgcaatgtgcaagaagacattaatgtaaagacatgtaaag

SEQ ID NO: 16461 - DNA, 121 bp, Artificial Sequence
  Synthesized
  misc_feature (61): n=t or c
ttcagagaaaatgtaaggacctcaacattggtctgttgtattagtacataatctcctatangtactgaacaggcatgcctttgttttatgacatatatcagagtaagtcacatcatcacag

SEQ ID NO: 16462 - DNA, 121 bp, Artificial Sequence
  Synthesized
  misc_feature (61): n=a or g
gtgcttctgttgctcaagctgttgccagtctggaaatgaagcatctcactctggagaagcnttcagtcagacgtacagctcggcaaatgcagaccggggcagcctcacaccgactgcagcc

SEQ ID NO: 16463 - DNA, 121 bp, Artificial Sequence
  Synthesized
  misc_feature (61): n=a or c
aggactgcttcttgtatttcacatttttatcaaaagaaaacattaaccgtccctgagccancctgacctccgtatatgggtttacgtgggactagtttcaacttgattcaactctagccca

SEQ ID NO: 16464 - DNA, 121 bp, Artificial Sequence
  Synthesized
  misc_feature (61): n=t or c
ctgtcaaaacagggaggattatttcatcccaacaggaaaaggcaaactgactaatgttttntaaaacgtgaagctggatctagagatgtcaatcagcttgtgttttcaaaagctgcttcta

SEQ ID NO: 16465 - DNA, 121 bp, Artificial Sequence
  Synthesized
  misc_feature (61): n=a or g
cccttgggcagcaggttctttatcaaagctgttggactaagaatccttaatctataaacantttggggccagggaacttctgaaaaggtttgttgttgttgctttagtggtgatgggttgt

SEQ ID NO: 16466 - DNA, 121 bp, Artificial Sequence
  Synthesized
  misc_feature (61): n=t or c
ttatggtgaagaccatgtgctgttgaaaagcatttagataataaagttaatgtcaggtacnatccacatagcttcaggaaaggaaagtcttgccgtagtaatttgatatccttctgtgata

SEQ ID NO: 16467 - DNA, 121 bp, Artificial Sequence
  Synthesized
  misc_feature (61): n=a or g
gcagaagctcacctgactggaagagttgtaccagtgtacaccagtcaaggaccttgacagngacgtgtggaagtacgtaagaacaaactttagtccttaagtcatttcatgagatttttgt

SEQ ID NO: 16468 - DNA, 121 bp, Artificial Sequence
  Synthesized
  misc_feature (61): n=t or c
gtggcatattcctgtgagtgaagtttactttttctctgaagatctggaggctgaaaagagnatcctggctcattgggaatggcacaaagccaataagcatcattaataaaacagggtggtg

SEQ ID NO: 16469 - DNA, 121 bp, Artificial Sequence
  Synthesized
  misc_feature (61): n=t or c
ttgcttctcactgcaggtgaggaacttgcaggatggatcaaatttgtactctctgatgtgnttccctgctctctttccaggacctctccatggctggctgctcgtctgcatgccattttgt

SEQ ID NO: 16470 - DNA, 121 bp, Artificial Sequence
  Synthesized
  misc_feature (61): n=t or g
gttttatactaaaatatatgtaatataaaattaaaagcagcaatagctagggagtcatgcnacggacaaagatttaaattctcaaccgaaatgaactctgcgtgttcgtacagatggtatc

SEQ ID NO: 16471 - DNA, 121 bp, Artificial Sequence
  Synthesized
  misc_feature (61): n=c or g
acagcatataacgcatattcttcgagctcccgtttaattgtgagttctgttagtgcaacancagaaagtagcaatttctgctctcctgaggtccttacgggatcttgctttgaaccggtgt

SEQ ID NO: 16472 - DNA, 121 bp, Artificial Sequence
  Synthesized
  misc_feature (61): n=t or c
gcatgtagtgagattttcagtcttacaagcaaagactggtgagatactacatctcatgttnaacaaacacaacctaactgtttcacacaacctgagcacgatctagcaaggatgtgcttat

SEQ ID NO: 16473 - DNA, 121 bp, Artificial Sequence
  Synthesized
  misc_feature (61): n=a or g
tcttgcttacaaaatgggatttccttgataccatagcacgtggaggtgtttctgttaattngatatcagccttgctagtattttaaataagcttttacagacattgctccttgcagtgccg

SEQ ID NO: 16474 - DNA, 121 bp, Artificial Sequence
  Synthesized
  misc_feature (61): n=a or g
tccctgttgttttgaacttagtcaactcagaaaaaagttttgtgctatctattgtgacaanttttgtacttggtagccatagcattaactgtatgcagctgtggagttgagctgtttaaga

SEQ ID NO: 16475 - DNA, 121 bp, Artificial Sequence
  Synthesized
  misc_feature (61): n=a or g
tgtgacaagtcattctctgctctggcagtgctcctcagattcaaattctaatatccacttnatattacatcccaccaaccaagctgtctcattcctccagtgcctttctgatgaggtcaga

SEQ ID NO: 16476 - DNA, 121 bp, Artificial Sequence
  Synthesized
  misc_feature (61): n=t or c
acagttactctctcctgacagaatatttcctttcaatagaaagcgtgcctctttcttcccntgtggctgttaaatagtgttgatcctacagtactgccacattttgagggtcatttaatgt

SEQ ID NO: 16477 - DNA, 121 bp, Artificial Sequence
  Synthesized
  misc_feature (61): n=t or g
gagaacagaggatgaggatacattttcaatgaaaaaagggaattttagagtaactggtggntatcatctaagtgttagtgctaataccaaaacaaaatgggtaaaatacaaggatttgtct

SEQ ID NO: 16478 - DNA, 121 bp, Artificial Sequence
  Synthesized
  misc_feature (61): n=t or c
gagatatttttcaaccttaatgattccataatctatatattacacatatagatctttaagntctgtaacaatagaagacctggtctccaatttatatagatattatgctgaaacaaagagg

SEQ ID NO: 16479 - DNA, 121 bp, Artificial Sequence
  Synthesized
  misc_feature (61): n=a or g
gggtgtaagatgctcttggaccaactgcaggaatgcagcatgtctttttccacagcgacancagaccaaatcgtgccccttcagccccacattttgtcccttatgtccatcatcaagcctg

SEQ ID NO: 16480 - DNA, 121 bp, Artificial Sequence
  Synthesized
  misc_feature (61): n=t or c
ctttagcccagtggcactgcgagggaggagggagagagcactccagtaggcatttctgganatggtgttgacagagattgacagtgtttgaaggctattcaggaaatggttttatcacagt

SEQ ID NO: 16481 - DNA, 121 bp, Artificial Sequence
  Synthesized
  misc_feature (61): n=t or c
gtcagcataggactcaaaatagcccctctatcattaacaaaagaaaagcagctgaatcaangcctttagcacagttgatctagaatgactcctgatctgaagaagcataactgaagcctct

SEQ ID NO: 16482 - DNA, 121 bp, Artificial Sequence
  Synthesized
  misc_feature (61): n=c or g
tcctgcatccttctttcttgcagtcgtcagctgtattccatttagcttttgcatttctctnttattgcccaacaacgtaaatgagactgccagcctgtggagctcctgacatctaattgag

SEQ ID NO: 16483 - DNA, 121 bp, Artificial Sequence
  Synthesized
  misc_feature (61): n=t or c
ctgatccaactatctgaatttattgatgcttatttaataagagaatctttcttactgaacnacatgggttttttcagcagaaaaggaaagagctgaaatacacagagaaagaaaaagctga

SEQ ID NO: 16484 - DNA, 121 bp, Artificial Sequence
  Synthesized
  misc_feature (61): n=a or c
caagttcgaacagggttgaagcaaaaagactagaatggaaataaaggcagacatttggagntggagaaatgatgataggttggttaagatgtgcaggttaattccacaaggtgaagctaat

SEQ ID NO: 16485 - DNA, 121 bp, Artificial Sequence
  Synthesized
  misc_feature (61): n=a or g
tttgataatgtttatctttgttgcttttattttacatggtgttgtttcacatgagagagcnctgtttctctcagtgtacaaattcagctgttccttgtatatatcaaagcagccttataca

SEQ ID NO: 16486 - DNA, 121 bp, Artificial Sequence
  Synthesized
  misc_feature (61): n=t or c
catcagcttatagcacacgtcacaaccccgactgtcagtctgcaagaccttgtgcagcctngtcatcagtagctgcaggagctctcctgccttctgcttcccttggctccctctccagctg

SEQ ID NO: 16487 - DNA, 121 bp, Artificial Sequence
  Synthesized
  misc_feature (61): n=a or t
ttttgtcatcttaatacagacccttaacctcggggctgttgtctgggaggcattctgctancctgagttacctgcttctctatcatcagatgtataaaggaagtctgagatgtgagttcat

SEQ ID NO: 16488 - DNA, 121 bp, Artificial Sequence
  Synthesized
  misc_feature (61): n=a or c
aaaaaagtgatgcagacaaagtaagtcttcagagctttccacttgtcagtgagtcagtctncgtgtccaaatctctggtggtatctaagcttttccaatgacattgataggaaaggtttgt

SEQ ID NO: 16489 - DNA, 121 bp, Artificial Sequence
  Synthesized
  misc_feature (61): n=t or g
ccagttcccaaaatccctttatttccgtagtaatttgttttatcttcaggatgagtacttnacacttaaaacttttctcactgtcagtatgggaaaataaatacataggcaatacgtgtta

SEQ ID NO: 16490 - DNA, 121 bp, Artificial Sequence
  Synthesized
  misc_feature (61): n=a or g
tgaaggctgccctcacatgaattgtaaggacaaagcagaccacatatctgaatggatacanagaacactgtattttccaagaccaaaacagaagtcatacctgataatatttataataggc

SEQ ID NO: 16491 - DNA, 121 bp, Artificial Sequence
  Synthesized
  misc_feature (61): n=a or g
cacatggtgataacagagcagcatacgtctgagctgtagtcccaagtgttgctgctctganatctgcatgtgggacaaggagaaggatcaccccctgcctgcttctcacaagggacaaggc

SEQ ID NO: 16492 - DNA, 121 bp, Artificial Sequence
  Synthesized
  misc_feature (61): n=a or g
gaaagcactttccaggatttaaatatttttgtgttaagggatatgaaagattctctgctantacgacaaaaattctacctttaccgtagataagcaccaccccagagggcaacacctgact

SEQ ID NO: 16493 - DNA, 121 bp, Artificial Sequence
  Synthesized
  misc_feature (61): n=t or c
gggcctggaactgcaaccttcctcttcaaacggtcgagtgagacatctctactccttgggncatggttagcgtgacatggaaaagatttcttcttcaaatttagaaatgattttttttacc

SEQ ID NO: 16494 - DNA, 121 bp, Artificial Sequence
  Synthesized
  misc_feature (61): n=c or g
gggcgcaggaggactaagatcccactctgggtaagaccatcacagctccttgaaattgcanttacactgaaggttttcctggaggggagaaaaaaagccataaaagctactgttgctggat

SEQ ID NO: 16495 - DNA, 121 bp, Artificial Sequence
  Synthesized
  misc_feature (61): n=c or g
ctggtgtaccaggaatgcagagaggaaagtgtgagagactggcagtttggtaaaataatcnttgttgggatgtgcgaagagaagcctgaggaagtgttcaggcttgacaattttgtctttc

SEQ ID NO: 16496 - DNA, 121 bp, Artificial Sequence
  Synthesized
  misc_feature (61): n=c or g
acattttatatatatatatatatatatatatatatattaacatttagctggcaggtttcanttttataggtgagactccaattctgatcactaaacacatgccaaaagttagatgcaatcc

SEQ ID NO: 16497 - DNA, 121 bp, Artificial Sequence
  Synthesized
  misc_feature (61): n=a or g
gcctgaattttatatttcatttctattttcaggtaagatttttgtcatattctgaaatacnaaaagcaatgaagaaattcatgtgctgaaccctgcatcccacttaaatacagttaaaact

SEQ ID NO: 16498 - DNA, 121 bp, Artificial Sequence
  Synthesized
  misc_feature (61): n=t or c
atttgtgtccagattcagaagtgctgaagaaaaagtgtagtgccatggaagtactaacacngatacagagaagatgatggttgtatgatctggtctgatttacaatatggacacttatttt

SEQ ID NO: 16499 - DNA, 121 bp, Artificial Sequence
  Synthesized
  misc_feature (61): n=t or c
gggaccaagctgcagaagtggagaattaagcctcaatgccaaacgcacacataattctgcngtagagtttgcacataaaattgaaacaatggagggaaatatcttttatccttgttttcat

SEQ ID NO: 16500 - DNA, 121 bp, Artificial Sequence
  Synthesized
  misc_feature (61): n=t or c
actcttagatttctgtattgtctgttcaggcttcatctttccatctctgtgaaggctaccngtccttactgagcaggtatggctaatgaagggtcagtcttcccttcagctcgtaatttcc

SEQ ID NO: 16501 - DNA, 121 bp, Artificial Sequence
  Synthesized
  misc_feature (61): n=a or g
aagaaaatcttaagggctcagaatggtaattttacccattggcagctgagctttggcaatntcaagatattagtgtgagcattcagcaggtagtttgcagataagtaaaacatgaagctac

SEQ ID NO: 16502 - DNA, 121 bp, Artificial Sequence
  Synthesized
  misc_feature (61): n=t or c
gctgctccataaacatactgatagtacttgcgatcttaattctctcatctatagaaagaanccacatttaatatacttgactagtggaacaataatgttactatgatttgttttattaaaa

SEQ ID NO: 16503 - DNA, 121 bp, Artificial Sequence
  Synthesized
  misc_feature (61): n=a or g
ttaagtgaagcatgggagttgagagagaacaaattatgacagaagcgtggcagctcacacntccacgttaacttaagtgcaagcaaaacatgctgtaatgattcagtggttaccctaagtg

SEQ ID NO: 16504 - DNA, 121 bp, Artificial Sequence
  Synthesized
  misc_feature (61): n=t or c
tgatttctgtttatctttcagcttccaactatcttctgttgtgtatatgaacatagaaagngtccactcctgactgtggtagacatttggaatttgatgtttctggagtgaattaaaggct

SEQ ID NO: 16505 - DNA, 121 bp, Artificial Sequence
  Synthesized
  misc_feature (61): n=a or g
gaaggggcactgaatgcatggagagggtttcagtccatcacccacttggaagcggtcctcngcagtttgggtccatgcatggctgagccagcagctcccacatggttctgcctggagttgg

SEQ ID NO: 16506 - DNA, 121 bp, Artificial Sequence
  Synthesized
  misc_feature (61): n=a or g
gaaaataaagcaaggaggaaagtactctagcattttccatctaactctgggaaacatttgntattgaatatcaaagatagtacaagagtcttcagtaaccttacagtctcttgctattttc

SEQ ID NO: 16507 - DNA, 121 bp, Artificial Sequence
  Synthesized
  misc_feature (61): n=a or g
gtcatcttgcacttcttcatagctctcatccacaatttataatttgtacagtactctctgnatacctcagtatattttagggatcttactttcagagattttggttttacatgaatcctat

SEQ ID NO: 16508 - DNA, 121 bp, Artificial Sequence
  Synthesized
  misc_feature (61): n=a or g
tagagcgataatctgtatctctgtattctctacaagtgtttggcacaagtatttttctccnaaagaggtgctgacagaaatggaattctctgttttaaagagaagctctgaagccttccca

SEQ ID NO: 16509 - DNA, 121 bp, Artificial Sequence
  Synthesized
  misc_feature (61): n=t or c
tgatggcaccatggggaatatggggccaagccttctgcgtgggaacaaatcagtgccagtngcttcatggatgaggtaaagaccagaggtgagctcaggcttattggagtcaatctggtgc

SEQ ID NO: 16510 - DNA, 121 bp, Artificial Sequence
  Synthesized
  misc_feature (61): n=t or c
cgccgtcctctgccaactgagagtcttgagggaaggaggcaatcgaaagacggccgaaaanatcggatttctttctccctatcccatcttcaccatcagacaatttttctaggccgtccgg

SEQ ID NO: 16511 - DNA, 121 bp, Artificial Sequence
  Synthesized
  misc_feature (61): n=t or c
tttatttttaaataacctaaactgtatttttccctgttttgcactttgtgctgtcacttanacaattattaagggggcagaaaatgtcagtcttacctcagttcaagctctaatttcattt

SEQ ID NO: 16512 - DNA, 121 bp, Artificial Sequence
  Synthesized
  misc_feature (61): n=a or t
aagattacccataaaataaaaagtgtttaaaaagtctttttactctcagatggaaagtaantctcaagccttctgatatgttaagtgcctgttgcaggtgatgtactaccagacagatatg

SEQ ID NO: 16513 - DNA, 121 bp, Artificial Sequence
  Synthesized
  misc_feature (61): n=a or g
atgcttctgttttcttacatccatgaatccataactgttgatacaactgagatcagctatntattgagcatgcttgtctttgctacctttaaactgcagcttttttagaggagagatggaa

SEQ ID NO: 16514 - DNA, 121 bp, Artificial Sequence
  Synthesized
  misc_feature (61): n=t or c
ggtgtgggggaggctgaggaatagaaactgctgagcaaagaaacagaaacgtgggacccgntggtagtgctgttcagcagccgggctgtggagagctgggcagtgctggcagagctgtgac

SEQ ID NO: 16515 - DNA, 121 bp, Artificial Sequence
  Synthesized
  misc_feature (61): n=t or c
acaagtcagtgaaaagaataggcacgtcagaagacagctgtgaaaggacactggcatcacngcatgttcctctgtgtgaaaaggtatatgaagaaaaaggaatcatgtgaaccacaaatgg

SEQ ID NO: 16516 - DNA, 121 bp, Artificial Sequence
  Synthesized
  misc_feature (61): n=t or c
tggtagctcagctaaatgcacaatataaagtctacaggtggtccatggctgtgttaagganagaaagaaaagtctcagcgatattacagtgcatgcactcagaagagatttcatatttccc

SEQ ID NO: 16517 - DNA, 121 bp, Artificial Sequence
  Synthesized
  misc_feature (61): n=t or c
tgaagaggaagcgttggcttcccaaaaccgatcatggctgaggatcctgagagctttaagnggcagagcaaggctaagcaggttgtttgcattcctctgtgtaacctcctcgttcccacag

SEQ ID NO: 16518 - DNA, 121 bp, Artificial Sequence
  Synthesized
  misc_feature (61): n=t or c
aaaaaagcggagccgaaccccggctgctgtgacttcgtgacttttctctcctattttaggnagaattggatctttttaactcttttaccccctcttcccctctctcccccctcctttccat

SEQ ID NO: 16519 - DNA, 121 bp, Artificial Sequence
  Synthesized
  misc_feature (61): n=t or c
ctacagcaaacccccacactgttgcttttgcttatttgtttacctttaaacattcaacatngcctttccacaaaaataaacatcctgaggatctgacctataaacatctctctgcatcacc

SEQ ID NO: 16520 - DNA, 121 bp, Artificial Sequence
  Synthesized
  misc_feature (61): n=a or g
agtgtgtcagattgtctatggataagctgagcaaacacagcctgatctgcccttttcagcntatgtacacaggaaaacagtgatacagtttctagacatttttgcttagtgtatggatctg

SEQ ID NO: 16521 - DNA, 121 bp, Artificial Sequence
  Synthesized
  misc_feature (61): n=t or c
ctcagtagtgtctccaatgctgtttttaggaccagatggagagttggagatgtatttcagngtaactcagaaaattgaatggaaaatgagggggatttgtcagagactgaggacacttttg

SEQ ID NO: 16522 - DNA, 121 bp, Artificial Sequence
  Synthesized
  misc_feature (61): n=t or c
tctatggggtcacttcctctggttcaacagataagcaggagtaattcaatcatttgccatngtatatcagtatttaagagtctgattaaaagcctcaaaccaggtgttgaaacctaaaagt

SEQ ID NO: 16523 - DNA, 121 bp, Artificial Sequence
  Synthesized
  misc_feature (61): n=a or t
gagacaagatctctgtttgtttttcctgtgctgagaagtgtatggaatacaacctaaaaanataggaggttttgtaattattttaacttgagagattatttcatactaagttaatgatttt

SEQ ID NO: 16524 - DNA, 121 bp, Artificial Sequence
  Synthesized
  misc_feature (61): n=t or g
acttgtgtaagttcatcaggtagcgcaaaggccattgaaatacttatgtatgtaggaacanccagaatttttaactaggcatcctgtaacttcctatacttgcacacatttagcagatttc

SEQ ID NO: 16525 - DNA, 121 bp, Artificial Sequence
  Synthesized
  misc_feature (61): n=t or g
agatctgtgatttgtaactgttttctacacagtctggaagtaatttgacattaaaatgccntgagatgatctgaatactaagaaaaatatgattctgagttttcctttccctaatgctgct

SEQ ID NO: 16526 - DNA, 121 bp, Artificial Sequence
  Synthesized
  misc_feature (61): n=a or g
ctgctcacttcaccttttttggactgaaggcatacaagagcttgatgccagatatccctcntctgctgaaggcttgatcatgctctattccaaaccagtgattaattcccatcaatttatg

SEQ ID NO: 16527 - DNA, 121 bp, Artificial Sequence
  Synthesized
  misc_feature (61): n=a or g
aaggtattaaatgcttcagaaattgctacttaaaagaagttgggatgaactattgtgtctnttgatttcgttggaaacctggtattttttagttcttttctctctttgaactcccaaggtt

SEQ ID NO: 16528 - DNA, 121 bp, Artificial Sequence
  Synthesized
  misc_feature (61): n=t or c
gcgagacaaagcacaactcaggatttcaaaggaagctgatacccatccagagagttctcangggtgacgttacttaatctgcagatctatcttctggggaggaaaggaagcttcaaatata

SEQ ID NO: 16529 - DNA, 121 bp, Artificial Sequence
  Synthesized
  misc_feature (61): n=a or g
attgtgttgatactgataagaaaaagtttcctcaaatttttgagaacatcaacgtgggggncagcctgattcatttgcattagattttcttaaaactaccttctttcaataaaatgcaaac

SEQ ID NO: 16530 - DNA, 121 bp, Artificial Sequence
  Synthesized
  misc_feature (61): n=t or g
tgttctttcagaaatgtgcaaaaatctatcatttccatcatggtagcttttcaggtacatntgattttgcttcacattatacttgcagttacttttttggatgtctaagtcagttaagtgc

SEQ ID NO: 16531 - DNA, 121 bp, Artificial Sequence
  Synthesized
  misc_feature (61): n=a or g
tggctacagacaaggggaggtaacaagtcagggagaacaagcagcttttaccaaggaacancagcaggaaatgaggcatggagaggtcagtgtgggaactggagatgcaaaggtatctagg

SEQ ID NO: 16532 - DNA, 121 bp, Artificial Sequence
  Synthesized
  misc_feature (61): n=c or g
tcacctctacaacctccatctaccttttaattgatttgtagtaccctatgtaaggtatctnatagtaatcataaactgaagctcagaggcagaacagtgaagacgaaagaaaacattctct

SEQ ID NO: 16533 - DNA, 121 bp, Artificial Sequence
  Synthesized
  misc_feature (61): n=a or g
tacacaagatcacagcttcgtaacccaaatcccagtgtgttttggcttctgccaagctagntgttaactttgtcctaccagagaatctgttcttattcttgcttcactccagtaacagaac

SEQ ID NO: 16534 - DNA, 121 bp, Artificial Sequence
  Synthesized
  misc_feature (61): n=t or c
ataaatgaacaaacaaacgaatacataaaatcctcgaatgagttttaaaggaagagacatntagggatttgtttcgtgggctgaccgttctctcttctcccctcgctgttagctcagctcc

SEQ ID NO: 16535 - DNA, 121 bp, Artificial Sequence
  Synthesized
  misc_feature (61): n=c or g
ctcttaatgatcttgaatgggcagtatatttgagaaaatagctttaaagagtaacttaganaaagtgagcatttggtagcatgaaaatcagatattcacctggctatgtgctacagtgctt

SEQ ID NO: 16536 - DNA, 121 bp, Artificial Sequence
  Synthesized
  misc_feature (61): n=a or t
aactctgctgcctgccagagtcaccagaacaatctgagggagccttggaagccagtgagcncccattcccatgagcccttggcttctccattgccagactgttgctgttccctcgcagaat

SEQ ID NO: 16537 - DNA, 121 bp, Artificial Sequence
  Synthesized
  misc_feature (61): n=t or c
ctaaacaaaaatgtcctgtgtgtactcagagactcttaggaaaggcaggggcagaaggaanaagtgtggacgccaaactcaacagttttcctgggtgcagtttcctgtgagtagaacagct

SEQ ID NO: 16538 - DNA, 121 bp, Artificial Sequence
  Synthesized
  misc_feature (61): n=t or c
cagccccgcggagcttttgggtgataaaaaaggcgtttgtgaagattatctccctcatcantgatgaggtctcaagtgcatgttaagcgacattgtatagattataacttgtacatatatt

SEQ ID NO: 16539 - DNA, 121 bp, Artificial Sequence
  Synthesized
  misc_feature (61): n=t or g
aggtatttcttgcacagatccctgggaagcaactggaagtttctgggttgaaggacagagntgtggctaacgtctgcaatgatacatgatacaagaagtgagaggtttgtttcacagtcat

SEQ ID NO: 16540 - DNA, 121 bp, Artificial Sequence
  Synthesized
  misc_feature (61): n=t or c
agccttcgtctatccacctcagaactaagttttgtagatatggtttagccagtcactgtgngtgcaggttgtcagtgacagctggaataggcaagttagagataatctgatcttgtatgta

SEQ ID NO: 16541 - DNA, 121 bp, Artificial Sequence
  Synthesized
  misc_feature (61): n=t or c
attctgtgattctcttctggctgcatgtcttcccacccaggacattcctcttgagataaanagaacactgcaaaagagcactgagatatcaggagcctgcataagagcatatcagcacctg

SEQ ID NO: 16542 - DNA, 121 bp, Artificial Sequence
  Synthesized
  misc_feature (61): n=t or c
agcctggaaacccagagaaaagatttgcccctcttctccagtgctagtgtttgactctctnctgcatcagtctgtttccacagctgccagtgaggtactggtattttgtcactgacttgcc

SEQ ID NO: 16543 - DNA, 121 bp, Artificial Sequence
  Synthesized
  misc_feature (61): n=a or g
gtactccagcctttctcagcatctctgcttcccagcaatacatctgcagtcaccttggtcnctcccgtggagcagtcattcccttaagtcccatcagcggagtatgcagtttggaacagaa

SEQ ID NO: 16544 - DNA, 121 bp, Artificial Sequence
  Synthesized
  misc_feature (61): n=t or g
ctggccctcgagagtctgggaacaaaagaaaaagtttaatgcctgaattctactactcaangaataaaaagacaatatttggttggtactactaatggaacattttgtgtagtatgaggat

SEQ ID NO: 16545 - DNA, 121 bp, Artificial Sequence
  Synthesized
  misc_feature (61): n=a or g
gtttgcctggttaggatatttattaattgttttataacgtggggactttggtttgcagtgnaggtgactgcatgaattcctagtataagtgatgcttgataaagttggtcagaatgaatgg

SEQ ID NO: 16546 - DNA, 121 bp, Artificial Sequence
  Synthesized
  misc_feature (61): n=t or g
catttaaaccgagaagcacagaagcggacctctggatttctccagtacaacctcttggcanagcaccaatgctagctcagaacagccatggctttgtacacccaaggtttgaaaccaccca

SEQ ID NO: 16547 - DNA, 121 bp, Artificial Sequence
  Synthesized
  misc_feature (61): n=a or g
aaaaattgcatcccacatgttcattcaagcaacaggctattactgcaacagaacacagacngtagattttgatgccagccacaaagcatgacataagtcatggcagaattggaaacctttc

SEQ ID NO: 16548 - DNA, 121 bp, Artificial Sequence
  Synthesized
  misc_feature (61): n=a or g
attccattgttgtgctgaacaaagccctagctctttaaatcaaaacatatgcaagagacangatggggagatctcagcctagttaattcagcccaggtttactgacccagtcttgtgccca

SEQ ID NO: 16549 - DNA, 121 bp, Artificial Sequence
  Synthesized
  misc_feature (61): n=t or c
ctccaaattaccagctctctgcctgaaatgtgagcggctggactacatacagctttcctanagctgggtaatatgtcctatagaagtaacatgacctgatgacattacacttctctggact

SEQ ID NO: 16550 - DNA, 121 bp, Artificial Sequence
  Synthesized
  misc_feature (61): n=a or t
gggcaacctttattgaaagtaaacttctggtcatctattagtcatcttcactgctcctgcngttagcatgatatttatgtggaactggtgggggttatatgtgtggaaaagtttctgtgta

SEQ ID NO: 16551 - DNA, 121 bp, Artificial Sequence
  Synthesized
  misc_feature (61): n=a or g
tttattaggaaaaaatcttgtgtgtccacgatgttgacagcagtgggtttctgctttaggnaatggggttgtatttaggtggtcaagcaaaaaattaagaacggggtgcagctgaaggcaa

SEQ ID NO: 16552 - DNA, 121 bp, Artificial Sequence
  Synthesized
  misc_feature (61): n=a or g
tgagggggaaataatgcctagaagatggttaatttaataaaaacagtgggaaaggggatgnggcaagggattgcttgaagaacaacagttcctatggagaggacacacctgcctcttaaga

SEQ ID NO: 16553 - DNA, 121 bp, Artificial Sequence
  Synthesized
  misc_feature (61): n=t or c
ggaactccaatgaagatttttttcaaagcactgtaatacccatttcagtaatgttatttgnaagcattcctttgtgcagaaagaagagcttctgaactgtagattgtgaccagctagataa

SEQ ID NO: 16554 - DNA, 121 bp, Artificial Sequence
  Synthesized
  misc_feature (61): n=a or t
acctgtgctgtgttggtttgtgctggctgaagatgtgagcagcactggcattgattccatnggctgttttataagttcttcatctcccctgaactgatgtcacttatttgcattacaaaat

SEQ ID NO: 16555 - DNA, 121 bp, Artificial Sequence
  Synthesized
  misc_feature (61): n=t or c
cctgttgtgtccgtttactgtctctatctgtggagacaatgactttgtaaagaacatctcntcagggcaatagtttgtttttctttggatttagaggtagttcttgcacagggaaaaataa

SEQ ID NO: 16556 - DNA, 121 bp, Artificial Sequence
  Synthesized
  misc_feature (61): n=a or g
tgcgaagaggagaggtgagtggaagccgtaaagcacagccccactacacgcacagactaancagagcacaagcccccaaattccaacgtggtgatccagcaccaatggcacagccctgtgc

SEQ ID NO: 16557 - DNA, 121 bp, Artificial Sequence
  Synthesized
  misc_feature (61): n=t or c
tgggcaccttgagatgtttgtccatcacttgtttaaaagtatttctgtgtatttcttgtcnagcttgcccactatctaataaggcagacattacgttggagactaggttatactcatgagg

SEQ ID NO: 16558 - DNA, 121 bp, Artificial Sequence
  Synthesized
  misc_feature (61): n=a or g
gaactgttgtttgtggctcaaaatcaaggacaacagatcctagagggctcatctgaacacncattcaattttgacagaatgcaaacattttggagggagacagcaccaacatgtgaaatta

SEQ ID NO: 16559 - DNA, 121 bp, Artificial Sequence
  Synthesized
  misc_feature (61): n=t or c
tatttcaggttggaaatattacatgttttttctttcagctgggctttgaagaaagatctcngaccatttgttaccctgcagggaagggatatctttcttgggaaacaaggatggccatgga

SEQ ID NO: 16560 - DNA, 121 bp, Artificial Sequence
  Synthesized
  misc_feature (61): n=a or g
gggacacccagcggctgctgtcccaggcagcttgggaccaaacaacaagcatgctggaacncttccctcgcaggtaaaggcagagcaaacaaagtgcaagaagcctccaggagctacaaca

SEQ ID NO: 16561 - DNA, 121 bp, Artificial Sequence
  Synthesized
  misc_feature (61): n=t or g
gataaaaaaagctggggaagtgactaggatgaaaactcataaaaagtcagcacttcatctncaaaacagcaatccaatttagatttggcagatcactttacccgaaaaagacggcatctga

SEQ ID NO: 16562 - DNA, 121 bp, Artificial Sequence
  Synthesized
  misc_feature (61): n=t or c
ctcagtgtgtctttgacatgtcctttgtctgcaggatgaaccagcagcactgaccacccangagctgcctggatctgcagtcacctttgaggtgacagggctgacacctggacaagctttt

SEQ ID NO: 16563 - DNA, 121 bp, Artificial Sequence
  Synthesized
  misc_feature (61): n=a or c
gatgaatatccagcttcaagacctccaccaaggaaggcatcgtgtcctccctttaattaanactgaatatcctttcttccccgagcaagtccctccacactcctacctcggggaaaaaaaa

SEQ ID NO: 16564 - DNA, 121 bp, Artificial Sequence
  Synthesized
  misc_feature (61): n=t or c
attttaatgatgttttcatgtttaatttcactgtaaatcatgttagcagagttttgactgngatgtcagagcttaaaaactgagctgaagttatttcacaagctgagaatttgtctagcct

SEQ ID NO: 16565 - DNA, 121 bp, Artificial Sequence
  Synthesized
  misc_feature (61): n=a or g
aagcccatatccagacttcaagctgttatgtgcaggaaatatatttatacctgtgtttgcnaagtgtctggtgttggggttcccatccacaaatgaagcttctagtcataatggcttgcag

SEQ ID NO: 16566 - DNA, 121 bp, Artificial Sequence
  Synthesized
  misc_feature (61): n=t or c
gtgtttgcgtgcagctctgtacgcagctgttaatgcaggtgtgtgtcttccaggactccancgcgcaggcgcggactacatctcccatcaacccccgcgcctcgccccgcccccagcttcc

SEQ ID NO: 16567 - DNA, 121 bp, Artificial Sequence
  Synthesized
  misc_feature (61): n=a or c
atattatgccaatgtctcggctctctgtctgaataataattccttattctaaactgtaatntaaagcaatctatggggactcaaaaaagggaagtctaattgttgtagataacattctcta

SEQ ID NO: 16568 - DNA, 121 bp, Artificial Sequence
  Synthesized
  misc_feature (61): n=a or g
tactttaacctctcttaccatggagcacttaaaatcatcttgggagacaactgtaacagcngtgtctgacatggctaccagcacacctacatcagctccagttgcgagagcgactccaggt

SEQ ID NO: 16569 - DNA, 121 bp, Artificial Sequence
  Synthesized
  misc_feature (61): n=a or g
tcatcatctccagccccatgctctctcttgggggtgaatcaccattatataaaatagcacncatagtaccatgtgatgatccttgtccttgccggggaaaaaacctaaaaaccacagagga

SEQ ID NO: 16570 - DNA, 121 bp, Artificial Sequence
  Synthesized
  misc_feature (61): n=a or g
ttgtgttaacatccaggacagcgaatacaaaggggcaaatttctggtccagttgggatcantgatagtggtttaatggcacttcagaagttttgttttatctgattcagcctggtattgtg

SEQ ID NO: 16571 - DNA, 121 bp, Artificial Sequence
  Synthesized
  misc_feature (61): n=a or g
atgcaaaccctgcacgaactgctcaaaaatcaccagctcctcaagctcaccctcactgaanggcatatcagttgcacaagggactctgagatatgaccaaaggaattgcagggtacaaatg

SEQ ID NO: 16572 - DNA, 121 bp, Artificial Sequence
  Synthesized
  misc_feature (61): n=a or c
aaggaagaaatgaagtctctttaacaaaaactgtagtatattatcaacctctatgattaangtgtagagatggacttgcaaaaccaactcagcagtaaagctaaagctttatatttgtagg

SEQ ID NO: 16573 - DNA, 121 bp, Artificial Sequence
  Synthesized
  misc_feature (61): n=t or c
aaattatagcagaattgcatccctcaagccaactatttggtgtatgcaggagctcagtcangggcataaggtgcatctctcagaactagtacacctgcagaatacatttgcctgtaatccc

SEQ ID NO: 16574 - DNA, 121 bp, Artificial Sequence
  Synthesized
  misc_feature (61): n=t or c
tgcttgggctggggtgagggctctgctggcgtctgcgtttgtagctggagatccaaagggngggttgcttaacgaggtgggtgttaattgggggggttaaaggagctgtctctttggattt

SEQ ID NO: 16575 - DNA, 121 bp, Artificial Sequence
  Synthesized
  misc_feature (61): n=t or c
aacttttgacatggatttaaatgtgccatgtgttatcctaaagttgtttggtttaagtagngcctgcagaagacggaaaaaaaacggcacacaaaaataaatcatgtatgctacaagcatc

SEQ ID NO: 16576 - DNA, 121 bp, Artificial Sequence
  Synthesized
  misc_feature (61): n=t or g
acggccacgcgtctcatgcgtacaccggcccggtaggactgtgagagcacagcactgcggnttaagttttacctgtcctcggcagctcggtttgaagggcagtcagtgatactgtgaggtt

SEQ ID NO: 16577 - DNA, 121 bp, Artificial Sequence
  Synthesized
  misc_feature (61): n=c or g
atcaccatctgtatactagcgctatcatcatggcagtctgttagttttatactgttacatnctctgggagttataaaatactgtacaaaatatatttgtgtatatctaaaggcatcataac

SEQ ID NO: 16578 - DNA, 121 bp, Artificial Sequence
  Synthesized
  misc_feature (61): n=a or g
taggttcttgcacttcggaactacaccactcctaattaccttagtgaggtcagaaacattnaacattatctaccgctatgctatctaatatatcattagcactactatgtcagcccaatgt

SEQ ID NO: 16579 - DNA, 121 bp, Artificial Sequence
  Synthesized
  misc_feature (61): n=a or g
gaaaacttaggctacaaacataatacagacaaaacttcagcgcagattccagaagagaagngaattataagtgagcagtagtgtaattaaactgcgttctggctgtcagacatccagcaga

SEQ ID NO: 16580 - DNA, 121 bp, Artificial Sequence
  Synthesized
  misc_feature (61): n=a or g
agctctcactgacttcagagtgggaattttgtgttcagctatagtatcttagtttcaatgnttaagctatttagttaatttagtcagagtttatacacctagtatacttttcttctggaat

SEQ ID NO: 16581 - DNA, 121 bp, Artificial Sequence
  Synthesized
  misc_feature (61): n=t or g
tcagaatatgaaggtgggcttgcactctctacctgttcccatgtgcttcactcacctcacntctttctcacttaaacagacttaattattgtgtcctctgcatgtggcctgcaattggaag

SEQ ID NO: 16582 - DNA, 121 bp, Artificial Sequence
  Synthesized
  misc_feature (61): n=a or g
ctttgaagctgaagttattttaaggtgcttttattcacccaatcagctgtgtaaacagctntgagatacattgttgggaactgcattgtcagcagtttatgggatgatttggcccggttct

SEQ ID NO: 16583 - DNA, 121 bp, Artificial Sequence
  Synthesized
  misc_feature (61): n=a or g
ctcccattgtcagcatgggttgctaccacaatggaatcatccaagactcagagaaacaatncaaatcattttattgagagcaccctaacaacaattgatacactacttcaaagtaacattg

SEQ ID NO: 16584 - DNA, 121 bp, Artificial Sequence
  Synthesized
  misc_feature (61): n=a or g
gattttgttctccttatcaagaagaacaaacaaagtcaaacagacaaatatttggtttaanggaaacaacaggtcccccgtcaggaaaacaatgtcactgtgtgattttatacccttttac

SEQ ID NO: 16585 - DNA, 121 bp, Artificial Sequence
  Synthesized
  misc_feature (61): n=t or c
ggcaggatttgctgctgtgcatctctgctgctgagcagacctgcctggatcccttctgttnggtgacgcagggctctctgcttgctttgtcacctttaaggctccccagttcctcgcacac

SEQ ID NO: 16586 - DNA, 121 bp, Artificial Sequence
  Synthesized
  misc_feature (61): n=a or g
caaagataccaggagtgacaaggatcagttgcaaccatttttcttgcttggccagatcctntttccagatgaggtcaatgaacagtgctttagagcatggctcaccaaccaggcaccttga

SEQ ID NO: 16587 - DNA, 121 bp, Artificial Sequence
  Synthesized
  misc_feature (61): n=t or c
actatgcataagttctgtaaagcagagaaatgaggactggaaggaattgaggtcatttganattcattatagagttcacttttgccagcatactttaagagagcagaaaaataatggattt

SEQ ID NO: 16588 - DNA, 121 bp, Artificial Sequence
  Synthesized
  misc_feature (61): n=a or g
tgttgggttggactctgtcaaatgtataattccagaaagataaggaatcaaagcttttgangatgatggatgttcatgcatacatgcatgtgtaggttggggagagaaatagaaaaggaag

SEQ ID NO: 16589 - DNA, 121 bp, Artificial Sequence
  Synthesized
  misc_feature (61): n=t or c
agtgttggctaaaagaaagggacatatcttccccaaaactgaggggttttacttctaccangttgcttgaacactctgcatagcaagacagaagtttgaatatgagtcagcactgcaagga

SEQ ID NO: 16590 - DNA, 121 bp, Artificial Sequence
  Synthesized
  misc_feature (61): n=a or g
ggtcatagctgtcctttttggttctttgccaagatatagggcttgggtgggtgcttgggcntgagcaaagcaaccacaggttgatgaatttcagcaagttcaaaacatttacccggtaaat

SEQ ID NO: 16591 - DNA, 121 bp, Artificial Sequence
  Synthesized
  misc_feature (61): n=t or c
gatgtatatgtattttttaattttttgtttaagctggggaaaacctaaagataatcccacnaacagcccaaaaaggcactcctgagtgtcccctaagccccatcatccctaaaagcaaaca

SEQ ID NO: 16592 - DNA, 121 bp, Artificial Sequence
  Synthesized
  misc_feature (61): n=t or c
tatgatacagtttcagatactcactctgtttctatgagcattgattgatgcatatcgtacngttccccgaaaaccagcaacagctcgtggctattaaagaataaaaataaaaaaagattct

SEQ ID NO: 16593 - DNA, 121 bp, Artificial Sequence
  Synthesized
  misc_feature (61): n=a or g
actagctcaggaatgacacaaagctgttggaaggcagagtccaaagtaaccttgacaaaangaagagcacgtagttcctaaagaaccagtaaaataatccaaatttgagcaagaataaagt

SEQ ID NO: 16594 - DNA, 121 bp, Artificial Sequence
  Synthesized
  misc_feature (61): n=a or g
cccacaccgagctcagcgcagcacaaccagaacgcaatcattcccttatttgcaacggccntacaacaaagaggctgtgtttgaggctctgcttttgttatgacagctgctgggccatcca

SEQ ID NO: 16595 - DNA, 121 bp, Artificial Sequence
  Synthesized
  misc_feature (61): n=t or c
cacatttcttggtgatacagtgtcacagcaaaaggatggagctttcaattgttaaagaacncaaatatcaagaggtgatttgttatatccttagagaacattactagttatactgtcctat

SEQ ID NO: 16596 - DNA, 121 bp, Artificial Sequence
  Synthesized
  misc_feature (61): n=t or c
ttgtttacaaagctgacagacttgtccctgtaactgcatctgccctgggaaaggagcaggnttcctctgcttttgcccaccagcaatgcaacagagctgactgctccccctggctctgccc

SEQ ID NO: 16597 - DNA, 121 bp, Artificial Sequence
  Synthesized
  misc_feature (61): n=a or g
atctcagtggtgctccaacactatcttccttagcacagcaataacccacacaataaccatntctgttttttctgaagcagttttctccatgtcctgttttatgtgctttcttcagcctctc

SEQ ID NO: 16598 - DNA, 121 bp, Artificial Sequence
  Synthesized
  misc_feature (61): n=a or g
tgaaacatttcttgtgtgaattctccattctttaacatgtaataacctgaaattcatggtnatacaagcttattttcattctgttcaagactatttttcctttaacaagaaaataaaattc

SEQ ID NO: 16599 - DNA, 121 bp, Artificial Sequence
  Synthesized
  misc_feature (61): n=a or g
catctgagccgcccattgcgtcctgggtgctaatgagggcaggatggctctcaacatctgngaaataagcttgcctcctgaagtgccacaagcttcagaaaggcggtgatgggcacgcagt

SEQ ID NO: 16600 - DNA, 121 bp, Artificial Sequence
  Synthesized
  misc_feature (61): n=t or c
tctgtcattggtccaaacagatggaagtcaaaaggcaccaaatatgaacaatgcagtgacngtggtaggacagtctaggcaagattcacaacggactttgtggtcttcaaactggtatggt

SEQ ID NO: 16601 - DNA, 121 bp, Artificial Sequence
  Synthesized
  misc_feature (61): n=a or g
ttatatttggcaaagaaaagagtctgccaatcattttgcttaatagttaagccaatctctnttttgctagaactacatgatcatggaagaaattttgttctcccatgagggatgttttacg

SEQ ID NO: 16602 - DNA, 121 bp, Artificial Sequence
  Synthesized
  misc_feature (61): n=a or g
cagtagtcaaatagctgaaaaagcatgccaaagatatgtgaaatttgtcagacttgagaantggaaaagggggattacgccaccaaaatcccaagacgagtatgaactactcgatgtagat

SEQ ID NO: 16603 - DNA, 121 bp, Artificial Sequence
  Synthesized
  misc_feature (61): n=t or c
tcattcaggtcagggtttttttccatctctgagctctggggtctgaatctctgagaccagngtaaatgtttttttgagtatcatctttgaatgaaaagttcatatacttgaaatatctcaa

SEQ ID NO: 16604 - DNA, 121 bp, Artificial Sequence
  Synthesized
  misc_feature (61): n=a or t
agtaggaaatcagggcgtgctatcatgtgccttgatgaatgaactatacacaagacatagnagctggatttaggcataacataatttttggcgttgaatgctgaccttctgcagtgtgagc

SEQ ID NO: 16605 - DNA, 121 bp, Artificial Sequence
  Synthesized
  misc_feature (61): n=a or g
tatagtcacctaacaaggaaggatgaggaaaagacagaggcatttaatgccttttttattntctcagtttttaacagcagtgacagaccttggctgcccagtccccagagttagaggacca

SEQ ID NO: 16606 - DNA, 121 bp, Artificial Sequence
  Synthesized
  misc_feature (61): n=t or c
aaaataggttaagagatttttatttttttttaaatatagaaaccataagaatgctcgctgnattggatgagattgaattctgacctaaccatgtagactggcctcagcagtgaccacagca

SEQ ID NO: 16607 - DNA, 121 bp, Artificial Sequence
  Synthesized
  misc_feature (61): n=t or c
taaattctcctcttactgaataatgacattaccctctgaatgacagaggtgcttgttacangatccgacttacagatacatctggaacttggccctagctgggcctcaaaatagaatgacc

SEQ ID NO: 16608 - DNA, 121 bp, Artificial Sequence
  Synthesized
  misc_feature (61): n=a or t
tccccggtgcagccacatccagataccatgtcagtttcccaaaaagcacctgctacttgcntatgcatgtgtggatttaaccttacgaacagaaatgctgaagactgcacatttgaaataa

SEQ ID NO: 16609 - DNA, 121 bp, Artificial Sequence
  Synthesized
  misc_feature (61): n=a or t
ttggtttttttttctcccatggtatatagttcgctagtgtaatgttgcagctactgaaacnatctcactcttgaactccctctctctggatactgcaatgtttcatataattgagccttcc

SEQ ID NO: 16610 - DNA, 121 bp, Artificial Sequence
  Synthesized
  misc_feature (61): n=a or g
ctacccaagattctggagaagaggggctgcctggtaacctcctgtaccacacactgatttnctgactggtagctttctccaatcattcatcagacctttaaatttgacaagagaggcacag

SEQ ID NO: 16611 - DNA, 121 bp, Artificial Sequence
  Synthesized
  misc_feature (61): n=a or g
aacagctgccccaactggccgaagtgtcagcatttggcttcccaggaaggtgttacacacnatgggtcctgctctcctggaagtggctaaacagcttcccctgcaaatgaagcccttgttt

SEQ ID NO: 16612 - DNA, 121 bp, Artificial Sequence
  Synthesized
  misc_feature (61): n=a or t
tcattttcatactagttcggggaagcttcaaggaatataaagatatacaccaagtataaangtccaatgaggacatcaaaaaatttttctactcgctattttccatcattagagagaataa

SEQ ID NO: 16613 - DNA, 121 bp, Artificial Sequence
  Synthesized
  misc_feature (61): n=a or c
ggatgcaatgaagaatatagtaggttccagaaataaataatccgaggcagtcagctttttncactccaccttttcttttgctgtactcagtactgctattaaccagctatcatctttatta

SEQ ID NO: 16614 - DNA, 121 bp, Artificial Sequence
  Synthesized
  misc_feature (61): n=a or t
aattgttcaccatttgaaaactgaagtaatacctatatatgactccggttgctgggtactnaggttcaacttcttgacttctttttaagagtgcttctgatttttaaaatgctggcactga

SEQ ID NO: 16615 - DNA, 121 bp, Artificial Sequence
  Synthesized
  misc_feature (61): n=t or c
ttgggtcagaaggaagcctcaagtatttccactaatgaataccacacacacaaggtcttgnactagacgattccttacaaggactctacagctacagctgttcagctccatcactctacca

SEQ ID NO: 16616 - DNA, 121 bp, Artificial Sequence
  Synthesized
  misc_feature (61): n=a or g
agcttgaatgttgacagttgatttctgactaagtatctttgcaatatattctttcagtgtnggcatttttctcaattcagtatgaaggctcgatagtatgttcagaggtgtgaactgtcga

SEQ ID NO: 16617 - DNA, 121 bp, Artificial Sequence
  Synthesized
  misc_feature (61): n=t or c
ggctgacctgaactacatctttctgtcagctacatgtgcttttttgttaaaggttcacatnaccacagtacatctgatacaggttatggaaggcatctttatcagagctcttacaaggctc

SEQ ID NO: 16618 - DNA, 121 bp, Artificial Sequence
  Synthesized
  misc_feature (61): n=a or g
ctcgtaggagtattaattagagccgattatatataacctgcttggccagtcactgtgcccnaatggctacttcaacagccagcctctgtgggagatggaggttgctcttacaggctcagct

SEQ ID NO: 16619 - DNA, 121 bp, Artificial Sequence
  Synthesized
  misc_feature (61): n=a or g
tccaatcatggctggaagactctggtttcttctcagtcctgccattaagttgctacctgcntttaaaaacacagccgagtctggcctctgcaagctaacctctgccccctgattcttcttg

SEQ ID NO: 16620 - DNA, 121 bp, Artificial Sequence
  Synthesized
  misc_feature (61): n=t or g
tatcattccaatggacaatggctcattctaacatgtttcactgaagaattgaaaaactcangttgactactgcatcctgtggggacagatcaaatcacaaaacactgttcaaacaagtaag

SEQ ID NO: 16621 - DNA, 121 bp, Artificial Sequence
  Synthesized
  misc_feature (61): n=t or c
aagtaaccaaagatctctgcagcatgtggtccacatatatgttcaccttgcacctaccttnctcctctccatcatagtcctgcctagtaggggtctgcagcgggcaggaggagaagtggca

SEQ ID NO: 16622 - DNA, 121 bp, Artificial Sequence
  Synthesized
  misc_feature (61): n=t or c
gaatggatgttcagatatcaattaattctagtagcaaatcctagtagccagcaagttacangcgtgattttgagagaggtaaaggattagactgtctccttcttcctctgccctccccgcc

SEQ ID NO: 16623 - DNA, 121 bp, Artificial Sequence
  Synthesized
  misc_feature (61): n=c or g
tgtctcattttttgatcacgtgagtctaacccaagtgatagaatatgagggtttattgggnaaatatcaggtaggattcagctttccagtgcctctggctgtatcttcagaatggctccag

SEQ ID NO: 16624 - DNA, 121 bp, Artificial Sequence
  Synthesized
  misc_feature (61): n=t or c
taaagacacatgaaatatatatatcctttttgactaataaaacttttcatgtgcctattanagctttgagtgggggcttaagaagtcatagggagtggtcaaggtgaagtgtagtatgtga

SEQ ID NO: 16625 - DNA, 121 bp, Artificial Sequence
  Synthesized
  misc_feature (61): n=c or g
ggtatcaccaacagcacttctggctgctaaggcttttgaaaattctccctgtgcactgctnataacacaaccacagcgtgtgcacacctccttctgtgccaccccccacttccctgggcag

SEQ ID NO: 16626 - DNA, 121 bp, Artificial Sequence
  Synthesized
  misc_feature (61): n=a or g
gccttcagggagcaattgatttccttgcattcaatttgtttgtgtttttccatcagtgggnaatgaccataagtccacctacagttttgatcaactctgcatgacttcttcagtctgcata

SEQ ID NO: 16627 - DNA, 121 bp, Artificial Sequence
  Synthesized
  misc_feature (61): n=a or c
gattggacagtgtaagtctttcctttgacaaacctacacataaattttgtaccacatgaanagtagttcaagtaaagcacaaataagtatactaatgtacacatacaactgtgtgtgtata

SEQ ID NO: 16628 - DNA, 121 bp, Artificial Sequence
  Synthesized
  misc_feature (61): n=c or g
cgtgatctgccaaaagagaacggaaactccttaacagcaccttgccagaaacaatgcgtgncagagtctgctttaaacaagatgatttttcagaatattgttcctgactttttgtacagtg

SEQ ID NO: 16629 - DNA, 121 bp, Artificial Sequence
  Synthesized
  misc_feature (61): n=t or c
gttaaatctgtggttttcaaatttatatgtggaattccactagaacgagatgttggactcngctaggttttaccagcaggatatgttgctgatcttcccctacactttgtggatcagcttg

SEQ ID NO: 16630 - DNA, 121 bp, Artificial Sequence
  Synthesized
  misc_feature (61): n=a or g
ggctaccgactgtttcttgggaccacagatctacattatgctttataaacagtatgaaacntgtctcactctaaagtttacatactttacccagaaacaagactttattattgccttcttg

SEQ ID NO: 16631 - DNA, 121 bp, Artificial Sequence
  Synthesized
  misc_feature (61): n=c or g
cacaatctaaatcttgattttaaaatattttgcttaaatgtgcattagagcagtattttgntttaattgccctcacactgcaattttccataggaaaccattttcctttgttttcatttgt

SEQ ID NO: 16632 - DNA, 121 bp, Artificial Sequence
  Synthesized
  misc_feature (61): n=a or c
tttagtctggaggcaaatgttttacagaacctatcagctctaaatattcccaagcaaaagnactgaaaatctcaatgaaattggactgaagagtaggttttcattatttcacttaagtgaa

SEQ ID NO: 16633 - DNA, 121 bp, Artificial Sequence
  Synthesized
  misc_feature (61): n=t or g
atacatctcctcctggacatgttagaattgccttccctgtggtaagacatccacacctggnaagatccagaagagtcagagagcatctgtgttccttatgcctctggaaagctgttttgca

SEQ ID NO: 16634 - DNA, 121 bp, Artificial Sequence
  Synthesized
  misc_feature (61): n=a or t
gatcttggcattctcaagttgcctccgccatcacaatataccacatgaagttgcaagactnacagaacaaagttctaattgggaagtgaaggacaaactagaagtgttagcattttaggct

SEQ ID NO: 16635 - DNA, 121 bp, Artificial Sequence
  Synthesized
  misc_feature (61): n=a or g
ttcgctggaatatggggatgattttacagagctatcttagatttacctgtgttaacaaaangggattcttaagttaaaagctctatttagggggaagatcagtagagaataaaatactgct

SEQ ID NO: 16636 - DNA, 121 bp, Artificial Sequence
  Synthesized
  misc_feature (61): n=a or g
tatatccaacctagaaagaccttgagaaaaacatgtattttatgtaaagatttaagatgcntgttcagcagcgctctcaccagtggacactgaaaaggtgaatgccaacaaaaccatgaac

SEQ ID NO: 16637 - DNA, 121 bp, Artificial Sequence
  Synthesized
  misc_feature (61): n=a or g
aaaaacataaaggaagggttatatttttgtctcttgtgggttctatgatagggataccccnaattcctttgataactgtactctccaggaaaaaaagaaacacgaacagcacttgcagata

SEQ ID NO: 16638 - DNA, 121 bp, Artificial Sequence
  Synthesized
  misc_feature (61): n=t or c
ttttcattaggtagaggtaacagactttccagtctgcaaccaggtatctcaccagccaagntccagttcttcagatatcaattttttcctcaaaggaacagaattactgatgttgtcagaa

SEQ ID NO: 16639 - DNA, 121 bp, Artificial Sequence
  Synthesized
  misc_feature (61): n=a or g
gcagagccactgggaagtcctgaccccagagccacaaatcctgctgggaacatgggatccnagcccagacctgtgagctgcatgtacatccagagggagacatgcaagctgtgctcttaca

SEQ ID NO: 16640 - DNA, 121 bp, Artificial Sequence
  Synthesized
  misc_feature (61): n=a or g
gaaacattcacagaactctttctcagtgatgtagagactcaagaaagaggttacatgtttnaaaacgtggggagccttgcttagtatgggttccttcaaactaggtggatcaaccgagtat

SEQ ID NO: 16641 - DNA, 121 bp, Artificial Sequence
  Synthesized
  misc_feature (61): n=a or g
tcacacactgaaagggcaacggatgaagaaactgtctattactgcagataagcagaatggntgccagctatccggatggaatgaggaacgaggctgagaaatcaggctggagctgtacact

SEQ ID NO: 16642 - DNA, 121 bp, Artificial Sequence
  Synthesized
  misc_feature (61): n=t or c
gaagcaaaagagagacaggagctcagcttctgtctgggaaatcccgtttttcaaggccatnctcactgcgctctgtgcaacctgtgttctgggtaatggtttgtctgtaacggggtgaagc

SEQ ID NO: 16643 - DNA, 121 bp, Artificial Sequence
  Synthesized
  misc_feature (61): n=t or g
ggaggatctgtttagcagttatttactcaaagtgaaatgaattagggatttttatttattnttgtgcaagggtaggagccagaaatacctgtgtgggttttctctactccagcatttttgt

SEQ ID NO: 16644 - DNA, 121 bp, Artificial Sequence
  Synthesized
  misc_feature (61): n=t or g
taaggcttatgcagccacctgagctctccataacctgagttcttagttaagacacctgatnggatgtttctggcaagaaaagactgtaatgcttcttacttctggggggaaactgaggcac

SEQ ID NO: 16645 - DNA, 121 bp, Artificial Sequence
  Synthesized
  misc_feature (61): n=a or g
agtaaaatcacaaccattagactgctgcacaacgtcaccgtgtaattaggatcacttggangaggacatcacctcatggctccatccccagcattctattctgcctcgtttgctgttctat

SEQ ID NO: 16646 - DNA, 121 bp, Artificial Sequence
  Synthesized
  misc_feature (61): n=a or g
actctccaaaacagctggtttttagcatggaacatgttatctaggatttgttcaaatatantttgaagtcaggatcatttaaatttgaagtttctcataaagctggacagattttagacca

SEQ ID NO: 16647 - DNA, 121 bp, Artificial Sequence
  Synthesized
  misc_feature (61): n=a or g
agcagccggcagcaagtacattgacactgaagtggagaacgccatcaatggggtgaagcanatgaagacactgatggacaagaccagcaaggagcaccaggccatgctgcacacgctggag

SEQ ID NO: 16648 - DNA, 121 bp, Artificial Sequence
  Synthesized
  misc_feature (61): n=t or c
tgcaagtttatacaatggcctatagcaataggttagctatttgcatctttcacaagactgngtgttacagagggatgcattggggaaaaaaacaaagacggaacatcttacactaaactgg

SEQ ID NO: 16649 - DNA, 121 bp, Artificial Sequence
  Synthesized
  misc_feature (61): n=a or g
tgttttatatcctgttcttgctttatattcaaaatctgtcatccaaagtataaatattccnatgcattatttgccttgctaaatatttacctttaataaaatccggggggaaaaaacattg

SEQ ID NO: 16650 - DNA, 121 bp, Artificial Sequence
  Synthesized
  misc_feature (61): n=t or g
tgaacttaaaccatgttctccattaattaagttagctctatcacctgtgctttgagcaagngatgagtcagatgggttggggtcatgttttttgggtacagaagaggtaatacttgctggg

SEQ ID NO: 16651 - DNA, 121 bp, Artificial Sequence
  Synthesized
  misc_feature (61): n=a or g
cctgtgaggaacaactgggatgagggctgggaagacgtttgtcttgatggtgatggctaanggcagaaactgctctcatctccccttgcttcctctgcccctcagcgtaacacacatatct

SEQ ID NO: 16652 - DNA, 121 bp, Artificial Sequence
  Synthesized
  misc_feature (61): n=a or g
gctgtcgtctgtctccaacagaaggaaaaagaaaagaggtggggaagggaaaaagcgactncagaaccacagtgtgagacagcaaaacagaggcggccgaagcgcgtgccctactttagga

SEQ ID NO: 16653 - DNA, 121 bp, Artificial Sequence
  Synthesized
  misc_feature (61): n=t or g
atacaaacaaactttggttagcatttttctgctgttgggggaaagaaaaggagcagacacncgagtgcacaaagtatggtggaaatacttaatcagaacttgtatggcatttaatctttct

SEQ ID NO: 16654 - DNA, 121 bp, Artificial Sequence
  Synthesized
  misc_feature (61): n=t or c
ggggttaaaggtttaaggctaaaaatatgaaaatccacattgtgttgtaccccaccaaatnatcgtacctcacttctacctgcagttgctgaatcccacagccagagctcctgagtgacca

SEQ ID NO: 16655 - DNA, 121 bp, Artificial Sequence
  Synthesized
  misc_feature (61): n=t or c
aaatccaggggaatcttggcagtgtcttcagtgcaaggcaaaatggatctatatccgagtngaaatataactcaggttgtttcccgtataaaggtagaacttcaaagtaaaccaagaagca

SEQ ID NO: 16656 - DNA, 121 bp, Artificial Sequence
  Synthesized
  misc_feature (61): n=c or g
atctcaagtaaagcagcaccaagtgccaccaccaaggtttcacttcaccaggctgcagtgntctcaggagaataagtttaaaggggaaaagtgcctcccagtgtttcatcttcaagcgtgt

SEQ ID NO: 16657 - DNA, 121 bp, Artificial Sequence
  Synthesized
  misc_feature (61): n=a or t
gctatatgcatacactgagagggtgtgggatgtttattcaaaagaagtatggggtcaaggngatgtaatgtagtcaagacccaagagaaaagttagagtgatgaaataggtgatattttcc

SEQ ID NO: 16658 - DNA, 121 bp, Artificial Sequence
  Synthesized
  misc_feature (61): n=a or g
accgatgagagcttcccctgcgcgacttccctctgtagttttctccccacgaggcaattanacagataacaaacggcttcaaggcacctcggagacatcgttcccaacgtgtggggtgaaa

SEQ ID NO: 16659 - DNA, 121 bp, Artificial Sequence
  Synthesized
  misc_feature (61): n=c or g
ctggggagggtcagagagcttatcggaaaacaggctcttgtccgctgctattgagactcantgcattacccgcagcaacctcaaaggagtgcctctgcagaaggctcttttgttgttgttg

SEQ ID NO: 16660 - DNA, 121 bp, Artificial Sequence
  Synthesized
  misc_feature (61): n=a or g
gtcagcagagctttctcactgtccttcctgggcacaaaacccatgcactgaatgtgcctanaacaacctttgaagccatccttgttattattagcagaatacaaaattcccttccttaacg

SEQ ID NO: 16661 - DNA, 121 bp, Artificial Sequence
  Synthesized
  misc_feature (61): n=a or g
tgatggcatcacagaaggctaccagactggtcaagcatgatttacccttggtgaattcatnctgactactcctaataacctccttattttccagctgcttggagatggcatccagaacaag

SEQ ID NO: 16662 - DNA, 121 bp, Artificial Sequence
  Synthesized
  misc_feature (61): n=t or c
tttttcaccaggtctctctctatggaaaattctttgcccttcctactgaaattagggtgangtgagtgccaggaggttgggtgtatcaacaggctctcttgggtgaggagtagaatatttt

SEQ ID NO: 16663 - DNA, 121 bp, Artificial Sequence
  Synthesized
  misc_feature (61): n=a or g
ttaccctcattttaaagctgagtaaagggccatgaagaactaaaatttagacagtccaaancacatgggtaacaaattctatttggaaacctctctgcctctgaaatcaatgtgaattagt

SEQ ID NO: 16664 - DNA, 121 bp, Artificial Sequence
  Synthesized
  misc_feature (61): n=t or c
tagtactggcttgtgttcattaactttaaatgatcagtaactgatttaaagcagctgtatntgctgctgcctatccttacagtagtttaatttcaaaatgagttgagtgttgatagttgaa

SEQ ID NO: 16665 - DNA, 121 bp, Artificial Sequence
  Synthesized
  misc_feature (61): n=t or c
catgaatgtcttgatgaaaatgaagatgaatgaaatgaatgatcaatgaaatgtagatccnctcttaacttcagtaggctttgaatgttgggctgcttgcagattataaagcacttacttc

SEQ ID NO: 16666 - DNA, 121 bp, Artificial Sequence
  Synthesized
  misc_feature (61): n=t or c
aaaactgctcttaaataactctgtttttcccatttaacttcgattttactttcaacatggncaagactagcctgctgcagtcagttttaaaaatctctttattttcacattgaaatgcctt

SEQ ID NO: 16667 - DNA, 121 bp, Artificial Sequence
  Synthesized
  misc_feature (61): n=c or g
gcagttttactggagaaaaaaaaaatcattaatggaaaatagcattggaaaatagacactncaggatatgaagcatgagattcttgttcttgagggtagatggcgagttggatgctccgtc

SEQ ID NO: 16668 - DNA, 121 bp, Artificial Sequence
  Synthesized
  misc_feature (61): n=t or c
atcatcattaactcatacaaacttaaaagaaggatgcctcatcttgaattagcagtgctgnggtcaaaccgctctctcctgcctttcactgttttattagtttaggcacagcacattgcca

SEQ ID NO: 16669 - DNA, 121 bp, Artificial Sequence
  Synthesized
  misc_feature (61): n=t or c
ggctgcatagctgcagctacaactgaatttcttgtcacgcttagttctcgtatctaagtcntcttcaacaccaccgatcaaagaatcagagaatcacctgaatatttaacttaattgttaa

SEQ ID NO: 16670 - DNA, 121 bp, Artificial Sequence
  Synthesized
  misc_feature (61): n=a or g
tttaagataattttttttgaccggatagccccaaaggatttggggggttctagttgtcctntgctcaagagtctaaacttctaagatattcaatacattggtttgaatataattataaact

SEQ ID NO: 16671 - DNA, 121 bp, Artificial Sequence
  Synthesized
  misc_feature (61): n=a or g
gggaactgagacgtcaccacggagcgctcttattccataatggctctctgtgacgatttantggtgtacactgattccaaagaggagctctgtgacgtcataatagggctccctgatgtca

SEQ ID NO: 16672 - DNA, 121 bp, Artificial Sequence
  Synthesized
  misc_feature (61): n=a or g
gccactatgtatgacatacagactgtgggcatgcaccttgggatgctacattttgcagaantgtgaacccataactcccacaggccttgtctggaagttagaatgtttgctgcacctccag

SEQ ID NO: 16673 - DNA, 121 bp, Artificial Sequence
  Synthesized
  misc_feature (61): n=t or g
tcagaagagaagctgtttttaaacattgctaatattcagtgctgaaatagcaccataaganaatttatctatttgaagatgatatggtgctttgtgtaactggccatgttgactgtgttgt

SEQ ID NO: 16674 - DNA, 121 bp, Artificial Sequence
  Synthesized
  misc_feature (61): n=t or c
ctccaatccaaacttctcagcttccaggcccaggcattcagttcattcaattacatccgtnctctgtattgtgcagataatatatgtatgtatgatatataacaacatacaacacaaaaca

SEQ ID NO: 16675 - DNA, 121 bp, Artificial Sequence
  Synthesized
  misc_feature (61): n=a or g
aacaacagagaggagaatgagaggagctatgaaaaatgcatgaaataagtggattctcttngagatttttaagaggacttagaagtggcagttttcaggttgtggcctagtgcctgcacat

SEQ ID NO: 16676 - DNA, 121 bp, Artificial Sequence
  Synthesized
  misc_feature (61): n=a or g
catggggatgcgtgccacagcctcagtacagcactgctcctttggtgtaggaacaaagccncaagcacaaagctctctgctggatgttaccgttcaaccataacacaactggaagatgtca

SEQ ID NO: 16677 - DNA, 121 bp, Artificial Sequence
  Synthesized
  misc_feature (61): n=t or c
ggaaaaagcaatgcacagggaaagcagcttcctgaaaatactggcatagacagaattgcanaggtctgacaagatttaccttgctatttcactgtgtgtatgaacacacgtgacactgtca

SEQ ID NO: 16678 - DNA, 121 bp, Artificial Sequence
  Synthesized
  misc_feature (61): n=a or c
gcaaaaactacataagaaacacaaagttagcataacttgggtgaactctttacacactccnaggtaagctatgcaaagagaggaggaggagcaattcaggtagagggagctggctgctacc

SEQ ID NO: 16679 - DNA, 121 bp, Artificial Sequence
  Synthesized
  misc_feature (61): n=a or g
ttcttctattcataattttcatcagcatgtttgcttgttgtgataattcagtgatatgacngactgaagaaatatgtcaagagttcttatcaacagtttacttctcccatctaccactctg

SEQ ID NO: 16680 - DNA, 121 bp, Artificial Sequence
  Synthesized
  misc_feature (61): n=a or g
tagaaatctctacttggcaaagccatagacacgttcaagatcactgctttgattatagctnggaacaaagctggcagtgctatgagcatcaacataacccccctctgctctgtcctcatga

SEQ ID NO: 16681 - DNA, 121 bp, Artificial Sequence
  Synthesized
  misc_feature (61): n=c or g
tcaaccagcaactagatatctgcttgaaaatttaacgtgcaaataagagccattttagtantcaatagagtatattttaagctgtccccgtattttcaatttcaaggagcaccatttttca

SEQ ID NO: 16682 - DNA, 121 bp, Artificial Sequence
  Synthesized
  misc_feature (61): n=a or g
tgcacagcccacatagaccccacggcaatgagatcggccctttagggctgagtgctggacncggagggcagaagcaccatcagctgccttagcaaagcctcagcaaagtcccaggccctac

SEQ ID NO: 16683 - DNA, 121 bp, Artificial Sequence
  Synthesized
  misc_feature (61): n=t or c
tctgttaattaaggccagttagaaggaaattgatgcaaacaagggaaaaatcagttgtgtncccaggaaggaaaaacagttgcatctttactgttactggtgtactcttctacccttgtat

SEQ ID NO: 16684 - DNA, 121 bp, Artificial Sequence
  Synthesized
  misc_feature (61): n=a or g
aggcagtgggtgctagctttgggctgctggatagcggggagcagagcaaagagttgcacangcgccgtggtgcagtgatggtggagtcctcactcgggctcttggctgcccagagagagcc

SEQ ID NO: 16685 - DNA, 121 bp, Artificial Sequence
  Synthesized
  misc_feature (61): n=a or g
attcaacagacagattattgttttcttcccttcctattgttttgaatgttttctggagatntgccgcagtgcaataatatggtatactggacctaaggcagttgaggattcctagtttgta

SEQ ID NO: 16686 - DNA, 121 bp, Artificial Sequence
  Synthesized
  misc_feature (61): n=a or g
cctcctggacccgagtcctattccgaatcctgataatctacaggtattaagtctcagttcntctttatcctaaccaaagcttgacaccacatgctgttagaacatagcagcagaccaacag

SEQ ID NO: 16687 - DNA, 121 bp, Artificial Sequence
  Synthesized
  misc_feature (61): n=a or g
tcttccttcctgaagaagttttattttttttatcaaagtgtttgatgttacctttgacttntatttcttgtatttgttctgtattcctccagctatgaataagttgaggtgggtgaaggta

SEQ ID NO: 16688 - DNA, 121 bp, Artificial Sequence
  Synthesized
  misc_feature (61): n=t or c
acaaaatgatagcaggctgtgcactggggaatgaaaattgctttgacatggagattaggcncctgtattgttacaagacattgtctcatatggacaagagtactgtagagaaaaaaaatag

SEQ ID NO: 16689 - DNA, 121 bp, Artificial Sequence
  Synthesized
  misc_feature (61): n=a or g
gacccccacacatgcagcaaagagagaacaaaaacactgctgtgctcacaggaaaaacaancagtgtgtgggaagccacagagacaaaccaccatgcaggttcccaggaacagagctccac

SEQ ID NO: 16690 - DNA, 121 bp, Artificial Sequence
  Synthesized
  misc_feature (61): n=a or t
tttccaccctctagtcaaacttggctgaggtaaaagcattcatgttaccagggaggagagngtgaggcagaagttgtatgcaggcaatcccatactatgcatacagtcagatggcgtaaca

SEQ ID NO: 16691 - DNA, 121 bp, Artificial Sequence
  Synthesized
  misc_feature (61): n=a or g
gccctggccaggtggtgccatgcatctctccctcctgttcccgtcatggctctgcttcacncaggaaattcttgttggtctatacgtgcaaaactcgacatggctttgcacccagcgctat

SEQ ID NO: 16692 - DNA, 121 bp, Artificial Sequence
  Synthesized
  misc_feature (61): n=t or c
agagggcatctgtagccttctctgtccaaaatacgcatctgtgtttgactgcatcttctgngctgcctggagggatcctgctgagaacatcactgcttgggacaccaagaggaggctgagg

SEQ ID NO: 16693 - DNA, 121 bp, Artificial Sequence
  Synthesized
  misc_feature (61): n=c or g
tggaagtgggttacattcttgggaaaagtatgtatttgaaataaaaaatcacataagcacntttctagcccagcccctttcagtgtttggattgccagagcaaactctgaagggagactct

SEQ ID NO: 16694 - DNA, 121 bp, Artificial Sequence
  Synthesized
  misc_feature (61): n=c or g
agaaatcacctcgtaggcctgggaaacagcagttccctttccatgaggaaggcagtgcttntccataacttggctgcgacagctcccccgtagctgtggaatgggctgagagtggtgtagc

SEQ ID NO: 16695 - DNA, 121 bp, Artificial Sequence
  Synthesized
  misc_feature (61): n=a or g
gcacgggaggtgtgtcctggaacggcagcttgcttataggtctttgtttgccaagtatagnaaagttttcctcgcgtgatttaaggactgaccgcccggcaggtcctctcaacgccgcccg

SEQ ID NO: 16696 - DNA, 121 bp, Artificial Sequence
  Synthesized
  misc_feature (61): n=a or g
acgttgggatttcagatcacccaattcagaggcagctccacacaatctacaaagggactcntatctcttctatctgacaaaatcagtgttacaaatcccatctttctcagtttttattata

SEQ ID NO: 16697 - DNA, 121 bp, Artificial Sequence
  Synthesized
  misc_feature (61): n=t or c
aatcacatcctcaccttccttagtggaaaataagtcctgtggctggccaggactgccctgntccccgcggtgctttggaaactgcaaggagaaggcaccacagggtcagcctttattgcag

SEQ ID NO: 16698 - DNA, 121 bp, Artificial Sequence
  Synthesized
  misc_feature (61): n=a or c
atcaggaaattccatgttatatttcatcttgttaagtgtctgtgttgctttcaatcctctnctcccctaacagatctgagtgaatatgtggggggaaaaaaaaaagaagaaataagggctc

SEQ ID NO: 16699 - DNA, 121 bp, Artificial Sequence
  Synthesized
  misc_feature (61): n=a or g
gtgtataagtggaagattctgaagtggaaaagtattaatggcattttaaggccaagtatgnaactgctttctgagaattgtttgtgaacctgaaatgatataatagtgtacagtgtctgtt

SEQ ID NO: 16700 - DNA, 121 bp, Artificial Sequence
  Synthesized
  misc_feature (61): n=t or c
tatgtatgtgagttcagtgactgaatagtgaaaattgctttgcaatatttcagcccccagntatggagtcacaaccgaaagattcagtgccaaataatggcgttactgatctaaaaaggag

SEQ ID NO: 16701 - DNA, 121 bp, Artificial Sequence
  Synthesized
  misc_feature (61): n=a or g
gcagtgggctttcccagagatgagactgtgactttgcctctcctctctgagtgacacctcngtggccagcaggcttctggatgcaagatgctccttcatttcaaataatgttttggagtta

SEQ ID NO: 16702 - DNA, 121 bp, Artificial Sequence
  Synthesized
  misc_feature (61): n=a or g
tcaccagtgtttgacaggaatgtgtgtacatagttagtaggaaaaagtgctcttatatctntatttttatctatgttctcatggggaaaactgctttcagttatctgtagttttgcatata

SEQ ID NO: 16703 - DNA, 121 bp, Artificial Sequence
  Synthesized
  misc_feature (61): n=a or c
aagatttccattgcatttcttagagtgttttctgcagcactgcacaggcactggtctattnccagcagctgaacggaatggcaagcatcgttcacccaaaaacctctattgagtggcggcg

SEQ ID NO: 16704 - DNA, 121 bp, Artificial Sequence
  Synthesized
  misc_feature (61): n=c or g
gctatgcaaggagcttccagcagcacttcaagtacaacaggaacagcagctgaccccaaancagccaaagcacagcacccgctgccaggccgggcagcatggactcccaagggaatgcagg

SEQ ID NO: 16705 - DNA, 121 bp, Artificial Sequence
  Synthesized
  misc_feature (61): n=a or c
ttgaagttaatctttttttttttttccctcagaaaaaccgagcacattgtttccaggttgnatttgttttgaaataccttcccaagtgcctttatcggttggtagagatgctttggttttg

SEQ ID NO: 16706 - DNA, 121 bp, Artificial Sequence
  Synthesized
  misc_feature (61): n=t or c
gctgtgggtgatgtgcaaagggaagctcagttcccaaattcttcagcgtgaaggtgttaangtgcaggaggaccctgagcctctgcagcctgcttctaaatagggcacagcccagaacatc

SEQ ID NO: 16707 - DNA, 121 bp, Artificial Sequence
  Synthesized
  misc_feature (61): n=a or t
agactcctttatttcctgctttgcaaaaagctctctgggcatcccagagtggacaagttcngaggccagtcatttacagaagtgtaggaatccaggggttgatcaggtgtgcactgagttt

SEQ ID NO: 16708 - DNA, 121 bp, Artificial Sequence
  Synthesized
  misc_feature (61): n=a or t
agcttctgtttcaagtcaacacgcgggatttgggattcatgtcttgagttcttccccagtngaccaatgccaggtggccccatgtcaggaggctgctctggggcagcttttggggctcagg

SEQ ID NO: 16709 - DNA, 121 bp, Artificial Sequence
  Synthesized
  misc_feature (61): n=a or g
ctgaaggacagactcaccattgagctgcacggtgagtgagaaggatcgaggcatgctgcanctcctctgatgggtcacaggtgaagctgcagaacctgtacatggtttttgtgtgaggttt

SEQ ID NO: 16710 - DNA, 121 bp, Artificial Sequence
  Synthesized
  misc_feature (61): n=a or g
cctgaacctctatggagcactctgaagtcttatttataaccctcacagtctgttgcaaatngagattctttaaggtgtctcagttcttaaagtgctgtgaacgttaccagggttcggtaca

SEQ ID NO: 16711 - DNA, 121 bp, Artificial Sequence
  Synthesized
  misc_feature (61): n=a or c
atatgtacctctagtaatctcctattttttagcctagaactaattccctagagggcagaantaggagagaagcagagcaaggttttcttaggctgtattttcctttttaatgctatttttc

SEQ ID NO: 16712 - DNA, 121 bp, Artificial Sequence
  Synthesized
  misc_feature (61): n=a or c
gtggtgataaggtggagacagggacaggatcctgccaccacaaagtagttttaaagccaangatagtgaagagttagatctgaggttgagctgaggaacacatgagatcagcaggtaccat

SEQ ID NO: 16713 - DNA, 121 bp, Artificial Sequence
  Synthesized
  misc_feature (61): n=t or c
aattaatgagctaaataacatcacattatctgaagtcaactgctatttgcattagtcccgnggaggtcacggaagcagacgggatgcatacctggcaaacttccacaccaacagtgaagtg

SEQ ID NO: 16714 - DNA, 121 bp, Artificial Sequence
  Synthesized
  misc_feature (61): n=a or g
catgcagttacccatgggaagagcacagcccaggaaagaaaataaagatatatataaatanacaaaacgtaaggacagaattgaggaaacaaatatgaaagagcaaaaataaactatcagt

SEQ ID NO: 16715 - DNA, 121 bp, Artificial Sequence
  Synthesized
  misc_feature (61): n=a or t
accatgtttggaaatggacattacttaacagcgctcctagcaaagaaaatctacaggtaanataagacaaccttcctcactccagtagtgcttgaaaggagacattttacatccacatgat

SEQ ID NO: 16716 - DNA, 121 bp, Artificial Sequence
  Synthesized
  misc_feature (61): n=a or g
atttccatcccacctctttctttagaggttgtaacatgatggaaaacagcagagcagcaanacctaaggccacagtgagtgagaatcctctcagagacaacaacagtaagtgcagaaataa

SEQ ID NO: 16717 - DNA, 121 bp, Artificial Sequence
  Synthesized
  misc_feature (61): n=t or g
atatgcatcacggtataatgccattacacaaagcattcttttttttcatgtgctaaatctncaccaatcttgttggagttaaggggaattaaatatgtgctcctgtaaggagtctcccacc

SEQ ID NO: 16718 - DNA, 121 bp, Artificial Sequence
  Synthesized
  misc_feature (61): n=t or c
tgtgagatgtccaacatgctgatatacttaaagactgatatctatgaaaacatttgatcangactgcaaacttcagccatactgcatagcatctaacatggagatgatagacaaagttagg

SEQ ID NO: 16719 - DNA, 121 bp, Artificial Sequence
  Synthesized
  misc_feature (61): n=a or t
ctacaccatccttgccaaaaggcagtttgacagagtttgacaaaggccagtatgttctagnagtaccttccaatagaaaggaatcagtacccatacacacaaagcctttttcaaaagcaaa

SEQ ID NO: 16720 - DNA, 121 bp, Artificial Sequence
  Synthesized
  misc_feature (61): n=a or g
acagcctttataataatgaattatttgttctctgatccgctcagattttgcagagaagttnatgtaagcacaagtaattaagaaagtcaacagtctgaacaaatgctttgggtcactgcct

SEQ ID NO: 16721 - DNA, 121 bp, Artificial Sequence
  Synthesized
  misc_feature (61): n=a or g
gagcagcatagactaaaagatggaaacaccaatactagggttttctcaccctgctgtcccntttcactttgctgccatagaccaagcaattccactgctgccttgttatcctcagagaaag

SEQ ID NO: 16722 - DNA, 121 bp, Artificial Sequence
  Synthesized
  misc_feature (61): n=a or g
aatttttagaactataagactggcaaaggcatctttcactcaaatgatgaaaacaaaaacnaattttctgttacttccctcttcccttattttgaatagcaattagtaaatcagccccttc

SEQ ID NO: 16723 - DNA, 121 bp, Artificial Sequence
  Synthesized
  misc_feature (61): n=t or c
attggtttaattttgcgagttcctgaggtgatatctggatggtcaaaacattacattaagntggcccctgagcaaaagtgttcttaataaaaaagatagaagagttaccaatactccaaca

SEQ ID NO: 16724 - DNA, 121 bp, Artificial Sequence
  Synthesized
  misc_feature (61): n=a or g
gtaaaatccttctgttctaatgcaaatcaggtaggagaaatttgcttaaggatagctaaancaaaataacaccgtaggcacctggttttctcagttttcctaactacaaaagtggtctttt

SEQ ID NO: 16725 - DNA, 121 bp, Artificial Sequence
  Synthesized
  misc_feature (61): n=c or g
agagaactttgttctgttatacagagctaaggaaacaatgcagtcagcctcagggatgaangattttttgatgttcatagcgctcaacactgcctggggtttggagagttggggagcgaag

SEQ ID NO: 16726 - DNA, 121 bp, Artificial Sequence
  Synthesized
  misc_feature (61): n=a or g
aacaggcccttcacctatttacgctatgttttttatcaattaccttgctgaatagtccagntgaaaccagtatttgtattggccagaatctggactgtgcctaaagaggtattttagtgaa

SEQ ID NO: 16727 - DNA, 121 bp, Artificial Sequence
  Synthesized
  misc_feature (61): n=a or g
ggaccaatgttatctcaccccatggctatccatcacttggtcctatggctgagtaacattnggaagatgtctcacattttcacagagtacttctccatcccatgcctctttctttgtacac

SEQ ID NO: 16728 - DNA, 121 bp, Artificial Sequence
  Synthesized
  misc_feature (61): n=a or t
aacagaaggcatgttaaaacaacaacaaaaaaacatgagttaactccatacaggagtagcntgtgtaggtgagaatttctgaagcaatctaaggtcattaaacaagcaggtgaaccattgt

SEQ ID NO: 16729 - DNA, 121 bp, Artificial Sequence
  Synthesized
  misc_feature (61): n=a or g
ctatagaagatgtggaactaattaagagcatgattatgctgaatgttgatgctggggaagnaagaagtacgatgttggatttcttgaacacttaaagcatgcagtaactataatatagcaa

SEQ ID NO: 16730 - DNA, 121 bp, Artificial Sequence
  Synthesized
  misc_feature (61): n=a or g
aatcatctaatatttgttcagaaatccataaatgttctatgttcaacaagacatgttttcntgtttctgacaaataactcccccaggtgttacagcttttaaatgggattgtatttacaaa

SEQ ID NO: 16731 - DNA, 121 bp, Artificial Sequence
  Synthesized
  misc_feature (61): n=t or c
tctgacagccaaactgacgtggctgcatgacgttcatttgcacagctgacgtaactctttnggtgcttttcaagtcccatcctcttggcttttcagatgcaacgcatggcaatggggaccc

SEQ ID NO: 16732 - DNA, 121 bp, Artificial Sequence
  Synthesized
  misc_feature (61): n=t or c
atcaagcaactttaacctgcccgctaaattgcacacaggtgtgtgtttgtaaccaagagantgtattttagaaataaataacagaagtaaggttgcaatagcaatcaccgattttaaaact

SEQ ID NO: 16733 - DNA, 121 bp, Artificial Sequence
  Synthesized
  misc_feature (61): n=a or t
tgtaagtgcaatgtggtgttattgaaccatgctctttgacctgttccatggtatatcaacnaaatgaacaaagaacctttctaggcaatgcctatttaaagaccagtgctcattcaaaggt

SEQ ID NO: 16734 - DNA, 121 bp, Artificial Sequence
  Synthesized
  misc_feature (61): n=t or c
tagccagtccctgttggagaggtgctctgtccctctgatggttctagttgcctgcatgacnaactctatgttcttgtgctggaggatctagagctgaatgcagtactgatggggccttaca

SEQ ID NO: 16735 - DNA, 121 bp, Artificial Sequence
  Synthesized
  misc_feature (61): n=a or g
ggtaaagtcattgacttcaagggatttgtatagcattctgctacactttgaattcagcacntattaaaatgccattctgaaaggagggattggctgttatcttacctttgcagatgaacaa

SEQ ID NO: 16736 - DNA, 121 bp, Artificial Sequence
  Synthesized
  misc_feature (61): n=a or g
tttaggatctggacagctttaagtagcatgacgtaagccatagattgtaggctccataggnaagtgactatttttggcttttcatattttgtacagtgtcaagaataccaaaggcttctgt

SEQ ID NO: 16737 - DNA, 121 bp, Artificial Sequence
  Synthesized
  misc_feature (61): n=a or g
atgtatatggcaagtacactgaaaagaacacttgcagggagaagattcttacctgaatgtnatgattgctgatggcatttcattaaaggcagactttcaggccaacgaaatatttgcattt

SEQ ID NO: 16738 - DNA, 121 bp, Artificial Sequence
  Synthesized
  misc_feature (61): n=a or g
aaagattcagcatcatagagcagggttacagtggaggacctcttaggatcactgctgtctntatcctgagatccatcagtgatggggaaggggagctgggctgcactctgcacttggtggc

SEQ ID NO: 16739 - DNA, 121 bp, Artificial Sequence
  Synthesized
  misc_feature (61): n=t or g
tccagcttttagcaaagataggagcattttcttttaaacacaattgaaacgcatacacttngaccttgtcctcgcaacacagccctacaatggagaatgtgggattgtccctagctgtgct

SEQ ID NO: 16740 - DNA, 121 bp, Artificial Sequence
  Synthesized
  misc_feature (61): n=t or c
ttgtttttcttttttaacagcagcagatatcatgcccttacagagtttgtcctacaaagangacacagacttattatttctcttagtattaagttactaccattgcactccttaaacacct

SEQ ID NO: 16741 - DNA, 121 bp, Artificial Sequence
  Synthesized
  misc_feature (61): n=a or g
tataaaaatgaatttccgtaacaagatgtataagagggagttgcataaagcagagccaggnttcccctacacagctttcttcttctgtatgcaacaactgcgtatagcattttgtattgaa

SEQ ID NO: 16742 - DNA, 121 bp, Artificial Sequence
  Synthesized
  misc_feature (61): n=t or c
ggttcaggatgaggatcctatcatagtagtgttcattcagaagggttctcagtgatctgtncaaagcacggtttggtgttgccagacagagaaacagcactaactcaatattcagggtcct

SEQ ID NO: 16743 - DNA, 121 bp, Artificial Sequence
  Synthesized
  misc_feature (61): n=a or g
atgtgtaaattagagacaaattagttaagaaggcggtccaattcctaggagcacttggcantctcactcagaaaatccatgacagaatacacaaatcacaaaagtctgtacattggtcttt

SEQ ID NO: 16744 - DNA, 121 bp, Artificial Sequence
  Synthesized
  misc_feature (61): n=t or c
agtgcagattatgcttgcatgcattgcacttttattacttttttcatcggaaagtctcatngctgtattttttacaaatgagtttaaatcatttttcaaagtaaagctgctaacaaattag

SEQ ID NO: 16745 - DNA, 121 bp, Artificial Sequence
  Synthesized
  misc_feature (61): n=a or t
ctggatacttgaggaaatcatcccttttgaaggctttttcccattagaattacacctcatnagttcacctgaaacataacatttttttatttaaagaatacttaggatgaaaaccttaaat

SEQ ID NO: 16746 - DNA, 121 bp, Artificial Sequence
  Synthesized
  misc_feature (61): n=t or c
aatgggccagtgcaggtggtgctcttgatatcagacatcagtgtggagctggcactcactngattcacaccagttgtcccagtaactgatctggaaatgtacattactcttgcccagtggc

SEQ ID NO: 16747 - DNA, 121 bp, Artificial Sequence
  Synthesized
  misc_feature (61): n=t or g
attctcactaaatacactgaaaaatgctccatgtttatgctgctttactcatcagctgacntcagtagtatttccaaatttgagaggtgattcaaagatacataagctgaggcaaagtaag

SEQ ID NO: 16748 - DNA, 121 bp, Artificial Sequence
  Synthesized
  misc_feature (61): n=t or c
tgttacgattacaattttaactcctaacagtacaatagactgaagatgcagcttggcagcntcatgctatggtgatgttattgttcctgagtaggcttggtgagaaaaggcaattctaatc

SEQ ID NO: 16749 - DNA, 121 bp, Artificial Sequence
  Synthesized
  misc_feature (61): n=a or t
tgcaggtgaaagttcacaattctaacctcttacagcttcctgactgcaaagcacagacacnccatagattttcagattattttaaaagtgtttaaaaaattagacagacatatatctgcac

SEQ ID NO: 16750 - DNA, 121 bp, Artificial Sequence
  Synthesized
  misc_feature (61): n=a or g
tgtcttgagtgagcaactgagccccagtgctggatgagaaggatctcaaccctctcccaanctgggtgagctgaaacagacagtgaacagacttgtccacgaagatgtttggctgttgtct

SEQ ID NO: 16751 - DNA, 121 bp, Artificial Sequence
  Synthesized
  misc_feature (61): n=c or g
aaaaatgaagccaaaaacttcagtaattatatgtaagattaaagggaaatggcagatattnaagtaccatctaatccagcaggccaggtgctgatcccatgtccacttttacaatatatat

SEQ ID NO: 16752 - DNA, 121 bp, Artificial Sequence
  Synthesized
  misc_feature (61): n=a or c
ctcctgccctttgagatctgaaacaaactgatactgaaaggagagcctttccccaggctgnaggtatatggagacaatgcagacagtgttattgagccctgtttaatgccctagaagccac

SEQ ID NO: 16753 - DNA, 121 bp, Artificial Sequence
  Synthesized
  misc_feature (61): n=c or g
tgtgttctatctgtatacttttaaagcgccatttagcaggtttttggttttgcccactganttatgcttatcatttgtacttctttgtatttcgtttcaacaaaatagtctttggtgacat

SEQ ID NO: 16754 - DNA, 121 bp, Artificial Sequence
  Synthesized
  misc_feature (61): n=a or g
ccgacagtggctggatgactctgctgcagctggttttcattcctattccaattgactcagntggcctacagctccctctttctctttactgatcttgttggaggcatcagggagaagcaca

SEQ ID NO: 16755 - DNA, 121 bp, Artificial Sequence
  Synthesized
  misc_feature (61): n=t or g
tcacttcaagatccctactagtggaaaggtagaggaagaagcaggtactcacacaaacagnatcagtgaataacgtgaacacagagcaactgaaaagcagtaaacccagcaacacaaagaa

SEQ ID NO: 16756 - DNA, 121 bp, Artificial Sequence
  Synthesized
  misc_feature (61): n=t or c
tgccccggcacccagccttaatggtaggaagaaagggcaacaactgtgcagaaacacaacnatctctctcggctactgggtgcactcacatttttcaagcacggaaatccaagctcttccc

SEQ ID NO: 16757 - DNA, 121 bp, Artificial Sequence
  Synthesized
  misc_feature (61): n=c or g
ggtaatgcataggtagttatggatttggtactctggcaaatttgcagtcaattctctattnaaaaactgcacttctggcagtaaatacctcttgcagatctgaagagatgtcaccaaaaaa

SEQ ID NO: 16758 - DNA, 121 bp, Artificial Sequence
  Synthesized
  misc_feature (61): n=a or g
ttgttgatttattcttcatatatcagttttacaatataaacataataaagttagtaacacntagggtgtaagtccactgatttccacttggaaaatagaaaacacagtagctgcattgagt

SEQ ID NO: 16759 - DNA, 121 bp, Artificial Sequence
  Synthesized
  misc_feature (61): n=t or c
actccgaaggcagctaggagaaatctttggttccactgatctcatgcgtatggcaaatttnaacttcccagacaccagctggaaatatcatactgccatgacaagcaagactgcaaaattc

SEQ ID NO: 16760 - DNA, 121 bp, Artificial Sequence
  Synthesized
  misc_feature (61): n=t or g
agggaactgagctgcggaggctgatgacagaggatgcaggctcatcttacagaaagacacnagagaaaagtggcaaaacaaaagctaaaagggcagtgcaaggagagcggcttatggaagc

SEQ ID NO: 16761 - DNA, 121 bp, Artificial Sequence
  Synthesized
  misc_feature (61): n=a or g
cctcctcttcacaatgcctttatacagcttccattgcaattccctcaggttacggaagacnacatatggtacttctggcactggcaataagtatgtattatgttaacatacatgttataca

SEQ ID NO: 16762 - DNA, 121 bp, Artificial Sequence
  Synthesized
  misc_feature (61): n=t or c
tttagcccaagatctttctgcagtaattaaattcatccctgtgaaatctaattgactgtanagtatgtaaagtggcacagtggtatctaagagtatgtgtctggcatttaatacttatttt

SEQ ID NO: 16763 - DNA, 121 bp, Artificial Sequence
  Synthesized
  misc_feature (61): n=t or g
ggaaaggtaacttgctctctcggtactactgtcagcactgcaggacaacccctttgatgtnaaaaggttttgttccaggagacacgaggcttttacagaaggaggttaaaagccacactgt

SEQ ID NO: 16764 - DNA, 121 bp, Artificial Sequence
  Synthesized
  misc_feature (61): n=a or c
aaagagtcactgcatttattgtaaagtgtgtgatttcaaagtttctgcaataactacaagncagtgtaaatcacatggcatgtctaaacagaaagatagctttcatacacttttgtgctag

SEQ ID NO: 16765 - DNA, 121 bp, Artificial Sequence
  Synthesized
  misc_feature (61): n=t or c
cttcagtacaagagagatgtggacatcctgatgcaagtctagcgaagaccaccaggacaangaagagatggaataatctgatatgcaaggagaagcagtaagaactggagctgttcagcct

SEQ ID NO: 16766 - DNA, 121 bp, Artificial Sequence
  Synthesized
  misc_feature (61): n=a or g
ttcccagaagtggggaatactattttccagatcacttccaagcacaggggagattcagaantctatttatagctactttgagctctgcctcgctacctgggcggtatccaagttggtgtct

SEQ ID NO: 16767 - DNA, 121 bp, Artificial Sequence
  Synthesized
  misc_feature (61): n=a or t
tgaacacagtaaataactccagcaagttcttctcaacgtgcattaacaccttttactgctncatttataaggagcattttcctcttctccctccacatcacttgtatttaagttcattgtt

SEQ ID NO: 16768 - DNA, 121 bp, Artificial Sequence
  Synthesized
  misc_feature (61): n=t or c
gctgattccactgaaactatattagtaactaattttgctcctgatgtatgtctttctattntgttttggctacattatattagctttctccacaggaaaaactgcatttacatgacacttg

SEQ ID NO: 16769 - DNA, 121 bp, Artificial Sequence
  Synthesized
  misc_feature (61): n=t or c
ttccatcctcccttaaaaaggagagcatgttctcaagcctgtcatgaagaatgaactgttnacttatgaactccattaggttagcttattcttgggctaagtttcttcatagcctcatgct

SEQ ID NO: 16770 - DNA, 121 bp, Artificial Sequence
  Synthesized
  misc_feature (61): n=a or g
tatttaagacttttccttcacagaggcaattagcctctaggggagatggtactttactcanttcagctctgaaaatcccaccacaattctaaacaatcaacttgagcaagtggtgagggca

SEQ ID NO: 16771 - DNA, 121 bp, Artificial Sequence
  Synthesized
  misc_feature (61): n=t or c
attgggtgccccagggaggccgatcccaaatcttgagtaccaggccccaaaaacacacacngatggacaaagccatgggtcgggtgttttcttccctgccacggaggcagctgctttgatt

SEQ ID NO: 16772 - DNA, 121 bp, Artificial Sequence
  Synthesized
  misc_feature (61): n=a or g
attctcatataaaatgaggagtaggagagggtggctactctgctttcaatagagtgtttcnagaggcagatgccatatatgaataactatcagtgtaacattttttatattggaaaatcaa

SEQ ID NO: 16773 - DNA, 121 bp, Artificial Sequence
  Synthesized
  misc_feature (61): n=a or g
tgtgtgttccatttgtgttcttcctgagcagcgctcccttcgcaggacttgtagctggaangaaatttcagaatggttaaagtacttaagtagagaaggaatgaatgtcagcattgctcca

SEQ ID NO: 16774 - DNA, 121 bp, Artificial Sequence
  Synthesized
  misc_feature (61): n=t or c
gaaagcacactgaaatgaatgggtacagccactcgttcttatgaggggcagcaggagccangtcaaataaaaccctacaactcaagcagcaggtttggggtaaacactgcttctttcatga

SEQ ID NO: 16775 - DNA, 121 bp, Artificial Sequence
  Synthesized
  misc_feature (61): n=t or c
acatgacacagtgacacgcaggctgttctggttaaggatgccttcaacaactgttacacanaggacttgtaaacctacacgcaaacaactgagacccctccttcctcctttacttacgtta

SEQ ID NO: 16776 - DNA, 121 bp, Artificial Sequence
  Synthesized
  misc_feature (61): n=a or g
actcccctcaactgtcttcaaaaacttttttgaaagcctctacgccaattttcaaaatgtntgctgttgaaatgctatatggagactgtctttttggataaatgatggtagtacaggccta

SEQ ID NO: 16777 - DNA, 121 bp, Artificial Sequence
  Synthesized
  misc_feature (61): n=t or c
aaagcaagagtttgaatttgactatcatacatttgaatatcaaacagacacttcagcacanactgcatgaaggcactgccaaggcattagtaaatatctcctctgccccagcacggattta

SEQ ID NO: 16778 - DNA, 121 bp, Artificial Sequence
  Synthesized
  misc_feature (61): n=a or c
caggtttcagaggagaagccaaacacgatatcatgataaaactcaggaagaagcgattatntgaccaaactctgaatctagaaaacacccacccctttgggtctgatgtatccaagagctg

SEQ ID NO: 16779 - DNA, 121 bp, Artificial Sequence
  Synthesized
  misc_feature (61): n=t or c
tgcaaagagagaaacatcttggccatgttacaaaatggtttgatgcttctggattcttagngttatctttgggataactttttattttcttatttttttgatacacagtagagtgattgac

SEQ ID NO: 16780 - DNA, 121 bp, Artificial Sequence
  Synthesized
  misc_feature (61): n=t or g
tcatcaagtccaacctcaaaacttaagaatttgcctgcctgtccacaccacattgtttacntatcagttctcacctaacagttggggactgagtatgcaaatacctgtttgaatgactggg

SEQ ID NO: 16781 - DNA, 121 bp, Artificial Sequence
  Synthesized
  misc_feature (61): n=a or g
acacctgttcaaaaggaagggctattaaaagagctagaagagtaacaggaagggcagagcntttggaggaagtcacagattctcagttgggctcaaaggaatgtgatggtctccaggagag

SEQ ID NO: 16782 - DNA, 121 bp, Artificial Sequence
  Synthesized
  misc_feature (61): n=t or c
tagtacaatatgccagctaaagagataaaaattattgtcagcaagaaagataagagtgcangtgacatgcatttttgtaattaaattggagatgtcagaacacctgagtttaatgataaag

SEQ ID NO: 16783 - DNA, 121 bp, Artificial Sequence
  Synthesized
  misc_feature (61): n=t or c
gttgtggtctgttttttaacactgacacatatgcaggattttctcagacagctttgtatcnatgcaaataagtattgccaggcataagtgtacctattccttgtttaatcaagttgttttt

SEQ ID NO: 16784 - DNA, 121 bp, Artificial Sequence
  Synthesized
  misc_feature (61): n=a or g
tgcacaaggatgtcttttatatctttcacagctctgtttcctccagacctgaaaatagtgnggagttcagtaagaagtcaggagtgagtcagatggtgaaatgaaaatagtatctttgcct

SEQ ID NO: 16785 - DNA, 121 bp, Artificial Sequence
  Synthesized
  misc_feature (61): n=a or g
catataaaaattgtttttatgattttttatgcatttttgtgatcctataactgcataatgncactaagaataacgtaaattgtcatgtcatttccgatgcacttgtaaattcttactccca

SEQ ID NO: 16786 - DNA, 121 bp, Artificial Sequence
  Synthesized
  misc_feature (61): n=c or g
ttcttactaaactaagtgagaaaatagatattgagcagggagaatactcatgatgaatcantcataatcagaaatcctatttcttcaaactggcattaacaagacaactgttaagactaga

SEQ ID NO: 16787 - DNA, 121 bp, Artificial Sequence
  Synthesized
  misc_feature (61): n=t or c
gcaatgaacaagtcaggaagactctatggaaaggtatgaaagctaaattctcctcaaccangtaagcaactaccacgctaacgtctctaacaatcatcatgaactatcttaaaaacatatg

SEQ ID NO: 16788 - DNA, 121 bp, Artificial Sequence
  Synthesized
  misc_feature (61): n=t or c
gttttcccgttcctagattaagtgttttcagccataagtgtttaaccttttccttcctcanagctaaagctcttgtccaagctgttgtctcaccgtgcctcagctaacgcaacatcctttt

SEQ ID NO: 16789 - DNA, 121 bp, Artificial Sequence
  Synthesized
  misc_feature (61): n=t or c
atggcgataaagaaggtgccttggaagagagatggggatagtgtgagtaaggagcctttcngttctaagagtaaggaagcatgatctgaatgagcagatggtttgaagacagtggtttttt

SEQ ID NO: 16790 - DNA, 121 bp, Artificial Sequence
  Synthesized
  misc_feature (61): n=t or c
gtgactctgacataattcctccaaaaggctggagaagccctgcttagagaaattgagatgnccaaaaggagttaatcccctggctctttgaacagtacaggcagcttaagagtaaacatag

SEQ ID NO: 16791 - DNA, 121 bp, Artificial Sequence
  Synthesized
  misc_feature (61): n=t or c
aaaggagcatcctgcatctatcaaagtcacattacagcaacttgtcccgcagacagtttcntacagaagcccattgtatttatcaatccgtgtaactgaaaaagcagtatcttttattaac

SEQ ID NO: 16792 - DNA, 121 bp, Artificial Sequence
  Synthesized
  misc_feature (61): n=t or c
ctattccttgattatgtggcaaaacttctaaatgtactggctgacttttatgagatttttntacctacttttttctccattattctgaaacatattttttgcctaatgattactaagagca

SEQ ID NO: 16793 - DNA, 121 bp, Artificial Sequence
  Synthesized
  misc_feature (61): n=a or g
gagaactagaacactacaatttacttgggagctctttcatcactgttccaaaatcactganaacattgaactggctgagctggtgagaatcaaatctgtgtagctcagtttttcagcacac

SEQ ID NO: 16794 - DNA, 121 bp, Artificial Sequence
  Synthesized
  misc_feature (61): n=a or c
gactaaaataataccaaggagaaccaaatagggtagcataataatttacatataatgcatnaagaacaacttagcagatactaaatgtataattgtgtacagtgtgtacagtggtagtttt

SEQ ID NO: 16795 - DNA, 121 bp, Artificial Sequence
  Synthesized
  misc_feature (61): n=a or t
ctagactgggctgctcctgacttgcagtaagctgatggaacctgtttcggtgatgacaacnactgtgtaaggtgtaatttttaatacctcataacaatgagctgtcaactgtaacatgcag

SEQ ID NO: 16796 - DNA, 121 bp, Artificial Sequence
  Synthesized
  misc_feature (61): n=t or c
ggaagggttaatgcattaccatatgtgaagtcctctgaaatcctcagatgaaagactcttnagaagtgcaaagagctattatttatctggcacctgaggagtgacttgtgcaggagctgct

SEQ ID NO: 16797 - DNA, 121 bp, Artificial Sequence
  Synthesized
  misc_feature (61): n=t or c
atctcatcacagggttacatgaattttgtatgtcttcttgctttttctgtttaaaggtttnaatggagaatgtgatgaatgttgttagaggaaactgctggaataaacgtgttgtgggctt

SEQ ID NO: 16798 - DNA, 121 bp, Artificial Sequence
  Synthesized
  misc_feature (61): n=t or c
ctggctgagctctcccggaaatacagccaggcattttggtaatatctttgggaagtctcangctttgcaagtgctgagccctggaaaatttgcccctatgcatttatgactacattactta

SEQ ID NO: 16799 - DNA, 121 bp, Artificial Sequence
  Synthesized
  misc_feature (61): n=t or g
agttttcatgtcactgtgctcacatagaaatgccgcatggacatctctgcatggatcaatntgggtaaggtacagtaccgaatcacagaataatagaatcaccgaggttggaaaagacctc

SEQ ID NO: 16800 - DNA, 121 bp, Artificial Sequence
  Synthesized
  misc_feature (61): n=a or g
aagaagtcaggtgagacagtcctagtcattgataccacattgataccacgtcacttggacntcggaagtttcctgttagctcctgagaaataccaatgcagttcggcatagctctgccaga

SEQ ID NO: 16801 - DNA, 121 bp, Artificial Sequence
  Synthesized
  misc_feature (61): n=t or c
agctttgcagctgcaaacaacacgggcactgggacaacttggctcctcttccaaccgcttngagcttctacaaatcagatgcccaatcagcccgtgtgtgaaatcgctcagaacgttccct

SEQ ID NO: 16802 - DNA, 121 bp, Artificial Sequence
  Synthesized
  misc_feature (61): n=a or g
gctgacaaatatataccttttcaaaggtccagaatgggcacttgctacatttcacttaagncttacagaggtttaattagcttttcatagatcccatcttaatattttgcatagtatgttg

SEQ ID NO: 16803 - DNA, 121 bp, Artificial Sequence
  Synthesized
  misc_feature (61): n=c or g
ccttctataacgatgttaggatttaatgcatttacatcttacttttccatagggccaactnctcccaaattttgatttcatgttggaggaattaaacaggttatatgttaaacacagagac

SEQ ID NO: 16804 - DNA, 121 bp, Artificial Sequence
  Synthesized
  misc_feature (61): n=t or g
attttccagtgagttgcctacatcatatggtaatattcttccttgaaggtaactgactttnttccagactcttcacaggagtagaaagaaagctttatacaaagtccatttcactttctag

SEQ ID NO: 16805 - DNA, 121 bp, Artificial Sequence
  Synthesized
  misc_feature (61): n=c or g
gggtttaaaacaaacgaaaataagtaatcatttatagttgttcattacaaggatatgttanttcatgcttaacaaaagaaatatcatgcataccttactggttttgttttgcccttgccat

SEQ ID NO: 16806 - DNA, 121 bp, Artificial Sequence
  Synthesized
  misc_feature (61): n=t or c
tccctctcagaacagagaggagagagagagagagagatttttcaacatcagttttcattanaaacatggagggtagcgtctgtttttaagtaggtctgttaaaggaatacaagtgaaactg

SEQ ID NO: 16807 - DNA, 121 bp, Artificial Sequence
  Synthesized
  misc_feature (61): n=t or c
tatctgtgtatgagactggctcatggcacagtggataacaaacttgtcttttggacagtantgtcacaccgctcttgttactagcaaggtctacagcagtagagaaatctcatcagttaat

SEQ ID NO: 16808 - DNA, 121 bp, Artificial Sequence
  Synthesized
  misc_feature (61): n=t or g
gcagacggaaggataacagctacagcggcacctatatgctgggactgccatgcttttaacnctcagaattgacagacatattaattggagacagctgcaaggaaaaatatcctaacgacat

SEQ ID NO: 16809 - DNA, 121 bp, Artificial Sequence
  Synthesized
  misc_feature (61): n=t or c
gtcatattctatgctataacaccatcatccctacagaatctggagccagaccttgagtttncttggcaaatcaatacagcaagcagattccaagaatgaaatcagtcccactagcagtcac

SEQ ID NO: 16810 - DNA, 121 bp, Artificial Sequence
  Synthesized
  misc_feature (61): n=t or c
agctggaaagtgatcctactgtggttggggctcaaagtgttaagaataagatcgcacgcantgtgtcatagggcaggatgtatctactgaagaactctaacagtgtaaagcataaaagtga

SEQ ID NO: 16811 - DNA, 121 bp, Artificial Sequence
  Synthesized
  misc_feature (61): n=a or c
ggcttatacagcttatttcagtggctattagtaggtatctgtgaaattgtaaaagcacttnctttgttcccttctcatataatgcttggcccctacttaaaacagagctaagaaaagaatt

SEQ ID NO: 16812 - DNA, 121 bp, Artificial Sequence
  Synthesized
  misc_feature (61): n=t or c
atgccagtggctctgccaccccaatgtcagcttctgccatccttgccatcagaaacctttntcctaatatttgaaatgaagctttctatctacaaattaagaccaatttcttgtactctct

SEQ ID NO: 16813 - DNA, 121 bp, Artificial Sequence
  Synthesized
  misc_feature (61): n=a or g
ttcattgcagtcgcaccaaacggagtgtacggcctgataaaatccctacagaaagcggtangttgtagaacagattaagaacactctcatgctattgctcttcatgcagcgcaaaagcaga

SEQ ID NO: 16814 - DNA, 121 bp, Artificial Sequence
  Synthesized
  misc_feature (61): n=c or g
ctctctaggtacgtaaggcaggcttgtttctcagttactggtatcagttcagaaatgaccnactctctttgctgttgtgataatggattctctagaaattcctgaaataaagaaatgcaat

SEQ ID NO: 16815 - DNA, 121 bp, Artificial Sequence
  Synthesized
  misc_feature (61): n=a or c
aagctctgataaatagtacaaccaacttttaacaatgcgaacatgaagaaccatttgcaancagcaaacagaccaaatctgtactgtgctcagctctacacgcttccccctgttcttgcca

SEQ ID NO: 16816 - DNA, 121 bp, Artificial Sequence
  Synthesized
  misc_feature (61): n=t or c
tgtaggtgctaactataagtgatgtaactgtggttaccgggagcgaaacagccataccagnggttacctgatgaaagtatcagggaatttaagaagcaggatatgtttatgtcagtgaagt

SEQ ID NO: 16817 - DNA, 121 bp, Artificial Sequence
  Synthesized
  misc_feature (61): n=t or c
tccatcccatctgcttggcgaccgcctgttgttgggttaatggtgaaaccatcgtcatagngcacttctgctgcagcatttgcatttcactaccttgcccttccaggacagcatggctgtg

SEQ ID NO: 16818 - DNA, 121 bp, Artificial Sequence
  Synthesized
  misc_feature (61): n=t or c
ggccttattctttctagagtatactgtaaataactggactctgaacttggttatctacctnaggcacagctttttcttctttaattttgcacttgtatggcatcaatctagcaagtttaac

SEQ ID NO: 16819 - DNA, 121 bp, Artificial Sequence
  Synthesized
  misc_feature (61): n=a or g
tattgacacagtattcataacaaagccatcttctgtgtgaccatttctgctttctcaaggnagaacatattctggactcctttataataagacgtaagggatgtaagaagtcataaaagag

SEQ ID NO: 16820 - DNA, 121 bp, Artificial Sequence
  Synthesized
  misc_feature (61): n=t or c
ttatggcatagggaaagaataaggaattccttgaatgaggaacctttcaaaagagttcttngctgccccttcactgttcttatttagtggcttggtgtttctgagcacagttaaacatgtg

SEQ ID NO: 16821 - DNA, 121 bp, Artificial Sequence
  Synthesized
  misc_feature (61): n=a or g
caagcacttggaatctgctcttcctgggtagatcttgctgaaaggcatcagaagtttcacntttgtgtccgaagagatggatgttctcactgtggttacagccaacactgtcaggcatgga

SEQ ID NO: 16822 - DNA, 121 bp, Artificial Sequence
  Synthesized
  misc_feature (61): n=a or g
agccaaagttgtgtgactttatgcacacattcccaaatcaagaagacttccagggcctggngcatgatacagaggcaccagggagtgctgcagagctgcagaggacctgcactgctcagac

SEQ ID NO: 16823 - DNA, 121 bp, Artificial Sequence
  Synthesized
  misc_feature (61): n=a or g
tgccttggcacagctcacaggctatgttacacatttctgggaaatgcatgtcaaaatcccngcgtttatttgcttggtttaagcaatcgtcgcagatctaactgtggggaaaggcaactcg

SEQ ID NO: 16824 - DNA, 121 bp, Artificial Sequence
  Synthesized
  misc_feature (61): n=t or c
ttgagttctgtgaattaactgtggctttcttcaacttgtgtcatgaccagcttgtgctctngtgctgtacggcactactacataggcaatctttgaattaaaacgtgaggctgtaggttgc

SEQ ID NO: 16825 - DNA, 121 bp, Artificial Sequence
  Synthesized
  misc_feature (61): n=a or g
aaattcttaaaaattactattcaaaggaattacacttctggcaaactactgtatgaaaacntaagattatactgagttatatatatattatactgagttaccaactcagtactccctgaag

SEQ ID NO: 16826 - DNA, 121 bp, Artificial Sequence
  Synthesized
  misc_feature (61): n=t or c
gttgatcaaattccaattccagatgcacacaggagaaaagctcagtctgatttgcttgtgnagaattgagggtagttactctggaagaagctgagcgagtaattgagaacctttgttcctc

SEQ ID NO: 16827 - DNA, 121 bp, Artificial Sequence
  Synthesized
  misc_feature (61): n=t or g
tcatctgacttaaggcctcacaacaattcttaggagataacatacatcccttaaaaagaangcattcatacaatgttatcagtaacaatgcagagcaacagaagtaggcttgcagaagacc

SEQ ID NO: 16828 - DNA, 121 bp, Artificial Sequence
  Synthesized
  misc_feature (61): n=t or c
atgggtaagaactgcttgcattcattagtcatctttattagattgcttaaatatgttaatnagcgtcacatataataaccgaaaagtctacatcattctttaactcattaaaactactaac

SEQ ID NO: 16829 - DNA, 121 bp, Artificial Sequence
  Synthesized
  misc_feature (61): n=c or g
atagtgagttgtaggagagctaggaatgaaacaaatgactcgtggttatcagtccttggcntaattgctttgttgtgtatgtgggagggtaaatggatggccaaactctgtcatggattga

SEQ ID NO: 16830 - DNA, 121 bp, Artificial Sequence
  Synthesized
  misc_feature (61): n=a or g
ctggctgtggcgtcagtcaagccttaccaccccaggtgccctcacctcaggcttcctagcnctacaaaggccttatactgcagaaaaacatccctattttatagcctgatgaaaaggcagc

SEQ ID NO: 16831 - DNA, 121 bp, Artificial Sequence
  Synthesized
  misc_feature (61): n=a or g
cacatgctgcaatcatgtattgggtcctccccttactttgagtttctctgtgctttgctgnagcgatcttgctgccaggtgggatttctgggtgagcagcccagcatcatcagcacgctgc

SEQ ID NO: 16832 - DNA, 121 bp, Artificial Sequence
  Synthesized
  misc_feature (61): n=t or g
ccactgacaccgtcccgcggggggttctcgcccggggcgtcgggcccttcgtgctctgcgnggttctctactgtctgcgcattgatgccgggtcgttacgagctggcagtgcgggggaaag

SEQ ID NO: 16833 - DNA, 121 bp, Artificial Sequence
  Synthesized
  misc_feature (61): n=t or c
ttcaaagcaaaagttctgccaagcaaatgtttaatgaaaaaaagtgaggagacttaactancaaaatttgattgaaaagctagacattctttgtgcagataatactaatgtagtaaataag

SEQ ID NO: 16834 - DNA, 121 bp, Artificial Sequence
  Synthesized
  misc_feature (61): n=c or g
tcactcatttgttctggttatattatgtagccttagaaagcagatgggaccaacctccatncttgggaacttttatatttaaaacattctagtctttaactggcacattattaaaaatcct

SEQ ID NO: 16835 - DNA, 121 bp, Artificial Sequence
  Synthesized
  misc_feature (61): n=a or g
ttctccaatttttactcctaagtaaaccctttgtaagcatcagtctgtgtttagtggtatntctacttccacctgcctttgaagcaatgtgcatgagcatagaatcatagaaatcaccaag

SEQ ID NO: 16836 - DNA, 121 bp, Artificial Sequence
  Synthesized
  misc_feature (61): n=a or t
tgacacaattacatggaatccagtaattaagaggaatagtttgtaaattgcacatttgtangtctaagggtgtgtgtgtatagctcagtagagagctacacaagaagcagtagcctcaact

SEQ ID NO: 16837 - DNA, 121 bp, Artificial Sequence
  Synthesized
  misc_feature (61): n=a or g
gttctgagaaatgtaaggatatttttctaaaccagtaccatggcccaggtggcttcctcanttgtcacacacgtcatgagcaaattaagctactcctctgttgaggtcagacacatgtaga

SEQ ID NO: 16838 - DNA, 121 bp, Artificial Sequence
  Synthesized
  misc_feature (61): n=a or g
acacacaaaaaaaaaaacaactgcaaccctgagctgtaaatagctacaatacataacaaangtctgtggtttgtcacatgcctagctagttctgttttcctgggaagctgtatgctgtcct

SEQ ID NO: 16839 - DNA, 121 bp, Artificial Sequence
  Synthesized
  misc_feature (61): n=t or c
caggaaactgagctggcatgtgtggttatatagcttagcaagaaagaaggacatttccccntcgtaaggtaccctgaaagtgctgactgctccttatttggctgcctcagtgttgagctgc

SEQ ID NO: 16840 - DNA, 121 bp, Artificial Sequence
  Synthesized
  misc_feature (61): n=a or t
gaagacacaaacttcagatagcgttacgcttgcgaggacttcaagctagtgatggtaatgnatgactttgtgccgtgtagtacacagaatttcacaccgggctggaattaaacctgtcttc

SEQ ID NO: 16841 - DNA, 121 bp, Artificial Sequence
  Synthesized
  misc_feature (61): n=a or g
tggggagtacagggggagggggctgcaaaagcactgctgtgctgcattaacccttatttangttctctgaagtataaagtgatttttttaaggtgtgttctggcacagtaaggagcttttc

SEQ ID NO: 16842 - DNA, 121 bp, Artificial Sequence
  Synthesized
  misc_feature (61): n=t or c
tggaagcagaggagggcagctgctggaaaagctgagcaggacagacaacagcttccttgtncaagagaaagtcctgtgtctgtatgatttctgaagtcataattacactatggctgattct

SEQ ID NO: 16843 - DNA, 121 bp, Artificial Sequence
  Synthesized
  misc_feature (61): n=t or c
gctagagatctctggcataatagctaaaacagctttcatttagcattcttccatgaggagnttctcagtgtctgctgaaaaaggcagcaatgcaaaagatctcattacaatcgtatacaat

SEQ ID NO: 16844 - DNA, 121 bp, Artificial Sequence
  Synthesized
  misc_feature (61): n=t or g
tgcaaatacctacccttcctgtcagctgctctttcagcgtgaaaggcaagataaatctctngaatctggaggtattgcagcttcagaatgtctgagaatatcttgtggaattgattgtttt

SEQ ID NO: 16845 - DNA, 121 bp, Artificial Sequence
  Synthesized
  misc_feature (61): n=t or c
tgactgtatagctgcctctgttctaagggaagaaattgtaggagaggtgaggtaatcaggntaattctttcagaggatttacaaaaattagtaaataaataattgctgtgtacctctgcct

SEQ ID NO: 16846 - DNA, 121 bp, Artificial Sequence
  Synthesized
  misc_feature (61): n=a or g
ctttatttcttttttttttttttttcctagtccaaaagtctgtaaaactacacaaactttnccaaggatttctatgaggatgcagtggatatctttttccaggtacgttattaataataaa

SEQ ID NO: 16847 - DNA, 121 bp, Artificial Sequence
  Synthesized
  misc_feature (61): n=a or g
tcaacccattagcactctgcccactaaaccaggtaccttcctgaacagccacaaggttcanaaatcccaaatacaagtatccacaagatttgggtttgcttattcccctgaaacatcagct

SEQ ID NO: 16848 - DNA, 121 bp, Artificial Sequence
  Synthesized
  misc_feature (61): n=t or c
actgcagtgcagccgtggggaccgcaggggctgctgagttggttcccctcaccttggtttngcttaggcttcgctcctggttgtttctccgtgaggagcacagctcagtggcctttcacca

SEQ ID NO: 16849 - DNA, 121 bp, Artificial Sequence
  Synthesized
  misc_feature (61): n=t or g
gacaccaagaagacacatccaagatagatgtcataataagggaggttgtagacaatattcngttatatgatataggagttcaccactcacagtaagttactttgatgattctcttagtata

SEQ ID NO: 16850 - DNA, 121 bp, Artificial Sequence
  Synthesized
  misc_feature (61): n=t or c
ctgagatcatgctaacaggtttcaaagaagcagaaagctgtgataagaaaactgaaagaangaaggctttagtttcccatgtgtaggaagtctctgtgcactctgccactccactgctact

SEQ ID NO: 16851 - DNA, 121 bp, Artificial Sequence
  Synthesized
  misc_feature (61): n=t or c
cttctgcagatgagcataggaaatcacgggtgtgcatgtataattctgaggctttatgganttcagaaggctactgactctaaatagcaactcacaactacaatgttgatgcagttgatag

SEQ ID NO: 16852 - DNA, 121 bp, Artificial Sequence
  Synthesized
  misc_feature (61): n=a or t
acagagctggtcatcatatatcaagatagacttcagaacagtgcagaaaagccaggatgangacaaaaaagcaaatagattctatctctaatttatgggttttgtgggctacaatctctca

SEQ ID NO: 16853 - DNA, 121 bp, Artificial Sequence
  Synthesized
  misc_feature (61): n=a or t
gcaaattatcacagcaattaatgcactgttttgtaagtatggcagtttttaccagatgatnatcttcctcctggcctgcaagaatcaccaattcaatacacgacacaataaagatggttac

SEQ ID NO: 16854 - DNA, 121 bp, Artificial Sequence
  Synthesized
  misc_feature (61): n=a or c
ataggagatgccaatcaataccttgggaaaaaggaacacggtgtttactaaagtgatcggnttgaggtaaacagtgagctacagtttaaactagctgtcagcagctcattccgaaaggtat

SEQ ID NO: 16855 - DNA, 121 bp, Artificial Sequence
  Synthesized
  misc_feature (61): n=t or c
gcactctctgcttgacctgccgtccacatctcaccagcccatgacaaggggccaggcatcncttgtgtgcagagcactcagttcgagggtgagcagaagaggcagcactgtgcagctcagc

SEQ ID NO: 16856 - DNA, 121 bp, Artificial Sequence
  Synthesized
  misc_feature (61): n=a or g
tttctccatctatgcctgaaattgaattggtaattgaaactgtgcagcgagcagaactttnaaacaaaacttactacacctctctcctgtagatcttgcatcccttgcatattttcattca

SEQ ID NO: 16857 - DNA, 121 bp, Artificial Sequence
  Synthesized
  misc_feature (61): n=a or g
tgtgcctttatgctccataaaaccttccctgcatggctgtgctcgctgctggagcggctcnggactcggggtgtaaaagtttgggattgaaatcaatccgtcaccactgggtttatgacat

SEQ ID NO: 16858 - DNA, 121 bp, Artificial Sequence
  Synthesized
  misc_feature (61): n=a or c
ccttctgtaagtttcatgagacaagaagaattagctttacagctagaagcgaagtcttagnatgttgaatggcctaacactctaacgtctgatgtagccccaacctctgcatatttggagc

SEQ ID NO: 16859 - DNA, 121 bp, Artificial Sequence
  Synthesized
  misc_feature (61): n=t or c
tatgtagattttatcctttataaagaacatttccctcttggtggttcatttacagggaacnacagccctggacttaggaaaaaatagctgttgcaaacataagaagttagtgggttttgta

SEQ ID NO: 16860 - DNA, 121 bp, Artificial Sequence
  Synthesized
  misc_feature (61): n=a or c
ctgagtacccaagacatttctgaaagcagcatcttaaaatagctttattttagaagagagnaggttggaaataaaaaatagtggaggcgtaaaagaacacattatgggaagaattacttaa

SEQ ID NO: 16861 - DNA, 121 bp, Artificial Sequence
  Synthesized
  misc_feature (61): n=a or g
gtggctgccaaggaaagcaaacctgagatttagaaagttgtgccacttggcttctcctgcngccgctattcatcttcagcagaagctgtgtgtccgtagcagctctgagaaacagcgtgct

SEQ ID NO: 16862 - DNA, 121 bp, Artificial Sequence
  Synthesized
  misc_feature (61): n=a or g
tgagctgtcatgggacagaaaggcttacatggatcttaagttttacggatgggctacttgnagagtatcaggcacgttttcacacatattacagtatcacgctgattggtgtaagaaataa

SEQ ID NO: 16863 - DNA, 121 bp, Artificial Sequence
  Synthesized
  misc_feature (61): n=t or c
tttgtctctccaaacaacctgccaaaaccaagctacttgtaggtaaaatttcagcttgaangatgaaaattgcagcattttctaaagacaagaaaaggaaagatgcttaaaaggcctggac

SEQ ID NO: 16864 - DNA, 121 bp, Artificial Sequence
  Synthesized
  misc_feature (61): n=t or c
tgaagagccaggctgcctgttgacataatgaaaatgcatgtcagagcactaagaaaggtgngcaggctctgcattgcactctttcaattgattccaagaggatttgttcatgaaatatcaa

SEQ ID NO: 16865 - DNA, 121 bp, Artificial Sequence
  Synthesized
  misc_feature (61): n=t or c
tctttaaccctaactccagttctccttctcaaaagcaagtagcacagcttcattcacatcntgcactatgtaagatgcctccacgaggctggggtcaaagcagaagtcccgatggccgtgg

SEQ ID NO: 16866 - DNA, 121 bp, Artificial Sequence
  Synthesized
  misc_feature (61): n=t or g
tgagaacagtgaagagccagattttccaaaaactgtctgtactgttctggaacacagaganaaacctctggatggaaagcctgcttctctatcacagtgtcatccttcagacttgaacaga

SEQ ID NO: 16867 - DNA, 121 bp, Artificial Sequence
  Synthesized
  misc_feature (61): n=a or g
gaagaagattgtctgaagcaacaagtgaaagcagcattatgaatttcatagaggagaacgntttgacagagatgaagcaactttaccatgcaaagaaaaactgcttcactaaccagcaaca

SEQ ID NO: 16868 - DNA, 121 bp, Artificial Sequence
  Synthesized
  misc_feature (61): n=t or c
aaatctgctttatcaggggtgctctgctggtgaattatttgggtatttccaacaggagcantgagtaagagcccagaaacataaacgaagtaagaggaccagcttttcatggctgagcatt

SEQ ID NO: 16869 - DNA, 121 bp, Artificial Sequence
  Synthesized
  misc_feature (61): n=t or c
ctctttacagcagttctcattcctgacttcagttttcctcactgttaatggcagctatttnggtgtactgaaggcaaactgaagcagtaagtgcccacagctgctctgcaattttgaagtc

SEQ ID NO: 16870 - DNA, 121 bp, Artificial Sequence
  Synthesized
  misc_feature (61): n=a or g
gcaaaggaaatattctgaaaaccagtaatctaacaagaaaagagtcataagtggaagacanaagcatttcagttttatcaaaagaaaacaccaggctgcacctggagctctattttgggcc

SEQ ID NO: 16871 - DNA, 121 bp, Artificial Sequence
  Synthesized
  misc_feature (61): n=t or c
ctcttaatgacatccttggattgcatttgcaagaagtcagacacgtataaactgtcctttngtgaatgcaaacaatgatacttttcttctgttcaagaatggaaacaacaaagcagaaaag

SEQ ID NO: 16872 - DNA, 121 bp, Artificial Sequence
  Synthesized
  misc_feature (61): n=a or g
ccaacataggaataaactggaacaggaagtgaaaggaatcttgtggaaaatctgtgcttcngagagcacaggaagagttccttcctttggatggttgataatctctagaagttgtggatgt

SEQ ID NO: 16873 - DNA, 121 bp, Artificial Sequence
  Synthesized
  misc_feature (61): n=a or g
ctttctcaacaagatattcagctagttatggttataacaacattgtatcacataattaccnaaaagaaacacatgggaactccagcctgatgagatactatcaggtcccatgcactgggct

SEQ ID NO: 16874 - DNA, 121 bp, Artificial Sequence
  Synthesized
  misc_feature (61): n=t or c
tgcagtcatccatagctattctatatcacaaatatatgtactaaagtcagccttgcttttnaaaagtgcaaaatggtacagcttttagttctagctcagaggaaaaaaggaaaacaaacaa

SEQ ID NO: 16875 - DNA, 121 bp, Artificial Sequence
  Synthesized
  misc_feature (61): n=a or g
gcccggcttccatcattttcctgcatcctttccatcctgcaagcatgtctggccttctgcnctgaaaatcagcagccatctggcctccctggttcctgcctcctcacaggcagctgttcca

SEQ ID NO: 16876 - DNA, 121 bp, Artificial Sequence
  Synthesized
  misc_feature (61): n=c or g
cttcatgccattggtgatggcccagccctctgggctctcaagagctctcccaacgcctccntactactgagagtcagctgctcatccctaattactgtcatccacaaacttcttgcttggt

SEQ ID NO: 16877 - DNA, 121 bp, Artificial Sequence
  Synthesized
  misc_feature (61): n=t or c
catatatacaagtgtgtatgtatattcctgcataggatagagtatgaactattccatagcnctcttgtcactaacgtggaatattattcagctcaagaggcaattttctgctcctgagcag

SEQ ID NO: 16878 - DNA, 121 bp, Artificial Sequence
  Synthesized
  misc_feature (61): n=a or t
agccgtttgccagaaggcacttcggtgagcgcagaggtatctgaaataggtgtttcctcgnttaaaatgtcggattcggcggggggagcgagtaacttcgacacgcagggagcaatttctc

SEQ ID NO: 16879 - DNA, 121 bp, Artificial Sequence
  Synthesized
  misc_feature (61): n=t or c
gtttttgggggggtatgtttttgaagaagcaaaggggagcgtgacaggaaaatccgtgaangatcccatggacaaaatgtggatgggcaaaaaaaaagaggagggtgggtggggatcacag

SEQ ID NO: 16880 - DNA, 121 bp, Artificial Sequence
  Synthesized
  misc_feature (61): n=a or c
agtgacgacaagcatagatattgtttgttctgtgtgatactgctgagggggtacagcatanaatttgggagcttcaggtccctacaccatcgagtagaaggagaaggctcttccacaaaga

SEQ ID NO: 16881 - DNA, 121 bp, Artificial Sequence
  Synthesized
  misc_feature (61): n=a or g
atgacacacattacaatgttcaaaatgtagcgtttcagtaaagaccgctctaaatagaaancattgttgttcaatcacagagatgttggtaatcatgttaagcaccatcaaagctccacca

SEQ ID NO: 16882 - DNA, 121 bp, Artificial Sequence
  Synthesized
  misc_feature (61): n=t or c
aattttctgcaaacacagcactggaaaagcaaagaaagctgtaaaagtgttggaaattaangcgacagcacttcttatgtaccttactaatgtcagcagaacaagggaagagagcatgcta

SEQ ID NO: 16883 - DNA, 121 bp, Artificial Sequence
  Synthesized
  misc_feature (61): n=c or g
cgtcacatcccatcaggagtgagtggccattctgatgtctcatgtgcattgtcctaacttntctggtctgcattggttcacagtgcagctgcccaaatggctcactgtctgcagttcatgt

SEQ ID NO: 16884 - DNA, 121 bp, Artificial Sequence
  Synthesized
  misc_feature (61): n=a or g
tctcaggacccagctctgctcccacaaaagtgggggaaacctctgcaaggtgtaaaccagnatgcgaccatctctgcaatggatgcaaacctgtgcccaatggttcctgagcagttttgcc

SEQ ID NO: 16885 - DNA, 121 bp, Artificial Sequence
  Synthesized
  misc_feature (61): n=t or g
ttaaatcacattggtcttcagcaggcaaaaatttaggaaagattaaaggttaacaatctcngcttttagattcaagtgtatccacagttgttagacctaccattgcataatagacaggaag

SEQ ID NO: 16886 - DNA, 121 bp, Artificial Sequence
  Synthesized
  misc_feature (61): n=t or c
gtccacagaacagataagtcagttgctgttttctaatattaacattcttgtcctacttacngtgacaccgggtccgaggccaggacaggtaggatcactgccattgtatccttctccttgg

SEQ ID NO: 16887 - DNA, 121 bp, Artificial Sequence
  Synthesized
  misc_feature (61): n=t or c
actgcatgatcgtgcaagttccctggctgcaccacctcctcccagctctgccaataggaancagcagcaccattctctgacccagaagcaccattccttgacccaggcagaggaactcact

SEQ ID NO: 16888 - DNA, 121 bp, Artificial Sequence
  Synthesized
  misc_feature (61): n=a or g
cttttgcttactacaacttaatgtgcactgtggtcttcctggttcactttcacactgtgcnttattcttttaggctcatcgttagcaacattttttacttttcaaaattcttttgggccac

SEQ ID NO: 16889 - DNA, 121 bp, Artificial Sequence
  Synthesized
  misc_feature (61): n=a or g
caaggccagtagcctctcaggcatgctgcaagtgatttctttactctgatttcacctaacngatcaggttaatgtagcatagatagagaagcacaatctcaatgtttatcaacgtgatttt

SEQ ID NO: 16890 - DNA, 121 bp, Artificial Sequence
  Synthesized
  misc_feature (61): n=t or c
cactctaatacaggttaaagaacaatagattttaagcaacattttcctactgagaactcantgctcactcaacacctagaagaatttatctcagttttgaagaccagttcaagcctcttca

SEQ ID NO: 16891 - DNA, 121 bp, Artificial Sequence
  Synthesized
  misc_feature (61): n=a or c
tatgcactctcctgtaggtgaatcttttcttattctcttcttcaaaatgaagttacactgnacctgcttgcagcttccttgcagctttagttatactgatctttcttatttcctatccaga

SEQ ID NO: 16892 - DNA, 121 bp, Artificial Sequence
  Synthesized
  misc_feature (61): n=t or c
tttgtaggaaattctaaatcactgattttagactacagaagagacttagacaagatatgantatcttcactgatatttctctagagtgctttttctaacattggaaagtcgcaaaacttaa

SEQ ID NO: 16893 - DNA, 121 bp, Artificial Sequence
  Synthesized
  misc_feature (61): n=a or c
ttaaatcctttgtataaacaccatgatcccacggaaagaactggttgtggcctatgttatntttttccctagctatctgttcctgttgctgccttagtttctgtgcagtgagtttttcata

SEQ ID NO: 16894 - DNA, 121 bp, Artificial Sequence
  Synthesized
  misc_feature (61): n=c or g
tcccctaaatctacgaaaagtcacagtcattactgtgtctctttgagcaccctggattctnactcctgtaacgaaatgcgttagttcagatacagcatgcaaagatgcatctaactcggtc

SEQ ID NO: 16895 - DNA, 121 bp, Artificial Sequence
  Synthesized
  misc_feature (61): n=t or c
cagaaagatatctaccactcttgtaccttgctagcaaatctggaatatctgaaatacccantgaaagggaatggcacagagaacgcagagcacagcacttcttgctgcttctgttcaccca

SEQ ID NO: 16896 - DNA, 121 bp, Artificial Sequence
  Synthesized
  misc_feature (61): n=a or t
tttcctgattttaccagtcaaatggacttgctttaagtgtctgcacataggtcagattgtnggaaattacagagttcaacagatatgtctgaagaaacagacataacagaaaactgtttaa

SEQ ID NO: 16897 - DNA, 121 bp, Artificial Sequence
  Synthesized
  misc_feature (61): n=t or c
accctgttcatgccctgctctctcacttgcccattgttttcccttggttgtgctaacactngtgtttcccatgcaggacaccccatcccgctcaaccttcacgagagctcccgctcggggc

SEQ ID NO: 16898 - DNA, 121 bp, Artificial Sequence
  Synthesized
  misc_feature (61): n=t or g
ccaaatatgacctcagctgctgagagttgcgttcagaagcattgaatgggggatattttgnaggaaggaaaatacaaagtaactaactaataattttcaatgaccatctctttttaagagc

SEQ ID NO: 16899 - DNA, 121 bp, Artificial Sequence
  Synthesized
  misc_feature (61): n=a or c
gcttgccagtcagtttgagccacagaaaaaaaaaatcattccaaattactccattgatttnacattgtaaatgaacagctgcaagaagctgtcctgagtttgccataagccttgacatatc

SEQ ID NO: 16900 - DNA, 121 bp, Artificial Sequence
  Synthesized
  misc_feature (61): n=a or g
taggaaaaagcagatgtgaaatcaccccttgtttcattcagagcaaaaggaaagggctacnacaggcaacggcctcacttggagcaatgagaaatgatgaaattgggttttaaagacagca

SEQ ID NO: 16901 - DNA, 121 bp, Artificial Sequence
  Synthesized
  misc_feature (61): n=t or g
agatttctcacgcatggtcacgttaggaccagtagctgataactctgagatcaagacttgnctgggctgtattcagtcaggaactgttagggaccctaacattctgaaggatccatttagg

SEQ ID NO: 16902 - DNA, 121 bp, Artificial Sequence
  Synthesized
  misc_feature (61): n=a or c
cacaagaacatatgcctaaagctagttatgataaccttctcagtagccctccagttaatcngagaatttacaaatacctttcttagctttattctgcttgaatttactcttttcctgtttc

SEQ ID NO: 16903 - DNA, 121 bp, Artificial Sequence
  Synthesized
  misc_feature (61): n=t or c
ctgaagccaccgtcatctttatctcctctgtacacagtggttctaagagtccttttttttncccctccctaattacaacttctctcgacggaggacacgaaagaattcagttaaaaagcac

SEQ ID NO: 16904 - DNA, 121 bp, Artificial Sequence
  Synthesized
  misc_feature (61): n=a or g
ctaaatattttctttagttgtgtttgctttatttttcacaaaagtctacactggaactcantatttagcagggtttatctgccattctgcagttcagggaatgaaaagcttttgacagtgg

SEQ ID NO: 16905 - DNA, 121 bp, Artificial Sequence
  Synthesized
  misc_feature (61): n=a or g
cactttttgtttgtcatgaagaaaataggctgaggattactcatagtggccattacagtgnaattagaaaagagggtaccatgtgtggactgaaaatccactccaaagaacttatctctga

SEQ ID NO: 16906 - DNA, 121 bp, Artificial Sequence
  Synthesized
  misc_feature (61): n=t or c
caaagcatcctctcttactggagcagcctcgtgtagccagactgcccacttctgatactcnatgctttgtattaccacaccaaagtgagtattcttgctatctttgctatttcctatcctt

SEQ ID NO: 16907 - DNA, 121 bp, Artificial Sequence
  Synthesized
  misc_feature (61): n=a or g
atggggagaatctaccctcaaactgctgtattcctgtcacaagatacaacggcatgttagngatctcctaatggcagtgtattctgagcctattcttcatgaggatttaacatttcagaaa

SEQ ID NO: 16908 - DNA, 121 bp, Artificial Sequence
  Synthesized
  misc_feature (61): n=t or c
attgtcaccacttggggatttcagtcctctcttcgagctggggaagataaatataggtcangttcttattcttgggggtgaaaacctctgagagactgaggctctgggagctatgtgctaa

SEQ ID NO: 16909 - DNA, 121 bp, Artificial Sequence
  Synthesized
  misc_feature (61): n=a or g
cattcagagctacgtatcttttgtaaggctgagcatcagtcagaaagcattatgtaaagantagctttcttgagaggatgagcagctccttggtccaaactgacaaagtaaatacaggctg

SEQ ID NO: 16910 - DNA, 121 bp, Artificial Sequence
  Synthesized
  misc_feature (61): n=t or c
tatcaattctaacagcctacatttggatgccagtagatggcttattaggggtagagccttntttgtgaaacaataaaaccttaacagaactcaagattaagctcagagcaaattatatttg

SEQ ID NO: 16911 - DNA, 121 bp, Artificial Sequence
  Synthesized
  misc_feature (61): n=a or g
gagaggatcatacaaatgaccagcttctctgaaattctcaaattaaaacagttttatcacntttgcttttgctgatgtagaaaagctgcagaatatgagttaatcatgcaatacttattgt

SEQ ID NO: 16912 - DNA, 121 bp, Artificial Sequence
  Synthesized
  misc_feature (61): n=t or c
taatacaagtcatttttccatcccgtgaacactgaatgggggtggcagctatttgctcccntggacaagatggtggccagaacagacatccaggcattgcttcagattcactttcaggagg

SEQ ID NO: 16913 - DNA, 121 bp, Artificial Sequence
  Synthesized
  misc_feature (61): n=a or t
gatcactgactgatatctgaagtgtggttactctgaaaacgtgctcagctctgatctgttnaacttctttgctgatcaggcctggagctgtctgaagtcttcactgatggtttgttgttgg

SEQ ID NO: 16914 - DNA, 121 bp, Artificial Sequence
  Synthesized
  misc_feature (61): n=t or g
tcagagagtacagtgaaatgtaaaacattattattgtataaaaaccattagtatgtgaaangaatagagaatatgataaagaggaaggtgagttagataacaacaggttacttgtcagaaa

SEQ ID NO: 16915 - DNA, 121 bp, Artificial Sequence
  Synthesized
  misc_feature (61): n=t or g
caaattgaggaagaagggaaggaaattaacaaataattaagaacaaatgaatgcgagaacngagagtgacagagatgcaaagaggagacagcactgctcctgctgtgccaggccgtgtgcc

SEQ ID NO: 16916 - DNA, 121 bp, Artificial Sequence
  Synthesized
  misc_feature (61): n=a or g
caacaccttaatagctctgaagaagtcaggttttatttttctcattcctgtttcttttcanttcattatagccccaatactgccaagagaagaaggtgcattattttaattcattattcat

SEQ ID NO: 16917 - DNA, 121 bp, Artificial Sequence
  Synthesized
  misc_feature (61): n=t or c
attagcacaagtgggaaagaaggacacgtgatcatattatactgaaggctttattgatggntaaaatgctgccacttttatcaggcggacactttaatttaattaatttaattttatctga

SEQ ID NO: 16918 - DNA, 121 bp, Artificial Sequence
  Synthesized
  misc_feature (61): n=t or c
ctcttgaaataaagaggttctctgatagcctcgataggggtaaatccctctgctgcgcctnagcctgggactgcggttacctccagggatttcagagcaattggcttaactgctaaatctg

SEQ ID NO: 16919 - DNA, 121 bp, Artificial Sequence
  Synthesized
  misc_feature (61): n=t or c
cgtttccagagcccttcctttagcctagtcagtcccagtccttcaaggctctggtgattantgttggttccccagacctctcgctgttactgatgtctcctttatgatatgaatgtaccct

SEQ ID NO: 16920 - DNA, 121 bp, Artificial Sequence
  Synthesized
  misc_feature (61): n=t or c
aactgcatagctctgctctgccgtatgaaactgctgcttcaggcagggcaacctgcttctnttctgcagcaaacaaaattgaggtctgtgacgatgaaatgtggagcatgagttgacacaa

SEQ ID NO: 16921 - DNA, 121 bp, Artificial Sequence
  Synthesized
  misc_feature (61): n=a or t
tttgaccttgcaagaatttcattttacaaactgagttctgtgctttgtggaagacttttcnaatgttttgcttcacagccaaagctgcctacttgagaaaactgaattaagatcactagcc

SEQ ID NO: 16922 - DNA, 121 bp, Artificial Sequence
  Synthesized
  misc_feature (61): n=a or g
ggactcggaggacgactccgactacaacaggtcgaagcggcgtaagtactcctcttctgangactacagctcgagccggagcaggtcgaggagccggagcaggaggtcgaggacgcgcagc

SEQ ID NO: 16923 - DNA, 121 bp, Artificial Sequence
  Synthesized
  misc_feature (61): n=a or g
taattatttttaatgaaaactgagatagctacaaagcttcttctaagtctgaagtattaanatacttgccttggaaaagtaaccaacaaggtgacagcctttgacatcgttctgtgtcagc

SEQ ID NO: 16924 - DNA, 121 bp, Artificial Sequence
  Synthesized
  misc_feature (61): n=a or t
agtatgactcccgattctcatgctctgaaatactatgcccagcccttagttcacttttctntctttgaaatgagactcacttgaataatgtagcatgtctaatagcatttaatttcactcc

SEQ ID NO: 16925 - DNA, 121 bp, Artificial Sequence
  Synthesized
  misc_feature (61): n=a or t
actaccagaagggattggcttcttcttctgtggttccttgctatagactcatttggatccnggagagttttcgaggtaaaattgttcaccataaagcataaaacagagagatcattggtga

SEQ ID NO: 16926 - DNA, 121 bp, Artificial Sequence
  Synthesized
  misc_feature (61): n=t or c
gccatacaactccagatcttttgcagtaaacagttgtgaaataatcaccaattcccttctngatcactaaatagccttctctgtcatgacatccagcagaaacaaagctataacaaattac

SEQ ID NO: 16927 - DNA, 121 bp, Artificial Sequence
  Synthesized
  misc_feature (61): n=a or g
aggagatgtcgtatccattgatacatttgtgccaagggataaaaagaggaaactcagaagnctgaagctttttgttttgacgtcttctaaacggcaccgctcatttcaggaacacttcagt

SEQ ID NO: 16928 - DNA, 121 bp, Artificial Sequence
  Synthesized
  misc_feature (61): n=c or g
cactttgatgaaagtgagatatcaaatctgctaatgacatgttggaccaggtggtgagganccgctgctccagctttaaccctttgcacaacttaaagcggtgcagtgtgtgatacgatgc

SEQ ID NO: 16929 - DNA, 121 bp, Artificial Sequence
  Synthesized
  misc_feature (61): n=a or g
ttaagtatcccatttaatgaatgacaatatgacaaatcatttcaattcattttgtttaagntgcaaacatgcctatatttaacccaaatggatttctctcacaattgacttgaggtactta

SEQ ID NO: 16930 - DNA, 121 bp, Artificial Sequence
  Synthesized
  misc_feature (61): n=a or g
gtttctagagtactagcatggtagcagttctccttccttttttaagtcccttttgttagcnctgtttccctgcattggttcataacttgctggaagcaagaactattgtgttggtgatcat

SEQ ID NO: 16931 - DNA, 121 bp, Artificial Sequence
  Synthesized
  misc_feature (61): n=t or c
tttgaacaatcggctgaaacagaatttaagagaatgccaaatgaaataatgaaggaatggntgttacaggtgtgaattcatacatttaaattgttacttgactttgctgaagtttttgtgc

SEQ ID NO: 16932 - DNA, 121 bp, Artificial Sequence
  Synthesized
  misc_feature (61): n=a or g
acttggggatttgtgtgtttgtgtgtgacattcttatgctgtatcaagtctaaataatacnaagcaatagagccaatgttacagttcttcttggataaaagtaatagtgtcgtagaaaata

SEQ ID NO: 16933 - DNA, 121 bp, Artificial Sequence
  Synthesized
  misc_feature (61): n=a or c
gtaaattatccaaagagggtgagacatgcacagacagggaagacgaggagggaggaggttnagagattttaaggccagggcagattctctgtctcattttgtagccagtgtgcatatttat

SEQ ID NO: 16934 - DNA, 121 bp, Artificial Sequence
  Synthesized
  misc_feature (61): n=t or g
accatgctcctaagatccactgggctgaaaaatagtgggagggggtggaaaaaaatgagancacagggaagaatgatgcatgatgagggctgaatcccaaggttggatccattgcctctgg

SEQ ID NO: 16935 - DNA, 121 bp, Artificial Sequence
  Synthesized
  misc_feature (61): n=a or t
tcttctttatctctggcagaatctgaacatatccacagagaaagtaacttgaccaaaaacntcactctgatttgaaactgacctcaatggtaccacaattttccaagacagtgtctttcca

SEQ ID NO: 16936 - DNA, 121 bp, Artificial Sequence
  Synthesized
  misc_feature (61): n=t or c
ttagcctgaggtaacaagttccaagtcccctgcagtataaccataagcagcagaacaaccncctcccaaagacaaatgtgtcccgttttcacgattatttaattatttatttaacacatag

SEQ ID NO: 16937 - DNA, 121 bp, Artificial Sequence
  Synthesized
  misc_feature (61): n=t or g
ctactgacctccttttcttactgagcacagtctgtggcacaatgctttgttctgcagagcnggatcagagcttgcagttcagttttgccagtacaaattctgttatgttttttacccagac

SEQ ID NO: 16938 - DNA, 121 bp, Artificial Sequence
  Synthesized
  misc_feature (61): n=t or c
gtttaggagtaaacggatttattctgtatgtggacagacaagtggagtatgtgtgctgtgnctctataggtgagctttagtgatctgttcctttttttttttaagtatgatgttgcagtca

SEQ ID NO: 16939 - DNA, 121 bp, Artificial Sequence
  Synthesized
  misc_feature (61): n=a or g
gcaggagtctggctggctttgtgctgaagcaaaaacaagcactttctcagtgtgaagactnttgtacatatatcactaaaccaaatttcacaatattaaataaactttctcccagcgcagg

SEQ ID NO: 16940 - DNA, 121 bp, Artificial Sequence
  Synthesized
  misc_feature (61): n=t or c
agtcatgaaatgctgtacacacattcaacagtttaactcagttgcacatctactatgctantatgctactactttgcctcttcctccatagggcagttttaattgatgcaagttttgagtg

SEQ ID NO: 16941 - DNA, 121 bp, Artificial Sequence
  Synthesized
  misc_feature (61): n=t or c
cagcctcgttttctctgcatgctctcatccttacctgggaaagggatacggtcaccaattnaattgtacacagctcattcagttaatgaagttagagttatttggatcactgctgacctca

SEQ ID NO: 16942 - DNA, 121 bp, Artificial Sequence
  Synthesized
  misc_feature (61): n=a or g
ttcaggctgcacgcaagctatgcacgtgagctcgcttttagttttcctccttcagaacacntccctcccttggtatgacaggtttctatcataatttagcgaattgtcagcacagaaacat

SEQ ID NO: 16943 - DNA, 121 bp, Artificial Sequence
  Synthesized
  misc_feature (61): n=a or c
aatataatttacagtctttagggatggcaataaagtttgctgaagttacagcaagtaatangggatataaaaagccttctttactattagttttttgaacatccaggctttttcctaaata

SEQ ID NO: 16944 - DNA, 121 bp, Artificial Sequence
  Synthesized
  misc_feature (61): n=a or g
ccctcagatttcaaaaactgccagggagtttttgtaattcacctcacagtaaacgtaaacnctgcttaatggatggctttaatgctgcctttctgcttcaaggatttttcattggtcgctg

SEQ ID NO: 16945 - DNA, 121 bp, Artificial Sequence
  Synthesized
  misc_feature (61): n=t or c
ctgagtagtttatttttaaaaaagtcacagaatgaacacagccatcatccaaagttcatcngtgattatcagtctcaagaactggaaagaatacaatgtttgctgcagatatggctggaca

SEQ ID NO: 16946 - DNA, 121 bp, Artificial Sequence
  Synthesized
  misc_feature (61): n=a or g
aaacaaacaaacaaacaaacaaacaaacaaaaacaggatttaacccaacctttcagaaatnttcttatttaactcagtcaggctctgaatgtgaacatgccataaggtattgccatgtgcc

SEQ ID NO: 16947 - DNA, 121 bp, Artificial Sequence
  Synthesized
  misc_feature (61): n=t or g
cgggtcctaggccagattcagctgttgtggcagaacaggccttccatatagactagaggtnactagaggtgagaaaagatgtacatgtcagtgacagtttgccttttcaggggtattgttc

SEQ ID NO: 16948 - DNA, 121 bp, Artificial Sequence
  Synthesized
  misc_feature (61): n=a or t
tagaaatcttgatttacagcatgtattgtgtcaattacacctcaaagactgatattagaanaccagtatgttatttcaatcagatattttgctaagctgtaacttcccatcttgcaaatac

SEQ ID NO: 16949 - DNA, 121 bp, Artificial Sequence
  Synthesized
  misc_feature (61): n=a or g
gagagtgctgagataggaaatgcctacagataccttttaaattgtcaagccaaattcttcntggtctttgaaacggtgtggctttgtgaataaaatatcagtgtaaggatatttgcgttct

SEQ ID NO: 16950 - DNA, 121 bp, Artificial Sequence
  Synthesized
  misc_feature (61): n=a or g
ctttgtttgcattaacctgtttacttaatgcagtgtggtaatccttaggagcttttccctnaaatgatatctaattgttgtgatgttttacatgctggaagatttttagcgccattacttg

SEQ ID NO: 16951 - DNA, 121 bp, Artificial Sequence
  Synthesized
  misc_feature (61): n=a or g
cctgaggcaggaaaatagttagggactgtttgttgtctgagacagtgggctgaaactgagnagtgttaaccaccacctttttggggagggatctccccagggctgccttcacctgctggga

SEQ ID NO: 16952 - DNA, 121 bp, Artificial Sequence
  Synthesized
  misc_feature (61): n=a or g
ggttacttcctcgtggaggtgttgtgaaggtgtctctcacagcccacacctgtctgtgggntctgccttcctcacagagcgagaaggctttgggtgctgaagtggctcacggtgctttcta

SEQ ID NO: 16953 - DNA, 121 bp, Artificial Sequence
  Synthesized
  misc_feature (61): n=t or c
aatgtcctcctttatgccatatttcttcctgcagcctgtaattgtcgcactggcaagctanattacagcctcctgctaactgccagcctgcagtcaccccgtggtgtggctgatgtccagg

SEQ ID NO: 16954 - DNA, 121 bp, Artificial Sequence
  Synthesized
  misc_feature (61): n=a or g
gcaaagttctaaagaagaatgtaaatagcttcctttcagtgggtccatcccatgacacggngagaaacaaaatgaaacgtcctgctgacactggctgccttcaggagctctcccagatctg

SEQ ID NO: 16955 - DNA, 121 bp, Artificial Sequence
  Synthesized
  misc_feature (61): n=t or c
ccactgatatgcattcgtaatgatattcagactgctaaggatgcccctgggttttcagatnacaaaggtttggggcatgtttgagcacaagtctcatccactcttgctcctaacgtggaca

SEQ ID NO: 16956 - DNA, 121 bp, Artificial Sequence
  Synthesized
  misc_feature (61): n=a or g
agagtattctgtagtggaatataaggttagaaaatgagaaactgagtaagaaaaaaatgcncttggtacatattgctgttcccaataatgattttccttaaaaaaaacccaaaaccctaca

SEQ ID NO: 16957 - DNA, 121 bp, Artificial Sequence
  Synthesized
  misc_feature (61): n=t or c
taacatcaactaaataatatgttgaactaatctgggctacattacaatgctataatcatanatatgaccatttaggaacacaagagctctgtcatgtttaaggtcaagacaaaatttctgc

SEQ ID NO: 16958 - DNA, 121 bp, Artificial Sequence
  Synthesized
  misc_feature (61): n=a or g
ctgctgtgtgtctggagagcaccttgtaaatgtttcattccttctctcaaatagacctccnacatcagtgacaggagcaactgggtcagaactaggacggatcacttttgtttttgagacc

SEQ ID NO: 16959 - DNA, 121 bp, Artificial Sequence
  Synthesized
  misc_feature (61): n=t or c
agcccctgttgccttgacattttcagctataagcatggtcatgaggatatgcattaatgcnattgacaaatagtatggtttgctaacggcctatgacccccaaaatgtgggactctccatg

SEQ ID NO: 16960 - DNA, 121 bp, Artificial Sequence
  Synthesized
  misc_feature (61): n=a or g
gatttaatttttccactttcgtgtgatccgaagcaggagtggcaaaaatattccagcaccngaaaacttaaactaaataagtctgtagaagttcttcagctctttcttacatctgaaaaat

SEQ ID NO: 16961 - DNA, 121 bp, Artificial Sequence
  Synthesized
  misc_feature (61): n=c or g
atcccatttagctttcccatctacaagtgatatgtctgtctagtctaaattactcatctantctccctctataattaatgaacagacactgatacctacaaaggagtatttgtcccatcca

SEQ ID NO: 16962 - DNA, 121 bp, Artificial Sequence
  Synthesized
  misc_feature (61): n=a or g
tcaacaggaggcattttagctctgtgtagccaggagtgactgcttgcattggccacttcancctctgtaacacactcttctcagtgccctctttggagtgagaggggatcagttcacaaca

SEQ ID NO: 16963 - DNA, 121 bp, Artificial Sequence
  Synthesized
  misc_feature (61): n=c or g
acggccgcctgctgacatcctgcctccagcaacgttctctgcgtgatccaagaaagtttantgcttgttgtatgctgtgccctattcacttcttgtgcttatacaaggggataataagtat

SEQ ID NO: 16964 - DNA, 121 bp, Artificial Sequence
  Synthesized
  misc_feature (61): n=t or c
gttgagaataaggtctttggctaaaatctttgtctaccagctatagagtcacttccctacnttttgagaaatattagacagaaacttgtccctgaaaggcagtttggagtaagggtctgct

SEQ ID NO: 16965 - DNA, 121 bp, Artificial Sequence
  Synthesized
  misc_feature (61): n=t or c
taagcacatgcaaagtcactgatctacaagcttctaatgtatatatactgttggggaaacntcttatggaaagctgtaactcaaaagagttaaatatcatagaatcgtagaattgttcagg

SEQ ID NO: 16966 - DNA, 121 bp, Artificial Sequence
  Synthesized
  misc_feature (61): n=t or c
acagacctactgattgcagaccactaaacttcaggtttttgttaatgaactacttgcaacngcttgtctcatatctgcccattttgagagcagtggcattttaaggattcctttgtgtttt

SEQ ID NO: 16967 - DNA, 121 bp, Artificial Sequence
  Synthesized
  misc_feature (61): n=a or g
cctgtgttctgctccacctggcagcctttgccaccgtcagaggtttgcaatttctccatcncagttttgagataaaagagtaatttcagtttgtctaatttttcctgagctttcagggaga

SEQ ID NO: 16968 - DNA, 121 bp, Artificial Sequence
  Synthesized
  misc_feature (61): n=a or g
gacctgctgtaggaaaacgaaactttggctgtgaggtagcaacatcctggtattttgtagnaaggatgaaatggcaaatgggtccttggaggagaggagcagttactgacaagtcatggca

SEQ ID NO: 16969 - DNA, 121 bp, Artificial Sequence
  Synthesized
  misc_feature (61): n=t or g
aatgaaaaaaaaacattgtctgcagagacaagactgaggctgaaggatgaggagaaacagngactcctagccaaatggatacagcgaacctgacaaaaaaaggattggtaagggcattttg

SEQ ID NO: 16970 - DNA, 121 bp, Artificial Sequence
  Synthesized
  misc_feature (61): n=a or c
gttcagaggtttttagcatggactaatatatagaagattaatttccgcctagaagaaaaanccaagttttgatctacaaacaaggaaacttaatgatagtttattctcagtgatctatgca

SEQ ID NO: 16971 - DNA, 121 bp, Artificial Sequence
  Synthesized
  misc_feature (61): n=a or t
catgctttttgtagtatggttggtctccaagaaattaagttaaaatgactccttacaagtnggttttcaataagttaaggatattataccctagcccaggtgtgaggccctgctgcttact

SEQ ID NO: 16972 - DNA, 121 bp, Artificial Sequence
  Synthesized
  misc_feature (61): n=a or g
tcaagagccagctccttctccaccaaaacacgtccctgcagggtgtgcttagtaatgaagntaaaaggaattcagtatcccggacctaagtaaacccattttgtgttccacctgcttatgt

SEQ ID NO: 16973 - DNA, 121 bp, Artificial Sequence
  Synthesized
  misc_feature (61): n=a or g
gagtccagaataatgggcttgattgaaacacataatcaaacatttttgtagaaacacaacnatatgaaggaaaatcatttttgggggcatttgaggacacacatcccacacttctggttct

SEQ ID NO: 16974 - DNA, 121 bp, Artificial Sequence
  Synthesized
  misc_feature (61): n=t or c
aggccctctctgagcaaacatttctgggggcaacccgccaagttacacaaactttctgtantgaatgcccaccatatctgaacaatcctaccacagatgggctttgtggcagggcacgaaa

SEQ ID NO: 16975 - DNA, 121 bp, Artificial Sequence
  Synthesized
  misc_feature (61): n=t or c
ccactttgaatggtggtcattccagatgagtttcccaatggttcctgctagcattcccacngcaagccaggactgttgtagctagcaggaatttcacacgtctgtgcatgtatttccttaa

SEQ ID NO: 16976 - DNA, 121 bp, Artificial Sequence
  Synthesized
  misc_feature (61): n=t or c
gtcccttccagcccaagccattctatgactctataattctatagaagatgacaaaaacaangtatgatgcagcatgattgggccctgatattttcctcatatacagatgagctcagaaggt

SEQ ID NO: 16977 - DNA, 121 bp, Artificial Sequence
  Synthesized
  misc_feature (61): n=t or c
caagctctgctgtattgtgctgtgtaatgggaactcatcatgagagagtgctgtgaagcancaaatacccagaagtctagtggaaagcaggaaatagggcttatccccagcacactctcac

SEQ ID NO: 16978 - DNA, 121 bp, Artificial Sequence
  Synthesized
  misc_feature (61): n=t or c
tgcgatgtcttgccagcctcagcatctatcatctgctgtctttttcaagcacttattcgtnggaaactctggtcagacactcctctactttgtttaaatcacttttgtgctctttactaag

SEQ ID NO: 16979 - DNA, 121 bp, Artificial Sequence
  Synthesized
  misc_feature (61): n=t or c
tgccatcgaacacacctacactgctccaatgcctgcactttaaagctcaaggttaagctcngcataacaaagcataagcagcaggcttcttcaccctccaaataaacacctctaaatatac

SEQ ID NO: 16980 - DNA, 121 bp, Artificial Sequence
  Synthesized
  misc_feature (61): n=a or g
tcctgcagtgtttcctggagctagctgaaagcctgaggggaagccaaatctgcaaggtacnctgctctgttctccctgggccttcttttgctatctttttgtttggaaatggaatcctctg

SEQ ID NO: 16981 - DNA, 121 bp, Artificial Sequence
  Synthesized
  misc_feature (61): n=a or g
gtctgtgacctggggcctgctttacagatgtgctgagctctcaggcaaaactgacatggancaacagagttttttttagcacagagacaacactagagaatatttggcgggtgggagcaaa

SEQ ID NO: 16982 - DNA, 121 bp, Artificial Sequence
  Synthesized
  misc_feature (61): n=t or g
acaagggcttgtaaaggatttattagaaataattgaaatagtgcatagaagtttctcttcntattgatcatgacaactcattttgttttttactgatagaaagcacatccaagtaatgtga

SEQ ID NO: 16983 - DNA, 121 bp, Artificial Sequence
  Synthesized
  misc_feature (61): n=t or c
aacttgatgaatcctgatttatggagagggctacacacacagaaagcacctctctgctctnagaccttgtgccttgtgggtacactatggaagagcagcctcctttgctccatgcactgcc

SEQ ID NO: 16984 - DNA, 121 bp, Artificial Sequence
  Synthesized
  misc_feature (61): n=t or g
gtgctccagctgaacagtgcatccttccaaagcataaagagcactacttcttcacagtgantactatgggctctgcctgtcttccttttcttgcagacagaggagtgcgaatatagggtgg

SEQ ID NO: 16985 - DNA, 121 bp, Artificial Sequence
  Synthesized
  misc_feature (61): n=t or c
agacatttacttaccactattcagaggtgacctggggagaaattggtgtacccaaaaactnacctgtattttccaggtctgtcatttcgtcgaataatattaagctgacaccaaaggctag

SEQ ID NO: 16986 - DNA, 121 bp, Artificial Sequence
  Synthesized
  misc_feature (61): n=a or g
aaaagggttcagtctctctacagtccttgcctttcatctgaacccattaatccttgtcccntttctcatcccaatgtaactgcagcttctgctacccctacctgcaagtttgacactgcaa

SEQ ID NO: 16987 - DNA, 121 bp, Artificial Sequence
  Synthesized
  misc_feature (61): n=a or g
gtgaaacactggaagagattaggagcaacatccacaaaacattaagaaaaaacccgctcantgtttacatggcatctcaaaacactgtaggttggacaaccctgcctgggcagcagcagca

SEQ ID NO: 16988 - DNA, 121 bp, Artificial Sequence
  Synthesized
  misc_feature (61): n=a or g
ttattactaatcttttctgattgttaatttagtagtctgatgaaatattttctccagtgtntgcaattacatttgttactcgaatccacttggaactatggctggatattctttctgactt

SEQ ID NO: 16989 - DNA, 121 bp, Artificial Sequence
  Synthesized
  misc_feature (61): n=c or g
tgtatcctattaaaatctgcattccacagtgcatgtgctaataatattgagaaggaaagtnatcatcttctcagtgtaaatagtttaaaaataataggaatataaaaataatgtaatatga

SEQ ID NO: 16990 - DNA, 121 bp, Artificial Sequence
  Synthesized
  misc_feature (61): n=t or g
gtcctgctgaatagttgtgatttctgttacttatcttcattttctgtgtgcttttgtgaangtcagtcatgtagcagttgaaagttgtctgaatatattcaggttttagatggagaaggaa

SEQ ID NO: 16991 - DNA, 121 bp, Artificial Sequence
  Synthesized
  misc_feature (61): n=a or g
cacttgcccagcaaaactacatcacttcactcacaaatttttagcagaactcctgtccccngcgtcaccgcagctggaatttcagctcttggtatacaagtatgataggtcagcacactcc

SEQ ID NO: 16992 - DNA, 121 bp, Artificial Sequence
  Synthesized
  misc_feature (61): n=t or c
cagcactgatataccaccactgacttcaatagaattatactcttttatactgaggctgaanttagcaataacagctaaaaatgaacatatccggaaatgcagtaaattgtgatttctcata

SEQ ID NO: 16993 - DNA, 121 bp, Artificial Sequence
  Synthesized
  misc_feature (61): n=t or c
atttcagaggtgtggataatcaccacaaatttcacctatctgtgaatacataatgaagcanctgagacttatttcgaagcatatcaacttctgtcaagtgattttcattacatcaaacatt

SEQ ID NO: 16994 - DNA, 121 bp, Artificial Sequence
  Synthesized
  misc_feature (61): n=t or c
ttatgagtagatagaaagttcctgaatcctatcaaattcaattcggaagtcaacagaaatntctgattttcatgtgcttttgatcagccagtctcatttttatgtttgtttgtttttttcc

SEQ ID NO: 16995 - DNA, 121 bp, Artificial Sequence
  Synthesized
  misc_feature (61): n=t or c
tggctccccatgggatcagagaggaagcagtaggtgaactgctctgcccagttatttccanggtcctccttcctgacgtgattagtgagcatggcggggatgggttggtagttgaactaga

SEQ ID NO: 16996 - DNA, 121 bp, Artificial Sequence
  Synthesized
  misc_feature (61): n=a or g
ctccagggtcggtgaggtaggagctttgaataacgctgcagaacaatagtggaggccttgnagaagctgagctatgggaacactgacagatcttatttagtgacgtggagcggttggtgtt

SEQ ID NO: 16997 - DNA, 121 bp, Artificial Sequence
  Synthesized
  misc_feature (61): n=a or t
tataaaatattcataaaactcttcaaattgaattgccctttcaagtaataaaagaatacancaaagtaatacactaaatgaggactttcctctacagcatatgatataaaccataagaatt

SEQ ID NO: 16998 - DNA, 121 bp, Artificial Sequence
  Synthesized
  misc_feature (61): n=t or g
agatgggcagcaaaacagattactcatagggcattcttatttgagagcttatctttaaaangttgggttacaaatggctctctgcagggtcactcagtactcattgaacttaagacttcag

SEQ ID NO: 16999 - DNA, 121 bp, Artificial Sequence
  Synthesized
  misc_feature (61): n=a or c
tactcccttggatgtcctcaagtcgcggatgcaggtggatgagtcgggacagcataagtanaaaggcctcatccactgtgcgagagaaagcgtcagacaggaggggctcaaagtgctgttc

SEQ ID NO: 17000 - DNA, 121 bp, Artificial Sequence
  Synthesized
  misc_feature (61): n=t or c
gctgtaacaaaaggaccacatgaaacacttagacattccagttttgctgcctccataagcngttagatcagttcctggttttgctataaacctgctaataatctctgctgcattcctagat

SEQ ID NO: 17001 - DNA, 121 bp, Artificial Sequence
  Synthesized
  misc_feature (61): n=c or g
gagacaaggaaggagaaaagccaggggaagcactagatcaaatttgggctcccacttgctnatttcagtgccctgcagaagcctggccccactgcacagggaggtggcactggtctgtact

SEQ ID NO: 17002 - DNA, 121 bp, Artificial Sequence
  Synthesized
  misc_feature (61): n=c or g
tggggctactgttgtgcctacatttgtgttttcccacctcccattgcaaattgcacatgcnatctgaaggaccactgtcctcccagtgccacctctgcactagaggccctgggcagctgtc

SEQ ID NO: 17003 - DNA, 121 bp, Artificial Sequence
  Synthesized
  misc_feature (61): n=a or g
ccaggcctccatctctgctgtgggttcgcactgctttgatgtttcctggagcatcactccnacagctccagctccggtgcagtgatgttgggtggcaccggtgagcgccccacggcaccgc

SEQ ID NO: 17004 - DNA, 121 bp, Artificial Sequence
  Synthesized
  misc_feature (61): n=t or c
ttcagaagtctgcaaaacagtttgacctactaatatcagatcctcaaacgtattggtgcangtgcagaataactctttaagatgtgccatacatgtgcaatgccattttcacaaagcctca

SEQ ID NO: 17005 - DNA, 121 bp, Artificial Sequence
  Synthesized
  misc_feature (61): n=a or g
aatgcgtggccaatgcgaacaagttgaagcaagaaacttaaattgcaagtttagaaacacncaaaatttattatgattatatgttccttgatggtaaatattagttgtccgttttgtatag

SEQ ID NO: 17006 - DNA, 121 bp, Artificial Sequence
  Synthesized
  misc_feature (61): n=t or c
gacagacagtgtgggaagagtgtaagtgttaccattccaggagtcattccctactgtcctnaaagccagaggagagggattgaggcaagagtgtgctgctgttcatttctgctgggtcatc

SEQ ID NO: 17007 - DNA, 121 bp, Artificial Sequence
  Synthesized
  misc_feature (61): n=a or c
cttgaattacaactttgcaagtagagcctggccaagaacatttctgaacaactgtccaagntgaagcaagacatttgttccttgttttcaattgattttcaaggagtgatgtcttaaaaca

SEQ ID NO: 17008 - DNA, 121 bp, Artificial Sequence
  Synthesized
  misc_feature (61): n=a or c
aactcatgggctgagatagagacagtttactaggtaaaacaaaagctgcacgttcaagcanaatgaagcaaggaatttgtttgctgcttatcaacaccaggcagatgtttgtccacttcaa

SEQ ID NO: 17009 - DNA, 121 bp, Artificial Sequence
  Synthesized
  misc_feature (61): n=t or c
gctactgctaagcacaaaaatattaataaatctaaacctcttctggcaccagtaagcatgnattgtcttgattgcatctcaagcagtaagatgtggcaagcaccactttattgcatgagcc

SEQ ID NO: 17010 - DNA, 121 bp, Artificial Sequence
  Synthesized
  misc_feature (61): n=a or g
aatatactagaaggttttaataacatataaaagcatttggaagtagtttctcaaatacgantaactgtaggagaatgaatgaatttttagtgagagtcacttaccagcatatattcagatc

SEQ ID NO: 17011 - DNA, 121 bp, Artificial Sequence
  Synthesized
  misc_feature (61): n=a or g
gaaatacttacattttcagatacttccaaatatcagaagcccccaagaagccctaacaccncctacaaaatgggaaaatgggaaaaactttcccatcaccttcgtaggagtttttaaggtt

SEQ ID NO: 17012 - DNA, 121 bp, Artificial Sequence
  Synthesized
  misc_feature (61): n=t or c
tttaacaaggaacatttctttccatgctgatggagtgcattgtattcttgatgctacttgngatcaggcagctcagcatttatcattgctgttgtacaaaaccttttgttctatttctgga

SEQ ID NO: 17013 - DNA, 121 bp, Artificial Sequence
  Synthesized
  misc_feature (61): n=a or g
gagggaaaaaattatataaaagggtcttttgaatgttgagcattcatgctggcaggctggnaggctgaatgaacaacagctgcccaagagaccaaagattttgagttgtaattattactca

SEQ ID NO: 17014 - DNA, 121 bp, Artificial Sequence
  Synthesized
  misc_feature (61): n=a or c
ggcacactgacgtgtgtccaaacactgcaagggctctgctttttgtatatcatttaggcangcttgtgtagtggcaggcagttaagctaattaagttcttaggttaaagctgtgctggaag

SEQ ID NO: 17015 - DNA, 121 bp, Artificial Sequence
  Synthesized
  misc_feature (61): n=t or g
aagctgaacagaaggtgtttagtctgaatactgtctttgtttcaccaaatcaaagtttcanacaacttcgtaagttgcaatctcaacacaaacgtcaaaagactcctcatattacactttg

SEQ ID NO: 17016 - DNA, 121 bp, Artificial Sequence
  Synthesized
  misc_feature (61): n=a or g
aatgatctggaatgtttgaaatcttagtgaatgaaagaatatttataattacagtacattnggtgtacattctcagaaacaatcccttaagaagaccaattctgtaacccatcgtgattcc

SEQ ID NO: 17017 - DNA, 121 bp, Artificial Sequence
  Synthesized
  misc_feature (61): n=t or c
acagtgtgagatttgcaggctggtttcttatttgggaattcagagccgtagagtatcctanagtcagtccatatatttattaaatgctaagcacttctctttccctgatatataaaatatg

SEQ ID NO: 17018 - DNA, 121 bp, Artificial Sequence
  Synthesized
  misc_feature (61): n=a or g
aatctaggccagtggcagatggaaggagtaaataataggatgatctttgctgtcatgagtncttgtggccatcatgctatgatggacaacctacatcaatacaatgatgtgagagttccat

SEQ ID NO: 17019 - DNA, 121 bp, Artificial Sequence
  Synthesized
  misc_feature (61): n=a or t
ccacaatggtcatagattttgacacactgaataataacttattacactcaatggactcaantattgttaattattctttctaacctatggggtacaccaacatggaagactgcagaatagg

SEQ ID NO: 17020 - DNA, 121 bp, Artificial Sequence
  Synthesized
  misc_feature (61): n=t or g
gcagcgaagaattatgagattgtgagttgttattacaattctctgagacattttttgatcntcctcagactattaatattagggaaatctctgacacaagcaccagaactctgaccacgca

SEQ ID NO: 17021 - DNA, 121 bp, Artificial Sequence
  Synthesized
  misc_feature (61): n=t or c
tcagcgataggctggctgtgtaaggcttggttattctgctaagtttcatgagtctgaatgntcctgcttttttttcctaattggacaatcaatgtaattgttgggaaataattatcactca

SEQ ID NO: 17022 - DNA, 121 bp, Artificial Sequence
  Synthesized
  misc_feature (61): n=t or c
ggtgacatttgggcaactccatcaattaggcacatgcagcttttgtggtctgcaggatcanttatctcagcttactcttcctgtagaatcaagttgcactagcaaaaaaaagatgcttttt

SEQ ID NO: 17023 - DNA, 121 bp, Artificial Sequence
  Synthesized
  misc_feature (61): n=c or g
tccagtgggctggatctcctgctgcagactgtaaattccacatagccagttttaacacctntttatataggtaagcataaaagcttgcagttccagtggctgtgtaaatggttagtgtgcc

SEQ ID NO: 17024 - DNA, 121 bp, Artificial Sequence
  Synthesized
  misc_feature (61): n=t or g
gggcatggggggtgggtgggctttttggtgctatttgtctccttttaatcactagcaaatnctgaaatgtctagtcatgctaggcaaccagaacttcttaatcatgctgcccatttcctag

SEQ ID NO: 17025 - DNA, 121 bp, Artificial Sequence
  Synthesized
  misc_feature (61): n=a or c
agttattacaacagaaggagtatagggagcaggaaggatattaggccttcagaacactaangtgtactctaaaaagccaaaaagatgttaaccacttatacatactcttctagtgaagaaa

SEQ ID NO: 17026 - DNA, 121 bp, Artificial Sequence
  Synthesized
  misc_feature (61): n=t or c
gaagatgctgatagcctacatctgctctcagcagctcagtacttgagatgacacaaactgnaacgctgcttcttctggactaacacgggagatgatttactgagaaatgggtgtttactcc

SEQ ID NO: 17027 - DNA, 121 bp, Artificial Sequence
  Synthesized
  misc_feature (61): n=a or c
tcccttacttccctttcagaaatgtggggattttgtcacaaagactaaacaaactctactncaatggggttgtcagatgtacatctgtaccagataagatctgcagatggctgaatggcaa

SEQ ID NO: 17028 - DNA, 121 bp, Artificial Sequence
  Synthesized
  misc_feature (61): n=t or c
ataaatactttgtattccataataaaagaaagaaaaataagggttgttgaggggaaaatantttctgcttcttacatcctacatgttttgcaggaaaggagcctgaaatattggatggaag

SEQ ID NO: 17029 - DNA, 121 bp, Artificial Sequence
  Synthesized
  misc_feature (61): n=a or g
ctccgcagtcagcagatgcactcagcaggaaggtgatgtcaggcactccaagtgggagacngggcagcagaaaaccattgcccacgagtaatcagatagaagggacaataaggaggcaata

SEQ ID NO: 17030 - DNA, 121 bp, Artificial Sequence
  Synthesized
  misc_feature (61): n=t or c
tcagaataggtggtttcagcagcacgactctgccatctgctcagggtttccaaggaatggnggtgtggcggagctggctgctggatgaggcaggacgggccggggctgctctgatgttggt

SEQ ID NO: 17031 - DNA, 121 bp, Artificial Sequence
  Synthesized
  misc_feature (61): n=t or c
cagaaattgctgtttcaggatatggatgtctcttcaaatgaatcagacaaacaacactgtntgtaataaaattgtctgtgatctcatgctacgatattatgaaataaaagtagaaatactg

SEQ ID NO: 17032 - DNA, 121 bp, Artificial Sequence
  Synthesized
  misc_feature (61): n=c or g
gtaattctgatgcagatacgaggtaatgggctggatggtggtggctaaattagcagtgttngcagtggagaaagcaatctgcactgtatactgtattatgatacagtaatgtgttttcaat

SEQ ID NO: 17033 - DNA, 121 bp, Artificial Sequence
  Synthesized
  misc_feature (61): n=c or g
gagactgcaagtatctaatttcaaggaacatcactgcctcaaggtatgctgtcagtatacnccgagctttttctatgattttatcttgtttggtacctaagccagttgcaaaaaaagaaaa

SEQ ID NO: 17034 - DNA, 121 bp, Artificial Sequence
  Synthesized
  misc_feature (61): n=t or c
atggcctcaggagctgtccacctgatggggatcttgcctccctgcagggatagacagcttngttattaagggcacacctgctctgtcctcccgaccccagatctgcagattcccatgagca

SEQ ID NO: 17035 - DNA, 121 bp, Artificial Sequence
  Synthesized
  misc_feature (61): n=c or g
gaggggcctcatccaggtcggcaggactcagctgtggccagagcccatgaaaacagtgctnggaggggcccaggtttatcccctaacagggaaacctttggggtccttgtgtgggccgggc

SEQ ID NO: 17036 - DNA, 121 bp, Artificial Sequence
  Synthesized
  misc_feature (61): n=t or c
tatttagcagcagcagggacgtggcagactctttaacaacccagggctagatgaagctgcnggggatagggttgcccacatttctgcctcagatttcttgtacaaaaatatgcacgagtgc

SEQ ID NO: 17037 - DNA, 121 bp, Artificial Sequence
  Synthesized
  misc_feature (61): n=t or c
catgagattcagacaagacaaatgagagaattctcagcagacatctcttcatttgcctccntgggataaatctgaagaggtcttcagaggctgaaactaaacataaatgacctgctcagcc

SEQ ID NO: 17038 - DNA, 121 bp, Artificial Sequence
  Synthesized
  misc_feature (61): n=a or g
ggaccatggagcagctgtagagaggagcaaagatgctgtgtgcgcagggatgctgggatcntcaagcagccacccctccaatctccagcccaacacagagggtccctgcaggcttctggga

SEQ ID NO: 17039 - DNA, 121 bp, Artificial Sequence
  Synthesized
  misc_feature (61): n=a or t
caacagccatttccacacttctactgttagaacagtttctatttgctccagctccacagcnctgaaagactgaactaccgtcatctaagcacagtcacctataatgcagatatctacgact

SEQ ID NO: 17040 - DNA, 121 bp, Artificial Sequence
  Synthesized
  misc_feature (61): n=t or c
ctatgatctggtgctgagcaagcaagatcctgaagagaattcaatgtagatctgaatatanagctctgagatctgtccttttggaatattattatattgtgccccactgacattttactta

SEQ ID NO: 17041 - DNA, 121 bp, Artificial Sequence
  Synthesized
  misc_feature (61): n=a or g
ccgtgcttagcgctgaatttcagtttgagcagagcagggcttgttggtgctgggcagaaangcacagttcccatggctaatgccatatttacccccagggtctctgcccccatccctgcca

SEQ ID NO: 17042 - DNA, 121 bp, Artificial Sequence
  Synthesized
  misc_feature (61): n=a or g
aaaggtgctgggtgtttagtttctacaggtgaaatcaaagtcataggacttataaatcctngctgtaggctgctgtgctatgcaatctctgtcctgtctcctctgaggccttggttgggag

SEQ ID NO: 17043 - DNA, 121 bp, Artificial Sequence
  Synthesized
  misc_feature (61): n=t or c
tcaaagtacgtgccatgagaagcacatacctgaaaggccatatgagcctaccacagaatcncacttgttttacatctctgcttgggcattgctatttaccctacatttgttacccaaagca

SEQ ID NO: 17044 - DNA, 121 bp, Artificial Sequence
  Synthesized
  misc_feature (61): n=t or c
aagtggagcggactcagcatcgttttgactgctgtagaacaaagcagcactctgagagctntgaagaacaggaggtaaatttgtattgtaaatttgttgtacctcttgaagaactactgtc

SEQ ID NO: 17045 - DNA, 121 bp, Artificial Sequence
  Synthesized
  misc_feature (61): n=a or g
acatcagacacattaataataaatatgccaattaggtataattagtctgataactactttntgttttgcatcatgcatgaaggtgcacaacaattgccgtacgttctgtgtgctgtcttac

SEQ ID NO: 17046 - DNA, 121 bp, Artificial Sequence
  Synthesized
  misc_feature (61): n=a or g
aaagagtcaagctttcagacaaagtggttgggcagaatgccattaacagttggaataatancggttcaaaaaaattgatgtatctttttctaaataatggttacattcccaaatggatttg

SEQ ID NO: 17047 - DNA, 121 bp, Artificial Sequence
  Synthesized
  misc_feature (61): n=t or c
accagtgactgtttcatttcattattttccatctctctgcctcacgtaatctgcagagtgngtttaatccgatattggaaagcttgtgatgctctgacggaagtaatgtcactattatgaa

SEQ ID NO: 17048 - DNA, 121 bp, Artificial Sequence
  Synthesized
  misc_feature (61): n=a or g
atcccactgaagggagcctttgggattcagagaacctagcagaatgcatagaccccaggtncagggagttgtatgagtcttggtctggtgtgtgtaaacctatctgtaacttgctttaaaa

SEQ ID NO: 17049 - DNA, 121 bp, Artificial Sequence
  Synthesized
  misc_feature (61): n=t or c
caatatcttaagtatatatccatgagtacaaccttgtatctttactctgagtgttcccagncttgtttagagctggagcaaaatatagatccaccctcctttgaaggacaatagagattta

SEQ ID NO: 17050 - DNA, 121 bp, Artificial Sequence
  Synthesized
  misc_feature (61): n=a or g
gctggaagttttccacgtgccataggtccagcgcagggctatggactacagaggtacaacncagttgacagtgtaatccacaggttatctggaacgcagaacaacgtgaggcccagcagca

SEQ ID NO: 17051 - DNA, 121 bp, Artificial Sequence
  Synthesized
  misc_feature (61): n=a or g
acgtcagcatatatcctctctgtccattatcttctccagctgccaagccactgcaattaangagtttaatttacttcccagcacagtattcagaggtttcaaaaaaaccaaaccaaaacaa

SEQ ID NO: 17052 - DNA, 121 bp, Artificial Sequence
  Synthesized
  misc_feature (61): n=a or g
tctggattctccccatgttgaaaaatgtagaagtaatggatttagttgctatttcccattnaacaaatgtaaactttaaagtcctagagatgcctgtgctgtgaccccagcacacaaaggt

SEQ ID NO: 17053 - DNA, 121 bp, Artificial Sequence
  Synthesized
  misc_feature (61): n=a or g
aaattcatctgagttaaagtgtatggtagatattcccttggcaagccatgtctgagaagtnaaagaatttctaactcctcctgtcacaatgtccttgctgcaccctgattcttgatgcatc

SEQ ID NO: 17054 - DNA, 121 bp, Artificial Sequence
  Synthesized
  misc_feature (61): n=t or c
ccaggtaatcaccgtatttcctgcaaaatgtaatgttgcttgtattcctcccctgaatggnacccaggtgttcctgacgtggattagctatatggagagtgatgagaacagaagagtttct

SEQ ID NO: 17055 - DNA, 121 bp, Artificial Sequence
  Synthesized
  misc_feature (61): n=t or c
aggtgggaattgattgtcttctttctcccgcagcatttgtcttgataattactcaagcaangaagggatggttttaggcagtataaagggagaagaagatgaattaatcttggcttcaata

SEQ ID NO: 17056 - DNA, 121 bp, Artificial Sequence
  Synthesized
  misc_feature (61): n=t or c
caggaccaaaataggaaaaatgtaggtgtacatgccgatgtcgtgcttactgaagtagtcntgctgaattttattgcaaatagtgatgtaacgtaggtggatgaattgtgctcatggtgtg

SEQ ID NO: 17057 - DNA, 121 bp, Artificial Sequence
  Synthesized
  misc_feature (61): n=t or c
ctacctccccttgctgtagggctgaagatctttggggtgtgccagttttgggtgccccaancaaagaaatgccagcctggctccatgggaaggctccatgggaagctctcaccaagagaag

SEQ ID NO: 17058 - DNA, 121 bp, Artificial Sequence
  Synthesized
  misc_feature (61): n=a or g
gggaagaaaatgattgtctgaacccaaacatcttaccatagatatctaaggaaaatgtgcnttccttaggagacctctcagtcagtcccagcatgatatgcaaataaaggcatagaccaag

SEQ ID NO: 17059 - DNA, 121 bp, Artificial Sequence
  Synthesized
  misc_feature (61): n=t or g
gacacagtgaagacagataatatattaagttatgcaagagttgtttatacagtgaattctnttcttccagctaccatgcaattaccatcagaattaagtaaaatctatcagcttagttcta

SEQ ID NO: 17060 - DNA, 121 bp, Artificial Sequence
  Synthesized
  misc_feature (61): n=t or c
taatcaggaactgtgtattctgtggtccagatagcaaaagccttgtaattgtacattgatntccaggcattggtgctatgaaagatacaagtctgattgttctaaaattgaagtcttctgt

SEQ ID NO: 17061 - DNA, 121 bp, Artificial Sequence
  Synthesized
  misc_feature (61): n=t or c
aaaaaaataccaaacgtataagctctggattcaattattattgacaacagtacaaaagctntaaaattaccatcagatctagagttcttatatgtttctttatcacagtgcacctgtgcca

SEQ ID NO: 17062 - DNA, 121 bp, Artificial Sequence
  Synthesized
  misc_feature (61): n=t or g
ttagcattcttttcccaaccacctccatttgtttactatcttagacaacttccagaccttnggaaaacatttggttccaatccagtttgaatattattggattgatatattggattgattt

SEQ ID NO: 17063 - DNA, 121 bp, Artificial Sequence
  Synthesized
  misc_feature (61): n=a or c
accagagacaagaatagagggaagcctttcagacagataaaccgttttcaaggaaaaaagnaagtacaatcttggaaagcagtcaaagctccaggctttgtggagtgctgtgttattgtgc

SEQ ID NO: 17064 - DNA, 121 bp, Artificial Sequence
  Synthesized
  misc_feature (61): n=a or g
atgactcaaggggctgggcttttatgaatgataaagccctgggatttaggcagggctctcnggcctttttctctgagcaacgccatcactttacatttctcaagtggcgttttgggcgcag

SEQ ID NO: 17065 - DNA, 121 bp, Artificial Sequence
  Synthesized
  misc_feature (61): n=t or c
ttacgatgttaagatgtgcctcgtgagcttccctttgaggaagatggaactgatgacaacnagaacatgagttcatgctttatcaaagctggcttagcaagtatttaacccccaccaccac

SEQ ID NO: 17066 - DNA, 121 bp, Artificial Sequence
  Synthesized
  misc_feature (61): n=c or g
tatcttatttttaatgataacgaagtgatttctgtcttttgtagggcgtaggcccctgtcnttgtcactgggaagataatgagaggttatcaaatgaaagggcccagggtggctgatttta

SEQ ID NO: 17067 - DNA, 121 bp, Artificial Sequence
  Synthesized
  misc_feature (61): n=c or g
cagtggctgagccagcagcaccctctgctgggaagcgcagccaaagctctgctgggtaaanattaacccaaacacaccgcacagctccgctccgatgggactttattgtttccatgtacag

SEQ ID NO: 17068 - DNA, 121 bp, Artificial Sequence
  Synthesized
  misc_feature (61): n=a or g
tcaaatctgagagagctcacaggggtgaaccatgcaatctaatgcttttttctgctcttanagaaaggctatacagccttagagagtaactcttgatttgcactcttaattctctgtatga

SEQ ID NO: 17069 - DNA, 121 bp, Artificial Sequence
  Synthesized
  misc_feature (61): n=a or g
cgagaacgcatgactgggaagtgcttgccagtcatcttgtgagaaacactacagaatgcantgcattgaaagggggaatgcctaacccaacaaaatgcagagccttcagaggcatggcagt

SEQ ID NO: 17070 - DNA, 121 bp, Artificial Sequence
  Synthesized
  misc_feature (61): n=t or c
tcatcctatggtaagtgtttcagttaccccaccaatcaaaaaaactgtcaaatgcctccgnttgggtgcaaaaaagaaaggcaagttttcactacaatctgtgcattgcataataacatct

SEQ ID NO: 17071 - DNA, 121 bp, Artificial Sequence
  Synthesized
  misc_feature (61): n=t or c
aagaaggcctgtcatcccttattcagtgttggaaagctcagcagttcattagagaccggangctctttctccctctcaacacttgacagatgagcagtttgcttggctgcttaggcactaa

SEQ ID NO: 17072 - DNA, 121 bp, Artificial Sequence
  Synthesized
  misc_feature (61): n=a or g
caacagagaatgtatatgagatctgtgtatgacaagagttcattaagaagcatttttgcantagaaattgtgatagagatacatacattcaccacagcaaataactcttgagataatcaaa

SEQ ID NO: 17073 - DNA, 121 bp, Artificial Sequence
  Synthesized
  misc_feature (61): n=a or g
ccatcctattgatttcagtggggtttgcagtgaaagtaacaccaccaccaagaataaagcnaggagcaaaaatcacatgtagatgaaatttgactcttttttttttttttttctaacttaa

SEQ ID NO: 17074 - DNA, 121 bp, Artificial Sequence
  Synthesized
  misc_feature (61): n=t or c
tgcagtttatgcatttgctctgccaaaagcttaccttagcaaacaaagtgtagtaaatcanggttactctgatttactgcccaatgtgtgctgtttgttttcagggacagttcagtgaaaa

SEQ ID NO: 17075 - DNA, 121 bp, Artificial Sequence
  Synthesized
  misc_feature (61): n=t or c
tcttcttgtcatgtaatattagagtaagagtctgctaagcatgataaatacacttgagtanagttaagtgtttggatttcaacaaaatggtcaaaaaatcattcctgcacattcacgattc

SEQ ID NO: 17076 - DNA, 121 bp, Artificial Sequence
  Synthesized
  misc_feature (61): n=a or c
gccactaggcaagggaagcccgaagttgtctgttttgtcaggctccatctctttgataatnacatttgaaagtcagagctgagctttgctcttctgggctatcacagaaagtaaaggacag

SEQ ID NO: 17077 - DNA, 121 bp, Artificial Sequence
  Synthesized
  misc_feature (61): n=a or g
atttgaagcactacctgccatttgagtggaggtatactttttttctcaagtttccttgacnaagagtgttattctattaaacttagtactgctgcacactccaaaatgatgacttgcagct

SEQ ID NO: 17078 - DNA, 121 bp, Artificial Sequence
  Synthesized
  misc_feature (61): n=a or g
tagaatagaaggacagatgttgctaatttatgatgcaaaggcctttactgaaaagtgcacntttcacttaagattctctacaaacgctattttaatgctgatttcctcctctttagaattt

SEQ ID NO: 17079 - DNA, 121 bp, Artificial Sequence
  Synthesized
  misc_feature (61): n=a or t
tgcttaattattccacacctctgaatggtcaggtcaaatatcacatcaaagacaggtgtcnagcagacctaagcagtaatctgagctagaattcagaaatgagtcagttcttggatttgtt

SEQ ID NO: 17080 - DNA, 121 bp, Artificial Sequence
  Synthesized
  misc_feature (61): n=a or g
ttctgtggtggcatttcacttcaattcttcattcccagggtagggcacaagagccaggacntacactgttcccaacctgatccacaactatcaggtaactacgcagatgaagcagaaagat

SEQ ID NO: 17081 - DNA, 121 bp, Artificial Sequence
  Synthesized
  misc_feature (61): n=t or c
agaaatttatatccaacacatctttaactcaaggattactgtccaattctcttgggcttanttaggacccttaacaaaacatattatttgattctccaaagcaaggtccctcctgacagaa

SEQ ID NO: 17082 - DNA, 121 bp, Artificial Sequence
  Synthesized
  misc_feature (61): n=a or g
aagaaaagtatttataaatacatagctttcaccaataggcgtgattattacatgcatcaantgcaacccaggagtgaaaagaagagatttgattcttaggaacaaatacctgaaacgaagc

SEQ ID NO: 17083 - DNA, 121 bp, Artificial Sequence
  Synthesized
  misc_feature (61): n=t or c
cagaacttatgtggcctgtgctgagcatgcattggtgagacaaggggcattgcagacatcnatgtgtcagtgagtttcaggagctgtgagtgcctggggcatttgattagtgtattgaaca

SEQ ID NO: 17084 - DNA, 121 bp, Artificial Sequence
  Synthesized
  misc_feature (61): n=a or c
aagaccactggtaaatgtatgatgtaaacattcacccaaagctcaaacactgagcttcttnacacttataaaacctgtgcccaagtgggaaaataatggctggcgttttggagatccagca

SEQ ID NO: 17085 - DNA, 121 bp, Artificial Sequence
  Synthesized
  misc_feature (61): n=t or c
tggctgtgcaatgctccatcacccagcacccagcagggacatggaaaattccacctgcagntcagctctctctttcccccaaccttgcagcatgtggctctcagtcattcagccctgtgat

SEQ ID NO: 17086 - DNA, 121 bp, Artificial Sequence
  Synthesized
  misc_feature (61): n=t or g
gcctgttggcttggtgaagccattaacaggcatttaatgcactgaagaataaagacaaaanatatggagagtatcagaattcacggtatttccattttcttacacacagtatgaatttcat

SEQ ID NO: 17087 - DNA, 121 bp, Artificial Sequence
  Synthesized
  misc_feature (61): n=a or c
ctttttcttctcaaattttgccttcccgttgcacagaaatagacgagacggtcgtttgctntgaagaaagaaaatcagattcctgcaaaacaagcgcatgttgctctccgaactcccgtgc

SEQ ID NO: 17088 - DNA, 121 bp, Artificial Sequence
  Synthesized
  misc_feature (61): n=t or c
tcctctgcaaagagcactgagactgggggataaggccaacagacaagcagagttgcagcancacattttgttgatttgcattattctttccaacaaatcagcaagaaataagaagtgtcag

SEQ ID NO: 17089 - DNA, 121 bp, Artificial Sequence
  Synthesized
  misc_feature (61): n=a or c
aagttgtccatatggcatgttcagggaattagacttttatttctaaataggagtcttcaanttcatcaatactatattgcagggttttgagcttgaaagagactatcataaataattatcc

SEQ ID NO: 17090 - DNA, 121 bp, Artificial Sequence
  Synthesized
  misc_feature (61): n=t or c
tttccaataaaaagtaaatttgagatttctggctccatagggggtgtaaattctgatgtcntaacttccttttataatagaatataaccctctgatttcagaaaaatactttctttttctg

SEQ ID NO: 17091 - DNA, 121 bp, Artificial Sequence
  Synthesized
  misc_feature (61): n=a or g
tatcacaccgaacattgctgcagttacgacaatagagtttttggcagtgtggcatactttntagttcaaaatactcttatatgaaagggtggcatctgctccttttagactcacattgcag

SEQ ID NO: 17092 - DNA, 121 bp, Artificial Sequence
  Synthesized
  misc_feature (61): n=a or g
cataaataaagagcacataggagaagcagcagcagcattgtcagaaataattaaaaccatnattgcaaaaatgaatggaggaacggcgtctcatgatgttttattctggctttcttttttt

SEQ ID NO: 17093 - DNA, 121 bp, Artificial Sequence
  Synthesized
  misc_feature (61): n=c or g
gctctgcgtgaccacccatgcaaatgggagaggggctcgggtcttcatcggcctcttgcancgatacctacctgaaacggccacattaaacgacagccaagttgtcagcgcttccttgagc

SEQ ID NO: 17094 - DNA, 121 bp, Artificial Sequence
  Synthesized
  misc_feature (61): n=a or g
attgcattaaatcaattattactccttatcacttggacacagtttctctttttttattaanctcaaaatttttttgcttcagtaaactccagtccaaaacaaaccataccaacctggtgag

SEQ ID NO: 17095 - DNA, 121 bp, Artificial Sequence
  Synthesized
  misc_feature (61): n=t or c
tcaatatgttctatcagactataattatctcaggatgaggaggaacatcgctgggttgacnttatgcagcatagaatcaaaaagcaactaatgtacaaataattgcgtgtgacatgggatg

SEQ ID NO: 17096 - DNA, 121 bp, Artificial Sequence
  Synthesized
  misc_feature (61): n=a or c
ggaaggacaggaaggttggaagcagtcatagaaggaggttaaagtctgtattaatcctggnaagatttggtaaaactgacatctttttcctcttctgctggcttctaactgtgaagttatg

SEQ ID NO: 17097 - DNA, 121 bp, Artificial Sequence
  Synthesized
  misc_feature (61): n=t or c
tgtatctacacaatatagacatttcagagagctacaattatgtatgttttgaaacagtttnagaagcaatgaatgaatgaagttgcagtgttataacttcactcctgtcaagcatggaatg

SEQ ID NO: 17098 - DNA, 121 bp, Artificial Sequence
  Synthesized
  misc_feature (61): n=a or g
ggttaaactgagatgggcaacaaatcagttaccccttggtccatcctgctgtttcttgtangttttgctgcccactcagcacagatggctgcaaagtaaggtttttttgatcctgtactag

SEQ ID NO: 17099 - DNA, 121 bp, Artificial Sequence
  Synthesized
  misc_feature (61): n=t or c
taagagagttagcaaagcaaaaatagtaattctttttagtagtcattcatgctaccacaanagtgtttggtcttacttgtcaaaacaaccaaggcagacagtgaaaagcttaatgtagaac

SEQ ID NO: 17100 - DNA, 121 bp, Artificial Sequence
  Synthesized
  misc_feature (61): n=t or c
caaaaggcttcaatactaaaggaaataattctccatctccagtggccctttcctgattgcnttctattttctgatattcacctcttcatccaccagccctctacactgttactttttgcca

SEQ ID NO: 17101 - DNA, 121 bp, Artificial Sequence
  Synthesized
  misc_feature (61): n=a or g
attttgtttctttgggctcagtctagagtttgtctgtcaaagtcaaacacaaatgtttatntttttgactcaggatcagaggctatttctgtttctattttctgtctgtcctgaaatcatt

SEQ ID NO: 17102 - DNA, 121 bp, Artificial Sequence
  Synthesized
  misc_feature (61): n=t or g
ctttagtgctctcctgcagagtagtgcttactgactgtaactaaatattgcagtgtttcantgtctgaaaatatgggaacacagtttgctttcagctctggtcatttaggaattaactaaa

SEQ ID NO: 17103 - DNA, 121 bp, Artificial Sequence
  Synthesized
  misc_feature (61): n=a or c
ctgaggaaagcaaaccaccctaaattgcattttgactaaaattcaccagatacacataganatcttccaaaacgtagcagcttgcaataaaaaattaactgcaatccccatagcttcatcc

SEQ ID NO: 17104 - DNA, 121 bp, Artificial Sequence
  Synthesized
  misc_feature (61): n=a or g
tggaatcacaactcaccccatgtcagtccggctggtcaggatgatgcccggttcactcttnttgtctgcctgcatcagccatctcctcacgtggcttgagttttcagaggttactgaaaca

SEQ ID NO: 17105 - DNA, 121 bp, Artificial Sequence
  Synthesized
  misc_feature (61): n=t or c
tttaacaattaatgtcacaatcgtatctagaggtaagaaggttctactgagatagggtctncttgaccacagaaagcatgcaatttactgatgatatctgcagtcatcttccctctgtgtc

SEQ ID NO: 17106 - DNA, 121 bp, Artificial Sequence
  Synthesized
  misc_feature (61): n=t or c
gaagataaggttatcatgctatttattttctgatctttgtcaagttaacctctttgctaanatctttggcaaagtaactttttaagaaaagggtcagaaggcatacattttcagtatggat

SEQ ID NO: 17107 - DNA, 121 bp, Artificial Sequence
  Synthesized
  misc_feature (61): n=t or g
aggtggtggtttctgggatgtcatgttcaatgtttgggcagagatagagctggatattagntgtgagggctttgtaaactctcttggaagaataaggtacatttaatggatatctcaccag

SEQ ID NO: 17108 - DNA, 121 bp, Artificial Sequence
  Synthesized
  misc_feature (61): n=t or c
gccactgggccatttgaggcccagtgcctccatgtgccagaaacatttacagtagaaagcntctcttgccagtgacagcttaaaaatgtcagactatctgatttggttcctctaacatttg

SEQ ID NO: 17109 - DNA, 121 bp, Artificial Sequence
  Synthesized
  misc_feature (61): n=t or g
caatggtaagaatgacacctttatcgtggaacattgcttctatattatataatttctctgntttttttcttctgactttcaacaagagctctgctgatgtctgtagtggaatgaaattaga

SEQ ID NO: 17110 - DNA, 121 bp, Artificial Sequence
  Synthesized
  misc_feature (61): n=t or c
catgtctgaaaatactttgagcatgcagttgtacattctaactttctggcttgttgcaganctcactgctaatcttacctattttgagcaaaatatcaatattctggttgcctagctcctg

SEQ ID NO: 17111 - DNA, 121 bp, Artificial Sequence
  Synthesized
  misc_feature (61): n=a or g
ttaaaagaggtgaaagtgcatggcatgattgagaacaccccactttctcttgcaggttgantccgtcgctgctctgggacggcctgggccgtgctgctgtgccccaactgggttagcccct

SEQ ID NO: 17112 - DNA, 121 bp, Artificial Sequence
  Synthesized
  misc_feature (61): n=t or c
acaagaactacttcagtctatttttccctaggatcactctgagaatgctgtccattctganctcttaattcttttcaatagctacttttggaggaaaaaaaagaagttgcctttcctattg

SEQ ID NO: 17113 - DNA, 121 bp, Artificial Sequence
  Synthesized
  misc_feature (61): n=t or c
ctggacttaaacttccttcaacttcatcaaatgccatattaatcagctgcttataccccanggcatctgtgaaaacaccagaagagttaaccaggaaagcaggacagattagggaaatcag

SEQ ID NO: 17114 - DNA, 121 bp, Artificial Sequence
  Synthesized
  misc_feature (61): n=t or c
aatctgtttctaccagctcagctgggctcctggagccttcagcaggaatgtattgctgcgntcaaatgggcaaaatgtctcctatttctcagagctgtagtgagagaggagtgggagtctc

SEQ ID NO: 17115 - DNA, 121 bp, Artificial Sequence
  Synthesized
  misc_feature (61): n=t or c
ctatgctcattataggttgtgatatgcttcttagcacaaatactgggggataaaaatacanatatttcatagagagattgattccatgaataaattttataatggaagaccaagtatccta

SEQ ID NO: 17116 - DNA, 121 bp, Artificial Sequence
  Synthesized
  misc_feature (61): n=t or c
gtgctctggttctggaaactgtggggggagctgaatgatgtcaggtatcgcttaaactgcngtcttaaaccatcctttctgggcactgaaggagcgcagggatccgctcatacaggcagtg

SEQ ID NO: 17117 - DNA, 121 bp, Artificial Sequence
  Synthesized
  misc_feature (61): n=t or c
acaaaagcctcaggggggatggggtggattttgtgtgggtctgcatccactcagtgcttangaggaggggctgtgtgctgaacagctttgtcagcacgatgttcaggcaatggcatctttc

SEQ ID NO: 17118 - DNA, 121 bp, Artificial Sequence
  Synthesized
  misc_feature (61): n=c or g
gaaccaagcccaatcgccaagctatgtattactatgcattattcattgatatgcatctttncacatgcacattaaatggtaatttagaggcatctgtgtccaaatggttagcaagcacctt

SEQ ID NO: 17119 - DNA, 121 bp, Artificial Sequence
  Synthesized
  misc_feature (61): n=a or t
agaaagtacctgaaagttcaagattttccagggaaaggtgtaaagcccaaaagtttcctgngtaactattgcaacagcagtgcagttcctgtctgtccaggctaaacatgctgctctattg

SEQ ID NO: 17120 - DNA, 121 bp, Artificial Sequence
  Synthesized
  misc_feature (61): n=a or g
atcagggtacattctttatttttcctgttagaagtttggtacacttctttaaagacatgangggttttaagaattccaaaaacacagctttccagatctatttcagttactttagacaaga

SEQ ID NO: 17121 - DNA, 121 bp, Artificial Sequence
  Synthesized
  misc_feature (61): n=a or g
agcagaaacctctgcacaggaccagcaactgcagatgaaccacatgacaacaaagctgcanagaaacgctcattcaaagcaagttgtcagcctcaacgtagatcagaagacatttcctgta

SEQ ID NO: 17122 - DNA, 121 bp, Artificial Sequence
  Synthesized
  misc_feature (61): n=a or g
gcacatcagtgcaagcaatcctttcgattccttttctccacaccatacatgatcttacagnctcctgtcacgcccaagctaaaaatacccaagctcattcagcctcttggcaagacatctg

SEQ ID NO: 17123 - DNA, 121 bp, Artificial Sequence
  Synthesized
  misc_feature (61): n=a or g
gttatctggtccttgcctcactggaacacaaatattgactgacaaacaattgcataacaancaacacaatcattttggcccgttgacttatctcccagcaaaagaaataaacaaggaaaag

SEQ ID NO: 17124 - DNA, 121 bp, Artificial Sequence
  Synthesized
  misc_feature (61): n=a or g
tttgaagccttcctgccattagtgatggaataattacatcagtcatcacgccacttgccantaaagttttttagcctataatttctcatttgtgaacattagttcttatgcattatggacc

SEQ ID NO: 17125 - DNA, 121 bp, Artificial Sequence
  Synthesized
  misc_feature (61): n=t or c
tttttagggttgcaaatgcaaactactgttggtctttgtgtgactaattgatggtagctgnaagaaaaacaccctttgatagaaatataattatcacataatagtcttaaatctaattatc

SEQ ID NO: 17126 - DNA, 121 bp, Artificial Sequence
  Synthesized
  misc_feature (61): n=a or g
gttgctagctcttctgtaagcatggaaaatagcataaaacttaattaacgctacatccacntctaccagaagacaggtggactcaaaaacatgctctgggaaccaacttttcataccaaca

SEQ ID NO: 17127 - DNA, 121 bp, Artificial Sequence
  Synthesized
  misc_feature (61): n=t or c
aaatgctactggcttctgtaaatatccaagtactcactactaatcacattttacgcaaacngcagtgcttaagcctttgttttcactggaaattacagcctttgtaacaatacattgccat

SEQ ID NO: 17128 - DNA, 121 bp, Artificial Sequence
  Synthesized
  misc_feature (61): n=t or c
tcttgcacgcattttttgggacagcactgttataacatgttgtacattcaagtctgaagangaagctggaatccttggagagccagcgagtgactcagccagtgcacaggctttgccacac

SEQ ID NO: 17129 - DNA, 121 bp, Artificial Sequence
  Synthesized
  misc_feature (61): n=t or c
ggaatccttgaaagagaaagaaatcccctatgggcctattatgcctgttccttttgtttanctcttcttgaatttcctattattttcagctatgattacatatcacaggtctctccagcct

SEQ ID NO: 17130 - DNA, 121 bp, Artificial Sequence
  Synthesized
  misc_feature (61): n=t or g
ttcaaagaagcctaaactccacgatgacttctattgtagctgatgatttgcatcatccagntttttcactcagaattaaaacaaggcaccatgtatagtgaaaacaaagaaaaaaaataag

SEQ ID NO: 17131 - DNA, 121 bp, Artificial Sequence
  Synthesized
  misc_feature (61): n=c or g
tttctagtccatgttagaagtctttcttgtttgttttggacatattcataaaagcaatagncaatcaattgttccttttgtggcagaggtggttatataatacacagcatgtgatcaaaat

SEQ ID NO: 17132 - DNA, 121 bp, Artificial Sequence
  Synthesized
  misc_feature (61): n=c or g
cattgtgcatttcgatatctttgattttgtgacttgcaaacttaagagaaaattgtagtantagtttatttaacagtggggatgctcagtatataagaatttggaaaatgagagagaaaac

SEQ ID NO: 17133 - DNA, 121 bp, Artificial Sequence
  Synthesized
  misc_feature (61): n=a or g
ctgtctgtattgcaactaacagggagtcgaacaatgctattcaagctgctctgtatctagngaggaatgacagaatacataggtggaaagggtccttcagaggacaacaagtccagtgtct

SEQ ID NO: 17134 - DNA, 121 bp, Artificial Sequence
  Synthesized
  misc_feature (61): n=a or g
atgagtggaaaaaagacacagaagcagcctttgagatgtgcgagttcaggtatataaaacntcaggaatgtacaggaggtcttctgtagtgagaaaatgtacagctatgactttggcaatc

SEQ ID NO: 17135 - DNA, 121 bp, Artificial Sequence
  Synthesized
  misc_feature (61): n=a or c
ccacatccaaacataaaatactgaacacatgaatcatcagatatttactgtgtctaaatangggcatccatagggtccaatagaacagataatagtacatcacttacctttaggactttta

SEQ ID NO: 17136 - DNA, 121 bp, Artificial Sequence
  Synthesized
  misc_feature (61): n=c or g
agagaaatgcctaacttctaactgaaggcagaaggtatttaagttggctttgatccagaangaattatgctttctgcaggaaatcgtagcagctgatttctattacagaattactgtgggt

SEQ ID NO: 17137 - DNA, 121 bp, Artificial Sequence
  Synthesized
  misc_feature (61): n=c or g
cattggacttgctttttcatttgaatttgttactgatagctcttcttatttccttgaatcncaagttccatatattctttctcacattttgggatagagcttgcatgatagatgacacaca

SEQ ID NO: 17138 - DNA, 121 bp, Artificial Sequence
  Synthesized
  misc_feature (61): n=a or g
attcagctcaccataaatgttttgactgcaaacttttagctctggtcatgtgaatttcttnaagattctgtatatccagcctgtaaggaaagaaaactcataaagcccctgagggtgcttc

SEQ ID NO: 17139 - DNA, 121 bp, Artificial Sequence
  Synthesized
  misc_feature (61): n=a or t
cctcccatgtttaacagcacaccttgtggatgagtggtcacaaaagactgtgagaaaaacncaaatgcttcagttcagggtccccaaaatctttcaaagcccgggtaaggcaaccaacctt

SEQ ID NO: 17140 - DNA, 121 bp, Artificial Sequence
  Synthesized
  misc_feature (61): n=a or c
tatagcccattgtcatctatagtaattaggataacaactctaccctgtaatttggagtacntgaattcttttggtaataaaaatgagaagtaatgcacacagtaacaaagatgacttaatt

SEQ ID NO: 17141 - DNA, 121 bp, Artificial Sequence
  Synthesized
  misc_feature (61): n=a or g
aaacaaaaaaaaggcaggcatcaaaagcaaagggaggaagatgaaacagcaaacacagtcntattcacactgaattccccatgctgaccttcagaataaagtgaaaaataagtcgtatctc

SEQ ID NO: 17142 - DNA, 121 bp, Artificial Sequence
  Synthesized
  misc_feature (61): n=t or c
cccgaacagttaagaaacctcattgccactcagcatttccagaggcctcagggaagatcanctgtgttaactgtgggacgcatcactgagtgccatgcagtgtgaagccccggtgctgcca

SEQ ID NO: 17143 - DNA, 121 bp, Artificial Sequence
  Synthesized
  misc_feature (61): n=t or c
gaattacagatcagcatatcagtgagaagccatgctccatggaattccacaaaagtcctancatttggacagtgacacatgcacggaatactggtaggaggctggagtattgggtacattg

SEQ ID NO: 17144 - DNA, 121 bp, Artificial Sequence
  Synthesized
  misc_feature (61): n=a or t
cttcctgttaccattacttgaaaatgcagaataaaatactgtctgaacttcaggcaaccgncctttccatatttaaaagtttcaactaattttaattactgccttctcttgctaaaattat

SEQ ID NO: 17145 - DNA, 121 bp, Artificial Sequence
  Synthesized
  misc_feature (61): n=t or g
ttttttttttgtggtatttactacaacacccaaagtagatcagaaaatgtgtcatttgccnccctcttggagcactaagttgtaagactcagcagttttaaccattaccaggcaagatgga

SEQ ID NO: 17146 - DNA, 121 bp, Artificial Sequence
  Synthesized
  misc_feature (61): n=a or t
atggagagcagcggtctgtagaaatgggtacaatcgttgaggctcactaagagagagcagngaaaacaaaaatagctagattggatcttctgtttacttgtttgatttaaaaataattaaa

SEQ ID NO: 17147 - DNA, 121 bp, Artificial Sequence
  Synthesized
  misc_feature (61): n=a or t
cagatgcagtgactcaattgcttatgattgtctgccacaactatgtgtctgcctgttttancctagtctagctaatgacctggagtttttcattctggactacaaataaccttaagaggat

SEQ ID NO: 17148 - DNA, 121 bp, Artificial Sequence
  Synthesized
  misc_feature (61): n=a or g
atcagttttcaagatgatttttttgtttggggtacaatcttccagctgtctgtggtgactnaccagggggatttaaaagttttccacatgatagtgactggccaactttccactgctctac

SEQ ID NO: 17149 - DNA, 121 bp, Artificial Sequence
  Synthesized
  misc_feature (61): n=a or c
caaacgtgatcagcactcctaacatctgtctggtgccactggtcaaacagcctcttttagnacttcctcaccagcactgtggatcaggcatcgttgaaagacagaataagctttcatgaaa

SEQ ID NO: 17150 - DNA, 121 bp, Artificial Sequence
  Synthesized
  misc_feature (61): n=a or g
cttacagacatttgttctgcattttgtgtatcgcagtgggagcaagcgagctagaacggcnctcaggaaatcccactggggctgtcagatggtgctgctggagcagctctgcccttttcct

SEQ ID NO: 17151 - DNA, 121 bp, Artificial Sequence
  Synthesized
  misc_feature (61): n=a or g
agtttgtgtgcaaaaactgcagagtccagatttgtcttggagtactatgacccatgtacancttactacgctctagcgaaagaggagaaatactcttttttcctttatcttgcaagtaatt

SEQ ID NO: 17152 - DNA, 121 bp, Artificial Sequence
  Synthesized
  misc_feature (61): n=t or g
tctcagaaagtagttttactgctgttgttttattgcatggattgtgtatgtgaacaaaacngattcctatgtctctctgagtgtcaagcctctagctgtaggaggcacaacaggtgatggg

SEQ ID NO: 17153 - DNA, 121 bp, Artificial Sequence
  Synthesized
  misc_feature (61): n=t or c
gctgctgtggtcccgcaggtacctgaagtacctgaccaagaagtacctgaagaagaacaanctccgcgactggctgcgcgtggtggccaacagcaaggagagctacgagctgcgctacttc

SEQ ID NO: 17154 - DNA, 121 bp, Artificial Sequence
  Synthesized
  misc_feature (61): n=t or c
agtgcaatctatgcaaacatgccacatagcagagccacaaaggaaccacataaaagcaaanaaaatgaagtgtctttagttcctcccaaagcacaatgcattcatgactgcatgtgggctt

SEQ ID NO: 17155 - DNA, 121 bp, Artificial Sequence
  Synthesized
  misc_feature (61): n=c or g
gccagcaagcagaggagatctcaagaatgccttcctgtgctgctgcaggagtgagaggggnctttcctagcaatgtggtagcaagatccagcactggccattgcagggccaccccccgtgc

SEQ ID NO: 17156 - DNA, 121 bp, Artificial Sequence
  Synthesized
  misc_feature (61): n=c or g
ctttaggatcttctcttttaagtattttattagagctctgaagagtttttactgagccgtntgacgaaatctttgttcctgctgagtgcagctgctttgttagattacacacagatcagtg

SEQ ID NO: 17157 - DNA, 121 bp, Artificial Sequence
  Synthesized
  misc_feature (61): n=t or c
catttgtaaacagactgccaatgtaggctccaaacagctgggtttttaacaaatagaaggnttcatatatcctttcattagtgtaaagaataacgaaatgttttctgtactacaaatttga

SEQ ID NO: 17158 - DNA, 121 bp, Artificial Sequence
  Synthesized
  misc_feature (61): n=c or g
cggaagagcgaagctggtggttgggctgtgggcttgtcgggtttgttcttgtgttgctgantgtgtgtggacctctgcacagaaactccaattaccagattttggctgagttatggaagaa

SEQ ID NO: 17159 - DNA, 121 bp, Artificial Sequence
  Synthesized
  misc_feature (61): n=t or c
ttttgaggccagtgagtctgcagaactctgtctgtggactttatcatagcagacagttttngtcagtggagtgctgtcaggacccattctgaattgagtgagtgctcagctgctctgcaga

SEQ ID NO: 17160 - DNA, 121 bp, Artificial Sequence
  Synthesized
  misc_feature (61): n=a or g
tcctgtaggcatatttggctttcctctaaaacgctgctcacagaaggcaaaagaataaagnaatgggctttcacttatggatgaatcactgagtgctacataaagccacagcagtcaggtt

SEQ ID NO: 17161 - DNA, 121 bp, Artificial Sequence
  Synthesized
  misc_feature (61): n=a or g
caatttgggcataaacctatggacatgtgttttactgatccagctccagccaccatatccngttactctatattcctctcctttctgtttccaaacctgttaaatattttaaatatattaa

SEQ ID NO: 17162 - DNA, 121 bp, Artificial Sequence
  Synthesized
  misc_feature (61): n=t or g
aaatcaaaatgacaaaaaaaaaattcaaattcttcttggcagtaggtcacctgtgaaacantttctgtccaacttcattacttttgaatacaaaatgccaagaaaaatgtgtgtgtgtctt

SEQ ID NO: 17163 - DNA, 121 bp, Artificial Sequence
  Synthesized
  misc_feature (61): n=a or g
cacaaagcagccctctgaactcacagcttttgatagaaatgcatctttgttagggattcanatgaagttctaaggagcttaggtagaagaaagggggatacagagttaagggattattttt

SEQ ID NO: 17164 - DNA, 121 bp, Artificial Sequence
  Synthesized
  misc_feature (61): n=a or g
cggcgagcggggaggcgatcaccgcaggacgagcgctagttctttataaagcccagagcgngggcgaccccgcgttccagacacttccattattcctctcctttattagtatttttttcat

SEQ ID NO: 17165 - DNA, 121 bp, Artificial Sequence
  Synthesized
  misc_feature (61): n=a or g
cacaaaacatggatcactgagctcagttaggggtggctaataggactagattactgcagangtctatcctcagacttgtaccttttcttcttatcagtgatatggatcatgtattggagtg

SEQ ID NO: 17166 - DNA, 121 bp, Artificial Sequence
  Synthesized
  misc_feature (61): n=t or c
tcagatgtggacgctgttgggatgcggtggtggtgtcgctcaggtctgctcttcagtgcgnccttgcagtggaattatcctctgggagccgatgccataatggtggtttcatccctgctgc

SEQ ID NO: 17167 - DNA, 121 bp, Artificial Sequence
  Synthesized
  misc_feature (61): n=a or g
cttacaaaagagactgaagctcaaatatgaaacactttcaagtgaggcaaagacttattcnctgcacttaacagtttcttttagtgttcttaccaatttcctcccacagctacatcacaat

SEQ ID NO: 17168 - DNA, 121 bp, Artificial Sequence
  Synthesized
  misc_feature (61): n=a or g
ccagcccatcagattcatgcttcatcacacctccagcaagtctgatgggtttgtacagtgntagtctcctccacagtattggttttgtcaggaaatttgggtaattagtagtaaaaacagt

SEQ ID NO: 17169 - DNA, 121 bp, Artificial Sequence
  Synthesized
  misc_feature (61): n=a or g
aactctgcgtaacttctgttccttaatttagcaactgcacctacactgtcacagtgaaganaatctgtaaatggtacaaaatgactacctgaaaagaaattcttgaattgctaatacgcat

SEQ ID NO: 17170 - DNA, 121 bp, Artificial Sequence
  Synthesized
  misc_feature (61): n=t or c
gaccatagtctgtccttgcagtcaccgtatcaccaagttaaaattaactttgacctaagtnagagagcatggtccagttggagtgctggattaaggactactggtaaactactgtagtgga

SEQ ID NO: 17171 - DNA, 121 bp, Artificial Sequence
  Synthesized
  misc_feature (61): n=t or c
taaaagctgaatttctatgagcagggaatagaaagattctgttttcaagtcacctctttangcatacacttgagaaacagataaaagattctccaaagtttatgttgttttaatatttttg

SEQ ID NO: 17172 - DNA, 121 bp, Artificial Sequence
  Synthesized
  misc_feature (61): n=a or g
ctactaccatatcaagcaaccatacatactggaacaatgagcctacctttgattatgtcanttagagcaagaagttgttttttccatgtccaagaatacttaatctttccaattgaaattt

SEQ ID NO: 17173 - DNA, 121 bp, Artificial Sequence
  Synthesized
  misc_feature (61): n=t or c
aagaagaatggcagaggcttcactcttgtcacagagtaattcaaccactattgaagttttntgaccatgaaaaatgtttcttgcttgaaaacagtgagcgtgaattctttctcctgtctca

SEQ ID NO: 17174 - DNA, 121 bp, Artificial Sequence
  Synthesized
  misc_feature (61): n=c or g
gagtctctacctctgttccttgaattccacctatcttatttatggggttgcagatcaaatnttgcttagctgtgctaaggccaaggtcggacgggcgttcatacataactcatggaagtcc

SEQ ID NO: 17175 - DNA, 121 bp, Artificial Sequence
  Synthesized
  misc_feature (61): n=t or c
taataccacacagtgcaggaactgagcataaaaaaaggtggcttgcctcattctaagtatntcctcctcccctgaaaaacacaagcataatcccttaaatgaaaatgaaaacattgaaaaa

SEQ ID NO: 17176 - DNA, 121 bp, Artificial Sequence
  Synthesized
  misc_feature (61): n=t or c
tatctgcatcgactctacaataccatggaccttcttgggaccccatgggaagggatgtccngctgcgatgttccctttctgtaacagggctgtgttaatgcaagtctcagttttcttgcag

SEQ ID NO: 17177 - DNA, 121 bp, Artificial Sequence
  Synthesized
  misc_feature (61): n=t or c
cactagttcccatccttacagcagctcccattgtgccagcaaatatttgtagtgagaaacntggttaagaaaatgacagaaatgaaaaataaaataaaattttaaaaaaaaaacagcacca

SEQ ID NO: 17178 - DNA, 121 bp, Artificial Sequence
  Synthesized
  misc_feature (61): n=a or g
ctgatggatgcgcttcttgttcattggggtttcccaaattgaaacggaccccattatcacntgcacaagaatagcatgcgaagacccagggaatgcagggaatttgcttcgtcgcagctgc

SEQ ID NO: 17179 - DNA, 121 bp, Artificial Sequence
  Synthesized
  misc_feature (61): n=a or g
ctcaacatgaggccagtatctccatgcctcagtgttgttcttcggtcaggctgctgtcctncatgttaacagaagtgggaagggcattacttatggccccagaggcctaattgcctcaatt

SEQ ID NO: 17180 - DNA, 121 bp, Artificial Sequence
  Synthesized
  misc_feature (61): n=a or g
taactttgccaccttccagttactgagtggacactgagcaaatgccattatgaaagataancacttagaaacacaaagacttcaatgaaccagcaaagatgtgctggtttggttaactttc

SEQ ID NO: 17181 - DNA, 121 bp, Artificial Sequence
  Synthesized
  misc_feature (61): n=a or g
ttggctggctaaacaattacatcttattttgatttggggctattatatctcagtagctgcntccctcagctgcgaagaataattctgaagactttcaagctgtttaaaatttcccacggaa

SEQ ID NO: 17182 - DNA, 121 bp, Artificial Sequence
  Synthesized
  misc_feature (61): n=a or c
taaaaatgaggtacacctttctcacgagtcctcaattagactccctgacagcaacaagacnaggattaccatcctgtttcacccttaccacacttaacttacagtagcttatcacagaatg

SEQ ID NO: 17183 - DNA, 121 bp, Artificial Sequence
  Synthesized
  misc_feature (61): n=t or c
aattagctatactcaagtcagctcaggcataactagctttatggcaatggcaacagggagntcagttacaactgtgcagcttgtctgtggaaacacttaaactacatccatgttactgcaa

SEQ ID NO: 17184 - DNA, 121 bp, Artificial Sequence
  Synthesized
  misc_feature (61): n=t or c
ttgagctcagattcaatgtcattgtgctatcagtctcatctgaggatgtctctgctcctgncagaaggaagttgtcaggtttggtcacttttttttccattttctagccaacagtcacaaa

SEQ ID NO: 17185 - DNA, 121 bp, Artificial Sequence
  Synthesized
  misc_feature (61): n=t or c
tttgaaaagtcaacaaaacccacattacagtaatcagagtgcttctgtctgtgaggagctncagctacaattacagcagggcattgggagatcagactctctacaatgcagctgatttagt

SEQ ID NO: 17186 - DNA, 121 bp, Artificial Sequence
  Synthesized
  misc_feature (61): n=t or g
agcctgtgtgagtagagccctgcagatatttgtttcaaagaatggaagcactaatggaaanccataaaccatacccagtggggcacttggtgtcgtgcagagtattatacaaacaaaaaaa

SEQ ID NO: 17187 - DNA, 121 bp, Artificial Sequence
  Synthesized
  misc_feature (61): n=t or c
tttcctgctgaagaaggaaacagcgttttcctcgacttatgtatatacgacttccctgctngtgaattttgccagtgatggaaataggcaggaaacttcccagagccccatgtctgcagcc

SEQ ID NO: 17188 - DNA, 121 bp, Artificial Sequence
  Synthesized
  misc_feature (61): n=a or g
atgttgtaaaccagtgatatagagcaatataaagagttctgcattgagtgttagttcagcnaagactgtgtgttaaaacaaatgtattaaattttagaggagaaacaaaatgtaaacttct

SEQ ID NO: 17189 - DNA, 121 bp, Artificial Sequence
  Synthesized
  misc_feature (61): n=a or t
ttttgcttttgcagctcttcagatcccattattttcaaccctgataaattttctaagacanttcaacagtaacaaatgagttccactcagtttcttcctccatttaagacttgtgttctcc

SEQ ID NO: 17190 - DNA, 121 bp, Artificial Sequence
  Synthesized
  misc_feature (61): n=a or c
ctcagctgtatcaaaaccagtaactggataaaatctctgagcagtctcaggagtagaaacnggagctgaagcacctttcatttcaatctcattggaacgatgtctcgtgcctttctagtca

SEQ ID NO: 17191 - DNA, 121 bp, Artificial Sequence
  Synthesized
  misc_feature (61): n=a or c
ggcacttacatgctttttaatttttaaggaagtatttttcttggcataattttactcaggntcatctgtcagaattgccttgcatatgccacacatgcaaaacaagcctcagtttgtgcct

SEQ ID NO: 17192 - DNA, 121 bp, Artificial Sequence
  Synthesized
  misc_feature (61): n=t or c
tcagtgataaagaagaaaattaaatgcttcacatttcagatcagaaaaccatggaggcggngagatggcagctcagcaaaatgcaaatttatttgtacacacgaaactataacaggctatt

SEQ ID NO: 17193 - DNA, 121 bp, Artificial Sequence
  Synthesized
  misc_feature (61): n=a or g
tactgcagtgctcaggctggggggtaggtgtgaatttagcaagcagcttctcggggcaagngcaagaagacaacgtgctcaggaccatggctattgataacgggctgtagaagacaagcac

SEQ ID NO: 17194 - DNA, 121 bp, Artificial Sequence
  Synthesized
  misc_feature (61): n=a or g
ggtcacagtaattagagattaccaaccttgagtatatgggagaagaattatagaagtgagnatttcaatatctcaatgtcattatcagagcaatctactgtaattccatatatcatgaacc

SEQ ID NO: 17195 - DNA, 121 bp, Artificial Sequence
  Synthesized
  misc_feature (61): n=a or c
tggggagttgcagatcagaccatgttactggccaggcactattcatactcattagtttagntgaagtgttgatcgttatcatattaatatttattatgtggatttgttttatgtttttttc

SEQ ID NO: 17196 - DNA, 121 bp, Artificial Sequence
  Synthesized
  misc_feature (61): n=t or c
aatttcaccaaaaggagatgtggtatgtgacattttcccatcatacattaaaactgctttnaaagtgaagcgaatcagcacaacttccaaattatgccagaaagagaccataactcttcag

SEQ ID NO: 17197 - DNA, 121 bp, Artificial Sequence
  Synthesized
  misc_feature (61): n=a or g
cagtgaagagggaacctaggatgatgacttctggtatgaatacacaccttgtacatccacnttcagatgaatgtagtagtaaacttaatgttttccctcctaagaggcctggagcagtggt

SEQ ID NO: 17198 - DNA, 121 bp, Artificial Sequence
  Synthesized
  misc_feature (61): n=t or c
aaggggaaaagtgaggaaggagagtaaactagctgagttgtcctggagcttttgttttcantgtgttctggccctactttcctacgaagcgtggtaggacagggaaaggtgcaagaaggtc

SEQ ID NO: 17199 - DNA, 121 bp, Artificial Sequence
  Synthesized
  misc_feature (61): n=a or g
gctttagcattgcatacagctgttgcatgtggttttgtacaaaatgctcagagccctgagngctctttgatctggatgctgaccactgactcctttatctgacattcatacaagcatattc

SEQ ID NO: 17200 - DNA, 121 bp, Artificial Sequence
  Synthesized
  misc_feature (61): n=a or g
ctgtcctctaactatacgctcagcagcatgtgcacagagcctgagaaagctcttgggggangtatctgaggggaagaattaaacaatatcaaagaagagctgtgctgtgttgatggcctgg

SEQ ID NO: 17201 - DNA, 121 bp, Artificial Sequence
  Synthesized
  misc_feature (61): n=a or g
agtgaatgcacagtgatgaaattcggaagttttatgaacattttcagtgttttttagaagnacaagagcagtgagcaacaaacattagcaatatgggggcaactctactctacatgtccaa

SEQ ID NO: 17202 - DNA, 121 bp, Artificial Sequence
  Synthesized
  misc_feature (61): n=t or c
aaaaaatggtgaaatccagtatctactcttatctgttttcccatatatctcatttatgtgngtcatgctaggaagtatttggtgcctgttttcaggatgtttcatgcacacacattgatta

SEQ ID NO: 17203 - DNA, 121 bp, Artificial Sequence
  Synthesized
  misc_feature (61): n=a or g
gtgattttgtgtgcctccaggaaaatgaacacttctagacctgtaaagctgtttgtggacnttaacatattgcaaagtagcaggctacgtgcatctcctgcaataagccacagaggatcag

SEQ ID NO: 17204 - DNA, 121 bp, Artificial Sequence
  Synthesized
  misc_feature (61): n=t or c
aaatctatgggaaagacggaccttgggcagcatcacacctttctgtggtctttcctgctgnttgcctttcaaatagccggcagtagatgtaatttctgttttcaaaatcacaactgctttt

SEQ ID NO: 17205 - DNA, 121 bp, Artificial Sequence
  Synthesized
  misc_feature (61): n=t or c
tccttgtggtggtggtggtggtttcagtttaatcacacagtatactggtatttctaaatgngatcattcaattatgttttaattgcactggagcagatattgttcccatatatgcagatag

SEQ ID NO: 17206 - DNA, 121 bp, Artificial Sequence
  Synthesized
  misc_feature (61): n=t or c
ctgatctagaacaaacaacagggaacacactcatacagaaatgtgcacagcccaaaggtcntcccaccaataaagtaacattacaaataacaaaatgcatgaaaactcatttctctgcaac

SEQ ID NO: 17207 - DNA, 121 bp, Artificial Sequence
  Synthesized
  misc_feature (61): n=a or g
ggtccaggtaaaagctggagcatctctgttatccctgggtgaccgtctttcacaaatcatnagctaaatttgcctccatgttgtgaatctaagggggaatgcccagaattacctgacatat

SEQ ID NO: 17208 - DNA, 121 bp, Artificial Sequence
  Synthesized
  misc_feature (61): n=t or c
ttgttctctgtcctgaggataagcaccatgttgcagcttgtgtacaactcaaccctcttcncacctgaaatgctgcagcatctgctggacacaaggtccaacttgtgctcttcccaggcct

SEQ ID NO: 17209 - DNA, 121 bp, Artificial Sequence
  Synthesized
  misc_feature (61): n=a or c
tttatccagcagctcctgaatctgcatctccactgcctgtagctcattttcaatggaaagnagttcctcctctaacactgatgacaaaaacaaggcaaaatgttaatatgaataacatatt

SEQ ID NO: 17210 - DNA, 121 bp, Artificial Sequence
  Synthesized
  misc_feature (61): n=t or c
tgcatgtaatcccacagcctgtaggcaagggctgtggctaagagcagtgcccctgtgctgncagggaggtctgcctctttatggccttcccttctgtcttcacgtggtttggagaagttct

SEQ ID NO: 17211 - DNA, 121 bp, Artificial Sequence
  Synthesized
  misc_feature (61): n=a or g
taattctttccccttccctcagaaattatagtgaagaaatgcctgaattgtattccagggncgatttcctctaggacctgctgctacattggtgaggacagagccatggctgcagcttcat

SEQ ID NO: 17212 - DNA, 121 bp, Artificial Sequence
  Synthesized
  misc_feature (61): n=a or t
ccaagcccttcctgaagatgaacaaactagatttttagcctaagatacaatttacagtttngaataatttctaagtaaaaatcatcaacaaatgacacatccactgcttgtttgggtggct

SEQ ID NO: 17213 - DNA, 121 bp, Artificial Sequence
  Synthesized
  misc_feature (61): n=t or c
gagacagcctgacttttaatctcgagtcccattgttgtttctcagttcctgagctgagagncccactgtaaaaccactttgggttagctcagacagaggatttgggctccgaaagccaaaa

SEQ ID NO: 17214 - DNA, 121 bp, Artificial Sequence
  Synthesized
  misc_feature (61): n=a or g
cctgaaactgactttgtaactgagttcataggaaagctgtactgaggactgtcagcttctnagctgaaaccaagcaggtgaattaacctcatatcctccatactttcctggaaaagataca

SEQ ID NO: 17215 - DNA, 121 bp, Artificial Sequence
  Synthesized
  misc_feature (61): n=a or g
ataattagcattttcaaatcaattttgacatttctctgaacgctgtcatttcaaaccttcnctgttgtatttatcaaaactatctttccaggaggaaaatatgactgggtagaagaaaact

SEQ ID NO: 17216 - DNA, 121 bp, Artificial Sequence
  Synthesized
  misc_feature (61): n=t or c
ggtcacatcagatcagtccagagccaccctgggtttatgcctcccttgtctcaatggcctnaaggtataaatccagcattccctgagcaccttactggatggaaacctgcctagctctgct

SEQ ID NO: 17217 - DNA, 121 bp, Artificial Sequence
  Synthesized
  misc_feature (61): n=a or g
cgagggcaggaataataaggaataataaggaattacaagtaggaagtgcacgactgctcanttcccacccatctcatctgttcgtacccagggctcaggggagctcctgtgtgtgctgccg

SEQ ID NO: 17218 - DNA, 121 bp, Artificial Sequence
  Synthesized
  misc_feature (61): n=t or c
ttgcagcgctggccatttatgatgttaggaataattcattcacctggccttttttctgtcncattgagtttaaaattcctcactgaaatactgatggtggagcataacctgtagtactttg

SEQ ID NO: 17219 - DNA, 121 bp, Artificial Sequence
  Synthesized
  misc_feature (61): n=a or g
cagaggaaggaccaatgccacataaaaacaaaatccagacacctcagctcctttccactgngtcaaaccagtatcattaatgttaaagggtcctcctaaaatcagagccttggctgaattt

SEQ ID NO: 17220 - DNA, 121 bp, Artificial Sequence
  Synthesized
  misc_feature (61): n=t or c
gctcgcatgtaaagtagattctctacagaactaaataggcctcccatgggcctggtcattngcttctaatactcaaattttatatggatgtagcatagacagggtgccagtccgtgctcca

SEQ ID NO: 17221 - DNA, 121 bp, Artificial Sequence
  Synthesized
  misc_feature (61): n=a or g
ccatcttgcatgctagcaatggcatagcaggacaattttcattcgaaagaaataccttgcntgctattagaaatgggtcatctttatactcctttaactctggctgagtgcaggatcagcc

SEQ ID NO: 17222 - DNA, 121 bp, Artificial Sequence
  Synthesized
  misc_feature (61): n=c or g
gagcaagcctcatccagtgagcaaggacttgaatatgattaataagcagagcagagggtanaggcctgcctacagatttgcaactgcatgcccccattccccaagtgctgatggatcaggc

SEQ ID NO: 17223 - DNA, 121 bp, Artificial Sequence
  Synthesized
  misc_feature (61): n=c or g
agaaacctttgcaaggtccttgagataagtgtgttcacatcctgttcattctccctgatgntatagtctgtttagctcctcccacaactccttttgctgaggtcttaagttacttggctct

SEQ ID NO: 17224 - DNA, 121 bp, Artificial Sequence
  Synthesized
  misc_feature (61): n=t or c
gtgcaggcttctgagctcctttcatccaggggtgccatgttctgctcctctgtgccttcanagcatacattcatacagcccccctgcaacgagcgctggcagttccttgttaatgaatgtg

SEQ ID NO: 17225 - DNA, 121 bp, Artificial Sequence
  Synthesized
  misc_feature (61): n=t or c
agtaaattcacgttatggaaattatgctctgaaatcaagctggaatttcctctcaagaaangtccaaagccctctagagtctgcagtcttcactaagatgcaatggcctagttccaagcta

SEQ ID NO: 17226 - DNA, 121 bp, Artificial Sequence
  Synthesized
  misc_feature (61): n=c or g
ccttatgttatagcctgttataccagcctgttgctgggggtagttctacatgtattttggntaccatcactatgtgagagaactctcatctgctgcaggatagctggaactgtttaattaa

SEQ ID NO: 17227 - DNA, 121 bp, Artificial Sequence
  Synthesized
  misc_feature (61): n=t or c
agtagagttgaaccttctctcatctgttatgaaaagtacaaaagacatcttcaaattcctntactccctcttctgtgtttctcatatctcagaggctcagctgttttggtcaaagtgttcc

SEQ ID NO: 17228 - DNA, 121 bp, Artificial Sequence
  Synthesized
  misc_feature (61): n=a or t
acataattgtaagtggagaacagccaccttcattggaggcttttaagagcaggttagactnggtctgctggagatgattatgtagtccttatagagtttgcagtacaggaggatagactag

SEQ ID NO: 17229 - DNA, 121 bp, Artificial Sequence
  Synthesized
  misc_feature (61): n=t or c
atatgtcctatctggactatctgtgtagcagtataaaactttttcaataattattagctgnactgagtttgaaatgacaagttcattatagcttttgttctactttgaaaatgaagttaag

SEQ ID NO: 17230 - DNA, 121 bp, Artificial Sequence
  Synthesized
  misc_feature (61): n=t or c
ctgatgccagcagcacgggactgctctattctgcaatggatatttcttgctgcacacgtcngcctccttcattagatgcctgtaagcccttccttaagttcccatcgtctgtgagctccca

SEQ ID NO: 17231 - DNA, 121 bp, Artificial Sequence
  Synthesized
  misc_feature (61): n=c or g
atctggcagtgatttgcagaagtactctggctgttggttctgaattcttggcaaagagttntgtggagtttaaactgctctttcaatcagtcaccacatgccttacgctttaggttatccg

SEQ ID NO: 17232 - DNA, 121 bp, Artificial Sequence
  Synthesized
  misc_feature (61): n=t or c
tccatctctgttcaaagctctggtatttgggagactaaatgctattgccattttctgtttncctaacagtgaattaaatgttgcagagcaagggaaggaacacagacattttgaatgctgc

SEQ ID NO: 17233 - DNA, 121 bp, Artificial Sequence
  Synthesized
  misc_feature (61): n=a or g
accaaattctggatgctttcaattgggacagaaggatatctgaaacaggtgatgggactcnagaagttttgctcgtgatctttctggccacttcagagctgaaaaattgggtgttcaaaat

SEQ ID NO: 17234 - DNA, 121 bp, Artificial Sequence
  Synthesized
  misc_feature (61): n=a or t
agacaaagacaatggaattaatcacactttaccttgtacacataatctttgcactgggggngaaacgctcaactttgcaaggtcatttccataaaaactaagaattagaggaactcagcag

SEQ ID NO: 17235 - DNA, 121 bp, Artificial Sequence
  Synthesized
  misc_feature (61): n=a or c
ggaacccaaaacattaggcaggaagttatctctggatctcagtatttaattcatgcaccancattctgcccttagttacagacgcacaaagccagtgacatcagtttgagagtgtactagt

SEQ ID NO: 17236 - DNA, 121 bp, Artificial Sequence
  Synthesized
  misc_feature (61): n=t or c
gtctgaattaatttaatacaaattgattgagtcacatgaaggttttgaaaatcccaatctncctaccagtttaggagtctacctttattcagagaggatgtaaaatgattataaaaatata

SEQ ID NO: 17237 - DNA, 121 bp, Artificial Sequence
  Synthesized
  misc_feature (61): n=t or c
gtctttaataattccaaatattagttaatctgcaagaaagaaggagttaaagcagtaaaanaacccattctgactttgcagtttgtacatcatttagcagtctttactcttgaaacaacat

SEQ ID NO: 17238 - DNA, 121 bp, Artificial Sequence
  Synthesized
  misc_feature (61): n=a or g
tcaggtacatctgttttggttttgtatctaggtctttgtacttcctaggattgttataatnacataccaacacaagcccaaagctcagccagcaaagtcaaaagagccaggactgtgcaca

SEQ ID NO: 17239 - DNA, 121 bp, Artificial Sequence
  Synthesized
  misc_feature (61): n=a or t
aagagcagtctacagaagtctgttcaaatgacagacaatccagagacacgtcttaaacttncagtgtaattaagctctaccacggcacatacatatcccacatgttgctgagatttgagaa

SEQ ID NO: 17240 - DNA, 121 bp, Artificial Sequence
  Synthesized
  misc_feature (61): n=a or g
ctcctcctcaagcgggggacagatagaggtggaggatccttccacttagtcctggtgactntctttggccgtgtaggtctatctgtgaccatcggagatcagcaatggacctggccagcag

SEQ ID NO: 17241 - DNA, 121 bp, Artificial Sequence
  Synthesized
  misc_feature (61): n=t or c
tctagacgatctacttcagatgtaaattattcagggtttgtatccacaagttgggtattgngaatttcaccatctgtgcctatactgtctattggttcttggcaatagttataataataga

SEQ ID NO: 17242 - DNA, 121 bp, Artificial Sequence
  Synthesized
  misc_feature (61): n=t or g
atacaaaactggaaagtactaactactactataactaccttgcattaacctgccatttttnattaatattctaggatctattaaaccttcatctgtaactgccaactttattgttaggtgc

SEQ ID NO: 17243 - DNA, 121 bp, Artificial Sequence
  Synthesized
  misc_feature (61): n=a or t
gtttgtttgttatttttggatgtggtatagctgtaaaaacatttcaaatgtttatatatgntaaactttatggttgataatctggaagactgtgttcccatcacaaaagtaattgtgaagt

SEQ ID NO: 17244 - DNA, 121 bp, Artificial Sequence
  Synthesized
  misc_feature (61): n=a or t
aaatgggacctatctacaggcataggacagaattattggttaaaatgttttgtaggttcangtgttgtttttggagctctggttttggtctctagaagtgtgtaaggtttgtgaaggtgtt

SEQ ID NO: 17245 - DNA, 121 bp, Artificial Sequence
  Synthesized
  misc_feature (61): n=a or g
aatatgtatattatcaattagattagattccaaatataaaatttctaaaaccctctgtatntgtcaatgcaaactagctatagcatgtaccagcacatgacatgctttctgaagaatttgt

SEQ ID NO: 17246 - DNA, 121 bp, Artificial Sequence
  Synthesized
  misc_feature (61): n=a or g
ccatcacactctgggcaatccaggggtccctctcaccaaatacctttttatttcctagaantcggtgttccggtgcaaaatgaggtcagctgtccaaactccaatctttgaacaaaaacaa

SEQ ID NO: 17247 - DNA, 121 bp, Artificial Sequence
  Synthesized
  misc_feature (61): n=t or c
gggggctgcagggctgtttctcccatgtttctcgctccttgttgcagagcatatttcccantcttaaatctgctctcataaaggcacaactagcgtcactcacagctcaagctctggccag

SEQ ID NO: 17248 - DNA, 121 bp, Artificial Sequence
  Synthesized
  misc_feature (61): n=a or g
cataattccctactggctagtgcagttgtctgctgtagttcagagccaaagatacgtaacncagagcataaggcaaggtacatagcaggcatcagtgtgtctgcagactgatctattagca

SEQ ID NO: 17249 - DNA, 121 bp, Artificial Sequence
  Synthesized
  misc_feature (61): n=a or g
tctcagtagagagaaaactcagggctgttagagatgagggcagaagctagtagcttaattntgcatcaatttaagctccaatagctgttatgtgacattttgcaaaggcatcttttgtagg

SEQ ID NO: 17250 - DNA, 121 bp, Artificial Sequence
  Synthesized
  misc_feature (61): n=t or c
atcaccttgatgtacagtaacatttggagtgagggaggggtggaaatccacacagaaacancaggagttactagggcaacaacaaaaaatagaaaacatctttgctgtttaaatgctgtct

SEQ ID NO: 17251 - DNA, 121 bp, Artificial Sequence
  Synthesized
  misc_feature (61): n=a or g
cagtagattgtcacttgaattttcctctagtggatccatttgtcaaagatcagagccctgnagtttgcagcttgatccttgggtgtacctgtgctaatctttaagtgctgagctgctttca

SEQ ID NO: 17252 - DNA, 121 bp, Artificial Sequence
  Synthesized
  misc_feature (61): n=a or g
aattacatcagaaaaggagagtctgcagccttgcatccagatcagtgctccagagatacangctgaaggctctgcactctctaaaacgtggaggcaggttgggacatcccatgttgctttt

SEQ ID NO: 17253 - DNA, 121 bp, Artificial Sequence
  Synthesized
  misc_feature (61): n=t or c
agtccttttcctcagggttgatctatttatcatccagtctgtattgatgtttgaaattacnctgacccagactcaggacctcgtgcttagccttgttgaataaggtttgcatgggtccacc

SEQ ID NO: 17254 - DNA, 121 bp, Artificial Sequence
  Synthesized
  misc_feature (61): n=t or c
ttaatccttgggcatttggagattctgatcctaaaaccaagcaccaaatcatacaaaaganattttcacctggacatagggttgctgtttgctactaatgacccatgacaggctgctagct

SEQ ID NO: 17255 - DNA, 121 bp, Artificial Sequence
  Synthesized
  misc_feature (61): n=a or g
gagaaggactcaaccccatcggctactgtaagtaccacagtgcacatcttcctcgggcccnctgagagtaaagctttgggaaaagagagtttttacccaactgttccatataagacactga

SEQ ID NO: 17256 - DNA, 121 bp, Artificial Sequence
  Synthesized
  misc_feature (61): n=t or c
ccatggaagccctcttactgcaatgcaatccaacccagtaaaactactgaaacgcaggaanaagaattcaaaggcacagattctgttaggggaacaagttctctgaaactacttcagtgaa

SEQ ID NO: 17257 - DNA, 121 bp, Artificial Sequence
  Synthesized
  misc_feature (61): n=a or g
ccatttaatatgagtcctggaggtgatcatatgttcctctttgcccactggagttgaaatntcatgatagttaccattggaattaagttttcaacaagcagctattttataatgaatgtac

SEQ ID NO: 17258 - DNA, 121 bp, Artificial Sequence
  Synthesized
  misc_feature (61): n=a or c
agcaccacttaaagttgatctaagccctgagtgggtgcatgaggtgttagataagacgatnatctgcaattctgaaggatggaaaggaattttgatgggttcctattattctgccctatat

SEQ ID NO: 17259 - DNA, 121 bp, Artificial Sequence
  Synthesized
  misc_feature (61): n=a or g
cagtgctgttaacaggagggctgtaaacacgtggacaacagcactgcttcctcacaagggncatgcattggaaagcaaaaaagcgcagcactgctctgcacatggagatgtgcaacagaga

SEQ ID NO: 17260 - DNA, 121 bp, Artificial Sequence
  Synthesized
  misc_feature (61): n=a or g
tacagtggctaatttgcagaacaagtgtgtcttctctagtttgcatccaagggaattaacncataatgaaagtaatctagatctacagaaaccaagtagaacaagcagcaaatgaagagct

SEQ ID NO: 17261 - DNA, 121 bp, Artificial Sequence
  Synthesized
  misc_feature (61): n=t or c
tttaacccagatttcacatcgtagttgtcaggagaaaattaatgtgttactccaaaggaangtaggaaaagtagtgggtttaagtttagatatttcacttgttgtcagtgacatttgagta

SEQ ID NO: 17262 - DNA, 121 bp, Artificial Sequence
  Synthesized
  misc_feature (61): n=t or g
tacagaaagtgtattcattctgtgcttctcatgttcagaattacagacatgtaaaacttcngcagttacacaattctgtttagagcacagattattggtgtgaatctgacatgagtcgttt

SEQ ID NO: 17263 - DNA, 121 bp, Artificial Sequence
  Synthesized
  misc_feature (61): n=t or c
tgggaagctgttgggaaaggacatggatctgccatgtgctcagcttggccctctgcatatncagccctgccacccattccaaacataccctccataggcacagaaattcattttcccctca

SEQ ID NO: 17264 - DNA, 121 bp, Artificial Sequence
  Synthesized
  misc_feature (61): n=t or c
aaaaggacatggcccttgtataactctcttgatgttctttctggcaaaatacaaacccctntacagttaaaacacttccaccaagcactacagtccattgcattgtctcataaatatttct

SEQ ID NO: 17265 - DNA, 121 bp, Artificial Sequence
  Synthesized
  misc_feature (61): n=t or c
atattgtactgactgggaaaacagtatgaaaaaacctccacatgttcaaaaataaaatgtnttgaccctttatgaaaagggaacatacgaggaaaggaatatttaagctcactgtatgacc

SEQ ID NO: 17266 - DNA, 121 bp, Artificial Sequence
  Synthesized
  misc_feature (61): n=t or c
tggccaactaacctgccacacttcaagaaatttggtacgctgctggccccttctgaatgcntcagccttaatcagaatgactcttggacattacgtgagtaaggatttggacgataaaaaa

SEQ ID NO: 17267 - DNA, 121 bp, Artificial Sequence
  Synthesized
  misc_feature (61): n=t or c
tgggctggagacctccgcagcagcgaggatggagcgcacatttttggtttccttccctacngcttaaatatccccggtccgcaaaacgttccttctcgctctcccattgattcgggtctct

SEQ ID NO: 17268 - DNA, 121 bp, Artificial Sequence
  Synthesized
  misc_feature (61): n=t or c
ggtggctctggtgcaaaagaggaagagtttgtaggggatgaggtctgggacacagtgctcngggatcacaaaatgtgggaagaggagtgggcgagggaatggatggggacaagtagatgtt

SEQ ID NO: 17269 - DNA, 121 bp, Artificial Sequence
  Synthesized
  misc_feature (61): n=t or c
gcacaataaattcatatgaccggttggctaaccccaagagatctgaaaaacaataccttcnccctcagtatctcagagtgcctttaaaacccatgtaaatttattgttctaaatcacaata

SEQ ID NO: 17270 - DNA, 121 bp, Artificial Sequence
  Synthesized
  misc_feature (61): n=t or g
aaatgtagctaataggagatacgtttctctctggtgaactaaaagatatcaagaaataaanatggctactcaattctacaatattaacttctccaagagccttatgttttatacaaacagt

SEQ ID NO: 17271 - DNA, 121 bp, Artificial Sequence
  Synthesized
  misc_feature (61): n=a or g
ttgagcgcagaggaaaggcaaactgcacgtggatgccactgtgccatttgagtggttctgnacgttaagtgcttgtgcatgggttgctgccacccgggctgataggcacccaggaggtaaa

SEQ ID NO: 17272 - DNA, 121 bp, Artificial Sequence
  Synthesized
  misc_feature (61): n=a or g
gtaaacctgaaaacatacatgatacaagaacagacagatttttggaagtctagtgtatccntagaaaatctactgatatgtcagggaaaaataagtattttctctcaccttcccacaaatt

SEQ ID NO: 17273 - DNA, 121 bp, Artificial Sequence
  Synthesized
  misc_feature (61): n=a or g
gagaggcagctttacttgtggaaagacacttcttttattttcccttttttgttggagtcantgaggaacgctttagcgcatcgatcctggtcgcacaagggctgcagctcttgcagagcgg

SEQ ID NO: 17274 - DNA, 121 bp, Artificial Sequence
  Synthesized
  misc_feature (61): n=t or c
gcaggagggttgaactggatgatcgtaaagatgctttccaatagaaaccattatatgattntatgaaatgttgctaatatgatttgaaaagaagcaatgtggcttcttcaggcttcaccaa

SEQ ID NO: 17275 - DNA, 121 bp, Artificial Sequence
  Synthesized
  misc_feature (61): n=a or c
tctgtagcacagctgggtccttgatactgaagcaaccagcaatttcacccatgtaaacacnacctctttatctacacttgttgacagaatatttacaattcaatccatcttggaattaaac

SEQ ID NO: 17276 - DNA, 121 bp, Artificial Sequence
  Synthesized
  misc_feature (61): n=a or g
aaatctgagatggcaaacatcagcacgtggctaaagagtgcacacaattttcttctagccnacctaaacccttctaaatgtaatgcagcaagtgctatgcttttactgtgttcttggcctt

SEQ ID NO: 17277 - DNA, 121 bp, Artificial Sequence
  Synthesized
  misc_feature (61): n=a or c
ccaacccaacccgacgttgccacagctgaactcacttcatcccaacattgccacagttganccaaccccaccttgctatggccaaacccaacccaacatggccaaggccaaacccaaccca

SEQ ID NO: 17278 - DNA, 121 bp, Artificial Sequence
  Synthesized
  misc_feature (61): n=t or c
gcagatcttgcagcatttgaaacttcatggaaaggagcaaaaagcatctgcatctggcacngaccagcttccaacttgtgctgagtatgacttgtatgctcctgtcttgagccagcaagtg

SEQ ID NO: 17279 - DNA, 121 bp, Artificial Sequence
  Synthesized
  misc_feature (61): n=a or g
gtagtactggtgcaaaggcagtgtgcctctcttcatgttgtacagcactgtgatttctgangtgatcccatttggtttacccagagcttaaaagaggaaaaaaaaaaaatatatttttaac

SEQ ID NO: 17280 - DNA, 121 bp, Artificial Sequence
  Synthesized
  misc_feature (61): n=t or c
acctgagcagtattgggcaggggtgattgatacttcctgctacacgtccattcgcatctcntctctcctgctgcatgtactggagatgactcaaagggcaagaggaggaaggaaagagggg

SEQ ID NO: 17281 - DNA, 121 bp, Artificial Sequence
  Synthesized
  misc_feature (61): n=t or c
ctctgtggcgatggttcaccctcaaaattgctcttgggattggaaagaaagctgagcttcntgttttcttgtgcattctcacagataacacggatcctgcagacagaatgtgacacacagc

SEQ ID NO: 17282 - DNA, 121 bp, Artificial Sequence
  Synthesized
  misc_feature (61): n=t or c
aagcaattgaccattgctagctaagaaggaaagtagcagtatttgaggactacacaaaacncaagaactggcacagtgaattacaagtgcagggccaatatcttaataaagcagcactgtg

SEQ ID NO: 17283 - DNA, 121 bp, Artificial Sequence
  Synthesized
  misc_feature (61): n=t or c
ttaactaaaaatgtcagaaaaaaatatgatgagagtgttatgctttctaattcaggatccntgataactaaagataaaaaatttcaaggtctttgacctaggagctcattactataaacag

SEQ ID NO: 17284 - DNA, 121 bp, Artificial Sequence
  Synthesized
  misc_feature (61): n=a or g
agagtggaaaaacaccatgtataatgaatttgaagtgcttgatctgtttattttatcaganagaggattaagccatggctcgattagcacgttaaatactgtaaaagagttgttggttcag

SEQ ID NO: 17285 - DNA, 121 bp, Artificial Sequence
  Synthesized
  misc_feature (61): n=t or c
atctgtcgtatcaactctcgtcttccagccttttgttactgtagagtctctccacttcatntttccgcaaacattactgcctttgtgctttatgcagacttctgaaatctttctcagttcc

SEQ ID NO: 17286 - DNA, 121 bp, Artificial Sequence
  Synthesized
  misc_feature (61): n=a or g
cctgaaggaaaaaatgatgtttcctcactgcagttctgtttctccatcactttgatttgcngctcggaacctgtgagtaccttttactgcaacagctattgacaggagtggaaagcattca

SEQ ID NO: 17287 - DNA, 121 bp, Artificial Sequence
  Synthesized
  misc_feature (61): n=a or g
gaatttgtctgagagcaaaaggtactcgaggttctgaatgacacctgacctgggcaggtcntcctgcagcgatcatggccagttctgggatggaagactgcaaatgttcagagaagaggga

SEQ ID NO: 17288 - DNA, 121 bp, Artificial Sequence
  Synthesized
  misc_feature (61): n=a or g
tttataaagaaaagtggtaaattaaacatattaagtggtaattaaacataaagagatcaangtggttatctgctggacttcatacttgaaattccctgcatgtaataatgcattgcaaaat

SEQ ID NO: 17289 - DNA, 121 bp, Artificial Sequence
  Synthesized
  misc_feature (61): n=t or g
attcttgggggggggggcagaacatcctttcacaaccaagtgctgaagccacatagggccncagctcagcactgacagcacagcccccaacgctgcaccgatgcggtgctgtctgcagagc

SEQ ID NO: 17290 - DNA, 121 bp, Artificial Sequence
  Synthesized
  misc_feature (61): n=t or g
aacaaacaaacaaacaaaaaaaaaaaaaacagataaatattccatagaaaatacttcaaancattagagaatttatatgaatatttcaaaggtgcctattgctagctcagtaaaaatattt

SEQ ID NO: 17291 - DNA, 121 bp, Artificial Sequence
  Synthesized
  misc_feature (61): n=t or c
gagtttccataacaccagtcctccaagccttatggcttaagaatactgcaggtcctctgcntaagagtgctttttgatggaataaagttagagggttccccatttagaagcagtgtttttt

SEQ ID NO: 17292 - DNA, 121 bp, Artificial Sequence
  Synthesized
  misc_feature (61): n=a or g
gtgaaatgaagaaataacttacagggaggagagactgaaaggtcacgtgaaaagacggacnacacctagtgtagaagaaacacaggcgaatgttgtaggggggctgctccaaaagtaatgc

SEQ ID NO: 17293 - DNA, 121 bp, Artificial Sequence
  Synthesized
  misc_feature (61): n=a or g
gagaggttggaaaacagcaataacattgcctcttcattcactcactcactcattcattcantcattaggaaatcaacatggagcaaaagcaaatgggcatatagctctggaatgagacagt

SEQ ID NO: 17294 - DNA, 121 bp, Artificial Sequence
  Synthesized
  misc_feature (61): n=t or c
aatatggttcagatattcatgtgtagaaaatgaccaaggtgaggtaggtaatctctccttnattaactagaaggttaccttatactgcttcccgtttacctctgtatgtggttatgtatgc

SEQ ID NO: 17295 - DNA, 121 bp, Artificial Sequence
  Synthesized
  misc_feature (61): n=t or c
cgtgtcctctctctttgcagcgtatttccactttgctgcatcgttacgaatctcaactggntttgagcacatcttgataacagtcactcctcaaattgtgattttctatgctaactgcaca

SEQ ID NO: 17296 - DNA, 121 bp, Artificial Sequence
  Synthesized
  misc_feature (61): n=a or g
ggaaggactgtagctgaccggacttaagcaattcagtaactctttctgcctactttcagtngtctataagattattgagcatttaaaaataatcatcattttatccactgtggctgtagac

SEQ ID NO: 17297 - DNA, 121 bp, Artificial Sequence
  Synthesized
  misc_feature (61): n=a or g
agatgagcagatgcagttgatccaagctatgtgccctcacagaacaggtgtcagaagagangactgaagctaagcacagtgatctctctttccaaacacccatgtaaatgtccaataatct

SEQ ID NO: 17298 - DNA, 121 bp, Artificial Sequence
  Synthesized
  misc_feature (61): n=a or g
ggattgttttgctggattttgttgctgttgttgcttaaagagaagcagaaactccaaagtngttccgtgacaccatggcctttaaagacctcctatcgtttctcttacttctcaaagttca

SEQ ID NO: 17299 - DNA, 121 bp, Artificial Sequence
  Synthesized
  misc_feature (61): n=t or c
ggaagcttcctccttttccatcctcctgaagtgatccaagcaatctcctttaatgatcctnttacccacctaggatgttagttaaaaaccccaaggctgctgttctacaaacccgcatttc

SEQ ID NO: 17300 - DNA, 121 bp, Artificial Sequence
  Synthesized
  misc_feature (61): n=t or c
ccagacagttggcagcgttttgcaagtcaggcagtaatgactagcagataaaacaagcaanagtgtaagtttgcgtgtaatgacccagattcaaaagtactctaaaaagtaatacagatct

SEQ ID NO: 17301 - DNA, 121 bp, Artificial Sequence
  Synthesized
  misc_feature (61): n=a or g
gctttaagaacagttcagttctgctgttgtttatcctagctaaggtaatagaatttttagnagacttcagattctaggtagatgtgttcctaagccaggttccactgtgcacatgctcgta

SEQ ID NO: 17302 - DNA, 121 bp, Artificial Sequence
  Synthesized
  misc_feature (61): n=a or g
aatttatttgataaatggcattcacattgcacaaaaggcttagaaaacatgttactgagcngaaaatttatgtccaagacaacagttatcagttgtttttcttttaaaagttatttaccat

SEQ ID NO: 17303 - DNA, 121 bp, Artificial Sequence
  Synthesized
  misc_feature (61): n=t or c
ctcagcaacaagtgccttcaatgatgttcagacatcattttttaaagacacctgtcttttntgagatcttgtctgcagaaagtgagttaataactaaggataacaaaagaacaaaagctat

SEQ ID NO: 17304 - DNA, 121 bp, Artificial Sequence
  Synthesized
  misc_feature (61): n=c or g
cccacttttagtcacaggcctagaagctgaaggaagcaagacctaacagccatggccattncttctgcattatgagctcccagaggacagacttgaaacacttttgctacccccatagatg

SEQ ID NO: 17305 - DNA, 121 bp, Artificial Sequence
  Synthesized
  misc_feature (61): n=t or c
caccatccattatccaaatttctagtgactgtgagcctttaacctttccaaccagcaatgngatcccttctgaaatactcctgtgtccatcataactttctgcccctcccctgcaaaaagt

SEQ ID NO: 17306 - DNA, 121 bp, Artificial Sequence
  Synthesized
  misc_feature (61): n=a or g
tttttttaccctcaaataagtctcattaagtgcctgtacatactccagtaactctcgaagnatatatatgtgctgaaaaaattaagtaattcacatgtaacttctggctgaaatttccaat

SEQ ID NO: 17307 - DNA, 121 bp, Artificial Sequence
  Synthesized
  misc_feature (61): n=t or c
gttgaatcagtcttgagtgatgaggagtgagaagacaggaacatgccattgtgctgtctcntccatgtcccaggctgtggctatcaaaggcaggtgaatcagtaacaagagcaaacactct

SEQ ID NO: 17308 - DNA, 121 bp, Artificial Sequence
  Synthesized
  misc_feature (61): n=a or c
tttttcccagtaaggataaaagcaaatggtgaaagtcagtcatatgcaaaatcctcttggnagaacagaagaacaattagagattaaattagagttgcaaggaaaaggtgtgatggtaatg

SEQ ID NO: 17309 - DNA, 121 bp, Artificial Sequence
  Synthesized
  misc_feature (61): n=c or g
cctttctggttgtcccatcatccagacagggcagacacaaagtgttcccaaacccattctnctgatttaaaataaatccccagaacaacaacaaatccacagccctaaatgaagcagtggg

SEQ ID NO: 17310 - DNA, 121 bp, Artificial Sequence
  Synthesized
  misc_feature (61): n=a or c
ggtggatgcacaccacccggacagtgggatcagaccccaagagctgaaactcagaagcaangagctgcttccttggaaaggctcaagcagaaagattcatgtcatcagatttggagcacct

SEQ ID NO: 17311 - DNA, 121 bp, Artificial Sequence
  Synthesized
  misc_feature (61): n=a or g
ttgagccaaaactgtatgtctttcagagacgaaataatggactgaagttaatagtcacatncagagtgagacagacagtagagatgctacccctagttgagcctgacagatttttccctct

SEQ ID NO: 17312 - DNA, 121 bp, Artificial Sequence
  Synthesized
  misc_feature (61): n=t or c
ccatttaagaacagtaacttgataaacatctctggtcatgttctattctgggagttcatgntttgttagttaaggaaggctggtaacgactgcttgccacacagctctcaaacctttggtt

SEQ ID NO: 17313 - DNA, 121 bp, Artificial Sequence
  Synthesized
  misc_feature (61): n=t or c
atagaaaaaaatatttttcccattttgtaatactggatattatagacttacaaagttattntgtgtcttttgtgtagctgtacaaacgtacaattattcatgcactctatcggttatattg

SEQ ID NO: 17314 - DNA, 121 bp, Artificial Sequence
  Synthesized
  misc_feature (61): n=t or c
gcaacagctctgcttcttgatctgctcttttccctccacgtgctagcacaaggcttaggcngagtgtggttgttcactgtgcaggacatcagttccttattgtgattatatccagacaggc

SEQ ID NO: 17315 - DNA, 121 bp, Artificial Sequence
  Synthesized
  misc_feature (61): n=a or g
tagaaatatctcagcttagcacacaggtcaccatcacgtgctaaggaaagttcccccttcntttcagttgaggattaatagagcattttgtgtgaatgctggataattagtgatgttagct

SEQ ID NO: 17316 - DNA, 121 bp, Artificial Sequence
  Synthesized
  misc_feature (61): n=t or c
tatttcttcatgttgaaatgtggcacagcagttgcagaggctctttgtagatttgttagcngtgagcagggctctggatcatactgacgtcatctcacctcttgccttatattagtttgaa

SEQ ID NO: 17317 - DNA, 121 bp, Artificial Sequence
  Synthesized
  misc_feature (61): n=a or g
actccctccttccctgtgtgcagaacaccaatatcttatttttgcctgatttggaagggantaaacttcaggtttccaaagccaggcaaattgttctgattcattacttttcccagttccc

SEQ ID NO: 17318 - DNA, 121 bp, Artificial Sequence
  Synthesized
  misc_feature (61): n=a or g
atggctgtgtcagctctgctagggcagcacaggatgcaaacccaaggataggactgctcanatcagcactgccatcagccagggaaccacagcatctcccaaagcagctgcagggttccct

SEQ ID NO: 17319 - DNA, 121 bp, Artificial Sequence
  Synthesized
  misc_feature (61): n=t or g
caggcgacagctcaagatcctgtcttccagaagctaaaagggcaattcacaacaggtaatnctaaagaaatcttaatctcctgggaaattttccccacaaagctcaactgtgaaagcattc

SEQ ID NO: 17320 - DNA, 121 bp, Artificial Sequence
  Synthesized
  misc_feature (61): n=a or g
attcatatacatttctctaacaatagttcccagagaaaatagctgtatgacagtagctgancacatgacatagcagtgcttctgtttaagctgtgttatgacacatcaaccttctattgta

SEQ ID NO: 17321 - DNA, 121 bp, Artificial Sequence
  Synthesized
  misc_feature (61): n=t or c
catcctgaaatgtagtaggatttccaaacttctctgtaggtgggtggtagacatgatccantttaacaggttcccttcttcgaacttcccatgacctatagtcatctttaaggcaaaaaca

SEQ ID NO: 17322 - DNA, 121 bp, Artificial Sequence
  Synthesized
  misc_feature (61): n=c or g
aagagactccactactgtacattacagagagaagcagcagctcccttctttagaggctganttggatccacctaaattaatcaagtgctgatacgcaatgttatgcggaagtagagctgca

SEQ ID NO: 17323 - DNA, 121 bp, Artificial Sequence
  Synthesized
  misc_feature (61): n=a or g
ctcccccctcccccaaaggttgaggctgctgcaaacatgaccaagaagcaggtcactgccntgggtctattttgcaacaggaatgtcagggggcccacctgcccttccagaggcaggcggc

SEQ ID NO: 17324 - DNA, 121 bp, Artificial Sequence
  Synthesized
  misc_feature (61): n=a or g
gggaatcagtatgtaacaggatttaggaaagatcttttcctttctgtttctaaaataaccnaaattaacattttggttctgagttagaaatgtttcccaaggcactgatgctcctagacgt

SEQ ID NO: 17325 - DNA, 121 bp, Artificial Sequence
  Synthesized
  misc_feature (61): n=a or g
ggtcaggacagctgctgggaacaggggaacgtcgagttatttgggatccaagcagggaatnctgctggtttccagccttccagccctgccgttgtcaccttcctgccatcgctgggtgcag

SEQ ID NO: 17326 - DNA, 121 bp, Artificial Sequence
  Synthesized
  misc_feature (61): n=t or c
aagaatacccgaagttttataattaaagaatgtgaaattctgagcacattgtgtgccttgngctccaagctacagtaatattaacatatgaggaactgaaaacctggttttatgacacaac

SEQ ID NO: 17327 - DNA, 121 bp, Artificial Sequence
  Synthesized
  misc_feature (61): n=t or g
atgttgggcttagaatacatgtcatgaagttttggaagaagtcgtctttttcattttgaantcatgaagaaatggaaaagccatctttcagggtatacatagaagtaatccaatgacaata

SEQ ID NO: 17328 - DNA, 121 bp, Artificial Sequence
  Synthesized
  misc_feature (61): n=a or g
taaagtgacacattcccctgagtcactaatggcaaagtcaagataaactcagatcaggaanagacagagaagtccaactccatagaaatgaccaaatactctttctgagagggacggatgt

SEQ ID NO: 17329 - DNA, 121 bp, Artificial Sequence
  Synthesized
  misc_feature (61): n=a or g
gccaccactcattctcagttcctgagcaactcatatcattaatttcaaggaaacctcagantgctcgttgataagccataaaatgcatccttaggttctcctctttcacagactctcaaag

SEQ ID NO: 17330 - DNA, 121 bp, Artificial Sequence
  Synthesized
  misc_feature (61): n=a or c
tacttttctctgtggctggtagagagaaagcagcacttccagacacacttcatctgcactnagataaacattcacatgtagataaagtttctctatccattccacgtgcagccacaatttg

SEQ ID NO: 17331 - DNA, 121 bp, Artificial Sequence
  Synthesized
  misc_feature (61): n=t or c
ctctgtcacttccatctcttcatgtgacccttgattcctcccattacagtcttgggtctgncactggcaattatccatcatttgagcactgacatgtaactacaagtaaaggacacctgat

SEQ ID NO: 17332 - DNA, 121 bp, Artificial Sequence
  Synthesized
  misc_feature (61): n=c or g
ctggaataaatctcatttccttggaaaactgagctagaaaagtgtatttaatatcaaaaanagcaagcaagcaaaacacagccaagatgtgtccaagatcacaaaatccaaagccctgagc

SEQ ID NO: 17333 - DNA, 121 bp, Artificial Sequence
  Synthesized
  misc_feature (61): n=a or g
aggtccacagcactgcagagagacaacagggagaggtaagtgctgcatctgtgcaccaggnaccgcatcctgaacccacacatctcctcctccatccccccaatgacaacagcagccacac

SEQ ID NO: 17334 - DNA, 121 bp, Artificial Sequence
  Synthesized
  misc_feature (61): n=t or g
ttgtagatattatagaaagtctatctgtaaaagtgttttctgagagcattagtacattatngcccaatccaagctgaccagcaattcttctcagaaaatgtgccacatttggtacacatgt

SEQ ID NO: 17335 - DNA, 121 bp, Artificial Sequence
  Synthesized
  misc_feature (61): n=t or c
aggtacaatgcttttacatatcatcgctatgtattttttatcagatttttacattactgtngtctttctactctgaatctcacatgctcctcttgtggaagttggacacactttgccaatg

SEQ ID NO: 17336 - DNA, 121 bp, Artificial Sequence
  Synthesized
  misc_feature (61): n=t or c
atgtgtaaggacagatcatccacagatgtaacaaagaatgatgttctaccttaaaatacanccaatgggctgcaggtatttcacttctgttattatatcttaggtatttttaaaaattatt

SEQ ID NO: 17337 - DNA, 121 bp, Artificial Sequence
  Synthesized
  misc_feature (61): n=t or c
cctctgtcaagaagcagcacagtttacatactgcatttccacctcctacctcctgttcagntgcaactacagagacacacaggtgtaactaagaccatgacagactttgtaaggacaagga

SEQ ID NO: 17338 - DNA, 121 bp, Artificial Sequence
  Synthesized
  misc_feature (61): n=t or c
ttaataagtcagcacctacggacatatttaatgctctttaagactacttcagacaaaaccngaagtacctacggctagcaagtttcttgtttggttttaatcagcttcaacccgacacaaa

SEQ ID NO: 17339 - DNA, 121 bp, Artificial Sequence
  Synthesized
  misc_feature (61): n=a or c
cagatgtagagacaacattgagaatctcagcctttcctcatttttagtggtcacgttcccnctacaagtttcaagacttgcatgaccccactggagacatatgagcccaaggggatctttt

SEQ ID NO: 17340 - DNA, 121 bp, Artificial Sequence
  Synthesized
  misc_feature (61): n=a or g
ctgaagattgcaaaatctctcagccaatctttgtaggaactgtatctgcaggattgctatnggtgtttttcaaatagctaccttttaaataccagttgtattttaatagcagtaactcggt

SEQ ID NO: 17341 - DNA, 121 bp, Artificial Sequence
  Synthesized
  misc_feature (61): n=t or c
aatgtcagtggaatctgatatcctgtgcaaaacacaacattatttgcaagtgagaaattcnatgctcactgggagagaagagcaaaaaattggaagcattggtagctttttccttacttat

SEQ ID NO: 17342 - DNA, 121 bp, Artificial Sequence
  Synthesized
  misc_feature (61): n=t or c
catattcttactcttgaagacagatacatgacccaaatcactcatagttttttgcacttangcttgctttcatttctttacaatgcttctggtgagctgtagtcatattctatcttgtctt

SEQ ID NO: 17343 - DNA, 121 bp, Artificial Sequence
  Synthesized
  misc_feature (61): n=t or g
aatcaaaaatatgtttgtacaaatatctacacactgacactctcaccactatttcggaatntagagtgaaaaatatacaatacatgttaatttttttaaatattatttttggcattagaag

SEQ ID NO: 17344 - DNA, 121 bp, Artificial Sequence
  Synthesized
  misc_feature (61): n=a or g
gatgttgcctggggtccgtgggctgctgttcactctgaaggtgcattaacttacataggantgtgtggctctgcatgcaacgaaatgctccccacaactgtatttagtaggaacgtttata

SEQ ID NO: 17345 - DNA, 121 bp, Artificial Sequence
  Synthesized
  misc_feature (61): n=a or t
tgtcactttggtagatcattaacactttaactgacaaccataaaagccaactgtactttcncttgtgcagtgcttccacgttgtaaggttcgtggctctctctgctgccattgtgagactg

SEQ ID NO: 17346 - DNA, 121 bp, Artificial Sequence
  Synthesized
  misc_feature (61): n=t or g
tattatttctagtaaagtggacttcctaaggctacaagaatttctcgtgcagcccaggttntttagctcagaaggcagatgtccgatgccacgcgcctgccgaatcagagctgttcacact

SEQ ID NO: 17347 - DNA, 121 bp, Artificial Sequence
  Synthesized
  misc_feature (61): n=c or g
ttaaaagatagcattcttctagaggcatgcattaagcccgcatatccttattagcaagaanctaaacaagtttctgcaccctccaacaagtttatcaccctcagtgtgaagtgaagtccat

SEQ ID NO: 17348 - DNA, 121 bp, Artificial Sequence
  Synthesized
  misc_feature (61): n=t or c
ccattctcagagctgggtagacacagtactcaccagctgactgctgtaccaatacagcgangactccttcagcacacaccagaactttttccatttgttgccaataaaagctcccttttcc

SEQ ID NO: 17349 - DNA, 121 bp, Artificial Sequence
  Synthesized
  misc_feature (61): n=t or c
ctagggtaagaaatatattacaagcctgttgttgctaattctgtaagaagaatagggtaanaactgcagtgttgcaatgagagtcttcttatacacaagtgttttctaagtatgtgcaacc

SEQ ID NO: 17350 - DNA, 121 bp, Artificial Sequence
  Synthesized
  misc_feature (61): n=a or g
caaggctgtatgcttctcttgctgttcttctactacctcttaattcttcttgaagtaacantaaataaccacctttaatcaatcatgggacatatgtttcagtgaaaacagaagtcatgac

SEQ ID NO: 17351 - DNA, 121 bp, Artificial Sequence
  Synthesized
  misc_feature (61): n=t or g
gtggcagtgctgctcttccaagagctgtgtccattggacagaaggcggccgtaactcacgncaggtttgtgtgcccgggcttcaccagcagcaaagctcctgggaccgagctgaggtcctg

SEQ ID NO: 17352 - DNA, 121 bp, Artificial Sequence
  Synthesized
  misc_feature (61): n=t or c
cagagatcactgatgttatcagtatatcactgcttatcagtagcttcccaagtccaacatnatgtttaatgctctgctgggtagagatgctgggagcataaccacgtgttccaaatgcaca

SEQ ID NO: 17353 - DNA, 121 bp, Artificial Sequence
  Synthesized
  misc_feature (61): n=a or g
gtggatttaaggctttataccagacagagctaatgaatgaccctcgcctggacccttcacntggggaatattttccactccaaacccaatgcctctaaagttaagtttagattaattacta

SEQ ID NO: 17354 - DNA, 121 bp, Artificial Sequence
  Synthesized
  misc_feature (61): n=a or g
ttcaggttttcttaccaccctcatctttggcccatctgttcaagggtgctatgaactcttntgacatctgagacagtgtaagcaccattttggcaagtcactgtgtctatttaaggaaggc

SEQ ID NO: 17355 - DNA, 121 bp, Artificial Sequence
  Synthesized
  misc_feature (61): n=t or c
aggaatgtatgaaaggccttaggatcctagcagctactgctcttctgctgttacagacagnacaccagtctgtaacacgtgggtgatgctggtacgtttttagtggtcagtgatgctgctg

SEQ ID NO: 17356 - DNA, 121 bp, Artificial Sequence
  Synthesized
  misc_feature (61): n=a or g
tactgctgctatttaaaatcccatgtgacgctatagatgtaccaaagaggggaacaaaatncaatcctgaataaaatgggaaggccagaatgcaacaaacaggatggggatgaacagactc

SEQ ID NO: 17357 - DNA, 121 bp, Artificial Sequence
  Synthesized
  misc_feature (61): n=a or g
aacactccagataactcagtaactaatttggggttcattatatgtatggcaattaaaactngataatgtctttgagggagttatttgcagagttctgctgttgtgctcaaaaatcatgttc

SEQ ID NO: 17358 - DNA, 121 bp, Artificial Sequence
  Synthesized
  misc_feature (61): n=t or c
caaagcctagcttcttctacagtgacttatagctctgcatttaattcccaactgttatgcnttaagatagtgttcaccgttgacgtggggaggagcagcatgttctttggctattcaagtt

SEQ ID NO: 17359 - DNA, 121 bp, Artificial Sequence
  Synthesized
  misc_feature (61): n=a or g
tcattccagggaattttggacatgtctgcaattaaaacggtgagcccgggcagaagcaggnaagcgggttggatgttcatgtaggagagactgctccaagtggcaggagcacatggcagag

SEQ ID NO: 17360 - DNA, 121 bp, Artificial Sequence
  Synthesized
  misc_feature (61): n=a or c
agtcatccgctgatgagctgccctaaggtgggctcctgtgtcagggctgaagcctggatgntctcctcagttccctttctatgactgagtggaaatgaagagattgcttgtcttgttggga

SEQ ID NO: 17361 - DNA, 121 bp, Artificial Sequence
  Synthesized
  misc_feature (61): n=t or c
gtatttctattctgttgtactaggagtacaagaaatgctacctgtttgtccatgatagagnaacagatttcaccagctagaaatagaggttactttggtaaaagagttggccttgagaatg

SEQ ID NO: 17362 - DNA, 121 bp, Artificial Sequence
  Synthesized
  misc_feature (61): n=a or g
catgagaaagatgccatgtaagactgtgagatactagtctgaatacaagagataagaaagncatcaagtaaactttgcaaattggtacctttacactgaacaacttcactttatttagggc

SEQ ID NO: 17363 - DNA, 121 bp, Artificial Sequence
  Synthesized
  misc_feature (61): n=a or g
aaagctgcttaagagctgacagcattcttctcaatgtcaaacggacttgactgatgaaagntcatctgtttatttacatgcaaatattcacgttttctaccagaaagttgatgtattgcat

SEQ ID NO: 17364 - DNA, 121 bp, Artificial Sequence
  Synthesized
  misc_feature (61): n=a or g
gctctcaccacagaggttcctgcccccaggttgtgtgtctgctcaagctgattcattcacngcccagtgaagttttgctatttagataattatgcaactgttttaggcttaaaattgactg

SEQ ID NO: 17365 - DNA, 121 bp, Artificial Sequence
  Synthesized
  misc_feature (61): n=a or c
agtggccctggagagcagtttgaatgaagatgagaggctgcttccaaaagacaaaaagccnaacctcttcagtgcccttatcaagaagaagaagaagactgccccaacccctccaaaacgg

SEQ ID NO: 17366 - DNA, 121 bp, Artificial Sequence
  Synthesized
  misc_feature (61): n=t or c
cagaagaaaccggttttattgtttcatgtattggttttcaacatgtgcgtgggcaaggcangcttgatttaccagtgctgctacagagatgtgaatttccgacacacccaaattcttgaaa

SEQ ID NO: 17367 - DNA, 121 bp, Artificial Sequence
  Synthesized
  misc_feature (61): n=t or c
cattttatacaggcactactgctctgtctctgttatcatgttgagaggtaatgggtggaantggtaattcaagaaagcacaatgctttctaagagcagaattgctcattttgtggcatagc

SEQ ID NO: 17368 - DNA, 121 bp, Artificial Sequence
  Synthesized
  misc_feature (61): n=t or c
ttattatcactgaatatacattttgcagcttaactttgaactcatgagccaactttgaaangatgatggaagggtatcttaaagacactgaatttttacctctttagatagtacaagcagt

SEQ ID NO: 17369 - DNA, 121 bp, Artificial Sequence
  Synthesized
  misc_feature (61): n=a or g
aaccaaagagcatgtattacctgatggcaaaagctctggaggcaactggttacaatttacnaggatgctggaacgcccacagctcctcctccaaagccactgaggcaggaggacagtgtgg

SEQ ID NO: 17370 - DNA, 121 bp, Artificial Sequence
  Synthesized
  misc_feature (61): n=t or c
catttaaaaatatacatctctttgttaggagataaaaccaccagtcacttttaaaaacatngttgtaatgaaataatacaagatctaattaggttttaattacttgcaatgtaacaaaacc

SEQ ID NO: 17371 - DNA, 121 bp, Artificial Sequence
  Synthesized
  misc_feature (61): n=c or g
agtatgatcccactaggccttgacctaataatgctccaagcattgagatcaatgggaacantggtcagctggaaggttagtgcagcagcatgttcttagttggaaggactagccttgtaga

SEQ ID NO: 17372 - DNA, 121 bp, Artificial Sequence
  Synthesized
  misc_feature (61): n=t or c
aaaaaagtatgaaagaagatagctttccacattaggcagtgagcatccactcagcagcgtnatctcttactcaaattttgtccatcttcttcaacagatttccatggagagacgacccact

SEQ ID NO: 17373 - DNA, 121 bp, Artificial Sequence
  Synthesized
  misc_feature (61): n=a or c
cggtgcgcccctatagtgctgcttttgggggttcctcagcaccctcaggaagagcccttgnagttccctgtgggtgcaggactggcccagtaggaacaaccccctgtgcacaaactgcttc

SEQ ID NO: 17374 - DNA, 121 bp, Artificial Sequence
  Synthesized
  misc_feature (61): n=a or g
ataaacccttgctcatgcatgcgttaagattcagcttgcagggcacttggtgtggctggancctagataaaagaattggatttctgaaaaaatgagaaaaagagaagctggtgtttaaagt

SEQ ID NO: 17375 - DNA, 121 bp, Artificial Sequence
  Synthesized
  misc_feature (61): n=t or c
ggcaaaatgcaaagtaagtggatccaagagacccttaattctgcaaaataatgagacacantgtccgcaaccttatgaaaagtgctgtaaattaaccacttttacagcttattatgaaagg

SEQ ID NO: 17376 - DNA, 121 bp, Artificial Sequence
  Synthesized
  misc_feature (61): n=a or g
aaagaatgatttgctgatggtgaagtattttcactacttaccattgtgaacaacttctccntgacaggcgccaaaactgggcactgaagaagaaggggtttccagcattctgggtgtgggt

SEQ ID NO: 17377 - DNA, 121 bp, Artificial Sequence
  Synthesized
  misc_feature (61): n=t or c
cctccagtaggtgtgcatggtgcagtcacagtgcaggtgtctgcagtgctatcaaaccagngtttaatagctaattgtctgcagggttatgaattggaggtttgtgaggttcgattggggc

SEQ ID NO: 17378 - DNA, 121 bp, Artificial Sequence
  Synthesized
  misc_feature (61): n=t or c
ctaaaataatgaaaccatttgaaaattaagaaaactaaattcaaatgagtgtgggaagtgnttcctacttttcttatctcttacagtaatatcagcataatccatatttttctggagactg

SEQ ID NO: 17379 - DNA, 121 bp, Artificial Sequence
  Synthesized
  misc_feature (61): n=a or g
accttggcctcctctgggctctgagatgtgtatagtaggaacaaaggaaatctgagctacnaaggagtacccccatgccctgcagggaatggccctgacatttggctcgacaaatgacctt

SEQ ID NO: 17380 - DNA, 121 bp, Artificial Sequence
  Synthesized
  misc_feature (61): n=t or c
gcttcagttttcaagtgagctgaatttgatctggattggtcactatcagacttttccatcntctagaacttatctggagagcagcgttaaatgcactcaatttatttcctaatggagagca

SEQ ID NO: 17381 - DNA, 121 bp, Artificial Sequence
  Synthesized
  misc_feature (61): n=t or g
ttacaaatgagggttttcaagcttttgtcccaaatccaatgctgttttctttgcgaacgcnggtaaaaaaagtaaaagaagaagagacgacctccaatgctaatcttgttaggttaaactg

SEQ ID NO: 17382 - DNA, 121 bp, Artificial Sequence
  Synthesized
  misc_feature (61): n=a or g
tccatctacacagggaaataaaggactaggtatggttatcactacacatgtcacggctgcnggtattgggctctgtcaggtgcaaggctgctttaaatttgtgactctcttaaattgaatg

SEQ ID NO: 17383 - DNA, 121 bp, Artificial Sequence
  Synthesized
  misc_feature (61): n=t or c
ggtatgtaaggccaggccccgtggttgtcaagtcgtgaagggaaagaggtcctgcaagacnggaaggcaaggagccatgcttgtcaagttcccccttgaaaaaatgggagaaggctgcagg

SEQ ID NO: 17384 - DNA, 121 bp, Artificial Sequence
  Synthesized
  misc_feature (61): n=a or g
gaaaaagtcaaccacagaaaactcaccacttctgaaaaccttacagcaggtgggaatcaantactagacaaggactcatgccatttagcttcatttctactagctaacggctccatggaca

SEQ ID NO: 17385 - DNA, 121 bp, Artificial Sequence
  Synthesized
  misc_feature (61): n=a or g
gaaaggtggggtgaagcaaagcttggcctggaaatacaatgagcacgcatcttctggaagntacttatgctccatccaaagctgaaggagtcactgaggcactgagaaagggagaaataat

SEQ ID NO: 17386 - DNA, 121 bp, Artificial Sequence
  Synthesized
  misc_feature (61): n=t or c
agctcttatcactgcacagagaaacatgccttggcaggttattggctgggaatgtaaatantgaagagaagtcattggctgctggggaccaatgtgctccaagtctgttatgacaaagtca

SEQ ID NO: 17387 - DNA, 121 bp, Artificial Sequence
  Synthesized
  misc_feature (61): n=t or c
ttcatgaaatgagaaccccagcatgtagcattgggtggcaatgattacatgttccctaagnagctatttaattaactcatgtagtggacagggtatttactacatttcattaaacgggtta

SEQ ID NO: 17388 - DNA, 121 bp, Artificial Sequence
  Synthesized
  misc_feature (61): n=t or c
ggtaagtaggttctcagttaagtactacttggctactagtgatgatcaagtgaaattattncatgtaatacagtacatactgcatagaatgcacttgaaagtggagaacacctactatcat

SEQ ID NO: 17389 - DNA, 121 bp, Artificial Sequence
  Synthesized
  misc_feature (61): n=a or g
aggagaacattatctgttgctatgaagggtaagcagtgaccagtcaaagtgagaaaggctnatagaggagatgacactgaacagatccacagcttttcatgtggacagaaaagcactgcaa

SEQ ID NO: 17390 - DNA, 121 bp, Artificial Sequence
  Synthesized
  misc_feature (61): n=a or g
agccttaaacgtgggtcagctctgggtcacgctgcttcacccatccctccaaaccctcccnatacttcgcagggatttacaaaggttgccgccttctttgtgctcactgctgggctggata

SEQ ID NO: 17391 - DNA, 121 bp, Artificial Sequence
  Synthesized
  misc_feature (61): n=a or t
cactgatcatcttaacatgatggaggagaattaagcctcttctatattggagaggatctgntttttctcttataatagcattgatagatctatgcctgacactctagtatgtacacaactc

SEQ ID NO: 17392 - DNA, 121 bp, Artificial Sequence
  Synthesized
  misc_feature (61): n=a or g
ttgttctgaccccaacgttaccccaggtgcccacatgatgaagtaccatgacagtgccagnaacaacccatgctctggttatataaaagcattactgtattgcaagcaagttctgcttgct

SEQ ID NO: 17393 - DNA, 121 bp, Artificial Sequence
  Synthesized
  misc_feature (61): n=a or g
gtccaatacatttttatgtaagacactgtaattacatgaaagatagcattaccagtaagancaaaatttatcataggagagtgctaatgcatttagatgcaatgagagtaggtttaattat

SEQ ID NO: 17394 - DNA, 121 bp, Artificial Sequence
  Synthesized
  misc_feature (61): n=a or g
actgtggtgctctccccaggggagggcttttatcttccctcactacagagactacataaantaaggaggcacttcattggcaagaacaatctcttttcctgctgactttcagctggtcatc

SEQ ID NO: 17395 - DNA, 121 bp, Artificial Sequence
  Synthesized
  misc_feature (61): n=a or g
ctgtgaatacaaagtctaagaggaatttttaggagcctccagctgttgtatgttcaagganccttcctttcctgtttgagcaacagatgcagtgctgctgtgcagcacactgggatgtgaa

SEQ ID NO: 17396 - DNA, 121 bp, Artificial Sequence
  Synthesized
  misc_feature (61): n=a or g
ctttccatgaaatgtcatacagctcgtgtgcactctccggaatcaaaaagcatttgtctanggaacacaaacaaaatgatcaccccatcaagtttgccttttcctgcagtgttgtaagcac

SEQ ID NO: 17397 - DNA, 121 bp, Artificial Sequence
  Synthesized
  misc_feature (61): n=a or g
tattactctggcacacgcatgtaacctctcacacattaacatcattgagtgctaggagatncacagcagtgtatcaggacagagccctttctctgtctctagaaaagctgtactattctgg

SEQ ID NO: 17398 - DNA, 121 bp, Artificial Sequence
  Synthesized
  misc_feature (61): n=a or g
actcctgttacaaatgagctccctgacttctgagcaaaaaactctacctcctttaaatgancagaccactattttccaactatacaaggacactagaaaacactaaactcatcagtgagtt

SEQ ID NO: 17399 - DNA, 121 bp, Artificial Sequence
  Synthesized
  misc_feature (61): n=t or c
gggctctcctggcttaaaacatagggtaagggatacacactacagtatatgtggttgctgngcttctcctgtactcaataggctgctttagggtgggcctaaagaagcacagagctaaacc

SEQ ID NO: 17400 - DNA, 121 bp, Artificial Sequence
  Synthesized
  misc_feature (61): n=t or c
gtggatattatttccatggctctaggcagtcatgtactaaatttcatttgtgcttcaaaanatgaggatggcagtctggtgtgttttattttgttgtggggagggaaatctgaaatatttt

SEQ ID NO: 17401 - DNA, 121 bp, Artificial Sequence
  Synthesized
  misc_feature (61): n=c or g
ccttgcaggagtgtaagtgcatactaaccagaagggagatacaaaatggatcagtgagtgnataagagtgaaagagcttacctgagacactgtggcatgaagactatagtatgctgctggg

SEQ ID NO: 17402 - DNA, 121 bp, Artificial Sequence
  Synthesized
  misc_feature (61): n=t or c
caataacatgtgagcagcagcttctgatcttagaaaaaaaaggggaataattgacagagangtattgcactttttcatctcaaggattcttacaggtttgatcaattgggtttaactctgc

SEQ ID NO: 17403 - DNA, 121 bp, Artificial Sequence
  Synthesized
  misc_feature (61): n=a or g
tattgcagtactttccattatgttggagtgttacacgtggtaatgcccttgtctcaaatcntggtgctactcccccccagctctcaataatgcttctaagccaactgaccaccaagtatcc

SEQ ID NO: 17404 - DNA, 121 bp, Artificial Sequence
  Synthesized
  misc_feature (61): n=t or c
gtaagtaaaaaccactcagtaattatctgcctgaagatgaacattttagacgtgtctatanatattacactgaacaggaatatttcaaaacactaacaaatatttttgaatacagcaacag

SEQ ID NO: 17405 - DNA, 121 bp, Artificial Sequence
  Synthesized
  misc_feature (61): n=a or c
gtagactattctaaatttcacttgatactgcattttaaatgttctgtattttttctctccntgctgtgtttaaaatccaggacacaatcttatttaatgccttcaatatcccctcttgtat

SEQ ID NO: 17406 - DNA, 121 bp, Artificial Sequence
  Synthesized
  misc_feature (61): n=t or c
acttatagataatggtgaaatgatagctgtaactatatccttgtaaatgagtattttaccnagataattggagttctttttaatgagagtattttggatgaatgatgccttcagtaaccag

SEQ ID NO: 17407 - DNA, 121 bp, Artificial Sequence
  Synthesized
  misc_feature (61): n=t or g
caagaatgcaaaggcctcagatataattggtttttcacagccaggctcaactccttccatntatttatttttagaagacagttagatagggaatattttcatagttatatcccatgccctg

SEQ ID NO: 17408 - DNA, 121 bp, Artificial Sequence
  Synthesized
  misc_feature (61): n=a or g
gctgaatcagcctccaaatagacaccacaagtgatggatctcttttcagtgctacgtcacnccatcaagcccagtgtcctaacttccaccttaatccagacatcagagtagtaggagtcca

SEQ ID NO: 17409 - DNA, 121 bp, Artificial Sequence
  Synthesized
  misc_feature (61): n=t or c
ggtggctctgagcccttcctgagtggagcgaaagggattttttttgcaaaagaagtcttgntgctgctgcgtactcaataggttttggtgaatttgggttgtggagatagcgtggggctgt

SEQ ID NO: 17410 - DNA, 121 bp, Artificial Sequence
  Synthesized
  misc_feature (61): n=t or c
tcagttggtcaccactcctgggtataggctgtctctgtgatcctcgctgacctgtcccctnatgccacctcctccaaaccctttagcctgttgtagtacaggggacacatctcctggttag

SEQ ID NO: 17411 - DNA, 121 bp, Artificial Sequence
  Synthesized
  misc_feature (61): n=a or c
ccccaaaaatgcataagaaactctaaggtcacagaagggtcaggtggcagaggggccatgntggtacttcttaaagctgtgggtgtgaatatggtgaatttcatgtgtttgcctgcaccag

SEQ ID NO: 17412 - DNA, 121 bp, Artificial Sequence
  Synthesized
  misc_feature (61): n=t or c
ttgagtctttccatgtctgtgtcaagcctctttgcgctgtgctgctttcagaagtgctggngcatgcacacctgcacagtggtagggacaggaggaatgcagagcaggcccagctccactc

SEQ ID NO: 17413 - DNA, 121 bp, Artificial Sequence
  Synthesized
  misc_feature (61): n=t or c
aaaaaacaccactgtcttcccaggatcacaggatctaacagaaacagagtgagtcttcacntggatgtaaacaccaataagtgtagataagcaacagggttataggcatggggcagggaag

SEQ ID NO: 17414 - DNA, 121 bp, Artificial Sequence
  Synthesized
  misc_feature (61): n=a or g
acatagaaacattagcatatatcccatcttaatttaagcaagtgaagaacataagtattgnaacttttgagtaacataggctcacaaactgtactgtcagtgaagagagaatctccacaag

SEQ ID NO: 17415 - DNA, 121 bp, Artificial Sequence
  Synthesized
  misc_feature (61): n=t or c
ctttggtgtcttagttgagtgcatcagttgtacattgagctggagaacactgacattctgntagggatttagcctcatgtgaactagtcagccatctctctgcagtgataaggggcagctt

SEQ ID NO: 17416 - DNA, 121 bp, Artificial Sequence
  Synthesized
  misc_feature (61): n=a or c
aggcaggatacccaactggtggcatgaattgcagttcacagcagacatttcagaaagcacncagaatacttccttttctcttgatggcactgcagatacatcacaaaactttgaaactgtc

SEQ ID NO: 17417 - DNA, 121 bp, Artificial Sequence
  Synthesized
  misc_feature (61): n=a or g
gcttggggtgcctgatgtgatatcatcagataggggcacacattttggggggagggaaagntagtacaacagattagcaaactcctgggaactgattggcaactgcacatccattataggc

SEQ ID NO: 17418 - DNA, 121 bp, Artificial Sequence
  Synthesized
  misc_feature (61): n=a or g
ctcccaaccaattctgttgcttttcaataatctagaaagtttagtttcaaaattcattgcntctcttgatctgattccataaactgatatgcatgcttaattgctgcttatctgttcattc

SEQ ID NO: 17419 - DNA, 121 bp, Artificial Sequence
  Synthesized
  misc_feature (61): n=t or g
tacaattatcactggttttttttattccaactcttcagaaatagaaaaaactcctacaggntagaggcagtgtgatttccgatagtgaaatcaggtctgtctttctgttacatgtagaatc

SEQ ID NO: 17420 - DNA, 121 bp, Artificial Sequence
  Synthesized
  misc_feature (61): n=t or g
ggctgcttcagatatcaaagcctgccactttctattcatactatccatgattataattcanagatagatgtcttgtgattcagaaggctctaactctattcagtctggtcaggatgcccta

SEQ ID NO: 17421 - DNA, 121 bp, Artificial Sequence
  Synthesized
  misc_feature (61): n=a or c
acaaggttactaaatacaaataatagtattttttaatcaaatacaatacattggaaaaaancaaacaggtaagttgttgcacacacaagcacttcaacaggttctttaccataaggtattc

SEQ ID NO: 17422 - DNA, 121 bp, Artificial Sequence
  Synthesized
  misc_feature (61): n=a or g
ctgccgagatgcaggagtgccacggtcagtcatttctgctctagacaagattaatgtcctnacctttgtattcgttagcctaggatgtctccttgtcttcttggttttaaccagagacatc

SEQ ID NO: 17423 - DNA, 121 bp, Artificial Sequence
  Synthesized
  misc_feature (61): n=t or c
aaaaaatataacagttttgagaaatgaaactgcttgtaggcaggactatcggtatctatgngcagagactcacatcatgttgttttgagaaccatcttgcaatactaccaggagtctgcag

SEQ ID NO: 17424 - DNA, 121 bp, Artificial Sequence
  Synthesized
  misc_feature (61): n=t or g
tccttttagtggtgtggtttgtagaatgctttcatctcagtagtgttaattctctttcttntctgtgcccttaaagttcagcatctgctgatgcctgccctgcttcctgagcagcagctgt

SEQ ID NO: 17425 - DNA, 121 bp, Artificial Sequence
  Synthesized
  misc_feature (61): n=a or g
agaaatgcagatgggacctaaagaggaggaatttggttctctataacaatgcagtcagtcnttaacaatgctgatagctgagtatccttccccgtttttatcttgcatctcatttgttttg

SEQ ID NO: 17426 - DNA, 121 bp, Artificial Sequence
  Synthesized
  misc_feature (61): n=a or g
atgatttggcatctgcatcaggcctccacacgttcacccttcccagctgtagaggtcaagnagttcaatacaagcagagggggacttgccaagctcttccatatccatagtcagacacaga

SEQ ID NO: 17427 - DNA, 121 bp, Artificial Sequence
  Synthesized
  misc_feature (61): n=a or g
tgcatcaaggttgtatgttgagtgtcttgccctgctgtgcttgtggggttttccacgtatnaaaggcaaagggccaggagatgagcgcttggttccttgggagggatcccagtggtatcac

SEQ ID NO: 17428 - DNA, 121 bp, Artificial Sequence
  Synthesized
  misc_feature (61): n=a or g
ggttctgtgctgttccatcaattaatcacggcatccaattgttcctatcagtggtaccacntgtgcaatggtgaaggaatgtgttgtgaaaaggaaggttaccaaactgaaatggatagcc

SEQ ID NO: 17429 - DNA, 121 bp, Artificial Sequence
  Synthesized
  misc_feature (61): n=a or g
gattcatctcaacagggattaggcagcaggaggaatattcatttttgagcttttgacttantttttcttgtatggtatgccttcattttctctatttaaagagttatgttatccagttttt

SEQ ID NO: 17430 - DNA, 121 bp, Artificial Sequence
  Synthesized
  misc_feature (61): n=a or t
agccattctaactctgtatagatgagcagttttattagttcagcagtaacataaaataagnaggcacacacctctagaaatgtacagcagaggacaagagacaaaatacttaaaacaaaga

SEQ ID NO: 17431 - DNA, 121 bp, Artificial Sequence
  Synthesized
  misc_feature (61): n=a or t
atgttaggtaacttttgaactgttgccaaaaccatgagcagactatgtcaacttactctgnaaaagcagatagaaaattgtaatccagtataactatatgaaactcaaggagatacgcagt

SEQ ID NO: 17432 - DNA, 121 bp, Artificial Sequence
  Synthesized
  misc_feature (61): n=a or g
acattcttctttaaatagacgttgtcacataacctgtacatctttagttcttccgaaattnttttgatgtatctttcagagtttctaacaaaaataagattattgaacttgaaacaacaca

SEQ ID NO: 17433 - DNA, 121 bp, Artificial Sequence
  Synthesized
  misc_feature (61): n=a or t
tagattttaaggagtatttctaagtgaaacttagatttctccaggcaatgtgcttcactgnatcactgaacttggactaagaaataatactgatcatatttccaacttcctacccccaaaa

SEQ ID NO: 17434 - DNA, 121 bp, Artificial Sequence
  Synthesized
  misc_feature (61): n=a or g
ggcagttggatggttgattttctggagctcatgttacttgggctcttctctcgtgctgtcngatgtcccacctcacccttgggatgtcactttgtctccttagcacctatgcagcgtccgt

SEQ ID NO: 17435 - DNA, 121 bp, Artificial Sequence
  Synthesized
  misc_feature (61): n=a or g
gagttatattttggagaaattcctctatctagtcccacgagttgaaacatactttagcagntcagtagtttgtatgcacacgtttattcaattttagaactttttttctacagctattact

SEQ ID NO: 17436 - DNA, 121 bp, Artificial Sequence
  Synthesized
  misc_feature (61): n=t or c
tctcgctgatctcatttaggaagtcatgactgtaattgccattataaccttacaataccantgtctgggcaagcataaaatgatctgcagtgaggaacacagcatatacctgcacagatga

SEQ ID NO: 17437 - DNA, 121 bp, Artificial Sequence
  Synthesized
  misc_feature (61): n=t or c
ttgagcctgaaggtggatatgtcccgaggtgattcacagtgtgacagcacgtttctcatanaccttccccacgctcctggtaccctatccctaccaggtgtagtgctgagagcgtggcaca

SEQ ID NO: 17438 - DNA, 121 bp, Artificial Sequence
  Synthesized
  misc_feature (61): n=t or c
gctagcactgaaaggacaaaaatgcctttgtgcagccatggctgagggcctggaggaatgngaggactgcagctctctggttggctgcgagatttgggggtgaacaaggacccagtctggc

SEQ ID NO: 17439 - DNA, 121 bp, Artificial Sequence
  Synthesized
  misc_feature (61): n=t or c
gcacattaagttgttgagggaactgctggctttataatagcttgggagagcttttggttgnttttgtacctctcactcatctcaatgtcttccataggcggctgctgctcagcagattccc

SEQ ID NO: 17440 - DNA, 121 bp, Artificial Sequence
  Synthesized
  misc_feature (61): n=t or g
tccacacttcttctaggagattgtccagctattctaaaggatggcacagttgttctactgncagcaaagcacaggctgctaaatagagatggcaagtgcactaatattcatgaaattagta

SEQ ID NO: 17441 - DNA, 121 bp, Artificial Sequence
  Synthesized
  misc_feature (61): n=a or c
agaaaatgaagcttacaatcatatatgaagaatcagtgaatttcttattgtgaataataantgtactcatagatgtttttactgtttaaataagcagggggacacaccagaggacatgcac

SEQ ID NO: 17442 - DNA, 121 bp, Artificial Sequence
  Synthesized
  misc_feature (61): n=a or g
gtatttactgaattttaatcatgaatcaaaatctggtggcaaacattctttgtaacagtgncagcaggggagggagtggtttatcatcaaggcagtattaaacttcaggtcagatttgaaa

SEQ ID NO: 17443 - DNA, 121 bp, Artificial Sequence
  Synthesized
  misc_feature (61): n=a or g
aacttcctgacaccattgaccgaaggcaccaaacggttatagagggcctggcagaacaaancatacagttagtactgctggcacaccccaaacatcttgaccagaatgagatgggttgaaa

SEQ ID NO: 17444 - DNA, 121 bp, Artificial Sequence
  Synthesized
  misc_feature (61): n=t or c
tgtttcccttacagcttacaaaatgtaattattgcacttctaagagcaactctctccatcngaaggtggttaatacagcctctccatttataaactgggagctttctgaagcaggcactgg

SEQ ID NO: 17445 - DNA, 121 bp, Artificial Sequence
  Synthesized
  misc_feature (61): n=t or c
tcagtaccattcgacatcgaacctcaagtaggattgctatgatcttgtctttacttcaccntccatgaaactaggcatttacatttgcaaagacactaaataaataaataaataaataaaa

SEQ ID NO: 17446 - DNA, 121 bp, Artificial Sequence
  Synthesized
  misc_feature (61): n=a or g
gaggggataacagagaaggatgggataaaaatattcatgctaaggtgttctcctattcccntattagatagcgggcaatgaaagacactataaagaaaaaaaaacatagaagctcacggaa

SEQ ID NO: 17447 - DNA, 121 bp, Artificial Sequence
  Synthesized
  misc_feature (61): n=a or t
taatgaaaggggaaatccctcagtccctcttcctgtttgtgtctctgttaccttctgtccngcagtgacctgacatgtgcctccccctagaaatgaagccaagagttgtagagaattgttc

SEQ ID NO: 17448 - DNA, 121 bp, Artificial Sequence
  Synthesized
  misc_feature (61): n=t or g
tgagattctgccccttagcaaatgagctgctgaaatgtgaccagtagtaacaaaataactncctcatgtggatggggaatttcctttccccctcatatattctccctacatcagaaatgta

SEQ ID NO: 17449 - DNA, 121 bp, Artificial Sequence
  Synthesized
  misc_feature (61): n=a or g
agagtttaatcataggtagaaaaatacaaccagtgaccttctcaaaagatcacactgcatncaattgccagaataagttagacactttcaaaatgtgatagttaggaaaaggaactgcttt

SEQ ID NO: 17450 - DNA, 121 bp, Artificial Sequence
  Synthesized
  misc_feature (61): n=t or g
tttcatttctgttctgcattctttatcccactctttctagatcacttttagagaaacgatnaaatacttctattttattgtgttcataaaaatgcacctgctttggtaatatatgaacagt

SEQ ID NO: 17451 - DNA, 121 bp, Artificial Sequence
  Synthesized
  misc_feature (61): n=t or c
gaagccctgcatgtaagcattgcttttgcaagacagctgtggcactggtctcaccttgctncaattagttacgttcagagaaactttttcggatgtttatttcttgtgttcctcacagcac

SEQ ID NO: 17452 - DNA, 121 bp, Artificial Sequence
  Synthesized
  misc_feature (61): n=a or g
atgctccatttatctttattttatttaagatatatacgtgtgagtttacaaatgggttagnaaataagaaagtcttatgacaggaacagtcacatgcactggttatcagaagtttcactat

SEQ ID NO: 17453 - DNA, 121 bp, Artificial Sequence
  Synthesized
  misc_feature (61): n=t or g
gctcagggtgggatggataaaagaaaagtggttgtgcgtagcactgtaatgggctggatgngagttagcttaatccccaagtcctacttgttcccagagacccaagaggctgttgctgtaa

SEQ ID NO: 17454 - DNA, 121 bp, Artificial Sequence
  Synthesized
  misc_feature (61): n=t or c
gaattggacaacttgcatgcctaaggcctagacagaggcatgacttcctaagtaaagcaangtgaactacaataattttcagtttccacacatggctacttaaggtttttgaactgtaata

SEQ ID NO: 17455 - DNA, 121 bp, Artificial Sequence
  Synthesized
  misc_feature (61): n=t or c
tatgccttagtcactcctcataccaacctccatgatcttgatcccttaccctctttctctntgttctcgtttgtccagactcatttcctgttcaagaactcagcacttgcctttctgaatt

SEQ ID NO: 17456 - DNA, 121 bp, Artificial Sequence
  Synthesized
  misc_feature (61): n=a or g
atgctgtttccagtttatcatcaaaaacaattgtagctaaattattgtcatttaaatttancttctaacaaagaaatgttgcacttcttatcatacgtttcattacaaacctcctttataa

SEQ ID NO: 17457 - DNA, 121 bp, Artificial Sequence
  Synthesized
  misc_feature (61): n=a or g
ggcagattggcagatctgtacaaatgttttcacaaaaatgtcagcagtgggtgtgcgagtnagggatgagggatcctttctgcagcaagaccagtattatgttgcctagaaacactcaaaa

SEQ ID NO: 17458 - DNA, 121 bp, Artificial Sequence
  Synthesized
  misc_feature (61): n=a or g
ggtcatagtcctcttccatcaaagaggtgagacaggaactgtagtcactgaaaaaaaaacnaaaacacaaccatcaatacaagtggcagaagcatgataaattgtgactagagagaagaac

SEQ ID NO: 17459 - DNA, 121 bp, Artificial Sequence
  Synthesized
  misc_feature (61): n=a or g
aacattttggtcagtttcccaattaataagaattaggtgaatcactaaaaaaatatcaccntctttccacatctttgcctatacagtaagtgtatgtgcaaactcatatgccacttgtagc

SEQ ID NO: 17460 - DNA, 121 bp, Artificial Sequence
  Synthesized
  misc_feature (61): n=a or g
cacccttgcagtgcattcggctcctgaaaaaccttcgttacaaaaccaaatccactccctngcagaatgctgtcatcaggacaagcctatcgtcttcagccttggccgttgagtcccatcc

SEQ ID NO: 17461 - DNA, 121 bp, Artificial Sequence
  Synthesized
  misc_feature (61): n=a or g
ctcttttttccctttctgattactaaatagacatgcatttcctagaatatgattgctgtcntaactgcaatacctccatatacaccaatttattttttgaaaccttttagagttacttgct

SEQ ID NO: 17462 - DNA, 121 bp, Artificial Sequence
  Synthesized
  misc_feature (61): n=t or c
agtaagcactgctaaagttcatcctcattctatctacgcatgtctaacctgtagcactccngagttgcactacagaaacaaacaggtttgtaaattacatttgtttttcaaaaaggcactt

SEQ ID NO: 17463 - DNA, 121 bp, Artificial Sequence
  Synthesized
  misc_feature (61): n=a or g
tgggagctggaagtgcttagccttgtgtgaacaatctcatcatttacacctgcacagagcnctgcaggaaagggcctggtggttacagtgaggctgaaaatgagacaacagcatggtccat

SEQ ID NO: 17464 - DNA, 121 bp, Artificial Sequence
  Synthesized
  misc_feature (61): n=a or g
ttagctctcctattttttaactgatttacaaagagccttgctcctacatgcacctttgtancactacacattttgctacaagcagtagacctcaccctttctcagctaccttgcttcattg

SEQ ID NO: 17465 - DNA, 121 bp, Artificial Sequence
  Synthesized
  misc_feature (61): n=c or g
taaatacaacttggcttctaacaggtcagagaccttcccatttggaagtttaccaataatnatggcaagcaccttcctgcagatgcttaacgtagcataagtgaaaaactccttctcgtga

SEQ ID NO: 17466 - DNA, 121 bp, Artificial Sequence
  Synthesized
  misc_feature (61): n=t or g
ggggaagcaggctgtgtccccaaaacatgtgcgtgcaactgttatctctgcccataactgnatttctttaacaggacatgtaatttttattaaaatcagtgatgcaggatttagtcatatt

SEQ ID NO: 17467 - DNA, 121 bp, Artificial Sequence
  Synthesized
  misc_feature (61): n=a or g
atcagagaactgtgttgaaaccaacaaagtcagactggggaaaggtagtggatccattagnatttcattacaccaagactttgtctcctctttgttctgctgatccgttaagttcatggtt

SEQ ID NO: 17468 - DNA, 121 bp, Artificial Sequence
  Synthesized
  misc_feature (61): n=t or g
atctgccccagtaaccccagagtgggaattgtgcctggctaatccatttacctgatgtttnccagtggaaaggcagctcaaagctattgggacaaaaggactgaagcaggtgttacgtacc

SEQ ID NO: 17469 - DNA, 121 bp, Artificial Sequence
  Synthesized
  misc_feature (61): n=t or c
ttctgtatctcacctcaataagtggacttactgcttacaaaatgtagagggcactgagtgntttaacaacgcatatggtttgctggctgttgcatgaactagcataacagaaatcagtgct

SEQ ID NO: 17470 - DNA, 121 bp, Artificial Sequence
  Synthesized
  misc_feature (61): n=a or c
taatgctacttattccaacagaggactttaagtgagcttttaagagtcaaatcagcttagnaaactggggacaattatgcaaaattttcccaatagctccgccttatttaatcaaacactt

SEQ ID NO: 17471 - DNA, 121 bp, Artificial Sequence
  Synthesized
  misc_feature (61): n=a or c
cagggtttgtgctgcttctaacgcattaaaacacctattgctgacaaagtaccttttggcnccatatgtttgcttcccagcaatcaataccaaaatcgagtgagagaagaaatatcgacct

SEQ ID NO: 17472 - DNA, 121 bp, Artificial Sequence
  Synthesized
  misc_feature (61): n=a or g
gtatttaaactctgacctaggccaccttcacaccatggaaaagatttggcaggggcaagangaggctgtctccatcctcatggcaatgcagtggggattgacagcgaggagccttgcttag

SEQ ID NO: 17473 - DNA, 121 bp, Artificial Sequence
  Synthesized
  misc_feature (61): n=t or c
caaggtgattctgtgattctatgagatcataagagggggaaaatgcagtgacttcggaagnagtagctaaaggattttatgatgtgaggaaatggacctcactctcttcatgtcatccccc

SEQ ID NO: 17474 - DNA, 121 bp, Artificial Sequence
  Synthesized
  misc_feature (61): n=a or t
ggaattctttctcaactgaaaatattcgatatgtgatagtcatgtttattttttccatctntgaagactggaattattcaatataaggaaaatgggctttgctagttgtggtaagtggatg

SEQ ID NO: 17475 - DNA, 121 bp, Artificial Sequence
  Synthesized
  misc_feature (61): n=t or g
catagatatagagaacccgcctgtaagtgaaaccaaatctaaaacagatgtctggagaganccatgaaagacaggctgatatttagtaaatatggggttcttagatgaagaatgtcttgga

SEQ ID NO: 17476 - DNA, 121 bp, Artificial Sequence
  Synthesized
  misc_feature (61): n=c or g
ttccaagacttgggtttatctcttgccatgtcggtattaacgcagcagtgttgtatgtcantgtatgtcacaacttcctgcaaaaagacttctctcagcaacctctggtttaacaaacagg

SEQ ID NO: 17477 - DNA, 121 bp, Artificial Sequence
  Synthesized
  misc_feature (61): n=t or g
tttcagatgatgagacagggaaggggggaggctgtatttgaattccacaatgtttagtgantttaacagaggcttctgggctctatttttgcatcatctaccttaaactggggtactggtt

SEQ ID NO: 17478 - DNA, 121 bp, Artificial Sequence
  Synthesized
  misc_feature (61): n=a or g
agaagaaatactttaaagaagaggatgaaaatgcaccttgaaaactccctttgatctgtcncaagtagctgtacactgaagccctgctgaaattcatcctaaagggagacagttccactgc

SEQ ID NO: 17479 - DNA, 121 bp, Artificial Sequence
  Synthesized
  misc_feature (61): n=t or c
gagatagagcagataggtgcaaataatggagacttaacagtaagaggcacttaaatatccngataaagtcatttaaattgtcttaggattggacattcagtgctgcatcacttcagcagtt

SEQ ID NO: 17480 - DNA, 121 bp, Artificial Sequence
  Synthesized
  misc_feature (61): n=t or c
atggagcttttattgaatatgccacttaaataagggagagctgagatggttaaagtgcttntgcttaggagtcaaaagcagggaaacatttcacatcataaccttgaaatccaccatcaga

SEQ ID NO: 17481 - DNA, 121 bp, Artificial Sequence
  Synthesized
  misc_feature (61): n=t or c
tttcctcaaggtaggtgtcatacagtacatgctacctccatcagtaaagcaaactgataanggtctgtagcttcctgactgtgattaccattctgataataccagatttttgacaggtgcc

SEQ ID NO: 17482 - DNA, 121 bp, Artificial Sequence
  Synthesized
  misc_feature (61): n=a or g
aagaacttttttttttttttaaagtaattcttgtgttttctgatgccaaggctttgagacnctagctcagatgtcaaattgatgtgaaatcttgcataaccagcaagtgaaactcacactt

SEQ ID NO: 17483 - DNA, 121 bp, Artificial Sequence
  Synthesized
  misc_feature (61): n=a or g
actaaacaagcctagcaaacaagccttcacagatatcttcacaaatatctgcactgctccntttttttctatcgtcactttctaaataaaataaaataaaataaaatacatgtcttaatga

SEQ ID NO: 17484 - DNA, 121 bp, Artificial Sequence
  Synthesized
  misc_feature (61): n=c or g
ggcatgccagccctccagaggattattgattcctttctgaaagtctaatgatgccttttcncccatctccctgcctatttcagccagtctacacatttgagaaggccacatgcaacatctc

SEQ ID NO: 17485 - DNA, 121 bp, Artificial Sequence
  Synthesized
  misc_feature (61): n=a or g
tcatcccactgtcagcagagcaaaacaaaccctctgacactgattttgctcaaaactggcnttcacaagaagtcttagaattgtaaaaccattgaatggtttgggttggaggggaccttaa

SEQ ID NO: 17486 - DNA, 121 bp, Artificial Sequence
  Synthesized
  misc_feature (61): n=t or g
tatcctggcaatcagagctgaggatgagtcacacgctggttttaaaacgaaacaaaggagnccaattgtattttaattctgcaggtgtcggaaattgcactggggtagatcagcacagaag

SEQ ID NO: 17487 - DNA, 121 bp, Artificial Sequence
  Synthesized
  misc_feature (61): n=t or g
tgaagtcaacttgtgactaaaccagctatacaggtttcagtcctcgagaaatattctgtcntctaggtttctagtattgaagaagtaagttaacaaacttgaaatatttgtcctaaccatc

SEQ ID NO: 17488 - DNA, 121 bp, Artificial Sequence
  Synthesized
  misc_feature (61): n=t or c
caaagctggagtttagcaatttctcggcattaccagtagttagaaatcggttagggatcantgataacagacactgtgcagatcattgcttgtgccaaactcctttgagcttcaactatga

SEQ ID NO: 17489 - DNA, 121 bp, Artificial Sequence
  Synthesized
  misc_feature (61): n=t or g
atccaattcccttctcaagcacagtcagccagttacccaggaccacgtccaattagatttnaaatatcttcaaggatggaggtttcaaaatctctttgggcaaagagaaaagcaccatcac

SEQ ID NO: 17490 - DNA, 121 bp, Artificial Sequence
  Synthesized
  misc_feature (61): n=t or c
tacatccctgcaaaatgtaatctgtctgaagagaaagtgctatggtttttgccttggcttntgcatccagccatttatctagctgagtgcaacttctgtaaacctgctctgctacataaaa

SEQ ID NO: 17491 - DNA, 121 bp, Artificial Sequence
  Synthesized
  misc_feature (61): n=t or c
attcatctctgataaaaacatcttcttgggtatggaaccataggttatggtagtttctttngttagataggtcttgctttaggaccagcactgcagcttccaagacagaacagtaaaaact

SEQ ID NO: 17492 - DNA, 121 bp, Artificial Sequence
  Synthesized
  misc_feature (61): n=t or c
taaattctggactccaatgctttcaagagtagaatgagagtgaaggactagctatttctanttattaaaatcaggtttgagcagtactgtaacatgctggagaagtaagtgatggatgggg

SEQ ID NO: 17493 - DNA, 121 bp, Artificial Sequence
  Synthesized
  misc_feature (61): n=t or c
ttcccaatgataatcctgggattgtagagctgaacacaagcaatcataagggctagcttcngtcacaaacacgttccataaatgctactgatctgtttttaaagtgtttaattcctagcac

SEQ ID NO: 17494 - DNA, 121 bp, Artificial Sequence
  Synthesized
  misc_feature (61): n=a or g
caatcccagctgcagctgaactctgcactgagagttctggagatctgcaaggacaccaaanggagctgatgggacaccaaagaaggctgaagagcctcacagccaggctggtgtgtacatc

SEQ ID NO: 17495 - DNA, 121 bp, Artificial Sequence
  Synthesized
  misc_feature (61): n=a or t
ggctgctacacacacaaatagggaacatgtcatgttttgagaaaaatatttgcaatctacnggatgtctaagctgcaatgtaggatcctaaaccttgaagcctggtctccacttcactgtt

SEQ ID NO: 17496 - DNA, 121 bp, Artificial Sequence
  Synthesized
  misc_feature (61): n=a or c
ctctaatgcttttgaggaaacagcactgcaaaaacacattgaggactctgaaaacatttgngcaaaacacttaacatccctagctagccatgacactctaaatattacagtcagtgctaca

SEQ ID NO: 17497 - DNA, 121 bp, Artificial Sequence
  Synthesized
  misc_feature (61): n=a or g
ccaaatccaagttactgagtaacttccagcaccaagactcagcgcactgctctaacagccnacttacagacacctcaacatctacaaatccagtaactctatcccataccccacaaggaat

SEQ ID NO: 17498 - DNA, 121 bp, Artificial Sequence
  Synthesized
  misc_feature (61): n=a or g
ggcccagataaaaatgggccaccgtgttcagctgagctgagccaaaacaaacacctggacngttctgtccagcaaatttacaggtctgttcatgatgaagtaaacacgattgagctgttga

SEQ ID NO: 17499 - DNA, 121 bp, Artificial Sequence
  Synthesized
  misc_feature (61): n=a or g
ccctcttgttcccaggcagctctctgaatccaagatggatgagggggtgaagcaagaggancagcatgtgtgtttccccccacgtcccataagataatgctatgaagcactgaggacccgg

SEQ ID NO: 17500 - DNA, 121 bp, Artificial Sequence
  Synthesized
  misc_feature (61): n=t or c
caatggacaccaaacttgccattttagaaaaacatagtccatccttttgcaccactgcatngaactgcttgcagacttgagcattgctcactgcttcctcttgtcttttgatttctgtttc

SEQ ID NO: 17501 - DNA, 121 bp, Artificial Sequence
  Synthesized
  misc_feature (61): n=t or g
aaaatgcattaattattattcaagagggggataacttcactgaagaagaagaaattatcanatggttcagataagggaatacttaggtcgttcgcattgaaaaattacgtggaacatctac

SEQ ID NO: 17502 - DNA, 121 bp, Artificial Sequence
  Synthesized
  misc_feature (61): n=a or t
agcttcactgacagtgtcattgtctttatactggtgatctgtgaatggtggttgttgggtngcttgatctctgagtgattggctttttgaaaatgtaaaaatgttagtttaatgcgagtga

SEQ ID NO: 17503 - DNA, 121 bp, Artificial Sequence
  Synthesized
  misc_feature (61): n=a or g
taatagcagttttacctcagagtaagaaaaatagaaaagtgcttttccaagaaaaccaacngcagtaacaaaagtcacagcacctctgagaagtggtggactgacagccccagagacccag

SEQ ID NO: 17504 - DNA, 121 bp, Artificial Sequence
  Synthesized
  misc_feature (61): n=t or c
aatgtgacccttccaagggttcaatttaaatgcagatctagcaagatttactagattgtanattttaggtcccaaataaaacgaagtggggaatgatgcaattaacatgcttcactgcatc

SEQ ID NO: 17505 - DNA, 121 bp, Artificial Sequence
  Synthesized
  misc_feature (61): n=a or t
aagaaagagaattaaaccggtaacgtgaataatatcgaagacttcaacacaactacagacngtcttcaaatgttgtacaaaatacagataaaatcaaaacaaacactgaaaactgagtaaa

SEQ ID NO: 17506 - DNA, 121 bp, Artificial Sequence
  Synthesized
  misc_feature (61): n=t or c
agatgctggcacacagcttctgaaaagagaagtttaaatctttccagggcagatccgtaantggtagtgaattatttctgcaggactttacctctgcagcttagctcaggaacaaagagga

SEQ ID NO: 17507 - DNA, 121 bp, Artificial Sequence
  Synthesized
  misc_feature (61): n=a or g
acgagggccaaagaacttcatagtgtgaaatgcctcatatttacttgcctttgtaggaagnccagatcagatgtattacacaaagtagaactaaatatatgcatgagggtctctttgcctt

SEQ ID NO: 17508 - DNA, 121 bp, Artificial Sequence
  Synthesized
  misc_feature (61): n=a or g
aaacaaagtgtttctacagaggtagttttcaacatgttagttgaagaacttcatagctgtntggaagactgattgaactacatgatctggtagcagacattaacatagatccattaacttc

SEQ ID NO: 17509 - DNA, 121 bp, Artificial Sequence
  Synthesized
  misc_feature (61): n=a or g
cccacagctctcggggcagcaccgccacttcagttctgagtcagtcttacttagggaaagnctagttcctaaaatttagcttctatccatccacagcaaggatagggcttaattggggtgg

SEQ ID NO: 17510 - DNA, 121 bp, Artificial Sequence
  Synthesized
  misc_feature (61): n=a or g
ttcccatacactaaggacacattgttcgaagtgccttggtagctgtctaactctgcttccnctcatggcagtagaagttttagctgaggagcgcaggagaaaacaattaggacatgtttag

SEQ ID NO: 17511 - DNA, 121 bp, Artificial Sequence
  Synthesized
  misc_feature (61): n=a or g
ttcagcagactccagggtgttgttatcacccataagaagccctactcagacctcctcttcnagtcccatttgtggtgatctgtctgaaacttcgcggacaacacctgagggagtgatgctg

SEQ ID NO: 17512 - DNA, 121 bp, Artificial Sequence
  Synthesized
  misc_feature (61): n=a or g
aataagcaaaattcccaaatgcttctttattcatatgcctttattctaaattaagttgtanaatgtgttcctgaatgtcctttggatttgttcatttaatacctgacttcttgtgcgagtc

SEQ ID NO: 17513 - DNA, 121 bp, Artificial Sequence
  Synthesized
  misc_feature (61): n=a or g
attttgggtgtagaccgcagtaatttttgaggaggtctttcttatgagctatttactgtcnctctaaggcttctttttaattcttcctcaagtgatcgtggcagttctggtgttcctggca

SEQ ID NO: 17514 - DNA, 121 bp, Artificial Sequence
  Synthesized
  misc_feature (61): n=t or c
aattcctacaactgcacttcaccagttctcttccagactcgagagataaggggttgtgccntgaagaacactgccaggcatgcgttaggttcagtggctgatttttggatttcagtggaag

SEQ ID NO: 17515 - DNA, 121 bp, Artificial Sequence
  Synthesized
  misc_feature (61): n=t or c
tatattcaagtgattaaatatacttaacatgccttctatggcacttagtagtcccaggcanctcaatttctaaaaaagcagaagtgtgttctgaagattccatatagcaaaaagcctcagg

SEQ ID NO: 17516 - DNA, 121 bp, Artificial Sequence
  Synthesized
  misc_feature (61): n=t or c
cgtagaagagtttctgatacacagtattactctagcagtattcttggtaatatgtgacatngagatagttatcaatatcaatttagaacccggtgctgtgatgcactgtttaacactgttt

SEQ ID NO: 17517 - DNA, 121 bp, Artificial Sequence
  Synthesized
  misc_feature (61): n=t or c
cagttttcctcgttaaaatgcttgacagtttagaactgaatttgtagaagcgttattaaanaaactgactgtggcatatttgctttttggaccttgtttagcaaagcacttaagtaaatgt

SEQ ID NO: 17518 - DNA, 121 bp, Artificial Sequence
  Synthesized
  misc_feature (61): n=t or c
tgggaggctttctattggttcctgtagacttcggatgactcagttacataaacaaactaangtgtaagaataaccaatgtttgccccttctcggaaatgtaccagccctgtacagggactg

SEQ ID NO: 17519 - DNA, 121 bp, Artificial Sequence
  Synthesized
  misc_feature (61): n=a or g
aggccagctctgacagacttctctataaatgcatcttccatttacactacactacctttanatgtaaaactctaaaatagtgattcagaaaacttctcctgagaatgctacatttctctgc

SEQ ID NO: 17520 - DNA, 121 bp, Artificial Sequence
  Synthesized
  misc_feature (61): n=t or c
tcactcatcatatgcctgtgacagacaaaccagctgtttcagagagtttcccaaatacttngtgtttcctaatactggggggacttcaggtggtaactggtcattgtaagaaagaggtttt

SEQ ID NO: 17521 - DNA, 121 bp, Artificial Sequence
  Synthesized
  misc_feature (61): n=t or g
aaacactgacttcattgaagtattgggttatttcactgtttgcttcaacagaactaagatnttatcagcctatctctgtagaagaaatcctgagcagtccgtagcttttacaggctctgaa

SEQ ID NO: 17522 - DNA, 121 bp, Artificial Sequence
  Synthesized
  misc_feature (61): n=a or g
atctaagataaataaaatctttgtcctataccctgtgttgaccatatgaccttgtatgacnttgtaatgacacgctgtccagaggctcatagaaaacctagctgcattttgtagaatccag

SEQ ID NO: 17523 - DNA, 121 bp, Artificial Sequence
  Synthesized
  misc_feature (61): n=t or g
tctattaagtcttcaactgtacagtagaaacacttctgaatggtacagatccgcgatgctnttgcactgcagcacttatggtagtgccagctgctcagtgctattaaaataaacatggatg

SEQ ID NO: 17524 - DNA, 121 bp, Artificial Sequence
  Synthesized
  misc_feature (61): n=a or g
tgatttctgtatgggatggaacagaagccatctaatctcctctgaagaccagttgcatatngctgggagggcatagatttccatgctggagagaataagaagagctgttaagtagtaattt

SEQ ID NO: 17525 - DNA, 121 bp, Artificial Sequence
  Synthesized
  misc_feature (61): n=t or c
cattctttttatagaaagagcttaactcctctcaggcaggaagtaaaaggcatttgtcttnctaagtcccctagcagaggtggaaaagtaacatactgtacttctttcagataaataacta

SEQ ID NO: 17526 - DNA, 121 bp, Artificial Sequence
  Synthesized
  misc_feature (61): n=a or g
atttcagttttctacagttttcagcagatcatccttaccatttacactgggccagcaaacnctgtgcaatataaaaaatctttaattgttaagttgaaaaagggaatgcattatcctccct

SEQ ID NO: 17527 - DNA, 121 bp, Artificial Sequence
  Synthesized
  misc_feature (61): n=a or g
ctaacctgcatacaatgatgaaaataaataaataaataaatactggctgaatgggaagaantatggtcctaaaatgtatttaaaacctcccctctccaaaccccagctggcaaactgggag

SEQ ID NO: 17528 - DNA, 121 bp, Artificial Sequence
  Synthesized
  misc_feature (61): n=t or g
agtgtgttccattaaagagcaaacgagccccttattgtggtggtttaggtatgttgtttgnttctctccacaagaaaaatgtattcgagtacaacagtataactcctgaatagcgattggg

SEQ ID NO: 17529 - DNA, 121 bp, Artificial Sequence
  Synthesized
  misc_feature (61): n=a or g
cacaacccagtgaccaagacatggccagcatctcagatcagcatctgaacaactcctccanaagtgtttgaatactgttacaggttgtatttttcttctcatcagaagaaggtaaaatact

SEQ ID NO: 17530 - DNA, 121 bp, Artificial Sequence
  Synthesized
  misc_feature (61): n=a or g
taagcaccaccctctgtcattactgttcaacttgccttaaaacctgcttggtttcctcacnttctttggcttggatgaaaaggtggctcaggattgccaggtcttctcatgcatttcccat

SEQ ID NO: 17531 - DNA, 121 bp, Artificial Sequence
  Synthesized
  misc_feature (61): n=a or g
cttaaacagcacgagcctgaatctgccacagtgtcatcaaaagtactggaatagcacaggntttaatatgtaatttagggtgactctagtctcaaattatgctggtttatcaccatacttt

SEQ ID NO: 17532 - DNA, 121 bp, Artificial Sequence
  Synthesized
  misc_feature (61): n=t or c
atgtaacatacttgcaaaacacaaatagttgaataacagacaacgatacttaaagaatagntaaatgtctagaactccatatttataagtataatctttaaagcagaactgaaattagaag

SEQ ID NO: 17533 - DNA, 121 bp, Artificial Sequence
  Synthesized
  misc_feature (61): n=a or g
aggagggaataaatcagttacttgctgaaaaataccttttgtgtgatttcatgaattctcntttaacaccctctctcccttcaaaaaagcaaagatgaaagaatacagaaagtgtacagcc

SEQ ID NO: 17534 - DNA, 121 bp, Artificial Sequence
  Synthesized
  misc_feature (61): n=t or c
tgacacctgaacgggggcgagccgtacaccctcctgttcccacctggttccctcccatcangagttcctgggtggccccaaggcattctcacaccagtaaggaaatcccattaggctctgc

SEQ ID NO: 17535 - DNA, 121 bp, Artificial Sequence
  Synthesized
  misc_feature (61): n=a or g
atgaaaagcacatcgctgtttacatgaaaccagcagggaaagcatctttcaacagcaagangtattttatgcaaatatggctattattttggcaagctggatgatgaagtttgattatcaa

SEQ ID NO: 17536 - DNA, 121 bp, Artificial Sequence
  Synthesized
  misc_feature (61): n=t or c
acatctagctttcttttgtcaaggttgctgctactctgagctattttgtttcacttacaangcaaaatacatttgtctacttagtaacgttttttaaagattagttatgtatatttattct

SEQ ID NO: 17537 - DNA, 121 bp, Artificial Sequence
  Synthesized
  misc_feature (61): n=c or g
gaactcccttccagttctcatagcattctcatttgagtgtttcttggaacataacaggatnaaatccaaattgtgcctagacaagtgaaattcaataccatcattacagaaaacaatctac

SEQ ID NO: 17538 - DNA, 121 bp, Artificial Sequence
  Synthesized
  misc_feature (61): n=c or g
gtcctctgcaccaaaatgttcttttctctcccatcacgctgccagaaaggtgggagggctntggtggtggctgcctgtatgtgggtctcaccctatgtgtggcttgtccaggtggctggga

SEQ ID NO: 17539 - DNA, 121 bp, Artificial Sequence
  Synthesized
  misc_feature (61): n=c or g
aagacattcaatgtatttttctgaggaacagctcatcaacagctgctatgaagtgtttctnccacaaatgaagattaatgtaatggcagagggcgcacatggataggctcaactcagaagt

SEQ ID NO: 17540 - DNA, 121 bp, Artificial Sequence
  Synthesized
  misc_feature (61): n=t or c
tgggggttgggaaagcactgcagtatgcacacagtggccctgcaattcatgacccacaaanattctaaagtcagtgatagaagcctctcacagttcatgggatctatcagctaaagactta

SEQ ID NO: 17541 - DNA, 121 bp, Artificial Sequence
  Synthesized
  misc_feature (61): n=a or g
tccaccagtttagcttgtggtttccttacagcagcctggattcaactcttactattctgtnagctacctaatgccagctcaaatgaaaggtattgtgcataattaactttgggactttctt

SEQ ID NO: 17542 - DNA, 121 bp, Artificial Sequence
  Synthesized
  misc_feature (61): n=c or g
cccagcaggcctgccacagctgttattccaatgatagaaaaaaaatgaatagatgtaccanggctcacccttaatcctttaaaatttagtatcctgtctccagcactcactagcccacagt

SEQ ID NO: 17543 - DNA, 121 bp, Artificial Sequence
  Synthesized
  misc_feature (61): n=a or g
aggctgttggtacttaaagttgacctttacactgaatgcttagtagtcacgttctcttgcngaatacatcatttcctcccattcttacaagcagggcagatacagcacatgcagtgcacaa

SEQ ID NO: 17544 - DNA, 121 bp, Artificial Sequence
  Synthesized
  misc_feature (61): n=a or g
tctgtgtgcacgttggtaggtggcgaagagcgatttcaggttgatgtggatactgggatcntcgtgaccacgggcttacctctggtgtggaacaaggagtacgtggtcacagtgcaagcct

SEQ ID NO: 17545 - DNA, 121 bp, Artificial Sequence
  Synthesized
  misc_feature (61): n=t or c
tgcagcagtgccggggtcctgtgatgccccaccgtgagctctgcggagcagactttgcccngagggcagggaaattcctggaacttctgcatgccggcactggagctgtagccttgtggcc

SEQ ID NO: 17546 - DNA, 121 bp, Artificial Sequence
  Synthesized
  misc_feature (61): n=a or g
caaagaaccactcccaggagccctgtggggctaaccacagttggtgcatccctactacctnactccagatgggctgggtaaagcacacatgcaattgctggtcctccctgcacagcagtgc

SEQ ID NO: 17547 - DNA, 121 bp, Artificial Sequence
  Synthesized
  misc_feature (61): n=a or g
tggtggtttctcatcagaacacgtttgagcaatgggcagcgtctgtgtaatttttccatantgtttctcacacaccaggggcacagaatttgtgtgtgtacgtatgatgtgtttgcatgtg

SEQ ID NO: 17548 - DNA, 121 bp, Artificial Sequence
  Synthesized
  misc_feature (61): n=t or c
caactaaagaaaaacacttttatctgcaagcacttaagaacattaccagtttcagaaccangtaagacgttagtagctggcttgttcaactcctttcagctttcatgctgacatgtaccat

SEQ ID NO: 17549 - DNA, 121 bp, Artificial Sequence
  Synthesized
  misc_feature (61): n=a or g
ccttggcatactgacagaaatatttcatctaatgtggcactccttggtcatttcgaaagancacagcttggactgctaaagctgtttccaaactaagcaactgcaacaaaataaatcacaa

SEQ ID NO: 17550 - DNA, 121 bp, Artificial Sequence
  Synthesized
  misc_feature (61): n=a or t
agtacaattcataacgggcagtcccctttttgcagcagtaccacatcattgaccctaacantagagagctgctatatgctctcagatccttatctgcattactgccacttgttttgctgca

SEQ ID NO: 17551 - DNA, 121 bp, Artificial Sequence
  Synthesized
  misc_feature (61): n=a or g
agtaagcactgtcagtttgcttagatatagatcttagagttttgtatcagtaagtgttccngtatactccacacaaaataaattgatcacagtgaagttcttaatggactttatgaaattc

SEQ ID NO: 17552 - DNA, 121 bp, Artificial Sequence
  Synthesized
  misc_feature (61): n=a or g
agcagacatccaaacgtaagggcatccacttgtcatttcttacctaacgccacgtggctcntatcattagctggcaaatactggagaaatactggccagtaatatcagcttttttagcagt

SEQ ID NO: 17553 - DNA, 121 bp, Artificial Sequence
  Synthesized
  misc_feature (61): n=t or c
tcctcctttcctctcgtggcacaaatgacatcattatgctgctctgcacatggcgggacgnctatggaggtagaggataacactgggccacgtgcaccccatgcacaccagaccgggggga

SEQ ID NO: 17554 - DNA, 121 bp, Artificial Sequence
  Synthesized
  misc_feature (61): n=t or g
ccagaatcagtatggaattctcagcatcttgtgtgcaacctctggttctgggctacagacnaagctgccaacagggagattctccatgatcactgtctacagaagagttggtgcaatcctt

SEQ ID NO: 17555 - DNA, 121 bp, Artificial Sequence
  Synthesized
  misc_feature (61): n=a or g
gagaacaggagccatggagtacattgcctctccaaggggtgcacagcatgtcttgtgtacnagcaccctgccctgagttatttactcctttatgtgcccagctgtgccatctccttgggct

SEQ ID NO: 17556 - DNA, 121 bp, Artificial Sequence
  Synthesized
  misc_feature (61): n=t or c
ctcctccaagacagacaagacacctatagtttgtaacaggaaaacttaattaaaacaaatncttaacagaagcttccatccagccaagttaggctaaatgatgtaaaactaggtgaggagg

SEQ ID NO: 17557 - DNA, 121 bp, Artificial Sequence
  Synthesized
  misc_feature (61): n=a or c
tacatgataatagggttcagtatgggaggcagcatatagaaaatcagtttcacacttgatngggttttgaatggatagcagaacaaagataatttgcaccttggggaagtgtgcttacttg

SEQ ID NO: 17558 - DNA, 121 bp, Artificial Sequence
  Synthesized
  misc_feature (61): n=a or g
caggtgaagaggtctaatcaggaatgtactgtcaatttctttcagttactttccttcaaangaatttaagcatttcaagttagctctctctctcgtattcattgcccttttcagagctgct

SEQ ID NO: 17559 - DNA, 121 bp, Artificial Sequence
  Synthesized
  misc_feature (61): n=t or c
attaagagcgagttttgtagccagaggagaaaaattggtggtcaaatcaaatatcctgtangttagatgtgaattacagaccttacttagttcaaaagctcataagcatggggaaaataaa

SEQ ID NO: 17560 - DNA, 121 bp, Artificial Sequence
  Synthesized
  misc_feature (61): n=a or c
caatatcaggtcttcatgcaaactttatcagggtgaaattctgaagtttctgaaaacattnaatgaattttctggtgaagaaggtattattttgcctagaaaataatttatgagggcctaa

SEQ ID NO: 17561 - DNA, 121 bp, Artificial Sequence
  Synthesized
  misc_feature (61): n=t or c
ctcagccatcaagtccctgggagaacatattttatgattaaaagtcctcttctaatgaccnatatcttctatacagacacacgtcatcccataatgtcaaaattctaaagaaataaaaatc

SEQ ID NO: 17562 - DNA, 121 bp, Artificial Sequence
  Synthesized
  misc_feature (61): n=c or g
cttaatggagtaggcaatgatatacataaaaagtggttaggtactggaacactgctgtagnagaggtcagtaagccgcatataaatgtaatcctacacttacaagtgatatttagtagata

SEQ ID NO: 17563 - DNA, 121 bp, Artificial Sequence
  Synthesized
  misc_feature (61): n=t or c
aagcagcagttccccacagttcccgtcatcctttcccactcacactgtgtttgcgctgtgngtacatatctgcctgttgcctcccgttcagttgtacggagcatatgtaagcaattcaggg

SEQ ID NO: 17564 - DNA, 121 bp, Artificial Sequence
  Synthesized
  misc_feature (61): n=c or g
acgggagattctgggaaataattgatgatttgccatcaatcaaaccaacttacttacatgnttatagaaagttgaagtcagtagcagccagagataaaagtgtttcatggtcttttacaca

SEQ ID NO: 17565 - DNA, 121 bp, Artificial Sequence
  Synthesized
  misc_feature (61): n=t or c
ggaaaacgtgcctaattttgctcagttttttcacttcagccaggctggctgttcccttccncaggaaggcaaccactcccttggtgctgtacatctgggtccctggatcccttcttctcgg

SEQ ID NO: 17566 - DNA, 121 bp, Artificial Sequence
  Synthesized
  misc_feature (61): n=a or g
cttagcttaaaaaacaatcattttaaattttcctactggggggaaaagaggaagttcaaanatagttttagccttaatattactacaatactacaatattgtctaataaaggttaaaaata

SEQ ID NO: 17567 - DNA, 121 bp, Artificial Sequence
  Synthesized
  misc_feature (61): n=a or g
aatttttgcaaatttagcatctatttcttgccagcgttcttcacaggctctgggcattccntgaacttcaggagaaatgcactttctcctaacagcactaacatacccgataggtgtcatc

SEQ ID NO: 17568 - DNA, 121 bp, Artificial Sequence
  Synthesized
  misc_feature (61): n=t or g
atactgaggattaggtggcactttatccatcagttatcacttgattttcttagattgcagntaagtacaaaacatctaggagtgtgaacacttcagtgactctagaaattggtcatgctga

SEQ ID NO: 17569 - DNA, 121 bp, Artificial Sequence
  Synthesized
  misc_feature (61): n=a or g
ctttggctacatgtgaaaccgctcttgaaaccactcttgcaggtctagatttactagagcntagatttaatgttccatcactgaacttttctgccaattgatcaatgagataattgaaaga

SEQ ID NO: 17570 - DNA, 121 bp, Artificial Sequence
  Synthesized
  misc_feature (61): n=a or g
tttaccaactaatagaaatacttaattgacatcagcttcatttgccacaattcttaacaanttacagcacttagttccaaaatcacaaaaccagaaagcactgtgagaaaaggacagtggg

SEQ ID NO: 17571 - DNA, 121 bp, Artificial Sequence
  Synthesized
  misc_feature (61): n=a or g
agaaacttagaatgaattttatcatctttgataggtgcatgaaaccctcagggcaactccnacagccctctttagtggcacgcaggcagcctgaaacatcctgaagcaacaaatgactaac

SEQ ID NO: 17572 - DNA, 121 bp, Artificial Sequence
  Synthesized
  misc_feature (61): n=a or g
taactgcaacaatgaagaaacttgctgcatattttctactgtagctagattaagtgagacntgtaacacacaaagaatgagctttttaaagtaagaaaattcaaagtatatgctaggtcca

SEQ ID NO: 17573 - DNA, 121 bp, Artificial Sequence
  Synthesized
  misc_feature (61): n=t or c
tattatagtcagccaagttaatgttctggttccttaagttggagtatcagtatttttatgnagtagcacactgttttgtgctgctggatactacatcaattacctagctgtgtttcattag

SEQ ID NO: 17574 - DNA, 121 bp, Artificial Sequence
  Synthesized
  misc_feature (61): n=t or c
ggaaccgagtaacatggagaagccttgtaactgaaccatgcaactcgctccagcttgctgntttcgttgtttagcaaacaggagaggttcactattagggtagtggtgagtagaaagtgaa

SEQ ID NO: 17575 - DNA, 121 bp, Artificial Sequence
  Synthesized
  misc_feature (61): n=a or g
tttggtcagcataagaatgcacatgcaatagatcagacagggacatgaattttccaagtanaataaggatgtaagtgacagtgagcatgtaaaaaataaaataaaaaacagaaaccacact

SEQ ID NO: 17576 - DNA, 121 bp, Artificial Sequence
  Synthesized
  misc_feature (61): n=t or c
ataaattgaaacgggaagtggacaagagagcattgaaggatgctggctggagaaaccctcngcacaaacgcaggcaatcagcctgattttgtttttttcttagagtggcccagcactacca

SEQ ID NO: 17577 - DNA, 121 bp, Artificial Sequence
  Synthesized
  misc_feature (61): n=t or c
tgacatgaaatttgggattgtgtttgtgtagttacaagagggattgatcttgtttggaagngtgtgttttgcagttgattgctacatcttgtcctgcacctgctaagcagaataggacact

SEQ ID NO: 17578 - DNA, 121 bp, Artificial Sequence
  Synthesized
  misc_feature (61): n=a or g
agttgaaaataatgctattaatatccagagagctaagagctgttgccctcgtaattccttnaagtgctgtcgttccctgatataatacaaacctttgcatttatagtaaagaaaattatat

SEQ ID NO: 17579 - DNA, 121 bp, Artificial Sequence
  Synthesized
  misc_feature (61): n=t or c
tatcttggttatattctgtgatacagagcaattccctcagttgttctatgcctcccgtgcntgtgctatgtgttttctctttctaagttgtcccttctgcagtcagtatctctcagtaagt

SEQ ID NO: 17580 - DNA, 121 bp, Artificial Sequence
  Synthesized
  misc_feature (61): n=t or c
ccaagtagaattccaccaagactctgttctcaccattcatctattcccaaccctgtatttncaaaaattcctgttgtattattgattgagagagatgttgtcatgaaggaagatatcagag

SEQ ID NO: 17581 - DNA, 121 bp, Artificial Sequence
  Synthesized
  misc_feature (61): n=a or c
cttaagtggaagcagctcagatgacagtctgacaacatgctgatgatcaaagtgtcctccntgtcaagccagaaagaatacaacaccttctctattttacattatacaaactacagacacg

SEQ ID NO: 17582 - DNA, 121 bp, Artificial Sequence
  Synthesized
  misc_feature (61): n=c or g
tctgtctccaagcatgagtcccaagaacgattttgtgttctgtcagccagtaagaacaggncttcagaagtgggtgtatgtgcacgtgatacagattcacaagctgctcacttgcacataa

SEQ ID NO: 17583 - DNA, 121 bp, Artificial Sequence
  Synthesized
  misc_feature (61): n=t or g
tgaaaagctagataagagtagtgccttgctatgacaggtgcagaacacaaactggataggnactgtttctttaagaggcacctatatgaagggtgaggaccttcttactttgccaatcctg

SEQ ID NO: 17584 - DNA, 121 bp, Artificial Sequence
  Synthesized
  misc_feature (61): n=t or c
ggggtcctttggatcatagttacctcaatttcagcatctaaacaccccagtactgctctgnaccagttaccagtatgttcaggagccagcagctcccagcctgggtgtgcagcaagtcgct

SEQ ID NO: 17585 - DNA, 121 bp, Artificial Sequence
  Synthesized
  misc_feature (61): n=a or c
gaaagttgtgtagtacttcatatttgaatttgaaataaagcttttttgttttattgagatnattcaagttctgggattttttctcctcttttagtttctgtttacttttgttttattttct

SEQ ID NO: 17586 - DNA, 121 bp, Artificial Sequence
  Synthesized
  misc_feature (61): n=t or c
tataaatgaggtgctgctttcagactcatctactagcaccgtttagctatagccagtgctncaattttaccatactttaaccaaacaagtatcagaatattatcaaacagataaaagtttt

SEQ ID NO: 17587 - DNA, 121 bp, Artificial Sequence
  Synthesized
  misc_feature (61): n=t or g
agtgtatgccagtgagtgctttgatatttgggtgtactgttagaaagtatttggaaagagncagagctaaggcagccaagcctaccctgatatccgcaggatgaatcaagagctgcacctt

SEQ ID NO: 17588 - DNA, 121 bp, Artificial Sequence
  Synthesized
  misc_feature (61): n=a or g
tgattgttatttaatttccaaacactgataattcatcatacactggagaagagctgaaacnacaagagtgttgggatgaacagggcttccataacagaaaaaaacaacatttatatacata

SEQ ID NO: 17589 - DNA, 121 bp, Artificial Sequence
  Synthesized
  misc_feature (61): n=t or g
ttttcccataggatcacaaacttttccagattggaccaaaatggcccattaatatgacaanctattccctgtgttcttctactaacagcggccagtgacaacaatttgaagagaatattga

SEQ ID NO: 17590 - DNA, 121 bp, Artificial Sequence
  Synthesized
  misc_feature (61): n=a or c
gtcctggaacaccattttttctcactgtaccgttacgtaatagttattctttgatcccttnataataaatcatttgttgcacctatatagataatcaaatttttaaaaaattgaatggaat

SEQ ID NO: 17591 - DNA, 121 bp, Artificial Sequence
  Synthesized
  misc_feature (61): n=t or c
aaaagccatgaaaagtgcagtcagttttattagagagtgggaactcaagagacgtggctgngtgctaataggtaccacaagcaaaatagtggataaaaataatgacctgcggagaaaagca

SEQ ID NO: 17592 - DNA, 121 bp, Artificial Sequence
  Synthesized
  misc_feature (61): n=a or g
ataaaataaaataaaaataataaaaaaaacatacactgcacacagatcagcagcatagagngtgccatgctcactattaattataggtgaggcacggaagacaatactcaacatttccagt

SEQ ID NO: 17593 - DNA, 121 bp, Artificial Sequence
  Synthesized
  misc_feature (61): n=t or c
gtcaggcttccagggtaagattcctctccagcctcagccttgcatcaagtttcatatgtangtgttaatcctcaagcaaaacacctacatgcaccaagtgaggaaaacagcccagatcctt

SEQ ID NO: 17594 - DNA, 121 bp, Artificial Sequence
  Synthesized
  misc_feature (61): n=t or c
gaagattagtgaatgtgtatgtgtgatgcatagatagaccatttcattccatgttgaaatncactttttttaagcatagtaggaattaagaaatgagtgtgggtgaagaattctccatcag

SEQ ID NO: 17595 - DNA, 121 bp, Artificial Sequence
  Synthesized
  misc_feature (61): n=t or c
ttaatagaaagcaggctctgagaccatctgtggtaaaggcaattgatttaagctcagagancagacatactatttaaagcttttcttcttcaatgtaaccaagaggagctacttgaaaaga

SEQ ID NO: 17596 - DNA, 121 bp, Artificial Sequence
  Synthesized
  misc_feature (61): n=a or g
tgcagtccctatccacctggatcaattggtattgaacgtgaagttcatccctgaggctctnaggtattaaatgtatttcatgcaggtctcggtagtaaactggaacaaacttgtaagccca

SEQ ID NO: 17597 - DNA, 121 bp, Artificial Sequence
  Synthesized
  misc_feature (61): n=t or c
ggttgattaatttaatttgattaattttatttgtagagcattgtataagtggttcatttanagcaagtaagcagaatgcaaaaaaaacaaatgttcccaataaagaaatccatacctgaca

SEQ ID NO: 17598 - DNA, 121 bp, Artificial Sequence
  Synthesized
  misc_feature (61): n=a or c
tgctaatactaacagaggtgtaggcacaggaggcaactgtgctccatctcctactccctgnaagtaggagtcctttgagatgcatgcagtgtgctgccatgcacaggccagctgcacagct

SEQ ID NO: 17599 - DNA, 121 bp, Artificial Sequence
  Synthesized
  misc_feature (61): n=a or g
cctttctgagagacctgagtggtgcacctggttatgctcaagctgaggagcacgttcatangaaggtcaccgtggcaaagagcacctgcagaggagccaggtagatgggagcatgaaagcc

SEQ ID NO: 17600 - DNA, 121 bp, Artificial Sequence
  Synthesized
  misc_feature (61): n=a or c
gttcagagagtgatgagcaaaagggacctctcccaagctgtgagataaataataaatggtnaaaaaagatgtagagatctaaaaataaagtcgagctacaccgtgaaccctactaggaatg

SEQ ID NO: 17601 - DNA, 121 bp, Artificial Sequence
  Synthesized
  misc_feature (61): n=a or g
acttaccttttctgcactattcataaccaaattaatgtaaagtaacatttgcaagtccttntcagatctctttaataataatctattaagccccattccatagaaaacatcagaaaatcac

SEQ ID NO: 17602 - DNA, 121 bp, Artificial Sequence
  Synthesized
  misc_feature (61): n=a or c
tagcgtgctttgaatagtaaaagcatctttaaagtgaaggattggctgtgattctgaaggnagcccatccaggttcatatttgtttatgcaaaccttttaactctaaatttgggtatattt

SEQ ID NO: 17603 - DNA, 121 bp, Artificial Sequence
  Synthesized
  misc_feature (61): n=a or g
ctttgctgtggagcaagcatgagagagctcctcagtaacaaagcctgcaatttcatgaacntgtttcctatttggctctttttgcctatgagtttgaagtatgatttgaatatgaactggc

SEQ ID NO: 17604 - DNA, 121 bp, Artificial Sequence
  Synthesized
  misc_feature (61): n=t or c
gcagaaaaccccacagttaccataattacttcatatgaacaaccatttcccagtgcaggangactcccatggtctgggaatgaatgaaagggactacagccccactgagctgggatgagga

SEQ ID NO: 17605 - DNA, 121 bp, Artificial Sequence
  Synthesized
  misc_feature (61): n=a or g
atggatgatatgtgtaataagaatgatctgtaaaaatatttagttcttttacactgccaancagactggaaatcaatatgaacagcaaaactgtatcttaagcccaacagaaaagcatgct

SEQ ID NO: 17606 - DNA, 121 bp, Artificial Sequence
  Synthesized
  misc_feature (61): n=t or c
acacaggtggcaattgatgtcagacactttgcaccagcaatgttagtttgtgtgcagttcngaccacggggctattttaattttgtgtacagaggtttactaccaccttataaaagaagga

SEQ ID NO: 17607 - DNA, 121 bp, Artificial Sequence
  Synthesized
  misc_feature (61): n=a or t
gctgtgtcccatttgctgagcagcgttccgagctacgcccacctgtctgcagctgacaagntacccatggattgttgcagggatagagaattttatgatgatgctgtgctctggcttaaga

SEQ ID NO: 17608 - DNA, 121 bp, Artificial Sequence
  Synthesized
  misc_feature (61): n=a or g
acaggttctcccacacttgggcacaatgactataattttacttgtgataccaatgtccttntgtaaaaatcatttatctccatgtgaaacaattccagattgaaagtgttttttatgcatg

SEQ ID NO: 17609 - DNA, 121 bp, Artificial Sequence
  Synthesized
  misc_feature (61): n=t or c
tcctgagtcaaaaaataaatattggtctcctacatctcaatatcatttggtacttctgtgngcattaaatgataatccagccttcagtgtatattaaacactcgaatttatttcctagcct

SEQ ID NO: 17610 - DNA, 121 bp, Artificial Sequence
  Synthesized
  misc_feature (61): n=a or g
acagcacccagccctgggaaaacaaaccaagctatgaattgagaccatttcagaagttgancgttaggcatttgcaatgttagcttgaaattacccaaattcccaaataaaaactgtgaca

SEQ ID NO: 17611 - DNA, 121 bp, Artificial Sequence
  Synthesized
  misc_feature (61): n=a or g
ataaaacaaatctgccaagcagcgtatctcttcctgtagcatttccatagaacatacatgnaaaaagtcttctcagctctgcctgttcttgtttttttttttttcaggctacatctgtgag

SEQ ID NO: 17612 - DNA, 121 bp, Artificial Sequence
  Synthesized
  misc_feature (61): n=a or t
tgaagataaaatacacaaagctgaagcacatcctgcagcatatggaggctttaagacattngccaagctgcgacagattgggcaggtggagtagttaggttatcaaggaaatgtgaagtct

SEQ ID NO: 17613 - DNA, 121 bp, Artificial Sequence
  Synthesized
  misc_feature (61): n=t or c
cttcatagagcaagggtttggactgggtgacctctggaggtctcttctgatcaaaattacncagtgatgcttatgtatagacaaactgctgatgtccagatggagtgggagctctgtttac

SEQ ID NO: 17614 - DNA, 121 bp, Artificial Sequence
  Synthesized
  misc_feature (61): n=c or g
tatgtgctgtgacaaggctgctgcacgaggtggagggattagtggagtaagtattgttttncccttgtgaagtgaagaatttttcctgtagcccctcttgctatgcaaacgccatttcctt

SEQ ID NO: 17615 - DNA, 121 bp, Artificial Sequence
  Synthesized
  misc_feature (61): n=a or g
cactccagtccggtgctggaatcatctaaccacattgacgtattaaaaatcttctacctgnaggacctttctttttgttactttaggtttttttttccaaaacatgctgtaacaagcaagc

SEQ ID NO: 17616 - DNA, 121 bp, Artificial Sequence
  Synthesized
  misc_feature (61): n=a or g
cagcatttattcagagggcatgaggggaaaaagggctttcctgctctttcacctcatagcnttctaatccttatcactgaactgaatgagtctctgcatctgaccgtgttgctttaaaata

SEQ ID NO: 17617 - DNA, 121 bp, Artificial Sequence
  Synthesized
  misc_feature (61): n=t or c
cttggatcagaacagtgctgtgtacagcaagcgtgagctggtgcagtaaaaatgagtaagnctgagatgcagattaaggaatggaagctgtggcagaatgcattgcaaggtagggactatt

SEQ ID NO: 17618 - DNA, 121 bp, Artificial Sequence
  Synthesized
  misc_feature (61): n=t or g
gcagagctgaggtttgttttagggacatactgtcaggactcagaaacacaagaatccttcnaactgcttcttgttaattattatggtggggaatgcacatctctctgcttcagttacaagg

SEQ ID NO: 17619 - DNA, 121 bp, Artificial Sequence
  Synthesized
  misc_feature (61): n=a or t
ttccagcttaattttggttttcctttcagggaggtgagttataaacctggatgactggatncacctgctaacaagaactgagtgtcccctggggtgcctgctggacgagtgcaccgagcca

SEQ ID NO: 17620 - DNA, 121 bp, Artificial Sequence
  Synthesized
  misc_feature (61): n=t or c
gcagttaatgctctttagcctgtatgctgccaactttacctcccagaagtggcaaatcacncattaaatgatcaactggaaaatgccaaggcagactgtgatgagggtagaatagatgttt

SEQ ID NO: 17621 - DNA, 121 bp, Artificial Sequence
  Synthesized
  misc_feature (61): n=t or c
cccaatgcttcctgatagctttcaatgtctcaacctggaataattacccccaaaaacctcngcagtgagattgttccacgaggagcccttctgtaaagaagcttttaagcaaatggctctg

SEQ ID NO: 17622 - DNA, 121 bp, Artificial Sequence
  Synthesized
  misc_feature (61): n=t or c
ctgccctgaggtagggctggacagaatgagggtccggggcagggcacctgcagtactcacncactcccttgagcactgtccagcactgtcaactactgagaagcaaattctaagaaaagaa

SEQ ID NO: 17623 - DNA, 121 bp, Artificial Sequence
  Synthesized
  misc_feature (61): n=a or g
atacttgtgtagtacagcagaagacaatggaagacaataatgaaacgaagctccgcatganggagtacaaaagaataaggaatttgtagacagtcttcaaaatgtgttaacagcgaagagc

SEQ ID NO: 17624 - DNA, 121 bp, Artificial Sequence
  Synthesized
  misc_feature (61): n=a or t
tttacaattactgtaaatacctggagtttggtttttgatgcttatccaaaggctgttacanactgttgtattatgatagacaatacaagccgtaactcacagtccgcatctacatcaaact

SEQ ID NO: 17625 - DNA, 121 bp, Artificial Sequence
  Synthesized
  misc_feature (61): n=t or c
agcaagctatgttccagtgggggctggctgaagctatcttggcacagagcaagctgtccgntaagaggacacagcatctgagtgttgtgctggccaaaatgcagggtaaggtaaggaacta

SEQ ID NO: 17626 - DNA, 121 bp, Artificial Sequence
  Synthesized
  misc_feature (61): n=a or g
gcaaacactggataccaattctcatgagtgtttttaaaggtgcagaagttgggttttaacngtctgtaaagatggacattctttttctcttttctgcagctggaccatatagtggattagg

SEQ ID NO: 17627 - DNA, 121 bp, Artificial Sequence
  Synthesized
  misc_feature (61): n=a or g
cgttcgtaaacagaaatattaaggagctgcacatctcctccaggcaaaaattggttggaanaactaacaataatttgtcctttgtgaatgcagcgctgcagtcactgaaacatctcagtgc

SEQ ID NO: 17628 - DNA, 121 bp, Artificial Sequence
  Synthesized
  misc_feature (61): n=t or c
cacggcagcccaggaaactgtccccaggctgggacgtaagggacctcagggacccattacngagacctattagacataatattcatgcagagagcaatcagtcatatgttctgccagccat

SEQ ID NO: 17629 - DNA, 121 bp, Artificial Sequence
  Synthesized
  misc_feature (61): n=t or c
gcccacctaatggaatcttatctagatttatatatattgctggggaaaaagagcagcaagngctgtcagataattcacaattgcctatcccagcgagtagctgttgcctatcccaacttca

SEQ ID NO: 17630 - DNA, 121 bp, Artificial Sequence
  Synthesized
  misc_feature (61): n=t or c
tttgtcccagtaagtaatggaaaggacatcgttttgaaggcttctgcaaagaagcccactntgaattccagcccagagaattttcatgagctctagtttctgagtgattactccaaagtca

SEQ ID NO: 17631 - DNA, 121 bp, Artificial Sequence
  Synthesized
  misc_feature (61): n=t or g
ttgccttctctaattgtggagacatagactgcatccagaatattagtagtctgttgaaaanataaaaagtgctaggctgcagtttgacctctcctactgctgtagtgcagccagtatttca

SEQ ID NO: 17632 - DNA, 121 bp, Artificial Sequence
  Synthesized
  misc_feature (61): n=t or c
ggctactccagtgcagttaggttacttcatctcatcccactgtcctgcttcgtatctagtnctcacataaaatcattctgccagatccagaaagtcccattcttcaaaactgagcattttt

SEQ ID NO: 17633 - DNA, 121 bp, Artificial Sequence
  Synthesized
  misc_feature (61): n=t or c
tgtatgcagttatacccaatgcaccctgcaaatatataatgtgaaagcatttatcttctantactgttgctgtatagccatggctatagctatggctatggctatggttatggctaatcat

SEQ ID NO: 17634 - DNA, 121 bp, Artificial Sequence
  Synthesized
  misc_feature (61): n=t or c
ccatggaaggagatggctacgtacatgcctcgcttggcagatctgatgaatgccttaaaanaggttgtggtctccttttggagaaggttttgcttttgtaccattgaatgaaagtgatgag

SEQ ID NO: 17635 - DNA, 121 bp, Artificial Sequence
  Synthesized
  misc_feature (61): n=t or c
agcaagagtaaattacagagctgcaatgggaacactgggagaagaaactcattgcaaaagnctaccgggcctttctgatgaatgaaggctgagaacagggtttccttactgcagtaacatt

SEQ ID NO: 17636 - DNA, 121 bp, Artificial Sequence
  Synthesized
  misc_feature (61): n=t or c
tattccactgagattaactgtcccattttgaaagacagatccagcacagaagtaaaacagnccttccaagcagaccactcccattgctcccattccaggtgtgaaaaaaaatcagcattac

SEQ ID NO: 17637 - DNA, 121 bp, Artificial Sequence
  Synthesized
  misc_feature (61): n=a or g
agcaaacgcatgcatggagaatagtaatagaagatccagaataaggacagaaaaaccttangaaaagaaactgtaactgaattatgagggcttctccaaaggtaatgccttttatctaatt

SEQ ID NO: 17638 - DNA, 121 bp, Artificial Sequence
  Synthesized
  misc_feature (61): n=a or c
gctcactgcagaggggctcaggtagcaaacaaatctatctcggagactgcaggtgggacancaggaggagaggctgacaatgtgataggcagtgattctgatctttcctctttttccaaag

SEQ ID NO: 17639 - DNA, 121 bp, Artificial Sequence
  Synthesized
  misc_feature (61): n=a or g
agggaaggttggagagtctgctgcttctctcacagacatgtttttaacagcaacccacacntaagagcattttctgagctttgtttttccctttgtttgagaaggcacaagaaggtgcgca

SEQ ID NO: 17640 - DNA, 121 bp, Artificial Sequence
  Synthesized
  misc_feature (61): n=a or g
gtcctggtgcttaagtacacttcctgtacaggcaagaaccacaggacaaagatgggctgtnctgtgatttaggccaccagcatcgccagcctatacagctcacttactgaaatcactctaa

SEQ ID NO: 17641 - DNA, 121 bp, Artificial Sequence
  Synthesized
  misc_feature (61): n=a or c
taccagtttcggctacacctacaattgctggtgcaagtcatcacagtttatgaagggaaanaactcctataaatctcatttccatgcacaatatacatagcattaattttcttactgtgcc

SEQ ID NO: 17642 - DNA, 121 bp, Artificial Sequence
  Synthesized
  misc_feature (61): n=c or g
gaaaaataagactggctatgaaaggactgaaactcttacttgacttcagtgaaaattcaanctgaagcatttaatccaaacttagagtttttttcaagaagtgcaagttttctaaggaaag

SEQ ID NO: 17643 - DNA, 121 bp, Artificial Sequence
  Synthesized
  misc_feature (61): n=a or c
agaagcaagtcaatgctctgggttgggtgggattgctttcaaaatgctgcgtaattcctgnattgtctctgggttggaggtagggggtttctaagaggaatctctgtgtgcacccaaggtt

SEQ ID NO: 17644 - DNA, 121 bp, Artificial Sequence
  Synthesized
  misc_feature (61): n=t or c
gtttaaatgtctcctccctggagctcactgcaacacagtgcacatacatggcttcctgacngagggggaaggtggagatccacactcccttccttgcgagagaaaaattagactagtattt

SEQ ID NO: 17645 - DNA, 121 bp, Artificial Sequence
  Synthesized
  misc_feature (61): n=t or c
ttcttgctttactagatgtttaccgaaagatgcttaatggcaaccaagaagacaatggcangtagagcatgcaccaacatatacttaagtgctcagagcaacctgaatttccttcaaatca

SEQ ID NO: 17646 - DNA, 121 bp, Artificial Sequence
  Synthesized
  misc_feature (61): n=t or c
tctcccgtccagggagccctgcgccaggctttgcacttcttgcacatgcacttctctcacngaaggttttgctctctcggttttgttccctgacgtgcaaacataggtggaaggatcagaa

SEQ ID NO: 17647 - DNA, 121 bp, Artificial Sequence
  Synthesized
  misc_feature (61): n=c or g
tttattctgcaaatcacatttcagaggctttctcccatatggtgtgaaagcattttcattntctgagtcaatgaagtgactcctagttaattattcagaagtaattactttgtgcagtctt

SEQ ID NO: 17648 - DNA, 121 bp, Artificial Sequence
  Synthesized
  misc_feature (61): n=a or g
gagtgccattagtgctgctcctgcatggaaatctctatttattaaagactccgagctcacncctctcatctgtctcaaggtgtgaagattttgctagtgcaaagttgttagctgaggtggc

SEQ ID NO: 17649 - DNA, 121 bp, Artificial Sequence
  Synthesized
  misc_feature (61): n=t or c
aagacagagaatgcttcatctaacaggagcaagccaagcaaacagctctgtgataacccanctgggccacaccgtcagcattcaggtaccccaagcacttctgggcgcccattttggcaga

SEQ ID NO: 17650 - DNA, 121 bp, Artificial Sequence
  Synthesized
  misc_feature (61): n=a or g
gcccacagtgaccccctccccagcttcacgctccttgccctcgggggctctttgctccatncatccctccgtggttgtgctccctgtgctccagcaattttctgctctgagagcagaagga

SEQ ID NO: 17651 - DNA, 121 bp, Artificial Sequence
  Synthesized
  misc_feature (61): n=t or c
acatttgaaaacatgggaaaatagccagattaatccagagctaaattttcactgttggganggagttaaagtgattgcatcatttgccttttttaaaatcatatccaacacatagcacatt

SEQ ID NO: 17652 - DNA, 121 bp, Artificial Sequence
  Synthesized
  misc_feature (61): n=t or c
taatcatggatatcgttcatctcaagtacagatagtttgcaagatggcagggaaactgtanggggattgctttgaaaactctatcaatgtgttgcctttgacttaaagtttctgtagaaaa

SEQ ID NO: 17653 - DNA, 121 bp, Artificial Sequence
  Synthesized
  misc_feature (61): n=t or c
gaaagtaatatagtgacatcttccaggatactaattatgacacctggtctctattgaatanttcagacattgttaatactgaagacaatattcaaatagcaaaattaaaactcttgtgata

SEQ ID NO: 17654 - DNA, 121 bp, Artificial Sequence
  Synthesized
  misc_feature (61): n=a or g
gcagctattgaactactcacagaactcttgtattaaaacactatagactgtgacatctatnatctgattcactttcttaggcatcagggagaagagatggatgaagactatggcaaataaa

SEQ ID NO: 17655 - DNA, 121 bp, Artificial Sequence
  Synthesized
  misc_feature (61): n=t or c
cagggttgggctgtgcaggaggagccttgggaaggcaggtaaatagcagcaggcgaggaangctgctcctcaaagatcagcccctctgtgctgccgtgtgcctgctgcaatccttcctcct

SEQ ID NO: 17656 - DNA, 121 bp, Artificial Sequence
  Synthesized
  misc_feature (61): n=t or c
gctgcagggcatttttgtgaaatctgcttcattcacttagcgatttctgtcttcattctcnagtatcctctaacaagacagaatgcatgaaaacttctcttttgccccccactcaaatgct

SEQ ID NO: 17657 - DNA, 121 bp, Artificial Sequence
  Synthesized
  misc_feature (61): n=a or c
ctatttttcccactgatatttacccttttctctatgggttagcagtacttgtatccaacanaatgaaattattaaacatagtttaaaaagcagtagcttttttgtatgtctgatagcttca

SEQ ID NO: 17658 - DNA, 121 bp, Artificial Sequence
  Synthesized
  misc_feature (61): n=a or c
tcccatttgtactgaatttctttccaatttactttttcctctcccagcaagttcaattccnttttcaagacatttgatgcaagtcacccatatgtttactaatatttcagttcattctgct

SEQ ID NO: 17659 - DNA, 121 bp, Artificial Sequence
  Synthesized
  misc_feature (61): n=t or c
ttagttgaggatcaagcctggtaccactgttctttttcatagctgtttgtctctttaacangcttactgaaaaactgacagcagaatgtccagacttattcaagtccgttctcttgcagga

SEQ ID NO: 17660 - DNA, 121 bp, Artificial Sequence
  Synthesized
  misc_feature (61): n=a or g
aactgccccatagagcaataccagacccgaccgaatctgtgtccttctcttgtccatttanaaatcatcacacaatacaatggggaactagaggagcaaccatctccagcataaaaaacca

SEQ ID NO: 17661 - DNA, 121 bp, Artificial Sequence
  Synthesized
  misc_feature (61): n=t or c
atgacctgtcctttttggaaaactgaaagttacgtcagtcttctgtggcagtgggttccanagcaccattctccatgattatttgcttcactttgtgatccagaagtactgccaattctct

SEQ ID NO: 17662 - DNA, 121 bp, Artificial Sequence
  Synthesized
  misc_feature (61): n=t or c
ggcacagaattagagacacactgaccattcaccagaattaagtcaagatcaaatttcttcntttcactgagaagaagcacagagtcagcctcctctacttggtccccagttatcacaaaat

SEQ ID NO: 17663 - DNA, 121 bp, Artificial Sequence
  Synthesized
  misc_feature (61): n=c or g
agcacgctggcgctgtggtgaggcccgtatggagagcactggcccagggacacctattcanagggatttcaggggctgtggacacccatatgggactccagaagcacagcatcagcaacac

SEQ ID NO: 17664 - DNA, 121 bp, Artificial Sequence
  Synthesized
  misc_feature (61): n=t or c
gagaacaactttcagaaagttaccacctgttagaatttgtcactgatagtaacaatatccnagaataatttatcatggccagcagaagctttatttgttcttgtatagtatcctccttcat

SEQ ID NO: 17665 - DNA, 121 bp, Artificial Sequence
  Synthesized
  misc_feature (61): n=a or g
gcataaatagatgactgcctcgtgtctaaaacattataaatgtatgtaataagagaaaagnactgcatggattcatgtcactggaagaattcttaagctgcataatgtaaagttaggtaat

SEQ ID NO: 17666 - DNA, 121 bp, Artificial Sequence
  Synthesized
  misc_feature (61): n=a or g
caacaactgaagtatcaaaccctcaggttcttttgctatagatcactgataatgcaatacnatgtgttatttggaaggcattggcttcagtggtagatggcagccctgatgggcattgggg

SEQ ID NO: 17667 - DNA, 121 bp, Artificial Sequence
  Synthesized
  misc_feature (61): n=a or g
taagacagccaaattttatgctaattacctgagcagaagtcaagcatgtaatcttctttcntaacacagcacttctgcataactggacaggaacatttaatgacatgaaaaatcagatact

SEQ ID NO: 17668 - DNA, 121 bp, Artificial Sequence
  Synthesized
  misc_feature (61): n=a or g
cttgatggatctttctattctcttccctatacagtattaggaaatagtgctcataaaccantccaattgaagcaagtcagaactggctcccagagccaaaaagaagaatggtcctcaataa

SEQ ID NO: 17669 - DNA, 121 bp, Artificial Sequence
  Synthesized
  misc_feature (61): n=a or t
accctgcactgcacacaggctttagaaaacccttgtcactgcaacttgattcctgctgtgnaatgagtcgcccagggcagaacacaggaagcaatttagttctgtgctgccctcctcactg

SEQ ID NO: 17670 - DNA, 121 bp, Artificial Sequence
  Synthesized
  misc_feature (61): n=t or c
ataaaaaactgaggtagctgttcactgtagcagcatggacttggatgagcttagcttgctnatgaacacacatgatggtctgtagattaggttttgccttctttcaatgaaatctttagtt

SEQ ID NO: 17671 - DNA, 121 bp, Artificial Sequence
  Synthesized
  misc_feature (61): n=t or c
gaaaacatcaaactttctctatctgaatacagaattttatgaatagatataatcctactancatcagttgtcaaaactgcacaatgtttatagaaaaaaactgagtatacaatatatcaag

SEQ ID NO: 17672 - DNA, 121 bp, Artificial Sequence
  Synthesized
  misc_feature (61): n=t or c
aactttctcagcctctttcagtctgacctttcagtcagaactccccgtttaatcagcctcntttttattacagtaaatcttgccatcgtggataagcttttgtagaattctgttctcaaaa

SEQ ID NO: 17673 - DNA, 121 bp, Artificial Sequence
  Synthesized
  misc_feature (61): n=a or g
aaccccaggagctctccaccagctagtccaggcaatgagccagctggtaagaatcaggccnatcaggaccactgcatgagccaggagaattgcctccaagagtcctccatctcccaccacc

SEQ ID NO: 17674 - DNA, 121 bp, Artificial Sequence
  Synthesized
  misc_feature (61): n=t or c
atggaatgggagtaaagacatgcaggatgtgtccatcactgtgttaaatgtcaccttgaangattcgggtatctacacctgtaacatcacccgggagtttgagtttgagattcaccggcct

SEQ ID NO: 17675 - DNA, 121 bp, Artificial Sequence
  Synthesized
  misc_feature (61): n=a or c
ttgacaggacggttcaggaatcgaggaggaacatgctctccctgttacaaaaccacccggnggtgcatgctcgaggtctggaacacaacaggttgacacgtttcatagcatgcagactttg

SEQ ID NO: 17676 - DNA, 121 bp, Artificial Sequence
  Synthesized
  misc_feature (61): n=t or c
aggcagctgtagatgggagtatgtccccattctctgccagcactggtagacaccgagggcngaatttgttcccatgccaagagaatatgcaaagcattttcgggcatctctaaaaactgct

SEQ ID NO: 17677 - DNA, 121 bp, Artificial Sequence
  Synthesized
  misc_feature (61): n=a or c
cagttaacccttccagtcacctgctcaaagtgattatttagcactcatcttcacttccttnataataagtcagccacatgctgcagatgaattgatttgctcagctacacaactgattaat

SEQ ID NO: 17678 - DNA, 121 bp, Artificial Sequence
  Synthesized
  misc_feature (61): n=a or g
gagaagcagactccacaacctccctgggcagcctgttccagagctgtcacgtccgtttcanatagacaactttaggaaaacaacaggcctacttgctcattctggatgagttcagctgcga

SEQ ID NO: 17679 - DNA, 121 bp, Artificial Sequence
  Synthesized
  misc_feature (61): n=a or g
agttgccgtgtattgcttagtatttgctttgtatgagagaatcatttaattgcctctgcanaagctgaagcattgggattagggttatgtcatttaaaaaatgcttcgtggtgagagggat

SEQ ID NO: 17680 - DNA, 121 bp, Artificial Sequence
  Synthesized
  misc_feature (61): n=a or g
cttcagcccagtactgggtcacttctaaggtactaaatgttctggtaactacattacaacnttgaaaaagtaccaccttcccttcaaaacagccaagtgtctaacatatgtttggtgcctc

SEQ ID NO: 17681 - DNA, 121 bp, Artificial Sequence
  Synthesized
  misc_feature (61): n=t or c
cctgttgtgatcagtgctctagtgcattaccattgtacgttactcagatttttatcagtangattctgtctccttaaagtagtgctttctgaattttggtctttaaccatcttcaggggtt

SEQ ID NO: 17682 - DNA, 121 bp, Artificial Sequence
  Synthesized
  misc_feature (61): n=a or g
cttctggaaataatacctttacccttccctttaaatttctcttctcttcacactgatctcngttcttgcatccttgccttcagttaaggaggcctcagctctgcagggcagaaatgttgcc

SEQ ID NO: 17683 - DNA, 121 bp, Artificial Sequence
  Synthesized
  misc_feature (61): n=t or c
tgtaacacctgcattttgttaaatgatttgttcaagtgagatttcagtaatgtaaaactangtatgtgtaatcattcaggtcaagttagattcagagcacttttaccaacttacttccagc

SEQ ID NO: 17684 - DNA, 121 bp, Artificial Sequence
  Synthesized
  misc_feature (61): n=a or g
ttcatacatacagatacacataatgttgcagattaaaaagtcaacatttacattcatcatngataatactgagattacacagctttcaccctcatggagtatgaaatcactgtgttaacca

SEQ ID NO: 17685 - DNA, 121 bp, Artificial Sequence
  Synthesized
  misc_feature (61): n=a or t
ggtgtttggccttgaaactataatatatgctgttgaatcagagtataatcttacttctttnctgttcttcactgttcataacactgcatccttctttaggaacagcagccaaacgaattgt

SEQ ID NO: 17686 - DNA, 121 bp, Artificial Sequence
  Synthesized
  misc_feature (61): n=t or c
ttcttgaactagagcatgaaaactctttcgctaatatgaccacattacataaatgacacantttaagcattttagtaagtttttatgactctgaggattttaggttttggttttattttgc

SEQ ID NO: 17687 - DNA, 121 bp, Artificial Sequence
  Synthesized
  misc_feature (61): n=t or g
ttttcaatttttccctttgccccatttttgaattccaacaaagctctattaacactctttnatttcagtgggttggcctcattatttttggcaagatacttgctgaggttacataatttgt

SEQ ID NO: 17688 - DNA, 121 bp, Artificial Sequence
  Synthesized
  misc_feature (61): n=a or t
ttatttttcataaacttacctctacactgaattacagtaaaaagaaagttgtaaggaaatngtatgattacacatattcaagtggtcaccattcaagatgtaatagcttatacctgttgca

SEQ ID NO: 17689 - DNA, 121 bp, Artificial Sequence
  Synthesized
  misc_feature (61): n=a or g
ccaggcagtgttttggatcttttctcattataccaattaattcaactttcaccatagggcntaactaatatttctggcctgtggatgttcctgacatctcagaatttgtcatctgtgccat

SEQ ID NO: 17690 - DNA, 121 bp, Artificial Sequence
  Synthesized
  misc_feature (61): n=t or c
tgccctccttttgttttcttatgaagagattatgtcactatttataacatgatgaatgctnattctctaagactgcatgtttttgggtcaggaaattatacccggttattaaattaaacat

SEQ ID NO: 17691 - DNA, 121 bp, Artificial Sequence
  Synthesized
  misc_feature (61): n=a or g
ctgctggttttttttttgtcctcatatttttgtcgaagtgtgtgaccgattgaggccgtgnaaggcaattcaggtctaggcagggatttcttactgacgaactactaattgccgcctcttg

SEQ ID NO: 17692 - DNA, 121 bp, Artificial Sequence
  Synthesized
  misc_feature (61): n=t or c
gcacgatagcgatgttttctgtttccaattcaatttctttccttgtaatccttaatactcngtttgctattgagtgctgagctgagttcttcatagaatcacaaagatttttttgtaaatg

SEQ ID NO: 17693 - DNA, 121 bp, Artificial Sequence
  Synthesized
  misc_feature (61): n=a or g
catcataaagattgactgcatttaataacagatccaatttggaatcccaaattcaaacctnattgtattggaaattgtagctcatcctaaatatgaggtgaatgcctaatggtggtgaaga

SEQ ID NO: 17694 - DNA, 121 bp, Artificial Sequence
  Synthesized
  misc_feature (61): n=t or c
agatgcttaacagcactaaaaaacgaaccatccgcacacccagttctgtccttatttcagngcagctctttgctaatgacacttcatggtgctcacgaatctccttaaccccagacaggca

SEQ ID NO: 17695 - DNA, 121 bp, Artificial Sequence
  Synthesized
  misc_feature (61): n=a or g
ttatttcatccaaatacataatctcttggatgggttcaattcttcccttctagatacctgntagggggaaagattccttacctggaggcacctggccctgttcagaaatgtcacaatatcg

SEQ ID NO: 17696 - DNA, 121 bp, Artificial Sequence
  Synthesized
  misc_feature (61): n=t or g
gtacacttaaattgtactgtatttatgcacatctaaagatttgcactgtagtttaaggaanatctatcctcatgccaaagacacttgggtagcacttagaaattatcacaatctcatcagc

SEQ ID NO: 17697 - DNA, 121 bp, Artificial Sequence
  Synthesized
  misc_feature (61): n=a or c
agggcatcccgacaccccaggtgggaggcagccatgcagcaatgggctcacatccctgaanggtctttgttcacaaaaaacatgcccagaagaagcccctctctctctagaggaaccaccc

SEQ ID NO: 17698 - DNA, 121 bp, Artificial Sequence
  Synthesized
  misc_feature (61): n=c or g
agagaacccaactgcagttgaagttgcatgctatggctgaaccaatacaacagcttggctntttggaaaagagtaatcccacccttacccattgaccctcccacctgcttagtttatccct

SEQ ID NO: 17699 - DNA, 121 bp, Artificial Sequence
  Synthesized
  misc_feature (61): n=t or c
cactccacaccggtttgcacgcccacgtgcaaagcccttttgcagccaacacattaaatcnattcaactctcattccgtgtcatgtgaagagctcttcctctgtatccagccatccaacag

SEQ ID NO: 17700 - DNA, 121 bp, Artificial Sequence
  Synthesized
  misc_feature (61): n=a or c
aagccacacagccagctcccaggaagcactaaagagttaatttcccctttctgacccctgnaccaaatgggatggcctcggtgtcctcctgatgtgctgctttctgttctttaatgaacac

SEQ ID NO: 17701 - DNA, 121 bp, Artificial Sequence
  Synthesized
  misc_feature (61): n=t or c
aacaacaaaaaaacattgcccttttcccctcctatgaggtctgtgttcaccctttgaacanagtgctcaggtgaaaaagttctggttttagctctttatgggagctgtagggtagtagaga

SEQ ID NO: 17702 - DNA, 121 bp, Artificial Sequence
  Synthesized
  misc_feature (61): n=a or g
aatgatgctgtgctgccaagctggctgtagcacacctggtttgtagggcagccttggatgnaaatgtccctgctgtggctgaatctgtgtgtgtgtccctcagtgtcaccccgatgtgcca

SEQ ID NO: 17703 - DNA, 121 bp, Artificial Sequence
  Synthesized
  misc_feature (61): n=a or g
gtcccttcctgaatccgctcacttgaaagtttaactctttcttctattctgcatattaccncagcaagctgtgacacttaagcaaaacaaagataacattctcatatgagcaacggatcag

SEQ ID NO: 17704 - DNA, 121 bp, Artificial Sequence
  Synthesized
  misc_feature (61): n=t or c
tgctgcaggcagtgtggtgggagggctgtcagcgtgcccagctgccaaaatagtgctgtanctatggttatttattccatgattgtatctgggcatggaagagacaagagactggggtcac

SEQ ID NO: 17705 - DNA, 121 bp, Artificial Sequence
  Synthesized
  misc_feature (61): n=t or c
tcaatatgtggaatcaggaaaaagcttatgaaggaatcaggctataaagaggttaaaatanttgtcccattgcacacacggtttattagaaacttgcccagttgttccagtgctctgctga

SEQ ID NO: 17706 - DNA, 121 bp, Artificial Sequence
  Synthesized
  misc_feature (61): n=t or c
tcttctgaggtttgcattgttgggtaaaaaaataaatgaaacactttggcttcacctttancttctacagacttttatgtaccttctctcaatacaagcaaagggcagtattgtgtttaag

SEQ ID NO: 17707 - DNA, 121 bp, Artificial Sequence
  Synthesized
  misc_feature (61): n=a or g
agacctccatgcttgagttgctttaagctccagtcttcctcaacacggatctgaaacctgnttttctaaagtaagacaaccagaagtctgtgccttttccacgtaaacattccatagtgga

SEQ ID NO: 17708 - DNA, 121 bp, Artificial Sequence
  Synthesized
  misc_feature (61): n=t or c
gtagggccatgtatatcacacgaccaatatgtcttccatcctaccccatttagtatatggnagaacagatactgacgctgctctgtgcccttgcagcaaagcaggaactcccctttttcta

SEQ ID NO: 17709 - DNA, 121 bp, Artificial Sequence
  Synthesized
  misc_feature (61): n=a or t
cattctcaagtccaaagacctacattctctcatttcataagagaatggtaggcatccccanccatttcagaggatttggatcagaagacctttaagacccccttccaacaggaattgttct

SEQ ID NO: 17710 - DNA, 121 bp, Artificial Sequence
  Synthesized
  misc_feature (61): n=a or g
gagatggggcaatgaattttcagccttcctcagccttacctgttccatttggcataacacnggtcagagcatacaggagtaacttaactgtatgttaagcactaatactgcctttctgctc

SEQ ID NO: 17711 - DNA, 121 bp, Artificial Sequence
  Synthesized
  misc_feature (61): n=a or c
ttagtggccctaatgtgcctcactttggttttccaatacccattcccataggcccaggagncccatttcaacccaggcctgagcacccagacactgtcagagggatgctgtagtgcaggca

SEQ ID NO: 17712 - DNA, 121 bp, Artificial Sequence
  Synthesized
  misc_feature (61): n=a or g
cacacatcctcgcctctccctgacaaccagagcagcaggtcttgagcttaattttcctttnaaggagcctcgtaatacagattctttcattcagctcttgaatcgtgtattcctgaaaggc

SEQ ID NO: 17713 - DNA, 121 bp, Artificial Sequence
  Synthesized
  misc_feature (61): n=t or c
tggctattctcagcagaagtcagaggagttctctggtagagcagcatttcaggtgcagtgnaatatcaacagcagcttcagaggttgataattttctttgtgatgtttcagcttgtttcct

SEQ ID NO: 17714 - DNA, 121 bp, Artificial Sequence
  Synthesized
  misc_feature (61): n=t or c
tttggagagtacctttcctcacagctatgtcaaacccctgaaggctatgtttattctgcantgttagaggctaatcatgtaacaatgtttaaatggctatgtttgcaacataggtgtccct

SEQ ID NO: 17715 - DNA, 121 bp, Artificial Sequence
  Synthesized
  misc_feature (61): n=a or g
ccagccattatgaaattgaagcaaactggatctgtggtttaggtgcaaagtctcaggagcncattaagcacattgcaaccacttgagctggtcatgaccttctgtctctgttgaccaatct

SEQ ID NO: 17716 - DNA, 121 bp, Artificial Sequence
  Synthesized
  misc_feature (61): n=a or g
gtattactcaagtgaaatagttgtttttttccaaggtgtcattatagaggacttcagtaanttttaatcagtttatggcaaaaccacagaagaattgcaacaaaatcaaactttcgtgatt

SEQ ID NO: 17717 - DNA, 121 bp, Artificial Sequence
  Synthesized
  misc_feature (61): n=a or c
tataccaaggagcagatcgagggggaaagaaaaatataactagaggaaaaagacaccaaangaaaagacttaggagaaaattaagaggtagaataggaaagaaaaatacaatgaagtgtga

SEQ ID NO: 17718 - DNA, 121 bp, Artificial Sequence
  Synthesized
  misc_feature (61): n=a or c
tgaaaaaatattttgatataacctgtacactaaaggtagattatatactaaaggttctttngggtgcttcttgccttgattgcaagcatcaaactaaaggtgatgtttcttttaagtaaaa

SEQ ID NO: 17719 - DNA, 121 bp, Artificial Sequence
  Synthesized
  misc_feature (61): n=a or g
atggaaagaattatcacatcacaacgtttcccatcaaagagatcaggaaaaagtctaatantcactagtcacctacagatactgggaaactgtgcttaacctgtatgaagagctctccaga

SEQ ID NO: 17720 - DNA, 121 bp, Artificial Sequence
  Synthesized
  misc_feature (61): n=a or c
aatgtcaaaattccccaacgttcaactgtttctttggttctacatgccataaacgtagggntgaagtcacactctgaagtgaaacaacattgtttgccacctcaggtgtacagaggtgctc

SEQ ID NO: 17721 - DNA, 121 bp, Artificial Sequence
  Synthesized
  misc_feature (61): n=a or t
tgtttaggagggagaattttctatgttaaatgcagggaatgtagaggctgaatatgctcangagcagaggtagacaatttcagataactgaaaacaaaatagattctaagtaccagttgct

SEQ ID NO: 17722 - DNA, 121 bp, Artificial Sequence
  Synthesized
  misc_feature (61): n=t or c
gggtttgatctggactagatttatcttttccttggatatacaacttgattaataagccaancaaattagtgtaagagaaaggacagactgaaatgatttattaagtcagctacagatgtgc

SEQ ID NO: 17723 - DNA, 121 bp, Artificial Sequence
  Synthesized
  misc_feature (61): n=c or g
caagacatctgacttccatacagctccacattcgttgtccagcactgagttgaaattcaantcttgcagagtggctggagccaaatcttccccaaaccattagtgaacgccttggcccatc

SEQ ID NO: 17724 - DNA, 121 bp, Artificial Sequence
  Synthesized
  misc_feature (61): n=t or c
tctgcctgaagacagcaaatagtttcaccatgtaatttaaggattacacctgctgaattantatttctacaccaaagatttttggaaaggtttggaaacatttaggaaatgaagaaaataa

SEQ ID NO: 17725 - DNA, 121 bp, Artificial Sequence
  Synthesized
  misc_feature (61): n=c or g
caggatgggaacctgatggctccagcacctctccatgtctgcgaaggtgcctgggacaaanctttgcctctcgagcagggtagaagagctcagtttatccccacttttcttcctcagccta

SEQ ID NO: 17726 - DNA, 121 bp, Artificial Sequence
  Synthesized
  misc_feature (61): n=a or g
ataccactgctgcactacaggagtcgtgggccttgccctgagagctcacattcacttcacntgcacaccactgagcttcaggaagctcagtgggtgtgtatgtaacagagaggagtatttg

SEQ ID NO: 17727 - DNA, 121 bp, Artificial Sequence
  Synthesized
  misc_feature (61): n=t or c
tttttttttcttaactacaagtatagttttagctgcatgactgctttaattctgaactgangaagatgcagagagctactcctggaggtgcagcatggagatagtcccttcctctctggac

SEQ ID NO: 17728 - DNA, 121 bp, Artificial Sequence
  Synthesized
  misc_feature (61): n=a or g
aattttgggccacaaatattgtgtgtatgtgaatacagagttcctcaaacaaatacacctnttcaatgagttgatgtttctgcaatggaaactgtgaacgttacagccaattcagttaatg

SEQ ID NO: 17729 - DNA, 121 bp, Artificial Sequence
  Synthesized
  misc_feature (61): n=a or g
tcgtttccattccccagaaacaaaaccgtgctgcagttcagttggtcagcctgatgctganaagccattgcagggacctgaaatgcctgcccgggctcctctgcggggctctgcctgatgg

SEQ ID NO: 17730 - DNA, 121 bp, Artificial Sequence
  Synthesized
  misc_feature (61): n=t or c
catctttggtactcgttttgctcctcatctttccaagtgtgctataaatttgtaacttaantatgctgcactatccctgcaaaagcattttcctacggtttaaacagctcttcctcccttt

SEQ ID NO: 17731 - DNA, 121 bp, Artificial Sequence
  Synthesized
  misc_feature (61): n=a or g
aaaaattataaaggaaatgctatgtattactgagatctgcataatgatgagattgacagancatccttcaaagagttaaaacaatcgtgcaaaaagagaatttaggtcttaaagaagatca

SEQ ID NO: 17732 - DNA, 121 bp, Artificial Sequence
  Synthesized
  misc_feature (61): n=c or g
aatttacaaaaaggaagcaatgcccaaacaaactgatagtcttctctaataaaatgactancttgctggatgaagcagtagatgtcttttgttttaactccaggaaggctttcaacaccat

SEQ ID NO: 17733 - DNA, 121 bp, Artificial Sequence
  Synthesized
  misc_feature (61): n=a or t
tagtctcctgcacagaaaatggccaacacacttattatgtatcagaaacataaggaataangataggcttttgcctttggtttcctaggcaaagttgaaaatggaaatgtaaagataaatg

SEQ ID NO: 17734 - DNA, 121 bp, Artificial Sequence
  Synthesized
  misc_feature (61): n=t or c
accagaactcccagcatcttctcctcaaggctgctcttaaggacttctactatcagtctgnatacatatctgatattgtcccaactcaagtgaaactgcacttggccttgttgaacttcat

SEQ ID NO: 17735 - DNA, 121 bp, Artificial Sequence
  Synthesized
  misc_feature (61): n=a or g
agcggggcacgctcccacccaccgccccctctgagctctcgcttagaaatcccttcagcantggaacaagcaagaggaattaaaaaaaagtcaggcaaaagctttacctgggatcggtacc

SEQ ID NO: 17736 - DNA, 121 bp, Artificial Sequence
  Synthesized
  misc_feature (61): n=a or g
tttcttaacttttgcatggttactttttgttactggcaaatttcagacttttggactagtntaattgttccagttcttggaggtccgaagtgtatgatttcactggcagtgaccctgaaga

SEQ ID NO: 17737 - DNA, 121 bp, Artificial Sequence
  Synthesized
  misc_feature (61): n=a or g
gttaaagggcaaattaggtgacttctgaaagctgtaggaattttacttagatagcaccacngcaaatcattgacttcagtcaaacatacactagagatcagcttctaaaaatgtaactcca

SEQ ID NO: 17738 - DNA, 121 bp, Artificial Sequence
  Synthesized
  misc_feature (61): n=a or g
caccaaatatgggcaaattccacgactttgaatttttaattttgaattgcacaactacttntgatcaagctatagatgacagcggtctgacaacagcaatgaataacagttaccacactgt

SEQ ID NO: 17739 - DNA, 121 bp, Artificial Sequence
  Synthesized
  misc_feature (61): n=a or g
tttaaatacgtgctattcttcctggaaggtacagaagttaaacagcctgaattgatttggncagcagacaggaactcggcagcactcagtgagagctcctccacgcagagcacttcagccc

SEQ ID NO: 17740 - DNA, 121 bp, Artificial Sequence
  Synthesized
  misc_feature (61): n=a or g
taggtttacacatgtgcccaatgtgattgcattttcattctgccaattttaggcagagatncaatttggggttacacttttgaaagcaaacaactcagatgcaaaagcccagtagattttc

SEQ ID NO: 17741 - DNA, 121 bp, Artificial Sequence
  Synthesized
  misc_feature (61): n=a or g
gcagtgttggactgtactgaccccaagctcagggtcatcttcttgaaatggacatcgtcantgttactgcagttcctctaccagagaaacaattgtatgcaaatacaacctactttgtctg

SEQ ID NO: 17742 - DNA, 121 bp, Artificial Sequence
  Synthesized
  misc_feature (61): n=t or c
aacttgtagactcttcaaaaatactttattaaatatgtagcttttcaagcattacaccttncagcccctcctggggaaaactatgtagtcagctcacttattttatctatgtaatatcaca

SEQ ID NO: 17743 - DNA, 121 bp, Artificial Sequence
  Synthesized
  misc_feature (61): n=t or c
catatgagactagccttctccctctgaccggctctccaacttccccctttctaatgttccntgggacattcaaactacagcacctatcaaaaccaatttcttttttttctcctgaaatagc

SEQ ID NO: 17744 - DNA, 121 bp, Artificial Sequence
  Synthesized
  misc_feature (61): n=c or g
agtccagtacctgtgaaccaagaaccctcactcctactattcccaaagccataacgtcctntggactgctccaaaacatagatttgtacacactaatgattctgaaacctgggacaactca

SEQ ID NO: 17745 - DNA, 121 bp, Artificial Sequence
  Synthesized
  misc_feature (61): n=a or g
ggacatttgctacagtgaaaccactccaagggaaggacccacaaagagcttgggaagaacncgtggagagatgattccttgcacctccccatcagccctccatgcacctcctttgctatgg

SEQ ID NO: 17746 - DNA, 121 bp, Artificial Sequence
  Synthesized
  misc_feature (61): n=a or g
gccatgaaggcaggggagcaattgctttaacttcaaacatgccaatatttgagtgagactntgcaagctggtaacgttttaatcatagaatcatagaatggcttgggttggaagggatctt

SEQ ID NO: 17747 - DNA, 121 bp, Artificial Sequence
  Synthesized
  misc_feature (61): n=c or g
acaaacagtggagtctgtatatttggtatcacagtgaggctttggtaacatcagaacttgntcctaaatcggtactctttacatgatcaggtaaatgtataaactgagtgttacaaaaata

SEQ ID NO: 17748 - DNA, 121 bp, Artificial Sequence
  Synthesized
  misc_feature (61): n=a or g
gatttcttgtgggcaaaatcccggttttcctgtcaataaagatgtcacactcacaagtccnctcttggttaacctcctacaaagtgatatatcagcaggacactttggtgtgaacaacaaa

SEQ ID NO: 17749 - DNA, 121 bp, Artificial Sequence
  Synthesized
  misc_feature (61): n=a or c
gcccatgtcttgctttacttgcatatattggcttttgcagaaccaagaaaacaaaaacccntccatatcagcctcattaatagacatagtgtcatataaaataatggctgaattaatttac

SEQ ID NO: 17750 - DNA, 121 bp, Artificial Sequence
  Synthesized
  misc_feature (61): n=a or t
attagcccagattaagcagatggattatgatgtctttttgagctgagcacacttggaatanctctgaggatgttcagttaatttgccgtagacaatcacacatacaatttatgaatctctg

SEQ ID NO: 17751 - DNA, 121 bp, Artificial Sequence
  Synthesized
  misc_feature (61): n=a or t
acacctttttctatttaagaaactttctccttcttaggaactcagtcattaagaaccctancaaggccagtaacctccaggtttcttactattttttgtatgaaaagcacttgtaatacca

SEQ ID NO: 17752 - DNA, 121 bp, Artificial Sequence
  Synthesized
  misc_feature (61): n=t or c
atcccggtaccttcagcagaacaatggagctacctatgtgagctgctgggaaccagcaaanggagcagtgaatgctcgcgggttattgttataaaggatgcacatctcagaggtgtgaact

SEQ ID NO: 17753 - DNA, 121 bp, Artificial Sequence
  Synthesized
  misc_feature (61): n=t or c
tcacataatgtcctactacaatttcatcagatgttaaaaagcaagactaaaggatgtaacngattttgagaggcaacagtatatgcatatcattaacaaggatgaattcatagtaacaaac

SEQ ID NO: 17754 - DNA, 121 bp, Artificial Sequence
  Synthesized
  misc_feature (61): n=a or c
actatatacagtccagccattcagagagcttcctatgattgtagaatttaggcattgtgcncaaggtgaaacctggaaaaatactattttttccttattatacataaaacttatctccact

SEQ ID NO: 17755 - DNA, 121 bp, Artificial Sequence
  Synthesized
  misc_feature (61): n=c or g
ataacatttggtataccagcaaacagcaaattccaagcccacctgaaactggttttgtaantgaagccagaacaagttatgttcacacctttcagcaaagaaggcctaaaaatgcttcaaa

SEQ ID NO: 17756 - DNA, 121 bp, Artificial Sequence
  Synthesized
  misc_feature (61): n=t or c
ggctacatggcactctcagggtgctttgagaattgggcaaacccatttctgtaatggctgntagagatggatagcatatcccatgggtcttcgcataatcccactgctcacctgcatgaat

SEQ ID NO: 17757 - DNA, 121 bp, Artificial Sequence
  Synthesized
  misc_feature (61): n=t or c
agtgagtggtcttgtgcttgaaaaatctctatcactgcttttcagcctgaatcctggcttnttcctcagttagcaaatttttattttccaaccctcaacaatcccttaattgagcttttgc

SEQ ID NO: 17758 - DNA, 121 bp, Artificial Sequence
  Synthesized
  misc_feature (61): n=a or t
tcagcaggagctgaatgatcttacctctcaggatctcttccagctgtattctctaaaagtntatgtatgaaaggtattcattacagttgatttttttcacccttttctgtaactaactgct

SEQ ID NO: 17759 - DNA, 121 bp, Artificial Sequence
  Synthesized
  misc_feature (61): n=a or g
aattgggttcctgatggtgagagaacagtgcgtgcagctgcaaagccgacatcagcatttngaaagctgagcgaggagaggaagcccacgtaaatgcagacctgttccctctgccagctct

SEQ ID NO: 17760 - DNA, 121 bp, Artificial Sequence
  Synthesized
  misc_feature (61): n=a or c
gagatgagttaatataagcaaaggctacagaggtttttaatgtcttatgaacactatcagngtatagataaatgttatctgtaaatggatatattttattatcaggggaccatagttccag

SEQ ID NO: 17761 - DNA, 121 bp, Artificial Sequence
  Synthesized
  misc_feature (61): n=t or c
tagtttgcacttaagtaggacaaatgcaccaataatgagaacgagaatgaacatttcttgnaatgctgcagaaattctgacagtattgaaggcaagaaaaaggtgtggtgaaagtgtaaaa

SEQ ID NO: 17762 - DNA, 121 bp, Artificial Sequence
  Synthesized
  misc_feature (61): n=c or g
gctttacaaagttccactgtgcttattttgcagactgggtctgttgttacttgagatgacncaaccagaggcagagcgttaccaactgacactacattggccatgcaagaagcatgtttaa

SEQ ID NO: 17763 - DNA, 121 bp, Artificial Sequence
  Synthesized
  misc_feature (61): n=t or c
gtattgcaacagaagagaataaaaagagttgaaaagaagtcataaatgtacacatgatatntatcccattttctagtagttactgatactcctgaatgcagagttgatctcatgtttcgta

SEQ ID NO: 17764 - DNA, 121 bp, Artificial Sequence
  Synthesized
  misc_feature (61): n=a or g
gctgtccttgacatattccaaatctccagtgttctagttaagtgaactcttactaacatgngaatgcatcaattcatggtaataccttctgttaccaaaatagtttgtgtttcaataaatg

SEQ ID NO: 17765 - DNA, 121 bp, Artificial Sequence
  Synthesized
  misc_feature (61): n=t or c
gacaaaaggactatgaaatgcctgagaactttgttcagagccttcccaccaacatggagcntgcgaaccaatgtgagctggtttctttctattatctgaaagaaacattattttcactgtt

SEQ ID NO: 17766 - DNA, 121 bp, Artificial Sequence
  Synthesized
  misc_feature (61): n=a or t
tattttatttacaaatttgggtttcttagaggttacttttgagcttattcttattttgggngttgtgcttcataacatgtacagttaccttcttcataattctgaagagagtaattgtcaa

SEQ ID NO: 17767 - DNA, 121 bp, Artificial Sequence
  Synthesized
  misc_feature (61): n=t or c
ttctttcacttacaagtgacaattacagaagtgataaaccttcaaaaatattgaatgtgangcctattgatggattactgccaggaaaaaatgtgaaatgcgcattactaaagtcagtagg

SEQ ID NO: 17768 - DNA, 121 bp, Artificial Sequence
  Synthesized
  misc_feature (61): n=t or c
gtgccacttggtaagtaaaatggagtgactgctgataatattccgacctacatacacgtgngcttgcctgtgaagacatacgatttttgttattaagtggacatgtaagatgttttaaatt

SEQ ID NO: 17769 - DNA, 121 bp, Artificial Sequence
  Synthesized
  misc_feature (61): n=t or c
ctaatcagtactatcagaatgagacaaatatagaatactttctgttacacgaagaacaatngtcacaaaaacttgcagtaatcatactgagtcttttgactcctacagagaaagtcttgtt

SEQ ID NO: 17770 - DNA, 121 bp, Artificial Sequence
  Synthesized
  misc_feature (61): n=a or g
tgaaatagaaatggtgcaaacaaaagtaagccatactttttagaagcagaagctatggttntggcatttttgtactctcatggcacctcaaagcaaggacttttgtttaccgaaatgcttg

SEQ ID NO: 17771 - DNA, 121 bp, Artificial Sequence
  Synthesized
  misc_feature (61): n=a or c
tattttcctgaattcctcacctgctcatgtaattggagtctcagtttagctggttttgggngcactcagaaatccccagggatttttttctggctgggctgaaatgctcttcctgcttgta

SEQ ID NO: 17772 - DNA, 121 bp, Artificial Sequence
  Synthesized
  misc_feature (61): n=a or g
gcctcattctcctcctacctaagacacacaaggccatctcatgcaatacaaaaattgatcngaattcatgaagttctttcactttccaacaggggttttgggagagtgttaacatgtttac

SEQ ID NO: 17773 - DNA, 121 bp, Artificial Sequence
  Synthesized
  misc_feature (61): n=t or c
cactcttaatgagctcagctttccttttcttaatttaaattaatgagggcagtataggtcngtctaccagaaaagtgtcattcatcgactgcagcagcactggccgagctgcagctgggac

SEQ ID NO: 17774 - DNA, 121 bp, Artificial Sequence
  Synthesized
  misc_feature (61): n=a or g
ctccactgacttcatgtttgtaatcactgcatatttagtgggcaatctactttgctgttantcaactgacaaagaaggctacacactgagaattattttccctttcagaaccattattaag

SEQ ID NO: 17775 - DNA, 121 bp, Artificial Sequence
  Synthesized
  misc_feature (61): n=t or c
agttgaatgatgtttcccagattctacatttattcttcactttgggttctaatccagcacngacgacaaggtgtaccacagctttgtacctatgctggacttacaaatctgtaatttgcaa

SEQ ID NO: 17776 - DNA, 121 bp, Artificial Sequence
  Synthesized
  misc_feature (61): n=t or c
agtagtatccttacatgcagcagctatgtcacagtctctagtgtatctcattttcacattngtggtatttctttgtgacacaggaatataactgctaggtacacccctgcttggaagggtt

SEQ ID NO: 17777 - DNA, 121 bp, Artificial Sequence
  Synthesized
  misc_feature (61): n=t or c
ggttgtggttttaggactgcttctaaactctgcttacgtgcatctcttccttttttccccnctttgcagcactgaccctatgcccattgggacctccaggctcgtagggacctcaggccca

SEQ ID NO: 17778 - DNA, 121 bp, Artificial Sequence
  Synthesized
  misc_feature (61): n=a or c
tcatgagcacagagcctgatccaaaacgtatttcccagcaattctgatgaactttggatcnggcttatgtatgcagaaagggatggattttcccttggaattgtttttagttacattccaa

SEQ ID NO: 17779 - DNA, 121 bp, Artificial Sequence
  Synthesized
  misc_feature (61): n=a or g
agaattttcttaattgaagcacaagtcatggcaaaaaaaatgctagaattatgaggtgacntgatacagccagcctcatgacaaggattgttaataatcatattattcgtctctaatactg

SEQ ID NO: 17780 - DNA, 121 bp, Artificial Sequence
  Synthesized
  misc_feature (61): n=a or g
cagaggaggtatgaggggacatggcggctgaatgcaggtgagcaaccatggcagcatcagnggcttttacttgggggtgctagaagcaggaaaattttaggtaggctgaggggagaaagca

SEQ ID NO: 17781 - DNA, 121 bp, Artificial Sequence
  Synthesized
  misc_feature (61): n=a or g
ggctcctgcccgtttttagctcaggtgtgtgcagaaccccgctgtttaaccgacgttcccnagcacggaagtttgaaggctcctgtgaatggcagggaggggggagaaggcctctcttcgg

SEQ ID NO: 17782 - DNA, 121 bp, Artificial Sequence
  Synthesized
  misc_feature (61): n=a or g
ggcttgacagtggaagatgcctccatttataatgaacatttaattctaggggatgaatagnagaaaacaataaatgtggaagaggtgatttctttctgctgtagtggttttcagttcacat

SEQ ID NO: 17783 - DNA, 121 bp, Artificial Sequence
  Synthesized
  misc_feature (61): n=a or g
aagatcaaagaatgctacacacatttctccttctgcacgtactgtcttttgaatactacanttactattaatcagtgctgatagagtgagagggtctcataagtactgcttctgtagtgtt

SEQ ID NO: 17784 - DNA, 121 bp, Artificial Sequence
  Synthesized
  misc_feature (61): n=a or g
ttaaaaaggagtgaaccagaggggagtagagggtgacaagtagttaaatttcaagttgatntatgttgatttctgtggaatctcccatggtcatctcatactgcctgtggaacattatccc

SEQ ID NO: 17785 - DNA, 121 bp, Artificial Sequence
  Synthesized
  misc_feature (61): n=t or c
atgaaacataacaaccattcacagcttgatctaaagcccaatgaaaataatggaaatatcnccacagactttggtgagttttgcattaagctttcaaacattatgaacaggaatactaaag

SEQ ID NO: 17786 - DNA, 121 bp, Artificial Sequence
  Synthesized
  misc_feature (61): n=t or c
ttgtctctatctcccagttccttttctttacctgacagtttaatgtaatgatgatgctgcngtatctcaccaatatgctcatagaatcacagaatggcctgggttgaaaaggaccccaatg

SEQ ID NO: 17787 - DNA, 121 bp, Artificial Sequence
  Synthesized
  misc_feature (61): n=a or c
ttactcatcacatcagtctgtaagcaacaatacaggatttgtttaatcccatgtgaactgnagacacgactcttaggttctgggcagtggcttttgcttccttctgattcctacactgctt

SEQ ID NO: 17788 - DNA, 121 bp, Artificial Sequence
  Synthesized
  misc_feature (61): n=a or g
ggtcgttaccctgctgtggggcacagagctgatgatgctggaggtggatcagggccacccntgctgcagtgagggcagtctgttcctttgccatggcacttttgtccccggatcacctcgt

SEQ ID NO: 17789 - DNA, 121 bp, Artificial Sequence
  Synthesized
  misc_feature (61): n=t or c
caagctataaatttatggtcacgggttccaaaactaatcaacagtgacatggtgactttanaaagcctctcccatctacactgggagagcaagaagtactcggatacagtccttcccctct

SEQ ID NO: 17790 - DNA, 121 bp, Artificial Sequence
  Synthesized
  misc_feature (61): n=t or c
tccagtttaactgcatgctgggtcgagaactgcttcctttcacctgctttaaacctgctgntgctggctgtgttggtgccctccagcttggtcagacctggagaacctccaggcccattcc

SEQ ID NO: 17791 - DNA, 121 bp, Artificial Sequence
  Synthesized
  misc_feature (61): n=a or c
ctatttgtcttagaaggcgattcgttgatttcttatagcaacactcacgtgccaaaatcanttcctgtaaccccaaagttgctgatggagaatgcaataaggaaagtgtattgcagataag

SEQ ID NO: 17792 - DNA, 121 bp, Artificial Sequence
  Synthesized
  misc_feature (61): n=t or c
ggtcattccttccaccccagtgtcaaaaacgtcccctcataatacacctgtggcaagaaangcaactgtttaaatggaaaagtagtacagggaatactatgcatattttaaaatgtattaa

SEQ ID NO: 17793 - DNA, 121 bp, Artificial Sequence
  Synthesized
  misc_feature (61): n=t or g
gctttttgtattctaggttcgatgtctgtaatttcatgtaaaaatatgttccaacacaggnagaatactggaatgtttgcttctttctgtggtccccatcattcaattcaaggttgcccac

SEQ ID NO: 17794 - DNA, 121 bp, Artificial Sequence
  Synthesized
  misc_feature (61): n=t or c
tttctttcccttttccatcagatctagcacttgcatgcagctcatcgttactaaccattangattcccctatgctttactgcattaaaactttgcttcccattgccttttggcaagacaga

SEQ ID NO: 17795 - DNA, 121 bp, Artificial Sequence
  Synthesized
  misc_feature (61): n=t or c
aaaaagcactttgttgataagcactactttaatggttcgatgaactaggtcttactgcaantatatagcattaatcatgtacatttcagtatcataaaatatatcttaaaaacactgccag

SEQ ID NO: 17796 - DNA, 121 bp, Artificial Sequence
  Synthesized
  misc_feature (61): n=a or c
atatccatatttttgatgagaaaaaacattaccaagctactccctgaaaacttaaataaanagtagagactatttgtaagaggcattccttgcttccttcttacctattatggtggtttac

SEQ ID NO: 17797 - DNA, 121 bp, Artificial Sequence
  Synthesized
  misc_feature (61): n=a or g
gaaatgaatgtgaagagctttatttacctactgctgtgactcagttattaatactgttacntacctcttacattcagcctataagtaaataaagggtatcaaagtgctgtagatgtaaata

SEQ ID NO: 17798 - DNA, 121 bp, Artificial Sequence
  Synthesized
  misc_feature (61): n=a or g
tctgttctttctgccatgcatgtaaaatctgtgtatctatagtggcaaatgaaacacaggnactagcagttttgcccatttttagtattccttctgacactgttttgacacagtccaactg

SEQ ID NO: 17799 - DNA, 121 bp, Artificial Sequence
  Synthesized
  misc_feature (61): n=a or g
agaattttgagccacacatcaccatatagccatactcacaactttaccccaaagaagtganattacagtctcaggtaccattcaaggctctattgatgaggacccttcaagaagtcacaat

SEQ ID NO: 17800 - DNA, 121 bp, Artificial Sequence
  Synthesized
  misc_feature (61): n=a or g
gttttcccattcattgacctctgccttcttcactgcctgaaacactgcgataccaaaatcntgattcgtgattgatttgggttagtgggggagtgtgttggaaggactgactgcccatcat

SEQ ID NO: 17801 - DNA, 121 bp, Artificial Sequence
  Synthesized
  misc_feature (61): n=a or g
agtgcttggttggaaaaagaaatctgagattgaggactatgggcgttccccatcaaaatgnatgcagtcaccttagctaaatacagcactgttggagtaagcattgttatttttcccagtt

SEQ ID NO: 17802 - DNA, 121 bp, Artificial Sequence
  Synthesized
  misc_feature (61): n=a or g
agtccagatttaaacagtctatagctgaaatcagtaatactcagatcttaataattttcangctgttttgtgactcagagattctgttgcatattaccaacaatcacaacaaccacttatg

SEQ ID NO: 17803 - DNA, 121 bp, Artificial Sequence
  Synthesized
  misc_feature (61): n=c or g
atcaggctgctttattaagtgaaaacagaatattcagcttctacaccaggcactcctacangatgctttcacttctcaaacattttcagctaaggctcttgacaccacatgaccagcacca

SEQ ID NO: 17804 - DNA, 121 bp, Artificial Sequence
  Synthesized
  misc_feature (61): n=a or c
actccgctcaagatccagcaaactcaatacccgaggaaattaggttgctaggatcccgagnttgtttattatgctctcaactttaattagctgtaagtaacatcatgtcagtgttctgcca

SEQ ID NO: 17805 - DNA, 121 bp, Artificial Sequence
  Synthesized
  misc_feature (61): n=t or c
gattaggtgaaccctgctttcaaaatgattgttgctctccgctgccagctgccaggtaacnagttaaatgacttaggcagccacatcttcactgagaatgcctaaggggcaagtgagctga

SEQ ID NO: 17806 - DNA, 121 bp, Artificial Sequence
  Synthesized
  misc_feature (61): n=t or c
aaaaagaaagcagaactgcagaactaaaggcttgagatctttttgacgatcccagcttcangccatactttccaatgcaaattacctctgaagtcaaaatggaaatgttcatgcatcccca

SEQ ID NO: 17807 - DNA, 121 bp, Artificial Sequence
  Synthesized
  misc_feature (61): n=a or g
tgggtcaattttttttcacttgatagagaaatgttctttaccatgagaaataaaattatanaagtagtaattgctaaggttctagtgagtagaagtactcttctagttaaccataacagga

SEQ ID NO: 17808 - DNA, 121 bp, Artificial Sequence
  Synthesized
  misc_feature (61): n=t or g
tgcgtttccagcagagcagtttaccaggtcttggttagataaaacctgtgtaaatacaatnaaagaagtaggaatcatgctttgtctatggaaccttttttctcgatacacaaagtggaga

SEQ ID NO: 17809 - DNA, 121 bp, Artificial Sequence
  Synthesized
  misc_feature (61): n=a or g
tagagaagtttttctgaatatccaacctcaagagcccttagaacagggactactcggcacntaagttaatactctggcactgccgagagagaatgtcactggcagacaatttgcttctcaa

SEQ ID NO: 17810 - DNA, 121 bp, Artificial Sequence
  Synthesized
  misc_feature (61): n=t or c
gctttcaattgagaacaaggctgctgagactgggatcttgcagcaagccattttacatcantctttcaccatcggaaagcaatgtgagagttggtaaaatgagctcaaaagaaatggtcca

SEQ ID NO: 17811 - DNA, 121 bp, Artificial Sequence
  Synthesized
  misc_feature (61): n=a or g
actgccaggtttacttttgtcttggagttgtatattgtgcctgtttctcacccttactaantagcatttttgtctggcactccttctattgaagtgatcttttcctgttatgcatgttcct

SEQ ID NO: 17812 - DNA, 121 bp, Artificial Sequence
  Synthesized
  misc_feature (61): n=a or g
catcatgatttgaacatcttttggaatggaatacacaatgcaataaactaccagacacatnaataaaatatattgcaagcattttgtgtcatctttttagaagggcaaattaatctttgtt

SEQ ID NO: 17813 - DNA, 121 bp, Artificial Sequence
  Synthesized
  misc_feature (61): n=a or g
ctggcttcttttattttgaagcaacttactgatttttgtgccatttgaaatattcctctanatgcagaaccttctattgttggaccaaattttgccctctgcttaaagtgtctggatagtg

SEQ ID NO: 17814 - DNA, 121 bp, Artificial Sequence
  Synthesized
  misc_feature (61): n=a or g
tacattctttttgccaagttttgtcgcagcagttgtttatgctagtctagttgaagtcttncttgtgaccagtagacttggtttttctgcaggtcttgcagttcatgtcccagacttgaca

SEQ ID NO: 17815 - DNA, 121 bp, Artificial Sequence
  Synthesized
  misc_feature (61): n=t or g
taatgcacttgatcccatacagtctaaaagatggaaatcccctcctgttctcttttttttntcttaatagcatcttccaggttccagcatcttctcccctcctgtgactccagctcctgtc

SEQ ID NO: 17816 - DNA, 121 bp, Artificial Sequence
  Synthesized
  misc_feature (61): n=a or g
atgtcatcaccaccaccaccagacttctttgaaaactatataatatcatctcacatagacnggaaagagcaaagctagtatgtttatttcatgtgatttgttaggctgaccagtgattttc

SEQ ID NO: 17817 - DNA, 121 bp, Artificial Sequence
  Synthesized
  misc_feature (61): n=c or g
caaatcccagaagtccccatacagctcagccctgtttcttgctctgaactgttccttaaanccttcagactgaaaagcaccagcacttccctaacaccgctttgcccagatgctgttgggt

SEQ ID NO: 17818 - DNA, 121 bp, Artificial Sequence
  Synthesized
  misc_feature (61): n=t or c
tagagaaagctttaaaatatgcatccttgtgggacaagcaagaataaaatgtcatctctcngctctgaaaaagttaccacattgatttctgtttcataaaaatgaggttaagttgaatgcc

SEQ ID NO: 17819 - DNA, 121 bp, Artificial Sequence
  Synthesized
  misc_feature (61): n=a or g
aagaaaacaaagagtgctgctatatatatagccatatttggtgtttctagtgagatatgantaaatgaaaatgtattcttatgagttataatgcagtacaagcaagtctcaaggctctcct

SEQ ID NO: 17820 - DNA, 121 bp, Artificial Sequence
  Synthesized
  misc_feature (61): n=t or g
gctccactccagtgtttgtgatggagctctctcatgtcacctcccagtctgaggtgggatngtctttatagctcatgcttaaggcagtttaaagcagactcccccaagcccacgctcattc

SEQ ID NO: 17821 - DNA, 121 bp, Artificial Sequence
  Synthesized
  misc_feature (61): n=t or c
aattcttttcaggtcttcagaaacattttattcttcaatgtattcctttaagactacttangactaagaccacataaaatgctaataaattgttcaagtctcaagcgctctttcagggtag

SEQ ID NO: 17822 - DNA, 121 bp, Artificial Sequence
  Synthesized
  misc_feature (61): n=t or g
gttttctttatgctggtaaagggaaaatggagcacatcagatgttaaatcattttggtttntagcagctgaattctcctccatctgaactattttaaaagctaagatatatccatataaac

SEQ ID NO: 17823 - DNA, 121 bp, Artificial Sequence
  Synthesized
  misc_feature (61): n=a or g
gaccaacacacaggcttctctggaaaacaaccatcaccatgtaatgctcattttacacttnttgatacttcagcatcttgtcttataaggtctaagtctggacaaaagtaagagtttcact

SEQ ID NO: 17824 - DNA, 121 bp, Artificial Sequence
  Synthesized
  misc_feature (61): n=a or g
tttgcagtgggattccccccccatcagcacagcctttgttttataacagtgcgctgctgcnagcctgcccaggactgggaaatcagttttatcctgatttgggagctcaggattccatcag

SEQ ID NO: 17825 - DNA, 121 bp, Artificial Sequence
  Synthesized
  misc_feature (61): n=a or c
caggctgtgtctgttaagtttctgtactgaacttcaccgagtcaaagccttgaaagtgttnttgtttaaataaggaagatgaaaaagctattgctgggagccagtatgcctgcaagagaga

SEQ ID NO: 17826 - DNA, 121 bp, Artificial Sequence
  Synthesized
  misc_feature (61): n=a or g
aatttccttagagggatggatatgattgaatttttttctttccattgcttaagaaaaaatntggcagaaaagcaaactttcttgatacacctatgctaaataccatatagcttctgtagga

SEQ ID NO: 17827 - DNA, 121 bp, Artificial Sequence
  Synthesized
  misc_feature (61): n=a or c
aataatatttgtgcgcaagttctaataataaatgctattattataaagcaagatggaattnatttgcctagtattttaaggtcgtattgtattctgaagcttacacctacaaaaattgctg

SEQ ID NO: 17828 - DNA, 121 bp, Artificial Sequence
  Synthesized
  misc_feature (61): n=a or g
catttcataacttcactctccggtccttctgttagcattttaaggcttgcctccattcacntaaagtcatgtttggccataaataagtcaatcacatgaacaaactgcaataacattttgc

SEQ ID NO: 17829 - DNA, 121 bp, Artificial Sequence
  Synthesized
  misc_feature (61): n=a or g
ttactgtaataccattgtttattggctattctcacccaacatccaaccaccctgaggtacncatcagaattccccatctctatgcacgatctaccaagtgcacccaggtccttgagcaaaa

SEQ ID NO: 17830 - DNA, 121 bp, Artificial Sequence
  Synthesized
  misc_feature (61): n=c or g
ataaactttaatccagagcacataggagtacctcaggaagatttaaaggtgttaccatttnactgaaaatgaagaagcctctaaaataatgttccctgcagggtaaatgattaacctactg

SEQ ID NO: 17831 - DNA, 121 bp, Artificial Sequence
  Synthesized
  misc_feature (61): n=a or g
ggatctactattcaggacatcctgttcatcccctggtttatattccttatatttacaacangatacctggtcttatcctgccctgtgtaatatcgcttcttcaaccaaggatttagcaatt

SEQ ID NO: 17832 - DNA, 121 bp, Artificial Sequence
  Synthesized
  misc_feature (61): n=t or c
agaatatgcctgttgctttacagcccgaagctcttgcatgaggacactgtactgattttantcctgcattacttcacttatgcagaaagaagaccaagatgcagacatgcatgaggaagac

SEQ ID NO: 17833 - DNA, 121 bp, Artificial Sequence
  Synthesized
  misc_feature (61): n=a or c
gtacatgtacatctgtgtacgtgtatatatttcagatttataaagcctttaagcagactanaacttattccttggtctggtttcctaacttcctttgcagtctaatatttgagattatagc

SEQ ID NO: 17834 - DNA, 121 bp, Artificial Sequence
  Synthesized
  misc_feature (61): n=a or g
aatcccagagtagggatatgcaactcactgcatctaccgggacttcatctttatcacaagnaagtgcagacacgggagctcttcccctgctctgccgcatggtgtggtctgagcactgcct

SEQ ID NO: 17835 - DNA, 121 bp, Artificial Sequence
  Synthesized
  misc_feature (61): n=t or g
tacacattagtttttttctcttctgctcttgctgttctttccatgagcaattgtgtgattntcagttgttcactagggtcaatccactacagcataaaaatattttactgtgctttttttc

SEQ ID NO: 17836 - DNA, 121 bp, Artificial Sequence
  Synthesized
  misc_feature (61): n=a or t
cactgttcacagcttattattacatagaagcacgtatctcttacctgaactgatgcagggngcttaaaacttaacaaggttatggatgggtgagattttctcctttgctttacttcacatt

SEQ ID NO: 17837 - DNA, 121 bp, Artificial Sequence
  Synthesized
  misc_feature (61): n=a or c
taacactgggaaaggcagacatattttgaccctgtatttctgagctctgacagcaatgtgntacagaattagcctggtgctgggacagctcggttcttccctccttggaccccacgtccca

SEQ ID NO: 17838 - DNA, 121 bp, Artificial Sequence
  Synthesized
  misc_feature (61): n=c or g
atataatccagttgattgcagcagctgaggtatgaatcctttggatgaatttgagcagcancacgagggatctccaggtctggaacgagaagcagagttgagggatggacactgcagcact

SEQ ID NO: 17839 - DNA, 121 bp, Artificial Sequence
  Synthesized
  misc_feature (61): n=t or c
ctgttgacttccccgattaattttcacccttcataatttcactacactattgtaccttaangatgttctacagaaattcctgctgctttaagcaccatgctccctctgataacatggaatt

SEQ ID NO: 17840 - DNA, 121 bp, Artificial Sequence
  Synthesized
  misc_feature (61): n=a or g
caaagaaaaaaaatgtcatatttgggttcagacatcaagagtttgaagcataacatgaacntgaaagcactataagcttataccataagaataaaattgtcaatgattaccaaagagaaaa

SEQ ID NO: 17841 - DNA, 121 bp, Artificial Sequence
  Synthesized
  misc_feature (61): n=a or g
ctacacaggagaggaagggtttgaagttagaataaaacacatctcagatcccagcagtaantctcactaggtatgatttgatagtcctgaaattgcattatggtttgttttatactgacat

SEQ ID NO: 17842 - DNA, 121 bp, Artificial Sequence
  Synthesized
  misc_feature (61): n=t or c
agaacaagtcatttgcatagaaggattttatccatttgagctcttcttaatgctttcaaangggctgtatttcaggctgaagagtcaagttttctcggggtttctagacctcgcctcataa

SEQ ID NO: 17843 - DNA, 121 bp, Artificial Sequence
  Synthesized
  misc_feature (61): n=t or c
cacttttctcactggcttcataggttaaagcacagcaaaagcaaatcacaatattcccatnacatcagctgatacaataatatatccacttgcaaaaaaaaaaaaaaaaaaaaaagggtct

SEQ ID NO: 17844 - DNA, 121 bp, Artificial Sequence
  Synthesized
  misc_feature (61): n=t or c
ggaggtgcgcagtaggttttgatgaagaccacagatatttgagatttttgctccacacaanctcaccagctccactgatgcaagtatcattagaactccccacatcacatcccagctcaga

SEQ ID NO: 17845 - DNA, 121 bp, Artificial Sequence
  Synthesized
  misc_feature (61): n=t or g
aaaccttccatcaaagttttgtcatgttgaaggtagatgacagaatcttacagtcactgangtcagaatgtgaaagtgtggcctcatcaatactgaatggaggtgaaggttcacttacctc

SEQ ID NO: 17846 - DNA, 121 bp, Artificial Sequence
  Synthesized
  misc_feature (61): n=c or g
gtactctgaacttaacctgaagctgccctgtttagccagaagtggtcttcccagaggaganaagaatagaggaggtcaccaagtgggcgcatgcagggctaccatagtgtatctaaggctt

SEQ ID NO: 17847 - DNA, 121 bp, Artificial Sequence
  Synthesized
  misc_feature (61): n=t or c
acattcaattttttttttcattaaagtaacagtcttcattttaaaacaaatcacttcccangttacagcagagaaaagattaagaagttacagctgcttaaggcatctgcactaccccacc

SEQ ID NO: 17848 - DNA, 121 bp, Artificial Sequence
  Synthesized
  misc_feature (61): n=t or c
aatggctcattcagtgcttaatggttgtgtaaggaattggcaggaacatgaggtggaaatnctgcccccagctctgctcgtcttgcatggtaatcataatgcctgactgagagacgtggtg

SEQ ID NO: 17849 - DNA, 121 bp, Artificial Sequence
  Synthesized
  misc_feature (61): n=a or g
tcagaaaataagctctattgaaaactgaatgttgatgtctctcatactgctgcattaaganctgaaatatctttattaaactgtccatggacaatgaaaccaaataacttatatagagact

SEQ ID NO: 17850 - DNA, 121 bp, Artificial Sequence
  Synthesized
  misc_feature (61): n=a or t
taacctatcctaacccaaagacaagaagaatatctaaatctgtctaaccatttgcaacacngttttaatgtcatctagtgatgtttcatgtgtgacaggaatgcatatcaacacaattggc

SEQ ID NO: 17851 - DNA, 121 bp, Artificial Sequence
  Synthesized
  misc_feature (61): n=t or c
tccatgttttgtcatcacacactatctaaaatggaagataatggagtgtggtgtgtattcngatgagtatttaacttgtttggataacagcatattcacacaaataccagagctttccttt

SEQ ID NO: 17852 - DNA, 121 bp, Artificial Sequence
  Synthesized
  misc_feature (61): n=a or g
aagtctgaattgaagcaagcatcatcaggaatcttcaaaacaaaatgcagctaagagacantgagagaaatgagaatacccactagtttcatagattcaatgctgtatgatggcagtgcac

SEQ ID NO: 17853 - DNA, 121 bp, Artificial Sequence
  Synthesized
  misc_feature (61): n=t or c
ttctgagcgctcgctgatgggttgcaggaggtgcccaaggagccgttcagcaacagctganacattagtaggaatctcacgatctccactggaaatccacccaattcctgggaactctgcg

SEQ ID NO: 17854 - DNA, 121 bp, Artificial Sequence
  Synthesized
  misc_feature (61): n=t or c
caggaatatgcaattattcagaagatctttccaaattacaaatgctaccatcgagatcttngttcaggtggtaactgatacatgagtggaaaactgcagagagcagagaaatctcaccgtg

SEQ ID NO: 17855 - DNA, 121 bp, Artificial Sequence
  Synthesized
  misc_feature (61): n=a or g
tttacacagaaatgacttacacagaaagactggcaattccaactcagtttgacctggtttnagtggctgacaaattttggagctgagactaactcaataacattgtgctttcagtgaaagc

SEQ ID NO: 17856 - DNA, 121 bp, Artificial Sequence
  Synthesized
  misc_feature (61): n=t or c
tggacatcagcatcagctgcagaacagacttgtggtccatcctcgggtgttgtgctgccanggttactgtgctgtcgtgccggagctcaaagctggttcagagctgttgtgcaagtgtgtg

SEQ ID NO: 17857 - DNA, 121 bp, Artificial Sequence
  Synthesized
  misc_feature (61): n=a or g
ggatcggctccagaacgctgtgatgaatcactgtttcacatccagacccttcctaaattcnccgtgaaacaccactacatccccttaaggacggccctcggcacatccacccaaagaatca

SEQ ID NO: 17858 - DNA, 121 bp, Artificial Sequence
  Synthesized
  misc_feature (61): n=a or g
attttgctgcttcatattgcaagatcttccagtgtattgccctaaaaaaatccatctgtanaagaacagaagcaaggcactttccccttcactttaattgtacctaaggctttttccttcc

SEQ ID NO: 17859 - DNA, 121 bp, Artificial Sequence
  Synthesized
  misc_feature (61): n=t or c
aacatcaccccaagactttcctttgtactttaaactgtactttggtttgctctgttctttnctgattgcctccagaactgaaagaacccagcagacatcttcagcatcacagtctttttgc

SEQ ID NO: 17860 - DNA, 121 bp, Artificial Sequence
  Synthesized
  misc_feature (61): n=a or g
tgaatcaaaaatgaaagatttttctgccaaattccaaaagtgactaagttatttaattaanccttgaccaatagttgattattctgtctgcagatgaagccagttagtcattcttgatcta

SEQ ID NO: 17861 - DNA, 121 bp, Artificial Sequence
  Synthesized
  misc_feature (61): n=a or g
catgaaaagcatttttagggacattcagagggaagctgacatccgctgagcatgttgcatnttttgcaatggtaaaggacacatcttctatctaacttgtatgcctgtgttttcaggtgac

SEQ ID NO: 17862 - DNA, 121 bp, Artificial Sequence
  Synthesized
  misc_feature (61): n=t or g
taagtctttcacaacctccaaaagctttttctggccacatatggtgagtcccatcaccgtntagacagtagtgcccttggtgatctagagatcacattctgttgactcactgagggtatta

SEQ ID NO: 17863 - DNA, 121 bp, Artificial Sequence
  Synthesized
  misc_feature (61): n=t or c
gtgtgagggatagtggcttctgagagggacatcagagcaaagtggcttatcattggtcaanttaaggcactgaggaggcaccaagatattgtaaaacaggggtctgtaggaaggaagggca

SEQ ID NO: 17864 - DNA, 121 bp, Artificial Sequence
  Synthesized
  misc_feature (61): n=a or g
tccttggatgacgatatggaaacacctaagtgcaggtcctctgcgcttacatggtcattgncaacatggagacaccactacatggtggaagggcgagaaacaacactctgagaggagatcg

SEQ ID NO: 17865 - DNA, 121 bp, Artificial Sequence
  Synthesized
  misc_feature (61): n=a or g
cttgcacaggacagcattcaaactggaggagctgggaatgtcaatgcacccagaatgtgcnctgctccttaatcaggttacacagcctaggctctttaatcagcattcgtcttgcatagca

SEQ ID NO: 17866 - DNA, 121 bp, Artificial Sequence
  Synthesized
  misc_feature (61): n=a or c
caattttttcccatggtgctcagtgaaatttttaaaagaatatgatagagaagtccaattntaatatcttccatggtgattatagaatattgaaaattattaactataatactgcttgtga

SEQ ID NO: 17867 - DNA, 121 bp, Artificial Sequence
  Synthesized
  misc_feature (61): n=a or g
atctttagactgcatcttattaacttggatatgtgatgttacctgagtaagtcttctcctnacttgctctaagcagttaacctattgcatagttgtctttattctcaggtacataaggtca

SEQ ID NO: 17868 - DNA, 121 bp, Artificial Sequence
  Synthesized
  misc_feature (61): n=a or c
gagctacctgtgaatgggaatggagtaatgggaagctgcattcagctttaaatagagcttnaaatggagtctggtggctcacggtgtatttccagctccccattctgccctgcgtggaaaa

SEQ ID NO: 17869 - DNA, 121 bp, Artificial Sequence
  Synthesized
  misc_feature (61): n=a or t
ctgctatgtgttagtattttggctgttcagaatgctttacagaattattgtgcagctgggntttttttccaaatcattcccatcatccactgtggaaaatgtttgctgctcaggtttagga

SEQ ID NO: 17870 - DNA, 121 bp, Artificial Sequence
  Synthesized
  misc_feature (61): n=a or g
ctgatgttcagtagcatccaatttacagcagccaatttgtcctggccttaagcatgctggnggtcgctgacttggccaactggagctctgcactttgatttaaccccgaggaaaaggcgct

SEQ ID NO: 17871 - DNA, 121 bp, Artificial Sequence
  Synthesized
  misc_feature (61): n=t or c
gcacaagagcaatgtctcctctcttccagaaaccttcttcacttctccctaaattaattcngtgcttgaaccgagaaacagtgagcaggcagctcagcagcacccagcttcgtgctctctc

SEQ ID NO: 17872 - DNA, 121 bp, Artificial Sequence
  Synthesized
  misc_feature (61): n=t or c
ttactcttgcattgatatgtttgaatattgatttgcctgaagatttgagcaatggacgttngttagatgggtggaagtcagaaatgtttcttttggataatattaaaatagcaagagaact

SEQ ID NO: 17873 - DNA, 121 bp, Artificial Sequence
  Synthesized
  misc_feature (61): n=t or c
tcaaaattaaacaagcactttgtttctaattggatatggaagcataaagtattttgtgtcnaagtttttaagtgattacacttgttcagatacatacttaagctgtgttttctcttttgta

SEQ ID NO: 17874 - DNA, 121 bp, Artificial Sequence
  Synthesized
  misc_feature (61): n=a or g
ggttagccctgtttctggcttgtgctgggtgtgaagtacctcaagaacaccccacatctcntgggtcacatgatggccccatgcagaactggaggtgactgcagcccttggtaaggtggct

SEQ ID NO: 17875 - DNA, 121 bp, Artificial Sequence
  Synthesized
  misc_feature (61): n=t or c
cacataatgtgctaagtacagcaatgtcaaaatgtcagtaagaatcacatgagataacatntcacaaaatggagtaaaggaaaggaagaaatgactggctaacctgtttctgcaccaactt

SEQ ID NO: 17876 - DNA, 121 bp, Artificial Sequence
  Synthesized
  misc_feature (61): n=t or c
gatttcctggcctggaatgttgattttccctttaatctgttgagattcctctttttcaagnaacagccttcaattgttcatattagtggaagaggactatataacatacagtgactgtccc

SEQ ID NO: 17877 - DNA, 121 bp, Artificial Sequence
  Synthesized
  misc_feature (61): n=a or g
cctctatttgaataaagcagagcatcagcatgattccagtgtgactttggattatacacangtaatttaaattatgcaagacgttcattctagcagactcagtgggagttctggggaggaa

SEQ ID NO: 17878 - DNA, 121 bp, Artificial Sequence
  Synthesized
  misc_feature (61): n=a or g
ggtattcttcctgtgaagagatttttttaaagactgaataaatctttactttttctttggnagcctataacatcattttggtctctaggtattactttgttgattgacttaagtgtgtttg

SEQ ID NO: 17879 - DNA, 121 bp, Artificial Sequence
  Synthesized
  misc_feature (61): n=a or t
gttgagccttaggccatgcggggtttgggagtgcactacataaactttctgtatatataantcagaatcagagcgtaaactgctactgcctgtaactagtagaattgcaggcagtttgttt

SEQ ID NO: 17880 - DNA, 121 bp, Artificial Sequence
  Synthesized
  misc_feature (61): n=a or g
tctcccacctcctccatagccaagcttcctgaggaggcaaatcaaagagtacatttactancagtatcaatagtatggcttccaaaacacaaagacaactgcagtgctgaagacacacaaa

SEQ ID NO: 17881 - DNA, 121 bp, Artificial Sequence
  Synthesized
  misc_feature (61): n=t or c
aaaacacagctccttatattgtgaataactaacataattttcactaatcagttgagacttncaggccaaatcatgccactatggtattattaatgacaaaagcagaaattaggataagccc

SEQ ID NO: 17882 - DNA, 121 bp, Artificial Sequence
  Synthesized
  misc_feature (61): n=a or g
tctccaccagccttcatgtggacttcaacagcactgaaaagcatccacctgagtttcaacntctcagagtaggcagaatccagaccgagtataatgtcctcttcaaggagcatcaggatgt

SEQ ID NO: 17883 - DNA, 121 bp, Artificial Sequence
  Synthesized
  misc_feature (61): n=a or g
ctggtatccctctgccagaggttcctagaaatcatccctaagtaagggagagggtgacganttgcataggtttgcccccaagactgtgtgcatgctcacctactgtggataagctgcactg

SEQ ID NO: 17884 - DNA, 121 bp, Artificial Sequence
  Synthesized
  misc_feature (61): n=a or g
tgactccacagcagtggcagagagcgccataaacgtgctggtaaacatgttgaagctcccngtctagaacaaggcacatagatggcaaatgcacttctggtgaaataattctgcggaggtt

SEQ ID NO: 17885 - DNA, 121 bp, Artificial Sequence
  Synthesized
  misc_feature (61): n=a or g
cagagacactgctgactattagagcactgtgggataactgttgtgccatgtttgaaagacntttttcttctggtgcatattgtgacagcttgggatccagattacgtgtgtgcattcctca

SEQ ID NO: 17886 - DNA, 121 bp, Artificial Sequence
  Synthesized
  misc_feature (61): n=a or t
gcagcatgaaggacagcaaaaaaagtataatggtctgcattccttccttgcataattagtngatatacatgaactgagtataataactgtgttatttgccccctaaacctgatccacagtg

SEQ ID NO: 17887 - DNA, 121 bp, Artificial Sequence
  Synthesized
  misc_feature (61): n=a or t
ccatgaagacaatcaatcgggcagccaatgagaaattgtttgttagtctgcagcagtcttnaaagcaaatatactgattctttttaaatgttatgaatgttgtgtatatagccttctaggg

SEQ ID NO: 17888 - DNA, 121 bp, Artificial Sequence
  Synthesized
  misc_feature (61): n=t or g
ttgagttaccatccctggcgacatacaagaagcatttagatgttgtagtaagggactaagntaggcaaaacaaagaggaaactgcccctgcacacagatgggataataatgccttgggaac

SEQ ID NO: 17889 - DNA, 121 bp, Artificial Sequence
  Synthesized
  misc_feature (61): n=a or g
ctggtagccgtggtgccagaggaagctgatgctacatattagaaagatgaaacattccccnaggatcctggaaacccacagcataactgatcatctgaaagaccagcagtaaagtgaaata

SEQ ID NO: 17890 - DNA, 121 bp, Artificial Sequence
  Synthesized
  misc_feature (61): n=t or c
gctgagtgtgggcagtgcttctgccaacgagcacacacgtccctcacagccatggggtttngcctacaggaaaggcttggagactgtcaggaacaggtagcagagagtcacttctatggga

SEQ ID NO: 17891 - DNA, 121 bp, Artificial Sequence
  Synthesized
  misc_feature (61): n=a or g
ttgtgtggatgcaacttaactgtggggatataatgcagctatgagatcattacccttttcngggagcaaacagcactgtgatgggcaacaatgggaggactaatgtaggaatcctaggtaa

SEQ ID NO: 17892 - DNA, 121 bp, Artificial Sequence
  Synthesized
  misc_feature (61): n=t or g
tatttgccatgaagcttttcagagccatttaaatgcttagctcttgctaaattcagggttnaatactgttgaaagtatgggtcttcctaagtactggggagaagaatctgtcttgaaggga

SEQ ID NO: 17893 - DNA, 121 bp, Artificial Sequence
  Synthesized
  misc_feature (61): n=t or c
aatgttcaaggaatgtaaagcagtttaccagacgatggagggtattttgcagaagcatcangtgaagtgagatagtactctgagcaacccccttttaatagtggagtggatttggggaact

SEQ ID NO: 17894 - DNA, 121 bp, Artificial Sequence
  Synthesized
  misc_feature (61): n=a or g
ctgtaaccatagggaattcagggtgtctgtttcctactcttaaaaaggtgatccctgctcntcttcaccaaggagataccacctttaccacctcttatctttttagtatgtaagggacaca

SEQ ID NO: 17895 - DNA, 121 bp, Artificial Sequence
  Synthesized
  misc_feature (61): n=a or g
tgtccacaggtgttcggtttgcagaagcactgcccattgccctaggagagagcagggatgngagctgattccctctcattgctcctcatggctgagccattactcagctacgtgggttcta

SEQ ID NO: 17896 - DNA, 121 bp, Artificial Sequence
  Synthesized
  misc_feature (61): n=t or c
aaaaatatttgaatgtgcagaggaaaggtgatggaagaacatttgtagttccgtaattagnactgtaatgatgttggccatttaaagttagttaaaaaaatggaactacaatttaatagca

SEQ ID NO: 17897 - DNA, 121 bp, Artificial Sequence
  Synthesized
  misc_feature (61): n=a or g
gggtttttacagatataaagttctgttatttttaatgtacaaatctaaaattttctgaggnagggttgtaacagatgtattatggtgtactcgggcctttttaaatcctgaactctgactt

SEQ ID NO: 17898 - DNA, 121 bp, Artificial Sequence
  Synthesized
  misc_feature (61): n=a or g
tacttcaaacaaataacacagaagcttctgaagactcttactgtgggtccggagcattcgntggaactagcatgagatctgtaactttaagaaatctaagctggcctcagaagtctcatta

SEQ ID NO: 17899 - DNA, 121 bp, Artificial Sequence
  Synthesized
  misc_feature (61): n=c or g
tatactaggggacaaggcatcagatgaaaaatcaaaaagtgaaaaacccagtgtagggagncttctgatagcccgtgatcaaacaagcaacatgatcctcggatatggatacactttgaat

SEQ ID NO: 17900 - DNA, 121 bp, Artificial Sequence
  Synthesized
  misc_feature (61): n=t or c
acctaccctgataattaatagaaaacaagcaaaacaaggcatcccagctcctcaatccttnctgacaccgaaagggtttaattctgatctgcaataagcctccaggctgagatttgtggat

SEQ ID NO: 17901 - DNA, 121 bp, Artificial Sequence
  Synthesized
  misc_feature (61): n=a or g
tgcagaagtatgtgggagaggtaagagccaattcctaatgaaacgtggagtgaatcacaancttccagttctggggatgaggcaccctagtcagtctaatgggtgaacgtactggcatgct

SEQ ID NO: 17902 - DNA, 121 bp, Artificial Sequence
  Synthesized
  misc_feature (61): n=t or c
cgtgctctgcagagcaccctgcagggcactgtctcagggctgaatatccccacatcatccnacaatggtcctctgctagcttctcttgggattccatctgaacttactacccctccataac

SEQ ID NO: 17903 - DNA, 121 bp, Artificial Sequence
  Synthesized
  misc_feature (61): n=t or c
ttatatatattgtctcaagtacttcacattttcagcccagtaagcagaaatgacttttctngatataagctctttttctgaaaaattatgtttttcaggaaggaaatattatgttttaagg

SEQ ID NO: 17904 - DNA, 121 bp, Artificial Sequence
  Synthesized
  misc_feature (61): n=a or g
tgatgttcatgatgttcttggagaaggtggccttgctgggacaggcaaagaagcgcaccancagctcaaaggagaaccagatgatgcacaaagtctccaccacgaagaaagggtcggtgaa

SEQ ID NO: 17905 - DNA, 121 bp, Artificial Sequence
  Synthesized
  misc_feature (61): n=t or c
gtgtgagcttgcttcagtgctggaacattttagagctcttttgtcttaaattgggtgtagnttagctgagagcattctatgtaggttgtaaaacactatgtactgataatgacctattaag

SEQ ID NO: 17906 - DNA, 121 bp, Artificial Sequence
  Synthesized
  misc_feature (61): n=c or g
tatggggaagaagtgctgtgtcttgacaccactagttctatgtgggcctttcctcagctantgcaaggatcctctaggcaggttatcattccctactaagtgaaacaggacattttcatta

SEQ ID NO: 17907 - DNA, 121 bp, Artificial Sequence
  Synthesized
  misc_feature (61): n=a or g
gaaagaaagatgcagtgttctttaactcccccaaaatgaacttggagtgagagctggcacntggatgcagctgtgatggaacaagcatgctattgaagtgaacagaaatggaaaaaaaaat

SEQ ID NO: 17908 - DNA, 121 bp, Artificial Sequence
  Synthesized
  misc_feature (61): n=t or c
attgcagcagctccatccttcgttttgagggagcggttgtgttaaatagaaaaggactcangggacctcacatccacgatgccacctttcctgcatctgtgagcaggagctgcagccaccg

SEQ ID NO: 17909 - DNA, 121 bp, Artificial Sequence
  Synthesized
  misc_feature (61): n=t or c
tccttagaatattcagctggagaatattaaagcaaagcattgagtttattgagattaatanggcagtgagtatgcaacatcttgatgctttaattagaacctattcattaggaaagtgatt

SEQ ID NO: 17910 - DNA, 121 bp, Artificial Sequence
  Synthesized
  misc_feature (61): n=a or g
gtgggtgactcatctcccacagcagatatttgttttccaataggatgaattaccattttcntatgtttctctcagtacaactgtgagtacagtggaggctaaggtgaacagcagtagagta

SEQ ID NO: 17911 - DNA, 121 bp, Artificial Sequence
  Synthesized
  misc_feature (61): n=t or c
ggcctcaccaaacaggccaggaaacgcgcctgacccctgtgcactgctaaagcagcagcangctttagtgttctgatttatcatcccttccccggtgcaggtttgagaagcaggagaggtg

SEQ ID NO: 17912 - DNA, 121 bp, Artificial Sequence
  Synthesized
  misc_feature (61): n=a or g
ctggaaaattgattattagctaagttttctgccagttcaataaagcagattaatacctagntgtaccaaaagaaaattagaagatgggaagctggcagaagagtgtttcttaaaaaatatc

SEQ ID NO: 17913 - DNA, 121 bp, Artificial Sequence
  Synthesized
  misc_feature (61): n=a or g
tgttagaaagcaaggtgagaatcttctggagcaaagacaattttgtctgcaattaaaaacntgattgaattctactcggattgagaaatattttctggaaatgtgtgtttaacttctggcc

SEQ ID NO: 17914 - DNA, 121 bp, Artificial Sequence
  Synthesized
  misc_feature (61): n=a or g
gcttgatttagtttttattttttttttactacgaatggaggaaaaatgaatcacatgagcngagtgtttctgcagcatcattcctccaatttcagatgtacagcatgaaagcagctgcagt

SEQ ID NO: 17915 - DNA, 121 bp, Artificial Sequence
  Synthesized
  misc_feature (61): n=t or c
ggactcgagcatattttgagctaatgaaatagcagtggcctgtactggcacggagggcatnttcctgtgggatgcttcatttcagtcttgctcacggtactttgacaccgcaaggtttcag

SEQ ID NO: 17916 - DNA, 121 bp, Artificial Sequence
  Synthesized
  misc_feature (61): n=t or c
ctagagactattggcatggaaaattaagagggatttttctggggagctgcctgaaggcatngcctctgtcttggccatatttatgcacacaaaaagaaccagaaacaggattgttggcctc

SEQ ID NO: 17917 - DNA, 121 bp, Artificial Sequence
  Synthesized
  misc_feature (61): n=c or g
cttcaaaatgcattgtttcctctaaaatgagattcctttagcaaaaatctcaactcacaangatgtacatcatactagtgccatcactaatttttttcattagaccagctatgctgtatgc

SEQ ID NO: 17918 - DNA, 121 bp, Artificial Sequence
  Synthesized
  misc_feature (61): n=a or g
cccctagatgtgtatctcactcggactgtggaaatgtaaaaaatagtgtgataggaaaagntagaaacatgaaaaccttagaaatgttactgtattatgtcatagtgtgagttgtgtgaaa

SEQ ID NO: 17919 - DNA, 121 bp, Artificial Sequence
  Synthesized
  misc_feature (61): n=c or g
gtatgaaaagctttagtgtttttctttcaagacagtacaggcatgaaagtcatctaagtantcttctagttttcatgctatcaaagccaagtttcacaaaaagatgtgagaagcatatata

SEQ ID NO: 17920 - DNA, 121 bp, Artificial Sequence
  Synthesized
  misc_feature (61): n=a or t
cactccaaatcagtttctccacgtactcttgatccatagcttcttgcctccttggtacacngcatcatctgatgtggatttttgatgcgtcccatgatgtcataacacacagtttggtggg

SEQ ID NO: 17921 - DNA, 121 bp, Artificial Sequence
  Synthesized
  misc_feature (61): n=c or g
agcagtactgagagctagcagctgtaacacacagcattttgtaaatgtggcatatgcagtnaccagcaacagctgatgttttgttagaagacctcaaagatgaggctccttgaaaataact

SEQ ID NO: 17922 - DNA, 121 bp, Artificial Sequence
  Synthesized
  misc_feature (61): n=a or t
aatcagcctctagagagtataacatgacttgaaaaagtacaattctccacgtaatagagcngcaatgaaagtatttgataactcaacttgaaagattagggggtctccagctttaaatgta

SEQ ID NO: 17923 - DNA, 121 bp, Artificial Sequence
  Synthesized
  misc_feature (61): n=t or c
gtccttccaaagaaacgaagggaaaaagaaaacccaaagaagtagattttgtaagtgcagngacacagtgctctgggatgctatcaccattggacacgtggtaccaagatgttggccccgt

SEQ ID NO: 17924 - DNA, 121 bp, Artificial Sequence
  Synthesized
  misc_feature (61): n=t or g
cccagaatgctgctactgatgagtctgtatgaaatctcaccctctgtgcaaggccagagtngtaccttgcactagcagctccttctgctggaggagttagccagcattgcactcctcatat

SEQ ID NO: 17925 - DNA, 121 bp, Artificial Sequence
  Synthesized
  misc_feature (61): n=t or c
cgcattgtgcttaaaggccagcacagattcatttgactatttgactccaacattatagatnatgaactcaagggtttcgtccttgagcaagtgctttacgtgccaaggaagtgtgaagggg

SEQ ID NO: 17926 - DNA, 121 bp, Artificial Sequence
  Synthesized
  misc_feature (61): n=t or g
ttggaaggggagggaggagagggtattttgggataatatgccatttttgtttagtgtaaantttatttcagttaccatttaaaaatttcagcattttaaagaaaacagagctgaaaaattt

SEQ ID NO: 17927 - DNA, 121 bp, Artificial Sequence
  Synthesized
  misc_feature (61): n=a or g
ttacttatttttcagggcagatttgagtattattggtgttaattctgaatttctaaaaccngtgatttgctagtgctgttctgtaatgccctacattgcctatctttgcttagaatttcat

SEQ ID NO: 17928 - DNA, 121 bp, Artificial Sequence
  Synthesized
  misc_feature (61): n=t or c
gaggacttttatggctgtgacagtgagtctaattacagctaatacgcctgttgctgaagtngtactccaattagatccttcgatcactgaggctgccataacagccatgctaatactgctt

SEQ ID NO: 17929 - DNA, 121 bp, Artificial Sequence
  Synthesized
  misc_feature (61): n=t or c
aaagcgcatgcatatttgaaatatattgtatgacaaaacaattcgctattattcatatggngcattatacctgatagaaaagtgataggaattgatagaaccaatacacgtactgcctgat

SEQ ID NO: 17930 - DNA, 121 bp, Artificial Sequence
  Synthesized
  misc_feature (61): n=a or g
gctaagtttaaatttctcttgcttctgaacaagccattgactttccatcttagccaccacngaaataaagagcaatttatattacatttctttcactttaatattattcagacttcataag

SEQ ID NO: 17931 - DNA, 121 bp, Artificial Sequence
  Synthesized
  misc_feature (61): n=c or g
gctcagcctgccttaggcgagggcagcctgcagggacaatgctctcctgccttcacatgtnccaacatcaaacaagcaagttcaaaaagcaatgcatcaactaagctgccaccccgatagc

SEQ ID NO: 17932 - DNA, 121 bp, Artificial Sequence
  Synthesized
  misc_feature (61): n=t or c
tagtcgctacagcaatttattcccatccaccagctttgtgaataatgtgacttgttttaangtgaggattattacagttcttattgctgtttgagggatgataactatttgaatttagagt

SEQ ID NO: 17933 - DNA, 121 bp, Artificial Sequence
  Synthesized
  misc_feature (61): n=t or c
aatacagtatcaaagcacccagagataaaagcagtcattatgcatcaatccatcagcaaanttagtgttaaagggggaccaaaatgttgcatgtttgcctcatttctgaaaaggttttaag

SEQ ID NO: 17934 - DNA, 121 bp, Artificial Sequence
  Synthesized
  misc_feature (61): n=c or g
cacagctcctttactatgctgatggattgctctttaagaaggatggaatgagagaaagcanagatttagaaggaatgaagaaaacccttacattatcaccctgctcacccatgccagcatt

SEQ ID NO: 17935 - DNA, 121 bp, Artificial Sequence
  Synthesized
  misc_feature (61): n=a or g
tgcagtaattactctgatacagtcctaccagtctgttaggggtctcacttctagctttccngtttgcatttggggagtcatgacattctcttatcttaagcacgaataaattcttctgaaa

SEQ ID NO: 17936 - DNA, 121 bp, Artificial Sequence
  Synthesized
  misc_feature (61): n=t or c
ttttaaataaagggaaatggcaaaaccctctcagagggacaagggatggttcagtcaggantcgtgtaagatgggccaaattcattttaactgagccactgagagcaccactcaggtccta

SEQ ID NO: 17937 - DNA, 121 bp, Artificial Sequence
  Synthesized
  misc_feature (61): n=a or g
gagcatttctcgggcagtaaaagtaatattgcattttatggaggtacagtagacctgcatncttgaggcaatattctgtcatgtcattcttccatgaccaaaatgctggagaaacatgtta

SEQ ID NO: 17938 - DNA, 121 bp, Artificial Sequence
  Synthesized
  misc_feature (61): n=t or c
attcgcagcagtcaggtgtagcggatcctgtctcatgggacacaaggaaccaagtctgtcncaggtcctgctgcacatgatgctgcacatgatctactcctctgcaaagcagcagtacagg

SEQ ID NO: 17939 - DNA, 121 bp, Artificial Sequence
  Synthesized
  misc_feature (61): n=a or g
tctgctgtttctctcatttccactaatgacacgttagattgcaaagcagacaggaggggantactacaaagaatattgttaacaagagctccaagtgaaattagtacaagataatgctttg

SEQ ID NO: 17940 - DNA, 121 bp, Artificial Sequence
  Synthesized
  misc_feature (61): n=t or c
cattgccaaattttatcatttttgttcaagcttaaaaatttactgttgctgtatgaaaggnttttgtcaacaaggaggtgaaaaatacatgttgagttctccttgtttccaataactgaaa

SEQ ID NO: 17941 - DNA, 121 bp, Artificial Sequence
  Synthesized
  misc_feature (61): n=a or g
ctgtaaataaacaactgacttttctgtaagtatgtatcttgcagctacataattcagtatngggcaatgtaataccattttacttcatcaattaacttccagcgttgcaggccttgtcaca

SEQ ID NO: 17942 - DNA, 121 bp, Artificial Sequence
  Synthesized
  misc_feature (61): n=a or c
agcttgcactctatactctgtggtttcctttggaaacagaattagctgaagacttaaccantgatttctgtagtatgaggctttcagaaattcagaacagaacagttcttcagggacataa

SEQ ID NO: 17943 - DNA, 121 bp, Artificial Sequence
  Synthesized
  misc_feature (61): n=t or c
tgctgttgcaggcagtcaggaagagactttggtctccctaatttcctattaagtatgcatngtcaggtgactttctggttgtatttcttggccaaagctgaaaccaaatgtagtttaagtg

SEQ ID NO: 17944 - DNA, 121 bp, Artificial Sequence
  Synthesized
  misc_feature (61): n=t or c
aagtcctggaggacagagaaaacggtgtgtgctgaatgcactgggcctgcagggacaggantcctgctggcgtcttcccacgtcccaatcaataatgattgaacagaaagtgataaccaat

SEQ ID NO: 17945 - DNA, 121 bp, Artificial Sequence
  Synthesized
  misc_feature (61): n=a or g
aaatcttttccattactaacttccattgggctggattacatttctctatttcaaaaactcnctttcagatcagagcatccatttaaggtctaactggagagcttttcaaccctcttgcctc

SEQ ID NO: 17946 - DNA, 121 bp, Artificial Sequence
  Synthesized
  misc_feature (61): n=t or c
ccgcccacaatcctctgatctccagagtatgtacctctctacagatacctgaagggacgtnggggtgaggtagggatcatcctcttcacctggctaataacaataggcaaagaggaaacag

SEQ ID NO: 17947 - DNA, 121 bp, Artificial Sequence
  Synthesized
  misc_feature (61): n=a or g
cttaagctctgaaagatgtaagaagtctctgaatttgtggtaacagctcctactctccccnggtaccagggctcatcctcagcctgtctgttcacagcctcttctatttgcagataacact

SEQ ID NO: 17948 - DNA, 121 bp, Artificial Sequence
  Synthesized
  misc_feature (61): n=t or c
caccacaatcatcactcagagcagattgctcttacactcatacagtcctgtttgtacacanagagaaaacagccttcgtcaaggtgtcttgaaagcagtcaaatgaactttcaggaacacc

SEQ ID NO: 17949 - DNA, 121 bp, Artificial Sequence
  Synthesized
  misc_feature (61): n=t or c
ttctaaaatgatattttcattatctatatctcagatgcccaaattatgtagctaatctccnatttttcctacagagacaatagaaaatcagattaaacagagggcaattctgaacactgaa

SEQ ID NO: 17950 - DNA, 121 bp, Artificial Sequence
  Synthesized
  misc_feature (61): n=t or c
cactgttgatggtgagctgtctgttgggttaaagcatagcactgtgagaagggcctccaanggaagatggaaaacggtgctttccaaggtccttttgtggctgccactgacaagctcacta

SEQ ID NO: 17951 - DNA, 121 bp, Artificial Sequence
  Synthesized
  misc_feature (61): n=a or g
tctgatttaaacttggcctattgtggtctatggctatgttggtgcccttggctgtagtcancagaaacaggcactatctgtctatacaaagattaattaaatctacatatgaaaatgaggt

SEQ ID NO: 17952 - DNA, 121 bp, Artificial Sequence
  Synthesized
  misc_feature (61): n=t or c
tagtagttaaaagtcaagttgatggttttctaacttaatgttaatccagacaatgttctgntgctaatacattcccagggacactgtgacatattcgactcctagatcataaaatgtactg

SEQ ID NO: 17953 - DNA, 121 bp, Artificial Sequence
  Synthesized
  misc_feature (61): n=a or g
tcctgagctctgacaggtagtagggggattcctgtcctcttcttcccgtaaatgcactccntggccttgcagcactgatgtcaaaatcctacacaattagactctaaagggtgatccagat

SEQ ID NO: 17954 - DNA, 121 bp, Artificial Sequence
  Synthesized
  misc_feature (61): n=a or c
atgcgagtgtgcttacggcagttcaacaaagtggattatgtaagaaaataaagcccatagnattataactattcaagtagttgaattattttctctcagactgatgcagaagatttaaaaa

SEQ ID NO: 17955 - DNA, 121 bp, Artificial Sequence
  Synthesized
  misc_feature (61): n=t or c
aggtctgctgaacaaggctgtaattcaggagaaaacctaccagtaagagctgccaatgcangtttaaagcactcgtgtaactgctttcacctgagacagatgggagcaaaaccatctctgt

SEQ ID NO: 17956 - DNA, 121 bp, Artificial Sequence
  Synthesized
  misc_feature (61): n=a or g
gctactaaaagaaggcacacatcagaagtgcttctgtgcttggagtaactttctgagcccntacagactgaataatcttctgattaaataaaactacttcttcatagtcaggggaacgttt

SEQ ID NO: 17957 - DNA, 121 bp, Artificial Sequence
  Synthesized
  misc_feature (61): n=t or g
cccaaaagcctttgattttatgcttttctgagacaggcttgtgaatcaaagctgcttgctnagtaagtcttatggcaaaaacatatctaaacagttctatggtctgaactgtttacccatc

SEQ ID NO: 17958 - DNA, 121 bp, Artificial Sequence
  Synthesized
  misc_feature (61): n=t or c
tctgcagtgcactaacaatgctttgtagctcccagagtgtgcaagctcagtgaatgacttngctccctagtgttgctttgctagctgtaacttggaggaatgagaaaagcagccccagaaa

SEQ ID NO: 17959 - DNA, 121 bp, Artificial Sequence
  Synthesized
  misc_feature (61): n=t or c
gagcagagccctcctctccgctaattccattccaccagcctgtcatcacgttgcaattgcngcttctaaaaggtttttctgccttgcttttctgtggctgagctcccctttctaacttctg

SEQ ID NO: 17960 - DNA, 121 bp, Artificial Sequence
  Synthesized
  misc_feature (61): n=a or g
gatcaggctgtatataactatacctggcaagcaggtataatttcaaaagcagaaccagcantgaaactcaggtctcctgattctcagacttgcatccaagtttgtagatttcactccttta

SEQ ID NO: 17961 - DNA, 121 bp, Artificial Sequence
  Synthesized
  misc_feature (61): n=a or g
tgctggtcccactcacccccttcacagtaaccctgacacaggattgaggagccaggaggcncgtgcaagggctggaggttttctgttgctttctgcgcatcagaagtgcctgggagcatgt

SEQ ID NO: 17962 - DNA, 121 bp, Artificial Sequence
  Synthesized
  misc_feature (61): n=t or g
ttggtaaagtgacatctcctttgtgagattgtttttcttttctttatgccttgcatttaancctaagaacataatctgctgaattttggataattattgaagctccttaatcatttttgca

SEQ ID NO: 17963 - DNA, 121 bp, Artificial Sequence
  Synthesized
  misc_feature (61): n=t or c
cttctggtagtttcagttctgccattaaaagacagtgttacaatactagcaatgtctctgngcccagaaaatgggtaaaaaagcagtaagctggcgaacagtggcccattagcccagactc

SEQ ID NO: 17964 - DNA, 121 bp, Artificial Sequence
  Synthesized
  misc_feature (61): n=a or g
gtgaatcagatgaacgatgccaggcagagaacgtgatgctggtaccccacaggaggcattntgatccatcaccagcaggcctgggaaggtccagcaaatactgatggaaatgcacagcctg

SEQ ID NO: 17965 - DNA, 121 bp, Artificial Sequence
  Synthesized
  misc_feature (61): n=t or c
aattctgaagctcaaggcttttcaaatatgtgttcagagccacatttttctgatgtagcantttgcagcagaagggagttctgctatgtagctgtttgtgaaacactgcaatataaataca

SEQ ID NO: 17966 - DNA, 121 bp, Artificial Sequence
  Synthesized
  misc_feature (61): n=a or g
tggactcccacaacctaatttcaacatgggaacaaaattatgtggcttaatacaacgttantaatcttgtgtgatactgcagaataatcacacctccaagtgtgaagcagcagcactgaag

SEQ ID NO: 17967 - DNA, 121 bp, Artificial Sequence
  Synthesized
  misc_feature (61): n=a or g
taccagtacccttaggccagtaggcaacggtgtggctaaggaaagcctcagccagctcacntcctcgctgatgctgcagaaatgaagtggaaacagccatgcggccatcaggcagtgaacg

SEQ ID NO: 17968 - DNA, 121 bp, Artificial Sequence
  Synthesized
  misc_feature (61): n=t or c
tcgcgattgtaagagaactcatcaaggttttggagtttcctggaactgatccctattcttntttgctttctctttttcattgtagctgcatacactgtgacctagatctgatgatgttatc

SEQ ID NO: 17969 - DNA, 121 bp, Artificial Sequence
  Synthesized
  misc_feature (61): n=a or g
gacatgctgagtaacctattcttcagtttaatttgtgatttatctgcattgccagttatgnatatcaatgtctctgtagaatatggaccacagttcacctttgcattaccaaaagccagga

SEQ ID NO: 17970 - DNA, 121 bp, Artificial Sequence
  Synthesized
  misc_feature (61): n=a or c
aacagaatctcatgtgaaaaatcatttttttacaactgaaatagcgaggatcatgggttancaaatttatctcactgaagcaaatttcatgctctgaagaatgttggcattgtggtacatt

SEQ ID NO: 17971 - DNA, 121 bp, Artificial Sequence
  Synthesized
  misc_feature (61): n=a or g
agaacaatgctccccaatttaaggagtattttcaccttcccttcagtacataaacaattantgaaaaatcagcacgacaaacagccccagtttgtcccccagaatacactgtctggtactt

SEQ ID NO: 17972 - DNA, 121 bp, Artificial Sequence
  Synthesized
  misc_feature (61): n=t or c
caacaaagcatggaagtggatcatctgtgatgaacttcttatttgagaagataggatgtcngaaaaaggaaggggattatttaagtgactccatgtttggaagaagcccaatttaagcaaa

SEQ ID NO: 17973 - DNA, 121 bp, Artificial Sequence
  Synthesized
  misc_feature (61): n=t or c
aaaccaacttaccccttccaatgaccccttccagcaacagctcaaggggagaacaatctcnatccagaaaaaaaaattgttctggcagctgctaacccttaaatgaggggtgaggaggggt

SEQ ID NO: 17974 - DNA, 121 bp, Artificial Sequence
  Synthesized
  misc_feature (61): n=a or c
actctgtagccctcatctgaatgaactcacggtagacttcaccaattcagttggaccagcntttcacctttggtatttaactatgatgttgtgagcagcagaacatatgcatgcacaagta

SEQ ID NO: 17975 - DNA, 121 bp, Artificial Sequence
  Synthesized
  misc_feature (61): n=a or t
tcataccacttactgtattcttcctatccagctctccaaatggactatcttctcttttccncttgtgtcaagctccatcctttagcttacttacatattcttcatgttcctcatttgtatc

SEQ ID NO: 17976 - DNA, 121 bp, Artificial Sequence
  Synthesized
  misc_feature (61): n=a or g
ctacacacaggatgaaaggtcacgccttatgtgccttcaaatgctaatatcaattaagtancagcttggaagaaatccccttctctgtccctgctgaaccaagcagcaccgctgcccgtct

SEQ ID NO: 17977 - DNA, 121 bp, Artificial Sequence
  Synthesized
  misc_feature (61): n=t or c
cagcagcctcctgccatagtctggaagccaagagttctgctaaaggaaggctcttttatanacagtctattcttaaactcctttcacatctactgccaaccacgattggaaactgaatatt

SEQ ID NO: 17978 - DNA, 121 bp, Artificial Sequence
  Synthesized
  misc_feature (61): n=t or g
aataataaaaggaattgcgatgagaaggtagtttactcgtggagatactcaagtataccanactcagtgattgcaaaatatcctatctatatacaaattctgcaccaaaacctgcaattgt

SEQ ID NO: 17979 - DNA, 121 bp, Artificial Sequence
  Synthesized
  misc_feature (61): n=a or g
aattgttgaataaaaaaagagtttgctctaggaaccaaaactatgttttgattgggatatnctgggatatttatggaaaaattcttttagccagaaaaattataataaactacatgctata

SEQ ID NO: 17980 - DNA, 121 bp, Artificial Sequence
  Synthesized
  misc_feature (61): n=t or c
tcaaatgcagatcagtttttccaaaaagacagaccagattcaacctgttctttcctgtcangtttgccagtcatttggtatcacaacattatttctgtccacactgtcttcctgacttcct

SEQ ID NO: 17981 - DNA, 121 bp, Artificial Sequence
  Synthesized
  misc_feature (61): n=a or c
ataaactcttgcccagtatgacagagcacgagtccagaccatctccattagtgttctgctntactagtgctctgccatgaaaaatggataccgagccttgttcttccccatctgtgctctc

SEQ ID NO: 17982 - DNA, 121 bp, Artificial Sequence
  Synthesized
  misc_feature (61): n=a or g
ctccagagcagctctcatcttgatggtgtagctgctgtagccacttcaatctgggtgggcngccagtgtatggggcctttctggtgtgtttactagaaaattatactaattatttatggct

SEQ ID NO: 17983 - DNA, 121 bp, Artificial Sequence
  Synthesized
  misc_feature (61): n=t or c
acaggatgtttgattttatttgttttgtgtggacacagccgttcagcaatccttcttcatngttgtagtgagggttttgatttcaatttcaagctggttttaatttccttcttggctatat

SEQ ID NO: 17984 - DNA, 121 bp, Artificial Sequence
  Synthesized
  misc_feature (61): n=t or c
gaaatgtagtctgagtcaaccaccatgactgttcacctaaattttttctgtgtccttagcngaaggttgttgctgaacagcaacttctctcttccaagatgtcctagcacaaaggatgttt

SEQ ID NO: 17985 - DNA, 121 bp, Artificial Sequence
  Synthesized
  misc_feature (61): n=t or c
tagtagtgacccatatcaggttgaattaaaaaaacagaattactgggtacctcaatgctgngagtggaatctaaggcactggatttgtattttcaaagtcacctgaagtgtatacattttg

SEQ ID NO: 17986 - DNA, 121 bp, Artificial Sequence
  Synthesized
  misc_feature (61): n=a or g
ctcacatttctctctgaattcagcctctacacagttctgaacctagagtctgacagctaangacataacaaacatgcagcactaaccctcagggtggttagaaatgcctgatttctcctat

SEQ ID NO: 17987 - DNA, 121 bp, Artificial Sequence
  Synthesized
  misc_feature (61): n=a or g
cccagttctgtgttgattagaaaaaacttgtgttaggaacttggaagaacatcttaaccanactgctaagatcaccaacagaacagacactaaatgagaatgcttgccttacagagagaag

SEQ ID NO: 17988 - DNA, 121 bp, Artificial Sequence
  Synthesized
  misc_feature (61): n=t or c
taagaaatgaaatgcatttgtttgctgtcactttttgatggcaaaccagtgattctgctangctttgaattgttaatgttatgtaaatttgaatatgatgttgctaagtcagtaacagtaa

SEQ ID NO: 17989 - DNA, 121 bp, Artificial Sequence
  Synthesized
  misc_feature (61): n=a or g
atcaacctacataggtacaatttgtttaaatttaaatttgctaacttgataccgagcagcncagcatcaggcatggattttctggcgtttgcaggtattgctgatagcctccacctcctcc

SEQ ID NO: 17990 - DNA, 121 bp, Artificial Sequence
  Synthesized
  misc_feature (61): n=a or c
gtcgcagcgccggggggagggcgggagggaggaactttgtgtaacctgggatttacctgcnaacttttgctgaacgcttcagtcggttttaacgctgcctcttttttcagtgccctcaggt

SEQ ID NO: 17991 - DNA, 121 bp, Artificial Sequence
  Synthesized
  misc_feature (61): n=t or g
catggggtatcctgcacatagatccaagcagatgccgggacatcctgcagaagtacccacngagggtttaggctttccaaggcacacaggtaagacaagcagtcttgctatctccttgctg

SEQ ID NO: 17992 - DNA, 121 bp, Artificial Sequence
  Synthesized
  misc_feature (61): n=a or g
atggagaaaggtagctgaaaaatgtggtagaaaactttggaaaatgcacttgtagctgcanactgaacattagaacacttaaaaaagagaaaaaggtgtggtgttttagggtgggattttt

SEQ ID NO: 17993 - DNA, 121 bp, Artificial Sequence
  Synthesized
  misc_feature (61): n=a or g
taccctgaattgcttttctgttatctacctctgctgttgaggtagttcacatagtttcttntgattgcagaagaagagtcaatcttggacatggtacagaaaaaaaaagctaatctctaat

SEQ ID NO: 17994 - DNA, 121 bp, Artificial Sequence
  Synthesized
  misc_feature (61): n=a or t
tacattgctaaggggaatactatgggaacaaggcataagtttaataaggatgtgtatggtntaacccagcaggtggcttagtatcacatactgttcactcagcccctttcacagtgtgata

SEQ ID NO: 17995 - DNA, 121 bp, Artificial Sequence
  Synthesized
  misc_feature (61): n=a or g
acacaacagaaagcaaagagcagtgccatttccttacatctgcagtgcaacttcaggaaanaaattgatgatgttcctttaacagcagaaggccttgctaaaggaaaggcaattgagagag

SEQ ID NO: 17996 - DNA, 121 bp, Artificial Sequence
  Synthesized
  misc_feature (61): n=c or g
gtttagatcactaaaaaaacaaaatgtcaaagcagggagatgctgtactgaacagacatanagagatgttctggttctatttacagctggtaagatttaacagcttattctgcagacaaag

SEQ ID NO: 17997 - DNA, 121 bp, Artificial Sequence
  Synthesized
  misc_feature (61): n=c or g
ccaatcaccagcacgatggagacatacagccccatgatcctgcaaggggatgggatgaaancaccttcgttcccccctcgccacgacccccagctccctcccctgcccccctacgcaccca

SEQ ID NO: 17998 - DNA, 121 bp, Artificial Sequence
  Synthesized
  misc_feature (61): n=a or t
aatcttgctagtctatgactgcaaagaggtcaactcaaagcatttgtctacattgtatacngtgccatgatgcagcaaattatgacctacctgtaaaagactgatcagagtgctggaagct

SEQ ID NO: 17999 - DNA, 121 bp, Artificial Sequence
  Synthesized
  misc_feature (61): n=a or c
tgcgcactcctcctcatcttctctctctctgtgccacatggggagaaatcactgcctttcntcatgcgttaactttctgtttcttcataggcacgttgcattttggccttttgcctttttg

SEQ ID NO: 18000 - DNA, 121 bp, Artificial Sequence
  Synthesized
  misc_feature (61): n=t or c
aataactaaccaccaaatagagctcttaaggatatttggaagtaagtgtttgtttttctcngctgtttgccccaatattcaccctacaccgagtgccccaggcaaaagaaatcgctgtagg

SEQ ID NO: 18001 - DNA, 121 bp, Artificial Sequence
  Synthesized
  misc_feature (61): n=a or g
aatgttgaagatgggaacataggtagcttgggcagcatttttccacctgtattatcaattnaagggagaaattgttgcaggcccacctgttgatttataatgtgttgcagaaaaaaaaaca

SEQ ID NO: 18002 - DNA, 121 bp, Artificial Sequence
  Synthesized
  misc_feature (61): n=a or g
ttctgtttttcagtttggacaggcaggtgcatacgacagcttgtctgatatgtgtattttngttgagattttatctttgctctgaagctcacataagaacattttgtgaatagactcatga

SEQ ID NO: 18003 - DNA, 121 bp, Artificial Sequence
  Synthesized
  misc_feature (61): n=a or c
agctgaacttgaaacaagtttgaggcttaacccactcactgctagatttccacaagttgcnatctgtggagtgtattaatatagagaaacaagtttcggactaactggccttgcaattatt

SEQ ID NO: 18004 - DNA, 121 bp, Artificial Sequence
  Synthesized
  misc_feature (61): n=a or g
tcatctgttctcttcactagattttcttttgtgaatcttctactttaataatctcaagagntattacacattagcacttcaattaatcactgaattggaagacagagataagtagagacca

SEQ ID NO: 18005 - DNA, 121 bp, Artificial Sequence
  Synthesized
  misc_feature (61): n=a or c
ggcaggtcacatctacaacctccacaccccaaagagtcacttcacagcccagcagttgcanagcattgcacacctgaggggaatcacaggctgatatcgaattcagcctggtcacacatga

SEQ ID NO: 18006 - DNA, 121 bp, Artificial Sequence
  Synthesized
  misc_feature (61): n=a or g
gagggaaactgcatgtagtctggaaggcaagcagacatgagagagaggtgacaacagcacntgtatcagagaggaggaaagcatgcaagaaagtgcatgcaagagggtagaaacaatatgc

SEQ ID NO: 18007 - DNA, 121 bp, Artificial Sequence
  Synthesized
  misc_feature (61): n=a or g
gagtgggagcgtgcaggctgctgggagccccaggctttgacttcagagttattctggggtncgagggaaggagtgagaatgtttgctttgcaaccaaaaagctacaggcgagcttcaaact

SEQ ID NO: 18008 - DNA, 121 bp, Artificial Sequence
  Synthesized
  misc_feature (61): n=c or g
gaatgtgcactgctgagttctcaggttgtgaactgatggactgtctcaatagaaataaagntgataagaaacacctggaaatcaacttctcaaagttattgattatcagtactcaaatcaa

SEQ ID NO: 18009 - DNA, 121 bp, Artificial Sequence
  Synthesized
  misc_feature (61): n=c or g
atcgtggtgccccagctaaatagtcgtttactaagctgtgtttttatgtactggtgctagntcttactttgtatatcaagttccagggttgagtggatacctctaattcttagaagtagct

SEQ ID NO: 18010 - DNA, 121 bp, Artificial Sequence
  Synthesized
  misc_feature (61): n=t or c
cggggtctttaggtacatacatgggaagtggaaagcatcggccacattgcagctctgtcanctgttagacaaagttatagcaaagtgtagtacctggaagctgaatctagacacataatta

SEQ ID NO: 18011 - DNA, 121 bp, Artificial Sequence
  Synthesized
  misc_feature (61): n=a or g
acactgtttggtgtactgcagggccttggctgtccaagtccaggaccagggcccttcacanaccggccaaggaagcaaagctcacccttatgggctccccacacaccttctctctctcatt

SEQ ID NO: 18012 - DNA, 121 bp, Artificial Sequence
  Synthesized
  misc_feature (61): n=a or g
aatttgctcacctggaaggcaaaaatgagtaacattttaattcattgcctcagcggcaganaagtgtaacatgggccagaaggagacagaaatttcattgcgtacaaaacactttttcccc

SEQ ID NO: 18013 - DNA, 121 bp, Artificial Sequence
  Synthesized
  misc_feature (61): n=a or c
tctcttctttatagtctcttcacactgatgaccaaattcatcatgtattcgataggaaganaaatgtctgcaatgcagaaagtgtatgtgttaggtgtttgggtttttttttgcatgattg

SEQ ID NO: 18014 - DNA, 121 bp, Artificial Sequence
  Synthesized
  misc_feature (61): n=a or g
tctttagtaaagtttggagaggttttttttatttattctgtttctaaagagcactgtttcngtgggcttgctttggagcaattcaacattacattatatatagattaagataagaaacagg

SEQ ID NO: 18015 - DNA, 121 bp, Artificial Sequence
  Synthesized
  misc_feature (61): n=a or g
gggataccatgtggtaagccttgggcagaatgatcaaaagctggaggtatttttcacaccntttctatatccttgtgatggatttttctggcattttcatgtgagatttggagacattttt

SEQ ID NO: 18016 - DNA, 121 bp, Artificial Sequence
  Synthesized
  misc_feature (61): n=a or c
tgtggtgactgtctgacggccacgctgattttggacagaaaaatctgcactctgcctttgnggggaggtggacagttgctgtaaagtgcaaaatgagatcatggcagttaggatccgagct

SEQ ID NO: 18017 - DNA, 121 bp, Artificial Sequence
  Synthesized
  misc_feature (61): n=t or c
gcaactgatgcacacagatagcattcactcctgaaaaccagcatccccacgtgacaagctngagtctactgagttgttaaccattggaggggctaattctgtcctgttaaaatccctcagt

SEQ ID NO: 18018 - DNA, 121 bp, Artificial Sequence
  Synthesized
  misc_feature (61): n=t or c
cagaagaaatgtagaaaatggaaatgctaaatggtctatctgcatgcagtaggaactaggntcaggatttctgaatgcttgggcttgatatgattaaatacagagcataactagtaaagat

SEQ ID NO: 18019 - DNA, 121 bp, Artificial Sequence
  Synthesized
  misc_feature (61): n=a or c
tcttatttttttagggagttcccattttaagtgttttttactccttactacctgcttattncttggagcaagtgtttccctgctcaattatttccttctgctctggatgcttcccagaaca

SEQ ID NO: 18020 - DNA, 121 bp, Artificial Sequence
  Synthesized
  misc_feature (61): n=t or c
ggtgttaggtgaggttattgtaatgaaaaggtatcattcagttaccagggtgaatggaacnaatactagctagaggagaaatcattgcagttcttattaatgagaacagcatgtgttaatg

SEQ ID NO: 18021 - DNA, 121 bp, Artificial Sequence
  Synthesized
  misc_feature (61): n=t or c
aaacctaaataaatgacttgtcttttttcttctcccaaactcatggttcttatgaaagcantgtgaacagttctacagatattgtgactttctcagttgttggcgctaaaagtgtcgcctt

SEQ ID NO: 18022 - DNA, 121 bp, Artificial Sequence
  Synthesized
  misc_feature (61): n=a or g
actttattcttaaatggaattggttgaatgaaaaggaattttagtctgagctatccattcnttctatgtccacagtcagattacaagtattcctctggacgaaatgtaataggcaaggaaa

SEQ ID NO: 18023 - DNA, 121 bp, Artificial Sequence
  Synthesized
  misc_feature (61): n=a or g
gctagtaaccttgtgcctaagttgcctatacattcactagagaatgacaggtacttttganggcttccaaaccatgcctgcatggttgattaagacatccaaaattaagcatatgagatgt

SEQ ID NO: 18024 - DNA, 121 bp, Artificial Sequence
  Synthesized
  misc_feature (61): n=t or g
agttttcttgggctagttgggatcttaccttgagaaggcgcatctgaaggctcactgtggnattcacaatctgtttgatcgatcggttcttgagaagcagtgctaaacagtgtcctgaaca

SEQ ID NO: 18025 - DNA, 121 bp, Artificial Sequence
  Synthesized
  misc_feature (61): n=a or g
tacagcttcctcattcactttcttttctccccatgctgtaggtgacagggagacagaggancaaggagcacttccaaagccctgctaagaaagcactgggaagaggaagcaacatttcctg

SEQ ID NO: 18026 - DNA, 121 bp, Artificial Sequence
  Synthesized
  misc_feature (61): n=t or c
acagatttaagaataacctcttgtctaaagaccttggtgaagctcgcgcagttggtctacnctggtcacatcatcttccttccccatctcttcagaactgccaggacaaaaactgttttga

SEQ ID NO: 18027 - DNA, 121 bp, Artificial Sequence
  Synthesized
  misc_feature (61): n=t or g
gctttacagcaggtaaggatgtagtgctgagaagtgatagtgatgatggttgccatgaagngagtgtttacagcagtctgcaattgcttttggatcaaagtcaatggatctatcagtcact

SEQ ID NO: 18028 - DNA, 121 bp, Artificial Sequence
  Synthesized
  misc_feature (61): n=a or g
ttcttttgcctacattaatgtgttcctctcaaatccaggttctctcactccggaagttgtnggtttagtactgcactgctggttttaatttgaactttcctgagtattagggattatcaga

SEQ ID NO: 18029 - DNA, 121 bp, Artificial Sequence
  Synthesized
  misc_feature (61): n=a or c
tactgaggatgccaaggatgccaaggatcatctgtgtcaagtaagacagcttattaacagntttgtttgtggaaaaaagatatgctctgaaacttactgtctcaaagtatgaaaatgtaaa

SEQ ID NO: 18030 - DNA, 121 bp, Artificial Sequence
  Synthesized
  misc_feature (61): n=a or c
actgtgtcaacaataagcaacaagaccagaatgaagaaccacctgcttaacctttctaacnctgtcaactacaatgtgagttacagacagagtttggtcataatagcttcaggtctcctta

SEQ ID NO: 18031 - DNA, 121 bp, Artificial Sequence
  Synthesized
  misc_feature (61): n=t or g
tattttgcaataatcccaggatttatctgcttgctgataatatgcttactttgaagtcttngagaatacaactctcacacactaagaaatcaagcaaatgaagtctatccttttaaagcct

SEQ ID NO: 18032 - DNA, 121 bp, Artificial Sequence
  Synthesized
  misc_feature (61): n=t or c
gaggctgggaaggaggacagggcagaaatagaacataaaaaattaatgtgttctggccacngaagccagtgttggcacatctttgcatggatcactctggacaggggaagtcacctaatca

SEQ ID NO: 18033 - DNA, 121 bp, Artificial Sequence
  Synthesized
  misc_feature (61): n=t or c
ccctttttttcagtaactgtcatggcaaaaccccactaaaatggggcagttgtaccaaacnagaggaacatcgactcttctctctgattgactgaaagattgatgaaaagatgtgctcggg

SEQ ID NO: 18034 - DNA, 121 bp, Artificial Sequence
  Synthesized
  misc_feature (61): n=t or g
aaataaaatcagtcttacaacacgttttatattatgttaattggtagcaactgaatattantctgccacacttactttctgatccagttccttcttgtgtaataaaattatttccccccca

SEQ ID NO: 18035 - DNA, 121 bp, Artificial Sequence
  Synthesized
  misc_feature (61): n=a or g
caatcttagtgttcaatctaaagtgactaccaatgtccactcctgttgttgtcagaacctncagaggcacagtatcatggctgctttgtatggaatctccacattctatttcttctgcagc

SEQ ID NO: 18036 - DNA, 121 bp, Artificial Sequence
  Synthesized
  misc_feature (61): n=t or c
gtttacagaaaactttactgtactcatctgaaagtgcctttggctatttcccctttgttcnagtagtttccccttgttctccttaccctggagagtgcgggtggtttgacattataaaaag

SEQ ID NO: 18037 - DNA, 121 bp, Artificial Sequence
  Synthesized
  misc_feature (61): n=t or c
actagatgtgcttggtttttaatgaattgaaggctgtatttctgcagattaagagctcagnttttatgttggattagtcactgtcaagaagtacgggactaacaaactagcaggtgaattt

SEQ ID NO: 18038 - DNA, 121 bp, Artificial Sequence
  Synthesized
  misc_feature (61): n=t or c
ccaagagggaaaatgggaaaattacagtaaattcactggctgaaatacacagatgtgtganaatgtttttgctatacagtccttagaatagcgtggtccttctgttactacctgagggagt

SEQ ID NO: 18039 - DNA, 121 bp, Artificial Sequence
  Synthesized
  misc_feature (61): n=c or g
caaaaaaagatggagttatgaaccaaacaagtcacctgtggaaagagaggggagttacttnagggatgaatctggtccattgttcatacgttaaaaaccatacaggtctaattccttttca

SEQ ID NO: 18040 - DNA, 121 bp, Artificial Sequence
  Synthesized
  misc_feature (61): n=t or c
ttaactgctgcttatctgtgcactgcaacaaagcatgagcttcagtaaaatttcagccttngaccgagcctagagctggaagctttctgcttctgttagactgattggttttgtgttcaca

SEQ ID NO: 18041 - DNA, 121 bp, Artificial Sequence
  Synthesized
  misc_feature (61): n=t or g
tgtttattagagcctggaaataaagtttctccttttaaagtaggcaaatccatgcggaatnaatcactctgattgttctttgatgtaagctactttctattgtgtggccaatgtgatctat

SEQ ID NO: 18042 - DNA, 121 bp, Artificial Sequence
  Synthesized
  misc_feature (61): n=t or g
agtgatggactaggtgaccttttaggattccttagaattcagctttttctccgtttgccantgaataccataatgtataaagggaacagggcaatttctgctctcggagctgttcttttaa

SEQ ID NO: 18043 - DNA, 121 bp, Artificial Sequence
  Synthesized
  misc_feature (61): n=t or c
tccctcatgcagaatctctgcaactgttccaatcacaactgctgagtatttctgtggtgtntgccctaaaaattatgcctgtcaagaaagagccaatctgtacagtcatcatgtgactgtg

SEQ ID NO: 18044 - DNA, 121 bp, Artificial Sequence
  Synthesized
  misc_feature (61): n=t or c
aaagatgatgtggctacagtaggttacatttcttatctttccacagtactgttctcatctntctttaacgctacctttggtcctgaaagtattgctgttatttgagaaatgaagcttcttt

SEQ ID NO: 18045 - DNA, 121 bp, Artificial Sequence
  Synthesized
  misc_feature (61): n=a or g
aggaaaaaaagcacatgtaaaaattgtgtttctatgtgtatgaatgccaggagaaactgantgtctatgcactcagctcaggaaatcaagagatgaaccatttctgaaccttttcttgtgg

SEQ ID NO: 18046 - DNA, 121 bp, Artificial Sequence
  Synthesized
  misc_feature (61): n=t or c
gaaatgctgttttaccagtttcccatgtacctaaacaacttctgaacttacataacagagntcaatagtaaactggacgcatgctaaatgtcagcatttattctgggggtgttgtgaatgg

SEQ ID NO: 18047 - DNA, 121 bp, Artificial Sequence
  Synthesized
  misc_feature (61): n=c or g
attttgatggggaaaaaaagatagtttcatagaaatagttcagatattttattttacaagnaacaattttctcttttggcagatggctggagaaaaagtttttagattctcagcaaaattt

SEQ ID NO: 18048 - DNA, 121 bp, Artificial Sequence
  Synthesized
  misc_feature (61): n=a or g
aaaactgcccttctagaaaaaagatccatcaaggtaggtgggtatgtgtacgcaggctatntttttaatgaagcagacttattggataattactacttgggaagaaatccttaaattgtta

SEQ ID NO: 18049 - DNA, 121 bp, Artificial Sequence
  Synthesized
  misc_feature (61): n=t or g
gggtgccaccagccccgatgcaaccttcacataatagagtcaaattgctcgttcccaattngttctctctatgcaaaagcccagtgtagagaagggaaacgagccagactcgctgtggttt

SEQ ID NO: 18050 - DNA, 121 bp, Artificial Sequence
  Synthesized
  misc_feature (61): n=a or g
gtatgccatgaatttgtgttacaatacgatacaaaaattgaaatgaaagtgattgattgtntcataggttttatcacaagctacataatgagtcaaaattgcttgttaagtttagtctaat

SEQ ID NO: 18051 - DNA, 121 bp, Artificial Sequence
  Synthesized
  misc_feature (61): n=a or g
ctcactcacccaatcaagaaaagaaaaacaaccctttcttttctggactgtctgcaaaagncttgtggacggctttaagaggcggccaagggatgcttctaagcacaaaaaaactatataa

SEQ ID NO: 18052 - DNA, 121 bp, Artificial Sequence
  Synthesized
  misc_feature (61): n=t or c
gaatattttttccactctttcctcctttcctgcacttcagcagccttatccaatctcgcantgcaatgaaatggacaactaaagctacagcatcccataccagtctgtatggaacagtgac

SEQ ID NO: 18053 - DNA, 121 bp, Artificial Sequence
  Synthesized
  misc_feature (61): n=a or g
tgtcttgtaattaaacaacctttaatcaagccctcgacagcatccatccaatcacagatcnggttctgcagatcttaatgcacaggaccactttcagttttactgcagcaatcattaagct

SEQ ID NO: 18054 - DNA, 121 bp, Artificial Sequence
  Synthesized
  misc_feature (61): n=t or c
tcttgcatctgttgcctcttttccagctagatattttggtgttaattaacagactttaagnttgttgactcagctattatttttagctctaaattatgcctacgtatgtaaaccatttctt

SEQ ID NO: 18055 - DNA, 121 bp, Artificial Sequence
  Synthesized
  misc_feature (61): n=t or g
cagctgaaggggaaatggttttctccatgtagtgcctgggtggttttcttgtgcagttccnttccttgccagccttgttacgggcactcagctttgttcctccccttctcttcctctactg

SEQ ID NO: 18056 - DNA, 121 bp, Artificial Sequence
  Synthesized
  misc_feature (61): n=a or g
aaacttcatagcttctgagagtatgctaacaaaagtattgtcctctttactattgtactcnggtttagatggcaaggtgttggtagctagggaactgccggggtggctctgtgagcagcac

SEQ ID NO: 18057 - DNA, 121 bp, Artificial Sequence
  Synthesized
  misc_feature (61): n=a or t
taggacttacatgggtaatgcattttccagttaaattgatcccactttttatatccttccntgcacttatttgaaatttcctttccaagtcttttaatgttttcaagttgaatgctgattc

SEQ ID NO: 18058 - DNA, 121 bp, Artificial Sequence
  Synthesized
  misc_feature (61): n=t or c
cacatccaaaaccccttccaggtacattccatgggtcactgttgcagacacaggcctgtcnagttgctgtactcaatactgaagcagtgtccttatttcacagccctctgtacttctattc

SEQ ID NO: 18059 - DNA, 121 bp, Artificial Sequence
  Synthesized
  misc_feature (61): n=a or t
ttcaaaacactgaacattgaagtcctgaaaggaatatagagagacgtttattgaaagtgangaacatatgcaacacaagaatgaacctggaataattgtaactagatttactctatatgat

SEQ ID NO: 18060 - DNA, 121 bp, Artificial Sequence
  Synthesized
  misc_feature (61): n=t or g
ttctgcctccacactgtggctcccaggctggataagacagcagaaaagtctcttggaagangctctacaggtagacaacacctcggagacctatctctccctcttcccagtccaaactgag

SEQ ID NO: 18061 - DNA, 121 bp, Artificial Sequence
  Synthesized
  misc_feature (61): n=a or g
tgggtttcgtccttacaaaacacacagagctcccaaactcctgcaaaggtagctcacaaanttcatgtaatttaggctgcatttcttgatgtatcccagctattttgtaaaggccagtaaa

SEQ ID NO: 18062 - DNA, 121 bp, Artificial Sequence
  Synthesized
  misc_feature (61): n=a or g
ttttgagaccaacatgtgaaatcattaaatatgctgctgtttctcactattctttatcacngggaattacaacacacctttcaacttgcaaaaatcttagttagagttaatttttaactta

SEQ ID NO: 18063 - DNA, 121 bp, Artificial Sequence
  Synthesized
  misc_feature (61): n=t or c
aaggggatgtactgacaagataattccctactggtacaagtaacggagtggactttgcttntttaacatctgagaggtgtccatgctcaaagccctaagagacagttgctgtcattctcac

SEQ ID NO: 18064 - DNA, 121 bp, Artificial Sequence
  Synthesized
  misc_feature (61): n=t or c
acccagcccaaagtgcagggacttcatgcaggctatggagcctcagtgcccatgtgttctnctagaaaatgaaagctagtgatgtgtattttgcttgcagattttacaggctggagctgaa

SEQ ID NO: 18065 - DNA, 121 bp, Artificial Sequence
  Synthesized
  misc_feature (61): n=t or c
ctcgtctctttctccagctgattgcaccttatgaatctaagacaagaaatgtgttctctcntggaaaagtgacagctaaattggtgcaagtgctatttacaattttttatcattccattgt

SEQ ID NO: 18066 - DNA, 121 bp, Artificial Sequence
  Synthesized
  misc_feature (61): n=t or c
gtcagtcttactgttctttaaaattccagcctttctataacatgattgtccaggttcactnaagtgtttactgtatctgactagagcatttaattagacagattaatgactgactctattc

SEQ ID NO: 18067 - DNA, 121 bp, Artificial Sequence
  Synthesized
  misc_feature (61): n=t or g
gaagcaatttgtaaaccatgtgctttgtaggtaatacaatatttttctcctctggagtccntcagtgatgatggttagcgtaaatgtatgagatcccatgcagatctttaggctaggatct

SEQ ID NO: 18068 - DNA, 121 bp, Artificial Sequence
  Synthesized
  misc_feature (61): n=a or t
accattcagcacaagcacacccaacagtgaatgcagataaatgctgcagttaaaaatcacngttggtgaacacaatcatggcatgttcttgtagcccttcttttgtgccattctattttag

SEQ ID NO: 18069 - DNA, 121 bp, Artificial Sequence
  Synthesized
  misc_feature (61): n=t or c
tgactgttatttcttactgacaggtttaccttgctcttagcaggttgatttttatgtggcngctttatacgtgattatgaaaacttttctactctaggagttttctccctatccctcgacc

SEQ ID NO: 18070 - DNA, 121 bp, Artificial Sequence
  Synthesized
  misc_feature (61): n=a or g
ctgcagagtgaaacatggaaaagctgtgggttttcttaacttagggaacagtttacattcntatcgtaaagctgtgttgttgtaacatcgttcttgtaaaccagactcccagtggtaggtg

SEQ ID NO: 18071 - DNA, 121 bp, Artificial Sequence
  Synthesized
  misc_feature (61): n=a or g
ttgagcctctttagatttgtttccatacgtcagcctcactaccttggccaatataaatgtnaaaacacgtactctgttcagttgcttgtccacagtatcactggcagtcatagaggaaatg

SEQ ID NO: 18072 - DNA, 121 bp, Artificial Sequence
  Synthesized
  misc_feature (61): n=a or g
ttcccctgagcacagagtcagcaatattgtaaattaccaaccaatcattgcaaggaggacngactggaaaaattgctaagtcggtagcacagatcgttttgtttggggtgcttcacttgcg

SEQ ID NO: 18073 - DNA, 121 bp, Artificial Sequence
  Synthesized
  misc_feature (61): n=a or g
actgtacgtatttcttgtagttaaagctccttaagagacataaaccatgaaatggtacacntaaaggcaatgctaagagttaaattgcaagaaggatatatacaagtttagaatatctatt

SEQ ID NO: 18074 - DNA, 121 bp, Artificial Sequence
  Synthesized
  misc_feature (61): n=t or c
cctgctccactgtgtgagtgaaggtcagcatctctccgcaggcacaggaattttagagacncggtgctgcttcagtgcctgtgtcacctggtcctgctgctgtgccctggagctggagggg

SEQ ID NO: 18075 - DNA, 121 bp, Artificial Sequence
  Synthesized
  misc_feature (61): n=a or c
atgtggatttctggtgcagatttgataaatgagctttcaaaagtaaccagcggtgaacccnggcccttaattctgatccccaacctggacttcaagtcacctgcatttcatttgggattct

SEQ ID NO: 18076 - DNA, 121 bp, Artificial Sequence
  Synthesized
  misc_feature (61): n=a or g
aatatgagacagcaaattgctcagcactaagaactaatataatcagttttctaacagcccnctagaatgccttgtcagctattatcacccaagctgtctcctctccggtttgggcagcttc

SEQ ID NO: 18077 - DNA, 121 bp, Artificial Sequence
  Synthesized
  misc_feature (61): n=a or g
tgtgccaaaatttatgtcaactgttgccagttttcataaaaattacattgctccctcaacnttcatcttcatgagaacaaaggaagtgcatttctggttcagaacagaaatctttctaccc

SEQ ID NO: 18078 - DNA, 121 bp, Artificial Sequence
  Synthesized
  misc_feature (61): n=a or c
gcctggcgtggagcttacacacaaatcagtttgtaaaagtgaaatattccttctgctaggnaaggagcactgtgagggccttccaaagctcctttgctagttttgcttacaatccacaatg

SEQ ID NO: 18079 - DNA, 121 bp, Artificial Sequence
  Synthesized
  misc_feature (61): n=t or c
ttattattttgacaaattaagaacacttcatactggtaaataactagtaacaagggagaanttcatacatgcgtacataaggaaaaagaaaataaaacaagcatgcagcacatacatttct

SEQ ID NO: 18080 - DNA, 121 bp, Artificial Sequence
  Synthesized
  misc_feature (61): n=t or c
tctctatgtatttaggtactggttttctctgagtccctagtgcctacagtgagaaaagcantgtgtgaccctctggaagaagtgagagaggctgcagctaaaacatttgaacagttgcact

SEQ ID NO: 18081 - DNA, 121 bp, Artificial Sequence
  Synthesized
  misc_feature (61): n=a or g
catctttcctataatttcaaagcatttcattttttgaacattttgaacatctttaaatacnttcaattcacatgcttcaaagcaacgaggaatttaagctagaaagaaacaagactatttc

SEQ ID NO: 18082 - DNA, 121 bp, Artificial Sequence
  Synthesized
  misc_feature (61): n=t or c
caggcgggacgcaaagcattaatttcaatagagaacatttccttcctgtgccttatctcgnttcctgccttcttaaagagtgccaccctctaataaatgcgagagcagacacggcttcagc

SEQ ID NO: 18083 - DNA, 121 bp, Artificial Sequence
  Synthesized
  misc_feature (61): n=a or g
tggcatagctggaatttgtggctgagtttcaccaataaaaaagcagcacatctctcttctncagcctactaacaggctggtttgcatgatgttagagctacatggtgagggaaaaatacag

SEQ ID NO: 18084 - DNA, 121 bp, Artificial Sequence
  Synthesized
  misc_feature (61): n=t or c
ttcttttgagaacgtatttaaatccacaacacattccactctattttgaacacagctttgnctcagctggtgtgaagagtgtccatccacagactaacatcttaatttcaacacagaagtt

SEQ ID NO: 18085 - DNA, 121 bp, Artificial Sequence
  Synthesized
  misc_feature (61): n=t or c
agcattgccagaatcctgacgcctacatgtcaaggaagaagagagatcccagagggcaaangtagctcacagtcccaagcaatgaaaacatatgtccacagtttatacagccgtgacacac

SEQ ID NO: 18086 - DNA, 121 bp, Artificial Sequence
  Synthesized
  misc_feature (61): n=a or g
gctgcttgcaagtcacattcaaaaacattggaagtgtgcgttttttgatagtctgccaganctgtatagatatataaccagtacggctacagcacatcataaaattttatttcctgtagat

SEQ ID NO: 18087 - DNA, 121 bp, Artificial Sequence
  Synthesized
  misc_feature (61): n=a or g
aatatatgcattgggtttctctctctaaaatccattcttaaatctacctactgaaattccntacagttttctttaattgtctggtatgtactacatgctctatttcaatcaaagcatcaga

SEQ ID NO: 18088 - DNA, 121 bp, Artificial Sequence
  Synthesized
  misc_feature (61): n=t or c
agtggcctatgactctttttcacttctaagaatctctcttttctagctaaatcttcagganagcttgcaaactatttgctctggagttgaaagtaaccttgaaaacactactccatagtag

SEQ ID NO: 18089 - DNA, 121 bp, Artificial Sequence
  Synthesized
  misc_feature (61): n=t or c
tcaacagtggaatcaagtgcaccctcaccatgtctttgggtgatgccaagctgtgtagtcnggttatcatgactgagggacaggatgacatccagagaaacctagacaggcttgagcagtg

SEQ ID NO: 18090 - DNA, 121 bp, Artificial Sequence
  Synthesized
  misc_feature (61): n=a or g
tttgttgctaagctctccaatacttaagcatgcatctctctgctgcaaggctcatagagcnttttgaaagctcccatacattgtatcccaccagtctttttggtgagaggtagaacggata

SEQ ID NO: 18091 - DNA, 121 bp, Artificial Sequence
  Synthesized
  misc_feature (61): n=a or c
aaaaaaaaaagaaaaaaagaaagctttaaagggggcatgtaaacaattaaaaatagaggtngagactgtgtgaaattttacagaggaatctttccttagcctgcagttactacaataccta

SEQ ID NO: 18092 - DNA, 121 bp, Artificial Sequence
  Synthesized
  misc_feature (61): n=a or g
atctgaaagataaacatgggtgtttctgcagcgtttagactgggtaatgctttaagactcnctgagatttccattgaactctggtttgtgggatgtgtttctacttgttaattaatttcct

SEQ ID NO: 18093 - DNA, 121 bp, Artificial Sequence
  Synthesized
  misc_feature (61): n=c or g
tttgtgacgaaatgtgcaagtggcaccatttgagttactgtggttaggaaagacaaatatntctgtggcagaaggctccaagagcattttgggggcagctcattgctttgcttccacaagt

SEQ ID NO: 18094 - DNA, 121 bp, Artificial Sequence
  Synthesized
  misc_feature (61): n=a or c
tgagggcattttaccagacagcagccagagctcaaccaaggtaagtgcacagcatgcatgnagtcactgcagagatcacccatactaccagccacctgtggtttgttgtgtacaaaaaaaa

SEQ ID NO: 18095 - DNA, 121 bp, Artificial Sequence
  Synthesized
  misc_feature (61): n=t or g
ggtaatttgtagtggcttatcttgtacatctttgaatatcaaggataacaattgcaggatnacattaaatggtgcacatatttttctatatttgaaaatttatgcctaaatcaatgcaagc

SEQ ID NO: 18096 - DNA, 121 bp, Artificial Sequence
  Synthesized
  misc_feature (61): n=t or g
ttgcccacccagggctctgaggtaggattttacctgaagcactgacttcaaaagctccttntcttttcctaaggggagaaactgacctctacggacagccaacattctgcaaagtgctcgc

SEQ ID NO: 18097 - DNA, 121 bp, Artificial Sequence
  Synthesized
  misc_feature (61): n=t or g
gatgaccagctaaataagcacagtttctttccgtattagatgcctggatcacacatccagntacaataagctgatccacagcgctttccgtcccgaataaatgtgatcttccatcacctcc

SEQ ID NO: 18098 - DNA, 121 bp, Artificial Sequence
  Synthesized
  misc_feature (61): n=a or g
attaaagactacagttaaataagagaataggaatcagcaataggctttgccttgctggtantctgcagaactcttcagtatgccaattaactccttgtctccactttattcccgctccatg

SEQ ID NO: 18099 - DNA, 121 bp, Artificial Sequence
  Synthesized
  misc_feature (61): n=a or g
aactgaaagataggatatcaggaataaattattgatctctacaagcgaactgaaaccaccnctggaattctgcaggaatctgcactattcaacacatttatcagtgatctgggaagagtgg

SEQ ID NO: 18100 - DNA, 121 bp, Artificial Sequence
  Synthesized
  misc_feature (61): n=t or g
taagctacatagctaaaatgtataattaaggttaagttggataagcactaaatgtatgaangttgccggaatcattgatttcagagcagtcccctgatacataacagtgatatgattttct

SEQ ID NO: 18101 - DNA, 121 bp, Artificial Sequence
  Synthesized
  misc_feature (61): n=t or g
ttggaaacgtgtctaaattttaagctgctgtaagtcgatcccttgaatctgctgagccagnggcacccttggttggcacctttgtcacaggagtatctgagacggcctcactgcctgttgt

SEQ ID NO: 18102 - DNA, 121 bp, Artificial Sequence
  Synthesized
  misc_feature (61): n=t or c
atcaacattttgagaagtgaggtctaatgctgatgtgatcgagtcacagtcgtcagactgnatacgtagaagatgcgattttctgatagctggcccatcagaaatatacttcactgctctt

SEQ ID NO: 18103 - DNA, 121 bp, Artificial Sequence
  Synthesized
  misc_feature (61): n=t or c
caaagaacgcctacaacagattaggaaaataggggtcatttgcacccagagtatcagcagngctagaggaatgtctgacccgggagcacgtgctggcctgcagggctttcccattttgacc

SEQ ID NO: 18104 - DNA, 121 bp, Artificial Sequence
  Synthesized
  misc_feature (61): n=t or c
cttaaaggatgttctgtgattgtttttgaggctaatgttttaaagagctatttatgacagncccccataaccattccccactccggacaagcttagcttttcagctattttttcacatgct

SEQ ID NO: 18105 - DNA, 121 bp, Artificial Sequence
  Synthesized
  misc_feature (61): n=a or g
ctcttgttattttatgggaagagtaataaatctcaaaaatctctgcatgttcattatccanttgtaatacagaatacatactgcaaggatggttgaaactttatgttaaattggaataatg

SEQ ID NO: 18106 - DNA, 121 bp, Artificial Sequence
  Synthesized
  misc_feature (61): n=a or c
ttttaaatgcaatgatttagtggccctcttaaaaatcacgttgtgtgattcagacatccanagactaaataagacaaaacaaaaccatcaaaattacccacagaagcgttaattcttgggt

SEQ ID NO: 18107 - DNA, 121 bp, Artificial Sequence
  Synthesized
  misc_feature (61): n=a or g
tgaggacggctttccctggagagatacctgctgagctgacactgcatggagaggacacagncagcagggaggaggctcgctttggaggccatgttgtcaagaacaaccacgttaggaagat

SEQ ID NO: 18108 - DNA, 121 bp, Artificial Sequence
  Synthesized
  misc_feature (61): n=a or g
ggcagggggagactggcccatcgtacccagggcgttataaggcacacaggtgtaagtgccnagagcatcttcggttgcctcctcaattcggatcgacccatcttccagcaggttccagcca

SEQ ID NO: 18109 - DNA, 121 bp, Artificial Sequence
  Synthesized
  misc_feature (61): n=t or c
gagtcaaagaacaaaaagatagagcatgaggactcacgtgaccagcctttaagcaggtagntttatcacaacacgttcttgcacaaactcaagcagcgtaaggacacggcctgaagacttt

SEQ ID NO: 18110 - DNA, 121 bp, Artificial Sequence
  Synthesized
  misc_feature (61): n=a or c
ctttacatttagtgatttctaatagatttcacttaaagtacatttgtgttacatgaaaganaattttaccctaatttcaggctctctttctcacttctgtgacactattaaatcgattcag

SEQ ID NO: 18111 - DNA, 121 bp, Artificial Sequence
  Synthesized
  misc_feature (61): n=a or g
aatgaaaaagctagacataactgtttttaaaacagcataacaacataaaatgggaagaagngagactgagattgtactattaacgttttcatgaagaaacaaaacaccagacttaaacaag

SEQ ID NO: 18112 - DNA, 121 bp, Artificial Sequence
  Synthesized
  misc_feature (61): n=a or g
tttactctacataacattattttcctgcttacatcaaattgttaatcatatttaaagtacnggaactagaaataactatcagactttgtggtgaagtctgattttcaggttgcactcaagt

SEQ ID NO: 18113 - DNA, 121 bp, Artificial Sequence
  Synthesized
  misc_feature (61): n=a or g
ttgctttctgtgtttactccttcttttagaagggtatcactctttgcttttctggtcaacntcattttggctgtgtgttgatatacaatctcagactgcctgtgcagatagcttttcagca

SEQ ID NO: 18114 - DNA, 121 bp, Artificial Sequence
  Synthesized
  misc_feature (61): n=t or c
cactaactattactgtgggtaccaggatagcacaattggtagtttacaaaagcatcttcanacacgagactgctcagttacctgaaaggggtgacagagggttcggttccacccaagatgc

SEQ ID NO: 18115 - DNA, 121 bp, Artificial Sequence
  Synthesized
  misc_feature (61): n=t or c
aaaattaaagtctctgtcttctaaatctgaatccaatcacaaccatccagacacaaagaanacggataagaaacccataagtaccactatgtggctaaagaacagctattcaagataatgc

SEQ ID NO: 18116 - DNA, 121 bp, Artificial Sequence
  Synthesized
  misc_feature (61): n=t or c
ccaccatttagcacgaccacataaaacagacagctttctgttcagctcctgaatcccactngtactcaaaaattaactattttgtcagcacaggagtaattgttaggcatagtttaagaca

SEQ ID NO: 18117 - DNA, 121 bp, Artificial Sequence
  Synthesized
  misc_feature (61): n=t or c
acagcaagcctagtccaaaagcaagagacatggctgcggaagtcagcaccagactggtaanagaatggcagtggttatttcagtgtccaaaaccagctattaaatattggtaccctataac

SEQ ID NO: 18118 - DNA, 121 bp, Artificial Sequence
  Synthesized
  misc_feature (61): n=a or g
aagaaccccactgtggcttactccactgcaataggaatgataagatatggtgacagcaaanttctcatttccatagggcaataccccaacactccatggcagctacctggaacgttcctga

SEQ ID NO: 18119 - DNA, 121 bp, Artificial Sequence
  Synthesized
  misc_feature (61): n=a or g
aaattcagctgtagaatatcacgccagcaaatccagtcttcctgcggtgggtttgtgaatntttcaagtgcaacctgccaaaaaaagcatcagtcacagtctcctgcatcccgaattccag

SEQ ID NO: 18120 - DNA, 121 bp, Artificial Sequence
  Synthesized
  misc_feature (61): n=t or c
atgcagtcattgctaatgaatgcatggaaaagatggaaaaccaagggacaagtccgagtgntggggaataccagtctcaccttcctatctgccccatagatcagcttttaccctgaggaat

SEQ ID NO: 18121 - DNA, 121 bp, Artificial Sequence
  Synthesized
  misc_feature (61): n=a or g
tgagaaagagctccttaatattcacaagcttgggcaattcttcagggaggcacgataaccngttgtgactgacgttcaacacttttagtttatgaagcaatgatatttctggtggcagctg

SEQ ID NO: 18122 - DNA, 121 bp, Artificial Sequence
  Synthesized
  misc_feature (61): n=t or g
acactccacacaaaaacaaaaaccgatcttattttaacactgtcttagaataaacaagggnttaggcagggagcattaaataagcattagtaaacagtaagaaaaaggggggggttgtgca

SEQ ID NO: 18123 - DNA, 121 bp, Artificial Sequence
  Synthesized
  misc_feature (61): n=a or c
aataggcaaaaatacatgagtgcattgttatttagagaccctagaatcagagattcaggantaaaggttctttttgatcattaatattcatctggcagcgtttaattttttaagcacgagg

SEQ ID NO: 18124 - DNA, 121 bp, Artificial Sequence
  Synthesized
  misc_feature (61): n=t or c
ccagcctagtatctttcctgacaggctgtgtagcccggcagataaaggaagcaaaattatncttcttgaatgttagctcttgcttagcatcttggcaaaaccagttggcaaataaaccttt

SEQ ID NO: 18125 - DNA, 121 bp, Artificial Sequence
  Synthesized
  misc_feature (61): n=a or g
agtctataacgtgacgtggaatgcaaatctaccgtactcgaagaaccaacgattgcacagnatatgaagaaaggcacatggatctatcgaaaatttaatctttaatattttgatattgtaa

SEQ ID NO: 18126 - DNA, 121 bp, Artificial Sequence
  Synthesized
  misc_feature (61): n=t or c
tttgacttcatgaagatctagttcaggagattgtaagacacggattaaaatctcaattcanattatgcataaataataacagacacttctgtcccttccttagaaggctgcaatgtaatct

SEQ ID NO: 18127 - DNA, 121 bp, Artificial Sequence
  Synthesized
  misc_feature (61): n=a or g
aaaatgtaaaatcaaggctagagaaattcagaaagatgcaaaataattggcttacatcagnattatctccaggtaaatgatatttaaaaaacaaatttagaaaacaaatcagggtgtgaag

SEQ ID NO: 18128 - DNA, 121 bp, Artificial Sequence
  Synthesized
  misc_feature (61): n=t or c
tccagttgaccttagcacaagtggagcaagccaaggtctgcccaaacatgtctaggtagangtgtcccactagagttccgtgaaattcctgctccatctgcttgtctcagtcctagatctt

SEQ ID NO: 18129 - DNA, 121 bp, Artificial Sequence
  Synthesized
  misc_feature (61): n=t or g
acctaaggcatgtttgcttcctttttgcccatgtattgggatactcgagggacaagacatngggggagaaggcgtatgtgagtctcctacaaaaaatcctggagtctccttctcaagagtg

SEQ ID NO: 18130 - DNA, 121 bp, Artificial Sequence
  Synthesized
  misc_feature (61): n=t or g
aatgagatcaagctctggggcaaaaaaaaccttggaattgttttgtaaatgccatgctttntgacatgtctacatgtgtaaagagagatctcatctcaaagcaggcagacacttgtttaat

SEQ ID NO: 18131 - DNA, 121 bp, Artificial Sequence
  Synthesized
  misc_feature (61): n=t or c
tttttactttgcatgttgcaaatatcacatagatgcctgaaactgtttaatcacatatctnctgatctggtcacagaatcacgcagctcttcagttactttcctgcatggactagttttct

SEQ ID NO: 18132 - DNA, 121 bp, Artificial Sequence
  Synthesized
  misc_feature (61): n=t or c
aagtgcaggatggagagaaccacgagctgttccaaagctggggagccatgcacagagccangctggagcagtaacacagaggtgttctgtagtaacagggggaatgggacattgacagagt

SEQ ID NO: 18133 - DNA, 121 bp, Artificial Sequence
  Synthesized
  misc_feature (61): n=a or c
ttatgattctatgattctatgatcacagttcatattagaaagattttatttgtacctccanaggctactcacaggagggaataagaaataataaaatcattacagtgtattcacaagaggt

SEQ ID NO: 18134 - DNA, 121 bp, Artificial Sequence
  Synthesized
  misc_feature (61): n=a or c
ttgtgtcaggagccagaagctctcagacagcacatactccgggagcaccaatgtcctcagntaggccttatttgcttatgtattctcttggctgtttgtttgtttgggggaaacaaggtat

SEQ ID NO: 18135 - DNA, 121 bp, Artificial Sequence
  Synthesized
  misc_feature (61): n=t or c
ttctggatcttcagtatgcattcagtacttctacaccactggactcctagtctacttagtntactgcaaggaggaaggagttcaattcctgctgcttttcccatgatataagaaatattct

SEQ ID NO: 18136 - DNA, 121 bp, Artificial Sequence
  Synthesized
  misc_feature (61): n=a or c
tttgctctgtctcaccttttttcagtaacccataacatatagtcagcttttcaacgctganaaaatcctctccagaatgctctgtccctggtatctaataattgataactgaagagttctg

SEQ ID NO: 18137 - DNA, 121 bp, Artificial Sequence
  Synthesized
  misc_feature (61): n=t or c
accatattcaaaccagcagattaacttgtttctgctgtttcaagttgtctgtatagagctngtgattgaaaggggcaggatgggcattcctgtagctgtaatgctctaaggtcatgagaga

SEQ ID NO: 18138 - DNA, 121 bp, Artificial Sequence
  Synthesized
  misc_feature (61): n=t or c
ctgcatttattaacatgcgtctcaacaattttccaaaagaatatattcccagctagcaagntgtttaaagctctgtactgcaagcagaagtaccaatctggctctcatttttatgtggttt

SEQ ID NO: 18139 - DNA, 121 bp, Artificial Sequence
  Synthesized
  misc_feature (61): n=c or g
caacagacgtggccccttcaacggtgtttttcagacaatgtgatggaagtccaaccttctnaaatgtacttctgtgatgctacactaactgtagaaagagaaaaaatcattccactgtctg

SEQ ID NO: 18140 - DNA, 121 bp, Artificial Sequence
  Synthesized
  misc_feature (61): n=t or c
aaagcctctttaatgacaagaattggccaaggaatgtgagtgaatgtgtgtgggtgttagntctcggcagttgcctgtgctttggaaaagcaaggtctacgctctcacttcacagttgcca

SEQ ID NO: 18141 - DNA, 121 bp, Artificial Sequence
  Synthesized
  misc_feature (61): n=a or g
agtatggacatctgcagttcttaattaccaatgttttctgttcttacagctaacgtcaacnttactgcaagctttcatttcaggagttcctttttgtgggctggcctcagaaggtaacact

SEQ ID NO: 18142 - DNA, 121 bp, Artificial Sequence
  Synthesized
  misc_feature (61): n=t or c
tcctatgatgctttgcctgcttacagggatgacagagatgcaactgtgtcaaaatcaacangggacaactgtttcaaggcacagtgccatatccaatgagccaggcagaagtgaaggaaaa

SEQ ID NO: 18143 - DNA, 121 bp, Artificial Sequence
  Synthesized
  misc_feature (61): n=a or t
tttgtcagcagcaataatttctttcttgtgccatcaaatttcaggcatccagctgctgagntgctgccatatcctaagagtagaagtcagaagggttttgggaaaggtgtagcatttgata

SEQ ID NO: 18144 - DNA, 121 bp, Artificial Sequence
  Synthesized
  misc_feature (61): n=a or g
ctgccatgttttattctactttttttctgacgctcctgttgtgatgctatccacgtacacncacagcccgtagctcaaccagtgactgatgtctactgggtccgtgaaaagaatctgtgct

SEQ ID NO: 18145 - DNA, 121 bp, Artificial Sequence
  Synthesized
  misc_feature (61): n=a or g
gcagacctctcaatgtgatctagtcagtcagtgagtagctgctctaataagaacgctttcngattatccctatgtgtctgtagatcttgtcatttttgttttgtttttcctggggagagga

SEQ ID NO: 18146 - DNA, 121 bp, Artificial Sequence
  Synthesized
  misc_feature (61): n=a or g
caatagaagaagtcaaaccatttcatccagtacaggacgttccctgcagaccaagtgaatncaatccataacatctgtgctctgtgctgtacttctgaaaatacgacattcaaaccatagg

SEQ ID NO: 18147 - DNA, 121 bp, Artificial Sequence
  Synthesized
  misc_feature (61): n=t or c
gtcatcttagatgccgagtgaggcctaagctcatggaataatcactctggggagattttgngtgttaaagtcccagaaatcttgacagatcattggcaaaatccagattttctgttaaaat

SEQ ID NO: 18148 - DNA, 121 bp, Artificial Sequence
  Synthesized
  misc_feature (61): n=a or c
cctgaatgtttgacaaatgtaattcaaataacaaatgaacagtatggcacaaaaggacatngtcacgattatggagcttaaaaataagactatttttccaagcttgtctgccttcaaaggt

SEQ ID NO: 18149 - DNA, 121 bp, Artificial Sequence
  Synthesized
  misc_feature (61): n=a or g
agttaatatttggagatattaagaataaaaattaagaaaaagctggtatctgaatagtcanctgaaatggagggtgctttttgtaagggacttgaaatagttataactgagggggaagact

SEQ ID NO: 18150 - DNA, 121 bp, Artificial Sequence
  Synthesized
  misc_feature (61): n=a or g
tgtgttaacaactcttgatttgatcatgtttctctccttccctcctcttctccatcatctntaagttcttctcctctttttagggagtctctgtatctttcagatacaatagtgtaaacaa

SEQ ID NO: 18151 - DNA, 121 bp, Artificial Sequence
  Synthesized
  misc_feature (61): n=t or c
aataaataaaaaatacatgtaaaggatgtaaagcaagatcagtccttccgataattgattnggctggactggtttaacagcacggtatgaggaagctggttcacacagacacagataaact

SEQ ID NO: 18152 - DNA, 121 bp, Artificial Sequence
  Synthesized
  misc_feature (61): n=t or c
gagagccaggagactttgtccctcctgctatatttagtgtgacacaatcaataaagaatgntgtttcacattgtgcctaggaaggcatccatgatgtcccacattaatctctctctactga

SEQ ID NO: 18153 - DNA, 121 bp, Artificial Sequence
  Synthesized
  misc_feature (61): n=c or g
ctgcaaaggttaaggttctaccatggttaaccatggtacttcatgttccacaaggtgtacncagggtatagctgttttatttagcacagtggtcttttctgttgcagttatgttctgcatt

SEQ ID NO: 18154 - DNA, 121 bp, Artificial Sequence
  Synthesized
  misc_feature (61): n=t or c
agagtaagaaaggtgaaataaccccgaatatgctactgtagctggcatttagctctccaanctggtatatctcagagcgttcagagatgtgtcacagaaagtacagtttccagtggaaaaa

SEQ ID NO: 18155 - DNA, 121 bp, Artificial Sequence
  Synthesized
  misc_feature (61): n=t or c
tcttccaaaatcccagtaatcagtatgcaaaatttgtctgtccttgaagctaaaggcatantctggagtattgtcatcaattatagctttgggattctgttctgtatcttaaggataaaat

SEQ ID NO: 18156 - DNA, 121 bp, Artificial Sequence
  Synthesized
  misc_feature (61): n=a or g
gcacccagagctgccggggtgatgctctgcagcaatggcatcgcgctgcttctggtgcagntacacactgcagaatgtggattccctgcaaaaccactgcaggatgctgaagccgcgagat

SEQ ID NO: 18157 - DNA, 121 bp, Artificial Sequence
  Synthesized
  misc_feature (61): n=a or t
acttttgtattttttcccgaattttggctcatgaaacagtttgcatctgtcaagacaaatnaaggcattgttgtatttggttttcactttaaaaaaatgtatttcctacctttcaaatagg

SEQ ID NO: 18158 - DNA, 121 bp, Artificial Sequence
  Synthesized
  misc_feature (61): n=t or c
actgtttattacaatcctgtgccaaacctctgtactggacttgtagctcttctgaagtcancagaggcagagggattcaataccagctgagaatctctgtgccttgcagtcatatcttgct

SEQ ID NO: 18159 - DNA, 121 bp, Artificial Sequence
  Synthesized
  misc_feature (61): n=a or g
ccaggctactgcactgtgccatgctgctgcctgtgccatggctgtgcctgcagtacctacnaggcagctctgtgttgttgggtgaaaccaagcaacaggagactgttctgactgaacacag

SEQ ID NO: 18160 - DNA, 121 bp, Artificial Sequence
  Synthesized
  misc_feature (61): n=t or c
gctaaaacctgaaatggtggaggatagctcagctttctgccctgcccaaaaggcagcacgntgtctgtacactcagtagggagcaccaagaccaggatggaaaggaacgaggcaggctgtg

SEQ ID NO: 18161 - DNA, 121 bp, Artificial Sequence
  Synthesized
  misc_feature (61): n=t or c
cctctatcctttatcttggagctagaacagaaaactattggaacaccaaaaggcaggagangaggctgtgctgtgttcctgcctcctctgcctgttttctaattcttaattcagtgactgt

SEQ ID NO: 18162 - DNA, 121 bp, Artificial Sequence
  Synthesized
  misc_feature (61): n=t or c
gaaggatttcacatgggcaatatctcgttaggagaactgctttcaagcatggcatttcccnttagacgtgttgcacggtgtatccatggcatacagcactgttgtgttttctgctttaaag

SEQ ID NO: 18163 - DNA, 121 bp, Artificial Sequence
  Synthesized
  misc_feature (61): n=t or c
aatgacacagaacgtgtcttgcaggctcacattatgttggtgtggtaacaagagttgaatntcattgcagagctcttgaacatgatgcttctaaattcaggaaatctgctgaggtcatttc

SEQ ID NO: 18164 - DNA, 121 bp, Artificial Sequence
  Synthesized
  misc_feature (61): n=a or t
acaccaagagatgaaagagaagggtatacatcataagcaacactacaaaccatactctctnaaccactttgcaatcctgtgtcatgcaatggtgtctgtgtggctctcataatcagcctat

SEQ ID NO: 18165 - DNA, 121 bp, Artificial Sequence
  Synthesized
  misc_feature (61): n=t or c
gaattcaaagattgtcagaatagaaactcagagtgcttcttagagatgaagacttgcttanatgtgatcagctcctgtcccaaagactctcataaatcatgatgagtagctggtttcaatt

SEQ ID NO: 18166 - DNA, 121 bp, Artificial Sequence
  Synthesized
  misc_feature (61): n=t or c
gggatctatcccaaagctgcaaagggtttgaaagccctatcatttgggtttctacccaaancatgaacccattgctggctccgctgcccctgttggtcttatcttccattcattcattaag

SEQ ID NO: 18167 - DNA, 121 bp, Artificial Sequence
  Synthesized
  misc_feature (61): n=t or c
attctgagatttgaattgaattgaataacagacatttatacttaaggaagtaaattctgcnttccattgcatctgcctgtctttacgtatttcaatgttactggaggaaaatatgcagtgt

SEQ ID NO: 18168 - DNA, 121 bp, Artificial Sequence
  Synthesized
  misc_feature (61): n=a or g
taagacaaacacagaattccatgtctacttactgtgcatgtttgaatcaacttcatcctcncttaagccttttgaagcattcttcttcctttcaggactaagaagttgatttccaggttca

SEQ ID NO: 18169 - DNA, 121 bp, Artificial Sequence
  Synthesized
  misc_feature (61): n=a or c
ggcagcaagagcttgttggtagctttgatgcaagtcacttcctaagaggctgtctcctatncttcactttaccaaaagcaccttctggtcaagaggcaaaaaagaaaatgaatccatgcac

SEQ ID NO: 18170 - DNA, 121 bp, Artificial Sequence
  Synthesized
  misc_feature (61): n=c or g
gtgccgtgtgtcagggtgtagcccataggtggagagcagagctacaggtggaagaggaaangaaggagtctgagaacactgtccatggaggaaattagctgctctcagagccagtgaatgg

SEQ ID NO: 18171 - DNA, 121 bp, Artificial Sequence
  Synthesized
  misc_feature (61): n=t or c
acgcttttcagtctgaggtcatcagccttaagtttcttgacagaaaagttgagtgtcctgnctttaccaagtcttattaatggaatcactcatagaatcacagaatcaccaaggctggaaa

SEQ ID NO: 18172 - DNA, 121 bp, Artificial Sequence
  Synthesized
  misc_feature (61): n=t or c
cagacaaacgagggcatgcgaggaatcaattttctttttaatgcattcagctcttggattngtgtgttatgatagacgtttgctgagagcagattgttgcacacaacagctaatagaacgg

SEQ ID NO: 18173 - DNA, 121 bp, Artificial Sequence
  Synthesized
  misc_feature (61): n=c or g
tcgttttctctgcaagccctttacttcaatgctacacagagtgccgatttgcacgccattncccatgtgtatgtggcctggtgtcctgtgcatgtctgaagttctattccaatccttactg

SEQ ID NO: 18174 - DNA, 121 bp, Artificial Sequence
  Synthesized
  misc_feature (61): n=t or c
tgctcatttctagcatggcgtttcatgtggaaatatagtggagaaatggagagagcgcaanattcaggcttcattcactcccctgcacttacagagaagccattttcagtggtcccatcaa

SEQ ID NO: 18175 - DNA, 121 bp, Artificial Sequence
  Synthesized
  misc_feature (61): n=t or c
tattttatcttgcacagtgtattatgttcacatctgttcctcttcctggagacgctaagangacatggtacgtggaaagcactgacataagaattatgattagatcaataggcttccaaaa

SEQ ID NO: 18176 - DNA, 121 bp, Artificial Sequence
  Synthesized
  misc_feature (61): n=a or g
ataggttttcatcctcacattgctttgtgttgcctgcaccatgaactggggagcaccaacnagaccatgtcatcatccagtttcacaagattatgagatagccacaatgggctagagccaa

SEQ ID NO: 18177 - DNA, 121 bp, Artificial Sequence
  Synthesized
  misc_feature (61): n=t or g
tctttttggaactgggatctttgtgcttaccccatttgggctagccaggccttttgtgaangcatttgtgaagtctttgaagcctgctgtgctgctggacatctgcatctccgtggtgctg

SEQ ID NO: 18178 - DNA, 121 bp, Artificial Sequence
  Synthesized
  misc_feature (61): n=a or g
atatatagtagctttatagagaggaacctcattctgatactcttgtttctgaatctgccantgagctgaaggttggagaacccttgctacagcaacagcatgtccagctacaaatgtacat

SEQ ID NO: 18179 - DNA, 121 bp, Artificial Sequence
  Synthesized
  misc_feature (61): n=a or c
tgacagcaaagaggactgtatgtcatgcaaaaaaccaattaggactgactaaaaggaagcnattaaatgctccttcttgtctaaagaaagaggaaacatcattttggactcagcctttcac

SEQ ID NO: 18180 - DNA, 121 bp, Artificial Sequence
  Synthesized
  misc_feature (61): n=c or g
aagggaaattccagatgctgatgagatttggggttgtgggggactgcctgtgccctggttntactgggcttgatttgtaaagctgctgtgagatctctggtagtaattttggtttcaaaac

SEQ ID NO: 18181 - DNA, 121 bp, Artificial Sequence
  Synthesized
  misc_feature (61): n=a or g
tgcttaactaaacttgcccataactgatgaatggaagaagggcactgggagccctgttgtntactttggtgatgatgagccagttttcagggcagaagtggctttttaccatactgagtga

SEQ ID NO: 18182 - DNA, 121 bp, Artificial Sequence
  Synthesized
  misc_feature (61): n=t or c
acaaatcctctaaaaacgagaaatacgaggtctcaatgtactgcactagtgtacagtactnggctacacagttaatgaacgaaaggtgagtaaaacttgccacctgatcagcttctgcttc

SEQ ID NO: 18183 - DNA, 121 bp, Artificial Sequence
  Synthesized
  misc_feature (61): n=a or g
ttttattttttatgtttaataggaacatttagaaacacagcacatcagcttagtttgatcnactcacaacacctaaactttcagtgtgttactttttcattcaattttattaataaaattc

SEQ ID NO: 18184 - DNA, 121 bp, Artificial Sequence
  Synthesized
  misc_feature (61): n=a or g
ggactttcctgcagctcctttttgtggttgcacggcagtgatctgggacagacctaaatcntcttcatggtttcctattgcctcgtacttgttcctgagttcacatttctcaaagaaagtt

SEQ ID NO: 18185 - DNA, 121 bp, Artificial Sequence
  Synthesized
  misc_feature (61): n=a or g
ctaacagtatccttacatttgaccaatgtcatctcagttctttcatggtatagcacaagcngtgctggtgtcgcacacacagagtagatcacaggagaggtatgtggaaaacaaacacaaa

SEQ ID NO: 18186 - DNA, 121 bp, Artificial Sequence
  Synthesized
  misc_feature (61): n=a or g
atcttctggttttccttcagctgtgaaataattgctttgttccaccacactgcaaaaaatncatactatgtaccaaaccttaaaaaaaaagtaaaatattattttagaaattgttacaata

SEQ ID NO: 18187 - DNA, 121 bp, Artificial Sequence
  Synthesized
  misc_feature (61): n=a or g
ctccttcagggacacgtacagtgggggatgtagaaggcattggtgaaggtgagaggacgcnttgcaattgatttgggaaactgattttccattgcactttgaaagagctgcagtgcctcac

SEQ ID NO: 18188 - DNA, 121 bp, Artificial Sequence
  Synthesized
  misc_feature (61): n=a or g
tgactgtggggaaggtctacgcagcgctcatgatatttgacttctacaaacagaacaagancagcagggaacaagtccaccagcctcctgggggcctgtgccaggtactggggatgccact

SEQ ID NO: 18189 - DNA, 121 bp, Artificial Sequence
  Synthesized
  misc_feature (61): n=a or g
aagaaaagttaagaatcggggttatgccttggaagaagtggtgaagaagaagaagctctcnggctaatgaaagcacacatcctttgaactacggtttataaacccagtaattggcaacata

SEQ ID NO: 18190 - DNA, 121 bp, Artificial Sequence
  Synthesized
  misc_feature (61): n=a or t
tgtcttaaaagctaaactgagttaaagatcagaagcgtgtcctggtgtgactgtgagaatnatgcaaaccaaccatttcacttctcagtgtttaacagttagaagcttttagtgcatcata

SEQ ID NO: 18191 - DNA, 121 bp, Artificial Sequence
  Synthesized
  misc_feature (61): n=t or c
gacaaagcaagcgtgtgaagcttggtttgccaccaacataatgtgcaaggagacagagggncaggctgggagctgcagcctccaggccttaatgctgcatgcccagctgctctggaggtga

SEQ ID NO: 18192 - DNA, 121 bp, Artificial Sequence
  Synthesized
  misc_feature (61): n=a or g
ttgaaaatgctaccagtgattgtattaaatgcagcatgagagacaaagggtcttatgcaanatgcttactctgaggtctcaagcctatttttttcccagtttgctcaatagcttaaggggg

SEQ ID NO: 18193 - DNA, 121 bp, Artificial Sequence
  Synthesized
  misc_feature (61): n=t or c
ttggctgcatttcccttgcatctaaggtctgaagctctgcaatcagggcttgttgtgtttnccatccatctctcaccctggcacttggctgcctgttgtatttgggctggttctcacagca

SEQ ID NO: 18194 - DNA, 121 bp, Artificial Sequence
  Synthesized
  misc_feature (61): n=t or c
tcttacatgtgtaagagagaaaaaggcacctgaacgtaagaagtgactgtctttctgttantgaaaatgagatacagtctgtacgctacaagagtacaagtggaatatggttgtccttcat

SEQ ID NO: 18195 - DNA, 121 bp, Artificial Sequence
  Synthesized
  misc_feature (61): n=a or g
gctcagtttggtgtcatctgcaatgcagtatctctttgaaagctgacacaatggcaaggantcacctcaaataaaaattgtattaagacaaagtagctcctgtgcctgtctttccaggatg

SEQ ID NO: 18196 - DNA, 121 bp, Artificial Sequence
  Synthesized
  misc_feature (61): n=a or g
gaagccatcctcagcctctttggcctccttgaagccccccatgatctgcttgtggtaggcntccttctgccagttcttcaccttctcaaagtcatcgttcagcaggctgttcttcacctcc

SEQ ID NO: 18197 - DNA, 121 bp, Artificial Sequence
  Synthesized
  misc_feature (61): n=a or c
aagctttctgatatagaagaagactatcaatttaattctaaattagcttttgtgtttaagnaattctgagtctttgacccaagatttgcttttctgccatttacatctttttgtggatgta

SEQ ID NO: 18198 - DNA, 121 bp, Artificial Sequence
  Synthesized
  misc_feature (61): n=a or t
actccttactgcttaatagtgctgttttttatttgaaaggaaaacatatacaacaaactgnactcgccgcttagatgagcctttctcaacctgtggtctcggagtgctctgtaacatgatt

SEQ ID NO: 18199 - DNA, 121 bp, Artificial Sequence
  Synthesized
  misc_feature (61): n=a or g
ttaagttcacttatcttacccttgccttcctcagctgcaaacacacattcataaaatgatncagaataactaaggttagaagggacttctggagactgcttactctgctcagtgcagggtc

SEQ ID NO: 18200 - DNA, 121 bp, Artificial Sequence
  Synthesized
  misc_feature (61): n=a or g
gaatgtcatagtatgttgattaaggataaatgaacttgctttttttttgctgatttggacngagtgattatttctaacggtgctaccttcttcattactgtgtttgttctttgtatgaagt

SEQ ID NO: 18201 - DNA, 121 bp, Artificial Sequence
  Synthesized
  misc_feature (61): n=c or g
gggggaggaaaaagtaaaaaaagggaaaaaaaaggactgaaagcctgagtaccagagttcntacggcttacttatagtgctggggcagattaacacctgatgtaaacaagaggctgcatgg

SEQ ID NO: 18202 - DNA, 121 bp, Artificial Sequence
  Synthesized
  misc_feature (61): n=t or c
attaagagaaagcttgcaaggaagggctctgagtctgagattgcagagcttttcacttttncagcctttgagctgctaatggcacccttcaacgtgagctactcggaaaacgtcggtggtg

SEQ ID NO: 18203 - DNA, 121 bp, Artificial Sequence
  Synthesized
  misc_feature (61): n=t or c
gaaagttccttgggaacgagagtagaagtttccatcagcattgctgccagccactagtatnactaaagatggggaagaaccaagcaagatgtatgcaactagcatatattttaacagagtt

SEQ ID NO: 18204 - DNA, 121 bp, Artificial Sequence
  Synthesized
  misc_feature (61): n=t or c
tcagcagtgctatggagaggttgtgattagttgccaagggtctctgtgggcacctaagctngctccctggagcgaggaggagttcagctactcacagtcagcgttctccacccgggcatag

SEQ ID NO: 18205 - DNA, 121 bp, Artificial Sequence
  Synthesized
  misc_feature (61): n=t or g
caacagtctgactgctcagaatgattaaaaaaacccttttcagtcagatagcatggttctnaaaacctagggtgtttaaacagtgtgtcctgtaaactgacacattgaaaataccatgaac

SEQ ID NO: 18206 - DNA, 121 bp, Artificial Sequence
  Synthesized
  misc_feature (61): n=a or g
gtaggtttatacgtgaatgttaataatgtggctgtttattgtctctgtgaaacagaggagncaagcctttcccatctcccagggaggcagtgccatttaatgaatgcttgtattgtatttt

SEQ ID NO: 18207 - DNA, 121 bp, Artificial Sequence
  Synthesized
  misc_feature (61): n=t or c
gagaggcgtgacagtctttgtcacacactgaaataaagaattaaaagtggagatcaactanttttcttgtatacttcctgcaaggatgcctatgcctcaccttcttgaaggctgttcttct

SEQ ID NO: 18208 - DNA, 121 bp, Artificial Sequence
  Synthesized
  misc_feature (61): n=a or g
ctcagagatattagatacttcatcctggctagctagctagtatacttacatttttttgtgngaactgcatgtctgttaaactcttttctgaaactttactcattttctcattccaacatgc

SEQ ID NO: 18209 - DNA, 121 bp, Artificial Sequence
  Synthesized
  misc_feature (61): n=a or t
tttggaagagaggcaggaacctcaacggtactaaactcttatggttcgtaacaataggctnttgtgtgggtatagttaaagtaagacaggccctaatttatgtggcttcattatttatatt

SEQ ID NO: 18210 - DNA, 121 bp, Artificial Sequence
  Synthesized
  misc_feature (61): n=a or g
acttttgtgtttcctaaaatctgacaggtaccaagacttgaagaaatcttccattctgacnttttagatcagtttgttttacttgttacacataatgataattcacattggttcggtatgc

SEQ ID NO: 18211 - DNA, 121 bp, Artificial Sequence
  Synthesized
  misc_feature (61): n=a or g
gttttagtactttttgttttactaataacggcccagcatcaccaagtcttaaaaaactgtntctacatctgtaatgaaggtacagtgatgtatttgtatgcacatctcacccaagcactaa

SEQ ID NO: 18212 - DNA, 121 bp, Artificial Sequence
  Synthesized
  misc_feature (61): n=t or c
tacaggactgccatgccgctgtcttaaaagtcggttttagtctatgcagtgaactctcatntctagaagtgacactcagctaggaaatcatagtatacacatcactgaaactgcatattta

SEQ ID NO: 18213 - DNA, 121 bp, Artificial Sequence
  Synthesized
  misc_feature (61): n=t or c
actcatttaggtacaaaccaagagctatcagccacagagatacacgatctctagctgagcnattgttgttacggagcgataagaaaatagcgctttcgtttttaaatcttagttatgacat

SEQ ID NO: 18214 - DNA, 121 bp, Artificial Sequence
  Synthesized
  misc_feature (61): n=t or g
cgctgacatctttaattcaggctgaaaatctggtgtagcctgctggatagggcacagatancaggatcagagctaggattcaccccaccttgtgttctgacctgctttgtaagcaggcaaa

SEQ ID NO: 18215 - DNA, 121 bp, Artificial Sequence
  Synthesized
  misc_feature (61): n=a or g
ttctatggtgaacaagaccaggcctagtaccaaccccaggggaacactgcttagctacagncctctctaattacagaccttacaggccactgctagtcacaggccttcatagctcagggga

SEQ ID NO: 18216 - DNA, 121 bp, Artificial Sequence
  Synthesized
  misc_feature (61): n=a or g
attgctgtgtattcctgggcaatagaaaacaaggttcttatgcaccaaaagaataagagcncaaaatttagagcacagttgacaaaaaggtattatgcagaacaggacagtggagtaaagg

SEQ ID NO: 18217 - DNA, 121 bp, Artificial Sequence
  Synthesized
  misc_feature (61): n=t or c
gtaggaataactcatttatgtaatgagaagaaaaacattatctacttcttctacatatatnccctcctgaaaacaaagtgcctgggaatactgaggcaacagatttagatagaattgttag

SEQ ID NO: 18218 - DNA, 121 bp, Artificial Sequence
  Synthesized
  misc_feature (61): n=a or g
tggctgagttatctggaatgtcactgtttgtccgccaacagtgtggtgctgataagccccnaaggctctgagctccccagaggacacagcaagcagccccttctcctgcctcagtttccca

SEQ ID NO: 18219 - DNA, 121 bp, Artificial Sequence
  Synthesized
  misc_feature (61): n=a or t
gagaggcgagcagcagggaatgaagtcctagccaagactaggagcctttagatgaagaganactggcacttgggctgggctgcttatgggcagattttagttttgtagaccctttggtacc

SEQ ID NO: 18220 - DNA, 121 bp, Artificial Sequence
  Synthesized
  misc_feature (61): n=t or c
aaactcaagaaatgcatcagaatgccatgggggttataagaaggaagctgtctctttgtangttagatttgaaaatagatgaaattaaggagctaatgatttttagagttgttacgtatag

SEQ ID NO: 18221 - DNA, 121 bp, Artificial Sequence
  Synthesized
  misc_feature (61): n=t or c
ctgtttgggttatgtcctagacttgggcgtactgtgcatgaaaacatgatatgaaagctancctagaaaaagtaagattcctcatgtgacttcattgctctatgtccagtaaggagaatgt

SEQ ID NO: 18222 - DNA, 121 bp, Artificial Sequence
  Synthesized
  misc_feature (61): n=t or c
gtgccaccagtgtgacgcaactcctcgtgcctttggaactgctggatgagaatgatctccngagtgctgagtacctctggatccaagccagatgtttaaacatccaatgataggatcacag

SEQ ID NO: 18223 - DNA, 121 bp, Artificial Sequence
  Synthesized
  misc_feature (61): n=a or g
tcagagacagggaaaagtcagtcagagaaacaaatggaggaaggttgtgtatttcatatcntgtggtcggcctttgagagaggtgcaaccttcgtgtgcaattgttaagcaccactggtga

SEQ ID NO: 18224 - DNA, 121 bp, Artificial Sequence
  Synthesized
  misc_feature (61): n=t or g
cggattcctctgcttggacattcatactgatgtggttcagatggccatggttcaaagagcngcaagcattttagatagttagctttggttttggccttcacggacaatgctttccagtttc

SEQ ID NO: 18225 - DNA, 121 bp, Artificial Sequence
  Synthesized
  misc_feature (61): n=t or c
atcaatatctctcgcagtgcaatccacaactcagaaatgacacatacacagatgctataanctcatggaataaccatgtcatagtgagagactgtaaggctgacaacaatcagaatcccaa

SEQ ID NO: 18226 - DNA, 121 bp, Artificial Sequence
  Synthesized
  misc_feature (61): n=t or c
ctatgtcatctcatctaggtagatctgctgtaagttatcaaggtttaatttcacaggtgtncacctcctggttaatggatgttttaagttctttcatcgtggtattccagtcgaggattaa

SEQ ID NO: 18227 - DNA, 121 bp, Artificial Sequence
  Synthesized
  misc_feature (61): n=a or g
tatagccatctgtaagttattctgttacacgatgagttttcctcattaaaagaaaaaggtnttctgtggtatttctaaaggctaattgctgtcgtgcataaaacaaggaataatccagtat

SEQ ID NO: 18228 - DNA, 121 bp, Artificial Sequence
  Synthesized
  misc_feature (61): n=c or g
ttcacctccatttgcatttattcagtacaaatcttgaactgcttacttaaagatttgtggntaataatggatttggggtcaagttgaccactaaaactgccttcaaggacaaacaggcaag

SEQ ID NO: 18229 - DNA, 121 bp, Artificial Sequence
  Synthesized
  misc_feature (61): n=a or g
gactgggatatcttgagaaagatgacaatcaaccacatgccatgttttctgacaaaaaaantttaaaagtatcttcccttgtcagcttctcaggcattcggtgagtgtactggtggtcatt

SEQ ID NO: 18230 - DNA, 121 bp, Artificial Sequence
  Synthesized
  misc_feature (61): n=a or g
ttgagagagttttcaagttaaaaattccttaagacacgaaagcttaagtgggaaattagtngttaaactagatacaactgagctgaagggcaggttcctgtactagaaaaagattggcagc

SEQ ID NO: 18231 - DNA, 121 bp, Artificial Sequence
  Synthesized
  misc_feature (61): n=a or g
tttaagtccttgtacaaaacgagcaggtctgtcttcagctgagtatcctggcttcaaacantgcagctctttgaattccaaggaccacagacaccgaaagtaaaaccttctgtctcctttg

SEQ ID NO: 18232 - DNA, 121 bp, Artificial Sequence
  Synthesized
  misc_feature (61): n=t or c
aaatgaaccatgaatccataactacacagattctacacttctggataagacacactaaganctaactgcattaacacaaagtataaagagaatcaactttaagtcttattttagaaggata

SEQ ID NO: 18233 - DNA, 121 bp, Artificial Sequence
  Synthesized
  misc_feature (61): n=t or c
ctctgaggacttactttcataggtcagcactcctttgcactccgtttgtccacaccttggnctctgttgctgctttatttcagctgcttctcctccagttttgtaacagttttcagttttg

SEQ ID NO: 18234 - DNA, 121 bp, Artificial Sequence
  Synthesized
  misc_feature (61): n=t or g
gcagctgtgtgagctttgtgttacctgagcacaacctgaagcttaaacaggaagagaaggntaaaaagtgggtcgcctccatatccacctccatatctcgcaggcagtcctgctcctgctg

SEQ ID NO: 18235 - DNA, 121 bp, Artificial Sequence
  Synthesized
  misc_feature (61): n=a or g
tctgggcaacgagcaacctctgtaataatgggtttgtaacaagaaagagacttcacatcanccgctgcacagaggaattcttaagcaatccacactttgtgagggctgactacagccaagt

SEQ ID NO: 18236 - DNA, 121 bp, Artificial Sequence
  Synthesized
  misc_feature (61): n=t or c
ggaaacaaatgtaggcaaaagattgagtcagctctgcaaaagctacgacccttcccaccgngcctcacttcagtagttttgtagagggggaattagtgacatcaataagccacgggagtaa

SEQ ID NO: 18237 - DNA, 121 bp, Artificial Sequence
  Synthesized
  misc_feature (61): n=t or c
atctgattgagtccagaaggttgggaccagcttttactgcagtgaccaatagttatgcggnatgggatcctgggatgagggcacaggatatatagcaacatcagaacattggactttgtta

SEQ ID NO: 18238 - DNA, 121 bp, Artificial Sequence
  Synthesized
  misc_feature (61): n=a or g
gggaccaccaggggcttcccttggtgaatgacagcaacgtggtgatggcagtgaggagaangcaactaaaactgaataggcagcaaagtccttttaatggcattctcatgggtgtttccct

SEQ ID NO: 18239 - DNA, 121 bp, Artificial Sequence
  Synthesized
  misc_feature (61): n=a or c
agtcaattctatccattcagctaaagaacagactcctgtcaacagtctacatttctttccngacagtctctatttcggctatctttaaggaaagtgcaacttcactttttaatccactatc

SEQ ID NO: 18240 - DNA, 121 bp, Artificial Sequence
  Synthesized
  misc_feature (61): n=t or g
ttggtgattctatgattctatagctgagtgcttcctcttccagccaccagcatttcaacanatttgcagactagttgttcagtctataaaagagagcagcaatgccttgtcataccatcct

SEQ ID NO: 18241 - DNA, 121 bp, Artificial Sequence
  Synthesized
  misc_feature (61): n=t or c
gaagggttgattccaagagctggcatttattcttgaagaaaatagttattttcatctttgnacttctttgtgtcctttgatgctgtctatataaagtattttaaaaatggacagaaaattc

SEQ ID NO: 18242 - DNA, 121 bp, Artificial Sequence
  Synthesized
  misc_feature (61): n=t or g
atgtacattagaaactcctattttaagatgtacctagcttgtatgtttcagatctagttanctaactgtgtcagttgagaaattcaagatactggaagttaggttcttgcatcagcgctga

SEQ ID NO: 18243 - DNA, 121 bp, Artificial Sequence
  Synthesized
  misc_feature (61): n=t or c
taccctcggcccatgtgaaattgcagactaagggcactttggatgtcacactatagggaanggtaaataaaggtaattaaaggaaatctcatcctctcattacctggccttttgggaccat

SEQ ID NO: 18244 - DNA, 121 bp, Artificial Sequence
  Synthesized
  misc_feature (61): n=c or g
ttcgaaggaaatgcaacatctgaagtcctgctccatgaaagcacatatttttatgagcttntcccatatttatcagtgtagtaatacagcaataaactgcctacctgcccccactgggatt

SEQ ID NO: 18245 - DNA, 121 bp, Artificial Sequence
  Synthesized
  misc_feature (61): n=t or g
ttcccacacagtagtgtgggctgcagtgagaatacacagctgggattgggacttttaaggntaacggtttgatattgctgattctcacaacaaattgtagtgttctgcttgacagtttgtg

SEQ ID NO: 18246 - DNA, 121 bp, Artificial Sequence
  Synthesized
  misc_feature (61): n=t or c
tctgtatgagactaaccttctttatggggattttagagactctggtcaagcttgtactaanggcccgaaaagcagctctgggcatctcattaatgaaggagacagtctgctgcctgctcag

SEQ ID NO: 18247 - DNA, 121 bp, Artificial Sequence
  Synthesized
  misc_feature (61): n=a or t
ttgccagtaagttaagtgagttccatgttactgtttctggtataagaatagccttgattgnaagaaactgtaatatagttctgttcattttcagcagaaggtgtttgggcagtgagcggag

SEQ ID NO: 18248 - DNA, 121 bp, Artificial Sequence
  Synthesized
  misc_feature (61): n=t or c
actacaatgtcatctggctggctggagctgatgaggctgaagcagtgcttgcatgttggtntggacctgcccagaacatagctttgttctggaacatctctgtgcccagcagctagctgac

SEQ ID NO: 18249 - DNA, 121 bp, Artificial Sequence
  Synthesized
  misc_feature (61): n=c or g
actgatttctcttatggggtcaaccatgtctacagatgctatcagtctgctgacgtactantttcttctactcctttccttttaaggctattagtttcttctttggaaatgaaaagagaaa

SEQ ID NO: 18250 - DNA, 121 bp, Artificial Sequence
  Synthesized
  misc_feature (61): n=a or g
ttttgtgaagtaatataatccaaataactttctttgaaaatggatcctgacaatggaaatncttaaaatatgaacctacagggagtttccagaatagggaatggcttttccatattggtct

SEQ ID NO: 18251 - DNA, 121 bp, Artificial Sequence
  Synthesized
  misc_feature (61): n=a or g
actgaaagctggctgtgcaatgcctgtgtttacagctgccccttgattcctaatttgtacntccacgtgccaatctgagcatacaaatattggatttgtgtaataaaccctgccaacaagg

SEQ ID NO: 18252 - DNA, 121 bp, Artificial Sequence
  Synthesized
  misc_feature (61): n=a or g
gaacaaattatttcaaaggaaatttggggtgagaatggaaagggaaaggaatttgtctgcnttcctggatagtggtcgatgtccttcatcggcagttggtggagatggactcaggtatgcg

SEQ ID NO: 18253 - DNA, 121 bp, Artificial Sequence
  Synthesized
  misc_feature (61): n=a or g
tgtagtcgaccaattgaagttttacataatgaggaagtctgcatgtgaaagtgtggtattntaagaggagtttgtgtgaagactagtcattagagatatttgtccagtatctgaaaagaca

SEQ ID NO: 18254 - DNA, 121 bp, Artificial Sequence
  Synthesized
  misc_feature (61): n=t or c
attttcattaagtttatcggtttccatgttttctctaattccacattattttaaccttttnccctgttatttcttcattcaagcactttctatagcttgtttcaatccatttctacttcct

SEQ ID NO: 18255 - DNA, 121 bp, Artificial Sequence
  Synthesized
  misc_feature (61): n=t or c
acatctgaccacaggggttttattcctgctcaccaaatctggaactgtgttctgtaatccnctttatgcatacaatgctcactgtaagtttacaaaggaaaaaagttaaaggtgagcagct

SEQ ID NO: 18256 - DNA, 121 bp, Artificial Sequence
  Synthesized
  misc_feature (61): n=c or g
attatagatacccatcttaagaaggatctcagttaggtgatccccttagagtaacaactantgagtctctgaacttgtcaaataattgctgagtttccccagctgcaaaatgggcatgaca

SEQ ID NO: 18257 - DNA, 121 bp, Artificial Sequence
  Synthesized
  misc_feature (61): n=a or g
gcatgtgatattaaacacaccctgtccagagaggacaggaaaattatacaagaagcttganggtgagcaaagcatgagaagggaaatggtacaataatactgaggaaagcacaaactctga

SEQ ID NO: 18258 - DNA, 121 bp, Artificial Sequence
  Synthesized
  misc_feature (61): n=t or c
tgggaaattaattttgctagtattcttcaacacatattctcactgtcggcttttactgttnaatagctgggaaatttctccctacctgcagtaatgatctgtgtcaagttactgaaaggct

SEQ ID NO: 18259 - DNA, 121 bp, Artificial Sequence
  Synthesized
  misc_feature (61): n=a or t
ttttctcctattgcccgtgacatagtctttgttactaatggtattctgtttcttttgatcnctccctggaagttcagcctctctgtgtatgtttgctggggactactctgatgaataaagt

SEQ ID NO: 18260 - DNA, 121 bp, Artificial Sequence
  Synthesized
  misc_feature (61): n=a or g
gaaacagacaaagagaagaattatgaccatattttcagatgaaccctattctctcctggcnggtccatatatcactgaataccactgatttcctctcactgaagttccagcagtgatattt

SEQ ID NO: 18261 - DNA, 121 bp, Artificial Sequence
  Synthesized
  misc_feature (61): n=a or g
attctactttattctgaagaatttctcttagcatagatctcacagagatgcctgacagagntgcactgtaaacagttactgaacctcagcctgtcttgaaagctgtcatgattccgagaaa

SEQ ID NO: 18262 - DNA, 121 bp, Artificial Sequence
  Synthesized
  misc_feature (61): n=a or g
taaccttatatttgtagggataaatctgtcaacataaacatcagaaataagaacaaccaanggcataaatacacgctgttgttccacgtacatacaattgcactaactatcatggcataaa

SEQ ID NO: 18263 - DNA, 121 bp, Artificial Sequence
  Synthesized
  misc_feature (61): n=a or c
ctgcaaatactaaagcactttcagggttatcaagcaatttgtatccaaaagttgtaaaagngaagactaagaactatgggaaattcacattgttgctccataaattttggaataagagata

SEQ ID NO: 18264 - DNA, 121 bp, Artificial Sequence
  Synthesized
  misc_feature (61): n=t or c
gattaaatacgtcattgctttgtacctaaatgcagaacatcacttcctagaggaatatcangtttgagccttgtcccttgtctcacaagctgtgtcaagctaggtcactcttagatgagag

SEQ ID NO: 18265 - DNA, 121 bp, Artificial Sequence
  Synthesized
  misc_feature (61): n=t or c
agtgcagaggaagatgttcctactggtgcccagggcttttgctttaatacttttggtgttntgtcgtggcaactgctttattattaaaaagtagcttcttttaaaatgtggtcacctggga

SEQ ID NO: 18266 - DNA, 121 bp, Artificial Sequence
  Synthesized
  misc_feature (61): n=a or g
tcacattttggcaatccacccttctcttgataacgtcaaaatcctactatggaataggttngattattgatgtcatttgtcctattccttgcctgcaagttatgttaattgaggagaacca

SEQ ID NO: 18267 - DNA, 121 bp, Artificial Sequence
  Synthesized
  misc_feature (61): n=t or c
caaagcactaatcccctcccaaagaaagctcagtcactgccattctaccaagtcgatctanagctctggatgttgtgatacgataacattatggctcacctccttgaagagtgtcccaggg

SEQ ID NO: 18268 - DNA, 121 bp, Artificial Sequence
  Synthesized
  misc_feature (61): n=t or c
tcagatatgcagggatacaagagagtttactttaattttgatatttcttttggaattttangtactctttttcaaacttttgttcaagtactgatgctcatggacagactgcattgtcagt

SEQ ID NO: 18269 - DNA, 121 bp, Artificial Sequence
  Synthesized
  misc_feature (61): n=t or g
tcatattcctaaggtgctgccatactgtggtaatgatcacactgaaatgaggataccaccncacagttggccagtggtgagctgcagatgaggaatttatgctccggacacttccatactt

SEQ ID NO: 18270 - DNA, 121 bp, Artificial Sequence
  Synthesized
  misc_feature (61): n=t or c
taaaaacagctattaaaaaacaacaacaagaactaaatcataatctttctgttagtctctncttaaacatatgtattggccatatactcagggtgagttgagttcaagcaattttcaagtc

SEQ ID NO: 18271 - DNA, 121 bp, Artificial Sequence
  Synthesized
  misc_feature (61): n=t or c
gcagaaatgaatagctagctattcaaaacagttctaagatgatagggtatgaattcgtttntatgcagtatgtacagttaatgacagtatactttatatagacagtagattagctatatac

SEQ ID NO: 18272 - DNA, 121 bp, Artificial Sequence
  Synthesized
  misc_feature (61): n=a or g
aattgaagggagctgactggtaacaaagcaaagagcttgatggctcccacacaagttagcntattgcagatgctcacatcacagtgttaatttcttaattatcatcaaatactcccaatgc

SEQ ID NO: 18273 - DNA, 121 bp, Artificial Sequence
  Synthesized
  misc_feature (61): n=t or c
tgctccttatgttctccctgcaaaagggatcactgagagcctcccaattgcctgcgtgcantgagggaggaacagctcagccatggcgacttgtggaacatagcatggctatggaagggaa

SEQ ID NO: 18274 - DNA, 121 bp, Artificial Sequence
  Synthesized
  misc_feature (61): n=a or g
aatgccccggtctgagagggtcggcagggccatgaacagggcagtctcagggggctcttantacaagcaaagacctattgcagtgcagattatccctcattcctcaaaggcctcagcctca

SEQ ID NO: 18275 - DNA, 121 bp, Artificial Sequence
  Synthesized
  misc_feature (61): n=a or g
accaataactgtgctttttactgtgctattacctattcatctcacttcttaacccacggtnttccttcaaaattaagtcttgcttgctcagtctgatcaattaaattagttgtactgtgtt

SEQ ID NO: 18276 - DNA, 121 bp, Artificial Sequence
  Synthesized
  misc_feature (61): n=a or c
gttaaaaataatttctaataagctccagctgtctgctctgtaaatctccagcagcagtgcngggctgaggctaactaccatgtcagccaccactggctttgaatgatttggaattatgcac

SEQ ID NO: 18277 - DNA, 121 bp, Artificial Sequence
  Synthesized
  misc_feature (61): n=a or g
cccgtggtggtgattactgaacctcagctgagattggggctcccaagcgcttcatctctgnggtcttcaatccaagcacaaaagcccacaaagggcaaatcttggcccactgggctgtctc

SEQ ID NO: 18278 - DNA, 121 bp, Artificial Sequence
  Synthesized
  misc_feature (61): n=t or c
gacccaggcctaaatctagcaatctgctcatggtaggagaatcgagataatacatatgctncatttgctctggccctactgtttccaccattcaatcactgcagggcgttgtggtattcta

SEQ ID NO: 18279 - DNA, 121 bp, Artificial Sequence
  Synthesized
  misc_feature (61): n=t or c
gccccagggcaggagagctcagctcatcacaggagctggcacagggctgaaatacaagagngatgccttcattttggctatgctgtaggcatgttcaattgtatcatgagggacatgctga

SEQ ID NO: 18280 - DNA, 121 bp, Artificial Sequence
  Synthesized
  misc_feature (61): n=t or c
aaagcagaatggcggtgtttttgtttccttcattttagaacactattcatgatcatgaagnagctgccttaccattttactgtacttaaattccgtttctgacaactcataatcctcacaa

SEQ ID NO: 18281 - DNA, 121 bp, Artificial Sequence
  Synthesized
  misc_feature (61): n=a or g
gtgaatatgcttcttgatgaactttttgcatatccatcaaaggatgtgcactgtaaagagngaaagatttatgctgatctcaacataaacctccaaccatttgtccagaaatcgtgccttt

SEQ ID NO: 18282 - DNA, 121 bp, Artificial Sequence
  Synthesized
  misc_feature (61): n=t or c
aagggtctttcattatagcttgtaagtcttacttacctactcagagatcaaccagattctncccattaaaagaatcctgttagagaaaacaggaaccaaagaacgtgggagtccttatttt

SEQ ID NO: 18283 - DNA, 121 bp, Artificial Sequence
  Synthesized
  misc_feature (61): n=a or g
atgcttctgttctgcgtttcactgagcaatagctcctttgtgagaagccatgcagggaacntgtactgaaaaaccttcacaatagaaaatcgctgcatcccagccctgtcagaagttatcc

SEQ ID NO: 18284 - DNA, 121 bp, Artificial Sequence
  Synthesized
  misc_feature (61): n=a or g
tatatttaaaatgatgctagatttgaactcggaaagttacctaaccactgcacatgcaccntgtcctgggaagtgttctggccgagtgccctctcttcattctcttttctgattgcacttc

SEQ ID NO: 18285 - DNA, 121 bp, Artificial Sequence
  Synthesized
  misc_feature (61): n=a or c
tcacaacttgattctttgcttctctttttatggccaacagacctgttacaatctgctttcnttaccctcgcaccatttctcttaggttgatatttggcaattctcactttgtctctctgct

SEQ ID NO: 18286 - DNA, 121 bp, Artificial Sequence
  Synthesized
  misc_feature (61): n=t or c
ttgttccagagtaaggctttacgcaaaagatactgtgaagttaatgctcttttattttggntgaatacagttggatgctccaggaagagtcatgtaatagtgaggatcttcagggagctgc

SEQ ID NO: 18287 - DNA, 121 bp, Artificial Sequence
  Synthesized
  misc_feature (61): n=t or c
tacctgaagtattttccagtttaaataagcaaaatagataaagggcatgagaaaacactangggcagacaacacagattcagagagcttaagggatttaccccatcacaaagcagggactg

SEQ ID NO: 18288 - DNA, 121 bp, Artificial Sequence
  Synthesized
  misc_feature (61): n=a or c
ggatgcaaaataatactgaaaacatcaacagtgccatgatttgaaaagattcccttctccntctctcatactgtttctcagttcaagcaactttgtcctggaaagatataatattctaatg

SEQ ID NO: 18289 - DNA, 121 bp, Artificial Sequence
  Synthesized
  misc_feature (61): n=t or g
tttaatatacttagtaccaccattttaattctatttggctttgaatttaggataaaagtgntaaaacaccctatttcacattgtgaaaatgagccaccgagataaacctttgggttaggga

SEQ ID NO: 18290 - DNA, 121 bp, Artificial Sequence
  Synthesized
  misc_feature (61): n=t or c
tcttacttgtggagtcttactggtgctggtgctaacggggggttgtgtactggcgttaatntgtttcatgaagtccagtgtgttatttttctatacatatttatgtattgtaatacataca

SEQ ID NO: 18291 - DNA, 121 bp, Artificial Sequence
  Synthesized
  misc_feature (61): n=t or c
ctcttcagtttttagttgcatgatgtgttttgtgcttgtgagtgtgggatttctagcattntgctgccggtttacctctcactggctgcagcccctgtgcctctgattactctgagttcag

SEQ ID NO: 18292 - DNA, 121 bp, Artificial Sequence
  Synthesized
  misc_feature (61): n=t or c
tgctcatacagtctctgagactctttctattcagttttctcctgagattgatcaaaattgnattaaacagaagaacagatcactgattatacattttttttttccttaaattataattggt

SEQ ID NO: 18293 - DNA, 121 bp, Artificial Sequence
  Synthesized
  misc_feature (61): n=t or c
gaggctcatgtcaagggatgagacagtctgctggcactggtgggtgccctaactggtcccncactacaggctggtttgggtctgcaagcagcttctctgaagagcatgcccccactcacta

SEQ ID NO: 18294 - DNA, 121 bp, Artificial Sequence
  Synthesized
  misc_feature (61): n=a or g
tgcagtagcagtatctctccccaagtttgtctttggttattaaaaaaatgcaaaggccacntccaaccagaattgctaagaacaagttggaattggtatgttttaagcaagagtttggtta

SEQ ID NO: 18295 - DNA, 121 bp, Artificial Sequence
  Synthesized
  misc_feature (61): n=t or g
aagacatgatgcttatgttaagtgtttttcttcctcacagaaaatatgactaattcatcantaaaatatccacatttctgatagtctctcctttgacatctgtttcagcatttcaggatat

SEQ ID NO: 18296 - DNA, 121 bp, Artificial Sequence
  Synthesized
  misc_feature (61): n=a or g
attcccatgcagtaagctcagcgccattctatgagataactcaagtgagggggagggaaanatctccaaggattacaccaactccacctcttgcccaaaggagggaagttttgactttaac

SEQ ID NO: 18297 - DNA, 121 bp, Artificial Sequence
  Synthesized
  misc_feature (61): n=a or c
tcaagaggcggtgcagcctaatggcttacaacaatacaatcactgctcgtcttccaattanactcaacgagttcatttactgtgcttcaaacagcctcgaggagagacaggactataaatt

SEQ ID NO: 18298 - DNA, 121 bp, Artificial Sequence
  Synthesized
  misc_feature (61): n=t or c
gttttaaaacttcgcatagtcccaccatttctcagagtctgttcatgcattagggctggangtgtacttcctcttcttcttaggctccctccctgaactcttctctgttttatataaaagc

SEQ ID NO: 18299 - DNA, 121 bp, Artificial Sequence
  Synthesized
  misc_feature (61): n=a or g
tcagtacactgtattactacgtctgtagtttcttcacttaaatacatactgcttggcttgngagagaggagtatttgtgtcatttgccagactttctagtttttctatattgttatatttg

SEQ ID NO: 18300 - DNA, 121 bp, Artificial Sequence
  Synthesized
  misc_feature (61): n=a or g
gcatagggttgctttgtttgctgtaatgtttactgattgaaaggggctgcgcgggctcacngaggctgcgtggcactcgtggggacaacgtgaaagttgtggctttttaaaggcaaggagc

SEQ ID NO: 18301 - DNA, 121 bp, Artificial Sequence
  Synthesized
  misc_feature (61): n=t or c
gctatgctatatatctcatttcaagaatctgcgttcttctttctcatcagagcttttcctntattcttccatttttccctggtaatgtgtgtttttccagtttatatttccaaatgcagca

SEQ ID NO: 18302 - DNA, 121 bp, Artificial Sequence
  Synthesized
  misc_feature (61): n=a or g
tctccatgcattggaaatacctacagacatgtagatacctaccaccagaaaagggaacacntgagtccatttacattcacccaggtgagccatgttctcttgatattttacctaaaaagat

SEQ ID NO: 18303 - DNA, 121 bp, Artificial Sequence
  Synthesized
  misc_feature (61): n=a or c
gcacagtcataaacacttcaaatttacagctcatttggacagcaacatcccacgtaatatnctgttctaacagtaatgagtctgagcgcatgcttctcactaggaagcaatccatgattta

SEQ ID NO: 18304 - DNA, 121 bp, Artificial Sequence
  Synthesized
  misc_feature (61): n=t or c
cgaagagacccaagaacttcttgtctgcaaaagaaattatttctgtcacaagaataaaagnacagagagttagttcaacttagtctacttctggtaaattcatgttttattttatcctata

SEQ ID NO: 18305 - DNA, 121 bp, Artificial Sequence
  Synthesized
  misc_feature (61): n=a or c
caaatacacaatgaagtctactcaaattccattctccagcacagagcgaattcccacactnaaggatcttacgatcttagcaactgctcaacattttaaacctcaacttgatactaaatgc

SEQ ID NO: 18306 - DNA, 121 bp, Artificial Sequence
  Synthesized
  misc_feature (61): n=a or t
cttgtaacaggatgttgcttaactgtgagaagagcagttctaatctcttagttaaatctcntttcagtaggaaatgttctgcttgtgagctttccataccttccatgcattccgaagcttt

SEQ ID NO: 18307 - DNA, 121 bp, Artificial Sequence
  Synthesized
  misc_feature (61): n=t or c
agttgtgtggatctaaccaggccctcatcctgaccacccatgcatgcagggccaaagcctnacctaaaaccccactaaagtcattttagcaatctccatggttgatggaggagctcccaga

SEQ ID NO: 18308 - DNA, 121 bp, Artificial Sequence
  Synthesized
  misc_feature (61): n=a or g
taataaattgtcagttttgctttactgactcctgtcagagttctctgaactagggccaatnctggaattcatagatacactgcagccaccaagcttctactttgctactgaacgtgcagca

SEQ ID NO: 18309 - DNA, 121 bp, Artificial Sequence
  Synthesized
  misc_feature (61): n=a or g
acttgggggaagatggccattggtactttgcttccatgttttactgaatcttgttataccnagtaataggaaaaactgaaatgcagtcttattgtataacatggatttttgtgatgcccat

SEQ ID NO: 18310 - DNA, 121 bp, Artificial Sequence
  Synthesized
  misc_feature (61): n=a or g
gcagcaagtcattgcaaactgggggaaggggggaaaaaacaactctcatctgctgccgtcnctttgggcaaagcctgttttttaaacttgtgcagagaaaagtgcagtcccataccaacag

SEQ ID NO: 18311 - DNA, 121 bp, Artificial Sequence
  Synthesized
  misc_feature (61): n=a or g
taggggagagcagagaaggcacaaaagcctgggggctgctctggattcccagcaatagaantaccattgatttagggtaagaaaatggggataggaagtgaatctggcactgggagctatc

SEQ ID NO: 18312 - DNA, 121 bp, Artificial Sequence
  Synthesized
  misc_feature (61): n=t or c
atctgtgactaagatctcagtagatgtctttttgtcacagttcccctgataatcaatgatntttaatgggctttagggaaaaggaaaactaagcctgtatggaggttcctgttatatccct

SEQ ID NO: 18313 - DNA, 121 bp, Artificial Sequence
  Synthesized
  misc_feature (61): n=t or g
ttataggtggatcatccttccttctatgaagaatctaatacctagaaagcatatatctgtnttcatattaaatgatgcttagacaaagttaggaaccattgcatatacatggctgtactgt

SEQ ID NO: 18314 - DNA, 121 bp, Artificial Sequence
  Synthesized
  misc_feature (61): n=c or g
ctgctaactgtatccccatgctgggcagtatgctgggtgcacaagagcaaccgtcacttanccattaacttctgcctctgacttaatctctcacaggacaactactgttgttgtcctgctt

SEQ ID NO: 18315 - DNA, 121 bp, Artificial Sequence
  Synthesized
  misc_feature (61): n=a or g
ctttccttgtatgtatgtatgtatttttcctggcacttctttttgtgatcttgctgaagancacctctgagattcctctcccctgtgtcacttactgccacgctcagtgccttgcaggtgt

SEQ ID NO: 18316 - DNA, 121 bp, Artificial Sequence
  Synthesized
  misc_feature (61): n=t or c
agagtgctgcgtggggaaggagggattttgaatgagcccagcatgtactctgcacctcccnttttctatccaactaccactcaacattttataacctacctgaagtgttttctttagctgg

SEQ ID NO: 18317 - DNA, 121 bp, Artificial Sequence
  Synthesized
  misc_feature (61): n=t or c
ggaagtcacaccagttcagaagggaagcttagctttcagatgtttaaactgaggaaattcnacatttccactcttactatccatttcatttcattcacagggatattgtgattttcagttt

SEQ ID NO: 18318 - DNA, 121 bp, Artificial Sequence
  Synthesized
  misc_feature (61): n=c or g
gtaattttttcagctcctttggttcagtagctgaaatgccaaatcattcatttgcaaactntaattataaatatgattgtcctctactattcaccattcactttccgtggaatccaaaacg

SEQ ID NO: 18319 - DNA, 121 bp, Artificial Sequence
  Synthesized
  misc_feature (61): n=a or g
ttaagcttcaaaattccattgtgaatctttggagatctaaaactctccaggtgctggagangacatacataatttgaaaacagtcccagtgatggaagttgaggttgtcatgagccattct

SEQ ID NO: 18320 - DNA, 121 bp, Artificial Sequence
  Synthesized
  misc_feature (61): n=t or c
tattaattatgaacaagcactaaacctttctcatgtattctttgtgaaattagccctgaangcagttagctggatgcctaaccaagcgcaagatggtacatgcacagcaatttctcactgc

SEQ ID NO: 18321 - DNA, 121 bp, Artificial Sequence
  Synthesized
  misc_feature (61): n=a or g
gctagctagccagtcaggcccaggccttgttagtgcattctttggcctctcgctatgttcntgggtaattttttagtttctgctgtttgattttcatttgattgtgtttttttcttcttaa

SEQ ID NO: 18322 - DNA, 121 bp, Artificial Sequence
  Synthesized
  misc_feature (61): n=a or g
gccagaaaactgtgccaaaaagattaaaaaacatgtaaataatgtcagttgtattaattantgttctctttatggcattctctcaagtggtggggacagtatagaagtatgtagtatagaa

SEQ ID NO: 18323 - DNA, 121 bp, Artificial Sequence
  Synthesized
  misc_feature (61): n=t or c
tgctcaactcagtgacactgcatctgtcaaaaaggtgtatccgtgaccctcaaggtcaaanctgagatgacatattcatggttcaaacactcttctaaaattctgtcactgatgcacgcat

SEQ ID NO: 18324 - DNA, 121 bp, Artificial Sequence
  Synthesized
  misc_feature (61): n=a or g
tgttttggcacagcaggtagttctggattgcattgctttcaaccagagcacttgctccaanagcaggcaaccatggctatcagattgctttgtagccaccaaattcccagctcttccaagg

SEQ ID NO: 18325 - DNA, 121 bp, Artificial Sequence
  Synthesized
  misc_feature (61): n=a or g
tgtaaaattatgcttagacaaaagctggagaggctgtattagtcactgaaaggacactgcntttcttgctcaggttttgatcgattatcattgttaagtacacttacgagaaatatatgca

SEQ ID NO: 18326 - DNA, 121 bp, Artificial Sequence
  Synthesized
  misc_feature (61): n=a or c
gtgagctccatcccaaatatcttacttccctgcagtgtggtgtaggtggagttgttgtcanataagcttctctttgtgtcaagttgacactcacagtttggatagagttgttatttggtgt

SEQ ID NO: 18327 - DNA, 121 bp, Artificial Sequence
  Synthesized
  misc_feature (61): n=t or c
ctggctgcccacataggggacaagggcacacaggggcacatatctggccttgatctgccanggcattgagaccgccctctgcagcatctgctggtagaggggtctctcctggtcctcaaag

SEQ ID NO: 18328 - DNA, 121 bp, Artificial Sequence
  Synthesized
  misc_feature (61): n=t or c
aagctgaaaaaacttgcaccaatttaccaaaggaacgagccaccaagggaagcgatgatcnacagctcagaaccttcatcatgggaggatacaaaccagaacagcgctcggcagaagccct

SEQ ID NO: 18329 - DNA, 121 bp, Artificial Sequence
  Synthesized
  misc_feature (61): n=t or c
aacaagaaggcaattgagaaagacctgtgtgcaccgtgtgcctccctgccagctccatttncagtgcttcgtgccccaacgcatttgagatgctgaggaaggaaatcagctccacacccct

SEQ ID NO: 18330 - DNA, 121 bp, Artificial Sequence
  Synthesized
  misc_feature (61): n=t or c
agatgaaaacctttttgctgttgtacacttgaagattttggagagagaggacttattctcngaagagtaatttatatttttatggcacctgaaaatcttaatccacatgaaaaaactcata

SEQ ID NO: 18331 - DNA, 121 bp, Artificial Sequence
  Synthesized
  misc_feature (61): n=a or c
ggccacagagacagtaaggtactgatagctgactaaagaaacaagatgtacccaaattacnttcataacaacatcacaaaaactctacttttactccgagataacaaaacatcattgttcc

SEQ ID NO: 18332 - DNA, 121 bp, Artificial Sequence
  Synthesized
  misc_feature (61): n=t or c
cttgagccagactccatacaaagcaacagtagagcagcaggtgcctatgtgggcaatcctncctctctgggcactaagaaaatatggttcacagcagatcatgttgtgcaatgagtttctc

SEQ ID NO: 18333 - DNA, 121 bp, Artificial Sequence
  Synthesized
  misc_feature (61): n=a or g
ccatgtctcactatggctttttttctcagggaattttgaaccaaaacaacccctgccactngggacatggcagtggctgcactgcagcaaccctcctgctgcttattgattgtgagaaaaa

SEQ ID NO: 18334 - DNA, 121 bp, Artificial Sequence
  Synthesized
  misc_feature (61): n=t or c
ttcatttcatttaccaaccatttcatctacctcctgcagctagatcctgttctctgcaagngaccaccaccttccagcacccaccttggagaagtgggctggtgctcagcagggacatgca

SEQ ID NO: 18335 - DNA, 121 bp, Artificial Sequence
  Synthesized
  misc_feature (61): n=t or c
tacagcatcacatgatgctatcagagtcaaggtagctacaaaacacagaaggatattacantaactgggctgtacaagctaggttgttgtcttttatccaggtgatgagcttcacacctca

SEQ ID NO: 18336 - DNA, 121 bp, Artificial Sequence
  Synthesized
  misc_feature (61): n=a or g
gcagcaagctggcttcttccctgctcccacctctcccttacagagttgttgcactgtattntgaaggcattctcaattgctccctgcagatctggtctgcccagcttaagtctcctccctt

SEQ ID NO: 18337 - DNA, 121 bp, Artificial Sequence
  Synthesized
  misc_feature (61): n=c or g
gtaatcatggtgcctatattatcaatctacatttgatggtgtgtaaatggatggagcacantgtcccacatatgcaaatagcagagcattaaaagcaggtctaagtcagtaagtatatttc

SEQ ID NO: 18338 - DNA, 121 bp, Artificial Sequence
  Synthesized
  misc_feature (61): n=t or g
actggttctgcaagtatagaagatgaaagctaaataaaaaggccagacaaattcctactangaaagaggaagaagattttaacactaactttcagcaacaatggaaaaaaaagtcaagact

SEQ ID NO: 18339 - DNA, 121 bp, Artificial Sequence
  Synthesized
  misc_feature (61): n=t or g
tcaccttagccttcccttggaaaagagatgggggcaggagatgaggtgacagatgggttantatgattcttcgggaaggcagcttcttcatcctctttaaagcaagtggaagaaataggac

SEQ ID NO: 18340 - DNA, 121 bp, Artificial Sequence
  Synthesized
  misc_feature (61): n=t or g
tgcacagacatagggaatcatgaaagaaatgccaccaacaagattagatgtataaaataanatcaaactcaataaaatattcagaggaagatttagaagcattttaagagagtgtgtaaat

SEQ ID NO: 18341 - DNA, 121 bp, Artificial Sequence
  Synthesized
  misc_feature (61): n=t or c
ataaatctcccaaaattggcctttctgagataacctcagtcaatgtttcaagatgtagcangagaaatcatcaaatagatgataccaaacactaactgctttgctcacaggttgcaatggg

SEQ ID NO: 18342 - DNA, 121 bp, Artificial Sequence
  Synthesized
  misc_feature (61): n=a or g
gatcagcacggagcatttctgaggaacgtctgctgccggtacacattttgtgaaaaatccnaagcagttccaggtttgataaacagtgctaggtgccaaaatgatcaccctttctcaaatg

SEQ ID NO: 18343 - DNA, 121 bp, Artificial Sequence
  Synthesized
  misc_feature (61): n=t or c
gcaagtgtaagtgttctctatgctggcaaggcacaaagaacatgcatctctacttttcaanttacacagtcataccaataccaggatgagggaccagtgctgaggcaagataagctgagac

SEQ ID NO: 18344 - DNA, 121 bp, Artificial Sequence
  Synthesized
  misc_feature (61): n=a or g
actggagttagaagtattttgcatcctatctagtaatactgattccaagtctaagtctacnttcttagaattgtgaccttcgtggttgaaaatgtgaaatctttttgtgtgtacagtgtat

SEQ ID NO: 18345 - DNA, 121 bp, Artificial Sequence
  Synthesized
  misc_feature (61): n=t or c
acaatacaagaaaggagggctgagcagcaccagcgggtcctgcagcagccgtgtggttccngggcagctctgacataaagacataaaaaccccaaagcccctgaaaagtgagagctggggg

SEQ ID NO: 18346 - DNA, 121 bp, Artificial Sequence
  Synthesized
  misc_feature (61): n=a or g
gcctatgaactgatccacagcacccaggagcacatgcatgctgatagcccagtggatacantgcagctccaggctggcctctcccaacttgcaggagctcttgaagggcattgctttctca

SEQ ID NO: 18347 - DNA, 121 bp, Artificial Sequence
  Synthesized
  misc_feature (61): n=t or c
ttggtgatgttttcctgcatacagaggaccttgaggtcctgctccttgctttaaaatgggncctggctttggaaaacaatcagagctttagaaatgttcctgttcttggcagagcctgtgc

SEQ ID NO: 18348 - DNA, 121 bp, Artificial Sequence
  Synthesized
  misc_feature (61): n=a or c
catgttgactttgttcagtcaccaactacactgaaattaggaggaaaaactaatacaaatnagaaaaatttattgtctggatctcagtaggaagtgttgaagcctttgctaggttgtagag

SEQ ID NO: 18349 - DNA, 121 bp, Artificial Sequence
  Synthesized
  misc_feature (61): n=a or c
ctcagaaagcattgcttgtatataatcttgctgttgacagtcaagctggtgtgatgatttnatagatatattttgaagctctaatttactattccaggaagttattttaatgattgtttgc

SEQ ID NO: 18350 - DNA, 121 bp, Artificial Sequence
  Synthesized
  misc_feature (61): n=t or c
tggtttctgttgtgaaatccaagagattcatgcctaagaatactactaaaaataatccttnttatcattgtcagggcactgaaaccactggatctagtggaacaattcattctttagactg

SEQ ID NO: 18351 - DNA, 121 bp, Artificial Sequence
  Synthesized
  misc_feature (61): n=t or c
cttagcatcctctaacagctgctgttccagcttcaacttgcacattgtttttctttctagnttggtgtgaatgcattctcctttgctagaagattgattatcaagaaatcgtgcctgaaag

SEQ ID NO: 18352 - DNA, 121 bp, Artificial Sequence
  Synthesized
  misc_feature (61): n=a or g
gaaagataacagaagcaaacaacaaatatccaagtcatctagactttgccagcacagaccngggctgaactggatagtagttaactttaggctcaatatacttcttcctggaagtttttct

SEQ ID NO: 18353 - DNA, 121 bp, Artificial Sequence
  Synthesized
  misc_feature (61): n=t or c
tccctcctccctttaccagaggagacagatgacttggcatggtcagctcactaagtgcagntgagggaggttctggttgttctccagctgtgcgttggggatagcccagtaacatgtacat

SEQ ID NO: 18354 - DNA, 121 bp, Artificial Sequence
  Synthesized
  misc_feature (61): n=t or c
gttggagaatggtcattgaaatctgtgatcaaaacaccagatgagaaatatagctcaaganggagtcaggaaattatttatgtgaaaatgaagtaatgtgagtcttttaaagaacaagaag

SEQ ID NO: 18355 - DNA, 121 bp, Artificial Sequence
  Synthesized
  misc_feature (61): n=t or g
ctagaacaataagatgactttcaactgaagacagcgatgtcagtctccttatcagtacgcnccttcaaagagccatctgaaattctcttcctttcagacagacagccctcagatttgcggc

SEQ ID NO: 18356 - DNA, 121 bp, Artificial Sequence
  Synthesized
  misc_feature (61): n=a or g
ttctgatcataaagccctcctcacagtgggaaagtctctctcagtgctttaagacatctcntgtgctcctaattattcttcataaacatttttcctcttcctctccaatgttgtcccatat

SEQ ID NO: 18357 - DNA, 121 bp, Artificial Sequence
  Synthesized
  misc_feature (61): n=t or c
aaggtagattagaaagggagtgaatcacaatggtagattttagactttaatgtaactgtcnaatctctcaaactctagccaaccatatcttaaagagtctgaacagattttcatcatttgg

SEQ ID NO: 18358 - DNA, 121 bp, Artificial Sequence
  Synthesized
  misc_feature (61): n=t or c
tgactgagcactgacacaggttgaccagaatgattgtggaatctccttcttggatatattngtaagctgtcagcagtatgctatctttcacactgataccttcagaaggctcatatgtgag

SEQ ID NO: 18359 - DNA, 121 bp, Artificial Sequence
  Synthesized
  misc_feature (61): n=a or g
atcctttgcatgtgtttttatcattccagcctgccatatggtgtatggccttcacaaagcngatcgtgaaatagaagagtgcagtaagctgtatctcactagggaacataacttctggcat

SEQ ID NO: 18360 - DNA, 121 bp, Artificial Sequence
  Synthesized
  misc_feature (61): n=t or c
tcttttaattatttttgatcagtttgttactgtccttcaggggaagtttcacttttgagtnaaatacagtttggaccatgccatgtctggagaaaggcttttctcttcatgtgaaatctgc

SEQ ID NO: 18361 - DNA, 121 bp, Artificial Sequence
  Synthesized
  misc_feature (61): n=a or t
attcatctcagttgaatggggtagagtgttcagaagtaacatgctttttacctcctgcccnattcaccagtataaacaagttaggtatacactttaagcgtgtcataaaccactcttgact

SEQ ID NO: 18362 - DNA, 121 bp, Artificial Sequence
  Synthesized
  misc_feature (61): n=t or c
ttcaaggtctctttcaggctgatctttgaagtgttcatgtattacatttcaccttaaaaanacacctttttaatacatgttgccaaaaaatagtggagaaagaaatttgttctaaaggaac

SEQ ID NO: 18363 - DNA, 121 bp, Artificial Sequence
  Synthesized
  misc_feature (61): n=t or c
ttgaatatactgtccccagatccacaaacaaggatgtatcaatcttcaactcattccctantgaagtatattgagtttgtgacaagtatgcagcatgtgcattcactatttcctcacatgt

SEQ ID NO: 18364 - DNA, 121 bp, Artificial Sequence
  Synthesized
  misc_feature (61): n=a or g
cacagatctcccagtgctcggtctgggacaccctcaggtgggctcagcatctcccacctcncagggagaaccagtgtgcaacggctgaggtgcaaccatcacagatattacagaatcactg

SEQ ID NO: 18365 - DNA, 121 bp, Artificial Sequence
  Synthesized
  misc_feature (61): n=t or c
tcaagagaggaggacaaggagggatacctatttgtttaatgggtctccctcttaaaaccanttttgccacacttaataatactgttgtctcactatgaagctgagattttacattttatga

SEQ ID NO: 18366 - DNA, 121 bp, Artificial Sequence
  Synthesized
  misc_feature (61): n=a or g
ctttcgagccaccaccacagtgagatgaagggtaggttttgctccatgagttcttattacntgctacttaaagactctgaaaagtctatatgccttaataatgcaatcaaacagaatcatc

SEQ ID NO: 18367 - DNA, 121 bp, Artificial Sequence
  Synthesized
  misc_feature (61): n=t or g
taaatcaggaagatacaccaggaagatactgcctttgcagagaactgtgtatgctctctgncaggtaaaggccctaaagggaaggtgggcttccaaaaggagctaacaggactacgctgga

SEQ ID NO: 18368 - DNA, 121 bp, Artificial Sequence
  Synthesized
  misc_feature (61): n=t or c
atgggagatgggaacagctcttccagcctctctgctttctgagagttcccagctagcagcngtttcctgggagcattgtggtgcagtgcattacccaacaggatgtggggggaggtgaaat

SEQ ID NO: 18369 - DNA, 121 bp, Artificial Sequence
  Synthesized
  misc_feature (61): n=a or g
ttcatagtgagttctaccagaagtacctcacctgtgtagacccaaggctgggaaaagacangtgttgtgaagcagacttctctgttgctttctttgcctggaaacagacaaaagcttggcc

SEQ ID NO: 18370 - DNA, 121 bp, Artificial Sequence
  Synthesized
  misc_feature (61): n=t or c
gggccatctgtgtagatttgctgtctgttccctgggaaagcaaggcatgccagggaacagnttagtccactgtgtctttgttattctcactgctttctatttgaaagggccttctgatact

SEQ ID NO: 18371 - DNA, 121 bp, Artificial Sequence
  Synthesized
  misc_feature (61): n=t or c
tatagggacgttgctttcccttggcccccagtgccccccggttttaatgccagcaaagggngagcaccccaaatccacattgggaagctccgaggtcgctgggttcttccaaggctttaag

SEQ ID NO: 18372 - DNA, 121 bp, Artificial Sequence
  Synthesized
  misc_feature (61): n=t or c
ccatctcatcccttgctcagctatctaaactgcaacccaagcaaaagttcaactatagctntccttctccattttcagcatggttattcctagcacatataaaagtttttgttggcttttt

SEQ ID NO: 18373 - DNA, 121 bp, Artificial Sequence
  Synthesized
  misc_feature (61): n=a or g
gagcagcaattggctgtgtcatcagcatgctaccagaaacagtactgacttctactcatanattggtttggtaacagaatttgctcttcagggttgagataataggaaatatgttaggtaa

SEQ ID NO: 18374 - DNA, 121 bp, Artificial Sequence
  Synthesized
  misc_feature (61): n=t or c
tgttcaacagatatttcgggggaagtagccttacttacattttcatggaaatccggtcctnactttgcttcagaaatattcttaacctcattttttaagtaaatatgtagcttctctttag

SEQ ID NO: 18375 - DNA, 121 bp, Artificial Sequence
  Synthesized
  misc_feature (61): n=a or g
ctaggtctaagttatgtttcacaaggtctttagttttaaggaacttaaaacaccttttagnagctgaaacagaaatggcatcatagctacacacagagattatcaggtgagcatttgagac

SEQ ID NO: 18376 - DNA, 121 bp, Artificial Sequence
  Synthesized
  misc_feature (61): n=a or c
atttacattcttttcttgtgtagcaacaagttaaccttcacttggtagagcaattgtctgnaaatgttatcactattttctgattgtggtatctctgacatgatgtttttctttcttttgc

SEQ ID NO: 18377 - DNA, 121 bp, Artificial Sequence
  Synthesized
  misc_feature (61): n=a or c
tacaacttgcctcagagttttcaaatgtgatttagagcaatctcacttgaatcagttgcangtataacacctggacatccaattaaacattaaataaataaaaccattgactcattaaaaa

SEQ ID NO: 18378 - DNA, 121 bp, Artificial Sequence
  Synthesized
  misc_feature (61): n=c or g
caacaatgtgaactggcatttctttctttccaaaaaacaggcttgctgtgaggctaagaancaagaaggaaggagctctctctatggtaatgtatggtaataaatacattttcacacatag

SEQ ID NO: 18379 - DNA, 121 bp, Artificial Sequence
  Synthesized
  misc_feature (61): n=t or c
atgacacaagcactacatctactgaagaaagagcaacataccttgaaaacttcttttaaanaatgcctgtaaatttctgctatccacttgtaagatttccagacccaagaaatacacctgt

SEQ ID NO: 18380 - DNA, 121 bp, Artificial Sequence
  Synthesized
  misc_feature (61): n=a or g
gaagaatagatattcttacaaatctgattttactgtttgctagcttctaagacctacatcnaggttgacctgaaattgaaagaattaaacaagtaaatgatcagtatgcgtagatcagaat

SEQ ID NO: 18381 - DNA, 121 bp, Artificial Sequence
  Synthesized
  misc_feature (61): n=a or g
catttgtctccctttttcttttttaattgatttctttggtgtttctctgctttcctccaanacaaaagcatacatacaactgtacatataattgcagaagacttctctgctccctctttca

SEQ ID NO: 18382 - DNA, 121 bp, Artificial Sequence
  Synthesized
  misc_feature (61): n=t or c
tttgtcatgctcctgcttttcaagtttccgatttctgtatttccacttttctgttcactcnatttatttcccccaaattcccttgcaaatagttgctagacatgtgagggaccaccaagag

SEQ ID NO: 18383 - DNA, 121 bp, Artificial Sequence
  Synthesized
  misc_feature (61): n=a or g
acctatcagctcattggaaatctcagcagccctgtctgaagcacggcatgaaataaagacnttccaaagagctgaagtgaaaaccatacctgccacagtggaggcgcaccttgaaagacac

SEQ ID NO: 18384 - DNA, 121 bp, Artificial Sequence
  Synthesized
  misc_feature (61): n=t or c
cctgagatctctccatgagtacagctcttgctgactttcacagtaagcttcgtagctacangtgaggctgtaggggatcagcttttcccattttttttttttaagaaagcaataagtcatg

SEQ ID NO: 18385 - DNA, 121 bp, Artificial Sequence
  Synthesized
  misc_feature (61): n=t or c
ctataaaaaatcctccctgtactgctttttaataaaccaacaagcctctcccaaaacaacnagaaaataattcagcctcttacttctaataagctatcattgctctacacagaagcccaaa

SEQ ID NO: 18386 - DNA, 121 bp, Artificial Sequence
  Synthesized
  misc_feature (61): n=t or g
gttaattactctgagatggtaaatataatgttctaaagtgatggttcatcactactgattntctgcacaagtatcctgtacttacagcatgaatgatataagacagtgatatttcaagcga

SEQ ID NO: 18387 - DNA, 121 bp, Artificial Sequence
  Synthesized
  misc_feature (61): n=a or g
tactggagagcgacagcatagatctctcagcacagcttcctggcagattctgagattagcnatcatcgtaaaacttacagtgggttctgttcctcctgtccctcacaccgaaattatccct

SEQ ID NO: 18388 - DNA, 121 bp, Artificial Sequence
  Synthesized
  misc_feature (61): n=t or c
tacgagcacttagtacttaatgtcagaatacaaagccctttgctggtctttacgagacagnatcgctttctatacgtcctcctgctgctaggagaagttcagaggctgcagaccgagaggt

SEQ ID NO: 18389 - DNA, 121 bp, Artificial Sequence
  Synthesized
  misc_feature (61): n=t or c
aaactcctacattttataatcaagtaatgttaacaatgctaagtagctactatgaccaagngcatcacagattacaaaacattgctttgatgggcaataccattccctgtagcttctggga

SEQ ID NO: 18390 - DNA, 121 bp, Artificial Sequence
  Synthesized
  misc_feature (61): n=t or c
agaagacggtgataaatcagacagtagaggatttgattctgtccagactcctacttcatanagccatctgaatgaaaagctataaaaacaaattaaaacagacctcagtaaaccacagggt

SEQ ID NO: 18391 - DNA, 121 bp, Artificial Sequence
  Synthesized
  misc_feature (61): n=a or g
cttccaaactaaagtatgaatcagccacaccagcggcatttttcatgcacctgtttagacngtggacattatccggtgcttgcaaagcgctactgcagcccttgttagcattggttttaaa

SEQ ID NO: 18392 - DNA, 121 bp, Artificial Sequence
  Synthesized
  misc_feature (61): n=t or c
caactgtaggctaaacactaagataaaccccagacagaggtagttatttagagcagcaacngtgcaagcttatgtcagaaggaattaaaaatgaatttctttcagcatttcatttagacta

SEQ ID NO: 18393 - DNA, 121 bp, Artificial Sequence
  Synthesized
  misc_feature (61): n=t or c
tggtgcaaaggagctcagcctgagcaggacacaaactttagtctctgcagaaggggaaaangttcaagacagaataatacagtaagtaaggaagtgggtatgtttaagaaagagttgagac

SEQ ID NO: 18394 - DNA, 121 bp, Artificial Sequence
  Synthesized
  misc_feature (61): n=t or c
cacccctggaaacctcccagttctgtggaaactgacaaagtctgcttgcttctgactctantgcacatcacagaatcagaaccttgagaaattgcagactcttagcacagaggctccttgg

SEQ ID NO: 18395 - DNA, 121 bp, Artificial Sequence
  Synthesized
  misc_feature (61): n=a or t
gggttaaatgaagttaaatgcctttgactcttttaagaaacagtcctacactgatataatnaatattactaatttaactttacaatcagattacaatacagctgacattctaatatatata

SEQ ID NO: 18396 - DNA, 121 bp, Artificial Sequence
  Synthesized
  misc_feature (61): n=a or t
cagctaagatttcctgtatcaatatgttgccacggtaacagtcaataacctggtagtgatnagaaaaacctaaaatagctgttattatgggcatgcatatggacttgagggttctggtgga

SEQ ID NO: 18397 - DNA, 121 bp, Artificial Sequence
  Synthesized
  misc_feature (61): n=a or g
tgtccccacgctgctcctcagcactgcagctctcttgttaagtacaacatttgctttttcntattggccttttcctctctgaactcctagcactaggagctgctctgtcctgcactcagcg

SEQ ID NO: 18398 - DNA, 121 bp, Artificial Sequence
  Synthesized
  misc_feature (61): n=a or g
acagcaacagttggaaggtctggaacaaaccctgtgaaaattcaagcagagcttcctaacnagggcatcagcagggagaggaactggcccagataacattcatttagtccttgatcctata

SEQ ID NO: 18399 - DNA, 121 bp, Artificial Sequence
  Synthesized
  misc_feature (61): n=t or g
tttataatgagttattactccttatataagcaaactctggaaactatgcttccccattctnctgaacagtgagttggactaagcagctctcacaccaagacatgcttgcagagagagacag

SEQ ID NO: 18400 - DNA, 121 bp, Artificial Sequence
  Synthesized
  misc_feature (61): n=a or c
cactatgagatgaccattgttatctctctccttttatgcacaaaatactaaaatgcaatgnagcatgccagcatgacaccacaacatccggtaaatcaacgaggctgttgaaaaagcagtt

SEQ ID NO: 18401 - DNA, 121 bp, Artificial Sequence
  Synthesized
  misc_feature (61): n=t or g
agttcttacaagctcagctctccctttggaccagagagatcctctgagcaccaaagagcanccaggacaccaacatgtggaaagaagttgcagtcctttggtgggcatggtggacatctca

SEQ ID NO: 18402 - DNA, 121 bp, Artificial Sequence
  Synthesized
  misc_feature (61): n=c or g
cgagcactggaagcaggatgtgggcagatgcctggggatggctgctactagaggaaatcanattgccactcatttcttcctgtgttttttggcagagtcctgctgtcctctctccaacttc

SEQ ID NO: 18403 - DNA, 121 bp, Artificial Sequence
  Synthesized
  misc_feature (61): n=t or c
tccatgtggttaatgtcaagtcaaaagctaagtagttattctctctaccttaggatgcagngtcttacgatattctaagggtctctcatcagagtccctcactcaaggctcttccaactca

SEQ ID NO: 18404 - DNA, 121 bp, Artificial Sequence
  Synthesized
  misc_feature (61): n=a or t
gaatccctcgtgctcaataggcaattgcaaggtatagtctccttatgttgtggtgctgttnttcccctctgtggtacttacccaagccaagattagatattaggagaaagcttttccccca

SEQ ID NO: 18405 - DNA, 121 bp, Artificial Sequence
  Synthesized
  misc_feature (61): n=t or g
tgattggcaaagctcccattaacttcaacagcaaaagggtaggcatccagtaccagggacntgacccttgtatttcaataatgttgtgcacacagtggggtttctataaataatagtgaag

SEQ ID NO: 18406 - DNA, 121 bp, Artificial Sequence
  Synthesized
  misc_feature (61): n=a or g
gcattcactaggatatgtgtgtttaagtagaattaaattagcagtgagagttattaaaganatcttccatactattgtccagtggactgtgatctgtggtgaaatgaatagtaaatgaagc

SEQ ID NO: 18407 - DNA, 121 bp, Artificial Sequence
  Synthesized
  misc_feature (61): n=t or c
ctttctgtgtaagagtgcttcagacgatcctgttactcaaaatatataaaagtgggaaaanggcttttaacattgcctactactacatttacccttcttcccatactattggtaaaatata

SEQ ID NO: 18408 - DNA, 121 bp, Artificial Sequence
  Synthesized
  misc_feature (61): n=a or c
tgatttgacttgaatacataatttggggttctgtcatgacacctatgaaagtagtccaatnaaattatttgaaagtgtaggaagtgttgctggttctaaaataacttttatcatcagtaat

SEQ ID NO: 18409 - DNA, 121 bp, Artificial Sequence
  Synthesized
  misc_feature (61): n=a or c
aaacatctttctgtctacaacactaagataaatgaatgacttaaaacatcctactgaacanttaacatgtatacccacactaccttcaatagtttttaattttcaacagtccaaaacaagg

SEQ ID NO: 18410 - DNA, 121 bp, Artificial Sequence
  Synthesized
  misc_feature (61): n=t or c
tttttggggcgttgtgaagtgtgggttctctgaacgtagataggatgctgccaggctgtgnccctttgaggctgctgatgtcggctgtgtgaagttgtgcagatttgttgggtgtgtgaga

SEQ ID NO: 18411 - DNA, 121 bp, Artificial Sequence
  Synthesized
  misc_feature (61): n=a or g
gggaggtctctgcagtgctctacagcacactgtggagctgatgggtacattgggtggggtngcctgtcatgccccatgggaatgcataggagagtgtggggacagtagaggaccatggagt

SEQ ID NO: 18412 - DNA, 121 bp, Artificial Sequence
  Synthesized
  misc_feature (61): n=c or g
agagggaaatgaagggaagaaggactctgctccctgagcaattgcactctgcaaccagagntcttcaagaatagactacacacctgctcaggctgacaccagacacctacaatcctacagt

SEQ ID NO: 18413 - DNA, 121 bp, Artificial Sequence
  Synthesized
  misc_feature (61): n=a or g
agagatgcttaagcttacccagtaggatgtaagttgtcactgcataaacttttgcctctcngtttggactttccatagtactttgaggagagtgacctttctttctgttgcatacacgcag

SEQ ID NO: 18414 - DNA, 121 bp, Artificial Sequence
  Synthesized
  misc_feature (61): n=t or c
gctgaaggatcacacctctcctttgcggcagaggcagacttgcctcttctaacccccaaantaaagaatgaatccataaacaccttaaaatccacagaaagtaatgtggaagacatgaaaa

SEQ ID NO: 18415 - DNA, 121 bp, Artificial Sequence
  Synthesized
  misc_feature (61): n=t or c
tcttccttgttgttttaaacactgcttagctggagtgctagctgatactgaccaatcactncagagccaagcatcttcactggtctggcacagcaggagagtttctgtttctgctaattgt

SEQ ID NO: 18416 - DNA, 121 bp, Artificial Sequence
  Synthesized
  misc_feature (61): n=t or g
gtgcactgtagtcatcaagctcagagctgtgtgctgcatgctcagaaccagatgggcacancaacccctggcttcattaatcccaaagggaaaagtaggcctcccctcccctgcagcccaa

SEQ ID NO: 18417 - DNA, 121 bp, Artificial Sequence
  Synthesized
  misc_feature (61): n=t or c
tgcctgtaaataaacatctggggcttctaagctgatgtcttcagtaatccttgaagacttntgtacttcaggaaaaccttcatctgcctcctttgtatttgtattgcagtgagaatccacc

SEQ ID NO: 18418 - DNA, 121 bp, Artificial Sequence
  Synthesized
  misc_feature (61): n=t or c
catcagatccaactgggccagaaccatgacattttcccttccagatgagtcccaaacttcnttcaaacagaccacatggaatttcctcagttggggcaaagcaaaggaagtttttttgaac

SEQ ID NO: 18419 - DNA, 121 bp, Artificial Sequence
  Synthesized
  misc_feature (61): n=c or g
agttatatctacccttgacaataactttgaggaagaccaataaaaaacagcacaggaaaangttgtaccttccatctgtcctcacgtaacattgtgatggtttatgaagctacatgtgaat

SEQ ID NO: 18420 - DNA, 121 bp, Artificial Sequence
  Synthesized
  misc_feature (61): n=t or c
agcagaaacctggtattacatgtaggaaaactacatttttctgaattttgctgtatcagangtgcctccactaggaggagttgtcatcatatgcttgcactgtaagaatattaggcttgtg

SEQ ID NO: 18421 - DNA, 121 bp, Artificial Sequence
  Synthesized
  misc_feature (61): n=t or c
ccttcctttgccaggcaccaaatggacctggggaaaaatatcctgggaaagcaatacagcngttggtacgcagctcacatcccgccctacactaagttatcctgccccttagggtattact

SEQ ID NO: 18422 - DNA, 121 bp, Artificial Sequence
  Synthesized
  misc_feature (61): n=t or c
taggattaacaccatcagctgaaggaatgtgcctctggctgcactgtgcttctgttattancattgtatcttcagattttcacgttcagcctagttggagcaggccagctggtgtaaatca

SEQ ID NO: 18423 - DNA, 121 bp, Artificial Sequence
  Synthesized
  misc_feature (61): n=a or g
atagagaccgtggttttcccttgagttgtaagtgtggagccagcatcgtctcacagggacnaaatcaaggcaagattcggtgtgaaatgtagtgaagaacagcaaagcccacctgtgttgg

SEQ ID NO: 18424 - DNA, 121 bp, Artificial Sequence
  Synthesized
  misc_feature (61): n=t or c
tactgattttacaataagtcttttcaacctaaggtttgctgcagttgtttagggatcatgnagacacaaccatacatacactatctggtcagtcttttccacaaggtactggctttgttta

SEQ ID NO: 18425 - DNA, 121 bp, Artificial Sequence
  Synthesized
  misc_feature (61): n=a or g
accattcactttttctctactgctgctcagaaaattcctagaaactaagagtgataaagcnaagaatcctccagcaaccaagtcctgaatgtctgtctctaggagtagcagagaaccacaa

SEQ ID NO: 18426 - DNA, 121 bp, Artificial Sequence
  Synthesized
  misc_feature (61): n=t or g
ttctacctgctttagaaacaaggtgttgttgcagtttaccacttcttatttgttttgactnctggaagtgcagtacatcttatccaatgtaaggtaagaccagtcctgccccaaagaaact

SEQ ID NO: 18427 - DNA, 121 bp, Artificial Sequence
  Synthesized
  misc_feature (61): n=a or g
tacagtatttctatgcctctggctgggaggcaatacatgaatagaaaagtatctcatttangatattcagttgagcttggtgtccaggtctgagcaagctgtcttctaaaggtaatctttt

SEQ ID NO: 18428 - DNA, 121 bp, Artificial Sequence
  Synthesized
  misc_feature (61): n=c or g
tgttaatgtaccttaactttatcaaagtttgagctggcccatactgagctgactacaaacntatatataacctatgtattatttattttactattgcttaaaagtcatggacagggaaatt

SEQ ID NO: 18429 - DNA, 121 bp, Artificial Sequence
  Synthesized
  misc_feature (61): n=a or g
ttacctaggagagtgctgtttgttcccttctcttctctcttcctcctttttaaacagcgtngggggtgatttctgccctactttgtatcccaccttttttttttttttcccctttatatta

SEQ ID NO: 18430 - DNA, 121 bp, Artificial Sequence
  Synthesized
  misc_feature (61): n=t or c
attttctatgcatctaggtttcattgtggacttcagcaaacacattttgcagaacagagangaaccaggtgcagctcttctactaagactgtctttagccaactgaatttatgttatgccc

SEQ ID NO: 18431 - DNA, 121 bp, Artificial Sequence
  Synthesized
  misc_feature (61): n=t or c
gtacttcgacatatctaaagtatttcaacactcaaaaataattccagtactcaaaacatangttttgtaggaatgtgtttgagggagagcagacagggcgaggggcttgaggctggaaatg

SEQ ID NO: 18432 - DNA, 121 bp, Artificial Sequence
  Synthesized
  misc_feature (61): n=t or c
gatgagtctggtggaaaaaccagcacagtctgaattcccctttagggaatctcagactctngttctgggtagctgtattgagaatatgacgcactttgctatatgtcatgctgggtattgc

SEQ ID NO: 18433 - DNA, 121 bp, Artificial Sequence
  Synthesized
  misc_feature (61): n=a or g
aacaggaaatctgaggtacttcacaatacatcattttcacattccttccacacctgagcanaatctttcttcattctgtagcaagtgctgaatattgagagagatcctttggcaccttcgc

SEQ ID NO: 18434 - DNA, 121 bp, Artificial Sequence
  Synthesized
  misc_feature (61): n=t or g
cctggtaagctccttcagcatctgcaagagcgctgcatgtcctggtctagggctccagcancacgtagccatagacacagagcccatccttagcctgcagctgcaaggcagtaaggctcag

SEQ ID NO: 18435 - DNA, 121 bp, Artificial Sequence
  Synthesized
  misc_feature (61): n=a or t
ctaagtagaagcaaaattctgggattttcagctgagtatgaaaaataaattagtggcaagncagttatttaacttgtaacttttacattgaaaaatcatacggaaattcattttctaggtg

SEQ ID NO: 18436 - DNA, 121 bp, Artificial Sequence
  Synthesized
  misc_feature (61): n=a or t
tttctgtacaacctcagcaatgcttctttacctaccaatagagtcatgatattcagtctangaagacatctaaccagctcttcttcagacgccaagaagttcatcagtgccactgaacgcc

SEQ ID NO: 18437 - DNA, 121 bp, Artificial Sequence
  Synthesized
  misc_feature (61): n=t or c
aaatcttcgttttggctcaaacccccataaaccttgatagaacagttctcagcattgcttngtacacttcctgaaaatggtgactttggaatctaggggtttgcttgtataaaatttgggt

SEQ ID NO: 18438 - DNA, 121 bp, Artificial Sequence
  Synthesized
  misc_feature (61): n=t or c
gagaccatccctgcagaggtgggttgtgcagctctggttgggcgtgcgtgcctcgcagcangaacttcggctcagtgaaaccaggacttatctcagtaggaactcagtagaagtgaagcaa

SEQ ID NO: 18439 - DNA, 121 bp, Artificial Sequence
  Synthesized
  misc_feature (61): n=a or g
acagtcctgcttgctctcaaactatgtggctgtcagagctcttttgcagaagctccttatngtatccatttgtaaggagctgataatagttttattctcttgcataatgcttctggggaaa

SEQ ID NO: 18440 - DNA, 121 bp, Artificial Sequence
  Synthesized
  misc_feature (61): n=a or g
tccttccttactgtacttacttgatgctgcggctgccacagaggaatatgcagggtggacnctgctagaacctaaaaataagagattttgattttcatccactgaaccattcaaaaagaca

SEQ ID NO: 18441 - DNA, 121 bp, Artificial Sequence
  Synthesized
  misc_feature (61): n=a or t
cagtgttatatgatgaggtattctctcttgtatgtaaaagggcacattccatcaaagttanttttttctctgtgtatgcatgggtataaatatcacaatccaaaaatctccgtttgggtta

SEQ ID NO: 18442 - DNA, 121 bp, Artificial Sequence
  Synthesized
  misc_feature (61): n=t or c
tgtccagaaagtaaactagtaatgaaaatgagtaggaaaattatatctacaagataaaagntgtcaggaaagcttgtgcaaattgtcttggccctttatttctatttctgctccatctgga

SEQ ID NO: 18443 - DNA, 121 bp, Artificial Sequence
  Synthesized
  misc_feature (61): n=a or g
attcttaacattgtaaaggtgccttgtctctctgattccttctagttttctgtagtgttanagtgactcttcttgtactaaaacattcaaatatacttttgttgtaatagaaataatgtct

SEQ ID NO: 18444 - DNA, 121 bp, Artificial Sequence
  Synthesized
  misc_feature (61): n=a or g
aacacacacagccaagctctgcctttgcttggctgcgatagtctctcgcatcggggggaancagggccaaatttggctcacagctgaaataaaggaggacaatgctctgattaaagtgatt

SEQ ID NO: 18445 - DNA, 121 bp, Artificial Sequence
  Synthesized
  misc_feature (61): n=c or g
ataaaacattataatttctcagaaaattccaatacatttagttgtgtttcatcataattancttgcagctattgcatcttaaatattgtagtactaacaacccaagagtgaaaatgattac

SEQ ID NO: 18446 - DNA, 121 bp, Artificial Sequence
  Synthesized
  misc_feature (61): n=t or c
gtcttctgagaaaactgatatttgaatgaagaatttcaataaatgtttcagataagtctcncttgaacacttggtagcacctaaacttctgaactaaactgtgacaactctgggcataagt

SEQ ID NO: 18447 - DNA, 121 bp, Artificial Sequence
  Synthesized
  misc_feature (61): n=t or c
ctcaacagcttgagggaatagtctacctcatcactaagccttatgtttaataaagttgtcnccactcaacaaccagagtacagatagcagagactgcggggcatactgtatagaagggcag

SEQ ID NO: 18448 - DNA, 121 bp, Artificial Sequence
  Synthesized
  misc_feature (61): n=c or g
tctccaaccacccacatcaaagcctcacagcccacatccatcccttgttaactggcacacntttgcatcccaggatctcccagagaatgagctgctccacccacctctgaacatccgagtg

SEQ ID NO: 18449 - DNA, 121 bp, Artificial Sequence
  Synthesized
  misc_feature (61): n=c or g
gtgcactttcttgcttctcagtgccctgcatgcaaccagtacggtatacaaacacaacatncagtcattctttgcttcacattgctaacagtacatgcttgtgtgatccctttggggagac

SEQ ID NO: 18450 - DNA, 121 bp, Artificial Sequence
  Synthesized
  misc_feature (61): n=a or t
ctctcccacatttgtttgcaactggctaaaggattcaaacattatcagggaaagacaaacngcattatcactaagatatttttaaggaaataaagtggtttgcagtactgctgacattcac

SEQ ID NO: 18451 - DNA, 121 bp, Artificial Sequence
  Synthesized
  misc_feature (61): n=a or g
acagggtaaaagctcttcatctcggccaagtgaaaagcactgtggaggttgtatatcaganaacaaagttcttgctccagtgcagagatctgcgttctacacggtacctagctgttgaact

SEQ ID NO: 18452 - DNA, 121 bp, Artificial Sequence
  Synthesized
  misc_feature (61): n=t or g
cacctgtacccttactgagggtgcactcagttcccccgtccaggtcatcaattaataagtnaaacagggtcagccccagtattgatccctgagatccaccactgtgactggtcaccagctg

SEQ ID NO: 18453 - DNA, 121 bp, Artificial Sequence
  Synthesized
  misc_feature (61): n=a or g
agagaaacagcagaggaagaagttgcttgtccctgtggacaccttgggactggagctttcnatttgggtatcccagttaccacttggaacattcatgcccagtgcgagagagtgaatcgca

SEQ ID NO: 18454 - DNA, 121 bp, Artificial Sequence
  Synthesized
  misc_feature (61): n=a or g
gtgccctgttacgttccataaaagagaaagctgggatgttaaatgaatgcaagtacatccnaatccatgatttaaactcaggagtctgtgtaaatcagctgctgctcaagtggtagaaagg

SEQ ID NO: 18455 - DNA, 121 bp, Artificial Sequence
  Synthesized
  misc_feature (61): n=t or c
aacagatttcacagaagaaatgtcggtgagcgctggtgggagtgggtctgtgctggataangctcagccacccactgcagttccacattgccctgttccagcaccacgttggatgctccca

SEQ ID NO: 18456 - DNA, 121 bp, Artificial Sequence
  Synthesized
  misc_feature (61): n=a or g
ttggctcagtgtttgcagagaagaagggagcggaatggatacagagagacaaactgctganttttcccacgttctccatctgtcttgggcttccccacatcccacaagacccaggccagag

SEQ ID NO: 18457 - DNA, 121 bp, Artificial Sequence
  Synthesized
  misc_feature (61): n=a or g
tgcttctgatcttctgtcactccggaagcctctgtgtgagtgggcttacaagttggtgccntttcacactgttgtctccatcctgggttctgcctttccaaacagccgtcgtaccttgctt

SEQ ID NO: 18458 - DNA, 121 bp, Artificial Sequence
  Synthesized
  misc_feature (61): n=t or g
tgagcagctcaatggatctgagttgcaggattcacttcaaatgtagtcagctgatgtcagntgagagtatgttgactgaacttaaaactgattaaactttactatggcacagccagcatgg

SEQ ID NO: 18459 - DNA, 121 bp, Artificial Sequence
  Synthesized
  misc_feature (61): n=t or c
cttggctgccttcccagacaccactcagcaaggctgaaggggctgataatgagagaaaacnctggcacgctcctgggactgttttacctcttaattattattactttttttctggctttta

SEQ ID NO: 18460 - DNA, 121 bp, Artificial Sequence
  Synthesized
  misc_feature (61): n=a or t
atacttgcgagcgtgacagctttatcaccatacattgtgtagaaagcaacatgttgaagtntgttattgtagaacaggttgttgttcacaaattctttatttccagcagtagcacacgatt

SEQ ID NO: 18461 - DNA, 121 bp, Artificial Sequence
  Synthesized
  misc_feature (61): n=a or g
ctccccccccccagtagattggtagtgctctcagatgcagtggtgaagtgagcagcgaacntttctggcacatctttaagtaaaatgagaaagcagcacttaatattgcattaatgaaaaa

SEQ ID NO: 18462 - DNA, 121 bp, Artificial Sequence
  Synthesized
  misc_feature (61): n=t or c
atctcaaaggctgcacagccagataattaatgttcagtaacatccactctgcttgaaaaangcatgttttttaggacaatgacattgactgttggaaaaatacatgctttggagagtgagg

SEQ ID NO: 18463 - DNA, 121 bp, Artificial Sequence
  Synthesized
  misc_feature (61): n=a or g
tctttggctttcctttgttgcttatgggctgtctgtggtgattaggctcaagtactttccntaatggtgtagttcaggtcatggcaaaatttttttattttgtaactcttatctggagaac

SEQ ID NO: 18464 - DNA, 121 bp, Artificial Sequence
  Synthesized
  misc_feature (61): n=t or c
tcccagggggtgctggctccaccagctgctccctcttacttgtggcagaggtaacacagangacctgtggggtgtgcaagtaaccctctgctttatagtggtgctttgaataggtggaata

SEQ ID NO: 18465 - DNA, 121 bp, Artificial Sequence
  Synthesized
  misc_feature (61): n=a or g
tggttccacctccatgtagccttgctgggctgctgtgcaaatgataagtgttgtctctgantgttagtcctggcctttccaactgaagtggacccaatctatactcaaaggctgtgataaa

SEQ ID NO: 18466 - DNA, 121 bp, Artificial Sequence
  Synthesized
  misc_feature (61): n=t or c
tcaaagcagggctgctttgttgaactcattaacctccaaatatggggctctggaagtatangtggtcagtgattgtgaaagttgcagatatctttgcgtgagaaacatttgtggttaaata

SEQ ID NO: 18467 - DNA, 121 bp, Artificial Sequence
  Synthesized
  misc_feature (61): n=t or c
gctgacccctcgtatttaataagacagcactatagaaggaacagcattttttctcaatgantgtgttttgcatttctgttttctgcatttcaagggttatgtacgtgatcatatcaaaatc

SEQ ID NO: 18468 - DNA, 121 bp, Artificial Sequence
  Synthesized
  misc_feature (61): n=a or g
cgtaggctccaaggattacaataagatccatcatctttaatacgaacccagtgacagtacntaagtcccaccctgccaaagtcgaggatgggaggacaccatacaacatctcccacctcca

SEQ ID NO: 18469 - DNA, 121 bp, Artificial Sequence
  Synthesized
  misc_feature (61): n=t or c
atggcagtgttgtgcccatgctttcatgctaacatgtcagcacagaggggcctgagaaccnaggtggctgcaggatgcctgcattgaggtagtcccagacgtggatctcttttccagagtg

SEQ ID NO: 18470 - DNA, 121 bp, Artificial Sequence
  Synthesized
  misc_feature (61): n=a or g
attctcagttactgtaagcagtaagtgttgttcttttgggactacgtggctagaaagatcnaatcaaagaacacttatgggtcacattcttatctgctacgttgctgtctcaatcaaataa

SEQ ID NO: 18471 - DNA, 121 bp, Artificial Sequence
  Synthesized
  misc_feature (61): n=t or c
gtcaggacagggttagtggtgtggggctatgggacctgccctactgccaagcaaaagcaanggcttagattgccaaaagcatcaagaaaatagcaaattgtttcaggggatgttagagaat

SEQ ID NO: 18472 - DNA, 121 bp, Artificial Sequence
  Synthesized
  misc_feature (61): n=a or t
acaagatgagttttagttatgtccaaggacagaaacttcccaaactctctaggaaaaaaanttttgaggtcatctgaaatatagagtttattataggaattgaaacaaaaaataaatttct

SEQ ID NO: 18473 - DNA, 121 bp, Artificial Sequence
  Synthesized
  misc_feature (61): n=a or g
ggtgttgttattcagcctgatgatgatgtcctgctttcactatgcccctataaagcaagcntgactcgccagctaactgcctgaccctactggagtgggaataaaacagaaatataccctt

SEQ ID NO: 18474 - DNA, 121 bp, Artificial Sequence
  Synthesized
  misc_feature (61): n=a or g
gcataataggcatatataattaatgtctcccatgggcattattattatccatttttaatgnattcagtcaatcaaagctttgaaatcttctcatagccagtttcactttttactactatgc

SEQ ID NO: 18475 - DNA, 121 bp, Artificial Sequence
  Synthesized
  misc_feature (61): n=t or c
tacggttaagagcactgcgggccactaaactcgaacagctctccagtttctttactgtgcnatgaaccaaagacatcaggattctaacaaaatatttattactgtatagcaactgttaatt

SEQ ID NO: 18476 - DNA, 121 bp, Artificial Sequence
  Synthesized
  misc_feature (61): n=a or g
gacagggcccctcccctacactctattcccctgtgcagctctgtgcttctgcctgatggcngaggggaaggaatggcacatttttaagccattgaaaaattcctggagaatgaggcaagag

SEQ ID NO: 18477 - DNA, 121 bp, Artificial Sequence
  Synthesized
  misc_feature (61): n=t or c
ctgtagtagctaaatttctggggtgagtgagaagtggagagtagcaattaaagggtgcaantgggctttgatcacctatgtatctgtagtagcaggagtcaaaagaggccaactttgataa

SEQ ID NO: 18478 - DNA, 121 bp, Artificial Sequence
  Synthesized
  misc_feature (61): n=t or c
taagtattttaatgcaaatgtcctttatgtactcatacatacttccgcagttccacatgcnggtgttgtataacactttgaataatctacacttcaacactgatcatgaaaatgttaagat

SEQ ID NO: 18479 - DNA, 121 bp, Artificial Sequence
  Synthesized
  misc_feature (61): n=t or g
caaactctcggtaggcaaatgtggtttttaccattcgtaatctgtctccaaaagcaattangtcacctcacctgcttttgctgggcttcaagttcttcatcttcacgatttccatgttctg

SEQ ID NO: 18480 - DNA, 121 bp, Artificial Sequence
  Synthesized
  misc_feature (61): n=a or g
aattgggaacaccgctagcaggccattcttgctttttttaggagggaaggcagaggctgcnagcacaaaggtaccccgagagtgcatcaacttcgccatacggccccgccacgcaccgcgg

SEQ ID NO: 18481 - DNA, 121 bp, Artificial Sequence
  Synthesized
  misc_feature (61): n=a or g
cttaaaccctgatgacctttaaaaccagaagagatgtcttatgaacacactacaattattnctgcgaggtattggagccagtgatagctgaaatgtgtttggtattagtttgtgcatgcaa

SEQ ID NO: 18482 - DNA, 121 bp, Artificial Sequence
  Synthesized
  misc_feature (61): n=a or g
tgccggcctcgcaacagatgagtgtggaagtctggaagtcagggctgtcccagagaaacgnaggtgtcacctttctactttcttggatttggatgtaaaatgggtccaaaatcctacagaa

SEQ ID NO: 18483 - DNA, 121 bp, Artificial Sequence
  Synthesized
  misc_feature (61): n=t or c
aaactgggttggtttgctctgggctgtgctgtggagcgtttctccaaaggttgggtggtantcccatctcaacaatgcaaaacccttcgtacccacttggaagaatcaaagaaccttggaa

SEQ ID NO: 18484 - DNA, 121 bp, Artificial Sequence
  Synthesized
  misc_feature (61): n=a or g
caaggcaggctctacattatcttgagaatgacatttcacctccttgtctttttcacccgtnaagtagagagaagaggaaaagcaacttaggtcttctgggtactgccttaagttagggttt

SEQ ID NO: 18485 - DNA, 121 bp, Artificial Sequence
  Synthesized
  misc_feature (61): n=a or g
gtaactgcacaataccaaatcatggaagtaaatatcatgtgctgataataaaattgtgtantaccctcacccatcattgaaaatttgcccgcaaaattaggtctgccacgctgttctcaca

SEQ ID NO: 18486 - DNA, 121 bp, Artificial Sequence
  Synthesized
  misc_feature (61): n=t or c
gtgttgtatagaaaaacagcagtgatgtactggcaacatggcttctaagtagttcacagtncagtgtactgggagaaataaactatataggtgtaggctcacatctttgggtgaccaatat

SEQ ID NO: 18487 - DNA, 121 bp, Artificial Sequence
  Synthesized
  misc_feature (61): n=t or c
ttacaaacacgctgaaacagcaggatctggcgtcaacactccccacaactaacataaatangttaaatttattatcatgcaggggaagcagactaaaggaatgacccagcaatgcttttgt

SEQ ID NO: 18488 - DNA, 121 bp, Artificial Sequence
  Synthesized
  misc_feature (61): n=t or c
ctggctgtataaaatcagtagagtaaacctaagccttaaaccatctcatctatgtaaagancttagagattttaaacaactttcaatggtaggcgaaaactaaaattgttctttatataat

SEQ ID NO: 18489 - DNA, 121 bp, Artificial Sequence
  Synthesized
  misc_feature (61): n=a or c
atgaagcagccaggctttgctaacatggcactcttgatacattcctaatagaattgctctnaaaggaaagagtgaccgctaaaaacataacttcagaagtacttcagaaaactgtggttcc

SEQ ID NO: 18490 - DNA, 121 bp, Artificial Sequence
  Synthesized
  misc_feature (61): n=c or g
tggggtgcccagcaggtgaatgcaggctcattgctgatgtggttctgaccccagcacaacntcccaggtgaaaacatttactctctgctgtgcatggcaaaggcatggagccctgctcccg

SEQ ID NO: 18491 - DNA, 121 bp, Artificial Sequence
  Synthesized
  misc_feature (61): n=t or c
cattttagaaacaatatattaaaggtatatgtataaaaaagcatctaaaagatgggctgtncatattcaggtccatattctggcataatacaactcaaaagtaagggaaataggagaatac

SEQ ID NO: 18492 - DNA, 121 bp, Artificial Sequence
  Synthesized
  misc_feature (61): n=c or g
tcatcccgttccatgccgtggtggcccggcacaccaaacgctgctctgtaggctccatttntgccctttctgtattcccgatgccagagttgttttgtgtgacccagcaccagcagggcgg

SEQ ID NO: 18493 - DNA, 121 bp, Artificial Sequence
  Synthesized
  misc_feature (61): n=t or c
tcacacaaatgcctcaatcagaatgattcttcattgccataagcagatttgctgcactcantgccacagtctggtcgtgtgctgtttacacagttactcatagccaatggagaaaggctgg

SEQ ID NO: 18494 - DNA, 121 bp, Artificial Sequence
  Synthesized
  misc_feature (61): n=a or c
gaattatgacccgtctcatttaggccactttgtgtttcttggtggtgatggtagagcctanaagtaacaagaggacgtgagtgctaacagcatgaggtcagacaccaaagccttgcttgag

SEQ ID NO: 18495 - DNA, 121 bp, Artificial Sequence
  Synthesized
  misc_feature (61): n=t or g
gcagagagcccaaagtagcagcagccaccccgcatttttctctttgtaccaaatattgtgntttttttcacacaaagctacaagaaaatgggccgctggtaggaaggtacaccagaatttg

SEQ ID NO: 18496 - DNA, 121 bp, Artificial Sequence
  Synthesized
  misc_feature (61): n=a or g
gattgaagatgaaacaaagacatttcaagataagatgcactccttttctgcaatgcaacgnaccaaaacgatagcaaatgtcacctcgccctgtggagacgttgctgttccaagctcccat

SEQ ID NO: 18497 - DNA, 121 bp, Artificial Sequence
  Synthesized
  misc_feature (61): n=a or c
tgtgcatgttcagtgaagtgaacccctatgcacccggcacaattataacacaaatacctgnctgacataattcattggcatgtcaagttactttgatggattttccctgcttcacacccca

SEQ ID NO: 18498 - DNA, 121 bp, Artificial Sequence
  Synthesized
  misc_feature (61): n=t or c
gagtgctattttgatctattttgatctaaaatggagttgtgtatctttacaacgtgctagnaaatcgctgtgctaattaagctagataggactacccacagtaaccaatattccttcatct

SEQ ID NO: 18499 - DNA, 121 bp, Artificial Sequence
  Synthesized
  misc_feature (61): n=t or g
agaatcattattaaattaacagtttcataaggtggttcaacatctgacacagtgggaacanaaagtgaggtggttattttggatgtatggaaaaggaatacatttcaagaattgctcaagc

SEQ ID NO: 18500 - DNA, 121 bp, Artificial Sequence
  Synthesized
  misc_feature (61): n=a or g
ttcagctcccctgtaaaccaactatattattcaatatcactgatactcaccttgtactgcngttggccataatgtctttcaggaattgcaggactctgcacaattctattttggatgcaaa

SEQ ID NO: 18501 - DNA, 121 bp, Artificial Sequence
  Synthesized
  misc_feature (61): n=t or c
ttctatacgctcaactgctttgtggtgtcttcaggcagagaagggagttgcactgagcctntccacctcctgactggcagctctgaccacaaggaatccttcccactttcccaacacacac

SEQ ID NO: 18502 - DNA, 121 bp, Artificial Sequence
  Synthesized
  misc_feature (61): n=a or g
gtgatgcaggcttaatccatggtctgcagttgagctgtttgcaacaggttgatcaggctcnatttatacagcaataagcctctgatctctgctctcaaagctgaagtgataagaagttgtc

SEQ ID NO: 18503 - DNA, 121 bp, Artificial Sequence
  Synthesized
  misc_feature (61): n=t or c
agcacatgcctgtcttccacaaacacacaacatgtggttgagaggaaggcaaaggaagccntcctgtgctcctacgttccaagaattagacacaaacatgttaatagaatcatcaaattga

SEQ ID NO: 18504 - DNA, 121 bp, Artificial Sequence
  Synthesized
  misc_feature (61): n=a or g
gttcaatgtgcagaggtagaaatagcacaaggactgtttttaatgtttatcatttaaatanaactggtgcttaattgcaagcaaacagctgttgaccaacaagtgctaatccaagctctgc

SEQ ID NO: 18505 - DNA, 121 bp, Artificial Sequence
  Synthesized
  misc_feature (61): n=t or g
aacctgctataacttcaaaaaaaatctttgtggtcttcagatctgccctgtaggactcggnacacctcagtaattctttgagtatattggtgaactccaagcacactgctgaagatgcttc

SEQ ID NO: 18506 - DNA, 121 bp, Artificial Sequence
  Synthesized
  misc_feature (61): n=c or g
tatgcattttattaaaccattttattctttatctcttttcatgtttataaaccctattatnatttcaagattttgatcttttctggcattctcccgtgtggcacaagcatcatgcttgtgt

SEQ ID NO: 18507 - DNA, 121 bp, Artificial Sequence
  Synthesized
  misc_feature (61): n=a or g
tctgctccttctcagtatgcagtctatttacacaactgcttatttcttcagcatgacagcnggacctaacgttatggctgggactgcatcaagttgaacttgtatgtttcagtgggcccac

SEQ ID NO: 18508 - DNA, 121 bp, Artificial Sequence
  Synthesized
  misc_feature (61): n=t or c
aaattaacacttctttcaaaatgcagtctcaatgtcactgatccagtgagtcataatccantggtgcttgcacctggggaagaaaacccactggtttacatcataggagagtgaggcttgg

SEQ ID NO: 18509 - DNA, 121 bp, Artificial Sequence
  Synthesized
  misc_feature (61): n=a or c
attactgaaatacctgtgtaatctttgtataattttagcacaatcctctcagtatgagtantgtttcaatcaggcaatatctctttaaggaaagacatacatagccctactactattccct

SEQ ID NO: 18510 - DNA, 121 bp, Artificial Sequence
  Synthesized
  misc_feature (61): n=a or g
taaaacccagcctgtcaatccctctcgggctgggattttcacaggactgagcacccagttngtatttgacaagctttaactgtggtctccatttgtgtaaggaactatgatgttgtggcct

SEQ ID NO: 18511 - DNA, 121 bp, Artificial Sequence
  Synthesized
  misc_feature (61): n=a or g
tgcttcaaattgcctgtgagaaatggaatgaagaaaactgtgatcagctctgcaacccaantcctgactcaggataattcagaacaatgctactttgattgccatcactgttactatggct

SEQ ID NO: 18512 - DNA, 121 bp, Artificial Sequence
  Synthesized
  misc_feature (61): n=t or g
gcagggtgtgcagaagaaacgagttctgatggagtcagggatcatgcacttgtgctaaagnactgttctcttctggcaggaccacttccagtgcaaaaatagatgcatgctcagtagcatg

SEQ ID NO: 18513 - DNA, 121 bp, Artificial Sequence
  Synthesized
  misc_feature (61): n=t or c
caatctaaatactcaataagctctaaagatctttttgtgaatttgaatttgtacttcacanatacctggcaattcagaagagagcatgtatagtacaaataaatttctaagacattagaaa

SEQ ID NO: 18514 - DNA, 121 bp, Artificial Sequence
  Synthesized
  misc_feature (61): n=a or g
tcagtgtttccttctcacaaattccctgaagaaaaaaaaatgcccgaagtagaaatgtgtnctattaggggtaaaataagactggcaaaggtataagcaacagaaagaaaagcattacaag

SEQ ID NO: 18515 - DNA, 121 bp, Artificial Sequence
  Synthesized
  misc_feature (61): n=t or c
tgaagttggatagccaccaatgtggctgaggaccaccagggtgaggtgaggaccacctaancaccagatagtattttccagcccaaccttcccacagctccagaattctgcgttcattttt

SEQ ID NO: 18516 - DNA, 121 bp, Artificial Sequence
  Synthesized
  misc_feature (61): n=a or g
atgaacaaatgtacaactgcagaaatgagtggatgctgccttcagagaagaggagaaaggngaaaaatcaggatttacagggcttactgtgtggccaagaacagaaggatttcttctacat

SEQ ID NO: 18517 - DNA, 121 bp, Artificial Sequence
  Synthesized
  misc_feature (61): n=t or c
taggtggataaagtttgaggagaaggtagaacaaggtggggaaagatggagtaaacctcangtggccacgttatccctgcacagcttgtttgagttaaggacgtgtatagagaaaggctca

SEQ ID NO: 18518 - DNA, 121 bp, Artificial Sequence
  Synthesized
  misc_feature (61): n=a or g
cgtgcatgcatgcagcagtccagtggaggatgctggctgtcagatttagcaggatgccgtngctcagcaagctacagcttgctcagaaacatttcaatgtccctgaatgcaaggagaccca

SEQ ID NO: 18519 - DNA, 121 bp, Artificial Sequence
  Synthesized
  misc_feature (61): n=a or g
caactaaaactcctggggaacaagttcagctgcatgtgcctgtaccactgtggccctggcntgccccaggtcaactctgacatggtgccactgccatgacattgacacttctatggtcccc

SEQ ID NO: 18520 - DNA, 121 bp, Artificial Sequence
  Synthesized
  misc_feature (61): n=c or g
ggtgccagcctgcagggcccttgggtgatgctgagatgttagcatatccctttgctatgcnctatgggcataggcatttgggtgacccattgagccccgtggttgcccactgtgatgctgg

SEQ ID NO: 18521 - DNA, 121 bp, Artificial Sequence
  Synthesized
  misc_feature (61): n=a or g
agttgtgggctactccatgactggctttagcaatgagataaccaggctgtatgtgtatccnctgatggaatatagttgtgaagtcttgtgcaggggctggcagggcactgtaagtttggct

SEQ ID NO: 18522 - DNA, 121 bp, Artificial Sequence
  Synthesized
  misc_feature (61): n=t or g
agatgcagtggatatgagttgccaaggtaagatttcaaggcaagaactctgctcagctttnaccagctgaaaagtcttaaatatgctttgcgaacagtcccaccatcaagctgtagttaat

SEQ ID NO: 18523 - DNA, 121 bp, Artificial Sequence
  Synthesized
  misc_feature (61): n=c or g
aaacagttcatagtaaaattgcttatctgcataaataaaacacttctctcactattcctanaggatggacaactaggataagcatctcactttaactgttggttcctggctctggctaatg

SEQ ID NO: 18524 - DNA, 121 bp, Artificial Sequence
  Synthesized
  misc_feature (61): n=t or c
tgtttgtgtacgtgagtgcacatacatgcccatatttcttgtcctaaaggaaaaactttgntctatagctgcacagaaggctccggtatcagcagagcagccctgcagttgtgttcagtgt

SEQ ID NO: 18525 - DNA, 121 bp, Artificial Sequence
  Synthesized
  misc_feature (61): n=t or c
ggagtacctgagctccttgttaacagttaaattatcatcttcaacagcaactctgcataangggcaatgcatgtgtgctggaattagccacgctctgatgcacttctcacaaaaggcatgg

SEQ ID NO: 18526 - DNA, 121 bp, Artificial Sequence
  Synthesized
  misc_feature (61): n=a or c
ttaactttcttgtcctcaaatattctgaactggtcaagttctcgaaggtgaaataacattncactacaggggatacctctataaacagtatttttcaaagaaactaacttcatagcttcca

SEQ ID NO: 18527 - DNA, 121 bp, Artificial Sequence
  Synthesized
  misc_feature (61): n=a or t
cttgggctctgcaaagactaaacatgagcggttacttttcacagttgcatatattgatcgnctgaattgatgattcctttgctggttgcaacctggttctgcggcaacataataggtgaga

SEQ ID NO: 18528 - DNA, 121 bp, Artificial Sequence
  Synthesized
  misc_feature (61): n=t or c
tgtttaggcattagagcattgtaggtttagtctagatcatagacaaggctctttcccaacnatatctccaattatatttcttctagataaccttctcaatcatggcataataaaacaggcc

SEQ ID NO: 18529 - DNA, 121 bp, Artificial Sequence
  Synthesized
  misc_feature (61): n=a or g
tgcggggaagaggacacccagggaccatggcctgcatgctggccaagcatcagtctgtacnaggggctcttccccaatggcttggctttgtgggttgtgtcatggattggcatggctgcaa

SEQ ID NO: 18530 - DNA, 121 bp, Artificial Sequence
  Synthesized
  misc_feature (61): n=a or g
ttgtgagtgagacagtgggagcagaaggcacctgtatggaatgatgaggggatataggtcnccaggaaaaagaatctatagcagagggatactgcttttgtgtatcaggtcatgcatgaac

SEQ ID NO: 18531 - DNA, 121 bp, Artificial Sequence
  Synthesized
  misc_feature (61): n=t or g
taggtacaactaaagtatgttttccaattagtgattccctcaaatttgttgaaccatatanctttgttaaaaaatgtaagcaataaatgaatgccaacacaagctccttaagtgttagttt

SEQ ID NO: 18532 - DNA, 121 bp, Artificial Sequence
  Synthesized
  misc_feature (61): n=t or c
gatctccttgtcagcctttttaacctcattcctgctcggcagctgcatcaccagcttcaangtgcagtagtatactggtagaaagagagaaaaaggagaaaacctacaagaaataattttt

SEQ ID NO: 18533 - DNA, 121 bp, Artificial Sequence
  Synthesized
  misc_feature (61): n=t or c
cttctcctgcttgttttgaacctacaatctgtcaattttttttgccctttcattgctcaangacttaaggaagaaaagatgtgagtgcctatccaggccactcatgttctactgtctaatg

SEQ ID NO: 18534 - DNA, 121 bp, Artificial Sequence
  Synthesized
  misc_feature (61): n=t or c
tcacaagtgaacatctacactgtctgtcacaaacacagagagcaacactgggcctgaattnaccattcccctgaagacaattatagatatgaaaaaagaaaatcaaaaagctctgcaattc

SEQ ID NO: 18535 - DNA, 121 bp, Artificial Sequence
  Synthesized
  misc_feature (61): n=a or g
gcacaatctgagggggacagtgagcaaaccctctgttttttccaggtgttctgtggggctntaacgtcctcactgagaggggcattgctaccaccccagtccatgagctaggtgacatctg

SEQ ID NO: 18536 - DNA, 121 bp, Artificial Sequence
  Synthesized
  misc_feature (61): n=t or c
caggtctttctgacgtgtcaaattcatctcgaatcttcatttctgtgactactcctgtacngcagacaaaatagtctgtgtcacttctgaaatctgctgtctgatcgtcttgagcaaaata

SEQ ID NO: 18537 - DNA, 121 bp, Artificial Sequence
  Synthesized
  misc_feature (61): n=a or g
tgcatccactctggactgaaaaaggaggcagagcataaggcccagaccagtgtgctacaanaaatcttccagacagaggcagctcagcagctgtctcctctgcattaggctgtagcaaagc

SEQ ID NO: 18538 - DNA, 121 bp, Artificial Sequence
  Synthesized
  misc_feature (61): n=t or c
gcagatcaaagatgcagttgttttagcagcttttcaccttgaaatttgcagttaccaattntatcgttggacttcctggagctgaaaggctcatggaaagactcccctgttttccttgtga

SEQ ID NO: 18539 - DNA, 121 bp, Artificial Sequence
  Synthesized
  misc_feature (61): n=a or g
tttctagataagctgtagttcaaacaggaattaaatctgaggtgtctgacagcctatgctntataaaaggtcagcctaaataatcacagtgcactgtctctgtaatctgtgttttaaaaca

SEQ ID NO: 18540 - DNA, 121 bp, Artificial Sequence
  Synthesized
  misc_feature (61): n=a or g
ccaaacctgccatgtgctgagcaagctctgcaacagtttatcaggtgggtagctgaggtgngcaccaacttgcaggagaatgcaatacagtctcaatacattaactaccaaaaccagggtg

SEQ ID NO: 18541 - DNA, 121 bp, Artificial Sequence
  Synthesized
  misc_feature (61): n=t or c
acagacagagctgtccccaacagtaaggaccagagccgactatggccaagagcagcagcangagggctcggctggacagggcatcatacacataatgcaatggaagaaaggagggagcagg

SEQ ID NO: 18542 - DNA, 121 bp, Artificial Sequence
  Synthesized
  misc_feature (61): n=c or g
agttgggcaggggttctggcagggggttgtctcagccttgtgaggagctatcctggagctnaagcaatgggtttgggtctgaagttgacctgtttgggtcccagacaggtctcagtgtcct

SEQ ID NO: 18543 - DNA, 121 bp, Artificial Sequence
  Synthesized
  misc_feature (61): n=t or c
agtggccatctactcaagatcttcaatgtaagacatacgtttgtgcttactcatttatttnctagtccgtttaacagataaatatttataggagggagatgggcttttcagactgtctggt

SEQ ID NO: 18544 - DNA, 121 bp, Artificial Sequence
  Synthesized
  misc_feature (61): n=a or g
cagcctcaacttagcagccaaatgtcaaatattagatctgttccatcacttgctgcactcnctttctgcaaccctatgcacgtcaaacaaaatcttacattttttacttcataaaatgaaa

SEQ ID NO: 18545 - DNA, 121 bp, Artificial Sequence
  Synthesized
  misc_feature (61): n=t or c
ttgtaaattcaagctgcaatgcacatcgttgagagaactactgatgttactacctactganagtaggtgcccatagtcagtttgaagccagagtttctttaatgagttttattattttcaa

SEQ ID NO: 18546 - DNA, 121 bp, Artificial Sequence
  Synthesized
  misc_feature (61): n=a or g
tatttccagtctgcttttccataactgacagctccgagacgacctgtgttaagagcagccntagataatagccacagtaaggctaccttgtgttgtattgagttatccctgccccttgtta

SEQ ID NO: 18547 - DNA, 121 bp, Artificial Sequence
  Synthesized
  misc_feature (61): n=a or g
tctaaaatatctttagctatcaggacaggaattctgattatccagtgcatgtggtcatttnacagtacacacctcaagttctgcctggaaggtgaggtaaccacaaccagggatcattctg

SEQ ID NO: 18548 - DNA, 121 bp, Artificial Sequence
  Synthesized
  misc_feature (61): n=a or g
caaatgaagaaaaggaaatagttatattaaattctgtatcacctgtgaaggccattgttcnacactattttgtcccttagaaagcaatttcctgctcaccattttcctcttcctttcttta

SEQ ID NO: 18549 - DNA, 121 bp, Artificial Sequence
  Synthesized
  misc_feature (61): n=a or t
agtagttaaggttaaaaatgtgctgagctatagatatgctaagtactggaagtcttgcttnttttacagaggcatctgtttgtacagaaattctctctttctgttcctggggagaataaat

SEQ ID NO: 18550 - DNA, 121 bp, Artificial Sequence
  Synthesized
  misc_feature (61): n=a or c
gcaaatcatgtctgtttcggagctggaagttcatgcatagagaaatttcctcctgagcaangccaccaaaaaatgaaatgtgcacacagacctggagactgacctttttggtttccactgc

SEQ ID NO: 18551 - DNA, 121 bp, Artificial Sequence
  Synthesized
  misc_feature (61): n=a or c
actaataccagtaagccctaataaataggtagctcctatgaagatatattgctaatttttnacctactaaaacatgtcagaatttttccactgatccaattggcctttaaaacagatcacc

SEQ ID NO: 18552 - DNA, 121 bp, Artificial Sequence
  Synthesized
  misc_feature (61): n=a or c
caaagtgttgcccgatgtataggtaatgtgaacaccatatgtgtttggattggagctctgngtctgtggattagaacctccctcttctgaagggatcataaagtatccagaaaagctgtag

SEQ ID NO: 18553 - DNA, 121 bp, Artificial Sequence
  Synthesized
  misc_feature (61): n=t or c
ggtctgtccttcattagcagctgaattgttttaattgaagctcctttcaaaaaaggcaccntgagctaatgcagaatatgaaaattcagcccaggtagttcaaattatcaaaattaagcaa

SEQ ID NO: 18554 - DNA, 121 bp, Artificial Sequence
  Synthesized
  misc_feature (61): n=a or c
atcaaaattctccttgccaccatgtaagttcaggtgtggcaactagggagtgaaagcaagnattttgtttcatctcaccaacatatcctagtactactaaggaaggaaggttataagagga

SEQ ID NO: 18555 - DNA, 121 bp, Artificial Sequence
  Synthesized
  misc_feature (61): n=a or g
ggaaaatttcctactctgaaccattccattaagaaactcagacaccactgtgtttctggcnagctaattcaggagcaaaggtgctctcccttggggaaactctggtcaaagagatattaaa

SEQ ID NO: 18556 - DNA, 121 bp, Artificial Sequence
  Synthesized
  misc_feature (61): n=t or c
aaacccagacccgactctttcactagattaaaatgccttgctagtccatatggtctaacanggagtaattaggaacctgaagtaggatgtattggataaaaatcagcagcctctctgatac

SEQ ID NO: 18557 - DNA, 121 bp, Artificial Sequence
  Synthesized
  misc_feature (61): n=c or g
ttcctcagcttaatttctctttctctagacctttgctatctcaagtaaatgtcatgagaanatgcaaacatacaggttctctagctacgatttcttttaatcctgttccttttctcatcag

SEQ ID NO: 18558 - DNA, 121 bp, Artificial Sequence
  Synthesized
  misc_feature (61): n=t or c
aagaaaacaaaggtggcagagataaaggtccccaaaggaacgggctgttcttcacgggtgntgcattcacagaatcaggtggtggtgcctttctgcaatgctgggcgtggagttggctccc

SEQ ID NO: 18559 - DNA, 121 bp, Artificial Sequence
  Synthesized
  misc_feature (61): n=a or g
atggcagtgggaccaggaggatgctccatgctgcaccacaccgtgctgaccactcacctcntacttcttcatgcagctctccacctccgcctgcgtcagctgtgtcgagtagtcctcctcg

SEQ ID NO: 18560 - DNA, 121 bp, Artificial Sequence
  Synthesized
  misc_feature (61): n=a or g
caccggggctgcagagcttcccaagctggtgccctctgtaccgaccagcacaaaggtgatncagagacccctaagatccttatcagggcacagaaacatcgttggtctgtttcaggcctca

SEQ ID NO: 18561 - DNA, 121 bp, Artificial Sequence
  Synthesized
  misc_feature (61): n=a or c
aattatgatctgataacactaagtaactcaactccataaaagtatgaggccatatcatccnatcttttttaagtactccacaatcaaatcagtgaagggttctacctaaaaatcagtggtg

SEQ ID NO: 18562 - DNA, 121 bp, Artificial Sequence
  Synthesized
  misc_feature (61): n=t or c
cgggcaccaggctggatgtgatgctgtaggtttgaagtcaaagcaatggagaggtgaagcnggttcccttggtcacccccaaatcacaattccattcctattcttgagtagggcacatcct

SEQ ID NO: 18563 - DNA, 121 bp, Artificial Sequence
  Synthesized
  misc_feature (61): n=a or g
agagacccctgtgatcatgcaactagaaagcattatgatttgcttgtttacctcactgccntgaagaaattcccttgtagggagcaggatggcctcccagtaaggcaggcaggggaagcca

SEQ ID NO: 18564 - DNA, 121 bp, Artificial Sequence
  Synthesized
  misc_feature (61): n=t or c
acaagtgtaaaggagaagacaagggaaagaaaattcagtgacaaaatattactgacttagncttgtcttatttctcttctctgccacatctcatgttcaattcaacatacccagctcaaat

SEQ ID NO: 18565 - DNA, 121 bp, Artificial Sequence
  Synthesized
  misc_feature (61): n=t or c
gtgcaaaagtgtaggcacacgtagtcttgagctttgcagcatttacagctatctgggtctntagcgtgaacccagtaaaagcatgggtctagcactgaggaccagtcttgggttccagcgc

SEQ ID NO: 18566 - DNA, 121 bp, Artificial Sequence
  Synthesized
  misc_feature (61): n=t or c
tttgtggaacactagagtgatcagtccttaatttctaccagagttccaagaggtaatttgnacgttgtgcagatgaaggaattaaggctgggaagttgttacttctctgtgtcacaaaggc

SEQ ID NO: 18567 - DNA, 121 bp, Artificial Sequence
  Synthesized
  misc_feature (61): n=t or c
acaaaaaattagattttgagtatgggaaggtgaagtagagttagcattcatgttcacttgngtttggtaaggggattatcattatttggcgtaaacacgtgcacctgacacacacagaaat

SEQ ID NO: 18568 - DNA, 121 bp, Artificial Sequence
  Synthesized
  misc_feature (61): n=t or c
tgaaacggtacacaacatgaaagctaaggccaagcagctctcctttccagcaacgtaaaanagaatgtttctcacagatttaccaaaaaagagtgaaggaaagatttggggttaagaaata

SEQ ID NO: 18569 - DNA, 121 bp, Artificial Sequence
  Synthesized
  misc_feature (61): n=a or g
agcagctaacatgtgagggggataccttgctttcatacacagtgattttgaatttgtgttntttgcatgggaattgccgttaatgcctttttgtagtttttcaagccagtgtttggatttt

SEQ ID NO: 18570 - DNA, 121 bp, Artificial Sequence
  Synthesized
  misc_feature (61): n=a or c
ctagtattttggctttctgaagtgacaagtctaaacaattacatcctgtctgagaagatanagagttcttaataatttctgcatgcacatcagactctgtatctgtactgcctcagttcca

SEQ ID NO: 18571 - DNA, 121 bp, Artificial Sequence
  Synthesized
  misc_feature (61): n=a or g
tgcctctagcagcaaggagtatgtacactgtcattgttaggagatgtcagttgcaggtacncagcaaccttgtctctgggtagctggaaatgcctgtcagctggagtggctgagcagatcc

SEQ ID NO: 18572 - DNA, 121 bp, Artificial Sequence
  Synthesized
  misc_feature (61): n=t or c
cttgagtggtccatgacccagtcaaacaacttctaatacctgctaacagcttcaaagcagngttggaccacataagcagccaataactggcattgcagggctcggacaattggattttgct

SEQ ID NO: 18573 - DNA, 121 bp, Artificial Sequence
  Synthesized
  misc_feature (61): n=t or c
taagcagtgttgcctgagaagatgaacaattatagttatcaaacaccttcatatactaaangcatgttccagaattgcagatcctgcaatcatcatagcaaattcgccttgtgcaagcagt

SEQ ID NO: 18574 - DNA, 121 bp, Artificial Sequence
  Synthesized
  misc_feature (61): n=a or g
aggtaatatttaacctgctttggaacacaaaatggattttgactatcctatcagtttcccntgcttcttgaatggttgttatatgccatcatgattcagtcatacataaaaagttttcctc

SEQ ID NO: 18575 - DNA, 121 bp, Artificial Sequence
  Synthesized
  misc_feature (61): n=t or c
ttaattttctcagggtaaatctggaaagcacaaagagatcgaaatctgcagggcattcccncccttttccatgcaccatactcaacgaagcagtgaccacataaattcttcccccgtaacc

SEQ ID NO: 18576 - DNA, 121 bp, Artificial Sequence
  Synthesized
  misc_feature (61): n=a or g
tcggagggattcaggctgcaccaggcttcccatcacccagcaatgcagctttagcagaggngtgggcacccgtttgctcgtatagaagcactgaaggagcctgttgcattgcattgggatg

SEQ ID NO: 18577 - DNA, 121 bp, Artificial Sequence
  Synthesized
  misc_feature (61): n=a or t
tccttttagttccggctttctgactgctaacatcttgctttgaaaacaaaatgaaaccgangaactgctatggtgaggcacagcagtgcagagctcagggctgtccccttggaaggatgca

SEQ ID NO: 18578 - DNA, 121 bp, Artificial Sequence
  Synthesized
  misc_feature (61): n=a or g
gagtgcatttacacatccagctgagaaaccactgatgatggattatttcttcccactgtcnagcatcaatacctgtgatacctccaaagtgaaggagtttaccttggcattcatgatacat

SEQ ID NO: 18579 - DNA, 121 bp, Artificial Sequence
  Synthesized
  misc_feature (61): n=c or g
tgttgcatcttcacaggattcttgcactaacggttttccatctgttctctctgtacatggntgcactttactgttagaatttgttcctctgataagtactggatgttgaagctgagttgtg

SEQ ID NO: 18580 - DNA, 121 bp, Artificial Sequence
  Synthesized
  misc_feature (61): n=a or t
gatatgaaaacaagccctaagtctaaggctggcttgctgtcagttggagccaaggaataangaaggctttcttctctggtcacagctgtaaagaaatagggtgtggaattttccttttgga

SEQ ID NO: 18581 - DNA, 121 bp, Artificial Sequence
  Synthesized
  misc_feature (61): n=a or g
tacagtataaagttaaggtttatttagttcattggaatatgctgtttctctttatgtttcngaagtggaatatacttatacagcttcctaaatccctgcctaccctggattttatttctgc

SEQ ID NO: 18582 - DNA, 121 bp, Artificial Sequence
  Synthesized
  misc_feature (61): n=t or c
tccacatgtttttggcagacagttgtgggcccaacagactctgtaatggggtaacaggccngtaggtgagcaccagactgggctctggtctgtgttactccattgcttccctgctgtattc

SEQ ID NO: 18583 - DNA, 121 bp, Artificial Sequence
  Synthesized
  misc_feature (61): n=a or g
attaacacattttgtcatgttatgcaattttcccctccctgtatactgggcttttttccangcccagtagccagcaataaatcaatcccagcctctcgtaagcaatttgacttaagtttta

SEQ ID NO: 18584 - DNA, 121 bp, Artificial Sequence
  Synthesized
  misc_feature (61): n=t or c
aatgccactgacttcagcaaaattaattcagcgtataccatgactgacccataaatcaaantgtcatgaaagaatgggactacatttaagaaaacagtagtttccagtcctttgagtaagg

SEQ ID NO: 18585 - DNA, 121 bp, Artificial Sequence
  Synthesized
  misc_feature (61): n=a or g
aggtgtgaaatctgcaagccaagttaaataggaaaaatccaacaatcagggatacgaatgntgctgttatttactcatatgtgaatgctacccaattcagtttttcttttttaatggtacc

SEQ ID NO: 18586 - DNA, 121 bp, Artificial Sequence
  Synthesized
  misc_feature (61): n=t or c
ttgctgaactgtagtgacagagaaatccagttatcaagtgttttccagaagaataacaagnctgattcttccctgcaataatctgggttccattcttccagaaaatattcatagaagcatg

SEQ ID NO: 18587 - DNA, 121 bp, Artificial Sequence
  Synthesized
  misc_feature (61): n=a or g
agctgtatgtaagttgtacatttgctacatgctgcacagcaaaatagttggcatttcctgngaacaacaacaaccacactcacagagttgagtgttactttgatagccagagatgttgttc

SEQ ID NO: 18588 - DNA, 121 bp, Artificial Sequence
  Synthesized
  misc_feature (61): n=t or c
aatttggggcaagggagaccacggtatggaaggagagggagttttttttaccaaagggcangggtgttatgtgccacgcattctcgtcagcctcctgagcaggaggtgcccccaaggactc

SEQ ID NO: 18589 - DNA, 121 bp, Artificial Sequence
  Synthesized
  misc_feature (61): n=t or c
ccagaaataagaggagccttacttggagctgctgaagctaaaactcacctgccagctctangagcaaaggcacagacacagatcagcagaaggaacgctgtctttttggtccacgtgagca

SEQ ID NO: 18590 - DNA, 121 bp, Artificial Sequence
  Synthesized
  misc_feature (61): n=t or c
ctagggtgtgtgcttgtgcccctgtgtgtgtgcatgcatgtctgcaacccagagaaagtangcaggagtgggacagcatggaggagagcagaagtggattggtgatgggggggtacgcctg

SEQ ID NO: 18591 - DNA, 121 bp, Artificial Sequence
  Synthesized
  misc_feature (61): n=t or c
aaggaaaatctaagatggaaagcatattttttttagcttcagttctacatctgcaagagcnagaatagtcagctcctttacttggactggttttaccaaaggaatggtccagcgctgactt

SEQ ID NO: 18592 - DNA, 121 bp, Artificial Sequence
  Synthesized
  misc_feature (61): n=t or c
agagcccctcgaagctgagctgcaaacacacgtggatggtgtcagctgcagagtagttaanagagccactcctcacatcacagccctgataaggggtaattaaggcctgtggtcctggcag

SEQ ID NO: 18593 - DNA, 121 bp, Artificial Sequence
  Synthesized
  misc_feature (61): n=t or c
actccctggggtgtcaccgtgtgagatgtgcagcctacacgtgcacagaagacagagaaanacccctctccaaaccctgggaaagaagcagagaacagcacaaggaatcccaagcatcaca

SEQ ID NO: 18594 - DNA, 121 bp, Artificial Sequence
  Synthesized
  misc_feature (61): n=a or g
taagttgaatgaatttcaaaaagacttgattttccacttacgtgcagttttgctttcactngtgaaacatcattggcattggcacagttttcctgattagggctggtgcaagtttaaaaaa

SEQ ID NO: 18595 - DNA, 121 bp, Artificial Sequence
  Synthesized
  misc_feature (61): n=a or g
agtaagcaacaacactcttgctgagggaatagttaaaataattacaaaataagtaatgganctctgagggtctgattttgccaaacatgagcattactgtagtcttgttaacatgctgttt

SEQ ID NO: 18596 - DNA, 121 bp, Artificial Sequence
  Synthesized
  misc_feature (61): n=a or g
ctccctttatctagcaagggagccaatgatcagataaccattaaaacaaccaataaaacanaagaaactacacccaagccagaaaaatgatgaggacgctgcaacctgagacaccaggtct

SEQ ID NO: 18597 - DNA, 121 bp, Artificial Sequence
  Synthesized
  misc_feature (61): n=a or g
gtgctcctgttgtttcaggtcttccaaagggaggaaatgacattttatctggggtgatagnaagcaatactgcacacttcctcttcatatctgttacaaaagtgaaagctgagtagcaaga

SEQ ID NO: 18598 - DNA, 121 bp, Artificial Sequence
  Synthesized
  misc_feature (61): n=a or g
gcacacactgcgagttaatgaaggcgctggaggagctgtgagaacggctctcttatcgccnaaacaattaaacgcatggttttgacctagaaggagaaggggaatcataattgagcaatca

SEQ ID NO: 18599 - DNA, 121 bp, Artificial Sequence
  Synthesized
  misc_feature (61): n=t or g
ggctgtgcctattgcctccttgagcctctgctgccactgccatgtctgagcatggtgggtnttgtaccgaaaccggtgaaaaagaagagattaaagcccagatagatttagaggtgagtga

SEQ ID NO: 18600 - DNA, 121 bp, Artificial Sequence
  Synthesized
  misc_feature (61): n=t or c
gctggtttggcccagtttggtgactaccatcttagcatcgttagactagcatcttaggctnaaggcagacagcccgtccctccaacatgtcccagtcaccctgccaagacaggagctgtgt

SEQ ID NO: 18601 - DNA, 121 bp, Artificial Sequence
  Synthesized
  misc_feature (61): n=t or c
tcagcgtggaattactcagctgcgagcagtgggtcttactcagatgacacgtgaaacgggngaagtgactgctgtccctcctgggaggatggctgtgtgctgccaggttggcaaagctgaa

SEQ ID NO: 18602 - DNA, 121 bp, Artificial Sequence
  Synthesized
  misc_feature (61): n=t or c
gacctttcattatatcaagtttcctccgcagtcatgtgcaaagtcaacactggaaaacaancaggtacataaccttacctagaatcaggagaataaactccatgtctcctctacatctgat

SEQ ID NO: 18603 - DNA, 121 bp, Artificial Sequence
  Synthesized
  misc_feature (61): n=t or c
tgtaattaaaccttgctgagttttgagtagtttaattctgcctaatgagctgtacagaagngatctcctcaatgttaggaattcagggaacctgaatggcgttggaactacgattaagtgc

SEQ ID NO: 18604 - DNA, 121 bp, Artificial Sequence
  Synthesized
  misc_feature (61): n=t or c
tgctacagcaagccctgtgtttcgaggcaatgcctgatcctctttgggggctttgggttgngttgtttgcccagcatcttcactgcattcctacaaaggggtgaaaaagcacagacaacca

SEQ ID NO: 18605 - DNA, 121 bp, Artificial Sequence
  Synthesized
  misc_feature (61): n=a or g
tctatgttatttaaatgctggtaaacttgttcatggcaatttcaataagccacagcagacntataatgcttcctcttttaataggtgcaaagtgagttattgtcacaaagcatatgtatga

SEQ ID NO: 18606 - DNA, 121 bp, Artificial Sequence
  Synthesized
  misc_feature (61): n=a or g
tttttaattcttattattcctgaagggagcattctatttcactatttatcagttttccagnatattataattgttgatggcttttgtgattttcccaggagttctcacaggatataatgcc

SEQ ID NO: 18607 - DNA, 121 bp, Artificial Sequence
  Synthesized
  misc_feature (61): n=t or c
agctgtattttccacaggcaaaaggcaggcagggtctcagtgccagggtacaatagaagcntgcacgcagaacagcccttatctctggcaggctctgggactcgcagagttagagcaatga

SEQ ID NO: 18608 - DNA, 121 bp, Artificial Sequence
  Synthesized
  misc_feature (61): n=t or c
cttgcaggtttgcgggtaccaagtgctgtaggtgggatgcaaagtgtgggcattgcttctnggtgcacgttcccactccagggactgcccctccatgccaacgtgtcccctctgcccacag

SEQ ID NO: 18609 - DNA, 121 bp, Artificial Sequence
  Synthesized
  misc_feature (61): n=t or c
ttgttgctgtttgttttcttcactcctgagaattattttcttatttcaaaaagagaaatcnggtgaacttgacgtaggcctttgcaactcacatcagacttctggtatccagggatcacgc

SEQ ID NO: 18610 - DNA, 121 bp, Artificial Sequence
  Synthesized
  misc_feature (61): n=t or c
gtgaatccagagcctcccttctccctaggtagccctatcttcttgtctggacttgctctcntgccttcagaatcaacaggctgaatgacagtcttttcttttgaccatccatagtgtcctg

SEQ ID NO: 18611 - DNA, 121 bp, Artificial Sequence
  Synthesized
  misc_feature (61): n=a or g
aataaggaatgttgaaactaaaatatcaatagaaaaagtttccagaagggacagtctaatntagcaattatcaatcttttttctgattctgactatcttgcagtcattttcatgcagccca

SEQ ID NO: 18612 - DNA, 121 bp, Artificial Sequence
  Synthesized
  misc_feature (61): n=a or c
gaaggtctggctgctaattctgagcaagagcctggagggacaaactggggagtcctgtgcnttagtgcagctccgagccctcagcctgctcactagtggtttatcaacatagcagccaaca

SEQ ID NO: 18613 - DNA, 121 bp, Artificial Sequence
  Synthesized
  misc_feature (61): n=t or c
tgttctgctgaagtagtttcctgcttgattgctgtaggatagctttgcaaatctacatatnactaccactgcatctgccacaaattaattattctaataacactgctttttttgtgtgtgt

SEQ ID NO: 18614 - DNA, 121 bp, Artificial Sequence
  Synthesized
  misc_feature (61): n=a or g
aaatgtttttttgcctctcttgaaatgaggcattaaaggcagtagtttctatgcattgtantttgtttactctgacttactagaaaattaaacctaattgtagtggtctgagaactgttgc

SEQ ID NO: 18615 - DNA, 121 bp, Artificial Sequence
  Synthesized
  misc_feature (61): n=c or g
agcccaccttcagctgcccatctcctaacagatgtacacaaattaaacttgtcattcaacntacgtctaatgaatctctatatctctcagtgaacttagaagcttaataaagaagttggaa

SEQ ID NO: 18616 - DNA, 121 bp, Artificial Sequence
  Synthesized
  misc_feature (61): n=a or g
ttatatgcacgatgcacttaattatacgggtacggtgtttgctagcttgtaaacagaaatngaatcgaaatgaaaatgttcagtgaaaaaaacaccagcaaccgagttataggatatgctt

SEQ ID NO: 18617 - DNA, 121 bp, Artificial Sequence
  Synthesized
  misc_feature (61): n=a or g
cgttggcgtcaacaagttggagctttttccattaatttactcaaaggaggacttctttagntgtcttttgctttgttctagctgaaggctctggtcagcaaggctcatacggttacagagg

SEQ ID NO: 18618 - DNA, 121 bp, Artificial Sequence
  Synthesized
  misc_feature (61): n=a or g
cccatcataactatctatcagaatagcaaacagttttggcaatcagttaaaagtacatgantaggagttagaacttccttctcctcaactgtttgctgtctttcagtatgttatttctact

SEQ ID NO: 18619 - DNA, 121 bp, Artificial Sequence
  Synthesized
  misc_feature (61): n=t or g
tttacctcctcactcagcaaggtttttaacttggttattttctgcacagttatggaaacanttaatgcatttaatattaatcatccaatctgaagggtgctgttttcgagaagagtaaaga

SEQ ID NO: 18620 - DNA, 121 bp, Artificial Sequence
  Synthesized
  misc_feature (61): n=a or g
tctgagagtgccacctctgccccatgggatcctcctgccctccttggggtgccatccttgngacaggggaacagccacagcccctatatagtgctcagcaccccttgtcctatcaaagagg

SEQ ID NO: 18621 - DNA, 121 bp, Artificial Sequence
  Synthesized
  misc_feature (61): n=t or g
tgatagtgggattgtgttcattttctatgcatcttaatgttgctataggctgttttgtggngtttcgttgatactatattgtatagaatatagaaaggttattctgcaaatcttcttgatc

SEQ ID NO: 18622 - DNA, 121 bp, Artificial Sequence
  Synthesized
  misc_feature (61): n=a or g
acagattgggttcagttgcatgcggtgcattattctttatacacatcaagagcaaatgctncatggtactataatgaagattatatatgtacatgtattactcccaaggaataacaataat

SEQ ID NO: 18623 - DNA, 121 bp, Artificial Sequence
  Synthesized
  misc_feature (61): n=a or t
acccggttctgggtaggtgggttccctgctgaagttgtgacttgcagctacagcagagcancttgcttgcgttttgctgctggcccgggtggattccagatggaaatgtttgaaaactgcc

SEQ ID NO: 18624 - DNA, 121 bp, Artificial Sequence
  Synthesized
  misc_feature (61): n=a or g
atggaatttgcagggaattttgcagttctattgcaaagcaagagatttgtcgggccatgcnaatctcctttgtttttcttcaatttaatgtttgtttgttggtttgttttttaatccaccc

SEQ ID NO: 18625 - DNA, 121 bp, Artificial Sequence
  Synthesized
  misc_feature (61): n=t or g
atttttaaagggaaaattgtgtttgggatttctgactaaataaggattccttttcttttanttctcactaaacaatccagttcctttaagcaggagaattactgatgtaaacacttacctg

SEQ ID NO: 18626 - DNA, 121 bp, Artificial Sequence
  Synthesized
  misc_feature (61): n=a or c
gaggtgatgcaacaccaggatagagcaggacaaccacttccctcaaccagctagccatacngttgagatcttccattatgtacacaccattatgtacaggtcacagagtgggagtaaggcc

SEQ ID NO: 18627 - DNA, 121 bp, Artificial Sequence
  Synthesized
  misc_feature (61): n=a or t
ttctctgagcacaagtagtgcaaaaatgttggcgctttctgtattttagttggaatacgcnggaaaatgaatgcgtatgtttttttcttaagctgagagcagaaaaatggaagaagaggtc

SEQ ID NO: 18628 - DNA, 121 bp, Artificial Sequence
  Synthesized
  misc_feature (61): n=a or g
aatacaccttaacatctctctagaaaactagaagattactttccattttggaaggactaanaatttcaagttttctttcttgaactatattataaatatcgtgggaacgattcgggtgtca

SEQ ID NO: 18629 - DNA, 121 bp, Artificial Sequence
  Synthesized
  misc_feature (61): n=a or g
gttctctatacctgcaacaattaaggctgttatccatgaaagtgttccacttgcatagtcnaaagtttactaactgtaaccagatggcatttctctttttgcttcttgagaacgtaaatgg

SEQ ID NO: 18630 - DNA, 121 bp, Artificial Sequence
  Synthesized
  misc_feature (61): n=a or c
ttaggtgacaccaggctaaagcagcaaggctggatgcgactcaagatccacttttctgctnattatttcatgcctgggcttcaagtggggaaaaacacatttaagaaataccttttccccg

SEQ ID NO: 18631 - DNA, 121 bp, Artificial Sequence
  Synthesized
  misc_feature (61): n=a or g
cacaacatttttctttactttcttaaatgtgttatcagtgacgcacagccagcattggccntggctcatctctgtacagtggaggttctcttttggagcagctggatctggctctgatctg

SEQ ID NO: 18632 - DNA, 121 bp, Artificial Sequence
  Synthesized
  misc_feature (61): n=t or c
gaaaaagccagcattagcaaaccttccacctaagcaaaaggtaataccaagctcctgagangtgctcagagtaaagcatctgttttatttcttccctgtcctcaaacagagagaattactc

SEQ ID NO: 18633 - DNA, 121 bp, Artificial Sequence
  Synthesized
  misc_feature (61): n=t or g
aaagctgaaattcttgctgtgcttgtgatcttcactcacctaattatgggtagagttaatntatgaacagaccctatgatctgtaaaagcaaaccagaaatgtcaagctttggaaagtata

SEQ ID NO: 18634 - DNA, 121 bp, Artificial Sequence
  Synthesized
  misc_feature (61): n=c or g
gcagttccccagataatggagcgtacttctatgtactgttcaaacagtcttaaagaaaagncacatgtaaaggtcggttgtgacccagatttttctttgatagcccttcacttaggataaa

SEQ ID NO: 18635 - DNA, 121 bp, Artificial Sequence
  Synthesized
  misc_feature (61): n=t or g
gagttcaaacttccttatctggcatagcagagcacttcctgtcttttgatagaacagcagnctgccactactactgctgatgctgcctgcagccatcagagagaagtacattaatgacaaa

SEQ ID NO: 18636 - DNA, 121 bp, Artificial Sequence
  Synthesized
  misc_feature (61): n=a or c
gccttatttaaacaaaggcttaaatgacaacacttgctagaatctactgacatgaatgggntttaaattaagcaaagcatatactgaagtgttttattgacatgggtgttagggagatgtg

SEQ ID NO: 18637 - DNA, 121 bp, Artificial Sequence
  Synthesized
  misc_feature (61): n=a or g
ttgaacaggaaagcagaggactgctgacaaagcctaggagatctgtgatccctttctcatnctggtggaggaggcaaataacttcagatcaacttcagatcattttgctcggcattcagtt

SEQ ID NO: 18638 - DNA, 121 bp, Artificial Sequence
  Synthesized
  misc_feature (61): n=t or c
gtcttattctgacagagtaaagctttatttctccagcctgagtaaactgcattgccacagntttggtgccaagctctttcataccactgccaaccctgtatgtgatccacactgtgagtgt

SEQ ID NO: 18639 - DNA, 121 bp, Artificial Sequence
  Synthesized
  misc_feature (61): n=a or g
tgctgcagattgcaaggatatgtcttaatcatctatagcttgtgtcttgaagtaagtagcnaaactcaaaaaaatggatacatggggaaatggtgatataaccaacaaaaaataataataa

SEQ ID NO: 18640 - DNA, 121 bp, Artificial Sequence
  Synthesized
  misc_feature (61): n=t or c
ctgtcctgttcgtaagacctcccactgtcacctccctgcatcaattcctacccttgtcttnggattggtcctcagtgtctttggactgctctgccccagcacagaggacacccggcagcct

SEQ ID NO: 18641 - DNA, 121 bp, Artificial Sequence
  Synthesized
  misc_feature (61): n=a or g
aggattatttctccatgaggaatttagtagagggctcatcagaagcagtgagggctttggngcatcaattacctacatacaatttcatcagggaacgcacacatcccccaggtccttttac

SEQ ID NO: 18642 - DNA, 121 bp, Artificial Sequence
  Synthesized
  misc_feature (61): n=a or g
gtatgttatagaatttcaggaattacagtatggatgcctgtgagagttggacaaccatgcnccttttaactgggaatacaagggagattatattcttcaaattattagtaataattaagta

SEQ ID NO: 18643 - DNA, 121 bp, Artificial Sequence
  Synthesized
  misc_feature (61): n=a or t
atctcccaatcagtaacttaaacttcttatcaatcatcccagacacagtcagctttctttnccctgcacattttcatgaatctgaaggttttatgttacttctcaccacgtagtttacaga

SEQ ID NO: 18644 - DNA, 121 bp, Artificial Sequence
  Synthesized
  misc_feature (61): n=a or c
tttatcaaaataatattgaatggaagaacaaggagaagaggcagacaaatgccattctagnaaacagcagggagtcactgttagttatgcaagccaaactctgccatataagcagacactg

SEQ ID NO: 18645 - DNA, 121 bp, Artificial Sequence
  Synthesized
  misc_feature (61): n=a or g
atccccaccttggggtcagggcggtcccagtgtgccacaacgggtgcctgagggcatcacngaacaggatatggagataggagacataggggaggtggttggcagagggtttgggatgggg

SEQ ID NO: 18646 - DNA, 121 bp, Artificial Sequence
  Synthesized
  misc_feature (61): n=t or c
ggcctattgcacctctgctgcttcaatcagactttagtcctgggcttgaaatactgagacncttgggagtctgaagccaccatgagacatttacgtagtcagtgtctcactggaggcacat

SEQ ID NO: 18647 - DNA, 121 bp, Artificial Sequence
  Synthesized
  misc_feature (61): n=a or g
agattagccaggttcctggggagtatttttagggttattctttaaagcaaataaggttatntgacatggctcaggacagagagacaagagactgaaaacccagtgggataaagcagccttc

SEQ ID NO: 18648 - DNA, 121 bp, Artificial Sequence
  Synthesized
  misc_feature (61): n=t or c
tcttcagagcagaggcatccactgaaaggacctggcatttaacatacacagtgcttaacanatatgctgctagcttctctccaggatgtgataggtcatagctgaagtgagtatcaggagt

SEQ ID NO: 18649 - DNA, 121 bp, Artificial Sequence
  Synthesized
  misc_feature (61): n=t or c
tgttgttgttgttatgtgtagtacattaacccaattcctctggcaataggatagctaaaancgtattttctttgaacttctgaagaacttccttcctgtcttaggtttcctttaaaatctc

SEQ ID NO: 18650 - DNA, 121 bp, Artificial Sequence
  Synthesized
  misc_feature (61): n=t or g
ctgtggaagtgctcgaggtttccaatgtccaatttgaccaaagcagtagcagacaactgtnttacttccaagttttctgtctccacatcaaacataaaatattattaatatttttatttct

SEQ ID NO: 18651 - DNA, 121 bp, Artificial Sequence
  Synthesized
  misc_feature (61): n=a or g
taaacctggccttgaacaattccagagtgtcacaggttgagggccttttgcccatgacatngggttagggtcatcccaccacccttcccctatgggaagttagtagagaagtgagaaggat

SEQ ID NO: 18652 - DNA, 121 bp, Artificial Sequence
  Synthesized
  misc_feature (61): n=a or g
aaactgtcatagttaacaggaaaacattactaagaatgaaaacctttcagaaaaatatggnatagctgtagcacatgcaaacttattctcatgtggaagaaataaacccaggaaaacccac

SEQ ID NO: 18653 - DNA, 121 bp, Artificial Sequence
  Synthesized
  misc_feature (61): n=a or g
cactgaacttcccatcccacagttatgcactgaatagccactccctaaatttgaaacacanctttttcctcataactcctacaggatcaaatcaaacctgacaactgatactgatcagtgg

SEQ ID NO: 18654 - DNA, 121 bp, Artificial Sequence
  Synthesized
  misc_feature (61): n=a or g
ttgcataagatgctgatgaggatggtaagatgatgaggatttaaaaatgttaggcaacttntattagattttagctatgaatattattgctaggcctgagtaaattcatagaattctgtaa

SEQ ID NO: 18655 - DNA, 121 bp, Artificial Sequence
  Synthesized
  misc_feature (61): n=a or t
atcttgaaaggaactctcggatcaactgtaaaatacaggggagaactgccagtatgagatntaatctgtggagaagctttgatctctgctcctcctcatgccatttaagaaggtggggcta

SEQ ID NO: 18656 - DNA, 121 bp, Artificial Sequence
  Synthesized
  misc_feature (61): n=a or c
aaccattgagaaattttctcatagaaaatagaaaaagaagagtgacttggtaatttgtgcnttcagaaaggaaaatgtagaaaaccagtacaggtcatcaagaaatcctgaggttttctga

SEQ ID NO: 18657 - DNA, 121 bp, Artificial Sequence
  Synthesized
  misc_feature (61): n=a or g
ctgcaatgaagcagggaccaaataggggcatccttcacgctcctgaaatatgcactttgantctatgctgatattaattccgatcaacatcagaaaagcaaagagaggggagggagaatgc

SEQ ID NO: 18658 - DNA, 121 bp, Artificial Sequence
  Synthesized
  misc_feature (61): n=c or g
tgcaaacagtgcagtaagaacgcctttaaatgcttcgttaaatatgtctacttgaatgcanctttgtagtatggaccttcaccaaatgaaatatcactttatatcactttaccaggctttc

SEQ ID NO: 18659 - DNA, 121 bp, Artificial Sequence
  Synthesized
  misc_feature (61): n=t or c
cggtgagcgcttgcagtccctgggagcgtctgtgttactggttatgcaaacaaaataatgnatacgtgtgttcttcagaaattccaaatatcccatggaagcttttcaagaaggcgtgggc

SEQ ID NO: 18660 - DNA, 121 bp, Artificial Sequence
  Synthesized
  misc_feature (61): n=a or g
tctattggaacaaaacgtaaataagatggtagccatgctaaagaagtgctaagaaaatacntattagaatagttcaattatcaagaacaggatatgcataaacaaagtcatttcatccgga

SEQ ID NO: 18661 - DNA, 121 bp, Artificial Sequence
  Synthesized
  misc_feature (61): n=t or c
aacaccagaaactaccaggaaacactccccttggcaccttggatttctaccctctcagagnttcaggacttcttccccagtcccacactgtccctctgttcaggccatcatgtcagcagca

SEQ ID NO: 18662 - DNA, 121 bp, Artificial Sequence
  Synthesized
  misc_feature (61): n=a or g
aaaaaaaaaagccaccatgaaaagaccagacaataaactgattttctttctccatcactgnattgtcaccctgcctcttctcacctgccacagatcataccttaatcacaaaaccaactcc

SEQ ID NO: 18663 - DNA, 121 bp, Artificial Sequence
  Synthesized
  misc_feature (61): n=a or g
atgggacccagaacagagccagcaagaacagactgccaatctctctgtgacagctggcacnaacttgctacaaaaccacttcaacggttgaaaggaaaaggtagaactttcaaacatcctg

SEQ ID NO: 18664 - DNA, 121 bp, Artificial Sequence
  Synthesized
  misc_feature (61): n=t or c
atttcagatataaaacgcccataagtctcttaaacttttctctcctttctccccatctccntcctgcccattcccagtggtcccacagctgcacaaccctgcttgtgctcgcacattttcc

SEQ ID NO: 18665 - DNA, 121 bp, Artificial Sequence
  Synthesized
  misc_feature (61): n=a or c
cccagggtcagcacagcagggctgggcatcgtggtgatgatgctttgcttttgctgggacntcctctgcaatgtgcactgtgtccaagactagaaacttgaacatgtggaagcttatgatt

SEQ ID NO: 18666 - DNA, 121 bp, Artificial Sequence
  Synthesized
  misc_feature (61): n=a or g
ttttttttttcctttttctcaagagtaagaatccagaaaatctggaagcagttaagtcacngcactggatgtatacacagcctgcgaaactgcagacaatcataaaagctattggcaaaaa

SEQ ID NO: 18667 - DNA, 121 bp, Artificial Sequence
  Synthesized
  misc_feature (61): n=a or g
tggactaagcagccttgcagaagactgctcaccccccataatgggactccgtaagaatgcntgttaattataaagagtatggcaaagcaataggttttgtactccttgttgaaggaagctg

SEQ ID NO: 18668 - DNA, 121 bp, Artificial Sequence
  Synthesized
  misc_feature (61): n=c or g
atcctgtctctttgttcattttgtgcatttgctagcagcaagtgtccagtagtgtcaccanctgactctgtgcttgaagggcagacatggaagatggtcttgagaacaaattaacctgatt

SEQ ID NO: 18669 - DNA, 121 bp, Artificial Sequence
  Synthesized
  misc_feature (61): n=t or c
aatgtgaaacaagacgtaaacagtagataacattcaatatgatagattattaagaatcatntttcagcagaatggatagacttcatcaattctaacctatcaagtaaaaataaatacattt

SEQ ID NO: 18670 - DNA, 121 bp, Artificial Sequence
  Synthesized
  misc_feature (61): n=t or c
aaattgccttagtgtgatgtgcaaattcctatttacaagctacagacagcagcatctcagngatagctgcaacagaccagtgtgcaatgagcccccccaccaccatgcttactacaagctg

SEQ ID NO: 18671 - DNA, 121 bp, Artificial Sequence
  Synthesized
  misc_feature (61): n=a or t
tcagttctacttcttaaaacatgtcttccacgttcacccatcactgttagtcttacagaanatttctttgcagtaggccaatccccattggtgcttccattaccacaaacccataccatgc

SEQ ID NO: 18672 - DNA, 121 bp, Artificial Sequence
  Synthesized
  misc_feature (61): n=a or g
agcacacttgtgccatcgacacacggtgatgatttttgccacggtctttctgtccgtaaanatccactgttgtttttgtgatagcgatactctgcgatccttccttttctgttgagaaatg

SEQ ID NO: 18673 - DNA, 121 bp, Artificial Sequence
  Synthesized
  misc_feature (61): n=a or c
cagaagtactcatttttcctttgcacatggcagaggtggactgtgaacccattttagtagnttgacacaccttcaatgctatggagagtaaatttgtttaaaactagaagttatttatccc

SEQ ID NO: 18674 - DNA, 121 bp, Artificial Sequence
  Synthesized
  misc_feature (61): n=t or c
gattggccatgatgggatgtagatgtgcatgagatcacatcacacgtgcatgagatgagcncacatcaaactattccgatgctgtatattcacaacagaatagagccacatctgtgacatc

SEQ ID NO: 18675 - DNA, 121 bp, Artificial Sequence
  Synthesized
  misc_feature (61): n=t or c
actcaagatctccagacaagtgaaaattcatgggctcttctgggtctctgaaggacttctnctatccacattcactaatccttcaatatactgcttcttttgcaagaagatggagaaaata

SEQ ID NO: 18676 - DNA, 121 bp, Artificial Sequence
  Synthesized
  misc_feature (61): n=a or g
gcagtgtcaggagtgttattttcagtctagttgtgacttttaaatcccttcaaaaaaaaanaaaaaatccttctcatccacgctagtggttctggatagcctctacactaatcacttgcag

SEQ ID NO: 18677 - DNA, 121 bp, Artificial Sequence
  Synthesized
  misc_feature (61): n=a or g
caaccccagcaccagtaatgcagcctaggtaatgaggcaggagcacggggctgaaccgacntggaaacccgcaggctaacagcagagcaaatccctcctaaatccaggatggaagagcagg

SEQ ID NO: 18678 - DNA, 121 bp, Artificial Sequence
  Synthesized
  misc_feature (61): n=t or c
tgaggcaccaaatagggttttgtactggagatggaagggacaatgagaaaagatggtggangaatcactccttgttggggtgatgtttgagttttcagtcttgtgagctctatgccttgtt

SEQ ID NO: 18679 - DNA, 121 bp, Artificial Sequence
  Synthesized
  misc_feature (61): n=a or t
ggcacagaaaacaacacaagggaaaatatctgggatatattgatgactgccacaaataccnggacaaataccacaattcagttctcactgcacagctaatcaaagtctgaacctgcagaga

SEQ ID NO: 18680 - DNA, 121 bp, Artificial Sequence
  Synthesized
  misc_feature (61): n=t or c
gttttgtcatagaagatgcacacccgtgtgcacagatccctgaagaattcccaaagatccngccctgtacttaatatcacagagagtgacatactgaacaactctgagatagattgcttaa

SEQ ID NO: 18681 - DNA, 121 bp, Artificial Sequence
  Synthesized
  misc_feature (61): n=a or g
atgcttatacttatcttgttttccaagctgacagatatcctcccactattaagaatcccantataaaagaaaatctttgtaatacaagtatccaaggacacatctcttcacaaagcctcct

SEQ ID NO: 18682 - DNA, 121 bp, Artificial Sequence
  Synthesized
  misc_feature (61): n=a or g
caccttttttccttagggaaaagactgctttttctttgaattgcataatgtaacctgatancttgattatttctttaggaatcctcttagaggaaactgaaagagtaacgcaaggtcctct

SEQ ID NO: 18683 - DNA, 121 bp, Artificial Sequence
  Synthesized
  misc_feature (61): n=a or g
ggattaaccagaatttgtgggtagtatttgcagacatgataattgccagtttgtgcctccntctagctattacatacatccctctgaaagtaatgtctcctatttatttctgggggaacta

SEQ ID NO: 18684 - DNA, 121 bp, Artificial Sequence
  Synthesized
  misc_feature (61): n=t or c
atttaatgtactccacttagcattaaataaacatgaaaacatgcccccaagtagcactgtnaaatggcaatgcctcccattaagtaagtgcttcccagtctcaccattgcctgcacgcagc

SEQ ID NO: 18685 - DNA, 121 bp, Artificial Sequence
  Synthesized
  misc_feature (61): n=c or g
agacagggatgagcccatcactcatgcttccaagcgtggaaggcaaaaggcagagcagcantgaagctctgagggcatagaagaatgggctatgagacccctttggaccacaccaggctgt

SEQ ID NO: 18686 - DNA, 121 bp, Artificial Sequence
  Synthesized
  misc_feature (61): n=a or g
ccaatattactgtgttggataatttctttttatatatagaaaagaacttctttttctacantagttctacagtcacaaaggcttgtggaaaagggagctgcccaattgattaaaaaaaata

SEQ ID NO: 18687 - DNA, 121 bp, Artificial Sequence
  Synthesized
  misc_feature (61): n=a or g
aatgtgtgatcaacagtttgcatcatgctccctctttctccagaagcagcccttaaggatnttcggagttaatggggcatggcgcagttctacacaccaacatcttctgaaggacttttcc

SEQ ID NO: 18688 - DNA, 121 bp, Artificial Sequence
  Synthesized
  misc_feature (61): n=t or c
ttccataacaaatgatagagcataaccacagttgtctgagcaactggaaaaaaacagctcntgacatctcctgaggccaggccccaggtacagttggagacaccacaatgagcccagacac

SEQ ID NO: 18689 - DNA, 121 bp, Artificial Sequence
  Synthesized
  misc_feature (61): n=a or g
gcatgtggaccagaggaaagcgataactgtggaggatcctcatataaggtgagctgcaatnctgcttctggagatcttgttctgaatatgagctgacttcatttcatgcatttagcagtaa

SEQ ID NO: 18690 - DNA, 121 bp, Artificial Sequence
  Synthesized
  misc_feature (61): n=t or c
gagaccacataaggagaacgcatctctccaaatcacactgccctttccatcacaaagcatntccccatttctcttgtttatcttaacatcattactactgcttcccactcttcactgtggc

SEQ ID NO: 18691 - DNA, 121 bp, Artificial Sequence
  Synthesized
  misc_feature (61): n=t or c
gaatgtcctgtagctaactctaatagtgacagacactcagcctgagcaactgcagtgtccngggtatctatgcaagcatgtttgaagctcaaatgaaccattttcccataacattatggta

SEQ ID NO: 18692 - DNA, 121 bp, Artificial Sequence
  Synthesized
  misc_feature (61): n=a or t
acatataaaaattcttccttgcaacataataatgattacctgttctgaaagctcaaatgtntattttatgtgtactcatttttagtaaacacaggttcaggccaacagttttaaagatgat

SEQ ID NO: 18693 - DNA, 121 bp, Artificial Sequence
  Synthesized
  misc_feature (61): n=a or g
gctgctcaacaagctcaattaccgtaagtgaacatgcaaagtagatagtagcaggcgcacngccacttagatgcctattcatttgcatacgcaaacactcatttccaatgcaaaatgtgat

SEQ ID NO: 18694 - DNA, 121 bp, Artificial Sequence
  Synthesized
  misc_feature (61): n=a or t
gaattgatcccttgtcctctgcctagtagatgatagtatttgctttagttttcctgatgcnttttatttttctaacagtacctgtttagcactacagcagctagaatatgcagtttgcttg

SEQ ID NO: 18695 - DNA, 121 bp, Artificial Sequence
  Synthesized
  misc_feature (61): n=t or c
gacctattcatttaattgcagggaataaccccttgttttgtacaattgcaggtttcctcangatcctccaagttaagtgaggttatccactggagtagttgccgagatcaagaagagatgt

SEQ ID NO: 18696 - DNA, 121 bp, Artificial Sequence
  Synthesized
  misc_feature (61): n=c or g
tgtgtactgaagttgttcatagtgaaattctttgccttgtccagagacaaagaactgactncaagtacatttggaaacaagagatacgtgttgaaattaatgcactggaggatttcagtta

SEQ ID NO: 18697 - DNA, 121 bp, Artificial Sequence
  Synthesized
  misc_feature (61): n=t or c
ttcaaaacgcctcttgcaacactcgtcctttctttggctgctttacagccagcccttcctngactacactgggtgcatttgactctgtaagatgagagggactgtctgggtttgtccctgc

SEQ ID NO: 18698 - DNA, 121 bp, Artificial Sequence
  Synthesized
  misc_feature (61): n=t or c
agaaaaggccaaaaactccgttcccacctgctgtccaagaacaggaaacgctctgtgttgncccagcaccttacaccgggcagagctcaccaccgagctcagccaggctgccctttctctc

SEQ ID NO: 18699 - DNA, 121 bp, Artificial Sequence
  Synthesized
  misc_feature (61): n=t or g
atccaccaagaccccagacctgactggtgggaaataaacatgtttaaaaagatccaaactnctatgtaatcctaaatagaaagaggatttcctttcacacaatctagctctatcacctagg

SEQ ID NO: 18700 - DNA, 121 bp, Artificial Sequence
  Synthesized
  misc_feature (61): n=t or c
ttctggcaatagttgttcagcacttcttactgtgagtttgtgaaggaatgtaatgccttgngttgatatgtggcaaaacagcagattacgtccatgtcttgaaggtttgcttttctcttgg

SEQ ID NO: 18701 - DNA, 121 bp, Artificial Sequence
  Synthesized
  misc_feature (61): n=c or g
tctgcagcatataataatctaaattttcaagtagtatgcatccccttttgcccattatttnttatacaaatgcctataatattacgtttatatatttcagatcagataaccttcctttttc

SEQ ID NO: 18702 - DNA, 121 bp, Artificial Sequence
  Synthesized
  misc_feature (61): n=t or c
acagactactggctttcctgcaagctccttgtccatggagcctgctttcagtcctcaggantgcctagtgttagtgactattgcccagtgacatcaaagcttacgggaaaaagggagggca

SEQ ID NO: 18703 - DNA, 121 bp, Artificial Sequence
  Synthesized
  misc_feature (61): n=a or g
tctttgatcaaggaagaatttcttcaaactcctattcaaaccagtttctcctgcacacacncagtaacaagacccatttgctgtgcagaaatgaagacaggaatatttctttcactcccag

SEQ ID NO: 18704 - DNA, 121 bp, Artificial Sequence
  Synthesized
  misc_feature (61): n=t or c
cagcctttgaactgtcttaaaaaatactacgattctgtaaaacagaaggcctctaaagtanaagctgagggactaaatatcttctgaaaacagctgttcagatgagtgatatcctgtgaag

SEQ ID NO: 18705 - DNA, 121 bp, Artificial Sequence
  Synthesized
  misc_feature (61): n=t or c
tcttaattttatgcaaaaattaaggcagccgattgcttaggcccagaagagcatcctgacntctgcaatagcctgtggactatgaacagatacagttcttaattcattgtacatgacaacc

SEQ ID NO: 18706 - DNA, 121 bp, Artificial Sequence
  Synthesized
  misc_feature (61): n=t or c
atggtggcacatcctgctccctccaactttttatggtgttcctaaaagtcctcatgactgnggtttttgtttggctgaagccaaacagtgcctgggtgtgtggtgcttcctgtgggctttg

SEQ ID NO: 18707 - DNA, 121 bp, Artificial Sequence
  Synthesized
  misc_feature (61): n=a or g
ccagagctggctgacctcgtaacactgcatcaccttcgagatgaaacatccagctcttgtnccatccaggatgcaggctcttaggaaatccacactccctcaaacccccaacaattgcaag

SEQ ID NO: 18708 - DNA, 121 bp, Artificial Sequence
  Synthesized
  misc_feature (61): n=t or c
gctgctaggtacctagattggaagttagcacttttattccctacagacagaagtagtacangtgaaggttagaacagatggtggggaagtcaggaaacgtatgtttttatcaggacacctt

SEQ ID NO: 18709 - DNA, 121 bp, Artificial Sequence
  Synthesized
  misc_feature (61): n=a or g
tgtctgtggtgtgtgtttggagtgtctaacagtttgaaaaccaggacagacaaaaccctcnattgcttgttaaggacttgtaaaaaaaataactataataataatggtgtaaaacaaggct

SEQ ID NO: 18710 - DNA, 121 bp, Artificial Sequence
  Synthesized
  misc_feature (61): n=t or g
ggttattatgtggagctcttgctgtttcaactgatctttaattttcagtatgtctcagcangatcttgaagctctttttggattctattccttccaccttgggcttgtccttaatcttttt

SEQ ID NO: 18711 - DNA, 121 bp, Artificial Sequence
  Synthesized
  misc_feature (61): n=t or c
ttcagaattatctctgtggttaattacaatcaagatttcagggatgtatttccagctgaangttcatctatattcagtgatcttactgcaatcagctacctggaataatagcactttacat

SEQ ID NO: 18712 - DNA, 121 bp, Artificial Sequence
  Synthesized
  misc_feature (61): n=t or c
ccagccttttttctcaaattactcagtctgcctattactaatctgcttgatctcaaagatntgtacattgatatatgttattaaaaaacccaaactcttgaaggataccacagcaagccag

SEQ ID NO: 18713 - DNA, 121 bp, Artificial Sequence
  Synthesized
  misc_feature (61): n=a or g
gccgacatctgcctccatctcccctgcgagaggaaacagagagcaacaaggtcctggtccnaggggctctcaatcctcacaatggattttacctgtctctgaaagctgcctccatctctca

SEQ ID NO: 18714 - DNA, 121 bp, Artificial Sequence
  Synthesized
  misc_feature (61): n=t or c
tgttgagttgcagagaacgggaggaggagatgtcatctcatggaaattcccaaggagtacnttcctgctttgtaagagaagccgatcaaagcattcttagtattcttccctttgggccatg

SEQ ID NO: 18715 - DNA, 121 bp, Artificial Sequence
  Synthesized
  misc_feature (61): n=a or t
acctccctcacctctaggagctgtgaaaatcagtgtctcaacaccaaatgcaaagtaaaancttacaaaagcaacactggagtccttctgcgcacatgacttaagcatttcacagtgtaac

SEQ ID NO: 18716 - DNA, 121 bp, Artificial Sequence
  Synthesized
  misc_feature (61): n=t or c
tttaagactttcattcagatatttcagtatttatccagctaaagaaagatgctgagatcangcaccacattctgcttaggcagtgcagtgttgcctgaattatgaaataattctataactt

SEQ ID NO: 18717 - DNA, 121 bp, Artificial Sequence
  Synthesized
  misc_feature (61): n=a or g
tgtgctgcttctgaaggttgatatttctgattcatcctaatgagtggtgaggttgaagatncttcctttcctaggaaagatccagttgcctgccaccaatgattgatgaacttgcatcttg

SEQ ID NO: 18718 - DNA, 121 bp, Artificial Sequence
  Synthesized
  misc_feature (61): n=a or g
cactgacattccagagggaaaattcaccaccaaacaacttgggtttcctccagcaagttgnatgagatgaagccatagaacccaatgacaaaaacagcacttggtaaaggtggggtttcca

SEQ ID NO: 18719 - DNA, 121 bp, Artificial Sequence
  Synthesized
  misc_feature (61): n=a or g
catgatcttctgccccaggtcacagggggtttggcttcaaaatgcagatgggaacagcaanatggctggtgaggacagagaatgcaaatgatcaccatgggtttgagagattggcaaaggg

SEQ ID NO: 18720 - DNA, 121 bp, Artificial Sequence
  Synthesized
  misc_feature (61): n=t or c
ctaatttgcttgtattattttcagtttttctctctaaggttttaactgctacacaacgtcngtcttcaccacataatgagatcaagtagcctagctcaggttttgattaaatcctagatct

SEQ ID NO: 18721 - DNA, 121 bp, Artificial Sequence
  Synthesized
  misc_feature (61): n=a or t
atttctattgcagttgctgttgacagaagtactttgtatagatccctaaaaacacctgagnggaaagtccataatgcaacaaaaactctcataaaaagatgagaagaagataagcagaagt

SEQ ID NO: 18722 - DNA, 121 bp, Artificial Sequence
  Synthesized
  misc_feature (61): n=t or c
tgtaacaccaatactgctcagccgtgatgctgagttgtgtagtaacgtgttgttacaatcnaaactgtcctgaaaagaatacaaccacttccctcatttctagtgaagtcctcagcttcat

SEQ ID NO: 18723 - DNA, 121 bp, Artificial Sequence
  Synthesized
  misc_feature (61): n=a or g
agaacctttgttttaggagagaacagtggaaaaagttacaaattcatcaacatctacagtntgggatatatacagcagatgaagaggatatcatttcaagtacaagcagtgcaatgggact

SEQ ID NO: 18724 - DNA, 121 bp, Artificial Sequence
  Synthesized
  misc_feature (61): n=t or c
aagctcagtgaggggcttgggtggctgcaggtatgtgctgtgcagccaaataaaaccttcnggaagagatacggtgtgtcctgtctgccttcagaacaactccaggattccaggatgtggg

SEQ ID NO: 18725 - DNA, 121 bp, Artificial Sequence
  Synthesized
  misc_feature (61): n=a or g
ctggaatcaccttcacggtatttacataatctgcccgtagcccagtccaaggcacaatcanaacaagcctctaaattagaagctgacacattcctacaagaagaaatgtttcaaaacaccc

SEQ ID NO: 18726 - DNA, 121 bp, Artificial Sequence
  Synthesized
  misc_feature (61): n=a or g
tctgaaatgctttccatgtacccagggtagatgagacaagttttgctgtcactggggcccntgtttaggatgtcatctctttacaaacagcctttattttgggggttgaattcatgtagac

SEQ ID NO: 18727 - DNA, 121 bp, Artificial Sequence
  Synthesized
  misc_feature (61): n=a or g
gagcaataactctgacaatggatcctgttgtctcgagttaactgctcactctgagcttaancgtggtttatgctaccacacactgctcactcatcatcttctcgctgtctcagtgacgttg

SEQ ID NO: 18728 - DNA, 121 bp, Artificial Sequence
  Synthesized
  misc_feature (61): n=a or c
ctagttcttcagctgcctaacagcatgtctgtgcacatatataaagagaaaaaacagtccnaattcacccagtgcattgttgcagttctcaacaattatcacttaaaagcaatttaatgcc

SEQ ID NO: 18729 - DNA, 121 bp, Artificial Sequence
  Synthesized
  misc_feature (61): n=t or c
cttttgttttgactttccaagtcacaatactcccacataaagcagaactggcagagaaaangtattgctaagtcagcctggggaatgccacaaagaactgcatgagctcttcaatcatatt

SEQ ID NO: 18730 - DNA, 121 bp, Artificial Sequence
  Synthesized
  misc_feature (61): n=a or g
actgggatagagagtttccatgagcacatctcccagtgcaagaagttcagtcatccttctnagatgtctctgtagctttctgttagggaagcagaggtgcaggaggagctttgcagggaag

SEQ ID NO: 18731 - DNA, 121 bp, Artificial Sequence
  Synthesized
  misc_feature (61): n=t or c
ggcctcgtctggacggggctggcactgggaccaggtggtgccactggtggcattgggtttncagcaatacgtgatgatcccatggataggtcgggtcaggaaacaacgtaggagcatcact

SEQ ID NO: 18732 - DNA, 121 bp, Artificial Sequence
  Synthesized
  misc_feature (61): n=a or g
gagctttttggttgcttggtctgagatgcaggcaaaaaaccaccccagcatactctttggnttgcagtaatagtaggtactgggaaatgaatgtgtgtgtcagtaaatactgcattttgtt

SEQ ID NO: 18733 - DNA, 121 bp, Artificial Sequence
  Synthesized
  misc_feature (61): n=a or g
ccaacaatgcaatttctaagctctgaacacattagcaatctcaacacagtttagctataanttgtttacatatttaggcctccactatagacagtggaaagagacaagcacctccgtgtgg

SEQ ID NO: 18734 - DNA, 121 bp, Artificial Sequence
  Synthesized
  misc_feature (61): n=c or g
aaataacttatccttgttcccttggcgcttctatgctctgctcagcttcgtggctcattgntcattttccctctgtgtattattattatctgacgcttcaaacagctctgccctgaaagtc

SEQ ID NO: 18735 - DNA, 121 bp, Artificial Sequence
  Synthesized
  misc_feature (61): n=a or g
gtttttgtgtgaagtctggtgcgatggcagccttgggtaggaggcctgaccttaagagaancaggcagatttagatgaaagcatccatgttgggagcagattggtttaaagctgaggtgag

SEQ ID NO: 18736 - DNA, 121 bp, Artificial Sequence
  Synthesized
  misc_feature (61): n=t or c
aaaatctccctcattattctcactgatgttgctgcatattcaataacttaacttgagccanaatctggagaggatagggaagattacttagactgcagagaagttattcttaaaaattgct

SEQ ID NO: 18737 - DNA, 121 bp, Artificial Sequence
  Synthesized
  misc_feature (61): n=a or g
caagtgtcaacatgaaaaaggaatactgagagctttgaaaaatttacacttactaaaaaanttgcttagcatattttgactccaactgcacgtgctgcaaattaatttaaagattaacaga

SEQ ID NO: 18738 - DNA, 121 bp, Artificial Sequence
  Synthesized
  misc_feature (61): n=a or g
tctcagattttcagcccagttctcctgcttgcctcactggcttgtacttgatcagagtagngatctcagagctagggagccaatgaaacaggctgtgcatcagcctggtgaagcttcacca

SEQ ID NO: 18739 - DNA, 121 bp, Artificial Sequence
  Synthesized
  misc_feature (61): n=t or c
ttaaagtattttaggattccttaaataaatatatccttacttgattgcttactatcacagngctggtattttcttggtccgagaaggtatggaggtgagatacgtagactaagaggcaaag

SEQ ID NO: 18740 - DNA, 121 bp, Artificial Sequence
  Synthesized
  misc_feature (61): n=t or g
aacaattctcaaattgctgcctgttgtaacaaaagtgagattaggatattttaagtagttnttttaattgaattgaattgtctactaatatttaagctaattaagtaattttctaatccta

SEQ ID NO: 18741 - DNA, 121 bp, Artificial Sequence
  Synthesized
  misc_feature (61): n=t or c
tattaaagtttcttacattacatgtcttcctcattgctcagtataagctaatacttcagcngtgcaatgctgtcacccaagccgatgtctgctggacgcagccctatgcaacgcccagtga

SEQ ID NO: 18742 - DNA, 121 bp, Artificial Sequence
  Synthesized
  misc_feature (61): n=t or g
cagaggacacttggtcatggagccaggggtgctgttggactgaacagtctggccctgagancagccttagactactccataaaatacaagcataatagggcttcattgaatggtttaggtt

SEQ ID NO: 18743 - DNA, 121 bp, Artificial Sequence
  Synthesized
  misc_feature (61): n=a or t
acaagacctcccatttgtcttgatggtttccatccatgtatttcttgtgtacgtccaatanctgcaattgagctgggatttgcactcatcactcttccccatagccccatgggctgaagtg

SEQ ID NO: 18744 - DNA, 121 bp, Artificial Sequence
  Synthesized
  misc_feature (61): n=t or c
ggttgttgttggcactactaactaggtaacatcttttgtggatttgttcctctcagtgtcngcctctcactagagaaaggaaactgaaggcctgagtgctgcactggacagaggtgcaagc

SEQ ID NO: 18745 - DNA, 121 bp, Artificial Sequence
  Synthesized
  misc_feature (61): n=t or g
tttatgaagcagctagtcctatacacagctcaagttatccccatgcaaacacacaataatntgtcagagcattgaagaaacagtatgccaagactcagacgataatcaggtcatctcattc

SEQ ID NO: 18746 - DNA, 121 bp, Artificial Sequence
  Synthesized
  misc_feature (61): n=c or g
ctgcaaatccgtatcttctgactgagaactgaaaaacaaatggtcccacatgtacgtaaantaaagtaaaatttaagaagtaaaaattatgtaagtaaaaatttatgttttctctatttca

SEQ ID NO: 18747 - DNA, 121 bp, Artificial Sequence
  Synthesized
  misc_feature (61): n=t or c
atccatggtggagctcaaagtgaaaaagcaaagaggtggtttcctcagagggaaggaatangtgcttccacattggggcagggttttgaagaagcataaataaattatctacttgctaaac

SEQ ID NO: 18748 - DNA, 121 bp, Artificial Sequence
  Synthesized
  misc_feature (61): n=t or c
ccaagtcaaggtaagtgcaaaaacaagtaacccaaaatgtaaccagcctggattccaaaanggttgtatgactcctgtgttcactttctaagcgcacgcaaacgatttcatttcactgggt

SEQ ID NO: 18749 - DNA, 121 bp, Artificial Sequence
  Synthesized
  misc_feature (61): n=t or c
catgaacagttaatattatttctcattctgagcagccacttgaggtgtcttacaccagganagatgtcttctccatctcaaataccagcactgcataagcagatggagaaaagttacagca

SEQ ID NO: 18750 - DNA, 121 bp, Artificial Sequence
  Synthesized
  misc_feature (61): n=a or g
atgctggcctcagggccaggctgcagaggccaccatgtgctcctaagcgcagcccaggatntgtcgcaataacttggtgcagggttttccaccaacggttgcaaaatcaagcagatggatg

SEQ ID NO: 18751 - DNA, 121 bp, Artificial Sequence
  Synthesized
  misc_feature (61): n=a or g
agaagggaaatatggctgacagagcacatcccctggttatttcatccctgctctagccggnttcctgagaacatgaggtttttgtgaccacacagtgtagttgtatatttctctattgcac

SEQ ID NO: 18752 - DNA, 121 bp, Artificial Sequence
  Synthesized
  misc_feature (61): n=a or g
gcacacctgttctggacacacctgccgagtccctccaaaacctgagtaagtcctcagttgnattgagttcttgagaagcaaacaggagaaggcgaggctctggggtctgtaccagaggtga

SEQ ID NO: 18753 - DNA, 121 bp, Artificial Sequence
  Synthesized
  misc_feature (61): n=t or c
acaaaatatccttccatatttaaataatccatttcaatttgtcccagaaaatatgttgacntctgcattcctttaggcacactggaatggcacagtaaagaactgaggcggttcagaaggt

SEQ ID NO: 18754 - DNA, 121 bp, Artificial Sequence
  Synthesized
  misc_feature (61): n=t or c
gcaatcctcacttggctgctttcgttcactttcccatcttgcagctacttctgttccacangaccacctgttgtgatgttccctttgcacaggaggggctcttctcccatggctgctttcg

SEQ ID NO: 18755 - DNA, 121 bp, Artificial Sequence
  Synthesized
  misc_feature (61): n=t or c
ttaatgctgatacggcagcaaaggcagttgctagtgataagattgttttagatgtgggtgnggcactccactgtcctgttttctggttacctgagtgtgatgcagggtggcaggatagcta

SEQ ID NO: 18756 - DNA, 121 bp, Artificial Sequence
  Synthesized
  misc_feature (61): n=t or c
acgtggtcagtgggcatgtggggatccaagaaggtgattctgtgctcctatggagccgctnggtgctcccagctcggagctggtggccaacgtgggcacgcggtgctgcagaacagcgttg

SEQ ID NO: 18757 - DNA, 121 bp, Artificial Sequence
  Synthesized
  misc_feature (61): n=a or g
agtaacggaataagaaaatctactgaggaaactacagaatttcctgaaataacaaccccanttccttcaggtagttgttttttcccctcagaaacttctgaaaatatatggtgaactttaa

SEQ ID NO: 18758 - DNA, 121 bp, Artificial Sequence
  Synthesized
  misc_feature (61): n=a or g
agaaatctgttactgccctttgctttactcggatgagacaagaatgaggacaggtgagacntcctctcatgtagatacctgtaatactttcatttcaaaattcagtagagtggagttcagt

SEQ ID NO: 18759 - DNA, 121 bp, Artificial Sequence
  Synthesized
  misc_feature (61): n=a or g
caactgcaggattgtcatcaagaattcctttaattaaggataaccacacctaaagaaaacntattatgatgttatgattattactattaaactgcagaaaattgtgtgtgcatttataact

SEQ ID NO: 18760 - DNA, 121 bp, Artificial Sequence
  Synthesized
  misc_feature (61): n=t or c
agctcgctgccttgttgcagctctctaagcctgtgtggcagtgaggaaccccaagggcagnacagtgagccccctgtgaccatggcaccaagttggccagagggagctgaggcaataacgc

SEQ ID NO: 18761 - DNA, 121 bp, Artificial Sequence
  Synthesized
  misc_feature (61): n=t or c
atagtaatttcctaggcaatgctcccagttacaaggagagaaccagctgtgaattgctatncctacaagccacagctttaaatacaactgaaagatggtctgcagctattaaccagttaac

SEQ ID NO: 18762 - DNA, 121 bp, Artificial Sequence
  Synthesized
  misc_feature (61): n=a or g
gtgcaaggagtggtgggcaggagcacacatctccctcatccagccagagtgggaaatggangctaggatgacagtttagcactgtagtttccattagcatcataaaaataacatattcttc

SEQ ID NO: 18763 - DNA, 121 bp, Artificial Sequence
  Synthesized
  misc_feature (61): n=t or g
tatgagggagacatggagctgttggagcgagtccagaacaaagctactaaaatcatgaaangactggggtatcacgtatgtgaggagaagctgagagttaggtctgttcatcctggagaag

SEQ ID NO: 18764 - DNA, 121 bp, Artificial Sequence
  Synthesized
  misc_feature (61): n=a or t
caagtgtcaaagattgcctgaaagtgttatttgagcttcgagctttttgatcagaatgacngatagggattccaaagctgcagtagtctgtccagtagctatatacactagtaatgctttt

SEQ ID NO: 18765 - DNA, 121 bp, Artificial Sequence
  Synthesized
  misc_feature (61): n=t or c
catcaactgaaaatgagtttccagcgtccaaaatagagttcaaatatccaagtgggctccngaacaagaacagaaagttttctctttcttccaggatgaatataacttaaacattcttttc

SEQ ID NO: 18766 - DNA, 121 bp, Artificial Sequence
  Synthesized
  misc_feature (61): n=t or c
caaacaaacaaaacttggttgtctggataaccacttaagaaactgcatcttaaccacaaanctgaaactgtctaacttccattgacaactaccgatccttgtgacgtttttgtctaagaag

SEQ ID NO: 18767 - DNA, 121 bp, Artificial Sequence
  Synthesized
  misc_feature (61): n=a or g
cattttgcagactagttctgcagttcagtgcactgagccctgtgcagctgcacatcatacntactgtgaagacaacttatgcacagcaataaatctgatgcatttttaatggaattattct

SEQ ID NO: 18768 - DNA, 121 bp, Artificial Sequence
  Synthesized
  misc_feature (61): n=a or c
tttcatttgatgtttactttaaaactaaaacatctgtaataaactaatggagggccatctntctagtacatgggaaagaaatgaatacttcagtgttcagtaatatatcctgaatagctat

SEQ ID NO: 18769 - DNA, 121 bp, Artificial Sequence
  Synthesized
  misc_feature (61): n=a or g
tttattgcatatttatgctgccgtgatataaaacattttgaaagactctttgcatacaacntacttactggtgaacacccagtacttcccagtccttcccaacatccttaagagctatgtt

SEQ ID NO: 18770 - DNA, 121 bp, Artificial Sequence
  Synthesized
  misc_feature (61): n=c or g
cattaaatggagatctgtgagctgcaggtagttgcccagtaaggctgcagtgaccataagnttttcctcttcattttcctggtatgtggctcctgagcacaacatccttgcagaaccagtt

SEQ ID NO: 18771 - DNA, 121 bp, Artificial Sequence
  Synthesized
  misc_feature (61): n=a or g
ataagtgcttgcaccagataaatgggaagtttgctgtagaaccatgcaattgccctatccngaatttgtccaggcacactgccagttacttgtctcatggtttctgtgttgtccccagctg

SEQ ID NO: 18772 - DNA, 121 bp, Artificial Sequence
  Synthesized
  misc_feature (61): n=t or c
tatacttctttgccacatttaagaagttgtgacaccaaaataagtcatattgaaagtgtantcagatggaatgttaatgtagcaatacctagataagtaattacagcctattacaggttgt

SEQ ID NO: 18773 - DNA, 121 bp, Artificial Sequence
  Synthesized
  misc_feature (61): n=a or c
ctctgatgtgccttatttgcttgatgttctttctcctttcagctgatgacccctaggcggnttccctttcagatgcagcttctttgttttttatagtctcttcctttattaattagaaggt

SEQ ID NO: 18774 - DNA, 121 bp, Artificial Sequence
  Synthesized
  misc_feature (61): n=a or c
taacaaatataggtagtaaagggaacagatgaaagaattgtatttaaaatgaatcaaaatngatcttctcgcaccccttcaagtctgtgaagctttctgatccagctttagaatacgtcat

SEQ ID NO: 18775 - DNA, 121 bp, Artificial Sequence
  Synthesized
  misc_feature (61): n=a or g
tatgctgagagtttaggagaatgttgtctcagactacagcagctgggataatagcaatacnatgttcatattcgctcaaagcaaactccttgctattgcacgactacttcttgttgatgaa

SEQ ID NO: 18776 - DNA, 121 bp, Artificial Sequence
  Synthesized
  misc_feature (61): n=t or c
aatcttaaagacttctccagagcatttcgtactaaaagactggtgacatgggacaaatgancagggagctaatttgcatctttcagttccagaatctgggccttcttcttcctgatctgcc

SEQ ID NO: 18777 - DNA, 121 bp, Artificial Sequence
  Synthesized
  misc_feature (61): n=t or g
tctctgcaaaagaccattttaatgcaacctggtagcacaaaaccacctccagtgcaaccancccccaggagagcacgccagcagccagcccaacaccccttaccagcatcaacaaaacgaa

SEQ ID NO: 18778 - DNA, 121 bp, Artificial Sequence
  Synthesized
  misc_feature (61): n=t or c
gaaagttatattatcaagtccagatttttttttttttaaatgacttaacactaaaaaatanggctttcagtgagtgtattttcaaaacacagctcagtatctttattttaagaaatcaatt

SEQ ID NO: 18779 - DNA, 121 bp, Artificial Sequence
  Synthesized
  misc_feature (61): n=a or g
ttaaattgatggtgctgctctttctgtggtttcccaaagcttagttttgaatggggaaatntaacaaaaccaagtgctcccagaaccaagcctttgtcttgtactttctttccactgaatg

SEQ ID NO: 18780 - DNA, 121 bp, Artificial Sequence
  Synthesized
  misc_feature (61): n=a or c
acacagagagcaaattcattccagtattgaagttttccctcgtttggatgccacacttgcngtgctttctgctttacagtaagccttctgcctctctcccttctgtcctctttcctctatg

SEQ ID NO: 18781 - DNA, 121 bp, Artificial Sequence
  Synthesized
  misc_feature (61): n=a or g
ctacctgttgttgctatcagaaccaaggcttcagtattacaagtgcagacttcggattcangactcggattattctgggaggttttcagctatgctgtccttccaaaggtgtggaaaaaca

SEQ ID NO: 18782 - DNA, 121 bp, Artificial Sequence
  Synthesized
  misc_feature (61): n=a or c
ggaatctaaaaatagtcaagcactctgaattgcaactacactgtactcattaccctgagcntgtattcttgtcatcgttctgctggagtgtttcctggtgagctgcataaaacaagttagg

SEQ ID NO: 18783 - DNA, 121 bp, Artificial Sequence
  Synthesized
  misc_feature (61): n=a or c
tgacaatacatcagtatatggatagataaataatgtatgggttggatgcactggattcatngttaacttgtgctctcagagcaggagaaattgctttcagtctcaaaataagaactcaaca

SEQ ID NO: 18784 - DNA, 121 bp, Artificial Sequence
  Synthesized
  misc_feature (61): n=a or g
atagacttgctgtatttttcatactgaaacagacaaaactattgaaatccttagcagcatnaggtgtcactgaacatagggctatttccttggaattcatcaggccacaagaaatctcccc

SEQ ID NO: 18785 - DNA, 121 bp, Artificial Sequence
  Synthesized
  misc_feature (61): n=t or g
agctgattaaacaactgcatgaagagattggcaaatttattttattcaaaaataaatactntgtttaggaccaaaactgactttagctgaaactgaagcacactgcgtggtgtgggtgttg

SEQ ID NO: 18786 - DNA, 121 bp, Artificial Sequence
  Synthesized
  misc_feature (61): n=t or c
agcagtggactctgaacctgttttgtcacttggggtgaagaagcaaccaacacctgagaangtattggtgaaaacagagcctgtctcacggggcaagaacctccgcaacaagaggatccac

SEQ ID NO: 18787 - DNA, 121 bp, Artificial Sequence
  Synthesized
  misc_feature (61): n=c or g
tcagacaaccagcatgaaggctgaggacaatcctacaaaaagaaataggaactactcactntaatatcagcattatctcagccacactcaaactacctgccaccaatgtcacagcttttcc

SEQ ID NO: 18788 - DNA, 121 bp, Artificial Sequence
  Synthesized
  misc_feature (61): n=t or c
tgaagaaatgttctaaatcacctggtgttttgttgcattatgagaatttgtctcaacttangttgctctagacacgcacaggaggatgctgtgcctgctgattgcacagaaaggaaatccc

SEQ ID NO: 18789 - DNA, 121 bp, Artificial Sequence
  Synthesized
  misc_feature (61): n=t or c
atagattcatgctgctaaagggaaaaataagcgttgccatgcctagagtacatgcagacanctataaataaaatgtctgttactagataagcagacataatggctcaggtggtcccttcca

SEQ ID NO: 18790 - DNA, 121 bp, Artificial Sequence
  Synthesized
  misc_feature (61): n=a or t
gacagagtgttgtgttatctgtccataaagtcacagaaggaaagattttatcttgctttanaagtcaggcagatcactcatcaacaattcaattcctacaagaaaaatagcccaaggtttg

SEQ ID NO: 18791 - DNA, 121 bp, Artificial Sequence
  Synthesized
  misc_feature (61): n=t or c
aaaaaaaaaaataaatgtacacaagcaaagaagccttgtggacatttttgtggctaaaaanattgctctaattataaattgcagtggacttctgagaattattggtaaaaatcagtttata

SEQ ID NO: 18792 - DNA, 121 bp, Artificial Sequence
  Synthesized
  misc_feature (61): n=a or g
agcagagcagctgggctcctggaagcgctttatttgcacgggtgcagtcagaataaaaaangagaaaaagaaccacctcccgagcaggcagaagtttgcagaggcagcacgcacagaccca

SEQ ID NO: 18793 - DNA, 121 bp, Artificial Sequence
  Synthesized
  misc_feature (61): n=t or c
atgaccccttctacctcagtgttgaccatggtactgtcttccgtgctgctgtccttgaaantcctcctgtcaggaaagtatcacttggttaccactcccggagatgtgcaagcaagaggtg

SEQ ID NO: 18794 - DNA, 121 bp, Artificial Sequence
  Synthesized
  misc_feature (61): n=t or c
taccagcatggagtggttaacaagctttggaagcaggatggttttaaatggagtgtcccangggtattccctcttttaagagacaaaccagaggaatcagccacctgggagcggaagcaaa

SEQ ID NO: 18795 - DNA, 121 bp, Artificial Sequence
  Synthesized
  misc_feature (61): n=t or c
actgtttatgatagggctgaagataaagctgcagtagaagaacagcaagtataagaagtcnctaggagaaacaaaaattattaggcaatatagaagcatcactatttaaagttggtcgttt

SEQ ID NO: 18796 - DNA, 121 bp, Artificial Sequence
  Synthesized
  misc_feature (61): n=t or c
ttatgattttactgtgacgcttttgctcttggattttaaaatctatacaaaggttctcagnccttaaacagaagaagcaatcactgaacaagacttaggatggtacatatacacttccata

SEQ ID NO: 18797 - DNA, 121 bp, Artificial Sequence
  Synthesized
  misc_feature (61): n=t or c
agcaattacttgtaacagtgtggtggtatatgctaatccatgtgagaaggggaggagttgnctatttgccttctaggttaattgtgtaagttgatttagacttcaaaatgcagaaaagctt

SEQ ID NO: 18798 - DNA, 121 bp, Artificial Sequence
  Synthesized
  misc_feature (61): n=a or g
atccattactgttttctatggtgataaatattgatttttctgagaaagaaaatgtatgctngcatgatcaacattgcattaacactgacttttattgctaatgtaatgagcagtgttgtat

SEQ ID NO: 18799 - DNA, 121 bp, Artificial Sequence
  Synthesized
  misc_feature (61): n=t or c
tctatagccctagctttttgcaacataaaatggacagaaagctggagtcagttcccatctncacatttcaaaacaaatagggtcaaaaatgaatatatttttcagagacttacagtggagg

SEQ ID NO: 18800 - DNA, 121 bp, Artificial Sequence
  Synthesized
  misc_feature (61): n=a or g
ttgtgtaaacggggaagccctgctcttataaccgttttaattttgcctttcagttgttacncagaagtgttgatgtctgtttgtctgaaagcccatgtagagggacttgcatatacccata

SEQ ID NO: 18801 - DNA, 121 bp, Artificial Sequence
  Synthesized
  misc_feature (61): n=t or c
tgctacaaaatgattgtagtttggcctttcctaggagactaatctctgtatccagtttaanaacctacaacatcttaggtaggtgtgagtgcagaatcatatggattactgtccagttcct

SEQ ID NO: 18802 - DNA, 121 bp, Artificial Sequence
  Synthesized
  misc_feature (61): n=t or c
tgaaaaggatgaaatggggaaaagaggatttctaagcttttgatagagtacagttaaaatngagaggacattaattggatgattccatgaagagggatcacatttagggcataggctaatt

SEQ ID NO: 18803 - DNA, 121 bp, Artificial Sequence
  Synthesized
  misc_feature (61): n=a or g
caaacagctctttccatttttgcttcgaaatgacacacatggcatgagcgctctaaggganccaactcccagtttctttaaaagtttcactatattggaggaaataggcctgctagtgtgg

SEQ ID NO: 18804 - DNA, 121 bp, Artificial Sequence
  Synthesized
  misc_feature (61): n=t or c
atttttaatttctcactcttttcctgtgctccgggaaaacaccaaggcttgcctccaatanttaatcacttctaagtagtatcaagaagggtggttgcaccaaaacaggtacaggtcttgc

SEQ ID NO: 18805 - DNA, 121 bp, Artificial Sequence
  Synthesized
  misc_feature (61): n=t or c
tagaatgaaagatataggacaatcatcttctaccaattcagataatgtactataggcacantggtaaggtatgtactcttgcttcatgcagtgcttaatggctttttgttatttgttttct

SEQ ID NO: 18806 - DNA, 121 bp, Artificial Sequence
  Synthesized
  misc_feature (61): n=a or c
cagcttctttgtggctactagatttgcagtagtgagataagggtttccttaaagtcgtatntttatcctttagcacttactgtggtaagataagtgacagctggtttaattcaatgtcaaa

SEQ ID NO: 18807 - DNA, 121 bp, Artificial Sequence
  Synthesized
  misc_feature (61): n=t or c
gctgacactcaggagcaatgaggcatggaacaagacctctccagctcccccaagacaatancttccagaaccagaactcttggtccacaggtggtcttccggactctttcaggtggtgttc

SEQ ID NO: 18808 - DNA, 121 bp, Artificial Sequence
  Synthesized
  misc_feature (61): n=t or c
gtgggaagagaaaaatacaggctcttctgcccggtcctaccagtaattgcttttcctgtgnttttttgagtgcagtcagaagatggtgctgtactgaacatggattgtgtcaaggaacagc

SEQ ID NO: 18809 - DNA, 121 bp, Artificial Sequence
  Synthesized
  misc_feature (61): n=a or t
agaataaagcatcccagcttgtcctagacttcaggctaatttgtatttgcaccctagaatnggactttgtatgataaaaagttgttgctggtgggctcatcagtaccaaagcaagaacaat

SEQ ID NO: 18810 - DNA, 121 bp, Artificial Sequence
  Synthesized
  misc_feature (61): n=a or g
ttcaaaagaacagcaagacttcattgcagtgaatatcccaactactaacactttccatcantgtggacttagcttctgttcagatctgaaactcaattctgatagaagtagcaaacaataa

SEQ ID NO: 18811 - DNA, 121 bp, Artificial Sequence
  Synthesized
  misc_feature (61): n=a or t
ttatcaaagcaaaggtgttactagctgagcagtaataacaagtgggaagagaacaagaacngtttcttccttgtcttacatttaaatgtgcggtggttttgtttgtttgtttgtggggttg

SEQ ID NO: 18812 - DNA, 121 bp, Artificial Sequence
  Synthesized
  misc_feature (61): n=a or g
agatgttgagcacttcaattaatggaggctcgttggtgacagtccctgaccagagaagtgnactgtcacaaaccccgggctcatcttggtgccatggcaatgcagaggcaccttctctctt

SEQ ID NO: 18813 - DNA, 121 bp, Artificial Sequence
  Synthesized
  misc_feature (61): n=t or c
ttccctgctctgcagccatgcagcttgaaaggatgacaggaagacgtggggaggatacagntacttctgctagcagcaccagcttaaagtgatcccggcttcaccacctggcgttaggtgc

SEQ ID NO: 18814 - DNA, 121 bp, Artificial Sequence
  Synthesized
  misc_feature (61): n=a or g
gagagtgtttcttagagactcacacagtgtcctggcttcaggagcagcctgctcctgaacnatgggctccgtgttatggagctgtgttggagcagtgcttgaaaagctgcaccccctggga

SEQ ID NO: 18815 - DNA, 121 bp, Artificial Sequence
  Synthesized
  misc_feature (61): n=a or g
caggtgtaagacaaagtggttacgtcctccaatacaggctccccagcatgtgcaaactgcntatcacaatccatttgggtaccactgtcaaaaatgatacagtttgaaaagaaaaaactct

SEQ ID NO: 18816 - DNA, 121 bp, Artificial Sequence
  Synthesized
  misc_feature (61): n=t or c
ggtaaaaaaagtcaaagagagggaaaacctggagataattttttggttacatttcagatgngaaggtatgtttttccagttttgaaataccttgctattacatgcatggtggctatcacgt

SEQ ID NO: 18817 - DNA, 121 bp, Artificial Sequence
  Synthesized
  misc_feature (61): n=a or t
tgctacctgtgcactctataggtatctgatatgacttaaaccatttccttgtaaagccatntgctacttaggcgtagcaagaatgtgcaattgaattaaattcttgattcagcaaaatgcc

SEQ ID NO: 18818 - DNA, 121 bp, Artificial Sequence
  Synthesized
  misc_feature (61): n=t or c
gtacttgctttgtcagcatggtagagtaaaattgtttgagcagcccccttctggatgccancacggacatgacctgaccacaccaaggttagcacacacacctcaaccgatccacaataaa

SEQ ID NO: 18819 - DNA, 121 bp, Artificial Sequence
  Synthesized
  misc_feature (61): n=a or g
aaatgcattaacctaactgggtttagttaaatataacccactgcagttccaacagactggntcatcctgttgatttttaacagtgagcactttgcatggtttcttccctcagaacagcggt

SEQ ID NO: 18820 - DNA, 121 bp, Artificial Sequence
  Synthesized
  misc_feature (61): n=t or c
tacattccattgctttgcttttcactgatgaatagtttgacatgagtcttgtaagttattnaggcatcctttatggaaatctatgtgcaagaaaaatacattctaccagtaagttgaattt

SEQ ID NO: 18821 - DNA, 121 bp, Artificial Sequence
  Synthesized
  misc_feature (61): n=t or c
ctgcaaactgaatctgcttttgttgaagcagtgtcaatcacaagggtttttctgttcatanagttagtgatatgacagattgaaaaagaagacaggctttcatttggatctgcaatatgtg

SEQ ID NO: 18822 - DNA, 121 bp, Artificial Sequence
  Synthesized
  misc_feature (61): n=t or c
ttttgttctgactctttttcccctattctcctgggaggggtgggattgagagaaaagctgngtgctgcttgccaaggtaaaccacaaaataaagcctacactgtctgctctgaattttaac

SEQ ID NO: 18823 - DNA, 121 bp, Artificial Sequence
  Synthesized
  misc_feature (61): n=t or c
gtgctttaaaatctaaaaattagtttttagaaagttgctttgccacaggacggtcttcttnccggtgtttggttattctgtggttgcaagggaatggaggctcagactcctgaactgggaa

SEQ ID NO: 18824 - DNA, 121 bp, Artificial Sequence
  Synthesized
  misc_feature (61): n=t or c
tcaaagctgataggctgcataaatttttgaggagccattttctgcaccagttaactgcagngacatactgtcagtaaaacagtggtattcttcacacaatacatgctaatcaagaaacaac

SEQ ID NO: 18825 - DNA, 121 bp, Artificial Sequence
  Synthesized
  misc_feature (61): n=t or c
tctggttactattgaaaatgatcagcaaattaacacctttggaattcactcccaggaatanttcattaattcatacggcagggaacttcagaacaagcactttctttagttggttacatca

SEQ ID NO: 18826 - DNA, 121 bp, Artificial Sequence
  Synthesized
  misc_feature (61): n=c or g
ccttcaaaaaaacaagtggatagagctgcagggaacagaggggatgcatgacagatgcaantcctggtctttgagctctggacagagaaccagacagactgactcagatcaccaggtgacc

SEQ ID NO: 18827 - DNA, 121 bp, Artificial Sequence
  Synthesized
  misc_feature (61): n=a or g
cctgaggcgacagaggtggccaaaatctgcacagggggtttgcacatggagaaaggagctnggatgaactgaagctgggctgcgtgtgttctcctggcagcatttggctttctgcttgcag

SEQ ID NO: 18828 - DNA, 121 bp, Artificial Sequence
  Synthesized
  misc_feature (61): n=a or g
tttcaaattctgttcagagttcaaactgaagcacagccccatcataacatagttcattaangaatacagtgaaaatatcggtttagaagttgaactacaagattagattattagaccatag

SEQ ID NO: 18829 - DNA, 121 bp, Artificial Sequence
  Synthesized
  misc_feature (61): n=t or c
tcagtgatcttctaacctggcttatggagtctttgcaatatgtgggacctgggacctgacnccattatcagcaagggttttggtccctatgtatggcaggatgtgagcaatgagaaacctt

SEQ ID NO: 18830 - DNA, 121 bp, Artificial Sequence
  Synthesized
  misc_feature (61): n=a or g
aaaagtttttccagtaataaaacaccagaagtcacatggcagtcatattaatgaatcagcncaatattatgtattgtgctacatacctgagttttggtatttcatattacaggattatgaa

SEQ ID NO: 18831 - DNA, 121 bp, Artificial Sequence
  Synthesized
  misc_feature (61): n=a or g
gacaagattaccacatttatttgagggttaactgaatgaattattacctgtgtacgcctantttcatgccaggctacagacacacactgtagttactgtctttgaagttttatgcagtaag

SEQ ID NO: 18832 - DNA, 121 bp, Artificial Sequence
  Synthesized
  misc_feature (61): n=a or g
tatatatatatttgacactgtgtatttcgtcaaatggaagggtatttaattttctttggcnatatagcttatacagctctctgcatttttttggcctttactttactatgttagtttaccc

SEQ ID NO: 18833 - DNA, 121 bp, Artificial Sequence
  Synthesized
  misc_feature (61): n=t or c
gctctttacctgtacctgggaaatgtggaaccaaaacaccagtctaatctgagggcagttngcctttccagtggctgaagagaatctggctccagacttgagaaaaaatttccatgtagca

SEQ ID NO: 18834 - DNA, 121 bp, Artificial Sequence
  Synthesized
  misc_feature (61): n=a or g
tgtgaacaaccttttcatttaaaaagactaaaaacaagaaacaaatctattcaggactctnactggagatttccacttgatactgagaaaaatagaaaggaggagacaattttacagcttt

SEQ ID NO: 18835 - DNA, 121 bp, Artificial Sequence
  Synthesized
  misc_feature (61): n=t or c
tatttatgtttgggaggagcctacttgagggcagtagtaatactaatgctcaggcagttgnaattgtcattgtcctaagaaaagagcactataaaatacattcaaatattagcacctccac

SEQ ID NO: 18836 - DNA, 121 bp, Artificial Sequence
  Synthesized
  misc_feature (61): n=t or c
tggaggcagtattcttctcaagcacaagttgtgctgagaaagaataaagtggaaaaacaangtatacttcagaaacctgacagctgtagcagcttcttttctgttttaagagacgcaaaaa

SEQ ID NO: 18837 - DNA, 121 bp, Artificial Sequence
  Synthesized
  misc_feature (61): n=t or c
aggactggtaaaatttgaacaaggtaattgcaatgactgttaataaccaccttgtatgganctttctaatgttttaaagaactaggaatatcttctaagaacaaagggatggactgacaat

SEQ ID NO: 18838 - DNA, 121 bp, Artificial Sequence
  Synthesized
  misc_feature (61): n=t or c
gttaccctagacatgtactgaagttcattcactgaactatctgatatctttctctacattngaagggaacaaaaccttagggcccactctctgtggattgaattctgcaaaaaatatagta

SEQ ID NO: 18839 - DNA, 121 bp, Artificial Sequence
  Synthesized
  misc_feature (61): n=a or g
agccagctgaaaagattgtgtacgcctcacagtaaccacatggcaccaaaggtgaagttanagctgcacaaactcatctgttcctgagaaaaatctgtaacctaaaattagcagtagacag

SEQ ID NO: 18840 - DNA, 121 bp, Artificial Sequence
  Synthesized
  misc_feature (61): n=a or t
actgtggtgccatccatatgttcttgctgatatactcgcctctcaatactagagagaaggnaatgtgaattaatctttaatgtgttcgtgtctcatatggggcttttgactacagcccttt

SEQ ID NO: 18841 - DNA, 121 bp, Artificial Sequence
  Synthesized
  misc_feature (61): n=a or g
ttaataatgctatttcactactgattgctcagttcatgtttttatatgtaccttatatgantgtactactctgatactagattttccagtgtggggataaaacattatcatgtgacactca

SEQ ID NO: 18842 - DNA, 121 bp, Artificial Sequence
  Synthesized
  misc_feature (61): n=a or g
ggaatgtgcattaaatacagaagtgaacctgtaattgaatggacaaagcagtggagaacantacaaaatccagccagggaagggtgcagagaaaacaaagcagctcccaggaagggttaac

SEQ ID NO: 18843 - DNA, 121 bp, Artificial Sequence
  Synthesized
  misc_feature (61): n=a or g
agggtcagcacatgaaaggatctatcttttcacttctctcatgagggaaatgttacctgtnttgtcacaaattctcagtgagattaaaacaacttagaagtattttgattgcatactacag

SEQ ID NO: 18844 - DNA, 121 bp, Artificial Sequence
  Synthesized
  misc_feature (61): n=t or c
atatattaaaaaaaaaaaaaaaaagcagtaaaattacaaaatcagaatagacatactccanggttgagtagaaggtgataaaatgatttttggccacctgcaggtagccaatagtggtaat

SEQ ID NO: 18845 - DNA, 121 bp, Artificial Sequence
  Synthesized
  misc_feature (61): n=a or g
gttaaaatgtcacatataaaaatgtaactgatggataaaaaggcttctgttcacttaggcntcacagagaccacactgctggcagtgacagtcagatctcctaaaagagatggctgtcaga

SEQ ID NO: 18846 - DNA, 121 bp, Artificial Sequence
  Synthesized
  misc_feature (61): n=a or g
tgcttcagaggcttttgaattttttcttggcccataaaatgtagatccataagggaccctnggaggatatccagcctattccacagcctagagcaagatcagctttctctgaatgtgtcct

SEQ ID NO: 18847 - DNA, 121 bp, Artificial Sequence
  Synthesized
  misc_feature (61): n=t or c
tttatttagatgtaccaaccagggatagcggcatcttgatttaaagccgagggctgttcantgacggtagtggtgaagggtgtcgaagcatgtgtacagaacaggcagtgctaatgggcag

SEQ ID NO: 18848 - DNA, 121 bp, Artificial Sequence
  Synthesized
  misc_feature (61): n=a or c
caagccctccctgaggcaactgggagagacaggagaaaaacaacgacagtcagagcagctncatttctcactgagtgccacagagtagggtggagtgcttctgtgtttgccctctgggaca

SEQ ID NO: 18849 - DNA, 121 bp, Artificial Sequence
  Synthesized
  misc_feature (61): n=a or g
cactcctttttttgatgcagtccccgtaacagttggtcttccagactgtaagcaaactctnttgcctcatgttcagcttttcgtccatcaggactcccacctccttttccccaaggctgct

SEQ ID NO: 18850 - DNA, 121 bp, Artificial Sequence
  Synthesized
  misc_feature (61): n=t or c
atatgaattcgtgtgtgccattaaagaagaaagtgatttaacagataaagagtcatttttncacctctctttgtacctctccaactatcaacctatttcttctgctagcaagcagcacaaa

SEQ ID NO: 18851 - DNA, 121 bp, Artificial Sequence
  Synthesized
  misc_feature (61): n=a or g
catgttagaggaaaggagcaaaagtagaatagaaaaaagagtgagttccaggactgaggcncacaagctgctggagggaaaaaataacaataaaaaaaatgatactccattctaacccaca

SEQ ID NO: 18852 - DNA, 121 bp, Artificial Sequence
  Synthesized
  misc_feature (61): n=a or g
caggtaatatggaaaagtatgtgaagatacttccagggaggataaaagattttgcattaantaagagtaattttgatcctttgtctcacacaacttcaagagtttatataatttcccccct

SEQ ID NO: 18853 - DNA, 121 bp, Artificial Sequence
  Synthesized
  misc_feature (61): n=t or c
tacctacagtgccagcattaacccagtcctattcagactgagacagtcttactgacagcangttgaagttctctatcataaggaactactttcatgatacttctcttagtacttactaaca

SEQ ID NO: 18854 - DNA, 121 bp, Artificial Sequence
  Synthesized
  misc_feature (61): n=a or g
ggaataagcacagctagttagttacaggggaattcatgtgttgctttaaaagttctcaganctttgaatttcatgtggagattgagaatgtggaagaagattaaaaggaaatagtttacta

SEQ ID NO: 18855 - DNA, 121 bp, Artificial Sequence
  Synthesized
  misc_feature (61): n=t or c
acctttgcattgcacttctgttgtattcttgcttaatgttcgaatgcagtgaatagcatcnttatccaatcttagcaatccgagacaggtccatggagtcttatctttgtagctcatagat

SEQ ID NO: 18856 - DNA, 121 bp, Artificial Sequence
  Synthesized
  misc_feature (61): n=a or t
gaatatttttattacatttatgataaatttgtaaatctccctatgtgtgtctgctgtcaanatatgctcttgaatgtgcatcagtacatcaatgatgcactgtctgtatatgcagggtctg

SEQ ID NO: 18857 - DNA, 121 bp, Artificial Sequence
  Synthesized
  misc_feature (61): n=a or g
ctaaaatacttgggtaatttgggggcatgatgatctcctaactgcctactgcaaattaccncaggcaatttttctctttggccgtatgttaaacaaagcactgaaagaaaacttctaaagt

SEQ ID NO: 18858 - DNA, 121 bp, Artificial Sequence
  Synthesized
  misc_feature (61): n=t or c
ggaagccagaaatgcatacccaggctgagtacaacagggtccttacattaaacatctttanactgtctactgtgggcactctaaatcaagtgctgtcttatttaaacaccaagaaaccatg

SEQ ID NO: 18859 - DNA, 121 bp, Artificial Sequence
  Synthesized
  misc_feature (61): n=t or c
atctcttttaaacatctctcctgtttctaagaactgctccaagcaggaagctactgtgganctgaataattgaagcaatattatctatgataatatgtacctctgtcattttctgttccaa

SEQ ID NO: 18860 - DNA, 121 bp, Artificial Sequence
  Synthesized
  misc_feature (61): n=a or g
tgaaatcagaagcaagaatccataatgggatagaagagaccacctgcagaggagaacagcngttctgccaacttcaggaatgatacagaatgatagaatgtttctcatgaaagcaattatt

SEQ ID NO: 18861 - DNA, 121 bp, Artificial Sequence
  Synthesized
  misc_feature (61): n=t or c
gcaggatgctttggcattaagaccagaaagaccattttggtcctgtccaacctccagaganctctgcccactcacttcctatccatacccagtacacaagggcagcacaaggtgctctgcc

SEQ ID NO: 18862 - DNA, 121 bp, Artificial Sequence
  Synthesized
  misc_feature (61): n=t or c
cggtgacgggggacgcttcaccaaattggcaggagaaggggatcttctacgggcagacacngacggagaggaagggcgacgcaacccagaacctggggatggtttctcagcctctgatttc

SEQ ID NO: 18863 - DNA, 121 bp, Artificial Sequence
  Synthesized
  misc_feature (61): n=t or c
tacaggatcgttgcatggttgcattagagaagtttatccttaagttggacaatattgtcanggaagctttcataggctttgaagaacactctcataaaacagcatttgctgagcagagtta

SEQ ID NO: 18864 - DNA, 121 bp, Artificial Sequence
  Synthesized
  misc_feature (61): n=a or g
agcagagaggatgtcatgaccttcccaggcagcagcacatgctcaggaaggtctcagagangaaaaataagtttcccagcagagccaaaggcctcatgctctaccagagtgaggcctcaag

SEQ ID NO: 18865 - DNA, 121 bp, Artificial Sequence
  Synthesized
  misc_feature (61): n=a or g
tttgttgctgtctgcttaccaagtcactcctagtcatttcccccctctcaaaacgcaaacntgcacacaagttttttgtgttgatttttcctctctttactgttgcctactcacaggaatc

SEQ ID NO: 18866 - DNA, 121 bp, Artificial Sequence
  Synthesized
  misc_feature (61): n=a or g
ttgaaaggtatagaggaggagtagaagggaaaagaggcttcagagaaacttaattggtctncattcctcccaaagagtttttagtgaaatactctctgaccccttctatccaaggttgcag

SEQ ID NO: 18867 - DNA, 121 bp, Artificial Sequence
  Synthesized
  misc_feature (61): n=t or c
cgcccaccttgacagagcaacacagacccataacccaacagtgccagcaaagtactcagcncactccttgacccaaacccacagtcctgctttgccttctggaaaggctgagacgcagctg

SEQ ID NO: 18868 - DNA, 121 bp, Artificial Sequence
  Synthesized
  misc_feature (61): n=a or g
ttaatctcatgtgatgctgcacgtgaagtaaacaaatttcaagttcatgtgttgataagtncactgtcagttctgagctaatgcttactgtttttcagaccatagaatcactcaggttgga

SEQ ID NO: 18869 - DNA, 121 bp, Artificial Sequence
  Synthesized
  misc_feature (61): n=a or c
tcacttcagactgtgcttccagtaaaggagttttgagcgctggtgctcttttcataagctnctggtagacagtctcgtgaagcagcgattccactagagcagaaatcccattgtagctaat

SEQ ID NO: 18870 - DNA, 121 bp, Artificial Sequence
  Synthesized
  misc_feature (61): n=a or c
acagtgaaggtcttgatagtaaattgagtttgattaaaagctgttgcatagaaaaaaattnaaaaaaccatgcatgtaggtcatggagaactgccacaaaacaatgaggtatggactctct

SEQ ID NO: 18871 - DNA, 121 bp, Artificial Sequence
  Synthesized
  misc_feature (61): n=t or g
aaatgcatttatggaaggtttaaggccataatttatgataatggcatgtgagagcacaaantaattcaaagtgtgaatgaaacaacttttttcaagtgcaaacactgaacccttctatttt

SEQ ID NO: 18872 - DNA, 121 bp, Artificial Sequence
  Synthesized
  misc_feature (61): n=t or c
cagcaatttacaccttgttgtcttcttaccttccattcttaccttgacattctttcattcntcttaacaaaagctttgtgagtaggtagcaggcctctggcaaaattgtatatttgaaaac

SEQ ID NO: 18873 - DNA, 121 bp, Artificial Sequence
  Synthesized
  misc_feature (61): n=a or g
tcctgctccccatgggaagggcttggcttggccaggatgcgcttctccaacagctgagacntggagaagttacagagcgatgcctgttagctctgcagtggcgtgttgacacaactccagc

SEQ ID NO: 18874 - DNA, 121 bp, Artificial Sequence
  Synthesized
  misc_feature (61): n=a or g
tcttcctgcaggtgggtctgttctacaccacatgggtaagggcaaaggaaatgtcatgttngtagcaaagggctgtgtttgcccatggctgtttatgtgcctttgcaatgtcttttctcaa

SEQ ID NO: 18875 - DNA, 121 bp, Artificial Sequence
  Synthesized
  misc_feature (61): n=t or c
taaaccatacttctccctaggcaaaggctaagacaatccttctgagctctctctagtccantgcattaatctcatctataagcatctttcttaaggtgagtctgtctactaaaccactctt

SEQ ID NO: 18876 - DNA, 121 bp, Artificial Sequence
  Synthesized
  misc_feature (61): n=a or g
gtccaaacacatggaagctagaaggcgccaaatccagactatatatagtgggtgtggtagnacagccaagtaaaaattgatgatgtgctccacattcctcagactggtatggggcctggtg

SEQ ID NO: 18877 - DNA, 121 bp, Artificial Sequence
  Synthesized
  misc_feature (61): n=t or c
gagggggcgactccaggatcacacccctgaaattgtacagcctgatcttccagcaccttcncgtctcgcactttgccttgatctaagagtcaaacctcttttgtctgcgtgtcactgagct

SEQ ID NO: 18878 - DNA, 121 bp, Artificial Sequence
  Synthesized
  misc_feature (61): n=a or g
ctagatgcaaactgataccataaaatcagttatttttctatagttgctcttcaaataagtntcatggatgaaggtacccagactctggggaagaattgagattgcccatgtatcactacac

SEQ ID NO: 18879 - DNA, 121 bp, Artificial Sequence
  Synthesized
  misc_feature (61): n=c or g
gtaaatggagtctctcagcactgaccccacgatgcttgtaacagtctataaaacagagcantttcttcctctgtgctcacacatgcatgcatacctactggatgtgtacgcagtgtattga

SEQ ID NO: 18880 - DNA, 121 bp, Artificial Sequence
  Synthesized
  misc_feature (61): n=t or c
ctgatagatggtgctaggtggaaatacttcaccttgtccttatggaaaatatgaactgctncacaatgtgacaagatcttttaagagttcaaaagcattacagttccatatgggtgttagg

SEQ ID NO: 18881 - DNA, 121 bp, Artificial Sequence
  Synthesized
  misc_feature (61): n=a or c
gttattcagacctttccttacacatagcatacacttcttctgtgctgattcgtccacacantaggctccaagtagatactcaatataacatagatctatgaaacactatctgttaaagggt

SEQ ID NO: 18882 - DNA, 121 bp, Artificial Sequence
  Synthesized
  misc_feature (61): n=c or g
atgcactacagaagagcaaacaaagttattcaataaggcaaagatttctctcaaaagtaancagtacctcaaacaaactttcaggggctcaatgcaaaagctaagtgaagggcagcagtga

SEQ ID NO: 18883 - DNA, 121 bp, Artificial Sequence
  Synthesized
  misc_feature (61): n=c or g
aagatcatgcattacatactgtcagcacttaatgcaaagatcaaaattagcaatacacaanctgcaacaacatgtttaacaacagcaaaaaggcagctcagctgggaatcactctgtgcaa

SEQ ID NO: 18884 - DNA, 121 bp, Artificial Sequence
  Synthesized
  misc_feature (61): n=a or g
agtaccactgcattattggtacctcagtttctgattatttctccctggcaattcagaagcntaactgattaagtagcagtatggttttatgattacctcactgtttgggtaacttgctgca

SEQ ID NO: 18885 - DNA, 121 bp, Artificial Sequence
  Synthesized
  misc_feature (61): n=t or c
gatatggggttctcttctttatttttgactatttaattgctggtaataaccaaacttttcngtttgctgagactggagtcgtttgttgtgtgaggaacagtgagaaatcacagaagaaaag

SEQ ID NO: 18886 - DNA, 121 bp, Artificial Sequence
  Synthesized
  misc_feature (61): n=a or c
cactgtaacaagaaaagatacagaaatgaaaaacatctcttccaatgtagcatttgcttanaattgttgccaattcccatcttttcagtatgttttcatacttcaggagagtggctatttc

SEQ ID NO: 18887 - DNA, 121 bp, Artificial Sequence
  Synthesized
  misc_feature (61): n=a or g
tgaaaagaaacatgcaatgtggccaacaaagaggaacacgggttctaggctgagtgcaagnatgatacggtcagagagaaaatgccaggcactgacagcagaaggaaatgagagaaaaatg

SEQ ID NO: 18888 - DNA, 121 bp, Artificial Sequence
  Synthesized
  misc_feature (61): n=t or g
ttgtggtttcttcttcccagcagcatagaggtgcaccgctctggtggctcacactgcacanagcagaaagccattaagtgctgtttgtttgctgcaggcccgcagagggacgctcaggcag

SEQ ID NO: 18889 - DNA, 121 bp, Artificial Sequence
  Synthesized
  misc_feature (61): n=t or c
caaggcttgaaaatcaagagtacgtgggaggactgggagtgagactttccttactttagantgaaataatgttttcaagtccttgtgacccccaagactgtattaagtggccttacagtgt

SEQ ID NO: 18890 - DNA, 121 bp, Artificial Sequence
  Synthesized
  misc_feature (61): n=t or c
ctaccaaaggggaagatttggtgggctggagaggtaagtgcaagtctcatgggtgcttcantgtgcccatgagggcaactgagatctttcctgtggtagtgatctgatctgaaggtcaaag

SEQ ID NO: 18891 - DNA, 121 bp, Artificial Sequence
  Synthesized
  misc_feature (61): n=t or c
ccaaacaaaacaacctgctagcagagattgttgctgacacttcaaaattattgctaccagnaaggactcactttttggaatttcactcaaagaaggaagataaatattttatttattttca

SEQ ID NO: 18892 - DNA, 121 bp, Artificial Sequence
  Synthesized
  misc_feature (61): n=t or g
tccacgtgctcagccatgggacaaaacaataattatcagcacatctaagataaataggtanttggaaacattcatttgtttttaaatgtcagagtgttccttcacctctaacagctatttt

SEQ ID NO: 18893 - DNA, 121 bp, Artificial Sequence
  Synthesized
  misc_feature (61): n=t or c
acaataccacctcattttgtttatctaacatcaatgggaacagtagcagctgatgggaaangaaatcactgtttgctgcttttgtgacagtccagagaattccatgctgaaagctaccaat

SEQ ID NO: 18894 - DNA, 121 bp, Artificial Sequence
  Synthesized
  misc_feature (61): n=a or g
cccccagttcttcatgttcaaatattagtgcaagtgtatgcatgtgaaaactgcacagccntacatactgcttttccctcctgtatacgtgaagctcacacacattcgtatctacatgttt

SEQ ID NO: 18895 - DNA, 121 bp, Artificial Sequence
  Synthesized
  misc_feature (61): n=t or c
tatgtgaacttttagttgaacttcttatatactatctcagaatatttcatgagttggaaangtaatgccacaatgctatgtggccatgcagccaagccatgaagatttcaagagcgtgaag

SEQ ID NO: 18896 - DNA, 121 bp, Artificial Sequence
  Synthesized
  misc_feature (61): n=a or g
ccagcctccgtgtcaggtccccatctgcatgatggacacttcacatttaagccacacttcnttctgagctggatgtatgtaaggctgaggttcatcacatggagcagttactggcatcaca

SEQ ID NO: 18897 - DNA, 121 bp, Artificial Sequence
  Synthesized
  misc_feature (61): n=a or g
tacagaagttttgtctggtaaataactaaatacaagatgtatttaatcttgattactggantctgtgtaccataacctcttttactgtgccaaaacatcacatgccaattttcaatgatgt

SEQ ID NO: 18898 - DNA, 121 bp, Artificial Sequence
  Synthesized
  misc_feature (61): n=a or g
ttaatatgacaacattacataaaataattgtctttatagtactgaatccagggaaacaacnttagcagaagcactcatcaataattataacagtaaatttgcctatacttctattcattat

SEQ ID NO: 18899 - DNA, 121 bp, Artificial Sequence
  Synthesized
  misc_feature (61): n=a or g
agtcagtgcctgtgaaattgctctgctcgtgtgcagcagtcctgaagaacccaattttctnggcttgatgagagcagaactggttgttatgtgcgtttgatgaagtcagagtttccctgtt

SEQ ID NO: 18900 - DNA, 121 bp, Artificial Sequence
  Synthesized
  misc_feature (61): n=a or g
ctggtgtaggactgaagtagggtgaggaacacctgcagcagagcctgccctacttgtggangacactcggccctcattacctggtgaaggtctgctggcagcatttgaccagctctgtgct

SEQ ID NO: 18901 - DNA, 121 bp, Artificial Sequence
  Synthesized
  misc_feature (61): n=a or g
gacatctcaataatgaagttagttcaggtatttctcatcactgtagtttgggtaggtatangattttgtttcctacttggtcattatggcctcattccaacattctaatgtttaaatgagt

SEQ ID NO: 18902 - DNA, 121 bp, Artificial Sequence
  Synthesized
  misc_feature (61): n=a or g
gagtcagcaatgtgccctcaccataaacagggctaacagcactcttggcaaagtatcgccngtagtttaggagagaagatccttcccctctagtcacaatttacgaggccacatctggggt

SEQ ID NO: 18903 - DNA, 121 bp, Artificial Sequence
  Synthesized
  misc_feature (61): n=a or g
catcacagtggccccgtggaggcgatgcctcagcctgcagtgggtgggtgaggccttgcanaagaccctgcccagaggctgttgcactctatgtgctgtgagccacgcaaagcctctgcgt

SEQ ID NO: 18904 - DNA, 121 bp, Artificial Sequence
  Synthesized
  misc_feature (61): n=t or c
ctgggaaaatggccctggtgactgctgtgaataattcagtaaaatctgcatatttaataanctgtaaccaccagtgtctactgcttctgtcaacaggtatagatggaattcccgaatacag

SEQ ID NO: 18905 - DNA, 121 bp, Artificial Sequence
  Synthesized
  misc_feature (61): n=a or t
caagccttgcagaataaaatagaagtcattcagtcatgtagtgaattatgttcaacctgcnctggttccagagaggacccagcaatgctgttgctgactcaaagtgaaatcttggatgatg

SEQ ID NO: 18906 - DNA, 121 bp, Artificial Sequence
  Synthesized
  misc_feature (61): n=t or c
tccaacccctattattctgagagtctgtgattctgtaatgttgaaaaggcatctaagctantaacaggaatatataacagaaggtaatggtgtacataccatttctgtctctaaaatggcc

SEQ ID NO: 18907 - DNA, 121 bp, Artificial Sequence
  Synthesized
  misc_feature (61): n=a or g
caaactgcatgtcataaacacatacacgtatataaatagaggagtaggtcaataatatggnagcaatctactgcctgaagtcagtttgcataacctattcgctaaatactgctgatataaa

SEQ ID NO: 18908 - DNA, 121 bp, Artificial Sequence
  Synthesized
  misc_feature (61): n=a or g
atggggctgcagggctggcaggagggctccgcagcgctcagtgcctctgtgctgaaaagcnatacctgctgagatgaaaccacttggcctccttccccctgtctccaaggcaaacatagac

SEQ ID NO: 18909 - DNA, 121 bp, Artificial Sequence
  Synthesized
  misc_feature (61): n=t or c
aggaggagtgtgttaaaggagatctgttccaggtctttttctatagtttcaataaaatgcntgttagattttctgtttcagacatacctagtatttgcatcatagatgaacacaaaacaag

SEQ ID NO: 18910 - DNA, 121 bp, Artificial Sequence
  Synthesized
  misc_feature (61): n=a or g
actgcaaagccataattaaaagtagacggtacgttcatctttagtagcaacttgctgtgtncagtctgttttaaatcgagcactttttgggtaaggagagagattttggtcttgtgaggat

SEQ ID NO: 18911 - DNA, 121 bp, Artificial Sequence
  Synthesized
  misc_feature (61): n=t or c
catgtattctgataaaagagttggaattgtcagtgatttggagtggaagaagttgattgcnagaatctgacagtgaagaacctctgtcttcactcttgaaatcttttcaaagtgcttaggc

SEQ ID NO: 18912 - DNA, 121 bp, Artificial Sequence
  Synthesized
  misc_feature (61): n=t or c
acaatctatatagccatggaccaaagattccctgtaaaatattatgcacatttatccattnatgaacctgtaatctgacaaggatgctgtaagaatacaattttttattacaataataaga

SEQ ID NO: 18913 - DNA, 121 bp, Artificial Sequence
  Synthesized
  misc_feature (61): n=t or c
ggcagcttaagcttccctagttgctgtggcagcataatagtgcctataattaaggacaaangaaatagtgtatgccttaggtatatcctgtttagctttcacggataaggaggataaatga

SEQ ID NO: 18914 - DNA, 121 bp, Artificial Sequence
  Synthesized
  misc_feature (61): n=t or g
ctctgcactgacactggcaggaaagaagctctgacaaagagctgcttgctaaagatatatnctcagccttcatctatagggtttggctaaattttaagcaaatttcccatgctctccgagg

SEQ ID NO: 18915 - DNA, 121 bp, Artificial Sequence
  Synthesized
  misc_feature (61): n=a or t
cggggccccgaggaggacctctgtgtgaacagttcacagagcggctccaatgcatctgggntaaaagacacgacacaacacttccctactgtaaataaaccagaacgagtttcctgcgagt

SEQ ID NO: 18916 - DNA, 121 bp, Artificial Sequence
  Synthesized
  misc_feature (61): n=a or t
atgaatgccccccagcaaaatgtaagcatctgactttctgcttggctgacatgttattttnacagattaatgaaaacaagcatatacctgcctaaacaatactgtgactgctttaaagaat

SEQ ID NO: 18917 - DNA, 121 bp, Artificial Sequence
  Synthesized
  misc_feature (61): n=a or g
tgagacactgcctaaaaaacttcaaggccatctgtgatttcaccgtagcaaaaagtggaangcaaatattcctcctgaaaggatgaagatagctgtatcagttgcacaattgcataactca

SEQ ID NO: 18918 - DNA, 121 bp, Artificial Sequence
  Synthesized
  misc_feature (61): n=t or c
tcaaagagtagatctaataattgtgcagcatttcatttaacgcacaataggggaaaaatgntagtgctgcacttaagtaatagatatgacattactgcaagtatgctcccattttcatgca

SEQ ID NO: 18919 - DNA, 121 bp, Artificial Sequence
  Synthesized
  misc_feature (61): n=a or g
cccagtagtgtcaggcactgaaggaaagagccacgctctgcacagacacaaatcctgcacntggttggattagctttagaattacacaaaaacagtggaattctttcacattttgtttcac

SEQ ID NO: 18920 - DNA, 121 bp, Artificial Sequence
  Synthesized
  misc_feature (61): n=a or g
gagaaaagaggcacacaagaattatatcctttttgggaatggtatgtagttgttcacaagngaaggataaggctacagataagaagccagagggttgtgcagtcattgttagaggaggttc

SEQ ID NO: 18921 - DNA, 121 bp, Artificial Sequence
  Synthesized
  misc_feature (61): n=a or c
ctgcattacatcattttagagacaacacaacacattcctaagtacaggaatgcagatctgntccctgatctggaaactcctttgatgaatcaaatcaaagcaatccactagtaagactggg

SEQ ID NO: 18922 - DNA, 121 bp, Artificial Sequence
  Synthesized
  misc_feature (61): n=a or g
catcctcattattcataccatatcctcatactgtgtggttctttgggtggtgaaatgtagngtggtgaattgtagggtggatccaagaccctgattgcagctgatccaagttctcgaactg

SEQ ID NO: 18923 - DNA, 121 bp, Artificial Sequence
  Synthesized
  misc_feature (61): n=t or c
gtcgaatctttgactatgggcaaaattgtcatctgtagaaaactgcctttgtttattcctnctttgtttttgtcttaggcttctagcactggatcatctgctgatcagatcacgtcagcca

SEQ ID NO: 18924 - DNA, 121 bp, Artificial Sequence
  Synthesized
  misc_feature (61): n=t or c
cgagcaaaggcacatgataaagattcaacattctacttctacgcttccacttgaatccacntctcttatataggagtggtaaaaaatgtctgtcagaaaatgcaaaaaccataaggtatgg

SEQ ID NO: 18925 - DNA, 121 bp, Artificial Sequence
  Synthesized
  misc_feature (61): n=a or g
attcatgttttcagtattataaaaaatggccaattaagtatatatttcatgcttctagttnctggagagactgagctggcttttaattttcttagttctctgaatggcaaaaagggattga

SEQ ID NO: 18926 - DNA, 121 bp, Artificial Sequence
  Synthesized
  misc_feature (61): n=t or g
cagggagctgctatctgctggcaaggatggatgatatggtgctttttgtgctggtgtgganatatgggaaagcctggagttctttgctctgaccctattgctggtggtgcggagtgctgtg

SEQ ID NO: 18927 - DNA, 121 bp, Artificial Sequence
  Synthesized
  misc_feature (61): n=a or g
tttatttttagaagccattcctaaagaatcaaatctcactctatcttttcaacacaagctnaatgttttcctgattaaggtaattaaaggtagtacattaaaagtaacttagttttagaac

SEQ ID NO: 18928 - DNA, 121 bp, Artificial Sequence
  Synthesized
  misc_feature (61): n=a or c
gagtgggagagagagcagagcagagcgtcctgtggtccaccagagggaccgtgatggcacnatgtgtgcccaggacttggcacagctgctgtggttggggttcataacacagtgaccaaat

SEQ ID NO: 18929 - DNA, 121 bp, Artificial Sequence
  Synthesized
  misc_feature (61): n=t or g
atgagccctgggaggcccagccagctcttacagacttttttccacgatttgctcaccgatntgtaattagaaaacaatagtgtattgatgggaacactgccatgctgaatgctttccccca

SEQ ID NO: 18930 - DNA, 121 bp, Artificial Sequence
  Synthesized
  misc_feature (61): n=a or g
cctgaaagtgggtgtatggagtgtaactaccaggagtgattcggtgcatcgctattactgngcaccccagggcacacctctcacaggacagacacggctccctgcccacaggtgtgctcac

SEQ ID NO: 18931 - DNA, 121 bp, Artificial Sequence
  Synthesized
  misc_feature (61): n=a or g
gatacctacaaaaataaaatgaaaaacaaaccaacaacacagaacatgacagtagaagganctgtgtgtcggaaatgtcatcaggagaattgaagataagcttgcttgcctaatcacaacc

SEQ ID NO: 18932 - DNA, 121 bp, Artificial Sequence
  Synthesized
  misc_feature (61): n=t or c
ttataccttatgcttgcaattgggcactacatttatctttcttataagcaattaaccatcntttctccctcactgcaataggtcagctatgcagatagccatttaaattagttacaaggac

SEQ ID NO: 18933 - DNA, 121 bp, Artificial Sequence
  Synthesized
  misc_feature (61): n=t or c
gaagtaaattgaagagggaggaaaaaattaagatagcaatgtggttaaagggacagagttnagaagctgtctcaggcttttcaattgactttaagaagcaataaaccactttcaagcattt

SEQ ID NO: 18934 - DNA, 121 bp, Artificial Sequence
  Synthesized
  misc_feature (61): n=a or g
aacgtttaaaaaaaaataaaataaaaaatggcacaacggtaatgtgattacagctcctctnaaaggcacagtgagtcttggtaggttcgttcttaatgggggatattctctgtctcaggtt

SEQ ID NO: 18935 - DNA, 121 bp, Artificial Sequence
  Synthesized
  misc_feature (61): n=a or g
tttgcaaatgtgctgtcagctatctaatgaaaatgggtcatggtttgtcaataactggagnctaaataagtgctgttatttatgtacagtaaattctgccatgctgacttgtcctggtgtg

SEQ ID NO: 18936 - DNA, 121 bp, Artificial Sequence
  Synthesized
  misc_feature (61): n=t or c
gacattgccttaggactttattaaagaggctggctgcttatctggagagcatctggtcttncagctttcttggggcatagcacaggtgtgcatacgtagctggactgaagaagcactgtga

SEQ ID NO: 18937 - DNA, 121 bp, Artificial Sequence
  Synthesized
  misc_feature (61): n=a or g
gcgtgtctcatctctcacagtagttgggaaagtctgtggtctatttcgttgagcagcatcncatttctggggttagtccttgcaggtcaaaagacggtgtttttgttgctgcagccattga

SEQ ID NO: 18938 - DNA, 121 bp, Artificial Sequence
  Synthesized
  misc_feature (61): n=a or g
atagctgtaccagacatacttttctctcattccaggataggataccacattcccatgttcnttggtttcatcatcatgttcctctccacgctcagtgagtaccgcccctgatttgcccttc

SEQ ID NO: 18939 - DNA, 121 bp, Artificial Sequence
  Synthesized
  misc_feature (61): n=a or g
caattctcattcaccttagtgtataagctgtctgcttctgaagtacttggttttttaacgntatggtctcatttctgcaagctaattttgaaatactacaataagcagaagcctgttaatt

SEQ ID NO: 18940 - DNA, 121 bp, Artificial Sequence
  Synthesized
  misc_feature (61): n=a or g
aaatcaaagtctgttttaaatgtgatcccacctgcattgatacatgctaaacatcactacnaacagtttctgaaaacagagactcttacatacagaaaaattctcctttctaccttgttca

SEQ ID NO: 18941 - DNA, 121 bp, Artificial Sequence
  Synthesized
  misc_feature (61): n=a or t
atatcccaaaatgatagaatgaaggtatctgatttcatgaaacccttttctaaaatcctantggtggaccatagttactttcatttaatcagcaaccaaaacagagaaaaacaaatggaga

SEQ ID NO: 18942 - DNA, 121 bp, Artificial Sequence
  Synthesized
  misc_feature (61): n=c or g
atgtccccagtgacaccagctcccatggccaaagaagaaacggggacccaaggaaacgttnctcattcatgggctggaatattagaaacaaagcagctatgtaatcccccatggaaagaat

SEQ ID NO: 18943 - DNA, 121 bp, Artificial Sequence
  Synthesized
  misc_feature (61): n=t or g
aaatacagtcttgattcttctagcttcaaattacactgcttttggctggaattagcagcanacatttgtaggaaggtttcagataacccggaaccaaagtaaattaacatattttaatagg

SEQ ID NO: 18944 - DNA, 121 bp, Artificial Sequence
  Synthesized
  misc_feature (61): n=t or c
agctgtatatcaggcctagtgatttctctttacgtgtattgtggagcttgatactcttganagtttttacttccaattggatattagtcttcttaacgctattttattagtaaccttgcaa

SEQ ID NO: 18945 - DNA, 121 bp, Artificial Sequence
  Synthesized
  misc_feature (61): n=t or c
taaacacaacattcagatgttttgttgagtgcatgtagccaagaaagccagggcaaagaangcaagtgagtatcacggaaatatctgtggaaaccagaggcagaagtagtttatgaccttt

SEQ ID NO: 18946 - DNA, 121 bp, Artificial Sequence
  Synthesized
  misc_feature (61): n=a or g
aagcagctttcctcatctgaaaaatgctttggaaacatctgttactggttatcgagttagngaagtaggagtcagatttaattcactgtttgttgcaactgtattgttttatagcaagatg

SEQ ID NO: 18947 - DNA, 121 bp, Artificial Sequence
  Synthesized
  misc_feature (61): n=t or c
gtaaaatcttgtaagacaaggagaagcagctaggtcagaaatctgcattttttccagccangaagctactcaagatctgctccatatttaaccttttggcatccaaagtttcacctcttat

SEQ ID NO: 18948 - DNA, 121 bp, Artificial Sequence
  Synthesized
  misc_feature (61): n=t or c
ttgttatatactaaaccccaaacataccccttgccacattaaaaacagggaagcaaggaangagggcgttctaacagctaccacaagtcactgacagtgaaaacagaagctaaaagccaca

SEQ ID NO: 18949 - DNA, 121 bp, Artificial Sequence
  Synthesized
  misc_feature (61): n=a or g
acagatttcaccagtagtctcagacaagtgactgtaatgtaaagaaaagcctgactgaaancacatcgtgcccttggagaaaagttggattttcaccaaggttttgtgtctgctcccagtc

SEQ ID NO: 18950 - DNA, 121 bp, Artificial Sequence
  Synthesized
  misc_feature (61): n=t or c
aacattagtttcattccacagtaaggaaataggctttgaaaatgtaatggttttcctcttnttttcctgcagggaaattcagctcctgcgacgactgcggcacaaaaatgttatccagttg

SEQ ID NO: 18951 - DNA, 121 bp, Artificial Sequence
  Synthesized
  misc_feature (61): n=a or c
tctttttccatttgtatcaattactttagtgcagtccttgttccattcctctaatttcaanggcacatctctgaatgtccctcccaatctggggactaacctgagaaataggagttaatag

SEQ ID NO: 18952 - DNA, 121 bp, Artificial Sequence
  Synthesized
  misc_feature (61): n=t or c
accacacaactgacaatttgtgatagcaacaactatgatttccctcattttcccatacacnctttagcagctagtctagcatctctagtacagttctccctacacaaccaaacattatttc

SEQ ID NO: 18953 - DNA, 121 bp, Artificial Sequence
  Synthesized
  misc_feature (61): n=a or t
gcagtctgagatcctgttctgagggaccgtgcctctatgagactgctgtgctctatgagcngcttgaacacgttatcttttgttctgcagagaaaggagtggtgtttggctccccactgac

SEQ ID NO: 18954 - DNA, 121 bp, Artificial Sequence
  Synthesized
  misc_feature (61): n=a or g
ccaggcagaggggctccagctgcacgcagagcctgaccctacctgattccactgggaatgncaggggtgtccttggccattctgaaacaataacgggagatgaaatgctccctggacccag

SEQ ID NO: 18955 - DNA, 121 bp, Artificial Sequence
  Synthesized
  misc_feature (61): n=t or c
actgaatatttgactcaaatatttattttgtgtctagtgtgaaaaatattacatcaggtantctatttgaaaatgaagctgtaattcaactcctctatcgttttccagttcaacttttgca

SEQ ID NO: 18956 - DNA, 121 bp, Artificial Sequence
  Synthesized
  misc_feature (61): n=a or t
agttggcaaatgagcctgctggaaatagcatgaccggggcgagaaactgcggtgatgctcnaagaggaactatgcaggagagaatgaaagatgaagtttgggagagagcatgggctgccag

SEQ ID NO: 18957 - DNA, 121 bp, Artificial Sequence
  Synthesized
  misc_feature (61): n=t or c
atcttaacggtgagtgataaccagagatcttacttttccttcagtgctgtttgagctaccngaggctctgcttggctttacctcacgtcaaagcgttgcaaaaggttttatatgtcctcat

SEQ ID NO: 18958 - DNA, 121 bp, Artificial Sequence
  Synthesized
  misc_feature (61): n=a or g
ttcctcatctgacaagctggttcccactatgcgaacttggtagaaacttactttggagacncaacccttcctgaagttgtaaggcttgtgctctgctcagcactcttgcttgctgtttccc

SEQ ID NO: 18959 - DNA, 121 bp, Artificial Sequence
  Synthesized
  misc_feature (61): n=t or c
cattgtgaatgttaacactcagatggccagaacagaggacaggggcaaccttcaccagagntggagtgcaagtacccaacgtgtgctgccttacagtgggttccttctttaaatgccagct

SEQ ID NO: 18960 - DNA, 121 bp, Artificial Sequence
  Synthesized
  misc_feature (61): n=a or g
tggaagagttagcactggaacagattttgctgctgttaaaggtcatagattttttctctantagcttccagaggaatgagatagggccattttggtcaatgttctgcaacagcaaaataga

SEQ ID NO: 18961 - DNA, 121 bp, Artificial Sequence
  Synthesized
  misc_feature (61): n=t or c
tcctctataaaagactgcagatcattaaatactagaaaggatgatgtgaactgagctgtantttggtcaagaaagaaaacagttatggtttgtagctttgattacatactttgtcttcaga

SEQ ID NO: 18962 - DNA, 121 bp, Artificial Sequence
  Synthesized
  misc_feature (61): n=c or g
agaacgtcaatagaaaacttatgttacttacatctagttcaaaacagttcatatgcatacntgggtaatagtgttttttatatcactacattatgaaatgactttctgcatctaccccatc

SEQ ID NO: 18963 - DNA, 121 bp, Artificial Sequence
  Synthesized
  misc_feature (61): n=a or c
tctgctctgtactccccagaggaaggtaactcaggacagcagcgcctctcctaaaccactnatcttctttttgagattccttcctcctgcaagacctacaggtataaaatccaccccagga

SEQ ID NO: 18964 - DNA, 121 bp, Artificial Sequence
  Synthesized
  misc_feature (61): n=t or c
attccacctttattggccctaaggagagcactcttttgttcagtgagaataacagaacagntcaagtttgccatacattagcacagaaaactctggccagtattcctatagcttcactttc

SEQ ID NO: 18965 - DNA, 121 bp, Artificial Sequence
  Synthesized
  misc_feature (61): n=a or g
actgtaagaacaaatttgttcatttctccatagatttccataatctgtaagtgctgacagnagaagggtaaggacatatctccttgttacatgtaaagacaagttgtggaaattcctagag

SEQ ID NO: 18966 - DNA, 121 bp, Artificial Sequence
  Synthesized
  misc_feature (61): n=c or g
aatcccaacagggaatgaaattaaaatgccatcagttctggagatcagaggaaataacttntgatgaaatgtacaaacaacctatggaactacgctgcatcaccacagaagccaatggctc

SEQ ID NO: 18967 - DNA, 121 bp, Artificial Sequence
  Synthesized
  misc_feature (61): n=c or g
tttttcataaaacagaataactggatggaagaaaccctttctgaggagtgttgggggtttntaatgctgcattcctgtcgctatgtggtgctgttcgaagttataaagccgatcctctaga

SEQ ID NO: 18968 - DNA, 121 bp, Artificial Sequence
  Synthesized
  misc_feature (61): n=c or g
tgatgcaatggatatgatatgttgtctcttccagtgatgcatgccagatatattttactcnacagaaacctttgagatggccattagagaatttggcaaggagttgcttcacgagcattaa

SEQ ID NO: 18969 - DNA, 121 bp, Artificial Sequence
  Synthesized
  misc_feature (61): n=t or c
cgctctaataccattgcagagatttcatgatgggacctgagcacttgcacttccacagcantgtgctgaagtgcactctgtcttgcacactgcttccttgtcttgatgccgatgagcaccg

SEQ ID NO: 18970 - DNA, 121 bp, Artificial Sequence
  Synthesized
  misc_feature (61): n=a or g
ataaaataaattcctccttatcagcctgacatacgtgaagttaaatagaaatgatgctctnctgctctccgagaccaagcactattcagcatgtgtttcagccactgctaaagaccccgag

SEQ ID NO: 18971 - DNA, 121 bp, Artificial Sequence
  Synthesized
  misc_feature (61): n=a or g
tagaggaactggtcatccaaacaattagaaaacaatttatggagtggctcttttccagacntgttcctttaatgaacatcttgaattgccccgttattttagaagcaagttgttcaaatag

SEQ ID NO: 18972 - DNA, 121 bp, Artificial Sequence
  Synthesized
  misc_feature (61): n=a or g
cctgtcagaagatgtgtggggcaaccccgtcttccgtgcatcagtgctcgcctgtcatgtngtcaacgaggtaagacccacagatgggcctaaaaccacttcagacggtacatcttctgca

SEQ ID NO: 18973 - DNA, 121 bp, Artificial Sequence
  Synthesized
  misc_feature (61): n=t or c
atctcaaacggtaaacatgaatagatacctaagaagagcaatgatgaggcaagcatatacngtactgagtattctccctatctcctattattttcacctcatggggagccatgagactgac

SEQ ID NO: 18974 - DNA, 121 bp, Artificial Sequence
  Synthesized
  misc_feature (61): n=a or g
ggcagaaattctgcttgatacattgagaatgctttctctgcaacctcacatcagaactgtnttaacaggaatgttgtttttcattgatcctttgtcatatttctctaagtatagtctcaaa

SEQ ID NO: 18975 - DNA, 121 bp, Artificial Sequence
  Synthesized
  misc_feature (61): n=a or g
aactgcactatataggttttataatcagtactcctgtggaccttaatctctgacaacgaanaagccactgtggttaacgacataggtttgtaagtggaacaacagtaatttgtctaaaatg

SEQ ID NO: 18976 - DNA, 121 bp, Artificial Sequence
  Synthesized
  misc_feature (61): n=t or c
gatctattttggtatgcagacaggtatcattagcagcaaataacagagatttcctttattnagcctctctgaaattctgttacctgatttctgcaaaggaaagtgcataatatacagatag

SEQ ID NO: 18977 - DNA, 121 bp, Artificial Sequence
  Synthesized
  misc_feature (61): n=t or c
cctgttttggtttatttctatattcaacagcatcaaataaaggtagaaatagaatttgaangatcaaataaccttataagaaatcagcatgccactaacagaatgaacagggagaagacat

SEQ ID NO: 18978 - DNA, 121 bp, Artificial Sequence
  Synthesized
  misc_feature (61): n=a or g
cataatctcttgaatattttgaaattcagaacactcagctttcattttctctcaaagcacntaactgttctgagacaaccacagcttagaggcctgaaaacactgaaaaaatgcactaatg

SEQ ID NO: 18979 - DNA, 121 bp, Artificial Sequence
  Synthesized
  misc_feature (61): n=t or c
ctctccaaaaagactccagcaggtgcagtagggcttcggggtggtaggagggctccagganggttcttagagcaggactgtatcctacaggctgctctgcaacccacaacgagaacagagc

SEQ ID NO: 18980 - DNA, 121 bp, Artificial Sequence
  Synthesized
  misc_feature (61): n=t or g
atagtatgtgcatataagttatttgggtacaaaatgctaagcttacttttatgttatctgnaagaactgagaaagatgcatgagtggatttcacaggatattcaacttttctctcccatca

SEQ ID NO: 18981 - DNA, 121 bp, Artificial Sequence
  Synthesized
  misc_feature (61): n=a or g
taaagatacacaaacacaggcacagagtcaatgtattgttaccccccccttaaatagagtnattcttcccagttccaaaattggcactcagccacaatgcaagaatcacacaacaaacttg

SEQ ID NO: 18982 - DNA, 121 bp, Artificial Sequence
  Synthesized
  misc_feature (61): n=a or t
cccaaacctgagctcctgtataaatagacgcgtggcattcctcatctttttttggtcatgntgagctggaaaatgcatcctgaaccagaaagggcagcatcctgacccattcccagctgag

SEQ ID NO: 18983 - DNA, 121 bp, Artificial Sequence
  Synthesized
  misc_feature (61): n=t or c
caccctgcagcaaaaatctcattagtcaactgtagattgtagaaagggagtggcattcttnctcctgttgtgtcaactacaccgatcagcttggtgtcacccacaaacttgctgaaggtgc

SEQ ID NO: 18984 - DNA, 121 bp, Artificial Sequence
  Synthesized
  misc_feature (61): n=a or g
gaagctcgctacctgctcagcaatcttggccttctgctcttgagggagctgtgccatgatngcctgaaagagagagctttctcacagagcatcctccagccacagcacaggaggctttgtg

SEQ ID NO: 18985 - DNA, 121 bp, Artificial Sequence
  Synthesized
  misc_feature (61): n=c or g
tcatcatcagtcacacacgaagttgaagggttccaaaaagcattttgcaatacaaagctangtatgccagcttcactgcatcttgtagacacctttcataatcaacctcaactccaaccac

SEQ ID NO: 18986 - DNA, 121 bp, Artificial Sequence
  Synthesized
  misc_feature (61): n=a or t
taattgtttttacagagataaaggatgagccgttggaagtagagctgactgaagaaacagnacattatttattgttgagttcctaatgaaagttactctgaatgttacttattagactgca

SEQ ID NO: 18987 - DNA, 121 bp, Artificial Sequence
  Synthesized
  misc_feature (61): n=a or g
gactgaagtagtcattgcacagatacctgcttagttctgtatgcatatttaagagtaacancagaaactcacccacaaaaatatgtcagattttaggtttcaaaccacagacagaagcagt

SEQ ID NO: 18988 - DNA, 121 bp, Artificial Sequence
  Synthesized
  misc_feature (61): n=t or c
ggtggtttccgaagggcttggggtgctcgtgatgtgctggccaaaagatggatcggctacnactaaatcttttgggtttacctcctgtgcaacccagcccgtgcagctctgggctccgtac

SEQ ID NO: 18989 - DNA, 121 bp, Artificial Sequence
  Synthesized
  misc_feature (61): n=a or g
ctcttctcgttattgacctccatgatgccatttgtcttagccaggaatagagggaatgggnctgcatgctaacactgtacttcccacacctgccagtagaatcccagccatggctgtggca

SEQ ID NO: 18990 - DNA, 121 bp, Artificial Sequence
  Synthesized
  misc_feature (61): n=t or c
ttgtgctttctagacttctgtatctttttgatcttttctgtactgtttcctgttctatgangcttctttgtggaagcacagcactccatcattacaggtaaagtcagtgctgtgttgtctg

SEQ ID NO: 18991 - DNA, 121 bp, Artificial Sequence
  Synthesized
  misc_feature (61): n=a or g
attatatgagtctgccctgagtacaaagaaaaagaatcctcagagtaaggaacgtgagtcnggcacattaatccctggctgctgagatacatccagaaagcctccccttcaccttaacact

SEQ ID NO: 18992 - DNA, 121 bp, Artificial Sequence
  Synthesized
  misc_feature (61): n=a or g
aattcaccgattatcctgcttttgggataattctctccaatctcatcacatttctaagtantatctcactgctgaccttcttcgggtcagatgctaagcacagtaaagttaatcacctttc

SEQ ID NO: 18993 - DNA, 121 bp, Artificial Sequence
  Synthesized
  misc_feature (61): n=a or g
ggacaatgagagtgacatttaactcctccagcatctcaagcataatagtcttgtctcacancagcggggtagataattattttgctgtagcagtttactgacatgactttaaaataccaac

SEQ ID NO: 18994 - DNA, 121 bp, Artificial Sequence
  Synthesized
  misc_feature (61): n=a or g
ggtacttcaagcaaagctagagtcatgaagcttctaatactgcgataacaaaatgaaaatntggttgctttagtgtgcaaaaatgaatgggttgtttcagttgctcaaaaatgtgcataga

SEQ ID NO: 18995 - DNA, 121 bp, Artificial Sequence
  Synthesized
  misc_feature (61): n=t or c
tcttggctgggggcccaaacaaggagtgctttctatttattgtacatccacctgcaatcgnagaactgaatcctttaggttgggaaagaacctttggatcatcttgtccaaccatcaccta

SEQ ID NO: 18996 - DNA, 121 bp, Artificial Sequence
  Synthesized
  misc_feature (61): n=a or g
tttcagaacactcttcaccaatcatcatgccatgttctagcctataattttaataacctcntcatgctagagaagtgcacaaatcgtgggaatacagtatttttggattatgtaaatgagc

SEQ ID NO: 18997 - DNA, 121 bp, Artificial Sequence
  Synthesized
  misc_feature (61): n=t or g
tgacctcccagcagtctccagagagaaagcactctgaagatgtcagaccaagaggcctgtngtcaaaggctgtggttgtggggataagctgagttcccaggcagaatggacaaggagtata

SEQ ID NO: 18998 - DNA, 121 bp, Artificial Sequence
  Synthesized
  misc_feature (61): n=a or g
ggaggactaataacttttactgaacaacttctttgcaacatatcaaacaaaaactgcactngttgaaaaagaaaaagctgttgactctggctggtatttaaaaggtatttccgcccatcat

SEQ ID NO: 18999 - DNA, 121 bp, Artificial Sequence
  Synthesized
  misc_feature (61): n=t or c
ctaaaagtcaatttacttaaattattttcataggacaaaggacctacaaatcccaccagtntttgttatacgtgctggctactcatatttttttttttttcctacattattgaatgaaatt

SEQ ID NO: 19000 - DNA, 121 bp, Artificial Sequence
  Synthesized
  misc_feature (61): n=t or c
tattaggttctcactgtgcaaacaatatagcccatagcatggttaagtttaggttgtaagnagaggaaagtaacagtattatgtcccaaatctgttctttccttcagtgaaaagttcaaat

SEQ ID NO: 19001 - DNA, 121 bp, Artificial Sequence
  Synthesized
  misc_feature (61): n=c or g
tttatctatctcatctgtggcatatctttcatgtacctgtagcaagctgagatcatttatnttccctttcctgcattgtccccttgttccccagcaagtttcatgaacagaattaggggat

SEQ ID NO: 19002 - DNA, 121 bp, Artificial Sequence
  Synthesized
  misc_feature (61): n=t or c
caaggagcagtgatgaatcacttagtaaggtaaacaaattttattgggagcactgctttangccacaaagcagcacttgcagaattagtgctatatattgccttgtctacaaggagtaatg

SEQ ID NO: 19003 - DNA, 121 bp, Artificial Sequence
  Synthesized
  misc_feature (61): n=a or c
gcaaatttaaatatatctccagtatttagcctagatttttgctagttggactgctctgggnataaaggaaatggctggaattatccaggaccttatgcctgcatagtctgttgaactcttt

SEQ ID NO: 19004 - DNA, 121 bp, Artificial Sequence
  Synthesized
  misc_feature (61): n=t or c
gttacagcaggatatgaaactgcaggtttttaaaacttgacataattgcccagatctgtgngtgattccaaatcttcattctgaattcactactttaaaacagcacaaagggaatttaatt

SEQ ID NO: 19005 - DNA, 121 bp, Artificial Sequence
  Synthesized
  misc_feature (61): n=a or c
gccaaaggtgtgaaatatcaccttcagacaactcacaaccatttttctttcagaatgtggncctcaaatccacaaacccactcagcagcaagtaccacgcatctttaaaatggggcacagc

SEQ ID NO: 19006 - DNA, 121 bp, Artificial Sequence
  Synthesized
  misc_feature (61): n=t or c
catcatttcaagcaagataggttgtcttaacatattgtagacagatgtgaactcccactgncttaactgtgagctgcccaaatgcagctcctttagttgggaacctgtagagaggcagagt

SEQ ID NO: 19007 - DNA, 121 bp, Artificial Sequence
  Synthesized
  misc_feature (61): n=a or g
aaggtgccttgcatgcatgttcagtttcattactctttaagggtgctgaagaagctctaanctgattgaaaatggcttacagtgtctgagcagtattccactgtatatctgaatgtggatc

SEQ ID NO: 19008 - DNA, 121 bp, Artificial Sequence
  Synthesized
  misc_feature (61): n=t or c
cttaaccctattgccagcaggcttgcttttattcgtggacatctttgcacacagaaaaaanccaacactgataaatatcagtggtaagtggcagcctggatcagctccactggtgccatgg

SEQ ID NO: 19009 - DNA, 121 bp, Artificial Sequence
  Synthesized
  misc_feature (61): n=t or c
gtgcccagccgaaccggtccccgctgcttggtccaggtatgacagtacttttatcagctcnactgtgtcagtaccagtgttattgagtgctgtctggcctgatcactgtgtaattgcgtgg

SEQ ID NO: 19010 - DNA, 121 bp, Artificial Sequence
  Synthesized
  misc_feature (61): n=t or c
actgggtacgggttgcatgaggcaaaccccagtaaatcatggtgcacgtgcatggcacagngataacgacctgcaaactgtttccctgtcactggtgacgctgagccctatttctgtgcct

SEQ ID NO: 19011 - DNA, 121 bp, Artificial Sequence
  Synthesized
  misc_feature (61): n=a or c
tcaggaaatggaacgaggcacacacccaccagcagcagttctttgggtttttctttctctncgtgtgcacagcaaagggaaacaggatgcagaggtgcacccggctgctgaaggagagggg

SEQ ID NO: 19012 - DNA, 121 bp, Artificial Sequence
  Synthesized
  misc_feature (61): n=a or g
tgggctgtgggagtgtaaatagaagtaggtggcacatggtaggtgacacatctgatgtctnctctcacttctgctccaagaacagaaaccaccagcagagggccaaagcaaagcgcaggag

SEQ ID NO: 19013 - DNA, 121 bp, Artificial Sequence
  Synthesized
  misc_feature (61): n=t or g
caaattatctctctgtcactgttcacactgatatgttttcagaggacatgatcgctagggncacctcaactggtgataaactccgggaacaaatgaaagacaagatttgtgttagcagaag

SEQ ID NO: 19014 - DNA, 121 bp, Artificial Sequence
  Synthesized
  misc_feature (61): n=c or g
tggattcccagtttccttttctgcacaaagctttcctgcctctgggggacattgagaaganaaattcattaatctctgtaacatgctgagaggtctgctcaccaccagtttcaggcaagta

SEQ ID NO: 19015 - DNA, 121 bp, Artificial Sequence
  Synthesized
  misc_feature (61): n=a or c
aggaggagtagcagcagtgatggcatcgacatgggaagggtgtgctgaattcctctgcccncggctgctcctgatcccatttccagcatgcacgcattgttagaggagagcttttctctgg

SEQ ID NO: 19016 - DNA, 121 bp, Artificial Sequence
  Synthesized
  misc_feature (61): n=t or c
gctacctgcatccaaaggtcacagctcatgcccacatgcgcttgctctccgtgtttcaaanccacccttggtgctcctgcacgcagagatgctcacacaaagcacatgcaggagctgctgc

SEQ ID NO: 19017 - DNA, 121 bp, Artificial Sequence
  Synthesized
  misc_feature (61): n=a or c
gacctcagcagctgttgatcccttctctgttgcgttgcctcctcctgtgactggttcatgnccaccctactcctcagcagagcctgtggttaacagtcatccctatcaccctgtgataacc

SEQ ID NO: 19018 - DNA, 121 bp, Artificial Sequence
  Synthesized
  misc_feature (61): n=a or g
gcagccttgacacaactgagagtgaagcctgctcatctgtaatgtgacagaatgttaactngaagattttgtagtcaaacactcagttcttctctgggttacgcaggtgcaaatcaagaat

SEQ ID NO: 19019 - DNA, 121 bp, Artificial Sequence
  Synthesized
  misc_feature (61): n=a or c
tttttctttacttgaatatcttaagtttaagtttgatttcccttggcattttgtactatanagcttagatttcaaatttcaagttgggtggttgactgttttgatacataggtaggaattg

SEQ ID NO: 19020 - DNA, 121 bp, Artificial Sequence
  Synthesized
  misc_feature (61): n=t or c
cgctcagttgtaacgctctgttctgcaggacaggcttttgccccatggagatgtgattcgnactgattgcctcctcaagccttcccctgccccagaccacaactcctctctgtaccttcct

SEQ ID NO: 19021 - DNA, 121 bp, Artificial Sequence
  Synthesized
  misc_feature (61): n=t or c
gacttgacaacaatgcgccctcctcctccatttctcatcctacaacactattaaatgcaancagggcactctcccctatcagcgctctgtgtctacgcagaaagaaagcgaacgacttaaa

SEQ ID NO: 19022 - DNA, 121 bp, Artificial Sequence
  Synthesized
  misc_feature (61): n=a or g
cgcctgaggaggttctttggggcagagaagctgaccgaagtcatgctgtgaagatgcttcnctacgcctctaagatgagcatgaactcagggcacgggacctaaggacaacaccagaacac

SEQ ID NO: 19023 - DNA, 121 bp, Artificial Sequence
  Synthesized
  misc_feature (61): n=a or g
acaacttctggaaacattctgtcatgctgtaaaggtgttagttacagactaaggttctatnaacagcgaccaatcgtggtaggatttaagtcttaacaaaatgaccctaaaattgatgtac

SEQ ID NO: 19024 - DNA, 121 bp, Artificial Sequence
  Synthesized
  misc_feature (61): n=t or c
tgaagctggtaggaagctggatgttgactttcaaagcaccacattttcaccttttatcttncctctgcaggagctcaaggataacatggtggaatttgctttgcaaaacagggactccttg

SEQ ID NO: 19025 - DNA, 121 bp, Artificial Sequence
  Synthesized
  misc_feature (61): n=a or g
agtgagatgcaggatgtccacacccatcaacatgctgaaacaagagcaagaaaagagcccnagatgggagccaagcacaaatacgatgttctcaagctgtcaggaggaatgccaggttaaa

SEQ ID NO: 19026 - DNA, 121 bp, Artificial Sequence
  Synthesized
  misc_feature (61): n=t or c
acaggacaccaagatttagatacctaatatgcctcacatagtgtaaataaaccattcatangtgaaatgcataatcctacagacacctcgtgggacctgttctgcttgaactcttggagac

SEQ ID NO: 19027 - DNA, 121 bp, Artificial Sequence
  Synthesized
  misc_feature (61): n=t or c
ccatgaaggactgtcactggtgatgggtgggctggggaaaaggagtgcagatggatactgntcattcttcaaagaccatctcagcaacccacagccttcttcccaatagtgttaactctgc

SEQ ID NO: 19028 - DNA, 121 bp, Artificial Sequence
  Synthesized
  misc_feature (61): n=a or g
taatggagactaacagacttcatgagaagaacacaaggggagaggctggaaaatagaaagncattattttcaccagcagatgagtacttcctgagaaactcatggacactttagcaaacag

SEQ ID NO: 19029 - DNA, 121 bp, Artificial Sequence
  Synthesized
  misc_feature (61): n=a or g
tgtcctcttcatttgctacgctttgctatgtatagtttaagaaaaggaaagattattgatnttagtatgttatttttgttctttgatatccaaagctcccacactggagattactggtatc

SEQ ID NO: 19030 - DNA, 121 bp, Artificial Sequence
  Synthesized
  misc_feature (61): n=a or t
tttttccaaactaaatttcactttacataaatcatcactgccttacctatccttatgcctntatcagttctttcccatggtgctccagtatttatccacaaacctgtgcttggccctttcc

SEQ ID NO: 19031 - DNA, 121 bp, Artificial Sequence
  Synthesized
  misc_feature (61): n=a or g
aggtttaacggcaaccaaccagtacagcaaatttccttaactaaatgctgagaagtatcantataactgagttctcaaactatcagtattctacaacatgaatatcaaaagctaataaata

SEQ ID NO: 19032 - DNA, 121 bp, Artificial Sequence
  Synthesized
  misc_feature (61): n=t or c
gctgatggaatccctctgcaatatgaatcgggcttgaaattcagggcagtcatcaattgtntgtgctgccagagggtctcctcttccccactggtagaatttgtgctttcatgtcctgggc

SEQ ID NO: 19033 - DNA, 121 bp, Artificial Sequence
  Synthesized
  misc_feature (61): n=t or g
tgtggtggctgctgggagccccctgttagcacacaacagatgtccacaactccccgaaccncttaacccacgtgagaggtgataacagcaactaaaccgtctcttcctgccctgcagatga

SEQ ID NO: 19034 - DNA, 121 bp, Artificial Sequence
  Synthesized
  misc_feature (61): n=a or g
caagactttgcaatgtgaaaatacatgacaggatggaaaagtgggagggatatctgtaacntcacgagtcgggtaggaaaggcaaatcaccagatgttgatttatgaaggtacaaaagaag

SEQ ID NO: 19035 - DNA, 121 bp, Artificial Sequence
  Synthesized
  misc_feature (61): n=c or g
gagctgctctctgactacattatgaaattcctagaaaaagatagctgtgcaaacatatggnatagctcaagtacactgcatgacattgagaataaccaacaaatgctacatcattatggca

SEQ ID NO: 19036 - DNA, 121 bp, Artificial Sequence
  Synthesized
  misc_feature (61): n=t or c
acgagggagcctcctcctgtctgcagtgggtcgtagcaatgagctcacagcggtcttctgncttgctctgcagccttgggtttcccctgcttgcattcacctcttggagaggagcagcaaa

SEQ ID NO: 19037 - DNA, 121 bp, Artificial Sequence
  Synthesized
  misc_feature (61): n=t or c
ttgaaatacagttcctggaaaataaatgaataaataaatagaaaccactagtaacaatctnatagcaaataaatggcacacgttatgaatagcatatgtaagtgcagcccataagtataga

SEQ ID NO: 19038 - DNA, 121 bp, Artificial Sequence
  Synthesized
  misc_feature (61): n=a or g
ctctaatgcagagtgtcctgtggtgatgctatgtttagcagactgttatttccatgacagnaatatgtagagaataatttttagggaaataaaattggggggtgggggtgatcaacctaaa

SEQ ID NO: 19039 - DNA, 121 bp, Artificial Sequence
  Synthesized
  misc_feature (61): n=t or c
atgaggctacaggtgtgagggaggtcataatctaaaggcagcgtagttcacacacaaaaanggggacagaactcagcctgagttctttatggcaatggcagatgaggactggctttaaatt

SEQ ID NO: 19040 - DNA, 121 bp, Artificial Sequence
  Synthesized
  misc_feature (61): n=a or c
ttctgaaattacatttatttataaattaagtaaattttctggcttaatattttatttcacnaaaatgaaaatgattggaggaaaaccaaggtatttcagaacacaaaactgcaattaactc

SEQ ID NO: 19041 - DNA, 121 bp, Artificial Sequence
  Synthesized
  misc_feature (61): n=a or g
tctttctttctttgacagcctatgtgggttttcttccctgctactagaaaagaactaagangatgcagtaccttttctctgcccaatatgtgattattttattgttatttatgtgatatta

SEQ ID NO: 19042 - DNA, 121 bp, Artificial Sequence
  Synthesized
  misc_feature (61): n=a or g
catgcttaaataatagattcattatagggccttgaatctgtcgcttcatcccttgattggnagggagatgaatgatgtgggagcgctcagcgtctgtgtgtgatgttcctttgctgttaaa

SEQ ID NO: 19043 - DNA, 121 bp, Artificial Sequence
  Synthesized
  misc_feature (61): n=a or g
gctcagtttaacaaccaattacaatggatagtgctgatgtcaggggaagagcccagcatcnctgctacctgaaggctgaggctcctttacctcgaggtcagccctggggccataagcacag

SEQ ID NO: 19044 - DNA, 121 bp, Artificial Sequence
  Synthesized
  misc_feature (61): n=a or c
aaagctgtgagaattccaaggttaatattgggttggaggaagcacgtgactgccctgaggnatgatgtaatttagacctaccttgagttaagagttaggtcagagcctacagcagatgtgc

SEQ ID NO: 19045 - DNA, 121 bp, Artificial Sequence
  Synthesized
  misc_feature (61): n=t or c
atgatcttgttttgttttgtttttcccataaaattcactaaaaatgttctagtaaactccntgtgcataagttgttcctgctagcattttttgacaacagtccctataggtggttcttctt

SEQ ID NO: 19046 - DNA, 121 bp, Artificial Sequence
  Synthesized
  misc_feature (61): n=a or t
ttaaattcaatcaacacaaaaaagataaattcaaagccctgaggagatctaaagtacatanaacaggaataagaataaaacttacaatttcaacctcatcgttgcacagtaaaattgtgcc

SEQ ID NO: 19047 - DNA, 121 bp, Artificial Sequence
  Synthesized
  misc_feature (61): n=a or g
aagttctgcacagctacctgaatacagtacctatttgagtctttattatgcagattgtgantgctatacttagcactcatggcctttttttttgagagagagagaaaatgtaggctgactt

SEQ ID NO: 19048 - DNA, 121 bp, Artificial Sequence
  Synthesized
  misc_feature (61): n=t or c
agattattgggcatctggtggtacacattaaaagttcatcttctccaagatgtgaaagctngtgtaacataactgagtgagcagtgctgcatgactgagaggactggagttatttcagagg

SEQ ID NO: 19049 - DNA, 121 bp, Artificial Sequence
  Synthesized
  misc_feature (61): n=a or g
cagttgctatttagaagatggacaggagtagaaaatgccaattacaaggttttctccagcnaaagctgactggcaaagggataaagcttctcagaccagtgtggtaacgatgcagctctca

SEQ ID NO: 19050 - DNA, 121 bp, Artificial Sequence
  Synthesized
  misc_feature (61): n=t or c
ctctctttaaatcaacccttaggtaactttttgtttagagcaggaatttgtctatgggatntgtgttgcttgcagccttttagctgggatgaggaggtaacaggtctatgaagatacgaaa

SEQ ID NO: 19051 - DNA, 121 bp, Artificial Sequence
  Synthesized
  misc_feature (61): n=t or c
gataaatttatgctataaactgttgctatgatgtattgaaggatagcttaaaattaaatgngtacagagttactgtatttggtacatgtgctaatgttggagaaggaggggagaaaatata

SEQ ID NO: 19052 - DNA, 121 bp, Artificial Sequence
  Synthesized
  misc_feature (61): n=a or g
caaacagccatcgctgcaaagagacgctttcagggagcctagggattggagatgcccaacnatgatccttacttcagcagctggcttatattttgaaaatacttcattaacccaaggttgc

SEQ ID NO: 19053 - DNA, 121 bp, Artificial Sequence
  Synthesized
  misc_feature (61): n=c or g
gagcaagatgcacctagtactcattggctttgaggaacaacggcttcttgatttatggctnttgctggatcactacattatatcagacttcttcacagtcgctaaggtatttttttaaaga

SEQ ID NO: 19054 - DNA, 121 bp, Artificial Sequence
  Synthesized
  misc_feature (61): n=t or c
taggactcttctactgctttttaggaattctcccttcccttttagaaattgccctctagtnttccaaaaaactgtagccagctttctaggaattcactttttgcttcctaggattctcccc

SEQ ID NO: 19055 - DNA, 121 bp, Artificial Sequence
  Synthesized
  misc_feature (61): n=a or c
ggtgtcccggtagccaaccaatctcagccctgtctcagtcggcccaacaaactgccacaancaacatcaaaatcccagtgcagaagagcacaaagacattatcactgtaagaaggcagatg

SEQ ID NO: 19056 - DNA, 121 bp, Artificial Sequence
  Synthesized
  misc_feature (61): n=t or c
taaaaactgtcccctatctggggtcagtcttatctgctgtctactgtccaactttcagctnagctgtgatgattatgtagttgaagctttgtggtgaaaaataacagaaacttgagatata

SEQ ID NO: 19057 - DNA, 121 bp, Artificial Sequence
  Synthesized
  misc_feature (61): n=a or c
atttcactgaagtctgtgaagttccagttgaataaatggcatacaggatgagagtaggagntctttccttaaaatgagtagttgcaagttcagagtctcaggctcaaatatttagatgttt

SEQ ID NO: 19058 - DNA, 121 bp, Artificial Sequence
  Synthesized
  misc_feature (61): n=a or g
cagggatgaaggtggagaacaacaaaattcttaatgagtggctttattttagctaagattnaaaggttgtctgtgggagtcacactgatgtgagatcctcctcagtaccatttgaacttag

SEQ ID NO: 19059 - DNA, 121 bp, Artificial Sequence
  Synthesized
  misc_feature (61): n=a or c
ttctaggtaagaaaataatggaagcatccttcaattttaagagtaaaactgacaatcttcngttggttctctaatttgctggctatgctgcagtacaacagataacatgttgcctgcaaat

SEQ ID NO: 19060 - DNA, 121 bp, Artificial Sequence
  Synthesized
  misc_feature (61): n=a or g
ggtacaacatctgaagagtgcaagaattaaagtgcctcaccctgggacacggagttgacancatgacctgtggttcagcagtgaccaaccatgcagagctcagagggccagggcctgctct

SEQ ID NO: 19061 - DNA, 121 bp, Artificial Sequence
  Synthesized
  misc_feature (61): n=a or t
aaagctcccatttgtggctctacttaatgcaggatttcacccaaagagctgtaactaaaantatatttaccgttctttctgtcttcttcccagcagacattcattactgatatcatctgaa

SEQ ID NO: 19062 - DNA, 121 bp, Artificial Sequence
  Synthesized
  misc_feature (61): n=t or c
gaaatgtaggttgctctccgtagccacccgacaggactagcagtaactgccgtatttcctnggcagcaactttcttccaaatccaaagattattctttctctcctctgatctgtattcctt

SEQ ID NO: 19063 - DNA, 121 bp, Artificial Sequence
  Synthesized
  misc_feature (61): n=t or c
gaagcctgtacctgggttctcactgtgtgtccactttacttgttacattaatcaaaacaangtaattccaaccttacacaagatctccactacaggaactgagttaggagcttggtgatag

SEQ ID NO: 19064 - DNA, 121 bp, Artificial Sequence
  Synthesized
  misc_feature (61): n=a or t
gcatgagaagaagctatatttagaaatctatgcctccgtttggaatgtaatggaaacaaanatagtagacaaactttcgtcactgtttcaataggtaatattgaaaaggcattaaggctaa

SEQ ID NO: 19065 - DNA, 121 bp, Artificial Sequence
  Synthesized
  misc_feature (61): n=t or c
tccacttgggtttccagagcacgtgcttacattctgcccatttcaaggaatgtaaacatangctctaagttaatttgtgcagagtgagtgattttgatgctttgctgagtcgggaccagta

SEQ ID NO: 19066 - DNA, 121 bp, Artificial Sequence
  Synthesized
  misc_feature (61): n=a or g
actttcttgcatccattaaacagaacctgaagatcatgcatcctttgtccagaggcaatcngaatcataacagctgtgtcatatctctaaaagctaatcaccctgattcccaacattttag

SEQ ID NO: 19067 - DNA, 121 bp, Artificial Sequence
  Synthesized
  misc_feature (61): n=t or c
tgccccgcaagagaagtcttggccttcatgtactaaatacagtgttgtactttaaacagtnattgggtataatataaactaaccctgaaacaaaggctagaacccaggggcctcagttagg

SEQ ID NO: 19068 - DNA, 121 bp, Artificial Sequence
  Synthesized
  misc_feature (61): n=t or c
cccgcccaccccattccctggcacccccgggtcgcatgcaggtgttagcagggcacgcagnggcacatgttagcaggtgcaagaacaatccctcctgaagcagctccaagtatttcaattc

SEQ ID NO: 19069 - DNA, 121 bp, Artificial Sequence
  Synthesized
  misc_feature (61): n=c or g
acactgaatccttaaggagagactcaattttcctgcaaccaaacatctttagcacttttgnaattgatggcaatcaacgtgtagtttctacaccaccagtttctttcttttctggcagaat

SEQ ID NO: 19070 - DNA, 121 bp, Artificial Sequence
  Synthesized
  misc_feature (61): n=a or g
tgttctttcaaaaacaggagtctggttgactcagcaggtgccacactgagacccaacatcnctaagaatgtcatatctttactgagctccttaaattgggctggagctgcagctggctatt

SEQ ID NO: 19071 - DNA, 121 bp, Artificial Sequence
  Synthesized
  misc_feature (61): n=a or c
ggggaaatggcacaacagattaggaaggctctactttaatgaatgtctgtcatgaaatacnttaagtatctcagactgattttctgaactgtactttgttcagactaactgtatacaagca

SEQ ID NO: 19072 - DNA, 121 bp, Artificial Sequence
  Synthesized
  misc_feature (61): n=t or g
tctggcatgaactttaaaatatgtaatatattgaggcaaaaactcatctgatattgttaantcctatctgcaaacttgtgttgtcttcggcacaaaaattgcattactcagttctgtggtg

SEQ ID NO: 19073 - DNA, 121 bp, Artificial Sequence
  Synthesized
  misc_feature (61): n=t or g
aatgcatataagaggttttatcccactaagtgaggatgctccagtgacaggcttatcaccngaatcagtaagtcctctgtgaaacttgttttgtcatctttcattagaggaagtggcttga

SEQ ID NO: 19074 - DNA, 121 bp, Artificial Sequence
  Synthesized
  misc_feature (61): n=t or c
acttctgcactggcttgggtatgtgttactgaagtcggtcgctatgtttgctaacttttangaaggttgggaaatgcttttgtgtagatctttttcaagtatttgtctcctcctgcacttt

SEQ ID NO: 19075 - DNA, 121 bp, Artificial Sequence
  Synthesized
  misc_feature (61): n=t or c
agcgatcatggtttagtagagaaaattttttgctggatggtatctgagagatgattcagtnaaatgcatgtgtacagtcagatgtatttaaaagaagggaaataaattacaaataaatgtt

SEQ ID NO: 19076 - DNA, 121 bp, Artificial Sequence
  Synthesized
  misc_feature (61): n=a or g
agggaaagctgctcacatgcatgcctggtcaacaagcaaggaggatagcaggcattgctcnagggaccacatatggcgattgtcatcctaaccagtgtggagacccacgatccatcttcat

SEQ ID NO: 19077 - DNA, 121 bp, Artificial Sequence
  Synthesized
  misc_feature (61): n=a or g
atttcatgttaagccagaaagtctgggaaaatgttggtaaggaggaaagggaagggtgtgnaacggcgggactgtgtcagctctcacctgggagagctggctgctttgtgctttggtcatc

SEQ ID NO: 19078 - DNA, 121 bp, Artificial Sequence
  Synthesized
  misc_feature (61): n=a or g
ctgctgtgaataaaaggaaaccccaacccatctagaacgagtacagggcaaccgtcctcantgtgttttggaactggcattacagctgttctgtgtcgtgtacatatcgcatgacattatg

SEQ ID NO: 19079 - DNA, 121 bp, Artificial Sequence
  Synthesized
  misc_feature (61): n=c or g
agtgaaggaaataagccacaagcttcctacgggaccatgaagatgaagtggcagatttagncctctgaggtataggtaatctgtgaacaatgaatgccaataaactggaaaaccaagagta

SEQ ID NO: 19080 - DNA, 121 bp, Artificial Sequence
  Synthesized
  misc_feature (61): n=a or c
tgaactttggagtgattcctgttttacaacacattttcagtagttctcagtttactatggnaaatgccaggtactgtgccctgaactgccatggacgtccacatggagcagatgccatgaa

SEQ ID NO: 19081 - DNA, 121 bp, Artificial Sequence
  Synthesized
  misc_feature (61): n=a or t
gagtggcaatattagcatctctggtatgatcctctgacatgtgcaagactgactttcatgnaaaggaataaaataacacagaacatgttccacaatcactgtatgaacgaacacagaaatc

SEQ ID NO: 19082 - DNA, 121 bp, Artificial Sequence
  Synthesized
  misc_feature (61): n=t or c
tgaagaagactttatgtcccttggaaagatggtgatcagtagtgttctcctcaatcctccnggttggagacttgagacctgagaaggaggagaacaaagcagctgcatgaatggctgtgtg

SEQ ID NO: 19083 - DNA, 121 bp, Artificial Sequence
  Synthesized
  misc_feature (61): n=a or g
tgtgctaagggagaccaggatatgcgctggctttttatcagatcattcttcctgttaggtngaaatgctaataaggatgctgaaaaccaaactcaggtgtattctgacaaaacatatttgc

SEQ ID NO: 19084 - DNA, 121 bp, Artificial Sequence
  Synthesized
  misc_feature (61): n=t or g
gtagaaattatcttttatttatttatttatttatttatctatttaaacaattcttactttngaaacagacgtttgcattcattgttatttggatcactgctgagttggaatagatgtgagt

SEQ ID NO: 19085 - DNA, 121 bp, Artificial Sequence
  Synthesized
  misc_feature (61): n=c or g
gtggcctcactcccactttgggaatccaaatccctgagggaccccaaaatcttcctggaancctcaaactcgaaaacccctttggaaccccaaaacccccacgaaactccaaaaccctttt

SEQ ID NO: 19086 - DNA, 121 bp, Artificial Sequence
  Synthesized
  misc_feature (61): n=t or c
tcaccccctctaagaaaaaccaggtgtgcctcctcttgttagatagaagtttgatatgcanctcatcactttcctcatttctctcaagcccttttactcacctcttagatctttctggtaa

SEQ ID NO: 19087 - DNA, 121 bp, Artificial Sequence
  Synthesized
  misc_feature (61): n=a or g
atagacgggagtagggctcttatcccccatttggttgatgaggaatctgaattacaagganattgtcatttactaacagctagtcaggatgcatttaagtgagtatttcagccccagcttc

SEQ ID NO: 19088 - DNA, 121 bp, Artificial Sequence
  Synthesized
  misc_feature (61): n=a or g
ggcttttttttttacctgctatcacactgagaatattcccttttagaagaaagagtgaganttcatcatgtgacttttctgcccctttaatttttatatggttgctcctatcatttttata

SEQ ID NO: 19089 - DNA, 121 bp, Artificial Sequence
  Synthesized
  misc_feature (61): n=t or g
tgatgagagaatttggctgcagaaggggtctgaggggtagcttttgtcctgttgaggagancatgaagagagcaagaagggaacatgtacattacatgcataaaatcgttatattttccct

SEQ ID NO: 19090 - DNA, 121 bp, Artificial Sequence
  Synthesized
  misc_feature (61): n=c or g
agcatcgctttgagaagagctcttggccaaaggatggtggcttggcatgaccgatactggnttgtcaccacgacacttgtcccagagagtaggaatgaggccacagggagctgagcctcat

SEQ ID NO: 19091 - DNA, 121 bp, Artificial Sequence
  Synthesized
  misc_feature (61): n=a or g
ggcagagggggagaggggtattctgtgtcttctctcctccctacagcaccatgagttaatnttaagcaaacactgcttcatagaatcgttttgagttggaaggaaccctcaccttgtccaa

SEQ ID NO: 19092 - DNA, 121 bp, Artificial Sequence
  Synthesized
  misc_feature (61): n=a or g
gtgttatctcctgctcttggactcagagggatgggtgctttgaagggcacatggtgataanggaaatgttgctgtggtcctagggacgtgcaggggaatgggatgaagatggtcgtctgat

SEQ ID NO: 19093 - DNA, 121 bp, Artificial Sequence
  Synthesized
  misc_feature (61): n=a or c
aatccatattctgaaagtgtaaaataatctgattttggaaaattctttctgaaataggagnattctgtcctcttattcacctcattacaatgacaactcctggagttcaagagaagcagcc

SEQ ID NO: 19094 - DNA, 121 bp, Artificial Sequence
  Synthesized
  misc_feature (61): n=c or g
aacagctccttttctgcagctcgctgccctgtggccaaacccaccctgtcctcacaccctntaggatgccagcttggctgaggattagctgttacagcacagtcaagcaggtcaggagctt

SEQ ID NO: 19095 - DNA, 121 bp, Artificial Sequence
  Synthesized
  misc_feature (61): n=t or c
ttgcagaatgaattgcaggaaaatatttgggccatcgaggtctttactttctagctgtcangctgaaatggtgtgaaattgccagccttaaagcagacaggtttgattagaacactgtgtt

SEQ ID NO: 19096 - DNA, 121 bp, Artificial Sequence
  Synthesized
  misc_feature (61): n=a or g
ctgggaagaaccttgagagattcacagatctattcaccatcatgcctttgagatcacctcncttctatctaattacatttcagcacagagtagaatatatcatgtttattagtatcaaaaa

SEQ ID NO: 19097 - DNA, 121 bp, Artificial Sequence
  Synthesized
  misc_feature (61): n=t or c
atatcatgtttaaaagctggtacaacccagcaaagggagcagtgaaatcactccagcggantgcagatcagctcaatgttcagcctaaagtgcacaatctacacagatgagtcaggtaatc

SEQ ID NO: 19098 - DNA, 121 bp, Artificial Sequence
  Synthesized
  misc_feature (61): n=a or g
tcctgtaccttcaatgaaaatcaagagtcacctttgtatcggtaaacactgagttcagtcngaaggcaataagagaaaagcattgcctgtaatcgggcagctgtgagaggcttggaggcct

SEQ ID NO: 19099 - DNA, 121 bp, Artificial Sequence
  Synthesized
  misc_feature (61): n=t or g
tccctttcccaagggctttggcacttaaatctagtttctcctgagagctacccttgttggnctggaaggagtaccatgagcacatcctgcctagtcagatcgtttcctagggtagatcagg

SEQ ID NO: 19100 - DNA, 121 bp, Artificial Sequence
  Synthesized
  misc_feature (61): n=a or g
tctttccctgtcggctattcctgaatttttagtgaaggttacttttaaaatgctgaacgcnatacttaacacactccgttcacattacattataatgctttttataatgataaaaaaagcc

SEQ ID NO: 19101 - DNA, 121 bp, Artificial Sequence
  Synthesized
  misc_feature (61): n=a or g
ttttaaaaatggcattttgccttcctttggcaccttctaattgctgtgttggtatttggtngttgttacaccacaagccatgccaaaattattgttcctcagcccacagtcactttctttt

SEQ ID NO: 19102 - DNA, 121 bp, Artificial Sequence
  Synthesized
  misc_feature (61): n=a or t
atgtgtgataattaaaagaacaacaaatggccacaattaacaacaaaaatatctcattatnaactggaatgatgaataagttgcacatatatatgattcacttccaagaagggaaggtcaa

SEQ ID NO: 19103 - DNA, 121 bp, Artificial Sequence
  Synthesized
  misc_feature (61): n=a or g
gcccctgagggagaaaggatgctgagctacatggctctctggctcttctccaaagccctcntgtatacctaggtaaatggaaatgaattgaaattcacatcccaagtagcctgtggccacc

SEQ ID NO: 19104 - DNA, 121 bp, Artificial Sequence
  Synthesized
  misc_feature (61): n=a or g
ttttaattcctagaagataaaattctcttcccatctccaagccaaaggctgaggctgatcnatttctcctaagatctgcttaggaacaccagtgagaacatgaatgacctctcaaaggctt

SEQ ID NO: 19105 - DNA, 121 bp, Artificial Sequence
  Synthesized
  misc_feature (61): n=a or g
aaaattcttgcccacttataactgaaaattcattctcagatctctcacagttttataaacnatttatacttgccttgcatcaaagtgtgtgatttttactttctggaatagaacacataaa

SEQ ID NO: 19106 - DNA, 121 bp, Artificial Sequence
  Synthesized
  misc_feature (61): n=a or c
tccatccaatctcaatggttgctcatcatatacttccaaaaaagtctgtaaggaatcctanttatgttcaggtacgtgtagggaaaaacagtgaaaaggaacataaagaaacaaagcatag

SEQ ID NO: 19107 - DNA, 121 bp, Artificial Sequence
  Synthesized
  misc_feature (61): n=t or c
ttgttctaaaatagttccaatgtaagtagctttatctcttctgttttgcaatgttactagnttgatcatagtttgagtactgaatgaaaacaatgttacagatctgaataattactctttt

SEQ ID NO: 19108 - DNA, 121 bp, Artificial Sequence
  Synthesized
  misc_feature (61): n=t or c
gacttacatcaaggatgactttaacccattacaggtttatatactgcagctgaagaactcntttaaagcctaatgtatggtaatacagtttaattgtggttggttggcctgttgggattaa

SEQ ID NO: 19109 - DNA, 121 bp, Artificial Sequence
  Synthesized
  misc_feature (61): n=t or c
tcattattatggaaataaatttaaaatgtggcttttcggagctgttgaaagccatcgcttncaggagctgttgcatgcctctctgaagggctaatgctgagatctgtgatgtgtggggaac

SEQ ID NO: 19110 - DNA, 121 bp, Artificial Sequence
  Synthesized
  misc_feature (61): n=t or c
tgtgttttcctagacttatactggattctacaggttctacattgtaaaattctacaaatanacatcacatatttctacattctttagttggggcaccaaacatgcaaaaataaataaataa

SEQ ID NO: 19111 - DNA, 121 bp, Artificial Sequence
  Synthesized
  misc_feature (61): n=a or g
ttctggtaggcagagctgcagccattctttcccactgcctgctctcagaagaaatgaggtngccaactggccaaaacactgtcgtgcaactgctcagttggtaatgctgctcagaccacca

SEQ ID NO: 19112 - DNA, 121 bp, Artificial Sequence
  Synthesized
  misc_feature (61): n=t or g
cagctactccacagagcacagtcgggagcaagaggaaacagatctggaaagaaggcttcancataggtgttatatccatccaagagacagcgccaaaaccagacaaacaacagacatgcat

SEQ ID NO: 19113 - DNA, 121 bp, Artificial Sequence
  Synthesized
  misc_feature (61): n=t or c
caatttgatgcagttctcagctaagctataaatcaaaatttgagggaatactggaactatnctgttgataaatttggcccattatctctattagactctgacggtacccttcagtaggcac

SEQ ID NO: 19114 - DNA, 121 bp, Artificial Sequence
  Synthesized
  misc_feature (61): n=t or c
aacagaggggaaatagacgttggggtaaatatgcgaaagagcacagaagttaaagcactgnaactcaaatgacaagaggaaaaaaagataaggttgcagttctttagtctgctccacatac

SEQ ID NO: 19115 - DNA, 121 bp, Artificial Sequence
  Synthesized
  misc_feature (61): n=t or c
aatacgtctgggtactacagtaaataatcttagagcagaaatacacttacttttgtattanggaaagctacaacataacttcaggcttctctacatagtgttctgggtttcatttatccct

SEQ ID NO: 19116 - DNA, 121 bp, Artificial Sequence
  Synthesized
  misc_feature (61): n=a or g
ctataactgtagcagtatcacagctctccattgctctcattatgattctttcccattaaancagaagtacaaaattcctatcaaagacaattatttctgtcacacaaaatcatatttcttc

SEQ ID NO: 19117 - DNA, 121 bp, Artificial Sequence
  Synthesized
  misc_feature (61): n=t or c
ttaatttagttttgcgtatgggagctctcctgaatttcctctggcactttacaatgaaacnggttagtatttccaattacttgaaggcctctattcagtgtagtgtcaatgaagacagaga

SEQ ID NO: 19118 - DNA, 121 bp, Artificial Sequence
  Synthesized
  misc_feature (61): n=t or c
gaaatcttgtttgtacttaagagaagtaatgaagagatgggcaccttcaccatgtgcatcngaatatctatggacaccttcaccatgtgcgttacaatagcaatggacctgagttgcttgg

SEQ ID NO: 19119 - DNA, 121 bp, Artificial Sequence
  Synthesized
  misc_feature (61): n=t or c
tatctaaaaaaaaaaaaaaaagaatgattgaaaagtgcaaagctgcattatatatacacgnggccaactgtaagttttccctgtcaaacaagtactgtgtacctgctgcaaatgaggtatg

SEQ ID NO: 19120 - DNA, 121 bp, Artificial Sequence
  Synthesized
  misc_feature (61): n=t or g
ttctgacaaagatttattaattaatttatgcttgtgaacaaatgtgtctgacagttgaatnatgagattgtcatattctgtacaaagagcttattctggaaatctactttctgctgcattt

SEQ ID NO: 19121 - DNA, 121 bp, Artificial Sequence
  Synthesized
  misc_feature (61): n=a or g
gttccaaaacacgtttacagaatagagagaataaagcatgaaagaccagaataccaaggcnggcctccaaatcagctagaattttctagaagttagattagatttagctttgaaatgagga

SEQ ID NO: 19122 - DNA, 121 bp, Artificial Sequence
  Synthesized
  misc_feature (61): n=a or g
aaaagctggaggaggtggctctattgcagaagttcccacgtgggttggctgtggtaggtgnatgggtcaagtgagtatgatggcaacatcagccaccaggagggggaaaagcagagtctca

SEQ ID NO: 19123 - DNA, 121 bp, Artificial Sequence
  Synthesized
  misc_feature (61): n=t or c
gttaaagactgcggtaaaatcaaggagcatcctgtctgaatcaatccacaggtgttttttntttccctctccagtcttgagctcttatacctgcaggagattacccgttgctgtcccagcc

SEQ ID NO: 19124 - DNA, 121 bp, Artificial Sequence
  Synthesized
  misc_feature (61): n=t or c
gggcagaatcccaccctttcccagcactgaccactttaactgcaaacactgagctttcagntgttggaaggcagtcgctccttgcttgagtgcacctcaaagtggacgatgtgctcccaga

SEQ ID NO: 19125 - DNA, 121 bp, Artificial Sequence
  Synthesized
  misc_feature (61): n=t or c
gcaaaaacccaacctgcaaagcccctttgaacaaacgaactggaaagaattgtccagaaangaaataattcagtcctatttaaacagacagagtagcttgctgtcttcatcaggagtacag

SEQ ID NO: 19126 - DNA, 121 bp, Artificial Sequence
  Synthesized
  misc_feature (61): n=t or c
tgctgtaaataaatgccatccatccataggccttcgcaagctgtgtctgttcctgcaggcncactcagttcagcagctgtgccttccacactcccacaaatctgggttttccaagacagaa

SEQ ID NO: 19127 - DNA, 121 bp, Artificial Sequence
  Synthesized
  misc_feature (61): n=a or g
ttgttcactactacatctagcacctgcatttttgacattttctcttcacatatgaccacantttctctatggctgatgttagactcattttgaatcttgtctaacaactagtgttcctcag

SEQ ID NO: 19128 - DNA, 121 bp, Artificial Sequence
  Synthesized
  misc_feature (61): n=c or g
gagaagcttactacatctacggcttagagatggtttatgctgtttcatgaaagtattgaanaagctgctgtatattatcttcagtaatgctatgaccctaatgaagtattgagtgtcaata

SEQ ID NO: 19129 - DNA, 121 bp, Artificial Sequence
  Synthesized
  misc_feature (61): n=a or t
ccattataaacagcagaaattcaatttagtttcaattcttgttaatcaaatcatactatangtggcattattacatgtgtcctgtgtgctgtactcatgctggtccctcagatgaggcact

SEQ ID NO: 19130 - DNA, 121 bp, Artificial Sequence
  Synthesized
  misc_feature (61): n=a or g
ttgcacacatgaagttttataaatatgagaataaggaaaactatagtgaagctgcactagnagatgatcattgcaactagaaccttccattcacgctgatgttgcttcaaatggagaaagt

SEQ ID NO: 19131 - DNA, 121 bp, Artificial Sequence
  Synthesized
  misc_feature (61): n=a or t
tataaaaatattgggaactgctgaaaacactgaaaaaaggcaatgaaagcctagagaaaanttctctctaccattgctaatggtctgatgcaatctagagtatcttcattctcatagcagc

SEQ ID NO: 19132 - DNA, 121 bp, Artificial Sequence
  Synthesized
  misc_feature (61): n=a or g
tccttttaattttaggaaaaaacaagtgaagatcaggtctgtaatgtcaaagctttttcantgtatgtatatgacagaaaaacaaaactatttgacggagctgcaccagcaaaatcctgtg

SEQ ID NO: 19133 - DNA, 121 bp, Artificial Sequence
  Synthesized
  misc_feature (61): n=t or c
tataaagcacttacaacatcaaacctaagtacgtttgtgttggcttttaaatgaaactganttctggtgggtctgcagtcctccctgatgcagcaccaggttgtgcctgggagtggagatt

SEQ ID NO: 19134 - DNA, 121 bp, Artificial Sequence
  Synthesized
  misc_feature (61): n=t or c
gcacagcatagcatgtcatgtagcataaatctgcaggaagccagcgtttgtgtggctcctngctcctaatgcatcctgatgccaggtaattagtctgcgccgtctgcatctcttcaaaccc

SEQ ID NO: 19135 - DNA, 121 bp, Artificial Sequence
  Synthesized
  misc_feature (61): n=t or g
cgttcctctcctcagggatgtggctggaagaggacagtggggccagtgagtcccatgggancagactacacaaggcaacctttcccaatgccccagcactgcttgtgcacacagcaggagg

SEQ ID NO: 19136 - DNA, 121 bp, Artificial Sequence
  Synthesized
  misc_feature (61): n=a or g
aaatcatatcagaaaattaagttgtaatatcttggccactatacggagttgctcacaaagnaactgatggatttccctttgcatggatgtcacagatgacacaaattgcagggccaggggg

SEQ ID NO: 19137 - DNA, 121 bp, Artificial Sequence
  Synthesized
  misc_feature (61): n=t or g
aatcctggaatcaccgtttgatagggggtagaaatgtttgttctcaattttgatgactttnggggattttacgtgcacttcagcataataagacatgaagtccagctatcacctaatacta

SEQ ID NO: 19138 - DNA, 121 bp, Artificial Sequence
  Synthesized
  misc_feature (61): n=a or g
tgggctccttcccaggctctcagcaagcagccaggtgtcaatgggagcagttgctgcctcntgtgacagaagtctcaagatttgcagttgaacaggctccaagggcagctaataactctgt

SEQ ID NO: 19139 - DNA, 121 bp, Artificial Sequence
  Synthesized
  misc_feature (61): n=a or t
caaatacagccttacatccagtccatcctcttttccatgataagattctgaatgaagacantcaggttggtcacattccttataatcatatccttgtatgttttttctttatcttcagttg

SEQ ID NO: 19140 - DNA, 121 bp, Artificial Sequence
  Synthesized
  misc_feature (61): n=c or g
ccatttgtttccttgtaatagatgtagttatgccagcttaattcctgttaccttgagcttnccacaacaaatagccaaatagttgtaaaaaggtaagcaatttagtcagaacggtgttgga

SEQ ID NO: 19141 - DNA, 121 bp, Artificial Sequence
  Synthesized
  misc_feature (61): n=t or c
tgaggtggagtcaccctccatatacaataatataaacatacaaatcttccatagtgcatanctctaacagaggtcaaccaggttatcgtgactagatttagacttagaaataaaggcacta

SEQ ID NO: 19142 - DNA, 121 bp, Artificial Sequence
  Synthesized
  misc_feature (61): n=a or g
ggagatctgggagtcaatattgccgggaggcaagggaaggacaatggtaagaagctgtgangagcaatggcacaatttgtaccgtaacagagcggttaaatctacaaagttttgaataaga

SEQ ID NO: 19143 - DNA, 121 bp, Artificial Sequence
  Synthesized
  misc_feature (61): n=a or g
ctgataacctgagtcaaagaattcttgcattaacggcccagaggaaggaataactgttacnaacacctctttcaactccttcaggaccattttgcccgttgctcttaaaataagctcgccg

SEQ ID NO: 19144 - DNA, 121 bp, Artificial Sequence
  Synthesized
  misc_feature (61): n=t or g
tgctcattagtgaaggcagcaagatgctttaggtctgatctgcactgaaagtaatgcaaangtctgactcatgtcttccagaacatagtgctttacattgttatttcaaataagagaataa

SEQ ID NO: 19145 - DNA, 121 bp, Artificial Sequence
  Synthesized
  misc_feature (61): n=t or c
gtcacatctgacacagatatatggggcacacattttgacaatgttctaaccctagagggantgactgtgtaactacttatatggtcctaatcaccaggctatcaagaacctcagttattta

SEQ ID NO: 19146 - DNA, 121 bp, Artificial Sequence
  Synthesized
  misc_feature (61): n=t or c
ctgatatgaaatactaatggaggcttcagtgcaagagttagggctctcctggggatttatngtgttgctttagactggtgagaggcagaagttagcagaaagttgcaagggctgctgcatt

SEQ ID NO: 19147 - DNA, 121 bp, Artificial Sequence
  Synthesized
  misc_feature (61): n=a or g
acggaagagcatccaccaggattctggttttctgtttcttccctctccttcgccaaaatcncttccaaaatgttttctgccctcttcttcccagctcggtgggctgatggtgccccagaat

SEQ ID NO: 19148 - DNA, 121 bp, Artificial Sequence
  Synthesized
  misc_feature (61): n=t or c
tttaaggagaagaaagaatcagaaacagacgtctgatgtttttaaggcacagtaccgtcanggagggatgcatcagtccttcgttgtgaattacacaccttcttgcgttcttggtcaagtc

SEQ ID NO: 19149 - DNA, 121 bp, Artificial Sequence
  Synthesized
  misc_feature (61): n=a or g
gatcataacttaggtttcatgtctatatgttcattaatcttagagcagaaccagctgggcntgttcacttgaatgccccttttctggtctattcttgccactcttgacatttctgtattat

SEQ ID NO: 19150 - DNA, 121 bp, Artificial Sequence
  Synthesized
  misc_feature (61): n=t or g
ctcagcactgcgcggggctcagcactggcagggaggtgcgggtggatatttcctctttccnaaatgctggtggagatgggaaccattccatgccaaggagaggaagagccccacctggggc

SEQ ID NO: 19151 - DNA, 121 bp, Artificial Sequence
  Synthesized
  misc_feature (61): n=a or g
tacagtagtttttcttttttttttcttttttttattttgaacaaatacagatcgtattatnccaccttctttcacaagaaaactgaaagaaacatacggtcaactgggttcttctgctgtg

SEQ ID NO: 19152 - DNA, 121 bp, Artificial Sequence
  Synthesized
  misc_feature (61): n=a or g
taatgataggactaataaagacaaaggatctagcctggtggttaactaaactacatatggncactgtaccaacagcaacctgtggttttgcatacagtatatttttgtatctgtttcatta

SEQ ID NO: 19153 - DNA, 121 bp, Artificial Sequence
  Synthesized
  misc_feature (61): n=a or t
tgtcactgccacttacaacaatgagaagaaaccattcttacacacacccatacacaaacanattatccacagactgcttctttcaaatatcaacttgacaaatacagcacaagttcaaagt

SEQ ID NO: 19154 - DNA, 121 bp, Artificial Sequence
  Synthesized
  misc_feature (61): n=a or t
caaaacgcagtctctgagcacataacatccttacccttctttatgaagcatctctagtacntagtttcaatccttttcgatcctacaggctcaagaagtctttttttggtgttcagagatt

SEQ ID NO: 19155 - DNA, 121 bp, Artificial Sequence
  Synthesized
  misc_feature (61): n=a or g
ttggggatcgtgcagcattacgcaaccgtaaatttggcattaaagaagaggaaaggcaggngggaaaatgcagggaacactgaaatacagggggacgcagctctgtggagtcggttgagtt

SEQ ID NO: 19156 - DNA, 121 bp, Artificial Sequence
  Synthesized
  misc_feature (61): n=t or c
gctctaagtccatgcacatcaaaccttgttgaactgaggttgttaagcacatcagcacttngagccttccgggaggggcagggaagtgttcaaggctgtgatcaaacatttataccaagac

SEQ ID NO: 19157 - DNA, 121 bp, Artificial Sequence
  Synthesized
  misc_feature (61): n=a or g
agctcaaactggtgtggcaaccaaaaaagcattttcatgtgcttcagctcagcgatcttcntcatgctgctgcatgacaactagattcaaggcaaggacgtgcatgtagagatttcgtggt

SEQ ID NO: 19158 - DNA, 121 bp, Artificial Sequence
  Synthesized
  misc_feature (61): n=a or t
gtttcactgtaaaagtaaccctcaactagacatgtgttccatgttgcatcagcatgccacncttatggggtgagcagccagggctgcaagagaaggtgagtttgcatgacacgtgtaggta

SEQ ID NO: 19159 - DNA, 121 bp, Artificial Sequence
  Synthesized
  misc_feature (61): n=t or c
tatacacttttatccagaacattttgcaaggatgaatctgtctactctgcccttagagttngcatagccacgagagaaaaagcagctggaaaaactttgctgttcttaatttgcttttagt

SEQ ID NO: 19160 - DNA, 121 bp, Artificial Sequence
  Synthesized
  misc_feature (61): n=a or g
taaacaaacagtgccaaagatactaagtctttccagaatgggctcctccacatggctttanacttaaaattaacttcttgacctgaatcactgtccttggtttctgcaacctgattaaatg

SEQ ID NO: 19161 - DNA, 121 bp, Artificial Sequence
  Synthesized
  misc_feature (61): n=a or g
aaaataaattctggtgatttgagaggcagacagacttttgtccttgaagtgattttaattntatctgattttcataaggaactgctaagggagaaaaaaaaacacataacagaattatatt

SEQ ID NO: 19162 - DNA, 121 bp, Artificial Sequence
  Synthesized
  misc_feature (61): n=a or g
cacgtgggtgtcacacagtctggtgctttccgtccaccttggtggaatgatgttggctgcngaccagggagaaaataaagcacaggctctggccctggagcttctgtcctctgctcagtgt

SEQ ID NO: 19163 - DNA, 121 bp, Artificial Sequence
  Synthesized
  misc_feature (61): n=t or c
ggtgtttggtctgtgtttttctccaccggtctctgcactgatattactgaagttcacctcngtgtatggttgcttttgcatctgtcccaaagctgtgtttgtccctttgttaatctgtagg

SEQ ID NO: 19164 - DNA, 121 bp, Artificial Sequence
  Synthesized
  misc_feature (61): n=a or g
ggccatgactgtatatcaaatgcgttaaattctcagagataaaataatactatcatatcangattgaaaacataatactaagcaggggctcagaagtttccttacatcatagcttgctttg

SEQ ID NO: 19165 - DNA, 121 bp, Artificial Sequence
  Synthesized
  misc_feature (61): n=a or g
tctcagtgagccaagttattttaaaggcttatcataccctgatatctgataattattgtcnttgagcttgtctttctttaagcatggcagagatggacatcgttagatggaatcattactt

SEQ ID NO: 19166 - DNA, 121 bp, Artificial Sequence
  Synthesized
  misc_feature (61): n=t or c
ctttgcagctctactctggagttaaaagtgcctttttttccccaataattacttgtattcnggtttttaagactgccgttatatatgatctatgagacatttgagttagggacaaacctca

SEQ ID NO: 19167 - DNA, 121 bp, Artificial Sequence
  Synthesized
  misc_feature (61): n=c or g
ttatctgtagtaaacaaactgtatacatgtgctgccatgaacgggatttgatgcaaccctnttgaaggcaaagggaagagtctttatcagctttaaaacaaataaaattgggatctaaatg

SEQ ID NO: 19168 - DNA, 121 bp, Artificial Sequence
  Synthesized
  misc_feature (61): n=a or g
caccattgtgcctttcagactagcaccagaggtcagaacctccgttttaggtttcattcancagatggcatctcttgcaacactatatcttctattattggtcacagtattagcacttaca

SEQ ID NO: 19169 - DNA, 121 bp, Artificial Sequence
  Synthesized
  misc_feature (61): n=a or g
tgacttggactctgaatctaaaccaaacaaataccttgctttgtgcccaattttccaaatnttttctgtatttctatggtttgtatcttcagaaaccaatgctgaatttgcacgccaagac

SEQ ID NO: 19170 - DNA, 121 bp, Artificial Sequence
  Synthesized
  misc_feature (61): n=t or g
gtttcccctgttctctttttctgccaagttcagccatatatcacttttatgcacccaaagnccacagtgtaatgcaatatgaagccatgaaggggataaagttacatattctccattgatt

SEQ ID NO: 19171 - DNA, 121 bp, Artificial Sequence
  Synthesized
  misc_feature (61): n=a or g
tgaatcctttatctggtgtagtattttgctaaccctctttccactgtgttgtagcctgggntagttgaacagttcagtagtgtggcccatattctcaaaattggaggcacgggccttgaac

SEQ ID NO: 19172 - DNA, 121 bp, Artificial Sequence
  Synthesized
  misc_feature (61): n=a or c
tatctatctgaacattggcaacgttgcatgcctacaacaccagggctagaaatagtatttnaattacttgacctctaaaaactaagaaaatggagagagaacgttcacctccccgtgcagc

SEQ ID NO: 19173 - DNA, 121 bp, Artificial Sequence
  Synthesized
  misc_feature (61): n=t or c
ttctcaagcaagttactgttcctctgtattagctcctcacttgtgtaatggtaactactcntgcatgtagacttctcatctgaaagttcaggaaccaaactgttatagtagctgagatgtt

SEQ ID NO: 19174 - DNA, 121 bp, Artificial Sequence
  Synthesized
  misc_feature (61): n=a or g
attacagacctagcagaattgttattttcttgaataaagatcgcctacgtaactatgcctntcactggcaagattcttatgaatgttgtgaacgtcaagcaccacgttaggataaagatct

SEQ ID NO: 19175 - DNA, 121 bp, Artificial Sequence
  Synthesized
  misc_feature (61): n=t or c
aagttaatataccggtgtctgattatatcaatcaacataactccattgttttcagtaaganagagttacagggaaccttcgtttacagtgaagacttagcacttttgtgtggctcatgttt

SEQ ID NO: 19176 - DNA, 121 bp, Artificial Sequence
  Synthesized
  misc_feature (61): n=t or c
gtactttgcctttttagctgtatatctgatgaacttttttctgttcttaaaggagttcagngcagttaggtgaggttagaaaatgttgtgccccttattacttgttactaagcagcttttt

SEQ ID NO: 19177 - DNA, 121 bp, Artificial Sequence
  Synthesized
  misc_feature (61): n=t or c
ggcccatgtgaggatccgtgcaaggactgatcctgcagcgggatccctgctctagtcggtnctgtgtgagtattagggatctgaccaatcccatgggaaagtccatgtattgaccaatccc

SEQ ID NO: 19178 - DNA, 121 bp, Artificial Sequence
  Synthesized
  misc_feature (61): n=t or c
cttattccctgggacaagtgagtcacattttttccagaaccacttgttctttttcactacntaaatcagattctctcctggcaaggcagatatttctgtcttagctgtttcttccttctaa

SEQ ID NO: 19179 - DNA, 121 bp, Artificial Sequence
  Synthesized
  misc_feature (61): n=a or g
ccttgaaggttctgtgctgctgctgctgccatccgcgcacgcatggagcatcacctcactntccctcattcaggatgtggtataaccccgattattcttctcctttctccagcatgtttcc

SEQ ID NO: 19180 - DNA, 121 bp, Artificial Sequence
  Synthesized
  misc_feature (61): n=a or g
gaagaaggattttactgtcactgcaagtgttttaaaataaatgggccttttggtgtcctangggaaatgaaaacattgttctctttcatgggtgggtacaaattttcagtgttgttaattc

SEQ ID NO: 19181 - DNA, 121 bp, Artificial Sequence
  Synthesized
  misc_feature (61): n=t or c
taatgtttgcagctggatataacatatgcacgggacaagtgccagcttgcagggaggattnctagcactgaagaccaagcgtgttccctaatgaaatccatatagcattaagaaggatggt

SEQ ID NO: 19182 - DNA, 121 bp, Artificial Sequence
  Synthesized
  misc_feature (61): n=a or g
tctttgctgtctacctccgaaagcaaaggatgaaagaaattaatcacaaaacatacagggntctcctatagggaagggaaagctacaaaaagaaatataaatataaacaaatatatacata

SEQ ID NO: 19183 - DNA, 121 bp, Artificial Sequence
  Synthesized
  misc_feature (61): n=t or c
catttggctgggtcaacagaattttctggtaatgaaagtaacagtagttaaaatcaagaangcccagatcgctgcattacctggaacaatcattcaatccaatacaacgataacccttgat

SEQ ID NO: 19184 - DNA, 121 bp, Artificial Sequence
  Synthesized
  misc_feature (61): n=a or g
tagagtcagcacaagctgactctgaaaaccctttagctctgaaccctccagcagtcacttnaagaaatgcatgtctggatccgaacaaaactggcttcagtggtaatacagaacaaggagc

SEQ ID NO: 19185 - DNA, 121 bp, Artificial Sequence
  Synthesized
  misc_feature (61): n=a or g
atttttttagcctacagctttatttcaaagtcaggatggaatggggttcaaacctaagaangattcatgatcataaaatcaccattcttgtgcaaagagcttcattttctagcagaacacg

SEQ ID NO: 19186 - DNA, 121 bp, Artificial Sequence
  Synthesized
  misc_feature (61): n=a or g
agtggtccagtgctacctacaatgctttcctgtggacaggagctgagaatcggcccagggnaagtaaggaccacaggtggtgggtacacaatggctctggagtcattgcaggatgtcacac

SEQ ID NO: 19187 - DNA, 121 bp, Artificial Sequence
  Synthesized
  misc_feature (61): n=t or c
ttgctacttacataggagttctatgaatgaatagcagtaactgacaaagatggaggttttncctcatctttatttgcagcattagcagaaaaacccacaacacaattgtcttctggtgcac

SEQ ID NO: 19188 - DNA, 121 bp, Artificial Sequence
  Synthesized
  misc_feature (61): n=t or c
cacgaacagaggattacgcattcctgattgtgaaatccccagaaacagcaaacaaggctgngcagtctccatgcagaacagccagcagggagccacttcacaagggacttacttggccgag

SEQ ID NO: 19189 - DNA, 121 bp, Artificial Sequence
  Synthesized
  misc_feature (61): n=t or c
atttctgtgaattatctttttctcatggctgaataagagattctttggtaaatccagtatnactggactattaatgtatgtttgagatagccatagacacaatatgcatagtgttttagtg

SEQ ID NO: 19190 - DNA, 121 bp, Artificial Sequence
  Synthesized
  misc_feature (61): n=c or g
actgcaaagaatgctttaattacccttttcagaaggaagaaagcccaacattgagcaagtnttccttttggcatcaaagcacaaatgccagagaaaaataatgtacacacaactcaaatct

SEQ ID NO: 19191 - DNA, 121 bp, Artificial Sequence
  Synthesized
  misc_feature (61): n=t or c
aagggcagcagggctgctggcccaatgcctgatttgacctataaggctgatgggacccttnaaacatagagaggttttattagaaagaattagtcatagtatcgagggactctgtcattcc

SEQ ID NO: 19192 - DNA, 121 bp, Artificial Sequence
  Synthesized
  misc_feature (61): n=c or g
tttcattgtttaaacaactctgcatgataagctcatcacctttgttcccggattctacagnaccttacaagacttaggaaaagcaataaatctggggtaattaggatgccttgcagcattc

SEQ ID NO: 19193 - DNA, 121 bp, Artificial Sequence
  Synthesized
  misc_feature (61): n=a or g
tcctcaccttaccagtattgctgggtttttgtgagtggaggagaaatcagtgccatgtacntatgcctgtgctcaaatttggtatctgacttctttttcttttttcagtaacttcccttta

SEQ ID NO: 19194 - DNA, 121 bp, Artificial Sequence
  Synthesized
  misc_feature (61): n=t or c
gggtctgctagggtactaaataccttgtattttaatcagtagtttgggttttctaatgtanagctagtctttacctttccagctttagaaggtactcaggcttagtgctgcagacataaca

SEQ ID NO: 19195 - DNA, 121 bp, Artificial Sequence
  Synthesized
  misc_feature (61): n=a or c
gattatctcatctgggaccagaagatgattcaccaataccatcataagacaatttacttcnaaacacctacaatacttagccaggttttagagttgtataacaccgtgggttgttgatttg

SEQ ID NO: 19196 - DNA, 121 bp, Artificial Sequence
  Synthesized
  misc_feature (61): n=a or c
acgtaccttgttatagagtagatgggcacaaagtgacagcccaaacccgaggtgcatcccntaccacgaggcagcattataaatcactcccaaagatgcatctgggcaatctcagggcccg

SEQ ID NO: 19197 - DNA, 121 bp, Artificial Sequence
  Synthesized
  misc_feature (61): n=t or g
actgttgtgctgggggagaatgacttgccctctggaggcgtaaataagagacagacttgtngtgcttcctgtagtcttgagagaggggaaataaacaggacaggtgatgtggtgactggct

SEQ ID NO: 19198 - DNA, 121 bp, Artificial Sequence
  Synthesized
  misc_feature (61): n=t or c
aagaggatggctctccagagcactcatcccacctgtgcaccatgcagcgctggaaacttgnagtattttatatcagaagtctcacatttgacattttcattgagttcctgcttcatatttg

SEQ ID NO: 19199 - DNA, 121 bp, Artificial Sequence
  Synthesized
  misc_feature (61): n=a or g
caggaagcagcagtattcagagttggaggggggagatccttatcgcagatccttatcaccngcacaaaattgacaaatctctgtgtttaaaaatagttgtacctcctttccattttcaggt

SEQ ID NO: 19200 - DNA, 121 bp, Artificial Sequence
  Synthesized
  misc_feature (61): n=t or c
aaagggaggaggaatgattctgtcagttgcagtactggcagtttttcctagctttttcatngcttaatttgcagtattctgaagtctttcagttggtattttttattcttagaaattgaca

SEQ ID NO: 19201 - DNA, 121 bp, Artificial Sequence
  Synthesized
  misc_feature (61): n=a or g
acatactggagtccagcaaagggttaccaagattattagaagtctggagaaccagtcctangagtagaggctgagaggtgggactgttcagactagacaagagaatgtgtgggagcagatc

SEQ ID NO: 19202 - DNA, 121 bp, Artificial Sequence
  Synthesized
  misc_feature (61): n=a or g
ttgtgcttttgggagggttcatcttctgtcgggtcactgaactgattcagctcacaggacnagagttcacaaaccagattctcatcttatgagagtagtatgtttctttcattagcttgaa

SEQ ID NO: 19203 - DNA, 121 bp, Artificial Sequence
  Synthesized
  misc_feature (61): n=t or c
ggtccaagactttcctccatgattaggagcctcctgctcctccctgtcactcagctttgtngtgttctgcctggcttcaaagccttgcttaggaggtgggaaccagtgagatgaaaatata

SEQ ID NO: 19204 - DNA, 121 bp, Artificial Sequence
  Synthesized
  misc_feature (61): n=c or g
tataaaaaagggacatttatacaggacagatatttcaaaatttagaagcaggatagctgtnataagctcagcagaaaacacatgctgccctgcaatgaaaaacatagaaatttgaggactc

SEQ ID NO: 19205 - DNA, 121 bp, Artificial Sequence
  Synthesized
  misc_feature (61): n=a or c
gagagaccaccacagggaaggaaatgtatgaagagtggggagggggattaatccatccctnagtgctttggaacagcccaactccagtgctcacctacagcacaggaacagagcccaagat

SEQ ID NO: 19206 - DNA, 121 bp, Artificial Sequence
  Synthesized
  misc_feature (61): n=t or c
cacaaattaatgtacaactcttatctgaaaatccacagtgcctgttaatattaattggttnctttgcttccagagttgacggtgaaattaagatgccagttccatttgtaatacttcacag

SEQ ID NO: 19207 - DNA, 121 bp, Artificial Sequence
  Synthesized
  misc_feature (61): n=t or c
ctgtctttacggtcaagtttcttgtttgagttgcatccatcctcaatatcctctgaggacntgtaatgcctttccctgatactttaatgaatcacgcattcctgacttaattatattatac

SEQ ID NO: 19208 - DNA, 121 bp, Artificial Sequence
  Synthesized
  misc_feature (61): n=t or c
atgaaagacaacataatttaacctgctgtaatgtgtggagtcaagggcatctaatacttanggaaaacagaagatctagttgataaaatccagatgttccaaagctatttctttcttgatg

SEQ ID NO: 19209 - DNA, 121 bp, Artificial Sequence
  Synthesized
  misc_feature (61): n=a or g
tgaaggttatttgctgttcactgcaagttatcttcaggtgtactgcaggctcactcatgtnattttctgttaattacttatttgctcatgtaacattgctaataaagagaataggaggaca

SEQ ID NO: 19210 - DNA, 121 bp, Artificial Sequence
  Synthesized
  misc_feature (61): n=t or c
ctgctccccttttgtcctgcacataccctcacagcttacaaagctctgcagtttctacagngcccaacccaaacttttcccaccaccttcacaggcttatcagatccaaagtccaagctga

SEQ ID NO: 19211 - DNA, 121 bp, Artificial Sequence
  Synthesized
  misc_feature (61): n=t or c
acagagcaataggaagccctgtggtacgtgtctgaaagaaagcaccgtgcttccctcctcngctctgaggatgggacgtgccaccaagcaaccacctcttaactgaaagctcgaggagggg

SEQ ID NO: 19212 - DNA, 121 bp, Artificial Sequence
  Synthesized
  misc_feature (61): n=t or g
actgtttattggagggtaagaggaaagggccaattgcaagtgacttcagcagagccttccnccgcagattagaaggcgttacgccgtgcacaaagcaatcctgctttctgtttcacactga

SEQ ID NO: 19213 - DNA, 121 bp, Artificial Sequence
  Synthesized
  misc_feature (61): n=a or g
gtaggtgtgggtgcaggctccctcctggctgttgcaagatgtagcttggatctgcccactnttccttagcacgctcacctgcttgtttgcatatcccataagtccgtctggagccagtgct

SEQ ID NO: 19214 - DNA, 121 bp, Artificial Sequence
  Synthesized
  misc_feature (61): n=t or c
agatgatcccagggggtacgtggatccctgggttgcagtgttttggctgccatcagagtangccctttcccatctctgcaggctcttaaagtccagcagcccccaggagttcacagaaaac

SEQ ID NO: 19215 - DNA, 121 bp, Artificial Sequence
  Synthesized
  misc_feature (61): n=t or c
atctaattctcatcaagcaaaacattagcagcaaaacctcaaagcctcaaatcattaaaanggaaggtgtaagctctcttctctttcttgagataaactgtaagttttgtaagcatacaaa

SEQ ID NO: 19216 - DNA, 121 bp, Artificial Sequence
  Synthesized
  misc_feature (61): n=t or c
tgtacttgctgtggagcccagttcttcactaattgaactgaaaagcagagcttccgtggtnacccgtttatgttctcaatctaagctgtaccagaaaccccatggctggttgggattgcag

SEQ ID NO: 19217 - DNA, 121 bp, Artificial Sequence
  Synthesized
  misc_feature (61): n=c or g
atacatcatccagctgagggttgatattgcttctatcacaacctgccgacacatctctganatttccatctgctgcactttgctgagtcccacattctcttgactaatcacacatcccact

SEQ ID NO: 19218 - DNA, 121 bp, Artificial Sequence
  Synthesized
  misc_feature (61): n=t or g
aggggattttctccataactacaacacatttgggtcagaagctcaacaaatatccctgtgnggtgtgagctgcaccaaaggcaacgatctcagttaagcagcctcacattgtgtcctacag

SEQ ID NO: 19219 - DNA, 121 bp, Artificial Sequence
  Synthesized
  misc_feature (61): n=t or c
atcagtagggatacccacagttagaaagttcggtttgcagaaatggtattatgctcccttntttttgtgcttgtcctcattggtgccagattattttcataggtatgaggcaacaacagtg

SEQ ID NO: 19220 - DNA, 121 bp, Artificial Sequence
  Synthesized
  misc_feature (61): n=a or g
gcacgtagggaagtagcaatgaaatgcggagtgcgcaaaggggagatgaggaggcattcgngagaaacctgaccagatgaaatagcagtgtgctggggctggaaagctgtggggtgtagtc

SEQ ID NO: 19221 - DNA, 121 bp, Artificial Sequence
  Synthesized
  misc_feature (61): n=a or g
gcccacagctcctgcttgggttgcatcattccccctttggaatctgtaatagagacctgcnctcggtggcactgtacccactgctggagctgtaagggcacggacagcgagggtggaggag

SEQ ID NO: 19222 - DNA, 121 bp, Artificial Sequence
  Synthesized
  misc_feature (61): n=t or c
attgtgtcccttttccttttcagaatctgaatggatttattataataaatgatgtgactcngaggataaccttgctaatgtgttattacttgtaagagaaaaggaagagatctttctccac

SEQ ID NO: 19223 - DNA, 121 bp, Artificial Sequence
  Synthesized
  misc_feature (61): n=t or c
gtagcatgatgttgcagtacaattagaggaactattcctgatcctgtctgcctttgctatngtttccagatctctgctcggtaatctgcttggtgtcctctgaaaagacacgaatggtgat

SEQ ID NO: 19224 - DNA, 121 bp, Artificial Sequence
  Synthesized
  misc_feature (61): n=a or g
aagcccaacctcagtatttttgacttttgtgctgactatttgggcaggcgttagaagatgntactctagcagctcctgtttgatagcattttttaaccctgcctctaagaagacatgatca

SEQ ID NO: 19225 - DNA, 121 bp, Artificial Sequence
  Synthesized
  misc_feature (61): n=a or g
ctgctgctccactaaacttcagtgtattacttcagaatgaacacaagtgttaaaagcactnaggtgatgcaaaaaggctaatgagaatcctctctgtaacagttacatacaaagggcacca

SEQ ID NO: 19226 - DNA, 121 bp, Artificial Sequence
  Synthesized
  misc_feature (61): n=a or g
cattcttctctaaataagttaaaccctgcttgctatgaaaaaaaagatatacttcaaatgnaggatgattaaggaatttgaatctgcagtttctaaagaagttggcagaaggaggcctctg

SEQ ID NO: 19227 - DNA, 121 bp, Artificial Sequence
  Synthesized
  misc_feature (61): n=a or g
ccaaaagaattggagctattctggagatactgtaagaaagctacaggagagcccagtattntttcaagcgtgtgctgttcttctactgtgtttacctctagtgtagctcccagatgcgagc

SEQ ID NO: 19228 - DNA, 121 bp, Artificial Sequence
  Synthesized
  misc_feature (61): n=t or c
ttaaggaattaagtttaaatatgatttccccttccccatagtagcaatggattctttctcnaaatgaaaactaaggagagtgtacctggtagctctgatgcacatctcattccttgatagc

SEQ ID NO: 19229 - DNA, 121 bp, Artificial Sequence
  Synthesized
  misc_feature (61): n=t or c
actttgctctcttaatttcagagggagctagacagcgtaggatgctgagtgctaagactcngttttgtcctaatcctgcttgtttcaaggcagggaatgaagcctcggccccttaggggat

SEQ ID NO: 19230 - DNA, 121 bp, Artificial Sequence
  Synthesized
  misc_feature (61): n=t or c
acctcagagggatcaccaaagttttccagttgcatgtaatcatcaaccatttcactatgangttcagctgtcacctgcattacaaagaagcccacttatgcccccaaatgcattgtgatac

SEQ ID NO: 19231 - DNA, 121 bp, Artificial Sequence
  Synthesized
  misc_feature (61): n=t or c
tgttgttcggcatgcacgagggattgcgcatagagcaaacagtatcccctgtcgtccggtnggctttgcttgcagagccgtgctggagctgcatgggattgttgctcgcctcttctgcgtt

SEQ ID NO: 19232 - DNA, 121 bp, Artificial Sequence
  Synthesized
  misc_feature (61): n=a or t
agtattaatacagagttcaataattttaaggagttaatgatctttgaaacagggatgtctntccataacttgtatgccaagatagtgactagcactataaacccttacatttgataatagt

SEQ ID NO: 19233 - DNA, 121 bp, Artificial Sequence
  Synthesized
  misc_feature (61): n=a or t
ttcctgttgatttaggagctttagagttcgccagggagttcatctaacttccagaaccagnagcagacattttttggtgccattttccttgctggagagttgacatttgtgtaactaaaag

SEQ ID NO: 19234 - DNA, 121 bp, Artificial Sequence
  Synthesized
  misc_feature (61): n=a or g
cctggcctccaggctggttctggctttttgagctgccatgaataattcaagaactcaaatngctttaactgtgtggattatttagtgtatacattgaaatttcttctttccctgacagggg

SEQ ID NO: 19235 - DNA, 121 bp, Artificial Sequence
  Synthesized
  misc_feature (61): n=t or c
tttatccctaatcctaactcaaatgataacccttaacctaactctaattcatcccaacccnaacactaaaccttaacctaaccttaagcctaactttaaccctaacactaacactaacctt

SEQ ID NO: 19236 - DNA, 121 bp, Artificial Sequence
  Synthesized
  misc_feature (61): n=t or c
accccatcttgatccattttctgaatgccattatcttctgtcatgtgtgagacaaagatanggagaaatgtccccttggactgaaccttgtgagtcttatctcattgacgaacaacttggg

SEQ ID NO: 19237 - DNA, 121 bp, Artificial Sequence
  Synthesized
  misc_feature (61): n=a or g
aatttcatggtctggtttttttttccatgaaggttttaacttagcaaatagctcaaatgantaatgaaattcatcacaaaaaaaaatgctgattctgagcctagctgattatttccagcaa

SEQ ID NO: 19238 - DNA, 121 bp, Artificial Sequence
  Synthesized
  misc_feature (61): n=t or g
ttaagaatttaaatcttattctacacattcagctacaggaagaagatagttctaaatgaanttttttctcactaagacttgaaagttttaactacatgctcatattaagttggggatatga

SEQ ID NO: 19239 - DNA, 121 bp, Artificial Sequence
  Synthesized
  misc_feature (61): n=c or g
agatttctgttggtatggcatggcaagctgatggcacaggttgaaaagatccatgggattnggcagtcaagagtgaaaaaggaaataggggaagggtggatactactaaacatatctcacc

SEQ ID NO: 19240 - DNA, 121 bp, Artificial Sequence
  Synthesized
  misc_feature (61): n=t or c
ccccaattctcctcttcggttcccactcacactccctgcacaacttcagggcacccttttncccaagtcttctgctttttgatattggggatccgagagtttcttgaacgagaaagaaata

SEQ ID NO: 19241 - DNA, 121 bp, Artificial Sequence
  Synthesized
  misc_feature (61): n=t or c
cttcccgtacaccaccgccatgctgcccactttgttggatttgatgcgctgcctctcggtntggttgagctcctccgacacgaagcccatgaaggaattgtccggggtgtgcgctgcggac

SEQ ID NO: 19242 - DNA, 121 bp, Artificial Sequence
  Synthesized
  misc_feature (61): n=t or c
cacttctgggttcccagcattctcgcctcctcaagcagcagagaactgtcagatgccacangttccctaggatatacacaagggacatcctttcctttccaaaccatgccacaagacaagc

SEQ ID NO: 19243 - DNA, 121 bp, Artificial Sequence
  Synthesized
  misc_feature (61): n=a or c
acagggtcaaaaaactttaatggaggttttaatgcaagttcagcaaatctgttatcttaancaggtcagcaaatcttctaatctcaataaggatgttgtcccatgttgggtgccaatgtag

SEQ ID NO: 19244 - DNA, 121 bp, Artificial Sequence
  Synthesized
  misc_feature (61): n=t or c
ccctactgttgaaaacaaagcaatcagaccatagaagatattgacttttatatctgcacangctaggttcatgatatcaggatggaagcaaaaagaatgagagagctcagtcttcccacag

SEQ ID NO: 19245 - DNA, 121 bp, Artificial Sequence
  Synthesized
  misc_feature (61): n=a or g
ggagatatttgaatcatcacatcgaaagatcactacgaggccatgacattattatttaaanattgttcagagaaggactcatgtactatcccatgttttcttcccatccaacctcaccaaa

SEQ ID NO: 19246 - DNA, 121 bp, Artificial Sequence
  Synthesized
  misc_feature (61): n=t or c
ccaccaccctctgggtacgatcctacaaccagttcttcatccatcgaacaatctacccatngagtccatattgttccaaaatggagagaataatgttatggtggactgtgtcaaaggcctg

SEQ ID NO: 19247 - DNA, 121 bp, Artificial Sequence
  Synthesized
  misc_feature (61): n=a or g
aaatgtctcagaagagaataattgaaacatcttcaaatcttaagtacattatgcacagccngggactgcatgtgtgggtactgcacagacaatagacattttaatacatttaatacattta

SEQ ID NO: 19248 - DNA, 121 bp, Artificial Sequence
  Synthesized
  misc_feature (61): n=a or g
atagcataactatgtgactgtttaaaaattacttacctacagttaaactgacagagaatgncacagctcacctgctacttaggagagctgatacgatcctgaatctcttctctcctgcttt

SEQ ID NO: 19249 - DNA, 121 bp, Artificial Sequence
  Synthesized
  misc_feature (61): n=t or c
cagagaaagcacgtgcctcctcccacagcccaaagcacacaccgtgcccagccttccagcnttcagttttgcatgattgaatttggacctgtgcctgctcttgccatggtggttactaaat

SEQ ID NO: 19250 - DNA, 121 bp, Artificial Sequence
  Synthesized
  misc_feature (61): n=t or g
aataagtctgtcctacctgagggccgagtttcagtagatatcaacaccagctagacttttncctgcagaaattaagatcacgtaagcacggagtgatgatgagaaagaggacgctcaaacg

SEQ ID NO: 19251 - DNA, 121 bp, Artificial Sequence
  Synthesized
  misc_feature (61): n=a or g
gcaacaaaggaaagaggcttggatgtatttcagtcatcaattagacaaaaatcaaatgtcntacttgggggctaacaggaaagacctttccagtacaataacgaagtggagatgatatttt

SEQ ID NO: 19252 - DNA, 121 bp, Artificial Sequence
  Synthesized
  misc_feature (61): n=t or g
tacaaaggttgaaaactttcagctcttctgtactaagcaaagtagcacattagccttcccnaagtcacatcacacctgatctaaaatacacagtaggagaaaaaaatgtctgttacagaat

SEQ ID NO: 19253 - DNA, 121 bp, Artificial Sequence
  Synthesized
  misc_feature (61): n=c or g
cacatgcttgacccacagagtacatggctgtctctgagcacctgcagcaaggcaccagacnccttaactacaccctggttattttccatggtaaatctttagatgaaaaatttaagggagc

SEQ ID NO: 19254 - DNA, 121 bp, Artificial Sequence
  Synthesized
  misc_feature (61): n=a or c
attagttagaagagataagtggcacaggaagcaaagaatgtatctagattttcagatgagnatcatccagtagctgtaagcaagatagcctatgctagttctcctgttttcttttcttttt

SEQ ID NO: 19255 - DNA, 121 bp, Artificial Sequence
  Synthesized
  misc_feature (61): n=t or c
ctaaaattggatatatagctaaggtatgtctcaaaccttccatgacaaattcatctgtganttattacagttcacagtgacagtagtttacatcatggatacatactctggttgctaaaag

SEQ ID NO: 19256 - DNA, 121 bp, Artificial Sequence
  Synthesized
  misc_feature (61): n=c or g
ccatgtgctctcaccatactgtctgagtggcttcaacaccaagctatgaattttaaggcantgttgtttgtagtatggtacacagtccctcttacagataatgcaatgctgagctggctga

SEQ ID NO: 19257 - DNA, 121 bp, Artificial Sequence
  Synthesized
  misc_feature (61): n=a or g
aagacacctttctgtaagcttagagctgtgtgttctggctgctcctggagtggtctcctcngggaaacacagcacaggcacacagtgagccaaggctgggaccaggagctgagctggggct

SEQ ID NO: 19258 - DNA, 121 bp, Artificial Sequence
  Synthesized
  misc_feature (61): n=a or t
ttgttctggaattgtttttattttttggaggggaaaagataaaatgataaccagaagggantgacaaggagttattgtagaaagtgtcattgttttggttgatatggagttcatttgcttc

SEQ ID NO: 19259 - DNA, 121 bp, Artificial Sequence
  Synthesized
  misc_feature (61): n=a or g
ggcatttggtttgtgcttcaggagacttgcctggtttcactgaacttaagggcagtcttcnttagtctttcagcactgcctagtattattcatcctcattcttcctggttgaaagcctcta

SEQ ID NO: 19260 - DNA, 121 bp, Artificial Sequence
  Synthesized
  misc_feature (61): n=t or c
agctataatgtgttggattatttcggctttttttggaccaactgaaacctttggacacttnacattcttgactttgagttctttggtcttgaattgacctattcgcaggtcactttgtgac

SEQ ID NO: 19261 - DNA, 121 bp, Artificial Sequence
  Synthesized
  misc_feature (61): n=t or c
ttcacaagagggaattatacaactgtatgagggtggcagcaatcacacagccacaggggantcctgtaaagcagggctgagatgtgagatgtctggggctggactgggaagcatctgtgac

SEQ ID NO: 19262 - DNA, 121 bp, Artificial Sequence
  Synthesized
  misc_feature (61): n=t or c
aacatttttccaaagcttcagctatgatttcccaatctgggtggatccagatctttgagcngcaactctcaaggttcccttaagagctgtaacaatttttaatttgggatcttaagttatt

SEQ ID NO: 19263 - DNA, 121 bp, Artificial Sequence
  Synthesized
  misc_feature (61): n=a or g
ttggcaaagtctctggagaatcttcaggttgagcatttcctttttgtttggcccagtgaanggttcaggcaaacttccattgttgtcttcttacaacttaatacaaaagcatgcaactgaa

SEQ ID NO: 19264 - DNA, 121 bp, Artificial Sequence
  Synthesized
  misc_feature (61): n=a or g
tgttgactaatttgtaagcagctgctgactcagcaatctgggggacagcttctctcaagcnctcaagtgcattggaagtaaatggctcttattgttctttccttcccttcactccggtgtc

SEQ ID NO: 19265 - DNA, 121 bp, Artificial Sequence
  Synthesized
  misc_feature (61): n=a or g
tcacagaaatgatatactagtttacacgacttgtgcgatcaacaaacaggaagaaatcagntcaatttaaagagaattgtagcagactaataatatagatttccttcattttttttttact

SEQ ID NO: 19266 - DNA, 121 bp, Artificial Sequence
  Synthesized
  misc_feature (61): n=a or g
ggaattgttcacatatcggctacgtatcctcatttgccttctatctttacaacaacgcacntgtctaacaagcttccagcttttgcattttgcttctccgcttaaggaaatatccctttcc

SEQ ID NO: 19267 - DNA, 121 bp, Artificial Sequence
  Synthesized
  misc_feature (61): n=a or g
aaatcaaagttgggaaacaacattcatatagttcaagctgaaaaaatgtaatcaatattgnctcttctgtcatgtgggagggactggtatctatcaaatctactagtggtagctggaataa

SEQ ID NO: 19268 - DNA, 121 bp, Artificial Sequence
  Synthesized
  misc_feature (61): n=a or g
caattaaaatcagttagcagtagtatcaatacagattgcagctatcgattcgaacacaacnagaagagactggagtagtcaacagatcactctaaagagaaatatgccctggcagcagagg

SEQ ID NO: 19269 - DNA, 121 bp, Artificial Sequence
  Synthesized
  misc_feature (61): n=a or g
tacaatttaaaaaaagaaagaaagaaagaaagaaaaagaagtgaaaggaaaaagctctccnctcctgctgtgcactaaagatatcaaagggtttgtcaggtgcccttgaaggagtcctgaa

SEQ ID NO: 19270 - DNA, 121 bp, Artificial Sequence
  Synthesized
  misc_feature (61): n=t or c
ttggtctgatgtggcttaacagtgatgcaattgctcctggtagccacaagagaacttttcngaacatggtggctatgtcaggattacagagcctctgggttcatgaatagatccatcattt

SEQ ID NO: 19271 - DNA, 121 bp, Artificial Sequence
  Synthesized
  misc_feature (61): n=t or c
ggttgaatacagtcttactgtgttatgccagggctactcaacttatcccaagatccacttncatggaaatagttataacactgctgtaaaatttgccttttaaacttgggccacgcacaca

SEQ ID NO: 19272 - DNA, 121 bp, Artificial Sequence
  Synthesized
  misc_feature (61): n=a or t
gggggtagaggggtagaattagagaagatcttgcaaaagaatgaagatccagacccctgtngggaaggcatggccgtgtgcctcttgctcccacccaccttgtgggctttgggacatcagg

SEQ ID NO: 19273 - DNA, 121 bp, Artificial Sequence
  Synthesized
  misc_feature (61): n=a or g
cctgctgcgtggggccaacgttggctttcaccttgggttatgccagttgtctgcgggcagngtaaagcagaggctggctctttggaggtggcactgaaggattcccaatgcgttccctatc

SEQ ID NO: 19274 - DNA, 121 bp, Artificial Sequence
  Synthesized
  misc_feature (61): n=t or c
cctgtactgacagcattcattaaacaagcagtgctggaggaagtcttccatctagtctttnaccctgctgtgcgtaaaaaggaactggcaccaaatgacacatcaactttctatagtggag

SEQ ID NO: 19275 - DNA, 121 bp, Artificial Sequence
  Synthesized
  misc_feature (61): n=t or g
gtttttttttgcttgtatggtgtggttcttctctctctccaaatcccatccacgtataganaattcacgtgacttgagtaattttagataaacacaaaaatattaatttttgagagaaact

SEQ ID NO: 19276 - DNA, 121 bp, Artificial Sequence
  Synthesized
  misc_feature (61): n=a or g
cctgggcagccttttccagtgccttgccaagaagattctttgttgaggggaaaacactgtntgacttttatagagatgtttccttttgtcttctgctgtgaaactaactgcaaagtacaac

SEQ ID NO: 19277 - DNA, 121 bp, Artificial Sequence
  Synthesized
  misc_feature (61): n=a or g
tgtgttctctgctatgactccaaatgcagggcaggttctttttgcatggttaaagttgttnaaaattaggcaggacagcttcatcaagccaaaaatctacacctaggggaatattttttcc

SEQ ID NO: 19278 - DNA, 121 bp, Artificial Sequence
  Synthesized
  misc_feature (61): n=a or g
tttatctagtttggactattaaaatgaatcaaaaccttctggtcctggcagaatgactccncgtgaattgtgcatcaaaacacaaaacattttcagagcctgatatcaagttagttactct

SEQ ID NO: 19279 - DNA, 121 bp, Artificial Sequence
  Synthesized
  misc_feature (61): n=c or g
atactgcagtgacagttaaccattagaatcagtgggatatcagcattgtttctaatgtggntttgaaaatcaagaagaattacttcatccccacatcctagaacagacacagcagacatca

SEQ ID NO: 19280 - DNA, 121 bp, Artificial Sequence
  Synthesized
  misc_feature (61): n=a or g
ctacttcaggccatcagcagtccctcacaaaacaccagctcacctgctgtcaccttaaccnttagcaataagcagctgatgtcacaacagcaaaggctactgcaaggcatatacaagagga

SEQ ID NO: 19281 - DNA, 121 bp, Artificial Sequence
  Synthesized
  misc_feature (61): n=t or c
atgaagctgttggagaaatcttttgtacttcatatactcttgcaggtggtctaaaatgctnctaggagtatcaaatcaccatttcagaagtgatttatcaaaatattttttttaatataat

SEQ ID NO: 19282 - DNA, 121 bp, Artificial Sequence
  Synthesized
  misc_feature (61): n=t or c
taaactaatgatttaattgtttacccaggaagtacacagtaggtttcaataaagacagatngtattattaaaagaaaagagtggacattcacatttctggcaggcagttagtatatcttgt

SEQ ID NO: 19283 - DNA, 121 bp, Artificial Sequence
  Synthesized
  misc_feature (61): n=t or c
acttttatcctagaagatgaagctttgtaaagctatcttcatttgtcagagaccctttgtntcctgctgcttttgcaaggaaaattggtagtctcttaaaaccatcttatctcttgtcacc

SEQ ID NO: 19284 - DNA, 121 bp, Artificial Sequence
  Synthesized
  misc_feature (61): n=a or g
aaactgtgccttggatctttacagagctggctcacctttgatttttgaagctaaactccanaatctttcctgaatgtttgctgtacaattactttgtaacagcaacaagaccactgcaatg

SEQ ID NO: 19285 - DNA, 121 bp, Artificial Sequence
  Synthesized
  misc_feature (61): n=a or g
agtgcatcaccaacagcagcataatctcttaagtgctttctcaaagactggggaaatgcangagccatcatcttcctgaactgctcatgtgagatgggtgggaaggaggcaggggagcagc

SEQ ID NO: 19286 - DNA, 121 bp, Artificial Sequence
  Synthesized
  misc_feature (61): n=a or g
cctgtggagccaggcattcttaggggatttctgagacgtcaagtatacagcagttcacatnttaacagagaagatttaatgcttgtctacagtaaagccagttattacaaaatgctgttct

SEQ ID NO: 19287 - DNA, 121 bp, Artificial Sequence
  Synthesized
  misc_feature (61): n=t or g
tttaagtagtagcctgaaacaataaagatgtttgaaaagaagtcagtaattgagttattanctcaggaactctgctgaaatcctagcacaatttctcaatggcttgaaacagggcagctcc

SEQ ID NO: 19288 - DNA, 121 bp, Artificial Sequence
  Synthesized
  misc_feature (61): n=a or g
tagtagagctactagtactgaagctttagatgtgcaaagctaggcacatttagagaaaatnaattacgagatgagaacatcctgtacatatagagtcctaattaaatgaatagcataaaca

SEQ ID NO: 19289 - DNA, 121 bp, Artificial Sequence
  Synthesized
  misc_feature (61): n=t or c
ctaatgactgagcttttctcctcttacatcttatatctaagccatgctcaggtgggcagcnaactaaaagacaggttggaataacagtagcagcactgctgtatcccatccatgcttctct

SEQ ID NO: 19290 - DNA, 121 bp, Artificial Sequence
  Synthesized
  misc_feature (61): n=a or c
gactggaactaaattgagtcaccctacagcactgtatgcagaccctgcagagaccttgcantaagaaggaatacagaagtgcaaagtggtcttaagttttccagagatacaggtttatccc

SEQ ID NO: 19291 - DNA, 121 bp, Artificial Sequence
  Synthesized
  misc_feature (61): n=a or g
tgaacagatgagcccatttattacaagtcttgaacactgcacaataaatccccaactatgnactcccgtagactttgattagagagcagtgctctcggaagctaacaaatccttattttct

SEQ ID NO: 19292 - DNA, 121 bp, Artificial Sequence
  Synthesized
  misc_feature (61): n=t or g
ttagcagagagtatttctgaaagaattgccccttctttttttgttatatgatgttttaaanaagaggtaagcataggaagagtaagtcaaactactttctaatctttctgcaatagacttt

SEQ ID NO: 19293 - DNA, 121 bp, Artificial Sequence
  Synthesized
  misc_feature (61): n=t or c
aatggttcgggctgcaacaaccccgcaaccctgaggtgggaggcaaggagagctaagtgcntccccatggccctgctgccaaaaagaccctgatttcctcacgcaaagacatatctttaga

SEQ ID NO: 19294 - DNA, 121 bp, Artificial Sequence
  Synthesized
  misc_feature (61): n=t or c
tggtcttgagataacgtaactggtctaggacatttgtgaacaggtttctcttggcatttanctacgtccttgtggcatgacttcctttttgttattggtctccctgaatggtggttgaatg

SEQ ID NO: 19295 - DNA, 121 bp, Artificial Sequence
  Synthesized
  misc_feature (61): n=t or c
aacacttaagtttgtaaagtacttgggaaccttcactttaagatgattaacatgttggcangcttcttcccctattctattttctgtgatccttttgaagaatttgatgatagcatttatt

SEQ ID NO: 19296 - DNA, 121 bp, Artificial Sequence
  Synthesized
  misc_feature (61): n=a or g
ggattcagaaagaataggatgtgggaacagatatagcctgggcagaccatggtccctgatntggggaagcaagattcagtgtcctttgtgctgctgagaaatttgacctttcattctttgt

SEQ ID NO: 19297 - DNA, 121 bp, Artificial Sequence
  Synthesized
  misc_feature (61): n=t or c
cagtcaggctgcagggctgctggtgtgctgccagcaggagtcaacctgtggttgttggagnttctggttctcggggtgagatgtggtgctctgctcagggcatcagaccctggctgcagca

SEQ ID NO: 19298 - DNA, 121 bp, Artificial Sequence
  Synthesized
  misc_feature (61): n=a or g
ctattcatatccagacgcactgctcactccaaagcactgaggggatgtgggttttctggcngcggcagtggtttgggttttcttctttgttttaacaaatacggtctcttagatcaaacat

SEQ ID NO: 19299 - DNA, 121 bp, Artificial Sequence
  Synthesized
  misc_feature (61): n=t or c
ttcatctcatcacatactgtgcacgtcccggtgccatccctgctcgcatctgtctcatttncctctctgcttttcctctttgcacacctcaaaccaaagtttctccatatattgctgaacc

SEQ ID NO: 19300 - DNA, 121 bp, Artificial Sequence
  Synthesized
  misc_feature (61): n=t or c
cttgcaccactcctacacacagatgaaagaatcatgatggattggtgaaaagacacagctncaagccccctttttgacccagctttacttccagggcaactggcctctaaaatcataggat

SEQ ID NO: 19301 - DNA, 121 bp, Artificial Sequence
  Synthesized
  misc_feature (61): n=a or t
acataaaggtcttagtagaatatccattcaaaacatgaaaaaacgaatgtgatactttgcnatccagtttaagccaggtttgtggggatacgttaaaccatttaaaagactagctagtata

SEQ ID NO: 19302 - DNA, 121 bp, Artificial Sequence
  Synthesized
  misc_feature (61): n=t or g
gtattcagttgaatttggaactgaaaactatactgagctatgttttcaaatgcaaggcacngcttttgtgtttgttgcttcgtatatgtgtatattcaactattactgaattagggctgta

SEQ ID NO: 19303 - DNA, 121 bp, Artificial Sequence
  Synthesized
  misc_feature (61): n=a or g
actagattttgttaaattactaaaatggattttttcatgcatttgcctcacctgcctgtgnatgggttggtggagcactggcccatggtgcatcctcaaactgaacccaagctctgataga

SEQ ID NO: 19304 - DNA, 121 bp, Artificial Sequence
  Synthesized
  misc_feature (61): n=t or g
acctctgtccaagaggaacatccagtaagacatcacctgccaagactgctgcactcttcancactaacctttgcaccaaataaagcttgagaggagaatattaatcttttccttgtaaata

SEQ ID NO: 19305 - DNA, 121 bp, Artificial Sequence
  Synthesized
  misc_feature (61): n=t or c
atctccaagtttctctgaatgagagtgtggtgagatgaagcagcaattacccacacccttnatcacagaaaattatggtgtagggagacggaggccaaactttcaactgatttttcagagc

SEQ ID NO: 19306 - DNA, 121 bp, Artificial Sequence
  Synthesized
  misc_feature (61): n=t or c
gtcttccaaaggtctccttcatcagtgctgggccttttccttctccacgtaaacaaaatcnctctgccttttctctttgaggtagcaaatcctttgtgtaatgccactaagtcaaacttca

SEQ ID NO: 19307 - DNA, 121 bp, Artificial Sequence
  Synthesized
  misc_feature (61): n=a or c
ggaaacctttgttgctcctttgagcaattctgatctatattggagcgcttccataccagcnggtacaaatgtacacgtgtggatacgaaatgcttccctgacgtgtatccctacaggcact

SEQ ID NO: 19308 - DNA, 121 bp, Artificial Sequence
  Synthesized
  misc_feature (61): n=t or c
tacaccaggttacttatctctgttcatccatctctgcccaaaggttcccagtgccacaggnttatggtctcaaccacagagatagtcttaaagagggcagttaatacctaatgtcaaaggt

SEQ ID NO: 19309 - DNA, 121 bp, Artificial Sequence
  Synthesized
  misc_feature (61): n=a or c
aggcccttgaggcacaccattaagttcaggaacatactcagcacaggccaaaccaaactcncgagattcttccagtacatccatacctcactgtttaaatcaaagggatctttctgcacag

SEQ ID NO: 19310 - DNA, 121 bp, Artificial Sequence
  Synthesized
  misc_feature (61): n=a or g
acacaggacgctaccccaaaagcccacagatatctaaaaatttgttctttaccagatattngcaatgtaacatcagactattaaaactgtacactataaacgccttaacagcactgaaacc

SEQ ID NO: 19311 - DNA, 121 bp, Artificial Sequence
  Synthesized
  misc_feature (61): n=a or t
gtacctttgtgggttcagttgtttatttctattttatcatgcttgtttctgagtgcagtgngaaatgtaacatagttcctttccaaatgcatctgtctccgacatcctgcatatacatact

SEQ ID NO: 19312 - DNA, 121 bp, Artificial Sequence
  Synthesized
  misc_feature (61): n=a or c
tgaatctgcttgagagtcttggaacccaagagttcccttaagaatatatttaagtaacttngttttctaccttattctagaattaaaatcgcattctgattaaacatttacaactcttcaa

SEQ ID NO: 19313 - DNA, 121 bp, Artificial Sequence
  Synthesized
  misc_feature (61): n=a or t
ttttgcttaagagcttaatttaaatgtgacactgcttgctaggaaagaccatactactcangagaaaagacctccacaaatgcctttttcttactgttatactactgctattctatgatct

SEQ ID NO: 19314 - DNA, 121 bp, Artificial Sequence
  Synthesized
  misc_feature (61): n=c or g
cccaattttgtattcctacaaaaatgtttcaacaataccagctatcagttcttgcccttanctctcttgtatcctgttgtcagaaaccaggatatatacagcaagaaaagaattagctgaa

SEQ ID NO: 19315 - DNA, 121 bp, Artificial Sequence
  Synthesized
  misc_feature (61): n=c or g
gggagcttgagcttggtacttaccaagccaggagtttcctcttgggcttgcaacagagacngtgagtcttcaggaaagctttctccgtgttttaccctctccatcttgttttaactgaaat

SEQ ID NO: 19316 - DNA, 121 bp, Artificial Sequence
  Synthesized
  misc_feature (61): n=a or g
ctctctgctcatgtttaatttctatttttcttgatacaaatggtgctcactctctctcagncttttctggacacccctcagaagtttgactttgtctccactatatcctcccacaaaacag

SEQ ID NO: 19317 - DNA, 121 bp, Artificial Sequence
  Synthesized
  misc_feature (61): n=a or t
ccattctgtatttcctctggtacttgccaggggtatactttgtcttacctcctcttgtganagtggttatgcccttttgtctgcataaagatacacgtacttaggtcttcttctcaacccc

SEQ ID NO: 19318 - DNA, 121 bp, Artificial Sequence
  Synthesized
  misc_feature (61): n=t or c
gtggcacagcttcaacacttctcccctttcacgtgagaagggactccagccaggccaacangcctcaaaggatgttgcccaccttgggcagatagtgacgggtttgctcctgcatatgttg

SEQ ID NO: 19319 - DNA, 121 bp, Artificial Sequence
  Synthesized
  misc_feature (61): n=t or c
aggtctcagagaccaggggtaaaaccggaacaagaaagatgtacccatgatagaagaggancagttcagggaatatataaacaaataggacatatgaagtctagacgccctgatgggatgc

SEQ ID NO: 19320 - DNA, 121 bp, Artificial Sequence
  Synthesized
  misc_feature (61): n=t or c
ctttgaggccagcgttgtgtttccaatctcttgcttgagaacccctgtaccagacaaacangggcaaaacagaacaagcgtagcagaggcaccaagcttgttggggctgaagtggagatgt

SEQ ID NO: 19321 - DNA, 121 bp, Artificial Sequence
  Synthesized
  misc_feature (61): n=a or t
atctttctttttggaagaattacagctcattcagggaaaacattgtaggcatgtgcttcanactcttgaaaactgctacaagctctttgccattgaaggatgggctccgtttgctgatgtc

SEQ ID NO: 19322 - DNA, 121 bp, Artificial Sequence
  Synthesized
  misc_feature (61): n=t or c
tgcatactaaaagattcagactaatagactcctacgtgccgagcgcacattctccctgccncaataaatagacctctatttgctgttctccagccaaaccatcagcccctgtggtttgaca

SEQ ID NO: 19323 - DNA, 121 bp, Artificial Sequence
  Synthesized
  misc_feature (61): n=a or c
aagtcgcattttgtcagctggtgggtaaataaaagcttcagtgcacactgcttcctaccantgaaggtgttctataccaataaaggttttgctagaggcagtgagcatttcaatgtgttcc

SEQ ID NO: 19324 - DNA, 121 bp, Artificial Sequence
  Synthesized
  misc_feature (61): n=a or g
cagtctgatgaacagtagtgaaaaatagtgaaagccttcaaaaaagagcagtcctgttgtntagcattgtgctgttagtaacaaaaaatcataaataagattcagtgttcagagatgccat

SEQ ID NO: 19325 - DNA, 121 bp, Artificial Sequence
  Synthesized
  misc_feature (61): n=t or c
cttcctcacaagaatagcgaatgcgcttcttgtagcgtggattgctttcatcgtgactttnggtgagctgcaacgaagaacaaaagcagatctctggagggaagcataactcatggctccg

SEQ ID NO: 19326 - DNA, 121 bp, Artificial Sequence
  Synthesized
  misc_feature (61): n=a or g
gtaagagcctttccacaaagctgtgcctttcagatgctgctcctttgtcttccacctcctncagtcaaagcctggagagccaagtatttcaggaccccacctgaacaccggctgaattgta

SEQ ID NO: 19327 - DNA, 121 bp, Artificial Sequence
  Synthesized
  misc_feature (61): n=t or c
accagaagtagtgaaattagaaattatctacattaaaatgttgtctccttcctcaccgttnacctcataatcctgtcacattctttggggtgttgaatattttgaattatgtggcataacg

SEQ ID NO: 19328 - DNA, 121 bp, Artificial Sequence
  Synthesized
  misc_feature (61): n=t or c
tactgtagctgagcttcttgcttggtggcattattggctaactgctgcttcggggtcgttngatgtgtgccctgagagaagagatgagggtgaagcatctgctgttccttggaggcagagg

SEQ ID NO: 19329 - DNA, 121 bp, Artificial Sequence
  Synthesized
  misc_feature (61): n=a or g
gctatggcaccaaggaggtaagataatctctcaccttgcacagtaaagattttttttcctntggaagcctctggatcagtatctgtagaattttttctatttatttctcatactccagtgt

SEQ ID NO: 19330 - DNA, 121 bp, Artificial Sequence
  Synthesized
  misc_feature (61): n=c or g
aagtaaggcacgacccagctctaaacatgatctgtgcttggggcacactcattatcactgntattttcaaaggtgggatcagtgcttttctgaaggaaatacgatgactgctctcctggct

SEQ ID NO: 19331 - DNA, 121 bp, Artificial Sequence
  Synthesized
  misc_feature (61): n=t or c
atggttcctgttctgcagatctgaagctttttattgtattcttaaaggcagagcatctcantgataagagataaatatgttttaattctgacttcaatgcagtgaggcgattcctacacct

SEQ ID NO: 19332 - DNA, 121 bp, Artificial Sequence
  Synthesized
  misc_feature (61): n=t or c
aactcgcttattcctaactccatcacagaaagcaagaggtaccatatcctttataataaanagcgacaattcaattattttgttgttaatttcatacttctgaatgtctttgtttccaggc

SEQ ID NO: 19333 - DNA, 121 bp, Artificial Sequence
  Synthesized
  misc_feature (61): n=a or g
gacccagtgccagccccgggaatgtggtctgagtgtgtggttggggtatgagagacacacngcactgtgagttttggcagtatccaaagactcagctgggattgaagtgatggtgaaacca

SEQ ID NO: 19334 - DNA, 121 bp, Artificial Sequence
  Synthesized
  misc_feature (61): n=a or t
aacttctgttggatgcacagaggtgcaggaagcacactggattgtagagggggaagactgnctgtagcactgggctagcaacacacaagtttgctagggaagaattctgctgtttgattgg

SEQ ID NO: 19335 - DNA, 121 bp, Artificial Sequence
  Synthesized
  misc_feature (61): n=t or c
ttatttccatgggaccttctggagaagcaagagcaaaagaatacgtgcagaacaggaaganccaatgcagcagcttctgtctgccaaggggcttcttggtgtagggcagggcagggccagc

SEQ ID NO: 19336 - DNA, 121 bp, Artificial Sequence
  Synthesized
  misc_feature (61): n=t or c
agcaagtatctgatctaattcagaccaagggctcccagctgaagcttactgttccacatanttagtttctcatatgataccatagggactctactgaggaacacacagttgagacttgaaa

SEQ ID NO: 19337 - DNA, 121 bp, Artificial Sequence
  Synthesized
  misc_feature (61): n=a or t
acacccaccaagttatgttggcaagcccatcatcatatattaaatacttaaaagtactgangtatctcttgacacatcttacacatcaagatgcataaggggaaatgagcacctgcattac

SEQ ID NO: 19338 - DNA, 121 bp, Artificial Sequence
  Synthesized
  misc_feature (61): n=a or g
gagcttgttctcaggagcagaggtttaaaagctgtgagttctgctttgtagcatacgtaantaaatcatctgaattccattaggatgtcaaggctgtattctgtaaaatcaaaattatgat

SEQ ID NO: 19339 - DNA, 121 bp, Artificial Sequence
  Synthesized
  misc_feature (61): n=t or c
aaatccaggtgacatctgaaatattcagaactccagaacagcaacctgcatcacctgcacngtaatctctcttgctagaactatactacataacttttgttttggccagtaaagccttcta

SEQ ID NO: 19340 - DNA, 121 bp, Artificial Sequence
  Synthesized
  misc_feature (61): n=t or g
taggaaactatgataaggcatgtgattgcaaatataatagctaaaaacatgctctttgttntttgtcttatatgcaggtattagttaaattgctttcgttaattggtgctgtttccgacat

SEQ ID NO: 19341 - DNA, 121 bp, Artificial Sequence
  Synthesized
  misc_feature (61): n=t or c
tatctatatatatataaacaatgcagtctaatcgctgcttacagcctacagtgcttgttantacatcatctctactctctgatcttctaagtatctttcatctcttaaataagtcagttcc

SEQ ID NO: 19342 - DNA, 121 bp, Artificial Sequence
  Synthesized
  misc_feature (61): n=t or c
tatgctcttccaaaatagcattcccaaatctcttcaccaaggctcaggttactgtcagaanctgctaataaggcacatctgcacagaatacctctagaggagccccttctgccagttggat

SEQ ID NO: 19343 - DNA, 121 bp, Artificial Sequence
  Synthesized
  misc_feature (61): n=a or g
tcggtgccttcaaacgccacttactatcaaatcatgaaaaatgcttagaagccagtgttgntgcaaacagagcttaaaaaaaatctggtaaggttccattgctaagcactttggctctaac

SEQ ID NO: 19344 - DNA, 121 bp, Artificial Sequence
  Synthesized
  misc_feature (61): n=t or c
ttccttattatctactaatttaaatcttgtgccaccttgtgatgaacgttatataggctgncagtgcaacaaatacagttttttaagaacaaaggacaaattatttcagagctgaattaaa

SEQ ID NO: 19345 - DNA, 121 bp, Artificial Sequence
  Synthesized
  misc_feature (61): n=a or g
accaacatatttagctctgcaaggggaaatctggggaactgattctcagtggccgtgtagnatctggctaaaattggagtaaaacattatcaaagcagaacagctttggcaaaaggaagct

SEQ ID NO: 19346 - DNA, 121 bp, Artificial Sequence
  Synthesized
  misc_feature (61): n=a or g
gactgctgcccgtgctgtcagcacacacacatgtgcacggtgttaacctgtagcctcagcngtgctgcaggtccgtataacctcttggtctgtgtacgacggtaatgaaaaggtttcacag

SEQ ID NO: 19347 - DNA, 121 bp, Artificial Sequence
  Synthesized
  misc_feature (61): n=t or c
tcttttttccatttcctggcatgttgaatactttcctgcagacctcagagttgtgtcctgntgcctgcctggattagttatcccaaatcaatccaaagaaattatatccccaggcattgta

SEQ ID NO: 19348 - DNA, 121 bp, Artificial Sequence
  Synthesized
  misc_feature (61): n=t or c
ctctttagctgtattagaaagaagaagcagaaaaaacatcagtgctgaattattttacatngtggagccacttgatagcttttgttcctgactcacgttgcacagggtaagactttcctat

SEQ ID NO: 19349 - DNA, 121 bp, Artificial Sequence
  Synthesized
  misc_feature (61): n=a or g
gtgaaatatactcaaggatttgaatatgtggggactgtttaaattacaacaagaataactnatagatgagaaacttactgggggaaaaaaatgaatgaattatatacagaaaagtaaatgt

SEQ ID NO: 19350 - DNA, 121 bp, Artificial Sequence
  Synthesized
  misc_feature (61): n=t or c
tttgagacattattaaattaagcattagtccagctttctttacctaacactgcttcagctnctagtcagtctgtttaaaaactgttgtaaaatcagatactgccaagtttctggttttttt

SEQ ID NO: 19351 - DNA, 121 bp, Artificial Sequence
  Synthesized
  misc_feature (61): n=t or c
taagatgaggtctggatgctgggattgcctgtcaagctttctctcccttccttttgttganaccacgaatgcctttacatttaagataagaaaactgtttttgcaaaagctttccctggct

SEQ ID NO: 19352 - DNA, 121 bp, Artificial Sequence
  Synthesized
  misc_feature (61): n=t or c
aaaaaagcagatctgttttatccacatcagttttgcactttttcttgacagggctggccancattaaaagactagttgggttttttgcttttggtatttttacatactaggggatgttaca

SEQ ID NO: 19353 - DNA, 121 bp, Artificial Sequence
  Synthesized
  misc_feature (61): n=a or g
ccattaaaacagtaatcagaggaaaggatgctgtagttcttctgctgcaggattatgttanagtaacccccaatagaacaagcccaagtaattcatagaattacagaaagaatgggttgga

SEQ ID NO: 19354 - DNA, 121 bp, Artificial Sequence
  Synthesized
  misc_feature (61): n=t or c
gagggaaaacacaatataaaactttactattactcctgtggagttcagcatcatgttatgnttccacatccttctaagttaagtggaaaagcaatggacagaagaagctatgccccaaata

SEQ ID NO: 19355 - DNA, 121 bp, Artificial Sequence
  Synthesized
  misc_feature (61): n=t or c
cccagaatgtgttagcacttacactcttgaaagacggcatgcctcaccactgagccataanatacctgatgttatatggagaaaggcaatcagactgctaattctaaaaaaaaggccagtg

SEQ ID NO: 19356 - DNA, 121 bp, Artificial Sequence
  Synthesized
  misc_feature (61): n=a or t
gatggaggcagcagcccactgctgcagcgctcagtgggtttggctttcttgtctgtggtcngaaggcaatatgggaatgtcacaaccccatcggtgcttctggcactgcccttctctgggt

SEQ ID NO: 19357 - DNA, 121 bp, Artificial Sequence
  Synthesized
  misc_feature (61): n=a or g
taatattcagtgtaaagtggcttcattctctcaataaattgaaagctgagatatgatgctntatattggaagtatttgatccactacattaaagtgcctaatagtgaaaactattgaaata

SEQ ID NO: 19358 - DNA, 121 bp, Artificial Sequence
  Synthesized
  misc_feature (61): n=c or g
gccattatgctaagttccaaacagctatgaaatctgtatcagtatgaaactctctccaacnctaaaaaatagtggaagatgctaccccaggaaaagaaaatattacagtaattctaaacag

SEQ ID NO: 19359 - DNA, 121 bp, Artificial Sequence
  Synthesized
  misc_feature (61): n=a or g
tcggctacatggtccagtacttttccctccttttcctgtaacaacatcttccttcagtgancagcatggactgtgctgttgctaagtcatggctttgggaataacttctgcctcattatta

SEQ ID NO: 19360 - DNA, 121 bp, Artificial Sequence
  Synthesized
  misc_feature (61): n=c or g
attacaatgacattcatgaatggtaaacctaaagctaccaaatgctatcaggcatactgtntatgcgatgctgtacacagtcattcccctctgtgtggacacttgttccagtcatatggta

SEQ ID NO: 19361 - DNA, 121 bp, Artificial Sequence
  Synthesized
  misc_feature (61): n=t or c
tcacttgcagtttacactttctcatacctaaaacttcagtgtaagaactgagtaaccatcncttcagagaagcaatggtgcaggcaagggaaacgtgctgcagagggaagcaatcctgaga

SEQ ID NO: 19362 - DNA, 121 bp, Artificial Sequence
  Synthesized
  misc_feature (61): n=a or c
atggtttgcatttataaactaatgatggggaggaggggaatgaagtcttgcatacattatntttacttagagaaattaaaagctacaatattttgttggaatatttaactataagatttct

SEQ ID NO: 19363 - DNA, 121 bp, Artificial Sequence
  Synthesized
  misc_feature (61): n=a or g
tctgggagagaaactgaaggagagcatttcctcttgaagaatgttcagacaaaaatttgangaaaagaaagaagttagagatgtttagagtagtttttagataaattacaattatgttcca

SEQ ID NO: 19364 - DNA, 121 bp, Artificial Sequence
  Synthesized
  misc_feature (61): n=a or g
tccttccttggtgcaaatgcaaaaaacttgaattctgccacttccacgttatctttctccntggcttgtccaggtgtgcagacagctcggtaactcacatcacacatcatgcctatggtag

SEQ ID NO: 19365 - DNA, 121 bp, Artificial Sequence
  Synthesized
  misc_feature (61): n=t or c
tattgccaactagaaacttggatcaaattttcagtaccacatgagaaccatggaaacttgngttcacttacatatcacaagcaacagaagcagtcaacccttttcatggggttcccaaaaa

SEQ ID NO: 19366 - DNA, 121 bp, Artificial Sequence
  Synthesized
  misc_feature (61): n=a or c
agtgtcttggcctgagtgacttcatcttcaccagctaaaggccaattcctgtgttattttnatcaagtgtcaatgtaacctgaaatgtgtaagccttgctgtgggagaggccccgtgcctg

SEQ ID NO: 19367 - DNA, 121 bp, Artificial Sequence
  Synthesized
  misc_feature (61): n=a or c
agagagaggaatgaggctggaggaggaaagaaatggtgcaataagtgaagttcttgccatngaagagaggtgattttgtggcagaacacaataccacaccaaccgagtccttgaggaacag

SEQ ID NO: 19368 - DNA, 121 bp, Artificial Sequence
  Synthesized
  misc_feature (61): n=t or c
atgaatgaaagaactttaattgcattaaagccttccaaacacacaattacagcaaaagcantgaggcttaccttgagtgagctggagcactccctccagcaaaggaaaagctttaattttt

SEQ ID NO: 19369 - DNA, 121 bp, Artificial Sequence
  Synthesized
  misc_feature (61): n=a or c
cagctgctgttcgtcgcctctattgaactcatgatgggactgtatgggctgttgcttgtcnctttgcaccatgatattgtagcatgcgcatttatctttgatattcaggtgctgtgttcct

SEQ ID NO: 19370 - DNA, 121 bp, Artificial Sequence
  Synthesized
  misc_feature (61): n=c or g
ctcaactattttgtgatgacgttatacaaatgtgtggcatggaaatgtggatgacaatctngatgcttaaattattttgaactgtctacataaatttaaattaattattgacatatttaac

SEQ ID NO: 19371 - DNA, 121 bp, Artificial Sequence
  Synthesized
  misc_feature (61): n=a or c
cagagctggagcaagtaaacctagtaaaccaactgagattgtcacagcaaggacaccagtnggtaagccagacaaaccactgagtagcaaaagactgccatttttatggtcatttccaatg

SEQ ID NO: 19372 - DNA, 121 bp, Artificial Sequence
  Synthesized
  misc_feature (61): n=a or t
tccaaacaggaatctctatgtaatgttatcttatttaaagagccccataatagtttcctcnaatctgatatgacaaatccacagatacttgtgactttgatctctgttccttggtactgca

SEQ ID NO: 19373 - DNA, 121 bp, Artificial Sequence
  Synthesized
  misc_feature (61): n=a or g
ttcgactgtgtcatttgtgctatgctcctggagcctctgtggcttgctatcagaacacacncagcatggcaagaggaaaagaatgtagctggcccaaccctcaaagctgtttcacatcagc

SEQ ID NO: 19374 - DNA, 121 bp, Artificial Sequence
  Synthesized
  misc_feature (61): n=c or g
cattttattgtgcaaaatattatcacttgtctttaaggaaacgtaagatatttggaatctngtagtaaggttcctgaagcttccctttccttttgtctattggcagatcttcatttgactg

SEQ ID NO: 19375 - DNA, 121 bp, Artificial Sequence
  Synthesized
  misc_feature (61): n=a or g
cacagtgcgaatgggaacatgctaaactgggggaatagccctgagctggatgtggaagttntgaataatgaccgcacttaaaagaaaataatgctacggattcaaaagtgtttgtctaaag

SEQ ID NO: 19376 - DNA, 121 bp, Artificial Sequence
  Synthesized
  misc_feature (61): n=a or g
gggcaaagcctctccagaagggctatagggcattgctacagaattgaagaaaacaacaagncagcaaacactgttaacccacagggtactgactgtaaacctgtgctattacaggcaactg

SEQ ID NO: 19377 - DNA, 121 bp, Artificial Sequence
  Synthesized
  misc_feature (61): n=a or g
aaatcttataacagtgtaacaaatgaaaataggtatcagtctatcaagtaaattgatgcancttctggacttccttcaaaaattacattagtttcctcttcaggacaccagcattgagttt

SEQ ID NO: 19378 - DNA, 121 bp, Artificial Sequence
  Synthesized
  misc_feature (61): n=a or c
tttttttaaatgattttacatactgtactattagaagtagtcttaattctttcagttcacnaaccacatcctgattagacttaaatctgtaatactgtattatgagtgggatctcttgtca

SEQ ID NO: 19379 - DNA, 121 bp, Artificial Sequence
  Synthesized
  misc_feature (61): n=a or g
tccccatgttgtagtttcagacaggagagacaaaacacacaccttaattattacacaatantaggatccatgttaaggataagcgcctcagtgaaacagtcgtcaataatgcagagaacac

SEQ ID NO: 19380 - DNA, 121 bp, Artificial Sequence
  Synthesized
  misc_feature (61): n=a or g
gtccagttcactttaaggtttcttctcatctccacctgccaacctgcattagttctctaantcatcatctgtaaacactaaagtttccaatggttcttttcagcttgagtgtctgggtcag

SEQ ID NO: 19381 - DNA, 121 bp, Artificial Sequence
  Synthesized
  misc_feature (61): n=t or c
gttatcataaatgtatacataaaacaactcatgttgaaaatttttccccttcaagataaangggttttgataatctagtcaaaagttaggctgatccatgtcaaatactgaaattttagaa

SEQ ID NO: 19382 - DNA, 121 bp, Artificial Sequence
  Synthesized
  misc_feature (61): n=a or g
gtgtgatctgacctctctcagatgacatatccactgaacaatttcttctaccagtgtaccntacctgcaagaaattgcattctaagtatgagcagaaaattgtgtgtgtgcatgtgtgtat

SEQ ID NO: 19383 - DNA, 121 bp, Artificial Sequence
  Synthesized
  misc_feature (61): n=a or g
tggcctattctgaaatataggaaagattaaagaaattgcagtggacagtcaataagaacancacagttcagcatgtggactgcatgtctctctttgaagacaaggcttcctaaaatgatgc

SEQ ID NO: 19384 - DNA, 121 bp, Artificial Sequence
  Synthesized
  misc_feature (61): n=t or c
gcacttttgttggcttattacttgaagtgaaattctggatctcttgagttcaatactaatngtgtggtattaacttcaatggagctaaaattctaatctttatgtcgtatgcataactcat

SEQ ID NO: 19385 - DNA, 121 bp, Artificial Sequence
  Synthesized
  misc_feature (61): n=a or g
aaaacatcaaacagtatgagccactccttgctgttggtaagtatcttgactggtttattgnttactctgcaaattatgtattctagattaaatacaaatacagttatgtgttaccaaaagg

SEQ ID NO: 19386 - DNA, 121 bp, Artificial Sequence
  Synthesized
  misc_feature (61): n=a or g
tctaggtaacccagacttcccccctttctacttctaggttaccacaagaaattcataagcnttacaaagctgaaagctcaaagcctaaacacggcagagaggaaatacaaaataaattatc

SEQ ID NO: 19387 - DNA, 121 bp, Artificial Sequence
  Synthesized
  misc_feature (61): n=t or c
gacaactgtgaaggaaattaactccatcccagctggaagcagtgaaccagtgaagaatagnattcattcataatattggtttgcttgttctgtgcaatagtcattagtaagcaaagtgtca

SEQ ID NO: 19388 - DNA, 121 bp, Artificial Sequence
  Synthesized
  misc_feature (61): n=a or g
gtgccatattttgcactgtagaatcctgatgcttgttttgggtttgagcactatggcaacntgaatgtttgtaatgtatctgtgtgtataaaataaacgcctttttttcactcagaaggcc

SEQ ID NO: 19389 - DNA, 121 bp, Artificial Sequence
  Synthesized
  misc_feature (61): n=a or g
gaaataaaaagatgcctaatgcttgaaccacaatccccagctccttgcaagaaaaggttcnggcttggttccaccagtggtggaaaaaagagcctttagttactcctgtttggctgtggtg

SEQ ID NO: 19390 - DNA, 121 bp, Artificial Sequence
  Synthesized
  misc_feature (61): n=a or g
gtccttaacagctctaacaactgctaaattattttcatttcttatcctgacacaaacagtncagttcatgtgacatggagcccaggtccttacaagtgaaatttgggggctccctctgagg

SEQ ID NO: 19391 - DNA, 121 bp, Artificial Sequence
  Synthesized
  misc_feature (61): n=a or c
ccaattaatgttatattttaaacctgtgatattaactaggtggcctgagactgctaaaatntctgttgaatttctggtgggaatgcaatgaagtttcagtcatatttcatatattaagact

SEQ ID NO: 19392 - DNA, 121 bp, Artificial Sequence
  Synthesized
  misc_feature (61): n=a or g
cagtgaagggttcggagggctgaggtccctgttctgcactgggatcagaaatcagaccccntcggtggaaatgaagactttgacaggagcgcagagagcttcagctgtctgacaggagtaa

SEQ ID NO: 19393 - DNA, 121 bp, Artificial Sequence
  Synthesized
  misc_feature (61): n=t or c
tttggaccttcgtagagttttcaaggcttggtgctcctaatttaagtcctttagcatgcangcttctgagcaagtcactcaggcacaggccaagaaatgttaagagttcaattacttgtcc

SEQ ID NO: 19394 - DNA, 121 bp, Artificial Sequence
  Synthesized
  misc_feature (61): n=t or c
aatccctatatctgcttatcattttcaagattttctgtagtctgttgtttaagcataacanggcacaaccaggttacatctgacccaaccagtgaactatggggcattacccttctgttga

SEQ ID NO: 19395 - DNA, 121 bp, Artificial Sequence
  Synthesized
  misc_feature (61): n=t or c
tactttaggtgtagtaaagctgctgtaatgtgatggcaaatgttattagcaatattatatnataaaaatgtctagagcttgctatggtcaatgcaatttcttccttttccttattttaatc

SEQ ID NO: 19396 - DNA, 121 bp, Artificial Sequence
  Synthesized
  misc_feature (61): n=t or g
atgtgcaaaaaatagctcggagcgggatttataaaaagggttttggtgatttaggaagcanttccctcgtgagagacatccagttgggtcaagacatgcattgcctctgtgaagatgtggg

SEQ ID NO: 19397 - DNA, 121 bp, Artificial Sequence
  Synthesized
  misc_feature (61): n=a or g
cctgcaaggataggcagcagccaacatagttgctttaaacctaagaaaggtagtggtcacnacccagtaacaaagacagaattcctacccctttccgaacatcagggcccaccaaacactc

SEQ ID NO: 19398 - DNA, 121 bp, Artificial Sequence
  Synthesized
  misc_feature (61): n=a or g
aattgtatgggctaatacaggcctacttgtgaggttcccctgaattagcatgactgaaganatgctaaatgcaaggcaggatttaccacctggctgaaaatcaacgtcatgtgctttgctt

SEQ ID NO: 19399 - DNA, 121 bp, Artificial Sequence
  Synthesized
  misc_feature (61): n=c or g
actaaaattgtgatgatattgcttaccaacaagcaaggaaacaggaaggtaagagacagantaaatgctctgttttcccaaatgtataaacaaacatatcttatctttttttctccagggt

SEQ ID NO: 19400 - DNA, 121 bp, Artificial Sequence
  Synthesized
  misc_feature (61): n=a or g
gggaaatggttcaggctgggaagagcaaggtttcagccttgattaacgacgtaaagaaacncaggcacgccgcatgaaagcaaggaaagagaagaagctggaaggcttgcaggaccgggcc

SEQ ID NO: 19401 - DNA, 121 bp, Artificial Sequence
  Synthesized
  misc_feature (61): n=c or g
tcggaggaaacccaataaggatgggatgactaaaaatggtcacggtgcccacacaaggagnaatccaaatatggttgtgacaagcaaataagcatgggatgtccaaataaggagaaaacca

SEQ ID NO: 19402 - DNA, 121 bp, Artificial Sequence
  Synthesized
  misc_feature (61): n=t or c
aaacagagatgccagtagtctcttgatagcatctgaagaaggatttagggctaacacatanctgaaacaataatgaagtttcaaaatacagcaggatgtttttcagctcttctttttagac

SEQ ID NO: 19403 - DNA, 121 bp, Artificial Sequence
  Synthesized
  misc_feature (61): n=t or c
tcaggccttcaggcttctctcacatatttgctgtttagcctcaggagttcattcagtacanaaatatgtatgacattcatttcgcatttataaacatataagcacatatatattggtggcc

SEQ ID NO: 19404 - DNA, 121 bp, Artificial Sequence
  Synthesized
  misc_feature (61): n=t or g
tctattcaaaagatctttgttacctttaccctcatgcacagttttaatatggtcagagtgntctgtaatagccacttcaaatttggggggaaagaccagacttactaccagtaatgacagt

SEQ ID NO: 19405 - DNA, 121 bp, Artificial Sequence
  Synthesized
  misc_feature (61): n=a or g
actggcattgtatgcagagttaatggactcacacaaatactgtaggatgtaggcaaaagtnctgtggaactggagagtatggcagtacttccatatccctgtatcttctaaggcacaggta

SEQ ID NO: 19406 - DNA, 121 bp, Artificial Sequence
  Synthesized
  misc_feature (61): n=a or g
gttgtgatttttgctcactgagcagtgagtaaaattgcctggaaaattagaagagaagtanaaaacaaccaaaagcattgcttggcagcaataatggcaactgagtagagggggagacaga

SEQ ID NO: 19407 - DNA, 121 bp, Artificial Sequence
  Synthesized
  misc_feature (61): n=t or c
ttgttcattctgaaggttttctggtatgtacttgattcctgccaaagaacacatccattantgaattcaaggacaggaaccatgtttaaaaaaaaataataaaaagtcccccaaacgaacc

SEQ ID NO: 19408 - DNA, 121 bp, Artificial Sequence
  Synthesized
  misc_feature (61): n=t or c
acagtgatgactgaagcacaagagaaaaggtgacaactatctaacactggcagttgaagangagtatgaaggcaagaatgaaactttcggagcagggctagattaacatggtcaaggaaac

SEQ ID NO: 19409 - DNA, 121 bp, Artificial Sequence
  Synthesized
  misc_feature (61): n=t or c
tctccagatcgttgtggtacgacagtgtgatacacagccatgctgcatgacactcaggggntgctgagttcatagttccctcagcgtttctcagtaacatccattcctacagacattacca

SEQ ID NO: 19410 - DNA, 121 bp, Artificial Sequence
  Synthesized
  misc_feature (61): n=a or g
tgccaccagtttgagtccagcagctttaacagcttctatgttcctattaccactaatatcncttatcctcctattatcactacatatccaatgcctaaaataggactgggttagtaagttt

SEQ ID NO: 19411 - DNA, 121 bp, Artificial Sequence
  Synthesized
  misc_feature (61): n=a or t
gctgagtgttggaatagtctcctgtctcccaacctgtccattaagaaagctaacacctcanaaataaatgtaactaataatattaaatctctctctctttttttttttttttttttcagtt

SEQ ID NO: 19412 - DNA, 121 bp, Artificial Sequence
  Synthesized
  misc_feature (61): n=t or c
tcgacccttcccatctcttcctaagctgcattaatttcccaatgagatttattccagctcnttcctctcccatcactgatgatctcaattcttcaaatgactgcctgagaattttctctgt

SEQ ID NO: 19413 - DNA, 121 bp, Artificial Sequence
  Synthesized
  misc_feature (61): n=t or c
aaccgctttggatgatcacagctcttccgctcctttctgataattaccatccatgcctaancagagaaacagccacctaggaaacgctccttcagctcaatctttccaagtctactttaaa

SEQ ID NO: 19414 - DNA, 121 bp, Artificial Sequence
  Synthesized
  misc_feature (61): n=a or g
gagcagggctgaatacagtgagtcccaccacattctgcatccaggtatgttgggctggccntttgggactgccagatgcctgtgacaacacacctggtgttttcaggaggcctttgttcct

SEQ ID NO: 19415 - DNA, 121 bp, Artificial Sequence
  Synthesized
  misc_feature (61): n=a or g
aggggcatctttggggttttagtaaggaatccttgaggttttgagtggaggcgtcccttgncttttgctgggggcatccttaggttttagtgaggcatctttaggtcttagtgacagtatt

SEQ ID NO: 19416 - DNA, 121 bp, Artificial Sequence
  Synthesized
  misc_feature (61): n=a or g
tctctctagtcgagttcagaacaatactcacaatacactggcgttcctcaatgagtgatgnctgaggctgactcaagtgagacgactttgccctggccactattcatagagagccctgagg

SEQ ID NO: 19417 - DNA, 121 bp, Artificial Sequence
  Synthesized
  misc_feature (61): n=a or g
taactccaacagccatttttgggctttctcatctctttgaagagctatcaaaatctgaggntagtaattaaaagaaattttggttgagcagtgttcacacatcctagaagttccgcaattt

SEQ ID NO: 19418 - DNA, 121 bp, Artificial Sequence
  Synthesized
  misc_feature (61): n=a or g
ataagcaaagaatcttcttcaatctgattgcgaagatgcaataattaaaactgcaggagtntgtaatggcaaattgaattcagagcccttatggaaaactattgccagtgcattgagggct

SEQ ID NO: 19419 - DNA, 121 bp, Artificial Sequence
  Synthesized
  misc_feature (61): n=a or c
ttcagcagactagaaaatgtgcagtgttcacagcataacggatttctaaaggttcatcttngatactaaagtaataccatgacatacactcaattccagccaaatgacatttgtcttgggt

SEQ ID NO: 19420 - DNA, 121 bp, Artificial Sequence
  Synthesized
  misc_feature (61): n=a or g
cttcaggaggaaaaaaaaaagctcctcagtaaaaaggtgaagaggagagagaaaggtaagnctaatctgatctcactgtgtttaaaaacttggtggtgctgaagattacaaagcagaacag

SEQ ID NO: 19421 - DNA, 121 bp, Artificial Sequence
  Synthesized
  misc_feature (61): n=a or g
aaaggcgttaaactttgcagaagtccatcaaaacttgcatcgcttctcttggtgctttcanttcaacatacagatggttttgtgagagtcagctttaatgagtttcaggttgttggtctca

SEQ ID NO: 19422 - DNA, 121 bp, Artificial Sequence
  Synthesized
  misc_feature (61): n=a or g
aaaagcccaaaccaacatacagtagtgccaggagtttcttgcttgttcagaataggatgcntattccaattccagcaagagtttgttaccagcttaaatgtattagcaactcccaggttct

SEQ ID NO: 19423 - DNA, 121 bp, Artificial Sequence
  Synthesized
  misc_feature (61): n=t or c
tttctcactctgctgtttctttgaaacccagtaaattttggaatatcctgttttttaactntctgagaggatgttttagtgaccattcctcaggttttttattgtatgagtgatcatttgt

SEQ ID NO: 19424 - DNA, 121 bp, Artificial Sequence
  Synthesized
  misc_feature (61): n=a or g
ctgatatgtggaaaaaactgaacctcaagacattgtattttaatagggttctaacctgatnctcataacgtaactctcacgctaccaatgctatgcagtgccctagggaggcctcagagtc

SEQ ID NO: 19425 - DNA, 121 bp, Artificial Sequence
  Synthesized
  misc_feature (61): n=a or g
tgctcaccacaaagtatgtttcttctaagccatgctaaggccaggcacagaaggcgaagcnttttggtttcatttagtttcactccaggccacgatcctggctccttccgctaatcccgac

SEQ ID NO: 19426 - DNA, 121 bp, Artificial Sequence
  Synthesized
  misc_feature (61): n=t or c
tcctggactgaggagttggtaaagttgtttctattacctctgagcatcgacaggctcaggngctgcacaggaaaggagttctcctacttcttccctggctgctccagtgtgcgtgtagagt

SEQ ID NO: 19427 - DNA, 121 bp, Artificial Sequence
  Synthesized
  misc_feature (61): n=t or c
ctcgcgcatgcgtacagcagtctaatagtaagcgcatgcgtattgcatttctgaagttcgntcatgcgtacagccgtctaacagttggcgcatacgtattgcaattttgaaacccgcgcat

SEQ ID NO: 19428 - DNA, 121 bp, Artificial Sequence
  Synthesized
  misc_feature (61): n=t or g
accctcccttggatcagaacacagcgccacccaacgcccgccctttctgcaatccctctgngccattttgttgggttttacccccatattcgtgtgaagagtgggggacaaaccctgtggg

SEQ ID NO: 19429 - DNA, 121 bp, Artificial Sequence
  Synthesized
  misc_feature (61): n=c or g
atataaaaaaagggtttgtatgctattttcatctcacttcaaaactagcaagagtaatganaatttgtagctttaatgttttgtcagaaaaatgcccaaagccttagctgatgagagccat

SEQ ID NO: 19430 - DNA, 121 bp, Artificial Sequence
  Synthesized
  misc_feature (61): n=a or c
acaatcccatgcagaaatcgggactcgggtgcaaaatcccatacagaagtggcaccgcagntgcaaagagcccatgcaggaagagggagatcccttggtggattcaatgtcacatgcagcg

SEQ ID NO: 19431 - DNA, 121 bp, Artificial Sequence
  Synthesized
  misc_feature (61): n=a or g
atgtttcttaatgggtcatctttcaagtcaatctgatgtacagacttgtgatgctcttacnagccgtgcttatctgcagagggaagctctgtgggatgctctaggatagttgtgtgtttgc

SEQ ID NO: 19432 - DNA, 121 bp, Artificial Sequence
  Synthesized
  misc_feature (61): n=a or t
cgaaggcttcttttcctcctgctccaaattaatatttcatgtttctgacaaaagattgccncttacatagaaagaggtcaacccagctctgccttccctgtgccatttctcgcggttgggt

SEQ ID NO: 19433 - DNA, 121 bp, Artificial Sequence
  Synthesized
  misc_feature (61): n=t or c
tgttgcctgcagtttgtggtgccaggttgcccatcccattaatctgcctcagaatggctgngtgtctacaggcaggtgataaaccttctttgcttgagctctgtggatctgcttctgaggg

SEQ ID NO: 19434 - DNA, 121 bp, Artificial Sequence
  Synthesized
  misc_feature (61): n=a or t
agtcctacagtatcagtaatagaaagtcaacgaaaggagaggcagaccagggctcaaacangcacatttcagaagggctagacatggccaaacaaaagctaatatatccctaatgcctata

SEQ ID NO: 19435 - DNA, 121 bp, Artificial Sequence
  Synthesized
  misc_feature (61): n=a or c
tttctaggagagctttcagctttctgagctgtaggtatccacatctgacacttagatgatntcaaagcaaaaagccatactgatggtcccagggatcctcttggtctggtgtaccttcttt

SEQ ID NO: 19436 - DNA, 121 bp, Artificial Sequence
  Synthesized
  misc_feature (61): n=t or c
ttggagcaggatagaagctctcccgtttttcctcctctacaatattgtctgtgtgggagantgctgctggaaggcttgtgggaacttgagagtgtgactgaaggccaaaaagttgcacaat

SEQ ID NO: 19437 - DNA, 121 bp, Artificial Sequence
  Synthesized
  misc_feature (61): n=t or c
gctgtttgaaaatgggacattgggtgagagtacaagaaatgtaggattaggataagaaaanacatctggagaagacaaaagaattagatcttggccatgagctacaccagttcagctgaaa

SEQ ID NO: 19438 - DNA, 121 bp, Artificial Sequence
  Synthesized
  misc_feature (61): n=a or g
taacctaagctgaattaaggtgatgaagaacattgatgttaagagaaggcacggctcctgnctcaggtaggtaagtgatgcctgccatcccacacacatgcacaccctcaggccggctgac

SEQ ID NO: 19439 - DNA, 121 bp, Artificial Sequence
  Synthesized
  misc_feature (61): n=c or g
ggagcagtttgccagcggttgcacagggggagacaatctctgagcctcacaggctgatcanggtgtacttacaagtccacatcaatgtgcatcacaactaacaaatctcatcctgatttcc

SEQ ID NO: 19440 - DNA, 121 bp, Artificial Sequence
  Synthesized
  misc_feature (61): n=t or c
tttaaaactttccagcctgtaggagctgtcacgattcaaaacagagctggggccacagagngtgtgacaactgcatggctgctcccagatgtgtttttccagcagagcacgattatctgct

SEQ ID NO: 19441 - DNA, 121 bp, Artificial Sequence
  Synthesized
  misc_feature (61): n=c or g
gctgtcttcagctgatgccattaactctcatcctcaaaagcaagactttcctgcaacgtanttcacagagtggaagctccccaatgcccttttaccttagcagtttggtagccctttgtct

SEQ ID NO: 19442 - DNA, 121 bp, Artificial Sequence
  Synthesized
  misc_feature (61): n=t or c
cacaagacttacaccagtgttacactgcaaaccagccttggcttgggatatagttctgtgntgcagtcccaggcatatttgaaaacattgttctgttaatgggaaaggccttgaagtaatt

SEQ ID NO: 19443 - DNA, 121 bp, Artificial Sequence
  Synthesized
  misc_feature (61): n=t or g
cccatgaaaataagtgtgtcaccctacataattatagtaagcttctggactacatgtaatnatgaggttatgtgaattgggaattgtactgagataacaagtctttatgctgaagaataga

SEQ ID NO: 19444 - DNA, 121 bp, Artificial Sequence
  Synthesized
  misc_feature (61): n=a or g
cgctgtgataacatgccatgcatatacacacatctatgctggaaaatacgagctccttccngacccagtgtgatgcaagttgatagaagttttctattgctctacctccaccatggggctc

SEQ ID NO: 19445 - DNA, 121 bp, Artificial Sequence
  Synthesized
  misc_feature (61): n=a or g
tatacacttagggtgattttggtcaattccacaccagacccaaatctgtgctagcacaacnaagccagaagctccagcacttccaagatgttctccttgacaacatgacagctcaagggac

SEQ ID NO: 19446 - DNA, 121 bp, Artificial Sequence
  Synthesized
  misc_feature (61): n=a or g
ttgggggggatctatatttcctcatgtgaccttgtaagccactgtaaattgttaggtcacntaatgtttcgggtagaccattttctgtcttccatttgttctcaagggctagctttgtcct

SEQ ID NO: 19447 - DNA, 121 bp, Artificial Sequence
  Synthesized
  misc_feature (61): n=a or g
catggctgccagtctgaccaagctagtgatggctggcaaactagggctgatggggcagtcntcggtgtcgtttcactggcagcgagttttcagcaatgtttcctgtgtcctggctcctgga

SEQ ID NO: 19448 - DNA, 121 bp, Artificial Sequence
  Synthesized
  misc_feature (61): n=a or g
ttggcttactgttaatgtttttaaaacacagttagcttttaacacagcaacaacgaatgcnctgttcatggagaaccttttgtaatgccaacacatttgctcagaggaacgcttatctggg

SEQ ID NO: 19449 - DNA, 121 bp, Artificial Sequence
  Synthesized
  misc_feature (61): n=t or c
aacacttctactctttgaaaaacagttcagcaagatagatagaatttagagaggtgtgttntttcaatgacagcctctggatattatgctgaaatggagagaagagcattaccacatgcat

SEQ ID NO: 19450 - DNA, 121 bp, Artificial Sequence
  Synthesized
  misc_feature (61): n=a or g
ctggcagggatgaaacctttggatcttgcagttgcaaaatgaaggcatggccacagatcanttgaaaagtctgtgccaagttttctctatgtctttctccttttctctgcaaacctccata

SEQ ID NO: 19451 - DNA, 121 bp, Artificial Sequence
  Synthesized
  misc_feature (61): n=a or g
tctgtgtgcgattaaagaaatagatggtcagagcctttttttcacttaatttgggatttcnatcattgggactgcaacaggagagctgtcagcctgtgctctagagctgtgctccaacccc

SEQ ID NO: 19452 - DNA, 121 bp, Artificial Sequence
  Synthesized
  misc_feature (61): n=a or g
ctggtctaaccacatcataggctacattttcattctcctgatttcatctagtactcattgntattttttccctcaatatccctgcccccatccccttcacagactgtggaaaaataacatg

SEQ ID NO: 19453 - DNA, 121 bp, Artificial Sequence
  Synthesized
  misc_feature (61): n=t or c
ttcaaattataacagggactggatagatttgcagacaagactctattgatgtggaaatctntgaaggcaagttaaaacggtcagtttcttttcttttgttaaggtttcttcctctgctttg

SEQ ID NO: 19454 - DNA, 121 bp, Artificial Sequence
  Synthesized
  misc_feature (61): n=a or g
cttgtcttcttagggactaaaaagtgagccaggcatgctctgaaaattattctctggctgntgaggacccatatggcattctctctttagcttttagctgaaatcacttagcaaggtgatt

SEQ ID NO: 19455 - DNA, 121 bp, Artificial Sequence
  Synthesized
  misc_feature (61): n=a or g
ggaatgagggcaaactgagggcaacactgtgtggctgtctgtgtgcagcagcatgctggtngtggacagctctccagggcttgctcagacatcttgcccaagttcctgggaccctgctggt

SEQ ID NO: 19456 - DNA, 121 bp, Artificial Sequence
  Synthesized
  misc_feature (61): n=t or c
ttgttcaggaacttacagactccgtgcaataccaataataattatttataacctactatgnaaggaaattagtccaggaaaaccgactgattataacgtagcacagtcaccccaagggaga

SEQ ID NO: 19457 - DNA, 121 bp, Artificial Sequence
  Synthesized
  misc_feature (61): n=a or g
atttgaagattcgtacccacaggcaccttctcttccctgtgattgtgttcaagaaggacantaggcaacatttgacctgttaattactagcatcaagtagtcctatgcagtacactgggaa

SEQ ID NO: 19458 - DNA, 121 bp, Artificial Sequence
  Synthesized
  misc_feature (61): n=t or c
tttttaccagaagtgcatgtaagtatttcaagagcaatccaaacatctaaaagctacatanatcacctttaagtgcctcagattgcatttggtgtgatctatctcctgcagggaaggacaa

SEQ ID NO: 19459 - DNA, 121 bp, Artificial Sequence
  Synthesized
  misc_feature (61): n=a or t
ttcgcccataaagcttgctggcaacattacatgacaggcagatttgctgcacctttggttnacatgaggcagaaaataggaccacaacccgaaagtaagctgttttgtgtttctttttaat

SEQ ID NO: 19460 - DNA, 121 bp, Artificial Sequence
  Synthesized
  misc_feature (61): n=c or g
ttttttttccccaaaaaagttcatcttccttacagaacccacctctccatctctcattgantcccattgacctttgactcttcctctctttatttcttggtccacactttcctctttgaga

SEQ ID NO: 19461 - DNA, 121 bp, Artificial Sequence
  Synthesized
  misc_feature (61): n=a or g
agaaaaagtcatttcaaaaacataagaggtttccttttcacaccaatcctttctgactttnctgtggtatgtatagatactttacaacattcctgagtacacaggtagtgtgtgcaagaaa

SEQ ID NO: 19462 - DNA, 121 bp, Artificial Sequence
  Synthesized
  misc_feature (61): n=a or g
caaacacagacacagcactcccaataaacagggacagtcccacagctcactcctctctctntctcacatggattctccaaaggacatctccgctttgtgacctggtagcacatcaccacgc

SEQ ID NO: 19463 - DNA, 121 bp, Artificial Sequence
  Synthesized
  misc_feature (61): n=t or c
atatccaaaagcacttttctagaacagaaggcctctgacactaaatgagttactttaaaantgaatctattaattccattttttcaatgatataactggtaaaataatttaggaagacctg

SEQ ID NO: 19464 - DNA, 121 bp, Artificial Sequence
  Synthesized
  misc_feature (61): n=t or c
tgctcccagccaaagttaattttacttccactttgcaatagaagagactgcaaagaccctntggaagctttccccaaaccaattcagtgctcacaggacaatgctgtgtgtcagcatccag

SEQ ID NO: 19465 - DNA, 121 bp, Artificial Sequence
  Synthesized
  misc_feature (61): n=a or t
attagaatgttccccagcccacatcatctagtctttgtcattgttgctgcaacttagatanctaatatttgcatcgcatatagaaaacaagatattgttttcctccttatgaattagtaga

SEQ ID NO: 19466 - DNA, 121 bp, Artificial Sequence
  Synthesized
  misc_feature (61): n=t or g
gctctgtatgcgtgacagttcatctcaatctgcgttatcacaaaatgaattgcatctacanctttcacatatactacatagaaatatcctcagtgtctaacagaactgagccaacaaccac

SEQ ID NO: 19467 - DNA, 121 bp, Artificial Sequence
  Synthesized
  misc_feature (61): n=a or g
aattgaatgctttaaaaaacagttccttcactgactttagcatcctatttaaatgctgganacaacttctctcttagaaagtgacctgctgctgttgtggactacagctaatattggaacg

SEQ ID NO: 19468 - DNA, 121 bp, Artificial Sequence
  Synthesized
  misc_feature (61): n=a or g
atgtaagcacaacactgactccaattgctgccacagacataggtctgtctcagagtttcanacccacagatgtaaagttctagaagcattcactcagaagggagtttaaataaatgtttct

SEQ ID NO: 19469 - DNA, 121 bp, Artificial Sequence
  Synthesized
  misc_feature (61): n=a or g
gtctctcctaatacatgttgtcataagagatcctaagacacaaaatgaagcagtaaagatntcatataagggtggaactgctgtaactgtgcagtcctaagacatttctcctcattctgtg

SEQ ID NO: 19470 - DNA, 121 bp, Artificial Sequence
  Synthesized
  misc_feature (61): n=a or g
tctaaatcatttcactattcacattttctgcatagtaagattactggggtgtatcctaccnttaatagtcagaatgactgaccaagaagtacagattgccacaataaaacctaaagctgca

SEQ ID NO: 19471 - DNA, 121 bp, Artificial Sequence
  Synthesized
  misc_feature (61): n=t or c
tgcctgtaaataaataaagcattaaatgggataacaattttcctcatgctaaatcacgganaccatcaatcacatttcaaaggctctatcatggtatttaatttaagcagttaagcaccac

SEQ ID NO: 19472 - DNA, 121 bp, Artificial Sequence
  Synthesized
  misc_feature (61): n=t or c
acagaggactggcaggcagagggatcaggcacttcaggtagcttcagctgcacacctgcangtcctgtgctcctagcattccatggatcagactcacttcacacagtgccttcttcaagtt

SEQ ID NO: 19473 - DNA, 121 bp, Artificial Sequence
  Synthesized
  misc_feature (61): n=t or c
gctgcgtcacaagaagtgccgcctgttgcagagatgatcgcttgtggcttttctctgctcnttgaatgcatgcaccctgcaattatcttccccgttattaaactggttggagtggtcagag

SEQ ID NO: 19474 - DNA, 121 bp, Artificial Sequence
  Synthesized
  misc_feature (61): n=t or c
gggaaagcctcggagactcgttctgaaacaaggctgcccttttattctcctttacgactgngttttaatatccacaaacacccctccctccccgggcggctgccagtagagcctgcatcgc

SEQ ID NO: 19475 - DNA, 121 bp, Artificial Sequence
  Synthesized
  misc_feature (61): n=a or g
gacatcacttacatcaacaggcataccagcagctgcacaaagcagagtcccagagccaacnctatatccagaattcagtggaccttacagaaatccttggttctaaaccagatgaaatgaa

SEQ ID NO: 19476 - DNA, 121 bp, Artificial Sequence
  Synthesized
  misc_feature (61): n=t or c
aagtccagaagcccatggaaaagacagcacaaaactgctatagatatgcaagcgtccaaangagagactgtgctcccaaaacagcagcagcagcaatgtctgaccacagagctcagatgta

SEQ ID NO: 19477 - DNA, 121 bp, Artificial Sequence
  Synthesized
  misc_feature (61): n=c or g
ggggtcagcgcccggccggactgttgactgccagccacattcctttgtcctgatttgattngttagcagcgtttggctgggacacagagacagctaatgagggactgagtttattgcagtt

SEQ ID NO: 19478 - DNA, 121 bp, Artificial Sequence
  Synthesized
  misc_feature (61): n=a or g
gctctgttggctttcagagactgctgcacccctcagataaagaccttacccagtaaccctnaaaccagccctggtgagctgcagcctggccaccctgagctgcaggctgcggtgacccctg

SEQ ID NO: 19479 - DNA, 121 bp, Artificial Sequence
  Synthesized
  misc_feature (61): n=t or g
ggaacactttttaagtttatctctagccatgctgaaatttgtatatggaatggagatgacntgcagctattatctatgtaaaataaaagttggtaaatgaaatctgcccaaaatatgtatc

SEQ ID NO: 19480 - DNA, 121 bp, Artificial Sequence
  Synthesized
  misc_feature (61): n=c or g
agtgtataaagttgtctgagatgttttaatttgatttcttctaaggagagcagacatgggnaagtgacaattgcaggaataagtgtatttataagcgtgtatgttccttcacagatcagca

SEQ ID NO: 19481 - DNA, 121 bp, Artificial Sequence
  Synthesized
  misc_feature (61): n=a or g
catttgtactgtttatataggaaagctccaggtaacaacagatgtactttatctgttgatntcttcgtgctttagaaaggaagggaaggacaggaaaactgagattcatgaataaggcaga

SEQ ID NO: 19482 - DNA, 121 bp, Artificial Sequence
  Synthesized
  misc_feature (61): n=a or g
gcttaacactgtacaatgcagcagcactgatcaagtcatgattcttcactattaccagtcnaactattggctaattctatatgacttatggaaattattaacatagagctgtattacatat

SEQ ID NO: 19483 - DNA, 121 bp, Artificial Sequence
  Synthesized
  misc_feature (61): n=t or c
aactgcctatttatttagactgaattttggtgtgggaagaaggattaagcatttatatttnctccaagcttatgtgtctttgtgcatggatgctgttttggattttgctgacagagctgaa

SEQ ID NO: 19484 - DNA, 121 bp, Artificial Sequence
  Synthesized
  misc_feature (61): n=t or c
ggtagagtaccttggtcccattcaattcctgtcacacctgagtgttgtacttctctgggangtaatatagaatgattgccccagattaacaagcttgccaatactcaggatgctctttcat

SEQ ID NO: 19485 - DNA, 121 bp, Artificial Sequence
  Synthesized
  misc_feature (61): n=a or g
tagcacaaataattttagcattcttttttttttcttttctttttgaaagttgttgatgccntgtgctgcaaaaactgttgtctgatgctgagtgtttccacatcatattaaacacccattg

SEQ ID NO: 19486 - DNA, 121 bp, Artificial Sequence
  Synthesized
  misc_feature (61): n=a or g
cacaagcaatttttcagtgttttgcttctgtaactcaacctcttagcttgactccttgtcnaggattgtttgctgtctcgctgccgtatttatcttatgccaaaagcaaactatacaaaaa

SEQ ID NO: 19487 - DNA, 121 bp, Artificial Sequence
  Synthesized
  misc_feature (61): n=t or c
ctcttaaatcataacgaagaatacagattagaaggtgtaaagcacgtaaataagctaaaancaacacaaacatggccatttcagcctggaacacattaaccccttggaacccaagctgtgg

SEQ ID NO: 19488 - DNA, 121 bp, Artificial Sequence
  Synthesized
  misc_feature (61): n=t or c
gttttaagcagaacaaaagcaataccaaaaggaaatgtttgcaatattcagtattcaacgntgacgctttcaaaagatgtgtttccttgcggagccaagcagttgactccctgccactaat

SEQ ID NO: 19489 - DNA, 121 bp, Artificial Sequence
  Synthesized
  misc_feature (61): n=a or t
ttgtaggtttcctttaaatattttactacctaataaatactccagcagcaatgtagacganttttaacagagtgtctttctggtcctattcatgctaatttataagatttaccacaattac

SEQ ID NO: 19490 - DNA, 121 bp, Artificial Sequence
  Synthesized
  misc_feature (61): n=t or c
ccatggccagatgtggctgcgtttgactagtttcaggccaggccacatctgctgctgttgnagtaggcctgcagcccctaacaggccatgggtctgcaccatccaatcatccctaagggac

SEQ ID NO: 19491 - DNA, 121 bp, Artificial Sequence
  Synthesized
  misc_feature (61): n=a or g
agtaggtaagtaatgaggatgtggactttgatacagtctgttattttctctgatattatanttgaacagaattactgagatgatttgcaggacatttgtggcacgtgggtttagaagacca

SEQ ID NO: 19492 - DNA, 121 bp, Artificial Sequence
  Synthesized
  misc_feature (61): n=t or g
gttgcacacttattctctccacagactcgctttcagtcttaaactgaaaatgcatagttgngaatggaacatcaactgctgatgttatcagctaagcaactgctaatgttgtttcaataag

SEQ ID NO: 19493 - DNA, 121 bp, Artificial Sequence
  Synthesized
  misc_feature (61): n=a or t
ttctcctgtgaagctttggacaaagaggctgaacatttctacaggtccaaatgccagaagnagtcaaaaaacactgagctgagacctggctgtacacaccgtgcatagagcattatgagac

SEQ ID NO: 19494 - DNA, 121 bp, Artificial Sequence
  Synthesized
  misc_feature (61): n=a or c
cacccaagtaccaggttcaagttcacaggaggtagaaaagaccacatcacacagagccatncccatctccctgaaaataacagatttttgcactaggttcccaagcaacaaactttcttta

SEQ ID NO: 19495 - DNA, 121 bp, Artificial Sequence
  Synthesized
  misc_feature (61): n=t or c
ttttaacaaataagttaaactgtgcattctgcttgctaccaacagagattgtatgaagaantggttcaagaggtcttgctgggtgccatgttatctttgcctgcactaaagagtatctcca

SEQ ID NO: 19496 - DNA, 121 bp, Artificial Sequence
  Synthesized
  misc_feature (61): n=c or g
gcagcagtgggagcagcaatttggtataccaacagatctgttctccaatggggcgctccanctgaggctgatgaaggcaccaagatcattattatattttttccctatggacaaacaggaa

SEQ ID NO: 19497 - DNA, 121 bp, Artificial Sequence
  Synthesized
  misc_feature (61): n=t or c
aacgttaggtggtgctgtgcattctcaaataagtcaaggttcacttagcaaatggtgcttnttctgaagccagcacgatcatttgcacaacgaggttcctatacaatggatgcagggctaa

SEQ ID NO: 19498 - DNA, 121 bp, Artificial Sequence
  Synthesized
  misc_feature (61): n=t or c
cctccttcctctctcactgctttccttccctcagatgtggtcttcctcagcccagaacagnccccctccaagcagtgggagccatctcttctgaagggaatgtgtgaaggttgctcttccc

SEQ ID NO: 19499 - DNA, 121 bp, Artificial Sequence
  Synthesized
  misc_feature (61): n=t or c
gcacagcagggagggacagccagacttgtgtgtggtttgtgttatgtttgtcacctcgtanatcagcccatgccctgaggaagctcctcacctaaggacatgccacccatgtgctctgtgc

SEQ ID NO: 19500 - DNA, 121 bp, Artificial Sequence
  Synthesized
  misc_feature (61): n=t or c
taaatttctccagtttagaggcacacagcagcacctacaaaaggagaactgggaagttttnctttgacatttcagggacagcctgcttccttgatttcctacagcaactgcacagcagggc

SEQ ID NO: 19501 - DNA, 121 bp, Artificial Sequence
  Synthesized
  misc_feature (61): n=t or c
ggagaaaacattttaacctattaaaaccagatggtcctattcaccttttctgcctatttantgttccacctgcacctcagtgtgaaggagataattctcctcccttgctctcatttatatg

SEQ ID NO: 19502 - DNA, 121 bp, Artificial Sequence
  Synthesized
  misc_feature (61): n=t or c
aggtgttcggtatgcaccggtttaatcaggacaaatgcacagcagagaagggatcagcacngggggaggtttgcaattcagatgagatcagcgccggcgcaaagcagtgatcccagcagaa

SEQ ID NO: 19503 - DNA, 121 bp, Artificial Sequence
  Synthesized
  misc_feature (61): n=t or c
aataccagcaagggcagctgcttcgcgtcaagtagaagtagtgtattacatgaagttattnggagagcacatttcagtccccattctgggcactggttttgtgagaggtgccagggcacaa

SEQ ID NO: 19504 - DNA, 121 bp, Artificial Sequence
  Synthesized
  misc_feature (61): n=t or c
cccttattcccctgaaatgtccctgaggctgtgaatctggagctcactgcagcagacctangttcgtgtttgagatttgaaatagagtattatgggtattgtctctccttgagtaagagga

SEQ ID NO: 19505 - DNA, 121 bp, Artificial Sequence
  Synthesized
  misc_feature (61): n=a or g
acagcttctccaaaaataaaggcagcaggagcctaacaccgagttctcaggagccaaccgntgtgctctggaatagcagccctgtcaccatcccagttagctatggtctggttctaccact

SEQ ID NO: 19506 - DNA, 121 bp, Artificial Sequence
  Synthesized
  misc_feature (61): n=t or c
cccagattaatcctgacaaagctgttagcctaggtgaaattctcagtggcaatattatctnagcttgtgtactccaagttctcacaacaatagaataaccagcatctctttcacagcccca

SEQ ID NO: 19507 - DNA, 121 bp, Artificial Sequence
  Synthesized
  misc_feature (61): n=a or g
tagccaaaaacacacttcaattcccatgtccaggtatgctactgtggacagactttcctcngatgctttatcatggtgcttagcataagctccttgttagcgttgagttaaaagggtaaag

SEQ ID NO: 19508 - DNA, 121 bp, Artificial Sequence
  Synthesized
  misc_feature (61): n=a or t
tttcaggtaagcacctcgtttttgtttttaaacctatgaattctttccaagtgtctaacangagcagtgaaggcttggtttgtattgttgccaagcacacaaacaatcccagcctttccca

SEQ ID NO: 19509 - DNA, 121 bp, Artificial Sequence
  Synthesized
  misc_feature (61): n=a or g
tcttagaagccattctgagaggatggagagtaagatggataccatttatttttttaatgcnaaataccatcttttgtagaacagagtatctgtattcaagacttctttcattggagatgtt

SEQ ID NO: 19510 - DNA, 121 bp, Artificial Sequence
  Synthesized
  misc_feature (61): n=t or g
ttcaaatctggaaatcctctgctgaagcttatggttcttagaaaggccattttcaatatangaagcctacagatcagatgaaatagtctactggcctgctgtgagccctgcatgtacaaag

SEQ ID NO: 19511 - DNA, 121 bp, Artificial Sequence
  Synthesized
  misc_feature (61): n=t or c
tattccgaaaggaaaatttcttttgattgtttcagtaaaccagtacctaagagacagacangagtttccacttgtgagagttgtatagattagagttgtgtaactgcacacaagaaaaagt

SEQ ID NO: 19512 - DNA, 121 bp, Artificial Sequence
  Synthesized
  misc_feature (61): n=t or c
ttttaaatctgagggaggctctgatatgacttaactggtgtaatttggattaatttgaaangttctaagtgcttatatgttgttattcaaaatacaatatatgctgaagcagcctgaagaa

SEQ ID NO: 19513 - DNA, 121 bp, Artificial Sequence
  Synthesized
  misc_feature (61): n=a or g
tcctgaccccacactcagcttttccaggtctttctacaactcttcctgcctgttttagagntcactcgattcaggctgctccacacaaggacagtgcccttgaaataagtgtgcacaccta

SEQ ID NO: 19514 - DNA, 121 bp, Artificial Sequence
  Synthesized
  misc_feature (61): n=a or g
catatgatttttctcagaaaccctctctgtttgtgatactgctcatttccactgtctccangtgacatagactttgatatagtttcatgtaatatagagtagttttcagtaaaaaaaaaaa

SEQ ID NO: 19515 - DNA, 121 bp, Artificial Sequence
  Synthesized
  misc_feature (61): n=t or c
tgggtcttgataatgtactgtttacttttttccccaccagtttaaacaatagtagtttcantttttgtcttatgcttgctcaacactgtgatatttctactgcaaacatgcaggaatttat

SEQ ID NO: 19516 - DNA, 121 bp, Artificial Sequence
  Synthesized
  misc_feature (61): n=t or c
cccgtggctgtagtatctcagcagagcacgacgatgggattcagattgtttcctcagcacngttcctctgtccctgtctcctctgctcttctatcattttcaggtacatgatctgctggtc

SEQ ID NO: 19517 - DNA, 121 bp, Artificial Sequence
  Synthesized
  misc_feature (61): n=a or g
tatcacttgaggtgaaggcttacagcttagtaagagaaaaatatatctttagcaggatttnggagtgatatgatgccagtttagtttattttgagataaggtaagcttggttttgctacac

SEQ ID NO: 19518 - DNA, 121 bp, Artificial Sequence
  Synthesized
  misc_feature (61): n=t or g
gcacggcacatgcagaacagccaggcacagccatctgttacctttgcagtactggagcacngtctccatggcgcatttcctgtctgtagcccacctgattcgagctgatccagtgattttg

SEQ ID NO: 19519 - DNA, 121 bp, Artificial Sequence
  Synthesized
  misc_feature (61): n=t or c
tgcaactgacaaggatttataattgcagaataattcactgaattacaattaacacatgcantacatttcccacaacactataaatccaaatttcactctaaatccaaattctactgaagtg

SEQ ID NO: 19520 - DNA, 121 bp, Artificial Sequence
  Synthesized
  misc_feature (61): n=a or c
ccttggcagcactgctggtgatagagttatacagatctctggttgctaattccttttgtcnaactgttgtacaccacgttttttcccatgttgatcatgtaggttcttttggcctttggaa

SEQ ID NO: 19521 - DNA, 121 bp, Artificial Sequence
  Synthesized
  misc_feature (61): n=t or g
ccccactcctgactggcacgggctttctcccacctactgcaggcaccgtagatgtgtttgnaagccttattcactacagctgagaagtcacacatgatgagtgctcctaagcacactgcca

SEQ ID NO: 19522 - DNA, 121 bp, Artificial Sequence
  Synthesized
  misc_feature (61): n=t or c
cgtcggcataaaaagagctcccgtcttctaaagactttctcagcgacaaagattccacagntgcacacagacaaacccggccgagaacttcggaagccctcgtttcgtacagacggatgga

SEQ ID NO: 19523 - DNA, 121 bp, Artificial Sequence
  Synthesized
  misc_feature (61): n=a or c
tgataggacatcccctcctcttacagagctcactgctcaccacttccatctgaagcacttnatattgcaaaacctgactacacaatggattgggagggagtgttgatctgccagatggcag

SEQ ID NO: 19524 - DNA, 121 bp, Artificial Sequence
  Synthesized
  misc_feature (61): n=t or g
ctgggctttcccacatctggtttgatgttaggacagagcagatttcattccagcaggaagncttcttgcatctctccatgtccaacttgccctgtaattcccaaatcaggcttgactcatg

SEQ ID NO: 19525 - DNA, 121 bp, Artificial Sequence
  Synthesized
  misc_feature (61): n=a or g
ctaacctcttaacaaaaatgttgaaattggtgagtgggcagcgctttggtgtgcacgtgtntgtgaatgtgtatcagtcaacagtgcatggaggtccttctaggatgctgttcacactatt

SEQ ID NO: 19526 - DNA, 121 bp, Artificial Sequence
  Synthesized
  misc_feature (61): n=a or g
gatctagttttgctgttcagacaaagcactgccttattatacaagcaactgataagtacgnctaaaagctttcattagtttgttcctatgacagactagcaagagctttcatgctttggtc

SEQ ID NO: 19527 - DNA, 121 bp, Artificial Sequence
  Synthesized
  misc_feature (61): n=t or c
taacctccatcttctctatcttgtgtatgaaaactgcatagtgcaacttaaacttttaganggaatgcatcatcacatgagctgccttgacagaaagtcctcactaaggtcattaatatct

SEQ ID NO: 19528 - DNA, 121 bp, Artificial Sequence
  Synthesized
  misc_feature (61): n=a or t
tattccaaggaaaaaaaatggtggcagtttactaggaaataacactaagggagacataaangtttcagtgtcacaacgaagaacatgattttagctaagctgcagagaaacaatctgaaaa

SEQ ID NO: 19529 - DNA, 121 bp, Artificial Sequence
  Synthesized
  misc_feature (61): n=t or c
ataaagggtacaagtcagcacagagtctaagtacatgaggtttcatttgcaaggaggatancacatagattacagcttttacttagccatagtctataatctttgtgtctatcactcagta

SEQ ID NO: 19530 - DNA, 121 bp, Artificial Sequence
  Synthesized
  misc_feature (61): n=a or t
tgctgcaggacactgggtgacaccaggcagtgggtcagctgctcgattcccagcacaaacngtgagtagggagggcaagtgatcctctgaatacatgcagatattggtaaattaaggctga

SEQ ID NO: 19531 - DNA, 121 bp, Artificial Sequence
  Synthesized
  misc_feature (61): n=t or c
atccttttgggtctggatggacatcaggtaagtactgaaatcagaacctattgggtgagtnataaataacaaaaaaagttcgccatcatacagtaacatgtaagtcaatctcaggtactta

SEQ ID NO: 19532 - DNA, 121 bp, Artificial Sequence
  Synthesized
  misc_feature (61): n=a or g
ttttagaaagatcatgaggagacttctcattttaatgtgcagggtattcagttttattacntcagcgaaaacctggggttttaagatatactttgtcctgaatgggacagctcagctaagt

SEQ ID NO: 19533 - DNA, 121 bp, Artificial Sequence
  Synthesized
  misc_feature (61): n=t or c
agaatagtcagtgtcaggtaaaaaactggtgttttgtcttttggtgactaatagaagaagntttattgcaagaataataaaacagcttcagtgccggtatgaagtgtgtgtggtcacagct

SEQ ID NO: 19534 - DNA, 121 bp, Artificial Sequence
  Synthesized
  misc_feature (61): n=a or g
ctcctaatcaacatttttccctagaatagtcttcatccttacctctgtgctgagggatcgnagagtgaggtcaaagtcattagtccctgacaaaagccctagcaggtcccactaagcacgc

SEQ ID NO: 19535 - DNA, 121 bp, Artificial Sequence
  Synthesized
  misc_feature (61): n=a or g
tgagaattaacaaaggataagcttgaccaatctgtgaccaaccaaagataaccttgaccanctttctcatatggataatgggaataatagcacttatttatggagcagggctactgttaaa

SEQ ID NO: 19536 - DNA, 121 bp, Artificial Sequence
  Synthesized
  misc_feature (61): n=t or c
gaaaattgtgcccaaaacattcccaggaatttggagcacaaatgcatgaattgcgtggttnatagtccaaggatcacccagcatctgtacacagaaaaatcttggtggacacattctttta

SEQ ID NO: 19537 - DNA, 121 bp, Artificial Sequence
  Synthesized
  misc_feature (61): n=a or g
ttgatgcctataacaagctctgtttccttatatgtttcactgccaagtgcttgtgaaaacntgtatgtatgcataaagcatttgtactgaaaaaattgcctacttgtatgaccataagcta

SEQ ID NO: 19538 - DNA, 121 bp, Artificial Sequence
  Synthesized
  misc_feature (61): n=c or g
tcagttatttatgtatctgtattccaaacaggaaccttgtttgttgtgaatgctaggcttnaattttcatagttcagatgtggtgagaaacagcacattgcagatctctttaaatcacacc

SEQ ID NO: 19539 - DNA, 121 bp, Artificial Sequence
  Synthesized
  misc_feature (61): n=a or g
gccacagatgcatctcatcagtaacttccatttgggttaaggcagcaagcctcatgcaacnaagaaccagaggcaaggttcttaaattttggtggatgcctaattctgaggacacccaagg

SEQ ID NO: 19540 - DNA, 121 bp, Artificial Sequence
  Synthesized
  misc_feature (61): n=t or c
ggtttggaggggctgatgccatgagattctctgcttattgcctttgcctgtgaactgtctnatcaagggtcatcttttctttaatattctgatagagtgagaaaagtttcttgctcaagtt

SEQ ID NO: 19541 - DNA, 121 bp, Artificial Sequence
  Synthesized
  misc_feature (61): n=a or t
gggaagtcaaggggaataactcaaagaacagtgcatcctggactcagttctacaggatacntacaacaactttaatctcagactgtctccaccctgcccatggcagaagggttggaattgg

SEQ ID NO: 19542 - DNA, 121 bp, Artificial Sequence
  Synthesized
  misc_feature (61): n=t or c
gcaaatggcagtacggatgtaaggccagtccaggtcacatgatcagttctgttactgcaanagcgtaatacatcaaaagcaaatgcgtatccagaagcatttctgttcaagtctgacagct

SEQ ID NO: 19543 - DNA, 121 bp, Artificial Sequence
  Synthesized
  misc_feature (61): n=t or c
gcaaggaacttcaacttttgcatttactggcttctgtgcttatggctgtgtgaagcattgngttaaatacacagtagtttctagcacctaataaggaaggactctcttactgttattgtta

SEQ ID NO: 19544 - DNA, 121 bp, Artificial Sequence
  Synthesized
  misc_feature (61): n=t or c
ttctgtcatctgacacaatgggagcagaaccacagggcattgaaatattagtgtactctgngagtagagcatgtctggaggcacaggtaagtgtttaagttccacttggcagagttaagat

SEQ ID NO: 19545 - DNA, 121 bp, Artificial Sequence
  Synthesized
  misc_feature (61): n=c or g
taactgctgtgaaacacttccaggacacaaccaagaggggattctgagatcgtttttcaanccctgcgactgtgagccagttgcagcatgaggaaaagccctccaacaccccaatgtacag

SEQ ID NO: 19546 - DNA, 121 bp, Artificial Sequence
  Synthesized
  misc_feature (61): n=a or c
ttctcacagcacagtttctgggcaagaaaactttcaaagctctcctacggactgcactctncctcagaccttaaagtaaatgggtgcaggtaacaggtggaactttggctgctgctcagac

SEQ ID NO: 19547 - DNA, 121 bp, Artificial Sequence
  Synthesized
  misc_feature (61): n=a or t
catgtgctgctattgttctgataactctagcttatatgcattacaatcgcatcgcactgantcctagtgtggacacccatgtgcctacacagagagacgtgtttatacctgcctaatttat

SEQ ID NO: 19548 - DNA, 121 bp, Artificial Sequence
  Synthesized
  misc_feature (61): n=a or g
aggcaaaggacgatactgattcatatacctcccagtcaactcagcagcaacagagtaagtncagtttatggagaccttcacaggtcagagactgctgactctatatgggtaggtctagaag

SEQ ID NO: 19549 - DNA, 121 bp, Artificial Sequence
  Synthesized
  misc_feature (61): n=t or c
ctttgcaaagaagatgagtataattcgggatggtcaggaaatttcagatgggataaagatntattgtagagtactgattcaataggaccaaccagtttggctctggtttttgttgtctaat

SEQ ID NO: 19550 - DNA, 121 bp, Artificial Sequence
  Synthesized
  misc_feature (61): n=a or g
tgcattcatttccattttcacttgatctctgcactagaaaggtaggctcactgggcagctntggtgtgtgcatgaaatcatgtcgtaacagatgaaaaggccaaagccagctctgtttttt

SEQ ID NO: 19551 - DNA, 121 bp, Artificial Sequence
  Synthesized
  misc_feature (61): n=c or g
atgaggttttgaggggtctacagtgggtgtagatctagatacttcactttgtcctcatagnaagacattagatacagaccaaccctgctctgagtagaaaccatggtactgtgtccatcct

SEQ ID NO: 19552 - DNA, 121 bp, Artificial Sequence
  Synthesized
  misc_feature (61): n=a or g
cgttttttctctttttttttttcttttttttttttttccctattttggcacagaaaatagnaaacaaaggaggggaaaacaggaaaggagaaagtgcaaatatgtgaattatctttgtcac

SEQ ID NO: 19553 - DNA, 121 bp, Artificial Sequence
  Synthesized
  misc_feature (61): n=t or c
caaataatgaagaacaaaagcattcttaccaaaaagctttagttttgatttggccacctgnggaaaaccattctgttagtaagactgattcctactatcatgtgcacgatcagcttacttc

SEQ ID NO: 19554 - DNA, 121 bp, Artificial Sequence
  Synthesized
  misc_feature (61): n=t or c
acgttcaccttagaatttcacacctactttttagtccagcagatctctgagcatgatcaangttaattaagacctggttcagtgaaacatagaactaattgcttaattcgaagcaaacatt

SEQ ID NO: 19555 - DNA, 121 bp, Artificial Sequence
  Synthesized
  misc_feature (61): n=t or c
caccatctgtataacttagagagccactaatagttaaatcacctaagcaggaaagacagangtgctgttcacacctgcacatatttcctcttcccttgggacagtaccactgtggcactgc

SEQ ID NO: 19556 - DNA, 121 bp, Artificial Sequence
  Synthesized
  misc_feature (61): n=a or t
cacaatgaaagaacttctctgatttagagggaataaggaaaaatgaggacactgaagtgtntaagaaaaggctgctcattaccagtctatcctgtaactgcactagtatgtttataggcat

SEQ ID NO: 19557 - DNA, 121 bp, Artificial Sequence
  Synthesized
  misc_feature (61): n=c or g
cagactaaattttcagtgaatagaacagcttcagaattttattgaatgacttttctgtttnattgattggtttgtttggttcattttctttttctttgtttaaagagaaaccaatttatac

SEQ ID NO: 19558 - DNA, 121 bp, Artificial Sequence
  Synthesized
  misc_feature (61): n=c or g
agttctacgagtttcactctcacaagcaagtaatttaatacaggacctgcatgccttccanagaaatcctttggctgccctcctttgaaaacccctaaaagtttggattccttgtgtactc

SEQ ID NO: 19559 - DNA, 121 bp, Artificial Sequence
  Synthesized
  misc_feature (61): n=a or g
tttacttcatgtgttttaatactgtgccttttaactcataatagttttcaatgcctgaagnacaaactcagactataatggcagttgatgagcttcaagccataatacaaagatgcgtaag

SEQ ID NO: 19560 - DNA, 121 bp, Artificial Sequence
  Synthesized
  misc_feature (61): n=a or g
tgctctttctaacagctgttcatactgttgtaaaagaattcagcagaccaaaaaggctgtnaactgatcgctgctgagtgaagctagtggcatgaggaagataaatcaatcaattgtactt

SEQ ID NO: 19561 - DNA, 121 bp, Artificial Sequence
  Synthesized
  misc_feature (61): n=a or g
taatgggctgaccgtaatgtcctccatcttccccatccctgttcaggaaggaaaatgagcnaacagctgggtgggagtttgccccttcaccaaagttaacccctccagcagagcctttctc

SEQ ID NO: 19562 - DNA, 121 bp, Artificial Sequence
  Synthesized
  misc_feature (61): n=t or c
ctcactgtcatcaagaaacccggttgtttgagtaatctccactactgcatcccacatgcangttacagccatatatcaaaatcagagcatcccagcctctcagatacagcaggcgtggggc

SEQ ID NO: 19563 - DNA, 121 bp, Artificial Sequence
  Synthesized
  misc_feature (61): n=a or g
tctcgttgccatggaaactggatccgatgtcatctctcttcactgttccatgatgctttgnggatggttgtagccattctcccagccctgctgtgggcaggagttgtggggtgtctgtgct

SEQ ID NO: 19564 - DNA, 121 bp, Artificial Sequence
  Synthesized
  misc_feature (61): n=a or g
tggttttcaaacttgtttttctttttgattcatcctccaggcagtaaaacaggctgagccntaccttcacagaaggcgccagtgctagagaatactcctcactaaaactggttcagtgaaa

SEQ ID NO: 19565 - DNA, 121 bp, Artificial Sequence
  Synthesized
  misc_feature (61): n=t or c
atgttctaatgggaacagtatataacagttatgaggaaacgtggaaaagtggtcacatggntggaatggtgttaccctgatgtgcttttagtctcctactacacttgcagacccagtggtt

SEQ ID NO: 19566 - DNA, 121 bp, Artificial Sequence
  Synthesized
  misc_feature (61): n=a or c
gctgaagaagttcggatacaacactcctgtggatccccacactgcattctatttcacacancacatctgaacaaagctggattataggaacactgaaaagtttggatttctcgtctgccaa

SEQ ID NO: 19567 - DNA, 121 bp, Artificial Sequence
  Synthesized
  misc_feature (61): n=t or c
tatgagttttacgtagagtgcaggttcttcaacttggatggcaaaggcagctcttccgccntaagacgctgatggataactggatcaggaggtcttctcagcaaaaccggtttcagcactc

SEQ ID NO: 19568 - DNA, 121 bp, Artificial Sequence
  Synthesized
  misc_feature (61): n=a or g
taaggctaaatcactggcagaataacaggatgcttgcttgatcagtgtctaccttatactntggctttgtcacactcaggatcgaagttttgttctaaagtgtcttttttatctcagagca

SEQ ID NO: 19569 - DNA, 121 bp, Artificial Sequence
  Synthesized
  misc_feature (61): n=t or c
tgcagtttcaggagctgctggtctgctgctacttctgtgaaagaagcattttccttaacangtaacagaggctgtagaaggtgaagtgaaaaatggttaggatgctgtaacgtgcacaatt

SEQ ID NO: 19570 - DNA, 121 bp, Artificial Sequence
  Synthesized
  misc_feature (61): n=t or c
aaaatcacgtgtcatttcattgtagacttttaccttgaatgtaaactacttgagtgttccnttcagcatatggagaggtgctgtaaatgagatttggcaaatacataattacatgctcaga

SEQ ID NO: 19571 - DNA, 121 bp, Artificial Sequence
  Synthesized
  misc_feature (61): n=t or g
tctgatgccctcgatcaacctgcagaaagatcactcgcatacaagcttggacagaggtctnaaagcctgcagttgtgtccctgctgcaacaaggctgccacgactgccaaaacaattcacc

SEQ ID NO: 19572 - DNA, 121 bp, Artificial Sequence
  Synthesized
  misc_feature (61): n=a or g
ggaatgctaagtcgttctataggctcctcctgaaacgtgtcccagggacagcagtttaganacaacacttgtacaaaccactaataccactatgatacaagtacacatagtgctttttcct

SEQ ID NO: 19573 - DNA, 121 bp, Artificial Sequence
  Synthesized
  misc_feature (61): n=a or g
ttaacgatatcagcaataaacttactccaagcacatctttggtcaattctagagaatatgntaaaatctctctgattgggctacaaggacctccaaatgtgctgattctaaaggtacccaa

SEQ ID NO: 19574 - DNA, 121 bp, Artificial Sequence
  Synthesized
  misc_feature (61): n=a or g
tatatccagaaagttttcagattaactgagtctcagttttaatatatatggttcaaaatcntctgttaggaaaactgtgtgaggctcacagctctataaatactctttttggttcacgctc

SEQ ID NO: 19575 - DNA, 121 bp, Artificial Sequence
  Synthesized
  misc_feature (61): n=a or g
gagttcctcaaaaagagattcctgtcattcttcttccaaaataagaaaaatgctcagagtncagttaatggtataacaggtacactgaaaaggggtgatcctctataacactcatcagatt

SEQ ID NO: 19576 - DNA, 121 bp, Artificial Sequence
  Synthesized
  misc_feature (61): n=a or c
ctttcatggtggctatgctgtgctagggatctggtccaacccttaactggtgtaaatcagntctgttatcttctctttaaattgccaagtactgacgttctcaaagcctccaatagcttca

SEQ ID NO: 19577 - DNA, 121 bp, Artificial Sequence
  Synthesized
  misc_feature (61): n=a or g
gctaaacaactcagtgctgctgaacatttcaatctgaaaaagcaaaagtcatcctcacttngacctaaagagaaaggaaagctcttgtaaactcacaggacaaatatggtttctccatgaa

SEQ ID NO: 19578 - DNA, 121 bp, Artificial Sequence
  Synthesized
  misc_feature (61): n=t or c
ttctttcagctataggcacgctccagccaaagctcttcagtccttactgaactgaggatgncagaagaaagaatgtaatcttattcacggtatgtacaaatttacttccccctcaatttct

SEQ ID NO: 19579 - DNA, 121 bp, Artificial Sequence
  Synthesized
  misc_feature (61): n=t or c
actcgagcagcctgtgggaaaggaagccaagctgtagatgtgatcttgcaaacctcttccnggctgggcagttacagagcagttaatgaggctgctcaatgagaacaggccagttcacaca

SEQ ID NO: 19580 - DNA, 121 bp, Artificial Sequence
  Synthesized
  misc_feature (61): n=t or c
tttttgtaaatcttttttttttttttttaaccaaatatgagccctgacctacccagcacangacctttaggctggataaaagctttgcttttagtagcaacaagcaggaaaatgccaagtg

SEQ ID NO: 19581 - DNA, 121 bp, Artificial Sequence
  Synthesized
  misc_feature (61): n=t or c
aatctttcaacgctacttcctctgtacataactattaatgttaaaatcccagttaagagcngttcagagtacggtggctaaaactggacaaagacagctgtcatagcaactgaaatagatg

SEQ ID NO: 19582 - DNA, 121 bp, Artificial Sequence
  Synthesized
  misc_feature (61): n=t or c
caactcctccttagctttgaggccagttctgaaagctgcgctataggaaaagggcagtcanggctttggaagcgctgcggtttcaccccgtcctgtaattcagacccgagaagtatttgga

SEQ ID NO: 19583 - DNA, 121 bp, Artificial Sequence
  Synthesized
  misc_feature (61): n=a or g
gctcctaactttgaacatttcattccagaggttcagacaagtcagttcacagtgctatgtncttcttgcacttgatcaactgggtcatctatatctaggggaaagggtggtggtgctcgga

SEQ ID NO: 19584 - DNA, 121 bp, Artificial Sequence
  Synthesized
  misc_feature (61): n=t or c
aaaaccatgcattaccatcagaatcacctttacctcctcaaactgatacttaacgctgccngtctttacttcatccaaaaaacctgcaagccaacccttgctgattaaagaattttaacac

SEQ ID NO: 19585 - DNA, 121 bp, Artificial Sequence
  Synthesized
  misc_feature (61): n=a or g
ccatccccatctccagcccaggacctgaggggtggccaaaacgggtactcctgttcccacnacacttcattttcctgcccagtccctcctttttcagaactcacaccacatttggtaacac

SEQ ID NO: 19586 - DNA, 121 bp, Artificial Sequence
  Synthesized
  misc_feature (61): n=t or c
ctttcaaaaactgcaggcacacaggtactctctggaagggcttagcacatagcttgaatanagcactcagcaaacactttcctttctagatagaatttaacaggctatgccctgttgtaga

SEQ ID NO: 19587 - DNA, 121 bp, Artificial Sequence
  Synthesized
  misc_feature (61): n=t or c
gaacttagtacatcagtcaagtaccagatcaattgcagctgagctttcctagccccagaanagtgcaaagcccccatatcaaataagccaaaacctaaggacaacaataagccaaaggaaa

SEQ ID NO: 19588 - DNA, 121 bp, Artificial Sequence
  Synthesized
  misc_feature (61): n=a or g
tgcacctccattctcaggatgtgcattaggtaacagatctgtcccacaatatggagtgcanttatgcaggtgaggcaacggaagctgcaagagtaaaccctctcgttgtgcttgaaatcag

SEQ ID NO: 19589 - DNA, 121 bp, Artificial Sequence
  Synthesized
  misc_feature (61): n=a or g
gcccgggctggaaattggattgttttgatgtctgtactgagtcgttcaggttggaatacanttcatgtttcagctgataagtctgcccatgtgtgactttcaaattaaaatctgtatgttc

SEQ ID NO: 19590 - DNA, 121 bp, Artificial Sequence
  Synthesized
  misc_feature (61): n=c or g
tttacagaagaaaaataaatgaaaagaaaaattcacgtttatactccagctgcgcaatagnatcttgggtttttccctattctctcctcccagagcttgtcagcagtaggaattcatatta

SEQ ID NO: 19591 - DNA, 121 bp, Artificial Sequence
  Synthesized
  misc_feature (61): n=t or c
agccactgagttatatagcttctaatcagtgtttatttgatgagaattaaaggtatttttnctgattttagcttcaggtgactactgactttaacttacagcaaacagtaagttcatgtgt

SEQ ID NO: 19592 - DNA, 121 bp, Artificial Sequence
  Synthesized
  misc_feature (61): n=a or t
aaacaagcaacttgggactgagaacagtcagttgcacaaaaaagcaagaaaataatagtanccatgtgccagctctgccttttacctctgtctgtttctgtcctttctagttctactggtt

SEQ ID NO: 19593 - DNA, 121 bp, Artificial Sequence
  Synthesized
  misc_feature (61): n=a or t
cgaacagaagaagtctaagaagaactggatgggaaaacatttctctcttaaccttagcaangtcaagtgagctgatgaaccaaccctgaggagctgtaattatatttgattactaaagtga

SEQ ID NO: 19594 - DNA, 121 bp, Artificial Sequence
  Synthesized
  misc_feature (61): n=a or g
attagaggaagcactggaatttcatcagcactcaacgcgcacactgtggtctaaaaagccnttttgaagtgtcaaagtgttctgttggaatagctgaattgtacagaactgtgcttattcc

SEQ ID NO: 19595 - DNA, 121 bp, Artificial Sequence
  Synthesized
  misc_feature (61): n=t or c
aggtagtaagggtaaggcaaatctgtcattttcagaccaatagttagagaatctgagttgntttatttctacaaggataattttatgttactcagagaagcttctaatttattaggtgagt

SEQ ID NO: 19596 - DNA, 121 bp, Artificial Sequence
  Synthesized
  misc_feature (61): n=a or g
atttttctcatatgaagatataagtcacgacaaacttcaggtagattttccttggtgttcncttgtacactcttctttacttgaaaaattcaaaccatgtagctgagaaagggtgaaatgg

SEQ ID NO: 19597 - DNA, 121 bp, Artificial Sequence
  Synthesized
  misc_feature (61): n=t or c
ttccaccagcaggtaaacctttggcagatcagaaattgttttccaacctgcagaatggaangggcacaagaaatatcccaggagtgcatcccagccaccatattatttattgtgtatcata

SEQ ID NO: 19598 - DNA, 121 bp, Artificial Sequence
  Synthesized
  misc_feature (61): n=a or g
agggaaggggattaattggactgctggcctcagctgcaaaagtacttcttaataaaccaantagaataatcaacagtattcaagtttgaatcttcttctacttttcatatatactttttga

SEQ ID NO: 19599 - DNA, 121 bp, Artificial Sequence
  Synthesized
  misc_feature (61): n=a or g
ttgcacagcctgccaagcttacggcaaagtggaataacaatggccttcagagccagacctncccaagagggcatacctgtgctctggctgcgagaacagacacacggtagatgtgcaggct

SEQ ID NO: 19600 - DNA, 121 bp, Artificial Sequence
  Synthesized
  misc_feature (61): n=a or t
actcatgcttagtgtccagctgactgatagttgactgagcactggaactggcaagcatttnagaaggtgttatgtctctgtcatctgcatgcatggtgctctgtgctaacacattaagtac

SEQ ID NO: 19601 - DNA, 121 bp, Artificial Sequence
  Synthesized
  misc_feature (61): n=t or c
cagagttaacttgtatttctggattccaggcacagcatacacaaataattcagtagtcaanggaccagtgcagaccaatggcaagctttaagggcacaatgtatagtgcattgctaattca

SEQ ID NO: 19602 - DNA, 121 bp, Artificial Sequence
  Synthesized
  misc_feature (61): n=a or g
ggggaccggcaccgccggggggacttcacagccctccaacctgcaaagggaaaacaacccnaaaaaacgcatcgatttgaatggcttttaggagaggaggttgctttattgtttctttctt

SEQ ID NO: 19603 - DNA, 121 bp, Artificial Sequence
  Synthesized
  misc_feature (61): n=a or t
tgagagtttcagacaccaagagtttcaataaagaaggctaggtgagttaaaaggcagaatnaataggcagggatggtattttcagtgtttaaagacatttacaaagtaattatccttaatc

SEQ ID NO: 19604 - DNA, 121 bp, Artificial Sequence
  Synthesized
  misc_feature (61): n=t or c
ctagttatccattaactcagcactagtgtagggacgggcctgatggcactgacgatcagtngagacagccgacgtcctacaagacctgtgaggctgacctctgtcaccatttcccttccag

SEQ ID NO: 19605 - DNA, 121 bp, Artificial Sequence
  Synthesized
  misc_feature (61): n=t or c
attaatctttgttgatccagggacaagaaaccagtccagaagtttcaagaggctgctgcangaagccagcttcagacatggaaaactgcaccatttgacttacaggataaacataattcat

SEQ ID NO: 19606 - DNA, 121 bp, Artificial Sequence
  Synthesized
  misc_feature (61): n=a or g
tttattggcacaaatgccatgtgaaagtaaggcaacaaagttctttggagccaaatgagtntcattcatttctgtcatcttgtagtattgctgctttaagcaatattgcaagcacagaaca

SEQ ID NO: 19607 - DNA, 121 bp, Artificial Sequence
  Synthesized
  misc_feature (61): n=t or c
ttaaaatgttacattaaaaaaacaaaacaaaacagaaagctgctgagtcaccgagcagccncatgaaggagtacagagggacaaaaagcactttcctactccggcagcactactcccaaca

SEQ ID NO: 19608 - DNA, 121 bp, Artificial Sequence
  Synthesized
  misc_feature (61): n=t or c
ctaatttaaaaaaaaactaagtctgaatatttttattttttttccaccacaagcgaacaantgtcttgatgattgatccttcctatcttacaaattatttatgagataaggtaaataaatc

SEQ ID NO: 19609 - DNA, 121 bp, Artificial Sequence
  Synthesized
  misc_feature (61): n=a or g
tggtactggatacagctctcctgatttactcctttaagtgctaggattgttaaatccttcnctgccctttgcacagacctacagcagaggaactcttgcaggcagttgtacagagaggctg

SEQ ID NO: 19610 - DNA, 121 bp, Artificial Sequence
  Synthesized
  misc_feature (61): n=a or g
taacttctctctataaaaaaaaacagaaattgagactttcctatatatagatacctcttcncacaaggactagaagatccacgtttcaattagttctgatctttcaatcaaagcctccagg

SEQ ID NO: 19611 - DNA, 121 bp, Artificial Sequence
  Synthesized
  misc_feature (61): n=t or c
catctccatacactaacaaacatgactgccctacagagcatcaggacccttttatatgtangttgcagttactgaactatacagatggtgcaacaatgtctcagccacttttaaatgaagc

SEQ ID NO: 19612 - DNA, 121 bp, Artificial Sequence
  Synthesized
  misc_feature (61): n=a or g
attctgtgaagacagactggaaaacaaacctaaagaaaagaggacgttgctaattatttcntaaactaattggaatctcagaatcattaaaatgttttcaagtgcatatagtaaagtgttt

SEQ ID NO: 19613 - DNA, 121 bp, Artificial Sequence
  Synthesized
  misc_feature (61): n=a or g
atatccaaaggcatttgaaaaccagacagtatgggttaaatacaagcactttatcattacntaggttatatatatacatctttttttaggagcagtctttagtccccaaaaatgtttaact

SEQ ID NO: 19614 - DNA, 121 bp, Artificial Sequence
  Synthesized
  misc_feature (61): n=t or c
aaatcacaattgtacctgcaaacctgacattctgatgcactataactgattacttcccctntgcataaaagacagacccatgctgtaatttcatattgggcctctacctccactagaggtg

SEQ ID NO: 19615 - DNA, 121 bp, Artificial Sequence
  Synthesized
  misc_feature (61): n=a or g
actcctttagaccaagtttattgcacatatcactttctcccttttgctatgattggatctnatcaacttcacaatgaatgggcatttctcataaggattagatgtaatgagactattatca

SEQ ID NO: 19616 - DNA, 121 bp, Artificial Sequence
  Synthesized
  misc_feature (61): n=a or g
aagttcagtcaacacctcacccttgtgatataacatggcattgcctctcacctgcaaatanaaaatttcactgcatcatttgtcatggtcttaattctcgagaaaaaccacagcgtgcagt

SEQ ID NO: 19617 - DNA, 121 bp, Artificial Sequence
  Synthesized
  misc_feature (61): n=a or g
attcaaattgctaaagcattccctagttgcacttcctgtgcactgggtaccttttccaccncttgaagtgaaaacacacagcaatataaaataaattactgtacctcacatcttcagggta

SEQ ID NO: 19618 - DNA, 121 bp, Artificial Sequence
  Synthesized
  misc_feature (61): n=t or c
aatgctgggtcacattaacacaaagtcattagataacggaaaactaggcctctgtaggaanagagagagattttcctacagcagttattcttcagaaattgaactgcatctaaggactggc

SEQ ID NO: 19619 - DNA, 121 bp, Artificial Sequence
  Synthesized
  misc_feature (61): n=a or g
ttctcacatgtagtggaaatggccacctgctgctgggcaaacctccagaggagatcctttngtgctggaggtagaagggaagcacgtacgccttgcagagtgcgactgggtgtgtagggtg

SEQ ID NO: 19620 - DNA, 121 bp, Artificial Sequence
  Synthesized
  misc_feature (61): n=t or c
gtgtgttattctgtatagcaaagatatgagagtctcttttctgcttacacccctactatgncaactatacaacactatttctcagctcttacgtaagaaggggaaggggaggtctctgagc

SEQ ID NO: 19621 - DNA, 121 bp, Artificial Sequence
  Synthesized
  misc_feature (61): n=a or c
tacttctaaaaaaacttattatttgtctatttatcttatgtttcagaattagaggaaagtnagttgatttgggcagacactggtctatactgtagcttaaatagtaatcggtgaaatatcg

SEQ ID NO: 19622 - DNA, 121 bp, Artificial Sequence
  Synthesized
  misc_feature (61): n=a or g
cacagttgcaagtttaactgcgttaaagggtaaaaacccaaacacataccggagaaaaccnattgatggaaaatgtgatggtgccaagattgtgaaacgattttagaatgtcagaccctct

SEQ ID NO: 19623 - DNA, 121 bp, Artificial Sequence
  Synthesized
  misc_feature (61): n=a or g
aaacaccctccaatgaaatacatttgaaaaacacacacattgctcttcttttccacagccncaaatccagcatactctggttagcagctcatatctggtctctcatctcccttacagatcg

SEQ ID NO: 19624 - DNA, 121 bp, Artificial Sequence
  Synthesized
  misc_feature (61): n=t or c
gacgtaccctggttcatttcagcaccctcattcatcatggacactgatctcaccgcgctanactttctgatgtgggtctaccagtttataacgcagcagtggacaccaactggacatgcag

SEQ ID NO: 19625 - DNA, 121 bp, Artificial Sequence
  Synthesized
  misc_feature (61): n=c or g
aggtctctcagcctttcctcatacaggtactccaagctcccaatcatcttttgtggccctntgctggattctctgtagaagttcccggtcttacttgaactgaggcacccaaaactggaca

SEQ ID NO: 19626 - DNA, 121 bp, Artificial Sequence
  Synthesized
  misc_feature (61): n=t or c
atacaaatgaggttagtgctcgctgttattcagtaataaatccattattccattttgttantaacataaggtatcatcccagggcaaagccccaaagcctgaggtgtatccaacatggccc

SEQ ID NO: 19627 - DNA, 121 bp, Artificial Sequence
  Synthesized
  misc_feature (61): n=t or c
agtagtgtgtgacaagttacgtcattgcacagctactatgatgaagatcttttctccttgncctctgagcttttggagcttatattgaattttcctttcttctgtcctctgtatatactca

SEQ ID NO: 19628 - DNA, 121 bp, Artificial Sequence
  Synthesized
  misc_feature (61): n=t or c
ttcttcccctgccttcccaacacaaaccccaaaacatgcaaatgagtgattaaatgcacancttcagcagaagccatatgacacatatgtaattatttgatgacattccctgttactttta

SEQ ID NO: 19629 - DNA, 121 bp, Artificial Sequence
  Synthesized
  misc_feature (61): n=a or g
atgatcgtagaaaaggggtctggaagaaatgtcaagaagagggtccttttaaattcccatntgtggaaaagcaagactcagccttgggagatcacagaacccgaaggggcagcaaccagcg

SEQ ID NO: 19630 - DNA, 121 bp, Artificial Sequence
  Synthesized
  misc_feature (61): n=t or c
catgcagacttcaaagattatatttctgctcttggtgcaaacctggcaaaaactacggtgnggaggtgatgccgtgcatgtaaaaaacattcaggcttgggcatatctgccttggagctgg

SEQ ID NO: 19631 - DNA, 121 bp, Artificial Sequence
  Synthesized
  misc_feature (61): n=c or g
ggtaagttttttaaaaagaaacatctgttgaggtaaatgtttcagagatttcaaggtcttncatgaaaatctttaacctctttcaagtatcatttgctcaaatggcgtttactgttctttt

SEQ ID NO: 19632 - DNA, 121 bp, Artificial Sequence
  Synthesized
  misc_feature (61): n=t or c
ctgtttggatttcagtgctgcagagtgctctgagtacagtagtacagttgcagctcatctngtatttcacggtgcttcgtctgctaatttgctgctgtcttcgaactctggcaacttcagt

SEQ ID NO: 19633 - DNA, 121 bp, Artificial Sequence
  Synthesized
  misc_feature (61): n=a or g
gattcatttttctgcaagctcttattgcttcactgttcttgataatttattatcttgcaanaagttgaagggttttatttcctgcttctttcctgctgcatatttggcaaatgctaccttt

SEQ ID NO: 19634 - DNA, 121 bp, Artificial Sequence
  Synthesized
  misc_feature (61): n=a or g
ttaccatcctgagaacagcactgttaatctggcaaattgtgtaagaagaaataatactgangctcttatcttactcagtgatgagagggtaaatgttgttagaagtggaagttcttgtttg

SEQ ID NO: 19635 - DNA, 121 bp, Artificial Sequence
  Synthesized
  misc_feature (61): n=t or c
tcttgtgggtgggtgtatcatgttagagacttcagttgttactgatgatgaggacaagagnctgctcctactctccctatgaatccaccttgctatggtatgagcaatagagaagccttag

SEQ ID NO: 19636 - DNA, 121 bp, Artificial Sequence
  Synthesized
  misc_feature (61): n=a or c
gagtctatgttgaagagagaagtagcttctgcagcattagttatgtttaagaagtcatttncccctctttcttggcacttcttaagaggcttgggagacatctgttcattttgttatttga

SEQ ID NO: 19637 - DNA, 121 bp, Artificial Sequence
  Synthesized
  misc_feature (61): n=a or g
ggcttgtgaaaagaaaaccctggcatgtgtactaagacatctttctcagacatctctgttnctggctgaaatggcttgtgcccagcctcattcagcaaatcaaagttatacagaagccaag

SEQ ID NO: 19638 - DNA, 121 bp, Artificial Sequence
  Synthesized
  misc_feature (61): n=c or g
ttcattccatcctcctctcactgaggaagatcaccaaggcatgcttggcaagacaaacatnttgtagtatagctgtatcatagcaatatagagacgtgtatgtgtatttacagacattctg

SEQ ID NO: 19639 - DNA, 121 bp, Artificial Sequence
  Synthesized
  misc_feature (61): n=a or c
taggttacctaaccaagtctgccagaagataagaaagcctatctgtttgcggtgatcaacnaattgcctttctatcttttatgataattcttgaagtttatcccgtatcaagtgaggctgc

SEQ ID NO: 19640 - DNA, 121 bp, Artificial Sequence
  Synthesized
  misc_feature (61): n=a or g
ctcctgcagctctgccagcacgcaggtgggaggatgctgctgtggaaagagtgtcggggtnggagtggtctttcaagaggataaaatatctctttgtgtctctgtgctctggcactgtccc

SEQ ID NO: 19641 - DNA, 121 bp, Artificial Sequence
  Synthesized
  misc_feature (61): n=a or g
agtggagagcagaaaatcaggacccatctgaaggtcgttagccaatggacatgcaaatacncctttcactgtttatgtcacacagtagaaattacatgtaccagacaacaaggatgttacc

SEQ ID NO: 19642 - DNA, 121 bp, Artificial Sequence
  Synthesized
  misc_feature (61): n=t or c
ggacctttctcgtgccaggaggagcatggacagactaatggccatgcagaaggtgttttcntttttcccactcaagttcttcatgctggtcgttctgctgtgactgggtaccaccttcagg

SEQ ID NO: 19643 - DNA, 121 bp, Artificial Sequence
  Synthesized
  misc_feature (61): n=t or c
catgtatgtgcatatgtggactagggagagggagaaggaaagcagctaacagaaatgtttngttgatgcaagtgaaatgctgaagtaatactgcagtcaaactcttaccctgttcatcttt

SEQ ID NO: 19644 - DNA, 121 bp, Artificial Sequence
  Synthesized
  misc_feature (61): n=t or c
cttggtatttagatagtgaatttcaagacaggccaatatggaccttttgagctgcctgcangctcggccaaagcacatcagtcactcccatggagcggtatactcagctctgtactttgag

SEQ ID NO: 19645 - DNA, 121 bp, Artificial Sequence
  Synthesized
  misc_feature (61): n=t or c
cattaatgttgtctttgtcaataaaaagttgaagatagctggaagctcagggtacactcangctggaatttataggtgtctcagagacagctgcatgatatacagttcaaggggaaggcca

SEQ ID NO: 19646 - DNA, 121 bp, Artificial Sequence
  Synthesized
  misc_feature (61): n=a or g
gaaagagattagttagatttaacaggaacaaaatatctgaggatataattcagctggcttnttgatgatttaaatgtaaattcaagatatgtggggaccagaaaatgtactttgactaatt

SEQ ID NO: 19647 - DNA, 121 bp, Artificial Sequence
  Synthesized
  misc_feature (61): n=t or c
gaatgaaattttctttcaagtggaacttgtttaaataaagtattcataacccaaacaaaanatatgtgaaagagaggctgaactaactatcccattgaaacaccttgtttatccacaattg

SEQ ID NO: 19648 - DNA, 121 bp, Artificial Sequence
  Synthesized
  misc_feature (61): n=a or g
tctcgtccagaagcagaaaatcaacaacaatacatcacacatttaaagagcattttgctantaatgacatcaaaatatactgctaattatagatcatataattgctacatatgaaagttaa

SEQ ID NO: 19649 - DNA, 121 bp, Artificial Sequence
  Synthesized
  misc_feature (61): n=a or t
gtgtgccaatgtcattttccattgtcccacttgatgtgatatgtattggcataagccagtntattaagggcacttatgaaatagcagttgggtgctgttcataacataataggttgcaaag

SEQ ID NO: 19650 - DNA, 121 bp, Artificial Sequence
  Synthesized
  misc_feature (61): n=a or c
ggttagtactaatcctcggtttccacccaggtccaggctcagcattgctaaacttccctgnaagcaccaagaggaaccagagctgctttggtctcaatggaaatacctcacagcgtgggca

SEQ ID NO: 19651 - DNA, 121 bp, Artificial Sequence
  Synthesized
  misc_feature (61): n=c or g
ctgtgagtgggagtcaggatgaggtctgggagctcagcatcagcctcagtctggtgatccntgaaaaggccaagatgataaggtagatccaaggccaagccaggtagtcaaggcagcaggt

SEQ ID NO: 19652 - DNA, 121 bp, Artificial Sequence
  Synthesized
  misc_feature (61): n=t or c
agagctgatcttatcaagtcattgatactaagcaggggaggttgttagtggaagagaaagngcatacacctataaaccttctgcttggggaagccaggctgtagggcagcctcttatggac

SEQ ID NO: 19653 - DNA, 121 bp, Artificial Sequence
  Synthesized
  misc_feature (61): n=a or c
atctgtccctcaaaaaagtgttcaaaattcaggcaggaagttggccagtggagttgcaaancaaactagattttctgagtctgacacctttgattttggatggagttacaagactcggggc

SEQ ID NO: 19654 - DNA, 121 bp, Artificial Sequence
  Synthesized
  misc_feature (61): n=a or g
ctctagtatctcttttgctgccacatggcagataacacactgataagccagggtgctatcngggtggagcagctgtttccttggccagcatgccggaggagcagataacagcttttcagtt

SEQ ID NO: 19655 - DNA, 121 bp, Artificial Sequence
  Synthesized
  misc_feature (61): n=t or c
ctctcttaaatgttaagctgcgcaaaacagagagattggtgcttttaaagcaggcacacanccttttgcacctcccactcctacaaagataactgtaaaaatctttgggttttgttgtttg

SEQ ID NO: 19656 - DNA, 121 bp, Artificial Sequence
  Synthesized
  misc_feature (61): n=c or g
ttcattcatcaaagaagttatttgaggtcgtttgcccagatcttcctcatctcaagtaggnagaatgaattactcacctaactcctgctgtacgtgtcaactgatggcgaataaatgaata

SEQ ID NO: 19657 - DNA, 121 bp, Artificial Sequence
  Synthesized
  misc_feature (61): n=t or c
ttaattaattaatttcacaccaaactaattagaaataggtattgttacacagataattgantcacaacaggataatgaatttttttgttgacaaatccaaactgcttctaggattgcaacc

SEQ ID NO: 19658 - DNA, 121 bp, Artificial Sequence
  Synthesized
  misc_feature (61): n=a or g
aggagcaccttggaatccatttccaacaaatgtaccttttgaactattaatatacttgccnataatgtttttaaaaggagcacgctttcagctgtaagatgaacaattcaaacactggcct

SEQ ID NO: 19659 - DNA, 121 bp, Artificial Sequence
  Synthesized
  misc_feature (61): n=a or g
agaaccccaaatcccaaacaacaactccaaatcccaagcaagacctccaaatcctgaaccngaaccccaaatcccacgaaagaaccccagatctcaagcaggagccccaaatccaaaggaa

SEQ ID NO: 19660 - DNA, 121 bp, Artificial Sequence
  Synthesized
  misc_feature (61): n=a or c
gaggtattcaggcagatatgatagctgccatttccttttcgctgcccgttccctacacctnctttggccagggctgcctttgaattttggtttcagcaaactccgattttaagtgtaaata

SEQ ID NO: 19661 - DNA, 121 bp, Artificial Sequence
  Synthesized
  misc_feature (61): n=t or c
gttgattacaacacatccccacagccctgtggtaattctgcctcatgtttaaaatgttacnggccccactccagtcatggcaaacaaagcgaggtgttcagtgtctcaagtaaggcctcag

SEQ ID NO: 19662 - DNA, 121 bp, Artificial Sequence
  Synthesized
  misc_feature (61): n=t or c
cactagcctgactgcctacctaatgacagaagaagatttcacttgtacatatttattttanggcagcatcccatctttagggcactttctgcacagctgtccatgtttaagacaaaaacct

SEQ ID NO: 19663 - DNA, 121 bp, Artificial Sequence
  Synthesized
  misc_feature (61): n=t or g
acttcactgattcacaaacatcaagcaggctttcaagagacaaaagcttcaagagaggtcntcagcataaaatcttcagaataaaaccttcagcataaaagtatgtaatattctaatttcc

SEQ ID NO: 19664 - DNA, 121 bp, Artificial Sequence
  Synthesized
  misc_feature (61): n=t or c
ttttagatagcatttcttttcttggatttaaattgtactgggaatccccatacatagattntttttgtttgatgaagcagaagtcatagttttttttctagttaaagtattacttatccag

SEQ ID NO: 19665 - DNA, 121 bp, Artificial Sequence
  Synthesized
  misc_feature (61): n=a or g
agcattttgtcctgtgaggccccttctgacctgggtaagcaattggaagctgaggtttacncgttaggacttcccccagattcctgacatttatcaaacacttttgacacgataatggcaa

SEQ ID NO: 19666 - DNA, 121 bp, Artificial Sequence
  Synthesized
  misc_feature (61): n=c or g
gctgggagagggaagcttgcaaaacctggtagacaatgtctctgaatatctgataatggangttgctttctggagcaaactcctggatgtggtaactatttcatagctcagtgcggctgta

SEQ ID NO: 19667 - DNA, 121 bp, Artificial Sequence
  Synthesized
  misc_feature (61): n=c or g
gcacatcactcactcaagaagctgtgaatcttagaatggacgggatgcccagcaggtcagnggctgacaggtgcgaagattcactggtggtagaaatgaagtaggaggattttggttttcc

SEQ ID NO: 19668 - DNA, 121 bp, Artificial Sequence
  Synthesized
  misc_feature (61): n=a or g
tgctaaacttctgtcagtatgacctgaagaccagggcaggcaatattctgtaatgtaccantgacaggattaagatccaatattttgtgatccatcagtgttgaaatgggagctgtatacc

SEQ ID NO: 19669 - DNA, 121 bp, Artificial Sequence
  Synthesized
  misc_feature (61): n=a or g
ttttctctacctcgttgcactcagtacttgtgaccccatggtgctcttaaacataaaagangtgtccaggccagaggaaggagagcaatgtccatcagctgctgctcctcacacctggggc

SEQ ID NO: 19670 - DNA, 121 bp, Artificial Sequence
  Synthesized
  misc_feature (61): n=t or c
taagagaaagtttagtgaaaggtattttcaggagttagcataatttggaaaatgcactccnagccctcctgaaaatatgtgtgtctaagtagacaattactatgctcgagtgtctgtcaca

SEQ ID NO: 19671 - DNA, 121 bp, Artificial Sequence
  Synthesized
  misc_feature (61): n=t or g
ctagtatccatctgtactgctaaagagaaatttattctggctacagaagatgacctcaaanacgtcagctgtggatagcttaatagcttatgtaagttgacaaagtgcttctgagctcttc

SEQ ID NO: 19672 - DNA, 121 bp, Artificial Sequence
  Synthesized
  misc_feature (61): n=a or c
tggccttctagaaagaaatacacagagcacttccttgcaggaaattatggtgccagacaanatggaatcactaaattcactttgattaaagtctctgtcaaaggaggtgtaatgtcaggga

SEQ ID NO: 19673 - DNA, 121 bp, Artificial Sequence
  Synthesized
  misc_feature (61): n=a or g
agactatttggggcatcttcattcttctctgcagaaaacaccagggacaaattcatattantcaagtctagaattattttgctgacagtaaggcatgcatgagctttaaatgctttgtcag

SEQ ID NO: 19674 - DNA, 121 bp, Artificial Sequence
  Synthesized
  misc_feature (61): n=t or c
gaggaagataaagtaaatcaaactacttcttaaacagagaagttgcacctgtcagtatatnatgacagtggaagactacctacttgaacatgataatagaaatacattgtagcagcgagtg

SEQ ID NO: 19675 - DNA, 121 bp, Artificial Sequence
  Synthesized
  misc_feature (61): n=a or g
cttctgtgcgttttgtgttgtggttgttgaaagaaactgctacctttaaacctagaatttngttaagtgtccctagtgcttttcttctgccattcagtcacccttctctctcaagctaacc

SEQ ID NO: 19676 - DNA, 121 bp, Artificial Sequence
  Synthesized
  misc_feature (61): n=a or g
attcagtctggagtagccgtagccatgccagtgccttaaatacctgacagctttttgttcngggcagagcttgaaggcagcttgactggacaaaatatgtgtgagtacacactactgtcaa

SEQ ID NO: 19677 - DNA, 121 bp, Artificial Sequence
  Synthesized
  misc_feature (61): n=t or c
aagctgttgttaggaatgctgttttagttaggctgggtacagatatagacagttcccagcntcctctgatacttggaagtactcagcatctaatttctcctagagttggaagtaaaggtaa

SEQ ID NO: 19678 - DNA, 121 bp, Artificial Sequence
  Synthesized
  misc_feature (61): n=a or g
gagtaaaaaatacaacaagctcaaagctcaggaaaacctgtgaagatgaagtaagcaggangagttgcagcattcaggtcacaaagacatgaaacaagtgttgatagccatgttggctttt

SEQ ID NO: 19679 - DNA, 121 bp, Artificial Sequence
  Synthesized
  misc_feature (61): n=t or g
atttccaatttactttggaatataccacaaaggagaatttatctccttgatcttaataatnaagtggtattctcccgaagtaagagttggataaaagatgttgggtttttttattatgact

SEQ ID NO: 19680 - DNA, 121 bp, Artificial Sequence
  Synthesized
  misc_feature (61): n=t or c
tggtactaacatgccacatcctatcacttcttttggtaatgctttggtggtcaacttcatntccaacaacaacattactaccaggggcttccatgccacctatgctgcatcatcatcatgt

SEQ ID NO: 19681 - DNA, 121 bp, Artificial Sequence
  Synthesized
  misc_feature (61): n=t or c
tccattcaatgttactttgtttcctcttaggtttcaaactactacttcaaagacagtcccnctaagcagctttgttagggctttggtaccagaacttttcaaaagtaccttgactttgcaa

SEQ ID NO: 19682 - DNA, 121 bp, Artificial Sequence
  Synthesized
  misc_feature (61): n=t or c
gctgcttaacacattcagcgacgtcctgttccactgcactctgcctggacagatgctcagngtctcacaggtgaggtgtaaaagcaagtgaaaaggcaggctaagcacatggaacgtgatc

SEQ ID NO: 19683 - DNA, 121 bp, Artificial Sequence
  Synthesized
  misc_feature (61): n=t or c
tgtgggcagaattggttatttcttctttcctaatttcatctctcattaccattcatgtccncaaagcctatgatcagttttaagagctatttttaccaatatagatgatcagaagaaggta

SEQ ID NO: 19684 - DNA, 121 bp, Artificial Sequence
  Synthesized
  misc_feature (61): n=c or g
ttcttaagatgtggtctggcttcatttattttaaatatcagcaaatgagagagtaagtttnaagatgcagttagcagcttttaatagatttgattttttttttttccctatgtaaagaacc

SEQ ID NO: 19685 - DNA, 121 bp, Artificial Sequence
  Synthesized
  misc_feature (61): n=a or g
tagttcttacaaggtcttaacaaatgagattggtatttgttttctgaattacactattacnaagatggttcttccacaatgtttcaaagttcttacttgttaagggcaattagcctgagaa

SEQ ID NO: 19686 - DNA, 121 bp, Artificial Sequence
  Synthesized
  misc_feature (61): n=t or c
acctttttgttgtctttgatgtctttggccagattcaaccatatctaagttttcctaattncatcccaggatgctcagataagatctctgaattccttccagattacatgtttttgctacc

SEQ ID NO: 19687 - DNA, 121 bp, Artificial Sequence
  Synthesized
  misc_feature (61): n=a or t
gcatcctccctgaagcagataaatgggtataggcgtgttttgggatgaggagtttgtgggntagaagcaaacatctcccctgcaagggcatcagcaataggttttcctcaagccagcccac

SEQ ID NO: 19688 - DNA, 121 bp, Artificial Sequence
  Synthesized
  misc_feature (61): n=a or g
ctaaccagtacaaatcctacttccaactactgtcaattttctctgttcaatgagtttccancagaggaaaaagcaaacctccgaatttgaagctttccagatatctgtacctgatatgtta

SEQ ID NO: 19689 - DNA, 121 bp, Artificial Sequence
  Synthesized
  misc_feature (61): n=a or g
acagcttcaatgatgacacaattcagactccacgctagttccacagatattgcacagtcancagtaacacaaaagataattaacacagacagaacgccaggtccctccagatccctatgct

SEQ ID NO: 19690 - DNA, 121 bp, Artificial Sequence
  Synthesized
  misc_feature (61): n=t or c
ctacctcattaagccagccgattgggtattattatgctttactactctaatgctcaatcantggaaggaattacaacagcacttgcttctgtatctctcacaaggagatgaagtcttcagc

SEQ ID NO: 19691 - DNA, 121 bp, Artificial Sequence
  Synthesized
  misc_feature (61): n=t or c
gttggctctcaacaccaccacatatacttctgtgacatggtggagagaaaccaatcatgangataacagtgtcattatgagtgaaatatacaagaagcattaggtcacattagagttttgg

SEQ ID NO: 19692 - DNA, 121 bp, Artificial Sequence
  Synthesized
  misc_feature (61): n=a or g
ccaaaaaaacaaatctcgccaaaagcagatccttctaccacagccaatgtactgtacctcnttttgcatctctcagaagctacacccaatgttttccttttcacagtccagattttcctaa

SEQ ID NO: 19693 - DNA, 121 bp, Artificial Sequence
  Synthesized
  misc_feature (61): n=a or g
ctggaaggacttcagaagaactccctaacagagacataatagagaaatgggaagaatattnggatactgctaaattatccttagcagtggcatgaaggctattctgacatgacgagttcac

SEQ ID NO: 19694 - DNA, 121 bp, Artificial Sequence
  Synthesized
  misc_feature (61): n=a or t
ctgtatctagcatgcttcctcagaaggaggagatgattcacatgaccatgagtgggagganatgtgcatgcattttggggtaccacttagtctgggctgagacacggattcaataaagtaa

SEQ ID NO: 19695 - DNA, 121 bp, Artificial Sequence
  Synthesized
  misc_feature (61): n=a or g
cttaccatccaagaatttccttacaatgctaagacagttcaagattagggagtgagagaanacccatgagggcgtgaaggtaaacaactgttactatcacatcaagacaaaaggttctttt

SEQ ID NO: 19696 - DNA, 121 bp, Artificial Sequence
  Synthesized
  misc_feature (61): n=t or c
ttgtcctttctgtaactattctcaggaggtatttcagttgttatacagaaagactaaaagngatattgcaagcagacagcaggaataaggaattgttcagatttcgccaatgcaaaagtgc

SEQ ID NO: 19697 - DNA, 121 bp, Artificial Sequence
  Synthesized
  misc_feature (61): n=a or g
attttttatttttgtgtcataaaaaaactaatttatcagttgagagaagtataatatcaangaaaggatttcagaaattgttatagacctttttgcctggtgttatgaggatgttgtgatt

SEQ ID NO: 19698 - DNA, 121 bp, Artificial Sequence
  Synthesized
  misc_feature (61): n=t or g
caggcacaccattgtcttgaagttccagagcttctctactcttggatatactcttggatancttctctatcttcttggatatttattggtatgcagagtccttggtagatctgcgcagcat

SEQ ID NO: 19699 - DNA, 121 bp, Artificial Sequence
  Synthesized
  misc_feature (61): n=c or g
acaatccaatgagaaaaggtttgtaggagtgttagaaaaccctgggcatgtaccttatttnatggaatttacagtctcttaaaatagaatttggcctacctctgctaaaatgcctacagat

SEQ ID NO: 19700 - DNA, 121 bp, Artificial Sequence
  Synthesized
  misc_feature (61): n=a or g
tatgtcaaagttgacttgcagatcaccacggagttttatttctactttccaagacagaatngaagtcctagatcctcctgttagcttgacatcaaagcctccttctgacacatcttatacc

SEQ ID NO: 19701 - DNA, 121 bp, Artificial Sequence
  Synthesized
  misc_feature (61): n=a or g
actcaaagaggtccctgaagcgtctgagaaagtaggtactgtctttattagtactgaaaanaaagtgctgaatttcactcttaaagagcaacatatggaccattcttccattctttcaacc

SEQ ID NO: 19702 - DNA, 121 bp, Artificial Sequence
  Synthesized
  misc_feature (61): n=t or c
gcatcttctgacgtattctaacccaatcctatccaaaaattgtgtttggtctttattctcnggggtccttattgtcgatgtataaacaaattcagattttgaagtgaaaagttggttatgc

SEQ ID NO: 19703 - DNA, 121 bp, Artificial Sequence
  Synthesized
  misc_feature (61): n=t or c
cttttttgaataaaaataccaatttctttttttcctctcctgcctcatctattatcctccnagtttttgcagcaaacccaaagatcacgttacagaattaaaaaatggtaaattaaatcta

SEQ ID NO: 19704 - DNA, 121 bp, Artificial Sequence
  Synthesized
  misc_feature (61): n=a or g
caaaatacataacacagttaatgtatataagtaacaaaacttacattttttaatcaaaacnttacaaaaagagtgcaacaaaagcatcgaatgagtgggttggacgtgtgtgcactaggca

SEQ ID NO: 19705 - DNA, 121 bp, Artificial Sequence
  Synthesized
  misc_feature (61): n=a or c
atttactcatgtcctctcagttcctcctgtacaaaggcatgtgttttagaaacatctggcngcagacattatcttgtttcttatacgataacctaagagtgagaacagattcttaactgaa

SEQ ID NO: 19706 - DNA, 121 bp, Artificial Sequence
  Synthesized
  misc_feature (61): n=t or c
tctcatgttgacatatgtcagtgattgatctccctccactctacagtcatggcaggggagncttctcctgttcctgacaaccaccccccaaatctctttctgtcaacaactgtggaaaaga

SEQ ID NO: 19707 - DNA, 121 bp, Artificial Sequence
  Synthesized
  misc_feature (61): n=t or c
gctgactcagtgcttgcctcatgtgaccaatctgaggttcaagctgagactcaacagttcncatacaatgtgcttttatgaatgggtaaaacgaaggagactgacttccctaatatagaat

SEQ ID NO: 19708 - DNA, 121 bp, Artificial Sequence
  Synthesized
  misc_feature (61): n=a or g
agtcctcagagaagggctcggcaccacctccagttgctatggtacagatttaaagcctctntgcaggatttggtacccccctgggagacacagcctgggccaggagccaggccctgcgtgc

SEQ ID NO: 19709 - DNA, 121 bp, Artificial Sequence
  Synthesized
  misc_feature (61): n=a or t
tcagttgtaaaatactttacagttacagtaaaaactatttaattagcttttaacttttagnggaatgccttgcaaagatatgttaaagtacgtttttccagtcctgcagtagggggaataa

SEQ ID NO: 19710 - DNA, 121 bp, Artificial Sequence
  Synthesized
  misc_feature (61): n=a or g
tggttattttggcttagctacaaggcagttgctgggaagcatatgtccaccaagggggccngtatcagaacagtttctgctccacccaatatcattcactggcccattccagagttatttt

SEQ ID NO: 19711 - DNA, 121 bp, Artificial Sequence
  Synthesized
  misc_feature (61): n=a or g
gtgttcctttggtcattaggaggagagcacaaactgaatcctcagcagaaagccttaaccncagggccatctaccttcaggtttgggaagctgacaacataatctcagttgtgctgagggc

SEQ ID NO: 19712 - DNA, 121 bp, Artificial Sequence
  Synthesized
  misc_feature (61): n=t or g
tctccacatcaagatttgaatgaaacctttttggacacctcccactctggtaaggaactgnacatgtaagcataaatataggagttagtttttcctttggttacatgtggagtaaatcgtt

SEQ ID NO: 19713 - DNA, 121 bp, Artificial Sequence
  Synthesized
  misc_feature (61): n=a or g
aagtcagtacttcaataaataaatcttgcattatcacaatggtcacagtacacagccatcnctggttggctacttctgtaccactgacctggtgaaataggtagcacaggggtgcctaaaa

SEQ ID NO: 19714 - DNA, 121 bp, Artificial Sequence
  Synthesized
  misc_feature (61): n=t or c
gacattctgagaaagcatgagccgtcacggcttcatatggtaaccttcttccagcacaaantaattaatgttgtgtgacctctaccccgaagcattttttctttcttttcccaggcagaca

SEQ ID NO: 19715 - DNA, 121 bp, Artificial Sequence
  Synthesized
  misc_feature (61): n=t or c
acaaatcaagtacagaatttaagaaatttgaagctaagttcattgaggaggtattttgctngggaattctaaccccaaaatttattttctcttgtgctctttttgatgtcagtaagcatga

SEQ ID NO: 19716 - DNA, 121 bp, Artificial Sequence
  Synthesized
  misc_feature (61): n=t or c
tgatggtcaaatttatttgagcctagctgtgtgacctaagatgctttgttgaattttgtcntccttctgaaaccagaggttactgctctgtactacagggagcaaatgagagtgtagttct

SEQ ID NO: 19717 - DNA, 121 bp, Artificial Sequence
  Synthesized
  misc_feature (61): n=a or g
aagtggaattcacctgcttaatagaggtaattataaactacctctcaaaaaacatggggancttgtcattctaaagggatacctaaattcccacagcagtgcaagaagatgcgtctggaag

SEQ ID NO: 19718 - DNA, 121 bp, Artificial Sequence
  Synthesized
  misc_feature (61): n=a or g
ttgtcttctagaaacttaacaatagtaatacatagaaagttacatctcagagtaggcagtncaagtaatttacatagaacatctgtacatatttctgtgtgtcagagtgcccaccactgtt

SEQ ID NO: 19719 - DNA, 121 bp, Artificial Sequence
  Synthesized
  misc_feature (61): n=t or g
ggtacctccacgcccactccatcccttcctgcagcgatctcaatgatggtatttccatggncccagctgaaaaaatgagggccaaggtaaggcgctgcccggtcctctttgtctcagcagt

SEQ ID NO: 19720 - DNA, 121 bp, Artificial Sequence
  Synthesized
  misc_feature (61): n=t or c
tatcagttctgcaacgtctgatgctttaccatagtttcagggtatgaacattagcaatttngaagtgtttaaatttgaaatatgggaacattagcctgtatttagagggtggagagagcct

SEQ ID NO: 19721 - DNA, 121 bp, Artificial Sequence
  Synthesized
  misc_feature (61): n=a or g
attgcaaatattcttctgggtagactacaaaggaggttttggtggctcttcaagagaatcnattgaggatagagcaaatctatgtaatggatgtatgtaattatgtaatggcaatttgcct

SEQ ID NO: 19722 - DNA, 121 bp, Artificial Sequence
  Synthesized
  misc_feature (61): n=a or c
tgtgatacaggatgaatgggtgcccaccttcccttcgtctcctttatgacatccagcatanttacaaatccttacacgcattgagaatgcaaggattgctatgaggtatttctttttaagt

SEQ ID NO: 19723 - DNA, 121 bp, Artificial Sequence
  Synthesized
  misc_feature (61): n=c or g
gtatttgaggtgaaacggggcgacacaactacttttgagtagtttaatgtttccgatattnttatgacaacaataaacgtagaaaatgctgttgtcttcaagagcaaacaaagaactctct

SEQ ID NO: 19724 - DNA, 121 bp, Artificial Sequence
  Synthesized
  misc_feature (61): n=t or c
tagcacaagaacacccgggtggcagggacttggcattccaccactgaaaaggaacattggngatagaggagctgaggcagacagcgccggcagtgagacttatgccgtccctaacgcagtg

SEQ ID NO: 19725 - DNA, 121 bp, Artificial Sequence
  Synthesized
  misc_feature (61): n=t or c
gtcaaaggccttcgtgaagtcctggtaaatgatatttgtgacattttccttgtccattgangcagttatgccatcgcagaaggccactagaaggctgaccaaacaggacttgcccttggtg

SEQ ID NO: 19726 - DNA, 121 bp, Artificial Sequence
  Synthesized
  misc_feature (61): n=a or g
gcagaaactcaagtgtttaattacagacgtgtggagcataatctgacttcagcatagcatnaactacgcaggatgctaaaccctacttcttaagctgggagcttttctgacagacagccat

SEQ ID NO: 19727 - DNA, 121 bp, Artificial Sequence
  Synthesized
  misc_feature (61): n=t or c
ctgtttttttaatgtgtttgtgattaaaggaagtgtttgtgtgaatgttcctaatcttggnttaggactctgactctcccctgatgtgcttagacagtgattagtacctcgcagagtaggg

SEQ ID NO: 19728 - DNA, 121 bp, Artificial Sequence
  Synthesized
  misc_feature (61): n=a or g
ggtcattggaacagaattcatttccttaagacttgagcttttcacagagattccttcaacnctcttccagccaccgaacatcccaggccagccatcagctacctggaaggggccggcatat

SEQ ID NO: 19729 - DNA, 121 bp, Artificial Sequence
  Synthesized
  misc_feature (61): n=t or c
tatcgctgcaacgtattgcatcaatccagatccccctaaggaaggggtgtttacactgaanagctagcaagtaatttgactacccttaccacttcctgcctgtatttcagtatagtggcac

SEQ ID NO: 19730 - DNA, 121 bp, Artificial Sequence
  Synthesized
  misc_feature (61): n=t or c
tcacagtgaaagaaaggagggtgaggaccaggagacctggttctcgtttcccatccccatnagtagactacattggaaagaagtgctcagaaagcaaacaagcaaacactgcttccacttt

SEQ ID NO: 19731 - DNA, 121 bp, Artificial Sequence
  Synthesized
  misc_feature (61): n=c or g
tgcactgccctacagctcagaagaaggctccttcgttagtgtatgctggggactgttccanctttccaactggcctagaatatctcagctggccaaacagatgcaaatatatctgcaccct

SEQ ID NO: 19732 - DNA, 121 bp, Artificial Sequence
  Synthesized
  misc_feature (61): n=a or c
atgaaaaatcaacaagaagattctgaataagagtgtaagtagtagcagagtcaagaactcngaatttgaaaatccctgggtaacagttaagaacaaattaatcttgtataagtctcattta

SEQ ID NO: 19733 - DNA, 121 bp, Artificial Sequence
  Synthesized
  misc_feature (61): n=a or g
ttagaataacaacaataataataaaggcatacgaagcagcctgcctcagcagcagttcacngagaaatcactgtacatcctttcctattacaaagaaaaaaaggtacggaacattaaaaac

SEQ ID NO: 19734 - DNA, 121 bp, Artificial Sequence
  Synthesized
  misc_feature (61): n=t or c
cggagccatgcccactgccctggggaatctgttccatatccaccactctttggtgaaaagnctttccccaacctggccctttgaggaaaagtagggccatgagatctcccctcaacttacc

SEQ ID NO: 19735 - DNA, 121 bp, Artificial Sequence
  Synthesized
  misc_feature (61): n=a or g
tatgcatctgaacggggcattagcaaacatgtagctgagcatcatacaagggaagaacatntcatatgcagatattggaaaaaggtggggctttcaaatgtttgtgttttgctttggtttt

SEQ ID NO: 19736 - DNA, 121 bp, Artificial Sequence
  Synthesized
  misc_feature (61): n=a or c
cctttcaattgtgttctaattgtaagctcccctaggcagagataatctgtatttttatganattggtctgtattggcatgactatttcattcctgattagtatggaaactattgcttaatt

SEQ ID NO: 19737 - DNA, 121 bp, Artificial Sequence
  Synthesized
  misc_feature (61): n=a or t
caaattcccaggcttttgttgtcttatattctaaaagaacagtttttctatagtgatgganaaaaacaacacctttggaacacagaaatatttacacacaggccttattcagcaacctgac

SEQ ID NO: 19738 - DNA, 121 bp, Artificial Sequence
  Synthesized
  misc_feature (61): n=a or g
tctgtctccagtgtattggaaattaaagacattgtaacgacctatcccatctccataggcntcaaacttgactgtgctgtctgcagcattgggaggattgaatggagctgtgaaaaaaaca

SEQ ID NO: 19739 - DNA, 121 bp, Artificial Sequence
  Synthesized
  misc_feature (61): n=a or g
cacctagacacgattgtgtccttgagctttgtggtttctgaatatgctcagtatgtctaancgagaggaatagcacaatttgtgtaatggtaaggattcctatatattgcctgtgatgatt

SEQ ID NO: 19740 - DNA, 121 bp, Artificial Sequence
  Synthesized
  misc_feature (61): n=t or c
tacaatcttctgtaaataacaaatgatcattgtctcaggaccatgttgccataagcccatnttcagtgtctggtcatctgtatcacaagtgaactggctaaggaagacctagacgtagatg

SEQ ID NO: 19741 - DNA, 121 bp, Artificial Sequence
  Synthesized
  misc_feature (61): n=a or g
atacacatttctatattgactgcactggattagagaattttactggaattagacagtgtcncttgtcatgtctttgcatacaaatactgtgtgaagtgttttgccccctttccagcttggc

SEQ ID NO: 19742 - DNA, 121 bp, Artificial Sequence
  Synthesized
  misc_feature (61): n=t or c
ttagatagagggtatttgtgaactacaaactcttggctgtgccttctgtcctgttaagtangtccacagtcttaagtgaaaatttccatttagtgtggccaattcagggtacatttgctgg

SEQ ID NO: 19743 - DNA, 121 bp, Artificial Sequence
  Synthesized
  misc_feature (61): n=a or g
tgtttctataacttgactgttgctttggccttcttgtctaagtaacacctatggccaatanagtagataatggtcatggagatcattcaagttacatactagacattctgcgtttatgata

SEQ ID NO: 19744 - DNA, 121 bp, Artificial Sequence
  Synthesized
  misc_feature (61): n=t or c
taaccatctgtataggctgtgagccagggatccgttgatctgggtggaaggacagaattancagtggttgagtttggagatggtggtgttctcttaagggcacaaagaattattgtgttta

SEQ ID NO: 19745 - DNA, 121 bp, Artificial Sequence
  Synthesized
  misc_feature (61): n=a or c
tgaggtgtctatatagaactacttgaaaacttcagctttgatctgagactgcccatacagnggtgaggaacagaactgagcctaagctaagttctgctctgcctgcaattagttctttaac

SEQ ID NO: 19746 - DNA, 121 bp, Artificial Sequence
  Synthesized
  misc_feature (61): n=a or g
acagcttcatcttttcttttgatctttttccttctattttctgtttattctgtcccctttnccctgcaatttctattttatgaagagattaaaccacaaggtagctttattttcttgttcc

SEQ ID NO: 19747 - DNA, 121 bp, Artificial Sequence
  Synthesized
  misc_feature (61): n=a or g
gtcgtggacgtggtcagcctcctcagtaaacctgctcatgttttgtgtataataaaatagntgaaaatgccacttgtgctgcatcagtgtgatttatttaagtgtataatttagagctcac

SEQ ID NO: 19748 - DNA, 121 bp, Artificial Sequence
  Synthesized
  misc_feature (61): n=a or g
atgaaaaataaattaatctttttacatattctacacctggaacccatgctttccagcttcnttacaagtcttaagcctcaggtatgagataacattaaaggttcattgcttagaaataaat

SEQ ID NO: 19749 - DNA, 121 bp, Artificial Sequence
  Synthesized
  misc_feature (61): n=t or c
atatttttacccatgaatgaccgcatagttttggagctgcacacagaacttgtgcctctgncatctgtctccatctgagctggtgcctctccactctctttgtccatatctaactgatctc

SEQ ID NO: 19750 - DNA, 121 bp, Artificial Sequence
  Synthesized
  misc_feature (61): n=t or c
ctctgttcaattcaaaagtggtgtcagtaccttgcaagctgaataatacatttaaagtcanacacttccttctgccacagtgtagattttgacctttccagatttcattcttttacacaga

SEQ ID NO: 19751 - DNA, 121 bp, Artificial Sequence
  Synthesized
  misc_feature (61): n=a or c
tcacggtgagtcaccctggccccacacagcttcctcggccagagctgtcacttcttggccntgtgccactggttaagcaatgatgtgatgcctgtcctctgagatcatcgttggacagagg

SEQ ID NO: 19752 - DNA, 121 bp, Artificial Sequence
  Synthesized
  misc_feature (61): n=a or g
gctgtcgatgtctggcacacaaaactgccttagtccctttccactccatattgtctgtccnttaatagacacatcatgccactactgactcaccttcctttgcttaattactgtgcacacc

SEQ ID NO: 19753 - DNA, 121 bp, Artificial Sequence
  Synthesized
  misc_feature (61): n=a or g
tcctgtattaaaatctggtcacattttccagggagaacacgtttatcttatcgacaatggngctgggcaatttcccagttaatgcaagtgaaatacccaacaaaagacaggggctttaata

SEQ ID NO: 19754 - DNA, 121 bp, Artificial Sequence
  Synthesized
  misc_feature (61): n=a or g
tccaaatcctttgctgcttatccagtttcactcttgtcctgcttattaaatgttctgtgtntgacatggttcagccaactgttgaagtcatccttgcaggtggccttctgcaagagactgg

SEQ ID NO: 19755 - DNA, 121 bp, Artificial Sequence
  Synthesized
  misc_feature (61): n=a or g
cttccacgactcatgaaactcatcagaacacaattatctatgaagcatttgtcaaatgtgnttgaacttggctaatactacagggggaagggggcaagcaaaacaaatatacaagtcccac

SEQ ID NO: 19756 - DNA, 121 bp, Artificial Sequence
  Synthesized
  misc_feature (61): n=t or c
agggttgctggtacattacagaatatcttttgtgctgccattgatagcttgggattgtaanggttcagtacagccactttctatttttcagaacttagtgacctctttggctacttacagg

SEQ ID NO: 19757 - DNA, 121 bp, Artificial Sequence
  Synthesized
  misc_feature (61): n=a or t
gcgaacattcaaaaataatcagtctctacaccagcttttactggaaaatacgcccgaaaanatatctgtgttttactgcagattcttctgaagacaagaacccttgaaggtagagtatttg

SEQ ID NO: 19758 - DNA, 121 bp, Artificial Sequence
  Synthesized
  misc_feature (61): n=t or c
accagtattttaaattaagctgaaatcagcagcaatttacattagcaaaaaggctgtaggntgggaggaggcgtgagtatttgtgctattcagctgtccttgctgcttgggggcatctcta

SEQ ID NO: 19759 - DNA, 121 bp, Artificial Sequence
  Synthesized
  misc_feature (61): n=t or g
cctgtgtaagtctaatatatgagcaaagtatttcctcagtattatctaaattgacacctgnactaaacaagaaactaaatgtaatacaccaaaatctagaatctataccatacgtagaact

SEQ ID NO: 19760 - DNA, 121 bp, Artificial Sequence
  Synthesized
  misc_feature (61): n=a or t
tttgtttaatttttggccaagaaatcagtattacttaaaagcatacaagcctgaaaaaaanacgcaataagtacattaatacataagacaggaatagggaaagcagtgtaggcaaatcttg

SEQ ID NO: 19761 - DNA, 121 bp, Artificial Sequence
  Synthesized
  misc_feature (61): n=t or c
gtgacgttcagtggttgaaaatatctgctaggatcaactttcaaccaatgaactgtgaagngttgtgagaaacagaatacttgctaatgagtagaggacctttaatgagaagtctctgctg

SEQ ID NO: 19762 - DNA, 121 bp, Artificial Sequence
  Synthesized
  misc_feature (61): n=a or c
aattacagtaagaaattatcaaattgcttattgtcttctgcatggaagaaacatcactttntaagtaggtgccggtgttctttcatgacgtttttctaaaactatctgtgaatgttattcc

SEQ ID NO: 19763 - DNA, 121 bp, Artificial Sequence
  Synthesized
  misc_feature (61): n=a or g
gcttgcattactgtgcacagctttctgacatcagaaatttccattactcgtgggagggacntattgtaaaaaaaggccctctagtgcagttttggttgggaattgaagttaaggtattatg

SEQ ID NO: 19764 - DNA, 121 bp, Artificial Sequence
  Synthesized
  misc_feature (61): n=t or c
gggatgtaagaaacaacaaacaacctacagcatctcacctacagaaaagaagccaaacctntctttgcacaggaccatcagcactgattcacaccagcaggtgtcaaaagtcaccctgcaa

SEQ ID NO: 19765 - DNA, 121 bp, Artificial Sequence
  Synthesized
  misc_feature (61): n=c or g
tctcacattctcttttccactattgctcttcgtagtgttttagcaaagatcattttctcancccattacttcgagctgttcctttctgtactctcagcctacagttttaccagttctttga

SEQ ID NO: 19766 - DNA, 121 bp, Artificial Sequence
  Synthesized
  misc_feature (61): n=a or g
gacacctatgcactgccataggtgcgtaatgagtctgtgcaagggatgccaaatccaaacngttgcagaaagggagatgacaacatccaggtccgcatgcaaatacagctctatctgcaat

SEQ ID NO: 19767 - DNA, 121 bp, Artificial Sequence
  Synthesized
  misc_feature (61): n=t or c
tgggggagtgaggaagaggagaggagcatcccctcaatgtgaccagaaaacctctctcttngatgcactctcttcccccttgtccctcagtaggcatgcaaatatctaccttccttattta

SEQ ID NO: 19768 - DNA, 121 bp, Artificial Sequence
  Synthesized
  misc_feature (61): n=t or c
cttcaaccaatagaaacagtagaaacacatagcttctctactgacaagaaaggtagccaancaaatagattcaataaaatatttgtatagactaagtgtattgatcagaagttagaatgac

SEQ ID NO: 19769 - DNA, 121 bp, Artificial Sequence
  Synthesized
  misc_feature (61): n=t or c
gctcttgtgaaaggacctccacaggactggaaagacacagggctcctgcttgccatgtacngggcatgcaggggcacacacagactttctttgtccatctggaggctcagatcaggttttg

SEQ ID NO: 19770 - DNA, 121 bp, Artificial Sequence
  Synthesized
  misc_feature (61): n=a or g
tctacagatgcagaggtgtccttctgtagctcttctgctatacaagcagaatggatagggncaggtctcttccatgaccacctcaagcctttctggttttgcttttagtttcaaatataag

SEQ ID NO: 19771 - DNA, 121 bp, Artificial Sequence
  Synthesized
  misc_feature (61): n=t or c
tgtgtttatggagcacgaggaaagaaggtggatgggtggcagaaggggtaatggaaagtgntgggagaaaaattatctgtgatataaaaaaagttcaacaggtgtagttacattacagcat

SEQ ID NO: 19772 - DNA, 121 bp, Artificial Sequence
  Synthesized
  misc_feature (61): n=t or c
atgtatgataccagcaccaacaaagttagcaggattgggatccacctcctcaagtaaggcngacccaaagccaattatctatgaaagagacccagaagatttacatgtgggaacaaaaaag

SEQ ID NO: 19773 - DNA, 121 bp, Artificial Sequence
  Synthesized
  misc_feature (61): n=t or c
atttcaggtgctatcattttttcagggtttgttcactttctatcaccagggatatgaactngctaaagacttcagtcattacaaaatggccctgcagataaatatacaaaatgtaagttgt

SEQ ID NO: 19774 - DNA, 121 bp, Artificial Sequence
  Synthesized
  misc_feature (61): n=a or g
cctgcagcaccgcttgctatcaagcagcaattagcatgcattaataaaaggacagcacccnccacaggagcagcacccacagcagctcgtgcagtgctttttggtgcccatggaagcagtg

SEQ ID NO: 19775 - DNA, 121 bp, Artificial Sequence
  Synthesized
  misc_feature (61): n=t or c
catctgttccatccatttaaacaaatgtagttaattcttgaggatccaatatcaactatcnggggaagagaattagacctaaaactcatgttttaagttcaaataccagaacagaatagag

SEQ ID NO: 19776 - DNA, 121 bp, Artificial Sequence
  Synthesized
  misc_feature (61): n=a or g
gcttcccaggacagcttatgctctgcacatgaatagatcagttcctaaaggctcgtggaanccaggccagaaatgactgacagtcacccatctctaacccatctctatagctcttttggtt

SEQ ID NO: 19777 - DNA, 121 bp, Artificial Sequence
  Synthesized
  misc_feature (61): n=a or c
tttcagcctcaagatttactcactgacatccccacagacactgacgtcacacagcagcacngtttcatcaagcacactttgtcttggctagtttcatttgatggcttgaaaatatcaactt

SEQ ID NO: 19778 - DNA, 121 bp, Artificial Sequence
  Synthesized
  misc_feature (61): n=a or g
ctgtatcatcactgttatttacgaagcaagtagacaacactgatatgtcccatcagcaatngggaagctaacaatgactgagtattttgggtaggcaaaagctgtcaaaaataagcaattt

SEQ ID NO: 19779 - DNA, 121 bp, Artificial Sequence
  Synthesized
  misc_feature (61): n=a or t
tgcacatcagatgaaatgagacattcagaccatgggagcagactagaactagccgaaagtnaacacctcaaaatatgtacagtatggcctttggagcatttagccctatgaggatgctctt

SEQ ID NO: 19780 - DNA, 121 bp, Artificial Sequence
  Synthesized
  misc_feature (61): n=a or c
cagagttgtgtactgcctccaattatttgctgcattatttttcctataggtcaaaaattcntttaaggtatggatattctgcaggcaagtcaaagcatgcagaataggatgtcttaatatt

SEQ ID NO: 19781 - DNA, 121 bp, Artificial Sequence
  Synthesized
  misc_feature (61): n=a or g
aatttccagtgatttcagaaatgaattgcatattggagtcctataaggtcctttccaaaanggcaatttgcatcgtagactaaataagctaaataagacatatatgaggtctgctccgaaa

SEQ ID NO: 19782 - DNA, 121 bp, Artificial Sequence
  Synthesized
  misc_feature (61): n=a or c
aatccagttaaaaaatagagcaactccgttatttatcttcagaattcatttatcagcttanatgttcgtttcagtttaagactacgtgttctccacatcaaaaccaaagaccacatgcaca

SEQ ID NO: 19783 - DNA, 121 bp, Artificial Sequence
  Synthesized
  misc_feature (61): n=c or g
tcttctttgtaaacacaatgtccacatcattcgaatttacctgcagtcaccctcaggctcncacccaattcaatgagagcagctctgaagcaggaggctgctggacatctcctctctggtt

SEQ ID NO: 19784 - DNA, 121 bp, Artificial Sequence
  Synthesized
  misc_feature (61): n=t or c
ccgttcgacttaatgcaataatttcattcttctgcaaataagaaccccagagatggatggngagcactctccaacaaagccacgtgtcttgcttttctttgactagaaaaaaaaaacacca

SEQ ID NO: 19785 - DNA, 121 bp, Artificial Sequence
  Synthesized
  misc_feature (61): n=a or g
aaatctcttttaaaagaatgcaaaaaggtccttcataagcaaacctatggaaaactcaggnctggtcttgcttgtacaaataacatctcccagcctgattcctaagggctattcaccagcc

SEQ ID NO: 19786 - DNA, 121 bp, Artificial Sequence
  Synthesized
  misc_feature (61): n=a or g
ttccacatctgttgagggaaagaacaatacatcctagctatgcaggtagttttgagagacntatttaatattatctacagtccagaaagttatatttattattactagtgatagctctgtt

SEQ ID NO: 19787 - DNA, 121 bp, Artificial Sequence
  Synthesized
  misc_feature (61): n=a or g
atgaaaataagctctgaccataaaagacctgtttggtttgcacacattctcaccctgagcnttcagttttatactgatttaatagacaacaaataaaatctttctgaagtttaaatattac

SEQ ID NO: 19788 - DNA, 121 bp, Artificial Sequence
  Synthesized
  misc_feature (61): n=t or c
aaaaataaaaagggaaagcagggagcagcaccagacccatagaacaccctgagagggatcnctgtttcacagccactctgaaactgttgctccttcacataacagggcaacgtggggttgt

SEQ ID NO: 19789 - DNA, 121 bp, Artificial Sequence
  Synthesized
  misc_feature (61): n=t or g
ttataccattgaaaactgatattctggattctctcctgtagctctccttgcattttttttnggaggcaagtgcaaaacccgctgaaactagcggaaagaattttcccgttgacttcactgg

SEQ ID NO: 19790 - DNA, 121 bp, Artificial Sequence
  Synthesized
  misc_feature (61): n=a or t
tagaataaagaacgtcttttcaccaagctctagcatggccaaaataaaggtcacttcaccnggacaatagtccccaaacaacttttttttcctttttttttggggggggaaggggggcggg

SEQ ID NO: 19791 - DNA, 121 bp, Artificial Sequence
  Synthesized
  misc_feature (61): n=t or c
ctgcttttttagtctgctttttttccctctgatcttttggatctgtccaggtaaactactncacatgttctatggtagccactacctaacctataaaaggtgaggaatctccagcaggtac

SEQ ID NO: 19792 - DNA, 121 bp, Artificial Sequence
  Synthesized
  misc_feature (61): n=t or c
tttgaggcagaaaactcctctttcactcagtttcctataggaagcacatagtgccgctctnagggcagtgctttgtggagagcaggaaaaaaattactgtcctcttctcgatagctgagca

SEQ ID NO: 19793 - DNA, 121 bp, Artificial Sequence
  Synthesized
  misc_feature (61): n=t or g
acatgaagttaagtgaatggacctaatatacttagtttggtaaaatatttcatacactctnagatacggtactttgtacaataacctgactaacataatgatacgtgagctggctaactaa

SEQ ID NO: 19794 - DNA, 121 bp, Artificial Sequence
  Synthesized
  misc_feature (61): n=a or g
agctccttggaaaagcacctcaccagtaagggaggaatgatgctgtgtttgctaacacgantctcgttgggcaaagataagagggctgctcggttccaccagcactgttggatgggattca

SEQ ID NO: 19795 - DNA, 121 bp, Artificial Sequence
  Synthesized
  misc_feature (61): n=t or g
ccaaattccaaattctcactttcatatacttagcaatccactgcttgctcactcatgaagnaagcacatctccagggaggtcaactgaatcctgtttttctttaacaacccaaggactata

SEQ ID NO: 19796 - DNA, 121 bp, Artificial Sequence
  Synthesized
  misc_feature (61): n=a or g
tgcagactgtttacccaacgctaccagcttctccaagcaagggggagcaaaagtgccaccnaacaaaagaactgaagctcagtgctctctgggataccaaacctttgcaaagcacaaggtg

SEQ ID NO: 19797 - DNA, 121 bp, Artificial Sequence
  Synthesized
  misc_feature (61): n=t or c
atgcaaaaatacattactaagaaattaaaagttttcatggaataggtccaagaagaaggtncaggaaatcgatttctgccccactccaaaacttatttctatgtatagctgataatagagc

SEQ ID NO: 19798 - DNA, 121 bp, Artificial Sequence
  Synthesized
  misc_feature (61): n=a or g
ctcatgtgacctggttttgcagctcctcccatgggccttacgtgtgtgttgcttgtgctcntgtgtccagagaacgtcccagcacagctcttctgagccacagtttcccattctcttgcag

SEQ ID NO: 19799 - DNA, 121 bp, Artificial Sequence
  Synthesized
  misc_feature (61): n=a or g
aattctctgcaaattcaaaggaaaccttggcaatagatggtcagataccttggttcaccanagcgacgtgccttcagtatttcaggttgcacagcatcctctcctacccaccctggagagg

SEQ ID NO: 19800 - DNA, 121 bp, Artificial Sequence
  Synthesized
  misc_feature (61): n=a or g
gtgtagtgacaaatgtagtgggtgacctagattcttggatgaggtttgagggtgagggggngtgcccagccttctcctcgcaaatgatccatctgagagggaacaacttgggagtagttca

SEQ ID NO: 19801 - DNA, 121 bp, Artificial Sequence
  Synthesized
  misc_feature (61): n=a or g
aggataaaatgtaaatataacaggttataactggacatagtttgcagatgggcaaccaggntgagaaggctatgggatggcttcctgcagcagagctaggttgttcctccccgggggcagg

SEQ ID NO: 19802 - DNA, 121 bp, Artificial Sequence
  Synthesized
  misc_feature (61): n=t or c
agttatctgagatttgggttgggttgtttctggtggtgtcgagccaaacctcttcgtggtncttggatttggggggctcattcgttcacctccttggtcccatgcttttcccactcaggtg

SEQ ID NO: 19803 - DNA, 121 bp, Artificial Sequence
  Synthesized
  misc_feature (61): n=t or c
ggagaggaaatcccagccattatcactacaagtccaacctgctgctcatgggctgcacagngtggtggggattggacacaggttctcaacaactgctacatacacacaatggtatttctgc

SEQ ID NO: 19804 - DNA, 121 bp, Artificial Sequence
  Synthesized
  misc_feature (61): n=t or g
aggccttgtaagacaaagcatgtgaagcaagcagacagtagcagagggcatcctggtaccngataatgtgggttgagctgtatcacagctgcttcaaagtgactgctgagaggtgtgttgg

SEQ ID NO: 19805 - DNA, 121 bp, Artificial Sequence
  Synthesized
  misc_feature (61): n=c or g
agggcaagactacagcttcacagaaggcatttcttacccaactggcttgcttgcttagctncttctccaggctactcacagtttgaacatcagggagaaaataaaagcagtatggcttgat

SEQ ID NO: 19806 - DNA, 121 bp, Artificial Sequence
  Synthesized
  misc_feature (61): n=t or c
gatgataggcaagaattcctaatacccctagcgtattaataatgctgcttctccctatctntctgaattatgtttcctacttcccctaaagaattgtttgaacttgaaaaaaaagatttct

SEQ ID NO: 19807 - DNA, 121 bp, Artificial Sequence
  Synthesized
  misc_feature (61): n=t or g
gtggacatggtggcctgaactttccagaaatgtgtctctggaggtgagctgagaaatccangtgttggctggatggaggacagctagggacaatcttgtttccagcaaggaaattgggtgc

SEQ ID NO: 19808 - DNA, 121 bp, Artificial Sequence
  Synthesized
  misc_feature (61): n=t or c
tgttccaatgctcatattaatgttgtgctactcagaggtcatgagtggtaagtcattgtantgtatggcacaaaactttgtggtaaatactgtactgaatagagctttgtattacaaaagg

SEQ ID NO: 19809 - DNA, 121 bp, Artificial Sequence
  Synthesized
  misc_feature (61): n=a or c
aggcaactaactgtggggaagttctcttgtcttgcaggctggccatgacatcccatagctntgggcatccacactgcacacgtgggaaaggttcattcatgacatcaggaggaaatgtttg

SEQ ID NO: 19810 - DNA, 121 bp, Artificial Sequence
  Synthesized
  misc_feature (61): n=t or g
ggaatcacctctatgcaagagcagcacacagtgcttgtattgtgggaccagaaaatgtttngggaataaaagagactgagagagaagaggagctccaaactctgactcaagacctttgtgc

SEQ ID NO: 19811 - DNA, 121 bp, Artificial Sequence
  Synthesized
  misc_feature (61): n=a or g
ccagaggagatcacttcatttttgagttttagaatatgtgtgtacctcttgagggtgtaangagcaaattgttgagttgttgagaatatttcccccccccccccccccccaaagagattgc

SEQ ID NO: 19812 - DNA, 121 bp, Artificial Sequence
  Synthesized
  misc_feature (61): n=a or g
ggccatacagacaatggcatcatagcatgtaatagggagaccagaagacagttgcacttancattcagtacatttctgaggaatatataggactgatacattctcaggaataaaaggcata

SEQ ID NO: 19813 - DNA, 121 bp, Artificial Sequence
  Synthesized
  misc_feature (61): n=t or c
gttgtatggagagctgaaaagcgactaggaattgttgaaggaggcacagagtatgttgtgntgaagtgttgaggaccaaaagcctgaatctgaaatctcagcttaaaacaacaacaaaaac

SEQ ID NO: 19814 - DNA, 121 bp, Artificial Sequence
  Synthesized
  misc_feature (61): n=t or c
ggcctggaaggaaacaatgtgcaaatgaactgaggcgtctgaaactaccaaagaccgcagnttgaatatgttcatagtaatatacagagggcttagagctttatacacaggtcagtttctg

SEQ ID NO: 19815 - DNA, 121 bp, Artificial Sequence
  Synthesized
  misc_feature (61): n=a or g
aagcaagggacaattattcactgattgactgatttgattgatttaatactctgacaaaacngacagttatggatgagttgtagatacaatcatggaaaattcagagagcacatgctctgtg

SEQ ID NO: 19816 - DNA, 121 bp, Artificial Sequence
  Synthesized
  misc_feature (61): n=t or c
aacaaccatgatgtacccaaagtggaatgacattctgtgtcaacaaagaacagcccacaanaacgctgacaaacatatcacactgcatgccaattgctacactattctgacgagaatcaac

SEQ ID NO: 19817 - DNA, 121 bp, Artificial Sequence
  Synthesized
  misc_feature (61): n=t or c
atcgatgttaaaagaacacaatgaacaaatttagcttggcctctctgttgtgtagcaatgnatgaagatcttagcaagcatctggcacagtgtacgttttcacccacttgttatccagcac

SEQ ID NO: 19818 - DNA, 121 bp, Artificial Sequence
  Synthesized
  misc_feature (61): n=a or g
ccattgcttcttaaccactactggtgtctttgccctacagacatctcaagatgaaaattcnggccaatctgaccacttccaaggattgcgagccacacatctgtgttgttgttagctgtcc

SEQ ID NO: 19819 - DNA, 121 bp, Artificial Sequence
  Synthesized
  misc_feature (61): n=t or g
taacctgattggctaaatgcaggctggctatgtctgtactagtaaatgaaacatggctagnttacagcctgagaattgctgaaatgcttgtgtgctctgtggcacagctgtgatttgtgca

SEQ ID NO: 19820 - DNA, 121 bp, Artificial Sequence
  Synthesized
  misc_feature (61): n=a or g
tagagctgaagcgctgaggatcggcccccatgaccttaccgaatgaacagctaagtgaggnctctgccctcaggctgtcccgtaaagaccatgagcaggtgaaatcagcatttaaagaacg

SEQ ID NO: 19821 - DNA, 121 bp, Artificial Sequence
  Synthesized
  misc_feature (61): n=a or g
ggtagacaacaatctccacgactctgtagtgttgcttggttacctttatatgcaagctccnaaatctgttttgagactttactatgtgttggattaaggctctggtttgtatacaacatag

SEQ ID NO: 19822 - DNA, 121 bp, Artificial Sequence
  Synthesized
  misc_feature (61): n=t or g
ttgctgttagcatatactgggaatgtagctgctgcaccttagcaagtcacaatttcactanaggcaacatctttccaattggtatactttccaattggacgtactctccaaggagtatttt

SEQ ID NO: 19823 - DNA, 121 bp, Artificial Sequence
  Synthesized
  misc_feature (61): n=t or c
agtaatgaagcataatactagtcatataaggtttaatactgagtaaatcctacttatcagntgctgtatctctgcctggaacgagacagctcttctggggaagaaagagtctaagttacta

SEQ ID NO: 19824 - DNA, 121 bp, Artificial Sequence
  Synthesized
  misc_feature (61): n=t or c
attccatcgatgcatgcttagttccactgacaggtatttcaaggcactgaaggaagtgttntgcctttctctggaggtcatgcctctcaatgacctaaaaatggttctgagtgagtcagga

SEQ ID NO: 19825 - DNA, 121 bp, Artificial Sequence
  Synthesized
  misc_feature (61): n=c or g
aaaataaagcactgctatcacctgcatgctccttgcatgcacaccgctgcaacgctgtcanatcatgtttgcatccaggaaagcactgctgcaaagcactgtacaaccagagcctagcagg

SEQ ID NO: 19826 - DNA, 121 bp, Artificial Sequence
  Synthesized
  misc_feature (61): n=a or g
tcctgcaagcaggggtctccatgtgggtccctttacccaccctatcccttgcccatcctcntggtgtttggctgcagaccccaaagctctgcaagcagaggtctcccagttgggttccttt

SEQ ID NO: 19827 - DNA, 121 bp, Artificial Sequence
  Synthesized
  misc_feature (61): n=a or c
tctactgtgtagttgcagaatagatttgtatggaatagtattcgcatacaaagaataactncttctctgttgtcttggtacacatgcaccctccaaatcatcacttatccccactgacata

SEQ ID NO: 19828 - DNA, 121 bp, Artificial Sequence
  Synthesized
  misc_feature (61): n=t or c
taatgttgatagcacgtggtattttagttattgctgagcacgctgggtgtttgcacggagncaaggacgtttcagctcctcatgctgccctgccagcaagggcctgggggtgcaccatgag

SEQ ID NO: 19829 - DNA, 121 bp, Artificial Sequence
  Synthesized
  misc_feature (61): n=t or c
gtgggtgtgtaagtgtgagtgtgtgcgctctgcccgtggttttgcacacaggtgtgcacantcaggaacagccgtgggtgtctgaataaacaccaccccccccctcaagtgaaactgtgga

SEQ ID NO: 19830 - DNA, 121 bp, Artificial Sequence
  Synthesized
  misc_feature (61): n=a or g
ggatatgacatatgtcatccagtccaaaagacctaacatttcctcaattccaaatgaaacntacaacctcaggaccttgctgttttaacagtgatcttagataaccccacagcagctggat

SEQ ID NO: 19831 - DNA, 121 bp, Artificial Sequence
  Synthesized
  misc_feature (61): n=a or c
acagacccatgaaagccagaatctacttttgcattttggcaagagacctgggtgtaatccnttcatttgctctgatggttccactttttaatcataaggaatcttagtggaggaacttcaa

SEQ ID NO: 19832 - DNA, 121 bp, Artificial Sequence
  Synthesized
  misc_feature (61): n=a or g
agcaagcacctgtataattaaaattttaacctaaaatatactaaagtgaaatgatttaccnaacatctgtgaacttggagatgaaaactgactagtcgcatgagtttcttaatcaagaatc

SEQ ID NO: 19833 - DNA, 121 bp, Artificial Sequence
  Synthesized
  misc_feature (61): n=t or c
gttggggtcaccaataaacaaagtttaagtataaaatctactttgggaatgttggatgtangaagcaaagataaatttcaggctacagggaagaggagaatattttcttctatgtgtggca

SEQ ID NO: 19834 - DNA, 121 bp, Artificial Sequence
  Synthesized
  misc_feature (61): n=a or g
ttcaaaatacatgcagttttcctttcactgctgctttccttgctttatattctctagtgantagggattatttcaagattacttaggcttttataaataaatgaccttacactaccaaagg

SEQ ID NO: 19835 - DNA, 121 bp, Artificial Sequence
  Synthesized
  misc_feature (61): n=a or g
tgcaggccaacagttggccttcagaaacctacctacaggagagtattttcttgctttgctntgtcactcacattcattcatatcccctgctgtaaggatctgtaaaactgcacaggttaga

SEQ ID NO: 19836 - DNA, 121 bp, Artificial Sequence
  Synthesized
  misc_feature (61): n=t or g
cataagaatttggttttttttacttctgaattctctgtacaaatcaagacaatagccactnagagcttgctcttttaaggattatgtatcttgcaaatcctacagttcgtttccatatctg

SEQ ID NO: 19837 - DNA, 121 bp, Artificial Sequence
  Synthesized
  misc_feature (61): n=a or t
agggacctctggagaccttttccagcatgggcaccccagacaggttggagttgggttatcnccaaggatggagaccacaatcactcagcatgtggccatcctcacagcaaaaccgcgttcc

SEQ ID NO: 19838 - DNA, 121 bp, Artificial Sequence
  Synthesized
  misc_feature (61): n=t or c
gtggttgttctgatagctacataaacatgctgtaacctatattcaactgcttatctgccangcatttgttacctctccatttcatagtcacattattaaattatttgtatgtgatcaagct

SEQ ID NO: 19839 - DNA, 121 bp, Artificial Sequence
  Synthesized
  misc_feature (61): n=a or g
ttaaatgctgagtaactgacaggtactgtttgaggctcaaatgggcagtgtgagttaaggnagataccaaattctcttcccctgcctttttgcaggaggaacaacttaccatcctatttat

SEQ ID NO: 19840 - DNA, 121 bp, Artificial Sequence
  Synthesized
  misc_feature (61): n=a or g
tcctgcgttgagattgcgcagccttgtaccaacatcgggtcttggcctgatgcctcggccnggagctgcaaaggcagagagctggctgacttctacggcagcactgtagctattaaaatgt

SEQ ID NO: 19841 - DNA, 121 bp, Artificial Sequence
  Synthesized
  misc_feature (61): n=a or g
gaacggctgcagcagtggtaatcgggggttccagtgtgagtttcagcaagacctgtgtcanggagcttgtcttagagataccacttcagtgatcaaggtcttgtttttttgcccagctgcc

SEQ ID NO: 19842 - DNA, 121 bp, Artificial Sequence
  Synthesized
  misc_feature (61): n=a or c
ctaacactccttcaaactccacttagtaagtatgctgttgtggtgtgtggagaatcttggnaagaaaacctccaagtgcatggaaaattatcattgtaactggggcctttggagcttttaa

SEQ ID NO: 19843 - DNA, 121 bp, Artificial Sequence
  Synthesized
  misc_feature (61): n=c or g
atccaaaagtagtagttctgacttggggctagtcctccagtcagacatgtagacactaccntcacaacatatattcaagaagaggcctccaaacgctaggccaagtaactcaagccaagct

SEQ ID NO: 19844 - DNA, 121 bp, Artificial Sequence
  Synthesized
  misc_feature (61): n=t or c
tgaccattgacaaagactgttaacaaagtctggtgggtctaccacatcatcaatatggggncaaccaatccacctgcactctcaagtgataggatctagcttcttgcatagataggacaaa

SEQ ID NO: 19845 - DNA, 121 bp, Artificial Sequence
  Synthesized
  misc_feature (61): n=a or g
caaccaagctcatttaatttagttttgcaaccatgaacatgaatgcctcctgattcaaacngcctgcctgatatgacagcaagtaaaagcacttctgccgagacttagaagtaacatcagc

SEQ ID NO: 19846 - DNA, 121 bp, Artificial Sequence
  Synthesized
  misc_feature (61): n=a or g
ccctgtaggagcatcagacttgcaaatcacctgaagcagaataaaacacagtactttcacntaattcatataccataaacatccaataacaaaaaaaactaggaaaatctacctgtaatga

SEQ ID NO: 19847 - DNA, 121 bp, Artificial Sequence
  Synthesized
  misc_feature (61): n=a or c
catgcaaatgacaacctttgggtcttttttgcatccaaaatgctaaatgtttcaataaagnaatagccaatgtgtcacactgccattgttcggagatttttttaatgctacgtcaattaat

SEQ ID NO: 19848 - DNA, 121 bp, Artificial Sequence
  Synthesized
  misc_feature (61): n=t or c
atcagtatctaacagttgctatcagaagagcatcaaatggcagcactgctgagatcacctncaggtaccaccttgaacgatgaccattgtcagtgcacatcacccagcggtgctggtcggc

SEQ ID NO: 19849 - DNA, 121 bp, Artificial Sequence
  Synthesized
  misc_feature (61): n=a or c
tatggttcttaatgttactttctctcccaatgacgagtggatatgacctcccaggcacagntccaggggaaagaaagggattatttggaaaccagtgtaaaaaaaataagaagtatctcca

SEQ ID NO: 19850 - DNA, 121 bp, Artificial Sequence
  Synthesized
  misc_feature (61): n=a or g
cacaggtcatagaaatccattgtttatcaagtttattccaagatattcttatctgggaagntattgcactaccttcctggttgttattccagaatctcccaataaatacatgtgcagtaga

SEQ ID NO: 19851 - DNA, 121 bp, Artificial Sequence
  Synthesized
  misc_feature (61): n=a or g
ccagagaggaccttgcactgaaatggctgaacagcaaacaaaatcacgagggcagatacanatccttggcaccagtagccaccaacatcccagcactctgcagagcttgcacatctccgtc

SEQ ID NO: 19852 - DNA, 121 bp, Artificial Sequence
  Synthesized
  misc_feature (61): n=t or c
ttctctgatctttatccttcagataattgttctgattggttggttgaaacttaagttgtcngtgtttgttttattccttttagcttcactgagtgggagattagtgaatggagtgaactcc

SEQ ID NO: 19853 - DNA, 121 bp, Artificial Sequence
  Synthesized
  misc_feature (61): n=a or g
tgtttgcggatttatttataggtaatactggctgttgtttaattagtaaatagatacctgncaattttttacccttccaaaatattgttgcaccactgaatttctgatctacacttaattc

SEQ ID NO: 19854 - DNA, 121 bp, Artificial Sequence
  Synthesized
  misc_feature (61): n=a or g
attgtagcctaagactgtaaaacagaatatgtctttccatcctctgtcttatctctttcantttgtgggctgaacagggctctcccacttgtggccttcagtcactgtaggaaatcccatc

SEQ ID NO: 19855 - DNA, 121 bp, Artificial Sequence
  Synthesized
  misc_feature (61): n=a or g
tcatctctgcctaacacagctttcttctggcattattcacaaaccagagatagcacctcantacagatgttgtcgggatgaattattaaaagaggaaagatcttcagaaggagatagtgga

SEQ ID NO: 19856 - DNA, 121 bp, Artificial Sequence
  Synthesized
  misc_feature (61): n=a or g
ctttgcagcgcttacaagcgtgaggctgaataccagtttgtgcttcattcttggcaatganactttatattgtgatgcaagcttctcctcaggatgaggatttcaaaatccaacccagaca

SEQ ID NO: 19857 - DNA, 121 bp, Artificial Sequence
  Synthesized
  misc_feature (61): n=c or g
ggggcaggtcctcagaaggttggccagaagcagcataaccttgtattttaaggtgttctgngtctgagcaaaactaaagagcatattatctccatatttcagacttgaccttattggacag

SEQ ID NO: 19858 - DNA, 121 bp, Artificial Sequence
  Synthesized
  misc_feature (61): n=a or g
tggggtgctcacacagctgtgcatgctctaacagaaggattttcggagggtctttattccnacagagaagcaatttcccactcggttttaattcttcttaatatgctgccttcatcttcgg

SEQ ID NO: 19859 - DNA, 121 bp, Artificial Sequence
  Synthesized
  misc_feature (61): n=t or c
gcagtgggaaaaacaaatgctcttgttaaagggcaattcatttaggcaacattttttctcngtcacataacagtttctttttctttcatgagtcacaggatgttcatattctgaccaggtt

SEQ ID NO: 19860 - DNA, 121 bp, Artificial Sequence
  Synthesized
  misc_feature (61): n=a or g
tctgaatacagttgtatgaaatcatggaataattctgcttggaaggagccatttagttcanctggccctctcaaaaggctgttattgcaatctcatggaagtatttactctccagatccta

SEQ ID NO: 19861 - DNA, 121 bp, Artificial Sequence
  Synthesized
  misc_feature (61): n=c or g
cacgtaactactaaagcagtatgcaattcttaactttatttgtagttaagagcagaagagntgcacctgcaagagcaccactggaagcagcactgcctctagaagagtttcctgcaggatg

SEQ ID NO: 19862 - DNA, 121 bp, Artificial Sequence
  Synthesized
  misc_feature (61): n=a or c
ggtttgatgcactgaatatccaaggacatgactacccatgactgtgcctatgtaagatggnctgtgctggcaggaggcgggtgacagacagtcagagataccattgacatcattttaaggc

SEQ ID NO: 19863 - DNA, 121 bp, Artificial Sequence
  Synthesized
  misc_feature (61): n=a or t
cctgccgtatctccaaagcaatgatgcttcagtgcgctgttcaggttattttcaggttgantaaaagctaccttctccagtcctcagcagggaataggttgcatggggtttgcctgttggc

SEQ ID NO: 19864 - DNA, 121 bp, Artificial Sequence
  Synthesized
  misc_feature (61): n=t or c
aaaataataaatcaatcacaatttcttagctatgatttagtgaaccatttacctttacttnccttgcttaaagcattggattcttctctgcatcttttcaagacaagttgtcaaaaggaat

SEQ ID NO: 19865 - DNA, 121 bp, Artificial Sequence
  Synthesized
  misc_feature (61): n=t or c
cgtgttatgtgatctgtgtccagagcacagtaccttttgctgtgtagcgtgttaaacaatntaagacaatgagagtggaaagtgctcagaagggagctgtggcagattaattcacagccgc

SEQ ID NO: 19866 - DNA, 121 bp, Artificial Sequence
  Synthesized
  misc_feature (61): n=t or c
gaattgaatacactttctcttttgtaatatgtacacattgagaaggatttaccatcctgcnttccagcttgcagaatttcatgactttttggtgaattttgtgatggttgtgaatgcccag

SEQ ID NO: 19867 - DNA, 121 bp, Artificial Sequence
  Synthesized
  misc_feature (61): n=t or c
tttaggacaggcacttttgtacttagtcatattgacctttagtttcgctgccaagtgttcntttttgtgctcttttctcagcctcttcagtcaataacatcttgatgagatgactagtaat

SEQ ID NO: 19868 - DNA, 121 bp, Artificial Sequence
  Synthesized
  misc_feature (61): n=t or c
aggttggtaaaaaactggataatctggtccagagggtcaacaggtcattctttaccttaantgtgctaacaagtagaatgttacagatgtctgtcatgaaacctattatttttagcatctt

SEQ ID NO: 19869 - DNA, 121 bp, Artificial Sequence
  Synthesized
  misc_feature (61): n=a or g
gatggcaggaagaaggaaatgtgcagcagacagggtttgggtggcaggctgaggtctagangcatggtgttgagaatccaatgaaaaagatacattaggcatataaagagttaaagaagtg

SEQ ID NO: 19870 - DNA, 121 bp, Artificial Sequence
  Synthesized
  misc_feature (61): n=a or g
gctggtcctgggtgtgagccaaagtgttggagaaaatcggcagtgagcgtgctggaaggcnatgtgcaattagccaattaaaggcggtgtttgctcggtgtgtagctcgcagccagtttgg

SEQ ID NO: 19871 - DNA, 121 bp, Artificial Sequence
  Synthesized
  misc_feature (61): n=t or c
ggctttcatccaaccagtaatataccacttgattagttgattcaatgttctttaccaagcntacactacccaaagttcattgttacactgaccaaagtatttcagaagaaatggattaatg

SEQ ID NO: 19872 - DNA, 121 bp, Artificial Sequence
  Synthesized
  misc_feature (61): n=t or c
ctttaattataaaatggcagaaagccacagaaacagacaacagtggttctgtaacagacanccaattactcagacagaccatttcaaagccttctgacaaatttgtccaaacctgtgtggg

SEQ ID NO: 19873 - DNA, 121 bp, Artificial Sequence
  Synthesized
  misc_feature (61): n=a or g
ctttctttttctttccttagcaatacagctggttagaaaagaaatatccttctggtcagantaatgctttttaatttcaaaaatgtcacattgccataacaccattgaccaagtggcatag

SEQ ID NO: 19874 - DNA, 121 bp, Artificial Sequence
  Synthesized
  misc_feature (61): n=a or g
tattaccaagtcagtagcctagtctgggactcagaacttccagaaaaacccctccgtaccnctcaccctacatgcacaccccaaacacagtgattagtgttacctctggaatgcgcacaag

SEQ ID NO: 19875 - DNA, 121 bp, Artificial Sequence
  Synthesized
  misc_feature (61): n=a or t
gaagttgcagtttatgaatataaagtttatcttatataaaagccttcactgcttaaaacancttgaccagttctcacagaaaatgctaaaagaaggaccttatagttctgaatcttttctc

SEQ ID NO: 19876 - DNA, 121 bp, Artificial Sequence
  Synthesized
  misc_feature (61): n=a or t
tttttttttcaggaggtaaacatctctatgggccatttataagagttccttggacatttcnatataggctgcctgcaactacttattacaaagaaaaattgcgaagctgaaaacaagtata

SEQ ID NO: 19877 - DNA, 121 bp, Artificial Sequence
  Synthesized
  misc_feature (61): n=t or g
cacaaactaaggcagaactctaaatgttcatcagaagtactttatctgctttatagaactntggctttcttgcagccagaacttggaagcagagcacaactgtcagtcctcatccagagtt

SEQ ID NO: 19878 - DNA, 121 bp, Artificial Sequence
  Synthesized
  misc_feature (61): n=a or g
gtctgagaaagaacatagaaagctgaggggtgcctatgcacacagcccaggtgataaagcnctcacgttgctccctgtaccaacatgggcttctcatgtccacagattacactttaattgt

SEQ ID NO: 19879 - DNA, 121 bp, Artificial Sequence
  Synthesized
  misc_feature (61): n=a or c
cctatccaaatcttcatatttgaccctaccatttataggtaattacttggtggtatctcanattctttagtatttcatagggtcaacttctggtttatagtgcttcatcaaaaactatttt

SEQ ID NO: 19880 - DNA, 121 bp, Artificial Sequence
  Synthesized
  misc_feature (61): n=t or c
catcctgttattctgtaccatgcacatcgttcagcatttctatccttacttccatttattntgaagatcattaggaggcaaccacaccatcttttcctctttatgaatcctaaaaatgatt

SEQ ID NO: 19881 - DNA, 121 bp, Artificial Sequence
  Synthesized
  misc_feature (61): n=a or c
aggtttaagacttgctgtgcatgacccctctagttaaaggtaggcagcaagacccacacanaagtactgaatgcctctgaattccagcctataaacaaactttgccttcagaagagaggaa

SEQ ID NO: 19882 - DNA, 121 bp, Artificial Sequence
  Synthesized
  misc_feature (61): n=t or c
atcatccttgctggtcataagccccagttttacatcagcttcacgttgaagaggtgatgcntgtccctgttgcctcacacagcatgcagctctggggagggaaggaagagcccagggagcc

SEQ ID NO: 19883 - DNA, 121 bp, Artificial Sequence
  Synthesized
  misc_feature (61): n=a or t
ggaacagctgctgggtgtattagaagagttaattgtcaaaacttgattagtttgcgtaggntgctgtgcttaaggattctataaaataagaaaaataagctttcctctccgtgtgggtggg

SEQ ID NO: 19884 - DNA, 121 bp, Artificial Sequence
  Synthesized
  misc_feature (61): n=t or c
agaaacgatttctcaggcaagagatcaaacactgtggtgccctaagtatacttcagattantgccctggcagaccaaggttactttagataaacaaccctgcctaaaatgagatttgttct

SEQ ID NO: 19885 - DNA, 121 bp, Artificial Sequence
  Synthesized
  misc_feature (61): n=t or c
ctgatatctgtggtactgctgtgttgtaaggtttctcaggttattccaactggtttctganatttcttttccaggtattgttcttgactctggtgatggagtcacccacaacgtgcccatt

SEQ ID NO: 19886 - DNA, 121 bp, Artificial Sequence
  Synthesized
  misc_feature (61): n=t or g
aaggcaccacagggacagagcttattctattgaaagaaggtgtctatggttgtacaaaggnagaaaaacagacttttggaaaactaaccttaaactttacttctggaaaacagaactgact

SEQ ID NO: 19887 - DNA, 121 bp, Artificial Sequence
  Synthesized
  misc_feature (61): n=a or c
atgctaagtgattagaatcaaattcccatctcagccaaaagttagcactgtaatactcccnagtgtagactaaggctctgcgccagtcttgaaggagttggaaagtatcttgtagcccata

SEQ ID NO: 19888 - DNA, 121 bp, Artificial Sequence
  Synthesized
  misc_feature (61): n=a or g
ctggacaccaattttacctgtgcacattaagttagagtcaagctcatcccctcatggtgtncattgtgttctatatgcatgcaagtgttcattttaaggtccccataaaatgtttgaccct

SEQ ID NO: 19889 - DNA, 121 bp, Artificial Sequence
  Synthesized
  misc_feature (61): n=t or c
acttgtcaaggcttagtgagtaaaagtctgaagctgtaaaatcttgtaaatatttcagcangtctgtgcatccatccttatttaagatctacgcttcttgtaaccttttctctcatttttt

SEQ ID NO: 19890 - DNA, 121 bp, Artificial Sequence
  Synthesized
  misc_feature (61): n=t or c
ttattatgtggttaagtgtttctccttcacacactatgctaagtcatggaagcatttttangattagagcaacaggaattcgtagacaaattgttggtgcagtggaataaatgtttccacc

SEQ ID NO: 19891 - DNA, 121 bp, Artificial Sequence
  Synthesized
  misc_feature (61): n=t or c
agacatctctgacttcacacctcactttgcatctatacagatgaatgtgtgattaactganttgtacttcaacaagctgatcttcttgttaaacaatacaaggtaaggtagttccttgtta

SEQ ID NO: 19892 - DNA, 121 bp, Artificial Sequence
  Synthesized
  misc_feature (61): n=t or c
ttggctgcactgtagcagtccccagcagtggcataaggaacaggtcgtccatcgtgcgtcngggaaaactgtaagtcagtcgctgcagagaggagttggtgaatagcacagaaagaaagat

SEQ ID NO: 19893 - DNA, 121 bp, Artificial Sequence
  Synthesized
  misc_feature (61): n=a or c
ttgtgtgaaaaggggaaaaggaaattgctccccagtcaataaagcacaaatatgtagttgnttatccattgcatttcatcatgtcccattagaattaaaattgatatttaatctttgacaa

SEQ ID NO: 19894 - DNA, 121 bp, Artificial Sequence
  Synthesized
  misc_feature (61): n=a or g
aaataaactaattttggtaagttttactttgcagtcaccatgacatgagagtacacagtangtttgttatgctggcttagctcatatgtggcacttcaatgagccacagtaattcaatgca

SEQ ID NO: 19895 - DNA, 121 bp, Artificial Sequence
  Synthesized
  misc_feature (61): n=a or t
ctccttagacttggtgctgtgggagatcagccagtaggaatctcagcagcggtgatgcacngtcttagatcagcatccgaaggctgcttcataccatgcagatgtgggaggtgatcccaac

SEQ ID NO: 19896 - DNA, 121 bp, Artificial Sequence
  Synthesized
  misc_feature (61): n=a or g
ttcagaacctgccctaaaaataaagccctgggccaggcagcgggaggtaactctatctccnccagccctatctcagcttcttctgagctctgtttgggcaaacggcgagcagcatggctgc

SEQ ID NO: 19897 - DNA, 121 bp, Artificial Sequence
  Synthesized
  misc_feature (61): n=a or g
aaagcttctcagtcagtcccagcattaatccaggcttccatgtgcatcccaaagaagggantaagacagaaagcaattctggcctctaatccacagactaaatagatctggatagctaaat

SEQ ID NO: 19898 - DNA, 121 bp, Artificial Sequence
  Synthesized
  misc_feature (61): n=a or t
accttgtttttagcttagttgatagtcactttctaatgaatttaatacaagcatgttcagngccacatctgctttgcaggacttctttgtagcatcctgagtaagctggcaagatctacat

SEQ ID NO: 19899 - DNA, 121 bp, Artificial Sequence
  Synthesized
  misc_feature (61): n=t or g
ctgcatgatgactgacaattaaaaattcctctcaggaatacaacatgtaattgaagagatnataaaaataaccccataaatagcagtgatttttttttttttttaaacaaagtaatatgag

SEQ ID NO: 19900 - DNA, 121 bp, Artificial Sequence
  Synthesized
  misc_feature (61): n=t or c
agattttaaagcagcttttaattctcccccagggaagcatttgttgcagctcctacaaaanaactagtcccgttgattgtatgagtcatttatacattgtgactagcattacaatgactga

SEQ ID NO: 19901 - DNA, 121 bp, Artificial Sequence
  Synthesized
  misc_feature (61): n=t or c
tgcttgtagaagaaactttgctttgacagagagtgatattttgaggggtgaaactaaagcngttcattgcagttggcaggacatcgagtatggccctcacttatttttcaacttttgacag

SEQ ID NO: 19902 - DNA, 121 bp, Artificial Sequence
  Synthesized
  misc_feature (61): n=a or g
gttgtctcctgcctgcccccagccagaagggcctcgtgccatacttgtggtatcacgatcnttttgacaacaaggaactaagatatcacaggccaaggattatgaattgaatgcgggataa

SEQ ID NO: 19903 - DNA, 121 bp, Artificial Sequence
  Synthesized
  misc_feature (61): n=a or g
agtactaaggaaacagcagtagctttcagtatgtatttagttagaatgtcagatcaccaancttatacttaggattcttggattcactgtaacacagtcctctgaggttcctggctgaaat

SEQ ID NO: 19904 - DNA, 121 bp, Artificial Sequence
  Synthesized
  misc_feature (61): n=t or c
ttccatgtttccaagaggatgtttgcatttggatttaagctgtttatgtaacacaggcctngttacgtgctctttgcacctagtaggagtaaacctttttaaaatattcgttcatagaatc

SEQ ID NO: 19905 - DNA, 121 bp, Artificial Sequence
  Synthesized
  misc_feature (61): n=a or g
ttgtcagtatgttcctgagcaaatcactccttgggcctctcattctctcgttaaactgatnctgacactactctcatttacaaaatgctttgagatctaatgatgaaagagtattaatctt

SEQ ID NO: 19906 - DNA, 121 bp, Artificial Sequence
  Synthesized
  misc_feature (61): n=a or g
tatgccgggcctgtgcaaaccaaacactttaactgaggcaaacgctcaggtgcacaccaangaacaaacaaattaggccagagctaccttccagctgtgggaggtatgagggagtgtctgt

SEQ ID NO: 19907 - DNA, 121 bp, Artificial Sequence
  Synthesized
  misc_feature (61): n=t or c
tagcagtctttcagctgagtgctaagctgtactgaacagaataaggacaagagcatttcanaactgaggcagtacaagttacattataaatttcaatgtcatgctacacagttacattaaa

SEQ ID NO: 19908 - DNA, 121 bp, Artificial Sequence
  Synthesized
  misc_feature (61): n=t or g
acattctcaacatccacggaagccaacagaaatgcagcagacactctcaagatgtaggtgnacagtggcatatctctgtgtttcagaagtttggactgtgcagaaaactgagcagaatgtg

SEQ ID NO: 19909 - DNA, 121 bp, Artificial Sequence
  Synthesized
  misc_feature (61): n=t or c
atcacgtaactgtaaaaagataactattgccagatttattttgctgtttgcttatctggtnagcagctagttgttcttgccaccaaaaaaaaaaaggcaaaaaaatcttcaaggatgctga

SEQ ID NO: 19910 - DNA, 121 bp, Artificial Sequence
  Synthesized
  misc_feature (61): n=a or g
ggctctaagcccgtgcggtagtgctttgtgactaattaggatgtaagtaaagtggacttcngtgtctcaaaaagttcttcaaaacttctgacagatcagtttttagccactgaaagcatca

SEQ ID NO: 19911 - DNA, 121 bp, Artificial Sequence
  Synthesized
  misc_feature (61): n=t or c
gggatgcattttccaaaacaggagttacatccacaattcctctcaggaaaaaaacaacagntgtacaccagtgcttccttccttacacagcactgcctgttgggtcaggtgggggttagac

SEQ ID NO: 19912 - DNA, 121 bp, Artificial Sequence
  Synthesized
  misc_feature (61): n=a or g
ggatatgtaacacaaatcaactttgtagaaatattcagccttaaatgtgttctgtttcttncagcgtagtaagtgctctcacagagactcagacaaggagaaaacctcccagcacacatca

SEQ ID NO: 19913 - DNA, 121 bp, Artificial Sequence
  Synthesized
  misc_feature (61): n=a or t
ggttcactcgggacaacgcagagaaatatgacagcagtactgctacagagaataggaaaanttactttcaggtggccacaggttactgctgcggctctaaaagcagctctaaaaccagacc

SEQ ID NO: 19914 - DNA, 121 bp, Artificial Sequence
  Synthesized
  misc_feature (61): n=a or g
actgtttcctgggtaattcaaattagctacttttgtctaactaagatataattgttctccnggcctacagagccccgttttttcatctttcagtgttcttacttaaggacataggacagaa

SEQ ID NO: 19915 - DNA, 121 bp, Artificial Sequence
  Synthesized
  misc_feature (61): n=a or g
tgctccagctagttcagcagaaatgcaaccctggcatgcactgctagggtgtccggcacancacagatcagtacatcaggatgaaactgcagcagcctacaaacagctacaccaggcacga

SEQ ID NO: 19916 - DNA, 121 bp, Artificial Sequence
  Synthesized
  misc_feature (61): n=a or g
gctaagcagtacataataaaggtcactttatatttaacactactccagctgacttctgacnctcattccctatgggaccaatgctgggatacagaagtccgagctaaaaatgaccttcctg

SEQ ID NO: 19917 - DNA, 121 bp, Artificial Sequence
  Synthesized
  misc_feature (61): n=a or t
gttaccttttccccatccaagtatatgtctcccctctaatgaatacagctgcaaccaaaangatacacagccttgtactactctaaatgagtagagagattcttttcgaaattcacataca

SEQ ID NO: 19918 - DNA, 121 bp, Artificial Sequence
  Synthesized
  misc_feature (61): n=c or g
tttttctgccaccagaaccaggtgctccagaggacagtggctataccgtttggtccgtgcncagtgggactcgagaaacactgacatagttgaagaccccagacccctcttccccataagg

SEQ ID NO: 19919 - DNA, 121 bp, Artificial Sequence
  Synthesized
  misc_feature (61): n=c or g
gtctactgcaaagatatttatcattacaaaggagcataaactttcacaaagcaagtttttnctccagaaaatgctgatgccaaaagcacatttttttctgtgactatgtgacttccagcgt

SEQ ID NO: 19920 - DNA, 121 bp, Artificial Sequence
  Synthesized
  misc_feature (61): n=a or g
tttgcccgtgtttacaagcacacttaaaatatattgcttttatgtctaaagtaagtgagcntttgcacaagaatcccattttagtagctaacaatgttttgataatcccttctgatatttc

SEQ ID NO: 19921 - DNA, 121 bp, Artificial Sequence
  Synthesized
  misc_feature (61): n=a or g
aaatccaagcgcgggtctctgtcttaagacagccgtaggctttcgtctgctcggggatgancattctggatcaaactacaagttttgggtatagaagtggctctcctccccttagcaacct

SEQ ID NO: 19922 - DNA, 121 bp, Artificial Sequence
  Synthesized
  misc_feature (61): n=a or t
atgagttttaagataactttatctcagactcccatggccaccagaataaagaatctaaatnaatgaagatgagtgcaccattaaaataaaattttatttgagaaagtgtttgtgaattaat

SEQ ID NO: 19923 - DNA, 121 bp, Artificial Sequence
  Synthesized
  misc_feature (61): n=t or c
acatgaatggtgtgcctgctgaaatgtagctccaacaaacaagagtaagcctgatgcttgngaggagcttatcagatgcagaagtttggcattagaacagtacactcgaagactgagatac

SEQ ID NO: 19924 - DNA, 121 bp, Artificial Sequence
  Synthesized
  misc_feature (61): n=t or c
cataaggagtttgggactgagcttttcattgtgctgatggcataactgatgtgcagcagangagggagttggaggatctgggagtcagtgatggctgtgagacagaagtggtgtgtgcctg

SEQ ID NO: 19925 - DNA, 121 bp, Artificial Sequence
  Synthesized
  misc_feature (61): n=a or g
ccacggtacatttctggtcactctgaaaggtgttctggagcttttgtggagctgacatcantgctttcctacaattcatccagcaaaatccagacagaaaaaccagctaactacgtttcac

SEQ ID NO: 19926 - DNA, 121 bp, Artificial Sequence
  Synthesized
  misc_feature (61): n=a or g
attgcattcaagatttgttttttaacctcaaagcatatacctttcttaatgtggttttagncaacttattttggatcaatggatcattaaggtttcaagtttgtcaggttgccaacgttgc

SEQ ID NO: 19927 - DNA, 121 bp, Artificial Sequence
  Synthesized
  misc_feature (61): n=a or t
catctttaaaaaaatttcaagaataaaaacctccaaccctaaattaggaagatcatttgtntaccagtaagtgactcccagcaggcaacagaaactagttttcttggtcaccagctatcag

SEQ ID NO: 19928 - DNA, 121 bp, Artificial Sequence
  Synthesized
  misc_feature (61): n=a or g
tgaaaaaaaacccgggcagtaactaaaggttgtggatccaataatgacagagcagtcaacnatcgtagccttcccaaatgctcaagaactcaccgtgctttcattggtacagggactacca

SEQ ID NO: 19929 - DNA, 121 bp, Artificial Sequence
  Synthesized
  misc_feature (61): n=t or g
cattaataatgcacacagcagagcttcctcatggaagcttttacacagctagtcaattcanggagaagtaggagtgccgacaggcattgttacttattgctacttcttgcaataaatattt

SEQ ID NO: 19930 - DNA, 121 bp, Artificial Sequence
  Synthesized
  misc_feature (61): n=a or c
ggaatctggataatggcctaggcaagcccctgggagaccaataataacaaaacagccaaancaaaccattataaatcaactaattttgcaagaggactatttagttgggaaagtagttact

SEQ ID NO: 19931 - DNA, 121 bp, Artificial Sequence
  Synthesized
  misc_feature (61): n=a or g
tatgcacagaaaaaaatggcatagatctgtgcagcaccctggtggagagagccttgcaaanaaaagatggtccacctcctcgtattattgtattatttcttaaagttgccaaagtttataa

SEQ ID NO: 19932 - DNA, 121 bp, Artificial Sequence
  Synthesized
  misc_feature (61): n=a or g
agtctcatcatctgtgtactgttaatccataaaacatcaacagaaatgggttgtgcagaangtacagtatgactgcatgtatagacttagtagcacagactgagaaatttatttctctgac

SEQ ID NO: 19933 - DNA, 121 bp, Artificial Sequence
  Synthesized
  misc_feature (61): n=t or c
aagtatttccactctttatgcccaaattactctgtcagaaagaactctgacaaatttatancaaattaggtaaatgctaaaacaccaactttattaataaaacgattcttattgaaggaat

SEQ ID NO: 19934 - DNA, 121 bp, Artificial Sequence
  Synthesized
  misc_feature (61): n=t or c
tggcagcataaaaggagacctttttgcaagaggatctttgtcacattctcctgcacaaacnctgcactctttgcccctatcacactgatgcattttctcaagtctaagagtttaagtccag

SEQ ID NO: 19935 - DNA, 121 bp, Artificial Sequence
  Synthesized
  misc_feature (61): n=a or c
ggagtaatgtaatcgtgttcagcagtgatacagcaacttccttccttcaggaggggttccnatgaaccctgatctgccaacccatccctccggccacatcgcttttatttttagaaccacc

SEQ ID NO: 19936 - DNA, 121 bp, Artificial Sequence
  Synthesized
  misc_feature (61): n=a or g
tatgtggtatgtaggtcacaacagctatgttgattagcatattggtgatttataaccacantatctattataatgtgacagaaaacataaaattctgtgtatttgttgggagaaggaattt

SEQ ID NO: 19937 - DNA, 121 bp, Artificial Sequence
  Synthesized
  misc_feature (61): n=a or g
taacaaagagaagtcagttgtgttgtaagtactgctgtgaacactgaattttaagtataantagatactgttagaaaatctttgccttcagttgaagaacaggtagaatctggcagaagta

SEQ ID NO: 19938 - DNA, 121 bp, Artificial Sequence
  Synthesized
  misc_feature (61): n=t or c
ggggcataaacatcacatctaaataaaaaaatggtgcatgggcttgttttttacaagggangagtacatatgctagagctcctgcatcagtacttgcaaagatgacagactcctatgttat

SEQ ID NO: 19939 - DNA, 121 bp, Artificial Sequence
  Synthesized
  misc_feature (61): n=t or c
tgatgattccaattgatcagtgatgtccagccatcacgtaggccgtaccagctgactgcangtttcttgtctactgtcttgtctattatgggcaagaatagacaagtctattccaactcaa

SEQ ID NO: 19940 - DNA, 121 bp, Artificial Sequence
  Synthesized
  misc_feature (61): n=t or c
gcaagacaggaaacacagaagagatagcacagcagtctcagtttttcccattggcatcctnggctctgtagtggtcccaacagtgaaaagaagtgctcagataagtgatattcaggctctg

SEQ ID NO: 19941 - DNA, 121 bp, Artificial Sequence
  Synthesized
  misc_feature (61): n=t or c
gtgtgtattgcaggtggtgccccagctttgggaagctcgtttttgtgtggggtttggaggnttgaagcgatgatctctgctattcagaatgttgggaactttgtgcagcgggaatagggca

SEQ ID NO: 19942 - DNA, 121 bp, Artificial Sequence
  Synthesized
  misc_feature (61): n=a or c
atgcttgtgtttggcttcttgaaatgcaggtgttggggttcttggaacacctttccccaanaaaccagcacgatgcaaccactgaaggtgcatgtggagtttccatcccgttgtgcagatg

SEQ ID NO: 19943 - DNA, 121 bp, Artificial Sequence
  Synthesized
  misc_feature (61): n=t or c
ccaggacctacagttgcaaaatacttaactacctaactctttcccctgtccccactctttncctccccccacgtagtaatctattaacaaaaaatcaagagtcggtgctaatgaaaaatgt

SEQ ID NO: 19944 - DNA, 121 bp, Artificial Sequence
  Synthesized
  misc_feature (61): n=a or t
gttaaataaattatccactccatcttcagacaacgcttcttacattggcaatactttcatnctaaatatgcctctttactgttttgcatgctgtgtgcatttttgtgcaggtgcttgaagc

SEQ ID NO: 19945 - DNA, 121 bp, Artificial Sequence
  Synthesized
  misc_feature (61): n=t or c
tgagtgcagcctttgtgtgcagtcttagcatgggtggttggtacttgtgggagaaagatcnacttgaagcctggtgggaagagtctatcctcccgtttattctcagctggaggtttacttc

SEQ ID NO: 19946 - DNA, 121 bp, Artificial Sequence
  Synthesized
  misc_feature (61): n=a or g
atggcaattgtgcctctgaaaccaaatgtagcatttgctgcagactcagtatcctatcccncataacggatgggatttcttcctggccccttagctatgatccaaggaagattttggatac

SEQ ID NO: 19947 - DNA, 121 bp, Artificial Sequence
  Synthesized
  misc_feature (61): n=c or g
caataataaaaagccttacgtttcactgttattctgtgaaagtggggaattaaataggacntggctttacatagtggtggttttccttcaatccattgcaaatggtatagagaggtttgtt

SEQ ID NO: 19948 - DNA, 121 bp, Artificial Sequence
  Synthesized
  misc_feature (61): n=t or g
ctgaatcaacatgtcaacttatttttacaccttgtatctgaagggttatgcagagatcacnagaaaatgcggccttttttgatgcccatctccttccaatgacacaaatctttgcatggtg

SEQ ID NO: 19949 - DNA, 121 bp, Artificial Sequence
  Synthesized
  misc_feature (61): n=a or g
cctaagtggaaatggatgcaagttttttcccatttccatagatctctttttagcaacagcncctttgaaagggaaaggaagtcagaagtagacaggaaaaggacatctgttagtacactcc

SEQ ID NO: 19950 - DNA, 121 bp, Artificial Sequence
  Synthesized
  misc_feature (61): n=a or g
ttctgcgtgtgcactgtacagaagtcctttacagcggtcctatcatattttagtctgctcngcatctagaaagtaggggaaacgaatgagtcgtgagaaggctgctgtgtcttagtctagt

SEQ ID NO: 19951 - DNA, 121 bp, Artificial Sequence
  Synthesized
  misc_feature (61): n=t or c
cctattattcctattactgaggaagaaaaaaatagggaagacaatttccttcacgtttgcntagtgattttttatcaaatgtaatggttatcccacagaggtttccatttacaaaattcat

SEQ ID NO: 19952 - DNA, 121 bp, Artificial Sequence
  Synthesized
  misc_feature (61): n=a or g
aacagttactcactgacgctacttcacagattgttttgaaaagtgaataccaagtcagtcnttgtccagttgttcaatacgtatgggatggctgatgaaccagccagttcctacacaggac

SEQ ID NO: 19953 - DNA, 121 bp, Artificial Sequence
  Synthesized
  misc_feature (61): n=a or t
ctttaagagttactttttgtaactcagtgcactttaggatattcacttaaacatctgcaanactgagaacactctccagtccttctggaagatatgttaccttccaaggaagcaaagcttt

SEQ ID NO: 19954 - DNA, 121 bp, Artificial Sequence
  Synthesized
  misc_feature (61): n=a or t
aaatgagcactcagatgttgagtgacataaaacacagaaaattcatcactaatgaagttcnaaaataccaggtgatgtcagatatcaaaacccagcagttttagaactacttctacagtaa

SEQ ID NO: 19955 - DNA, 121 bp, Artificial Sequence
  Synthesized
  misc_feature (61): n=a or g
ttgcacacaaagtaatgtatctgtccatttgctgtgtataggaaatagaagacaaagttcngtttgtagaatggaagagaaggacatggattaagtctttgagaaagtataaacattaata

SEQ ID NO: 19956 - DNA, 121 bp, Artificial Sequence
  Synthesized
  misc_feature (61): n=a or g
aacatctgcagaattgagactggcatttcactcgcactgctgaaagcacccaactgttgtnacagaggaagcaaatggtaaggatgtttgaacttagtcagatagtaacagtaactgcagt

SEQ ID NO: 19957 - DNA, 121 bp, Artificial Sequence
  Synthesized
  misc_feature (61): n=a or c
tcacctccataactgagttaagcagagatgagatggtaagagccgtggatgtgtgctgganctcaaactgatacctggcacaaaaagaattcctacttaatatttttcataaagtaaaata

SEQ ID NO: 19958 - DNA, 121 bp, Artificial Sequence
  Synthesized
  misc_feature (61): n=t or c
gttctctgctttcaattaaaggcacagtgtcagcacacagcactggagccttgaggaatgncagtgtttctgtagagtcttgtttaaattgggtaaataaagctgaaagtaaaaatgtttt

SEQ ID NO: 19959 - DNA, 121 bp, Artificial Sequence
  Synthesized
  misc_feature (61): n=a or g
ggggtggaaccggcagtgccaagaggtgccattgggctctgctgggtttgtggctgggtgntgggttagaaacagcctgaacaattgctttcatcagaagggagtcagagcaatggcctgg

SEQ ID NO: 19960 - DNA, 121 bp, Artificial Sequence
  Synthesized
  misc_feature (61): n=a or g
tcaggctggtgggttggaagggaagggttggaagcatgggttcttctgtgctctgtatcanaagaggagagaactgcaggattggtgtgcagagggaagaactgggcaaactggggccctt

SEQ ID NO: 19961 - DNA, 121 bp, Artificial Sequence
  Synthesized
  misc_feature (61): n=a or g
cccaacagtgtctaactattaaacacagatattccaatatctgtaactgtcttgaattccnccccccaatataaaagaaacgtaacctattgcttcttgctacaggtgtcacatttctact

SEQ ID NO: 19962 - DNA, 121 bp, Artificial Sequence
  Synthesized
  misc_feature (61): n=t or g
ggtcaggaactctgctcagcaattctgaggccattcccaaaactcctttccaagtcaagcncacgtgggtgggaagggcgtagcttccagctcactcagcacgtgttagcagcagtgatgc

SEQ ID NO: 19963 - DNA, 121 bp, Artificial Sequence
  Synthesized
  misc_feature (61): n=t or c
acagaggtcttccgtgggagatggagtcctttcttgccgcctcatcctaatgctgggaggnatgaggagaagagagggatgggcaaggttaaacaggaattgatggaatggaatgtttgat

SEQ ID NO: 19964 - DNA, 121 bp, Artificial Sequence
  Synthesized
  misc_feature (61): n=t or g
tcagagcctgaacttgagaatcatctatagttaaatctttaagttctttagctgggcaagnactagttcagaatgaagttggcatactctcatataatatggggtgtgttaaagagaggag

SEQ ID NO: 19965 - DNA, 121 bp, Artificial Sequence
  Synthesized
  misc_feature (61): n=c or g
ggcctaaaatgccaaataaaagaggtctagggacagatctcccaagcttgggtgacacatnctgccttagggcctttcccttgagggaacacagcatatcaaacctgatcaagtggtgtag

SEQ ID NO: 19966 - DNA, 121 bp, Artificial Sequence
  Synthesized
  misc_feature (61): n=a or c
ataaacacattctaaaaataagaaattgctatcatttattactattgtgtaggaaaaaaancgcactgcttgtttgaattcttccttggatctgtttgctacctccttctctgtcccttat

SEQ ID NO: 19967 - DNA, 121 bp, Artificial Sequence
  Synthesized
  misc_feature (61): n=t or c
gtttggcttatcagcccagcaaaggtttgggtttcaggtgtggctctgtgccaggtgcagnactcgtcattcacacagcaccaaggcagggagcacagcacacaggcttacaggcttatca

SEQ ID NO: 19968 - DNA, 121 bp, Artificial Sequence
  Synthesized
  misc_feature (61): n=a or g
gtgtgctaaagtgtgtttgggaatcatgtcccaaggtaggtcagaactgcagtcccaaatnatgtgagccacttaaaattcttcaaggacgagcaaaagagtcgatgttaattatagttaa

SEQ ID NO: 19969 - DNA, 121 bp, Artificial Sequence
  Synthesized
  misc_feature (61): n=t or g
ccccatccctcttccctgggacaaggggagggggtgccagggaatcattccacgatgtaanatcaacatccaaggatatgtgcaaaaaacactgtactgatttcaagaaacagaagggatt

SEQ ID NO: 19970 - DNA, 121 bp, Artificial Sequence
  Synthesized
  misc_feature (61): n=a or g
ctcatagaggtttgtgggctgccagtgtttgctgtgttagtcagacttgggagatgtttgntaccgtacaggattcagtggctctccctgtctttaggtgaggtgttaggaagaaattctt

SEQ ID NO: 19971 - DNA, 121 bp, Artificial Sequence
  Synthesized
  misc_feature (61): n=a or g
aatttcttgtgtacagtttctgcagtagcaattatccattccaaggctgtggaggatgccngatgataaataatgttttccttaaggtcctggcctaaaaactggtagatctttctactgc

SEQ ID NO: 19972 - DNA, 121 bp, Artificial Sequence
  Synthesized
  misc_feature (61): n=c or g
gtagcctttgatttggaaggtctaagatgggtggtcatcagataacaagcccatacttcgntcatacaccagccatattatttggccccctgtacaggtcacaggtttctctagatgattt

SEQ ID NO: 19973 - DNA, 121 bp, Artificial Sequence
  Synthesized
  misc_feature (61): n=t or g
ccaaacacaatctgccacaatcaatcaaagcaatgtaacaggcagcttatctgaaagtggnagcgaaaaaccacacaactggcttgataaacattctaggaaattacctgaactctaatgc

SEQ ID NO: 19974 - DNA, 121 bp, Artificial Sequence
  Synthesized
  misc_feature (61): n=t or c
gccccaggacttacccacacacatagatatgagcatttccatcattcaccagcttccagangtgttccttgttcttctttagtaagtgttggacataaacctggcaagaaacaatgaacca

SEQ ID NO: 19975 - DNA, 121 bp, Artificial Sequence
  Synthesized
  misc_feature (61): n=t or c
ctcttgtcttttcttccccctcaccttcaagctttctccattgctcggagatgcaggcagngaacacctccatccttgccatgtgtggctgctgctttcccattcacctgccccagtttca

SEQ ID NO: 19976 - DNA, 121 bp, Artificial Sequence
  Synthesized
  misc_feature (61): n=a or g
aagcatgttcacatcacccatgctctgtgaatttattgtggaattggtaagccaacttagntttccatcataaagagcaccagaccaccttaagacgtcactcgcttaggctgctctaatt

SEQ ID NO: 19977 - DNA, 121 bp, Artificial Sequence
  Synthesized
  misc_feature (61): n=t or c
tgatttcacagtatggtgctgactaatcagttcatgttcagaacaacattgctaatattgngttaagaaaagaaactaaggcccaattctgccttccatgaaataaaaaattcatttactt

SEQ ID NO: 19978 - DNA, 121 bp, Artificial Sequence
  Synthesized
  misc_feature (61): n=a or t
gcagtctggaccttcgtcatcaggagatccttctttttgtcgctaaggactgatccatggntcacatatcacgtaaatcaataggagtcagctgttgacttcatcaggctgtgaatcaaat

SEQ ID NO: 19979 - DNA, 121 bp, Artificial Sequence
  Synthesized
  misc_feature (61): n=c or g
tgccaagtccatgcactcgtttctggattatctcaaagagaggacagcctgcacttgtcanatttagtcatttcaatctttcctgtaaacttgggatttcccagggctggctatacggtgt

SEQ ID NO: 19980 - DNA, 121 bp, Artificial Sequence
  Synthesized
  misc_feature (61): n=t or g
ggctctcctctgaaccatataataatgaactctcatcactgggacaatgtttcccacctgnttctgtgttgatatggtagggtcatgctattataccacttttctggcttctgttttgctc

SEQ ID NO: 19981 - DNA, 121 bp, Artificial Sequence
  Synthesized
  misc_feature (61): n=a or g
tatgcagaaatatttctaatctctttctgtcatctacccctcctctaagctcctatatacntttgaaatagaaactcataagtaacacatatcactcaaattgggatcttgtcatttaatt

SEQ ID NO: 19982 - DNA, 121 bp, Artificial Sequence
  Synthesized
  misc_feature (61): n=a or g
ttcctccataagatccctcatcaggactacttgtgtgaatgagagctgcaaggcttctggntagcatttatataaaaacaggaatgttcctgaagtgctgtaaatggagctgcctaaattg

SEQ ID NO: 19983 - DNA, 121 bp, Artificial Sequence
  Synthesized
  misc_feature (61): n=t or c
tttatctcaggaatttaaatagactgtgatctttttatttttgttcattctcctggaatantgtagtgttgtatgttcagaaaaagaaaagcactctggtagctagctcttatgcagaggt

SEQ ID NO: 19984 - DNA, 121 bp, Artificial Sequence
  Synthesized
  misc_feature (61): n=a or g
ctgaagcatatctgcttaaaacattgaaaaacagaacaaaactctaccaaacttgggcccncaaggagtcatgcatttgcactgataagttgcagccatgacttaggagaaagtaagatac

SEQ ID NO: 19985 - DNA, 121 bp, Artificial Sequence
  Synthesized
  misc_feature (61): n=a or c
aacagacttcagagtactgcactatgttgaaatgaaggattcataagaaacactgaatggntggtatcctactgaggctcacaggaaaacaagttttccacttcaagatgctactatttag

SEQ ID NO: 19986 - DNA, 121 bp, Artificial Sequence
  Synthesized
  misc_feature (61): n=a or g
gtaccttttgattccaggtttctataatctcatagcaggacctcaatgcaaatactactanttgttaggactactaatagtgtaactgcacagacttgtcagcagaaaagcagctgagtta

SEQ ID NO: 19987 - DNA, 121 bp, Artificial Sequence
  Synthesized
  misc_feature (61): n=t or g
tgaaaactaattattttttgaaaaagcaaagaatcttcaatgaggaggaatttatttaatngccaagcttcaaattctctcagtgtttaagctactcaaataaaggaaagatttcaaaagg

SEQ ID NO: 19988 - DNA, 121 bp, Artificial Sequence
  Synthesized
  misc_feature (61): n=t or c
tgtggacttcctcaggaagacagtgctgttaccagctagtcattagctaggcagtaacatnagggatagatgttctagtgtcggtgaaacagaaaaagaaaaacaggttgtttttggtttt

SEQ ID NO: 19989 - DNA, 121 bp, Artificial Sequence
  Synthesized
  misc_feature (61): n=t or c
atgcatgcacaggagataaagattctgtgtgcttcactagcgtgggcctacccatgaaganctcatgatgtgacaggcagtgctgtctggttagggtaaccctgttatgcattaatgcaag

SEQ ID NO: 19990 - DNA, 121 bp, Artificial Sequence
  Synthesized
  misc_feature (61): n=c or g
ggaaagtatcccaggtttgtcctctgtcttcatctatctttgtttcttttatctgtactcntagtaaagtgctaggcttcgatcttccatatacttaatcatttgatttaagcaagttctt

SEQ ID NO: 19991 - DNA, 121 bp, Artificial Sequence
  Synthesized
  misc_feature (61): n=t or c
tgggatgagcgcccgcatcaccagtgctgccttcatgcctggcaactctgctcacagcctnttcatgacagcagctttgcaggactttaggattacgcggcacaaggccttgactcccctg

SEQ ID NO: 19992 - DNA, 121 bp, Artificial Sequence
  Synthesized
  misc_feature (61): n=a or g
gctctccagccttctatcagatctctgtttttgttaagcagctgttagcttcctgtacacnttgggtatcctaattacacgtgacataactatgtctggccatgtctttaggtttagttaa

SEQ ID NO: 19993 - DNA, 121 bp, Artificial Sequence
  Synthesized
  misc_feature (61): n=a or g
aaccaatatttaaaatttatgggtttcacctatcgtttcaaggtgagaggcagcagtagcnatgctttagcacttctgtctgtcttgccttttctttcagtgcaataaagaaaaacagcag

SEQ ID NO: 19994 - DNA, 121 bp, Artificial Sequence
  Synthesized
  misc_feature (61): n=t or c
agaatgagaaagctgcaagaaaaagactgttggagcaaatggaagaggaagctattcaatngagcaatagggatagttttggtatgatggagttggtaggaagaaaataagagaattgctt

SEQ ID NO: 19995 - DNA, 121 bp, Artificial Sequence
  Synthesized
  misc_feature (61): n=a or g
tattttactaagagatacaaaaaagcatttgttgactgctgggagctttatcagctagaancatcttgaccgatgcagttttacttacctgccacagctgtggagttgaatcacagctgag

SEQ ID NO: 19996 - DNA, 121 bp, Artificial Sequence
  Synthesized
  misc_feature (61): n=t or c
gctatggaataccctatgcagtgaatttgatctgaattcagtatgctcttattaatgcaantgcatatccacaaaatatgaatttaacactgactttgtgctttaaataagttgatgctga

SEQ ID NO: 19997 - DNA, 121 bp, Artificial Sequence
  Synthesized
  misc_feature (61): n=a or t
tcattacattttttcagctgattgtaaaatatggtatttataatagctgcttgctatagtntgacaaattgaattggaactgccaagtctgcaaaatggaaacagaaaaaaagtgttacgg

SEQ ID NO: 19998 - DNA, 121 bp, Artificial Sequence
  Synthesized
  misc_feature (61): n=t or c
gcctagctcgtccttgtgtttctttcagcttttcttcaaatgcattctctcccttcagtcncacctgacatttcagcctcccagagacaaagataaaaatgctaactccagcacaaataca

SEQ ID NO: 19999 - DNA, 121 bp, Artificial Sequence
  Synthesized
  misc_feature (61): n=a or g
gccaaagcaactgcctacattagtggaaatttagacaaggtgatgaaaactcttatgccangttgagaattcagagccccttatgtttaagggcttctgctacaggacattcagattcatt

SEQ ID NO: 20000 - DNA, 121 bp, Artificial Sequence
  Synthesized
  misc_feature (61): n=t or c
tgagattttgatcttcttcttcattcatgactataattgcttataataggagtgacaaaangccacttgaatgttatccctgcaggacaccgctattatttgcatgcttcttttactgtgc

SEQ ID NO: 20001 - DNA, 121 bp, Artificial Sequence
  Synthesized
  misc_feature (61): n=t or c
cctatccgggctgctcggggtgcatcccgcccgacttgtgctgacctttgggtttccccanggaaggatgcagcgaccgaccagtttgcaacgaagcagcactgctcctcatgccctgagc

SEQ ID NO: 20002 - DNA, 121 bp, Artificial Sequence
  Synthesized
  misc_feature (61): n=a or g
ctctgggactactctactccccagatgaatgccaagtaaaacaacaaataaatttagaagnggtacaatgaagcagagaaaattaaagctcttgtaaagctggttgttctgaggtagttta

SEQ ID NO: 20003 - DNA, 121 bp, Artificial Sequence
  Synthesized
  misc_feature (61): n=a or g
attttaatgaatttttgaaggaatgtggctcagtcagctttagaacacacaacttgtcccntttgactacgtgatttttgaggaaggcatacacttacagcttaatgtgaaaaggaatctc

SEQ ID NO: 20004 - DNA, 121 bp, Artificial Sequence
  Synthesized
  misc_feature (61): n=a or g
aacaaagacaacgtctttactgtgagagaatctttaagccttaatgtccttactaagaacnttttcctcctctttcacgctacaattagatttcgtccacagacctgacaccagagtcagt

SEQ ID NO: 20005 - DNA, 121 bp, Artificial Sequence
  Synthesized
  misc_feature (61): n=t or c
tcttaaatgctcttcaaagttctttggctgtttatttttttcagtcaactatggttccagncatacatttaaaaccacttaaggatcaaatcctattggtatatactgatcactttcagtg

SEQ ID NO: 20006 - DNA, 121 bp, Artificial Sequence
  Synthesized
  misc_feature (61): n=a or g
gaaacgggacttttttttccttctcagaggaggtcactgccaggaatagcatgggaaatanttaatggaggaagaaatattctccttcacatgagaagtattgtcttgctcggcagttctg

SEQ ID NO: 20007 - DNA, 121 bp, Artificial Sequence
  Synthesized
  misc_feature (61): n=t or c
taagcttcacagtcaaggctgtcttacatttgcatatgcttgtgctgcctgcacagggggntcctgagctgcattcagacctctggctgtaatttaatgacaaacattgcacaagggaaac

SEQ ID NO: 20008 - DNA, 121 bp, Artificial Sequence
  Synthesized
  misc_feature (61): n=t or c
atttagatgacacgttttcactgtttcagctaagcattcattaattgaattcaagaacttngtttccttattattccttctttccgtcccagtaaatgatctctaaataaaagcttattga

SEQ ID NO: 20009 - DNA, 121 bp, Artificial Sequence
  Synthesized
  misc_feature (61): n=a or t
atatttttatgttctgtaaagcacctagagatccaagagtagaagaaacaataatcctacnactacatatttcttaattctggcatggtttggattatagttaaaaataataatttaaaaa

SEQ ID NO: 20010 - DNA, 121 bp, Artificial Sequence
  Synthesized
  misc_feature (61): n=a or g
ttttcatgctcttgaaataatttagagcattgtctagccctggacttgtgtggcaactgtnacaggagttgagctcattacctgtgtgacctcaagtgatgtctcatcccctcagctgccc

SEQ ID NO: 20011 - DNA, 121 bp, Artificial Sequence
  Synthesized
  misc_feature (61): n=a or g
ctctgtacctgcacaagtgaaaatggaagttgtcaggagacaatgagattagatcttcacnaagtgtgaatagcaaatggccggactgcaatgaaaaagagaaggctgaagatacagaatg

SEQ ID NO: 20012 - DNA, 121 bp, Artificial Sequence
  Synthesized
  misc_feature (61): n=c or g
gggacgctaaagatcacccagttccagcccaccgccgtgggcagggatgtggatggagaantgctttgtactgtaacagtttcatttagaagcgagaagtccttcatgaggaggtagtggg

SEQ ID NO: 20013 - DNA, 121 bp, Artificial Sequence
  Synthesized
  misc_feature (61): n=a or g
gcatgccatgcacatttatttgcttgtgcttgagttggtgaatgtgtttgtgctcactacnttcacctgcttagttcttctgtctttgaggcttagtgcaattgaatattcaagatgtcat

SEQ ID NO: 20014 - DNA, 121 bp, Artificial Sequence
  Synthesized
  misc_feature (61): n=a or g
tacgaatgtgtgtcttgtcgtgttcacggacagttttgtattttggggctcttgacgggcnaatcagatctctgccttttatcgctgcctctgctgattaaattccactgctttcgtgcat

SEQ ID NO: 20015 - DNA, 121 bp, Artificial Sequence
  Synthesized
  misc_feature (61): n=c or g
cccaaaacatttgaaagagctactctacacttcaggtacataggctaggtggcagtgctanctcagatatctgtgccagaatttccttgttatttactcacttttagtgcctaagatacat

SEQ ID NO: 20016 - DNA, 121 bp, Artificial Sequence
  Synthesized
  misc_feature (61): n=a or c
ctgatgaaaaacatatgtatgtaaaccactgtgggctaaatgttctggttcagtatctcanacagttttgtaaatatcagaatattttttctccttgtcccctgcagccatgctatggagg

SEQ ID NO: 20017 - DNA, 121 bp, Artificial Sequence
  Synthesized
  misc_feature (61): n=t or c
gtctggagactgtttgccctttggatgtaggaagctgtatatcagttacttcaaaatcccncctaagatcaaggcagaagcatggccaggtgctgatgtccagggcacctccacctctgca

SEQ ID NO: 20018 - DNA, 121 bp, Artificial Sequence
  Synthesized
  misc_feature (61): n=t or c
cattcaagttatttcccacgcttaatagatgttttctcctcctggagtttacatctctaangattctgggtcagggaggtgaactcccaccagccttggcggctcgaggtagggcacatct

SEQ ID NO: 20019 - DNA, 121 bp, Artificial Sequence
  Synthesized
  misc_feature (61): n=t or c
gttgtagcttcatcccttcatgctaaataaaatcttcctctaatcctctagtgttaacccngtctcagtagatactgaaagaaaggtctccaaagggtgttactttttctcttgtcctcaa

SEQ ID NO: 20020 - DNA, 121 bp, Artificial Sequence
  Synthesized
  misc_feature (61): n=t or c
acaagtctcattcgtagagctttctctgaaggggtatcagctataggagaatccagtctcnggatttctagcaaagcacagtccactaataattattttaagttattttagtcttcagctt

SEQ ID NO: 20021 - DNA, 121 bp, Artificial Sequence
  Synthesized
  misc_feature (61): n=t or g
gtatgggaagtgtgtttgcatttccagtaatgatgcaaatgaatgtcactctattcaaatngtttagacaacagtgatacagattttagaaagtataatagaaaagaaaggcaagagggga

SEQ ID NO: 20022 - DNA, 121 bp, Artificial Sequence
  Synthesized
  misc_feature (61): n=a or c
acaaaacagaatgacaaataataagaagaaaatcttaaataccattaagctcttctaaagnactgtaataaagaacccatttacctgtcacgttgaccttaacttccagttgtttttctgt

SEQ ID NO: 20023 - DNA, 121 bp, Artificial Sequence
  Synthesized
  misc_feature (61): n=a or g
cattggcacccactcctgatgtgaatgcctgatgcagcgtcgaaggccctgttctgatatnaatttccttctaaggaagcttctgaagcttctgaagactcctgtccaataatagggtatt

SEQ ID NO: 20024 - DNA, 121 bp, Artificial Sequence
  Synthesized
  misc_feature (61): n=a or g
tgataggatcgatgcacacttttcctcccatcaggccagaactggaacacttccatcaatnaggatccttgagtggtcccttctcagcaggtgaaacctctctgctcagctctcctccacg

SEQ ID NO: 20025 - DNA, 121 bp, Artificial Sequence
  Synthesized
  misc_feature (61): n=a or t
caagagacacacaaaagaaattagaatctagtttaatcattttggcacaaacataaagagngggcattgacttttattctagctaaactctattctagctaaatgtgaaaaacttatttag

SEQ ID NO: 20026 - DNA, 121 bp, Artificial Sequence
  Synthesized
  misc_feature (61): n=a or g
tgtattttaactactacatatcttcagtcatatcagtaactacaatctgctactctccaantgcttatttttcagtaaaagtaaaaattgtccttagctcttgttgcgtgctgcctgcttg

SEQ ID NO: 20027 - DNA, 121 bp, Artificial Sequence
  Synthesized
  misc_feature (61): n=t or c
tctttcatttgtatgtgactaacaggctaatgttatagtagaaatcgtggcaaagaaggantgaatcatgaaggctttaagtttgctgtgagcttttgcaaagtaaatttgggatttctct

SEQ ID NO: 20028 - DNA, 121 bp, Artificial Sequence
  Synthesized
  misc_feature (61): n=a or g
aactcttgtggagacagtgctatgcaaggtcaggaggacgcatgtttctctcactcttccnctttctcccacaccaaggtttggagcacagtgaacagttatgagagctatgggtgcactg

SEQ ID NO: 20029 - DNA, 121 bp, Artificial Sequence
  Synthesized
  misc_feature (61): n=a or g
tctctcatgattagcagtctgtcccagagagatgtccatttctctcctgtccataaggtcnctggttaactcttctacactgtggtcagtgctgactgcaaacctttggggagcatctgtc

SEQ ID NO: 20030 - DNA, 121 bp, Artificial Sequence
  Synthesized
  misc_feature (61): n=a or t
ggtacagagaggtaagctgtgcaggaaagtgatttttctgatgttaatcgggtgtaagagnatctcatcttacagcttcttatccagagctttcatgtggctttacgtcctacacaatatt

SEQ ID NO: 20031 - DNA, 121 bp, Artificial Sequence
  Synthesized
  misc_feature (61): n=t or c
aaaacaaaactaatagctgagtttcatttgtcgcaatcaggagtttttttcaggactgttnagaataaagttggatggcgtttggagattcgctgttgaagcattactctccagcggtaaa

SEQ ID NO: 20032 - DNA, 121 bp, Artificial Sequence
  Synthesized
  misc_feature (61): n=t or c
ttctgtatttatgcttcttactaccagtttctaacctccgagatgtaaaagcaacaacatncccttcagcagagtgcttcaatccaggaaagtgaccatgagatggttccaaagcagcagc

SEQ ID NO: 20033 - DNA, 121 bp, Artificial Sequence
  Synthesized
  misc_feature (61): n=a or g
gatcaaaagcaacagatggtgcaagagattgtgagtagagcagctttaccagtgagagatnacatcaaagtactaggtgtggatgagtcatggcttcctctctccacaacctgtatccaag

SEQ ID NO: 20034 - DNA, 121 bp, Artificial Sequence
  Synthesized
  misc_feature (61): n=a or g
gaaaaagactgcttcctgggggagcatattgtgtatggactgatggactaatttccagacngataaaacacccagagtaaaacagtattagaaatttaaaatcttaacggtacaaataaag

SEQ ID NO: 20035 - DNA, 121 bp, Artificial Sequence
  Synthesized
  misc_feature (61): n=a or g
tagataggcttaggattctgtctgagatttgatcccccattgaggggattctagtgatttngaagaggataataatgatctggaggtcatacccatagagctgaatgcctcccttcatctg

SEQ ID NO: 20036 - DNA, 121 bp, Artificial Sequence
  Synthesized
  misc_feature (61): n=t or c
tgtgtcctttttttgctctcttatgtattctgtacctttatttattgttcatgagaattangtaggtcagggttgaggctttgcagtagagcagcataggtaaacctccctacaatataat

SEQ ID NO: 20037 - DNA, 121 bp, Artificial Sequence
  Synthesized
  misc_feature (61): n=t or c
tcaagatagttaccctgatcaattaattttgttccagattgcagaaaaactaaaaggcagntcagcataaaattcactgtcatgcatagacaacacaaagaatttaaaatgctagctaaga

SEQ ID NO: 20038 - DNA, 121 bp, Artificial Sequence
  Synthesized
  misc_feature (61): n=t or g
tgtctattgttctcctgcaaaaggtctaacaaattatttgaggtgcttccatgctaagatnctcaaaattcccccagttcctctagcattctggcactcttctctaatgtgcacccctgcc

SEQ ID NO: 20039 - DNA, 121 bp, Artificial Sequence
  Synthesized
  misc_feature (61): n=a or g
aaactaacaaaccaaaatatatacaatgaccaaaagctgcatgtttgtctggagggtacanagactatcccatccacggttctgcaattgcttactttgttcttaactaatgcaaaaaaag

SEQ ID NO: 20040 - DNA, 121 bp, Artificial Sequence
  Synthesized
  misc_feature (61): n=t or c
tcaacagtttcagaggaagaataaaagcatttcagggtcaaaaatccttcttctgaacttnccaagtggaaagaattaagcatctcagtggggactgtggtaacaaactttcccttctgtt

SEQ ID NO: 20041 - DNA, 121 bp, Artificial Sequence
  Synthesized
  misc_feature (61): n=a or g
gacaatccaaattgtatctccttccctatgacttctaggaatgggaggggatgggaaacanccggtgcgtgctggttcagaacagctctatggccccttggagactgagaacctctccctt

SEQ ID NO: 20042 - DNA, 121 bp, Artificial Sequence
  Synthesized
  misc_feature (61): n=a or g
tgtatgattcatttttttaaaagtgcagagctacataccaaatactatttctgataacacntggcaaagtgaaatctggattttgaccaataacaactggtcaacctgacagatacaggtc

SEQ ID NO: 20043 - DNA, 121 bp, Artificial Sequence
  Synthesized
  misc_feature (61): n=a or g
ggctgtccctgctcattgcaggcactgggaccaggtggcctttaaggtcctttgcaatgcnaaaggttctgtaatagtgcagttctaagcagggacacagatgctgacacagggagcactg

SEQ ID NO: 20044 - DNA, 121 bp, Artificial Sequence
  Synthesized
  misc_feature (61): n=a or g
agacatgacttccagaacaacccatgtgctaaaaagctacaaatccttgggtaacacctcnatacaacacacagaaatgattctcagccaaacagctttaagattcagcattcatatttag

SEQ ID NO: 20045 - DNA, 121 bp, Artificial Sequence
  Synthesized
  misc_feature (61): n=c or g
agcaacagttcaatccagttaccatagttcaccccaaatcaatatccttaatgagctccantctacaagaacatcactgtcctgcacatgctccagtaccagaaaccatgtattagtagtc

SEQ ID NO: 20046 - DNA, 121 bp, Artificial Sequence
  Synthesized
  misc_feature (61): n=a or g
taacatgacttgatacaactgtgatgtgaacatgacaaaacatccatcaccttcttgttcnggaataacgagggaaacgaggttaattttagtcctgtcctactgaagaacagtaattttt

SEQ ID NO: 20047 - DNA, 121 bp, Artificial Sequence
  Synthesized
  misc_feature (61): n=a or g
gttaacttcttgggattattataaataaataaacctgtaacctgtttaagaactgattacnaggataatggtaaagaacaaatcagatgaacttcttactgaaggtctggggtgataatca

SEQ ID NO: 20048 - DNA, 121 bp, Artificial Sequence
  Synthesized
  misc_feature (61): n=t or c
caaagtcatagaagaagattttctactttatgggaaacatcttcatgttggtgtcagaganccatctgatgctctccacacttcaatacagcctctcttacttttcttctttaatacccca

SEQ ID NO: 20049 - DNA, 121 bp, Artificial Sequence
  Synthesized
  misc_feature (61): n=a or g
aagtgggaattgttatttttatatatgtagcatctatatagtgagtgtgtgtactgacacnttttagaattaatacagtgatgctgacacagtaatcagttaatttctggaatatgctgct

SEQ ID NO: 20050 - DNA, 121 bp, Artificial Sequence
  Synthesized
  misc_feature (61): n=t or c
cttggaaagcagtcatctagttacatctgactgctactgccagctcacaaacaaagcttgnaaggctcaaaaggcttgcctagaaataaccagcacaccaacacacaaagggggaaagacc

SEQ ID NO: 20051 - DNA, 121 bp, Artificial Sequence
  Synthesized
  misc_feature (61): n=a or g
cagttaactcacagccactgctgagtgcaaggcagtttatagtcaagtccacgtgcatcanttcaactgtaagtcacttttaatatctactttctaatcttctgtcctgacaaagagttac

SEQ ID NO: 20052 - DNA, 121 bp, Artificial Sequence
  Synthesized
  misc_feature (61): n=a or g
gcataaagaggccacttaagtcatggtgcctgaaattggccattagaatgctttagcacancagcaggagcatcccatgtggcttgctgtaagaaaccacgggccttctccatctcttaga

SEQ ID NO: 20053 - DNA, 121 bp, Artificial Sequence
  Synthesized
  misc_feature (61): n=a or g
aaaatcttaccgaaaatctatttatgaaaagtcagtgactgcaacaatgtttacagtaaancatcaaacttcttcatgaagctcattacagtatctgtatagtataatggattaatatatt

SEQ ID NO: 20054 - DNA, 121 bp, Artificial Sequence
  Synthesized
  misc_feature (61): n=a or g
tgttaaaagatactgaaacaaccagtagcagaaaacatttttaggcttgccaaacacaaanagagtgttttagccttatacttgactttcaagataaaacacattgtcctgttaaaaaaaa

SEQ ID NO: 20055 - DNA, 121 bp, Artificial Sequence
  Synthesized
  misc_feature (61): n=a or g
tttgctttaccttgtcttcatctgagcaaaacaatggaaaatggagatgcagcaccaagancaggttgggtgggtggtggttgatgtgatatgatcatgaaagaggtgaaaaagcagtaaa

SEQ ID NO: 20056 - DNA, 121 bp, Artificial Sequence
  Synthesized
  misc_feature (61): n=t or c
taacttcactaatatcaacagaaaaatcacgacaatggcagaataacacaataaaaactangcttgcctactttaaagttgccccagaggacatcagactgtgactctctcatgttgtgca

SEQ ID NO: 20057 - DNA, 121 bp, Artificial Sequence
  Synthesized
  misc_feature (61): n=t or g
ggctatgaaaaagactcaaagaactatgcgtgtttattggcttaaaataatgccgtgtatntatgggatattttacctgtctaatgaaacatatataattgcatacgtgtacacacagagt

SEQ ID NO: 20058 - DNA, 121 bp, Artificial Sequence
  Synthesized
  misc_feature (61): n=a or g
cttccaacagaactgctgcagaaatctgacaaaggactgaattgctaagtcagatttttanttttacacaatttaaaaatcacagcaatacttcaacaacaacaacaagcatccaactgtc

SEQ ID NO: 20059 - DNA, 121 bp, Artificial Sequence
  Synthesized
  misc_feature (61): n=t or c
aggagctcgaatccagatagaggcatcacagaaatgctaggaagagcttgaggttttgacngagtgttgaatgagagttatgaaggatgctgatatctccgagacacaaacaagacaggga

SEQ ID NO: 20060 - DNA, 121 bp, Artificial Sequence
  Synthesized
  misc_feature (61): n=a or t
tccctaccatccagctttaggtgtcattttcgtaccagtttctgagaatgaatgaaacaancatagcggaaataactccataaatgaaaggagattatgggctcaatatgacttgtacttt

SEQ ID NO: 20061 - DNA, 121 bp, Artificial Sequence
  Synthesized
  misc_feature (61): n=t or c
ggaggagagcaggcagcaggacgtgcacgaccccatagatctgcacaaggaccaatgtcanccaactgtactgctgcagggtaactgcacgtctcctgctccattctgattccagacatca

SEQ ID NO: 20062 - DNA, 121 bp, Artificial Sequence
  Synthesized
  misc_feature (61): n=a or t
taaagagatttcattttggacagaggccactattgttattaaatgtgtgccctaatgattnaataccatttttgatcgatagaaaaaaaattgcaaagtcataaatgcatcgagacatcta

SEQ ID NO: 20063 - DNA, 121 bp, Artificial Sequence
  Synthesized
  misc_feature (61): n=a or c
tcattaattacagaaaaccactctctggtttttatggtacctaatctggagcctaggaggngtaatgagatggtgtagccaggcactgtgtatggtctgactcataaaatgaagcagacga

SEQ ID NO: 20064 - DNA, 121 bp, Artificial Sequence
  Synthesized
  misc_feature (61): n=a or g
cattatactattaaaatctcaaccgagaaaaaaaaaaatggattttcatttgaagtacttngtactagcctgacagagttgagcttttaaagcacttctttctagaacaacaggagcaagc

SEQ ID NO: 20065 - DNA, 121 bp, Artificial Sequence
  Synthesized
  misc_feature (61): n=t or c
ctgttgtgatctgacatagagatgcatggagggatgggatccactagaaagacctgctganagctatccctccatcccagctcatctcctcctctcttgtgctgacctgttggcattgtgg

SEQ ID NO: 20066 - DNA, 121 bp, Artificial Sequence
  Synthesized
  misc_feature (61): n=a or c
caacccaacgttaacgtgccgagcctcgattcgagtccagataatgtttatgagcaaaganaagcgactacaatctggcaggagcataaataagggagcggagtccctgcgttagccccgc

SEQ ID NO: 20067 - DNA, 121 bp, Artificial Sequence
  Synthesized
  misc_feature (61): n=t or c
cttggcgcagggagtgccagctgtgacacaagctgatgacttgtttcagtttttcaactcncatatttaagctagcgttattaaaactaaagcagatgtaggttctgaattcttctctaca

SEQ ID NO: 20068 - DNA, 121 bp, Artificial Sequence
  Synthesized
  misc_feature (61): n=a or g
gacattttgtaattagaccaaataagaagtgaatgctaaaatatgtccataactgtacccntaagagctattcatacatagcaaaaacagatttttcctgagtgtttcaccattcagcaca

SEQ ID NO: 20069 - DNA, 121 bp, Artificial Sequence
  Synthesized
  misc_feature (61): n=c or g
tgaacttggtcctttgaattccaggctgcatgcagagttgaaggaggctcttgagatgcanctggatgctcttcctttcacgcctctgggaactgctattcctgcagatgaagaaatactg

SEQ ID NO: 20070 - DNA, 121 bp, Artificial Sequence
  Synthesized
  misc_feature (61): n=t or c
aaacaatggcacgcttcccaggaggaagagtggctaagagccaaaccttataaatgtgctntgtctgtggagtccttggtagatgctagtgtggaagtggctccagaagccaagactgctg

SEQ ID NO: 20071 - DNA, 121 bp, Artificial Sequence
  Synthesized
  misc_feature (61): n=a or g
accaaacagtgatgtttctttttgcttcccacaaaaggccaagaaagagcacaaaattagngcagagtgtcttactggaaacactgcagcaattattggcaaagctacctggaatcctctt

SEQ ID NO: 20072 - DNA, 121 bp, Artificial Sequence
  Synthesized
  misc_feature (61): n=a or g
gaattccttctgtgtgctcagaggcagattcagcaaaataccccatgcccaatgcgtaccnacttacctgagaaacgaaggtgtgccgcagcagttcgcagaaggtatcggaacgttgcga

SEQ ID NO: 20073 - DNA, 121 bp, Artificial Sequence
  Synthesized
  misc_feature (61): n=a or t
gggggatttctgcttccacttgagctactgaggcttatggcaaaagttgtggtcactgtgnagttagcctgccacttaaaagaatgcatttcaggaatgtgtgctaaacacatctaaaaaa

SEQ ID NO: 20074 - DNA, 121 bp, Artificial Sequence
  Synthesized
  misc_feature (61): n=t or c
ctacaaccaaattcgttcacaggaaccttcatgcctgaagtttgaaatattaaagaccagngattgcttctcacaatgttgagttgaattaattctaacatttattccaaaagtgtaggag

SEQ ID NO: 20075 - DNA, 121 bp, Artificial Sequence
  Synthesized
  misc_feature (61): n=a or t
ttttttttctttaagtgtaaatgcagttagaatggaaatgttggtatgactaaaatacgtncttgttcacagcatgttttccttccctatctttagagagatgcagttgaatttgcaggct

SEQ ID NO: 20076 - DNA, 121 bp, Artificial Sequence
  Synthesized
  misc_feature (61): n=a or c
gtgaaaatttgaccagacggcaggatagggtgagggtttaccaaagacttaactgtatcantgtagaagaattaatgtgctattatggaaaggacaaattacattccttaccatgaaatta

SEQ ID NO: 20077 - DNA, 121 bp, Artificial Sequence
  Synthesized
  misc_feature (61): n=t or c
aaactgaatcacaccttgcactggaatgaacttaagatattctcaaaaatgatgagcccantggaacatccatttttacactgaaaatgtaagcctgtatctcattctacaaaatggccac

SEQ ID NO: 20078 - DNA, 121 bp, Artificial Sequence
  Synthesized
  misc_feature (61): n=a or g
tattatatgaaatgaggtttatattagcttatttcttatattttatcttgtcttaacaatntcttgatcttgagaattatcctgttgtccataaggtcagagatattactgagctgttgga

SEQ ID NO: 20079 - DNA, 121 bp, Artificial Sequence
  Synthesized
  misc_feature (61): n=t or c
ttcagtaccgttcttttgcgggatggattggtgacacgatccggattcaaaacagtccaantcagaaacgaagttgcattctttcccaacccttgctgtaaataagtgaatgtttgcagag

SEQ ID NO: 20080 - DNA, 121 bp, Artificial Sequence
  Synthesized
  misc_feature (61): n=a or g
gatgggctgaatttgtgtccctgggaccgttcaggaatcacttccatcaggcgctgaaccnacaacgaagccctttgaaaaccccctcttccccacccataaatcagccccagaggccccg

SEQ ID NO: 20081 - DNA, 121 bp, Artificial Sequence
  Synthesized
  misc_feature (61): n=t or c
catacttgggtgtcatacaagaaaccatggaaaaaggaaaagacagatgatgcttgaaacngtcctttattgcatcaaaattcaagctttgatcagctgaggaagaaagaatgtatgtgtg

SEQ ID NO: 20082 - DNA, 121 bp, Artificial Sequence
  Synthesized
  misc_feature (61): n=a or g
ctaagtaaagcatgaatagcagtgctttgtaaagagaagaggtaactgtatagcataaacnttgaatacaaactgaatggtctcaatagaccagaaataaggccgctgtaaaaagcagttc

SEQ ID NO: 20083 - DNA, 121 bp, Artificial Sequence
  Synthesized
  misc_feature (61): n=t or c
caagtattgctcataatctatttttcaacagtaaacacaaatgactccgaggatatttcancaccatctctaagtactcaatgatgaatttcttatctagctgatttgaaacctttgtctc

SEQ ID NO: 20084 - DNA, 121 bp, Artificial Sequence
  Synthesized
  misc_feature (61): n=t or g
ctgttgtgttacttaagaaccaaggtctgatccagcaatggatagactgtttagacttaantgtaattttcccaccaagattagaatcatagaatggcctgggttgaaaaggaccacagtg

SEQ ID NO: 20085 - DNA, 121 bp, Artificial Sequence
  Synthesized
  misc_feature (61): n=a or g
tgaccccctcttcactcccctaccatgggacaggccacgttaccatacacctttccaatgngcaatttttttctttaggacagttctgctttgctatagatcagagtaccctaacattaag

SEQ ID NO: 20086 - DNA, 121 bp, Artificial Sequence
  Synthesized
  misc_feature (61): n=t or c
ttaaacccttctccttttcaatctcagttcttcacaaaattgatacccgtatttaaaaaanggtttaccaaatagtaaaactgccccacatttcacctgtaagcaatgactgcaaagtatt

SEQ ID NO: 20087 - DNA, 121 bp, Artificial Sequence
  Synthesized
  misc_feature (61): n=a or g
acaatgaagcactttcactgataaaaaaatgaagataagaagtcgtgggagtaggaaaaanctacggggtgggggctattatgaaaatttctttatagattcagtatttctagtattttga

SEQ ID NO: 20088 - DNA, 121 bp, Artificial Sequence
  Synthesized
  misc_feature (61): n=a or t
ttagacatgttggaagtctgaatcaagaaaggtaaacaaatgtagtttcactttttgtagntagcaagttcatagcttcatattgtaagttctagtaaatggttacaaaaatggaatctgc

SEQ ID NO: 20089 - DNA, 121 bp, Artificial Sequence
  Synthesized
  misc_feature (61): n=t or g
tggtgtaggggaaatagttaccctttcggaagatggggcacgagagtagaaatcggtctcnaatcacttgcacctggtgaagtaaacttctctgtgctctagttttctgttaggcattaca

SEQ ID NO: 20090 - DNA, 121 bp, Artificial Sequence
  Synthesized
  misc_feature (61): n=a or g
ccaatctctctaaaaccagttttagagagcagttctgggagcaggccctgtcctgaccatntgaatgtggtgctggctctaatggacgcactcagggcatctccttgggtgcatccctcag

SEQ ID NO: 20091 - DNA, 121 bp, Artificial Sequence
  Synthesized
  misc_feature (61): n=t or c
taaataagcactaattagtaaacaagacaagtgccaacttctatgtgacagatgtgttgcngtttgtccatcatcctcaccactgatttattttgtggattcaaacaaactgagcataaac

SEQ ID NO: 20092 - DNA, 121 bp, Artificial Sequence
  Synthesized
  misc_feature (61): n=t or c
ttaactggtaagtggcagcatttgcaaacctgagagttcaagcatgagaaggaaaaggcangcgagtatagaggcagaccacgacgcagctcagagcataatgcacatatctgtgtacaga

SEQ ID NO: 20093 - DNA, 121 bp, Artificial Sequence
  Synthesized
  misc_feature (61): n=a or g
ggtgttcagatatcttgttcatctttcagttctggtatgtatgcagtatgaggtagctggnatgtgttttctgaactgtaattcctttggtgggtgacagggctattgcttctttataaat

SEQ ID NO: 20094 - DNA, 121 bp, Artificial Sequence
  Synthesized
  misc_feature (61): n=t or c
tctgtctttatctatttttatgtgaatttctaaaagaacaaggttattttcagttttgaangcaattccaagctactttaagctcaaaaagcataagcatggaggcctagggagagacaaa

SEQ ID NO: 20095 - DNA, 121 bp, Artificial Sequence
  Synthesized
  misc_feature (61): n=a or g
gtgaatggttgtaattaatgtcatacatttgtaatataattgtctcctaatcagatgcaangagtaaatgtaaaaactctagtttggaaaaacgtgctgaaacagcttgagatatgaaata

SEQ ID NO: 20096 - DNA, 121 bp, Artificial Sequence
  Synthesized
  misc_feature (61): n=a or g
aagctgcaaccagagcctgcaaccaaaccaactgacagaaatattccaaaatagtgggtgnaaggagaagttgcatagtcaggctctggtttcagctgagagatggggaagttcctggtgc

SEQ ID NO: 20097 - DNA, 121 bp, Artificial Sequence
  Synthesized
  misc_feature (61): n=t or c
ccatcaagtgtatgacgcaagaaatgaaacatgtcaaaagcttgggcatggacatgtatancagaatcttccccagcttttacataatatgaattattgtagatattatttccatgcagct

SEQ ID NO: 20098 - DNA, 121 bp, Artificial Sequence
  Synthesized
  misc_feature (61): n=a or g
agagaaagaaaagtttgactttccccccaggaaatatcatcctgtaagagatgccacttcngaggaaagagaacatcaaatctttccagctgaattcatgctacttcactttcatcatagc

SEQ ID NO: 20099 - DNA, 121 bp, Artificial Sequence
  Synthesized
  misc_feature (61): n=t or c
ttagttaataatgataatgactttcatccagaaggattcaaaattagattataaagataangtggtgtctccattattaaaggctcagtctaactgatgctagtgagtatgtcattgactc

SEQ ID NO: 20100 - DNA, 121 bp, Artificial Sequence
  Synthesized
  misc_feature (61): n=a or g
tgaaaccaagagggaggaaacaagcaggttccattccttaggactgtgggttttacactgncggtgtgagcaggatccatcagaacagacgtaagaaccacacaggggggttcagggggtg

SEQ ID NO: 20101 - DNA, 121 bp, Artificial Sequence
  Synthesized
  misc_feature (61): n=t or c
tccccccaggatatgctatttaattgccaatcttatacaaagtagtacaaataagcagttncttctgtgagagccttaatactgtacaatcactgaactgttcaggaaaacttctatcttg

SEQ ID NO: 20102 - DNA, 121 bp, Artificial Sequence
  Synthesized
  misc_feature (61): n=c or g
gtggggcctaggagcacagcctgccttccagatgcatgtaagcgggactagagaagcatcntgcagaaaagggagccagagctacaaagggattggagcctgaaagtatacgaacatctct

SEQ ID NO: 20103 - DNA, 121 bp, Artificial Sequence
  Synthesized
  misc_feature (61): n=a or g
ctcacctgtgcatctcctcttgttcagaagtgactgacagagaatgacgagtgtaaaaagnaggacactgatgattcctattgagcacacaaacactgcatacacgtacagatctgaaagg

SEQ ID NO: 20104 - DNA, 121 bp, Artificial Sequence
  Synthesized
  misc_feature (61): n=a or g
atccctgagatgctcagctcctgtgctgaaaatgctgcagaaaccattctttgcaaggaangatgaacttgtaatatgtgcttacctccatgtttactgtatttcttgaagatttcatacc

SEQ ID NO: 20105 - DNA, 121 bp, Artificial Sequence
  Synthesized
  misc_feature (61): n=t or c
ccttaatccaaaatcagatcaatacttggtagatgccactggagaattagtcaagtagttngatcaactactaacattttattttgactaatgctcttttatctgacaggtaaaatttaaa

SEQ ID NO: 20106 - DNA, 121 bp, Artificial Sequence
  Synthesized
  misc_feature (61): n=t or c
cgaagtagacattaaaaatgaaaaatgcatgggtatttttacatattcaagacttctcaanggatcatcaaaaacagaaaatgttcacaaatgcgtgacctctggaaataaagtatatttt

SEQ ID NO: 20107 - DNA, 121 bp, Artificial Sequence
  Synthesized
  misc_feature (61): n=t or c
ggaagattccacagcatatatttatacagtagattaattcatccttagaatctgtgctgangctttgccagcaaagttgaaaaagggacaagagctactgtgatccaagaatgccagctgg

SEQ ID NO: 20108 - DNA, 121 bp, Artificial Sequence
  Synthesized
  misc_feature (61): n=t or c
ttccaggaagtaagcatacctactggtcattctcccacagcagaaagtatgtgcactcccngtcttcttcgttttgtggctcccagctttgaataaccacctcaggtttgcttgtggctgc

SEQ ID NO: 20109 - DNA, 121 bp, Artificial Sequence
  Synthesized
  misc_feature (61): n=t or c
tgaggcccaatttgcaagtctatcgtttgccatgcatcacaaagaaagtcccccatacacngatgacagcctaggaaaattccaccaatcctctctgaagggacaacaggaatgacgtctt

SEQ ID NO: 20110 - DNA, 121 bp, Artificial Sequence
  Synthesized
  misc_feature (61): n=t or c
ccagtttgctatctatcatctgtgtgtgatgaaggctcttatttctgattagatacttttngttcatattccagacctctgaccttcatttctgtcccctctgtgtcacttctccctaagc

SEQ ID NO: 20111 - DNA, 121 bp, Artificial Sequence
  Synthesized
  misc_feature (61): n=a or t
gttaatagaaagcaaaaggttctccaagttgaagtgtcaagttacattatttaagcattgncaggtacttgatttaattcagtttctcttaagccactcagacactggttggttgtttttt

SEQ ID NO: 20112 - DNA, 121 bp, Artificial Sequence
  Synthesized
  misc_feature (61): n=t or c
ttttttgcgtgtgtatttgcagaatatttactaaaagctatttctgttgttcagatgacanctgtattgttggatttagtttccacttcacatttgtttgctgtggaagtatgcaggtgtt

SEQ ID NO: 20113 - DNA, 121 bp, Artificial Sequence
  Synthesized
  misc_feature (61): n=t or c
ctcttaataaactgtttttagaactcgtttctcacttttagtatttcacctcattctctanggtgctgctatttgagcagaccaagagctgctcgaagtcacaaaccctccctcagaaatg

SEQ ID NO: 20114 - DNA, 121 bp, Artificial Sequence
  Synthesized
  misc_feature (61): n=a or g
atgaattgctcctgttttcttcctacagctatcagagctgcataagatgcaggagaccagngaggttgtatctctttcattacttactgtattgaactcagctatagtttcatttgccatt

SEQ ID NO: 20115 - DNA, 121 bp, Artificial Sequence
  Synthesized
  misc_feature (61): n=a or g
caagatagaagggcaattgataataaagatcagattttgcagttcagggcatttttgaatngaatctttttggttgagccaatgaaaacttaataaaagaaccagaaagaggtattaacag

SEQ ID NO: 20116 - DNA, 121 bp, Artificial Sequence
  Synthesized
  misc_feature (61): n=t or c
gcaagcgaccgaagtttcttcaatcaccaatttcccattatgagtaaagcagcaatgaaantgaaagaaaagctcctcataaacctacacaaaagctctgctgagctcccagaactctgcc

SEQ ID NO: 20117 - DNA, 121 bp, Artificial Sequence
  Synthesized
  misc_feature (61): n=c or g
tgcactttgcatgcatgaagaaagcagagtaaggcattataatctattttaattattgcantttctaattctggggtgcctgaaatattgcgttctttatcgcaaagattttattgtgctg

SEQ ID NO: 20118 - DNA, 121 bp, Artificial Sequence
  Synthesized
  misc_feature (61): n=t or c
ttattgtttgatgtttttcgtagtgctttcagtacagtctttacttctgttttatactgcnaacttctgacatcaaaatacgcatagaagtgcaagtggcaccaactgaaaggaaaatgga

SEQ ID NO: 20119 - DNA, 121 bp, Artificial Sequence
  Synthesized
  misc_feature (61): n=a or g
gatcacaagccctaacatggtcatcgttgttttcagtgttggcagatgaggtacctgtctnggtgcaagacatctcctagtgcacaggtccacaagatctcagatgggttaaatgttaaat

SEQ ID NO: 20120 - DNA, 121 bp, Artificial Sequence
  Synthesized
  misc_feature (61): n=c or g
agaagcacactggaacctggctgtccacccctagagttgtccaatctttatcacatctgtnagacctgcagctttgacagttctcattaaagcagagtcacttgggagggtactaggttat

SEQ ID NO: 20121 - DNA, 121 bp, Artificial Sequence
  Synthesized
  misc_feature (61): n=a or g
gagcagcctgacagatgctgaatataatatttaaagtgaacttagacactgacttaaaagncaactaagttatcacgattacaatcaatgagacttctgctactacaagttcgttgagaag

SEQ ID NO: 20122 - DNA, 121 bp, Artificial Sequence
  Synthesized
  misc_feature (61): n=c or g
aatcttttattagcaaaatatcacaaggattcgattcgatttccataatggtattaattgntactgagtcagagtaaatgatgtgattaaataatttctcttaaagacctttactggtgtc

SEQ ID NO: 20123 - DNA, 121 bp, Artificial Sequence
  Synthesized
  misc_feature (61): n=a or c
aatacatgataatacgaatgtgggttgaagacactgcgagatcgtttggcgcaaaggaagncaaaatatcccccgtggcacagagcaaattttaacgaccaccccaaaacgtggtgtagaa

SEQ ID NO: 20124 - DNA, 121 bp, Artificial Sequence
  Synthesized
  misc_feature (61): n=t or c
ctacttactcactagctgaagtgtctttccacagtatacaggcttttaggagccacatccntactgatacctaaagctccttcttcactgccaaagaaagcttactatctgcccatgagtt

SEQ ID NO: 20125 - DNA, 121 bp, Artificial Sequence
  Synthesized
  misc_feature (61): n=a or g
cgtattttgctaagttaaagtaatctcttgaaatacctctttctcttaaatagtttcaacnaacctagctttgcggattatgaatgacattaccttgagaaaagaaaaaaatatggagaaa

SEQ ID NO: 20126 - DNA, 121 bp, Artificial Sequence
  Synthesized
  misc_feature (61): n=a or g
gtttagcatacaaaacatctcagttttggtctaagattatggacaggaagagtgggaaatntcctagacctgaagagcaaaacagggttagccttgcctacctggtaggcctgtttacttt

SEQ ID NO: 20127 - DNA, 121 bp, Artificial Sequence
  Synthesized
  misc_feature (61): n=a or g
aagggcaaaagtgtccaactttataagaagccaatgagattactgggaagctaaaggctancaactagccttactttggttcttaggaaatcatggagcaagtttcaggtatatgtttggg

SEQ ID NO: 20128 - DNA, 121 bp, Artificial Sequence
  Synthesized
  misc_feature (61): n=c or g
cagcccaaaagaggtgcatggacctatgtctgaattcagatatacttgtagcatgggacanggatgtgcagattgttgttaatttggtatacatgatgatccattatctgaaaatattaaa

SEQ ID NO: 20129 - DNA, 121 bp, Artificial Sequence
  Synthesized
  misc_feature (61): n=t or c
gaaaaatgttcaatgtcaggttgaagagatctgaaattcttgatgcttgtctagctctagngtcagctggcacaaatttggcatgtgaattgcgtttaccctaggacaggcaagataaaca

SEQ ID NO: 20130 - DNA, 121 bp, Artificial Sequence
  Synthesized
  misc_feature (61): n=a or g
ccccgaacactcaaaacattacaattagactaatacatctttttgttttgcacaaaaaacntaatttccctagtttcccatgctgtgcatacatcatacatagactgagctattcagtttt

SEQ ID NO: 20131 - DNA, 121 bp, Artificial Sequence
  Synthesized
  misc_feature (61): n=t or c
atgtatcaatggtcatattaacctgttcctcgcatatggcaatagcaagagacaaagcctngtcttgcgaagaaatctttcagttgttatcagagctttcagttatgcatctgaaatgata

SEQ ID NO: 20132 - DNA, 121 bp, Artificial Sequence
  Synthesized
  misc_feature (61): n=a or c
attcctgttttatttaaggtgcagatgaaaactactctgctgtaataagatttcccttctnaacagtgtgtatgcgcttgtttatgtcagttacccccaggtatctgattttgaaagcgac

SEQ ID NO: 20133 - DNA, 121 bp, Artificial Sequence
  Synthesized
  misc_feature (61): n=a or g
gatgattgttaaaggtctggcagccacatgctggctgtctttggaaggctgaagtgtggangagcttacaggagccagcatcctgcaaaaggtgctccccatttctagccaaggcccaaag

SEQ ID NO: 20134 - DNA, 121 bp, Artificial Sequence
  Synthesized
  misc_feature (61): n=a or g
ttcttttagtaggaaattaattttattctgtttgaatacttttaaaaaggcttctttaaanccagtttgcaaaaaattctttcgggatgactagtagtgcttaaaaaaaggggtgcacgta

SEQ ID NO: 20135 - DNA, 121 bp, Artificial Sequence
  Synthesized
  misc_feature (61): n=a or g
gaggtctgagttgtctctgccttgggcacttcctgccagaaatcagtttcttctaatctcnatttatcttgcctacagctgcaatgccctgaggactctgctctggattcctctctttggc

SEQ ID NO: 20136 - DNA, 121 bp, Artificial Sequence
  Synthesized
  misc_feature (61): n=t or c
caggaggtaccatttccatagctacagcagaggcatcaacagtgagaggtgatggagaggntttcaccctgtcattaacactcaccacagtaacctcgcctgcaagcacagccctactatg

SEQ ID NO: 20137 - DNA, 121 bp, Artificial Sequence
  Synthesized
  misc_feature (61): n=c or g
tttttcgttatatggtttcacctcgtttcactagtgactaaagatgacctaatgatggacntcccctcgctaaggggcttatctgttctgtttgtgagagtcctaagggctgtcctggaaa

SEQ ID NO: 20138 - DNA, 121 bp, Artificial Sequence
  Synthesized
  misc_feature (61): n=c or g
gtcaggggcacagcaacagaaaaacccaattctttccactgaggaggagaattgtttccancaccaggagaaaacaaagcagaccaagagggattattttccccaaacaaaatgctgtttg

SEQ ID NO: 20139 - DNA, 121 bp, Artificial Sequence
  Synthesized
  misc_feature (61): n=t or c
aaaccaaggtctctctggaatcatgtacctacctacagagattcactgattttattctgantaagtttttttaatgtataattcgtttttcactctattttgcaacacaaattttgaaaaa

SEQ ID NO: 20140 - DNA, 121 bp, Artificial Sequence
  Synthesized
  misc_feature (61): n=a or g
aatctcactctttccattattttattacgtttgattttttgaacatttgaaattgttttcnttagtcctcaaagcaacatcagaataataaatacccagaagctgctgcatagtatatggt

SEQ ID NO: 20141 - DNA, 121 bp, Artificial Sequence
  Synthesized
  misc_feature (61): n=a or g
caaggattctaacacagtgcacagctgaattatttttgtacaggtgatagtaattctgacntcttctaatttttcaggatctgaactttgcaagcctagcattcctttggtgcagacttat

SEQ ID NO: 20142 - DNA, 121 bp, Artificial Sequence
  Synthesized
  misc_feature (61): n=a or g
ttgaaggcccttagccctcaactcctgggtcctacatctaccaagaccaaggatcaccacnctcctggctatttctagatgctaaattacaagatgaagctttgctgctgtttttccacct

SEQ ID NO: 20143 - DNA, 121 bp, Artificial Sequence
  Synthesized
  misc_feature (61): n=a or g
gggaaaggtagagaaacaaaatgaacatcttaaatgcaatgcgtatatataaaacgtgganggctgtgtgtgagagaaacacttcctttgactgcgagggtgatctgcctgtgcagtgaag

SEQ ID NO: 20144 - DNA, 121 bp, Artificial Sequence
  Synthesized
  misc_feature (61): n=a or g
ccatggagctgagccaaggctccatctttgacaggcacagaacacatatatcattccaagngcaggcaaagtctacagcccagatcatgagcacgcagattttttgttctcttactgattc

SEQ ID NO: 20145 - DNA, 121 bp, Artificial Sequence
  Synthesized
  misc_feature (61): n=a or g
tcctcaataaaacaagcagtaaaatggctatctcatgaagtttaaaagtcatcaagtgatnaattcagagaatgtggtaaaaactactttaatatcagtaactttcagccactgaaacact

SEQ ID NO: 20146 - DNA, 121 bp, Artificial Sequence
  Synthesized
  misc_feature (61): n=a or g
aaaatattaacaaataaattgaagtggaagctgaaaagctccagaaagagactaaagaaangctacttaatttaagtgtggagatatcatttctcatactacgctattgacagaggtccag

SEQ ID NO: 20147 - DNA, 121 bp, Artificial Sequence
  Synthesized
  misc_feature (61): n=t or c
tgctgcttcccaccagaaagacttagacatctggtagcagtggacacttcccagccatagngcatgccatacagctcatagagattgagacaggtccctccagtgggtagggaactgagga

SEQ ID NO: 20148 - DNA, 121 bp, Artificial Sequence
  Synthesized
  misc_feature (61): n=a or g
ctatatttaggaggagcataaaactgacgaaaaatcagcctgaaataagatttgatccagnctggtgcctggaaggtgtttggtacttggaaattctgactcttctcctggctgcaatgtg

SEQ ID NO: 20149 - DNA, 121 bp, Artificial Sequence
  Synthesized
  misc_feature (61): n=c or g
acagaaagcaaccaaataacacaagcattcttattacccacaaaatctacttgaatcagtnaaggtaatcagaatgtaactctgtacatccaaacgcagaaacatgaacagacgtttcagt

SEQ ID NO: 20150 - DNA, 121 bp, Artificial Sequence
  Synthesized
  misc_feature (61): n=a or c
aggaacaatctggaaattgctccattttttatagctctcctaaaacattgagacaaacacngatctaagtgtatcttggattacctacataagcagggctggcaaccgtggcttgaagacc

SEQ ID NO: 20151 - DNA, 121 bp, Artificial Sequence
  Synthesized
  misc_feature (61): n=a or t
agatgtctgcacttcataccacctggaggtacagagagatttaacctgtttaaatgagctnaagcatatattgttgacagtattacagtaacagcagtgttgtttcttggaaaggataaat

SEQ ID NO: 20152 - DNA, 121 bp, Artificial Sequence
  Synthesized
  misc_feature (61): n=t or c
tttgatagtgatcaacctcctaatttctcagaatgtaatacatgcttagtacttaggaagnatgaatgtaatggactactttgctgactgaggaaacttcagctatttttccaatcagagt

SEQ ID NO: 20153 - DNA, 121 bp, Artificial Sequence
  Synthesized
  misc_feature (61): n=t or c
tctgctgtatgttccgatgggctgctgatcataggctgtctttagtctagcatggtaaccnatttttgatcaaaatacactctcagtgtatccctgttgttcagtgagcctttactttgag

SEQ ID NO: 20154 - DNA, 121 bp, Artificial Sequence
  Synthesized
  misc_feature (61): n=a or g
attaatatggaataaaaaaataagctgtgttttaccataccgtgtatgcttactggggaanttgaagtactgtatggtctgtaatcatgtatttgaaaaaaaaataaaaaatagtttgatt

SEQ ID NO: 20155 - DNA, 121 bp, Artificial Sequence
  Synthesized
  misc_feature (61): n=a or g
ttcttatcactgatcaacataccaaaagtttcaccatgttgcgtttttggactggggtacnaacattcccccatactttctagaggatccttgctataaactctgagtgaacttaattaac

SEQ ID NO: 20156 - DNA, 121 bp, Artificial Sequence
  Synthesized
  misc_feature (61): n=a or c
gtggataatgatgctagtgtttctaatgatactcactgcagctaacgtaatgctccagagnggttgtgctgtgaagaaaagaagggtactgtccacacatagctacttcctgttcacatgg

SEQ ID NO: 20157 - DNA, 121 bp, Artificial Sequence
  Synthesized
  misc_feature (61): n=c or g
caccagctaaaaggtcagagttcttaaactttcagtgactactagagtactgaagttctgnaaaccacataatttttgctttcttctgtttaaaaaaaaaaaaaaaaagtaaatgaaggac

SEQ ID NO: 20158 - DNA, 121 bp, Artificial Sequence
  Synthesized
  misc_feature (61): n=t or c
cctctgactcgcagttcagaaggaagaaacagtcgtgctgattgaagttgaacatttgtgnctgagattacaaacaaagccatgccagtgctttcagaagactcaggtaacgaatctgcat

SEQ ID NO: 20159 - DNA, 121 bp, Artificial Sequence
  Synthesized
  misc_feature (61): n=t or g
attttctttgacatgaatggagttatgacttcatgctttagaagacgttctgggatcgttntacacagagtcctctgatggagatgcagagatttcttccagggttttcctactccatctc

SEQ ID NO: 20160 - DNA, 121 bp, Artificial Sequence
  Synthesized
  misc_feature (61): n=a or g
aattctgttaccttacacctttgtgtacatttgtgctcaaggcagttttatactgtctccntagaagtaatggtaatattgttttaggagttatccacaggtaagtatggagaaaaggaga

SEQ ID NO: 20161 - DNA, 121 bp, Artificial Sequence
  Synthesized
  misc_feature (61): n=a or g
ggagcaaggcaggtggagaatctgagtctccctctcactggtgagtgctcaagttattganctttgggataaagagcccttctttcttccaatgacatttaaaaggagacaatgtcactaa

SEQ ID NO: 20162 - DNA, 121 bp, Artificial Sequence
  Synthesized
  misc_feature (61): n=a or c
agttaatgcattggcactcttcctccttctcctcttggatcttttcatggttggacgtcangagaggctgaagtgcaaagaggtggaaaggagacttcaaatgatcattgataagataaat

SEQ ID NO: 20163 - DNA, 121 bp, Artificial Sequence
  Synthesized
  misc_feature (61): n=a or c
tgcttagcattcctcctaaactgactgttttaatatagacacattttcctgactttacccnccctaactttaaatgtgaggctgttttcccaggatagaaaaaacaaaatgtaattaacgt

SEQ ID NO: 20164 - DNA, 121 bp, Artificial Sequence
  Synthesized
  misc_feature (61): n=a or t
tgtggagtcagctatgaccagtttcagggaaatgtgatcctttgtgtttgaggtacctgcnagaaagaacttctgccatggccatatttaatgctccagatggcatagtttctcatgaaac

SEQ ID NO: 20165 - DNA, 121 bp, Artificial Sequence
  Synthesized
  misc_feature (61): n=t or c
atatttttttggtcttcaaatataaattatataagacacacatggaatcatttagcaaaangtaagcagtagaactataagagtaacaaaaccaaagcatacttttccaaatgtgttgaac

SEQ ID NO: 20166 - DNA, 121 bp, Artificial Sequence
  Synthesized
  misc_feature (61): n=t or c
cgggcacaaacattatcagaaatatttaactcaaattagaatttctgtgatattttgggangtcattttcagtttttgggctgtgcattgcacagtaccataaaagacgtatgaacaaact

SEQ ID NO: 20167 - DNA, 121 bp, Artificial Sequence
  Synthesized
  misc_feature (61): n=t or c
aaaccctgtggggtataggcaggttcactgctgagcatggcttgtccccagctcttgaagntcgttccatctcttcgagttactacagcacaccatcaaattctgtactgcataaggacac

SEQ ID NO: 20168 - DNA, 121 bp, Artificial Sequence
  Synthesized
  misc_feature (61): n=t or c
aatactggttggtgtggtttgtactgtttcaggtggattgatgtatcaaatctgtctgtantcatttggtatctctgggagattcatgtattttatgtgaagtgttgagatggcaaattgt

SEQ ID NO: 20169 - DNA, 121 bp, Artificial Sequence
  Synthesized
  misc_feature (61): n=t or c
ggtactttgtagtgaagccaaatgcttgcgtgtagcatgtaagtaaagcaggaaagatganttagagagaaaatagagagacaggagtgaaggattcagatgtttaatcctcacatagcca

SEQ ID NO: 20170 - DNA, 121 bp, Artificial Sequence
  Synthesized
  misc_feature (61): n=t or c
ttggggacatggtacttttggcaagccaatctactcctcgctgcagggaatagaaagcccncgattatcaccccgcttggcctccagcattgcagcatttttcacttgttacattctcact

SEQ ID NO: 20171 - DNA, 121 bp, Artificial Sequence
  Synthesized
  misc_feature (61): n=t or c
cttggacacctgagcacactgctggctcatattcagtctagcatccgcagcaataaatatnttctattactcagaccaagctgcatacattattctcacctcaattaccatgttcagcttt

SEQ ID NO: 20172 - DNA, 121 bp, Artificial Sequence
  Synthesized
  misc_feature (61): n=t or c
ctgcaagaacagacattaagcacatttttcactctctcctctgtgaagtgtaatagagagnctgagatcaatatttccagtgaccactagattccctcagtcccagcagggtcctagtcta

SEQ ID NO: 20173 - DNA, 121 bp, Artificial Sequence
  Synthesized
  misc_feature (61): n=t or c
attcttgtgatgtttctagctttatcttgttacacacaaaaccgtatagatacggagcccnaaagctgcccttgtgcctctgctgagttcagttgcctactctgtcaggtgctaccactga

SEQ ID NO: 20174 - DNA, 121 bp, Artificial Sequence
  Synthesized
  misc_feature (61): n=c or g
gacataaaaagatgatttcattgctatacatggtagcaggagaaatacctgtgtttggttncctagaaaagcacttaaacctgcataaaacattgtttgaagtggcacatcgcttaagcag

SEQ ID NO: 20175 - DNA, 121 bp, Artificial Sequence
  Synthesized
  misc_feature (61): n=a or g
atcctgccagaagtgctccttgttgtctgaggctatggcactggctaacttagcaggtgcnttcaccatatgccagagccctgcaactgatcacagacatatgtgcagaaattagcaataa

SEQ ID NO: 20176 - DNA, 121 bp, Artificial Sequence
  Synthesized
  misc_feature (61): n=a or g
cttcaaaacaaatacatatctcaaattttcagataattcttcaagattatgaaacaaatcnggtatccatccccagcacactgccactgttctttaaatctcttcctcctagcctcagata

SEQ ID NO: 20177 - DNA, 121 bp, Artificial Sequence
  Synthesized
  misc_feature (61): n=a or g
agctagtttagaaaaaaaaaaaaaaatccaggtcttacagtgtggtttgtaaatggttgtntgcatgtgtgagctatcccagcccaactgctgaggagtttaaagcagaggaagcatgagt

SEQ ID NO: 20178 - DNA, 121 bp, Artificial Sequence
  Synthesized
  misc_feature (61): n=a or g
cacggctctcccaggctctcagacatcgttttttgtgaatcactctcagagggatgcattntgaaatacagctttgttgtcatgcagggcaagcaggaggtcctggctgagggaaggtgtg

SEQ ID NO: 20179 - DNA, 121 bp, Artificial Sequence
  Synthesized
  misc_feature (61): n=t or g
cagatataacaacaacttatctcaatgtagtatggaagctttgtgcttaatccactatctnttggttcaggacagaaatctgaactaagatgagcttttgtctggtgatctgggagacact

SEQ ID NO: 20180 - DNA, 121 bp, Artificial Sequence
  Synthesized
  misc_feature (61): n=t or c
gaagggcagccctctgggccatacaaaccagttaaaatgtttgctcttgcctctctggtangaatttaggagaaaggccaggatggcactgaagtgtataaaaaaatgcaacatgtggtca

SEQ ID NO: 20181 - DNA, 121 bp, Artificial Sequence
  Synthesized
  misc_feature (61): n=t or c
ttgtcccagataacagtatagctttgtcagtagtgcctactgggaacagtccctggcctgngcccagacattgtctaggaaagatagtttccactggggagcattcttactaatgagcatc

SEQ ID NO: 20182 - DNA, 121 bp, Artificial Sequence
  Synthesized
  misc_feature (61): n=t or g
atatgaagtttaggcacctgttctcctttccccttactgctctaggccatctactaactanccagctgtgaagtttgggtccagacaaacaccccaacttctctgaagattttggctgttt

SEQ ID NO: 20183 - DNA, 121 bp, Artificial Sequence
  Synthesized
  misc_feature (61): n=t or c
aacttcttttgtaaaacctgagattatatttgcagtactttggttttcagtctaaaattangctctttaatcagtaagcagtttcgtgatttacttatacctcaagtatggcagtttttgt

SEQ ID NO: 20184 - DNA, 121 bp, Artificial Sequence
  Synthesized
  misc_feature (61): n=t or c
gccacaacttaccgggcacccactctgataggcacattttaacaaacctcaggaaaatcanggtgcagaaatctctctctaaagaatcatagctaggattaactccgggaaaaaaatttaa

SEQ ID NO: 20185 - DNA, 121 bp, Artificial Sequence
  Synthesized
  misc_feature (61): n=t or c
tgaaatctttgacactggcactgacacagattggatttgttgtgggatgctgagaagtagnttatagcttgagatgctctgcaatgttccctgttgaactagaagtctcttgcagggcttc

SEQ ID NO: 20186 - DNA, 121 bp, Artificial Sequence
  Synthesized
  misc_feature (61): n=c or g
ttttacagtgagctgtggggaagtctgcatatcaagcaaagaaccatcattctcaagtcantaactgcttgccagacacagcatgggagaagctcacacctgagtgaatccctaggttttt

SEQ ID NO: 20187 - DNA, 121 bp, Artificial Sequence
  Synthesized
  misc_feature (61): n=t or c
tgcaatttatttttacatgacagtaggattacctgggcagcatatttaccttgaattttangctgcacgttgctataaattattattctattatgttcacagtttaaaattttagttataa

SEQ ID NO: 20188 - DNA, 121 bp, Artificial Sequence
  Synthesized
  misc_feature (61): n=c or g
tgatgtgtataaagctgttcaattaaatctttgagggattggagcatagacttttgaactntattgcctctcattaaaatcagtggcagtctcaacaaatgcaaaagttcaggatagaaaa

SEQ ID NO: 20189 - DNA, 121 bp, Artificial Sequence
  Synthesized
  misc_feature (61): n=a or g
cctcagcacagccgtggcgggacacagccctactgtccttttatataccttctctgctagncagtgggatccagcatcccttagtcagcagctgctagggatgtaaagccctctcaaaacc

SEQ ID NO: 20190 - DNA, 121 bp, Artificial Sequence
  Synthesized
  misc_feature (61): n=a or t
ttgcatcctctggtgtcttggcaaggtgggaatgaggtttcccacaggtgtcagtgtcagntgtacttgagaggcactggaaaaagcacagaaacagagaggatggggtcctggggcaagt

SEQ ID NO: 20191 - DNA, 121 bp, Artificial Sequence
  Synthesized
  misc_feature (61): n=t or c
aataaaaagaacattttgttacagcttgtggcatccttttataactcttaagcacacacanacacaaaaaaacctgcctttgtgcagtgcaaaacttttgatttttttccagagtctgatt

SEQ ID NO: 20192 - DNA, 121 bp, Artificial Sequence
  Synthesized
  misc_feature (61): n=a or g
tcctgatacttgaggtggtctgatcaagttgctctagaggtgtgtactgtatttacttggngttctaaggaagcaaaccagcttctgttatcaaagaaaaagaggaagcagtgagccacaa

SEQ ID NO: 20193 - DNA, 121 bp, Artificial Sequence
  Synthesized
  misc_feature (61): n=t or c
tggtatctttccactgcctgcaaactgtttctgagaatactctggtcatctattcagatangtaagacccacagctagaagtatttagtgaccttaacatgttgtcatgctaagcactgca

SEQ ID NO: 20194 - DNA, 121 bp, Artificial Sequence
  Synthesized
  misc_feature (61): n=t or c
cattaatcttttaacctctgcagtggtaacccagcttagagaattaaactgaaaggttggnttatccttgcatgtgtgatggaaggttgtgggaagtaacagtggagaatacatggtggct

SEQ ID NO: 20195 - DNA, 121 bp, Artificial Sequence
  Synthesized
  misc_feature (61): n=t or c
ctgaactgtatttaaagaccactcaaacaccgcccactgtaagctttcctttctgttgctnccagacctgcagatacaaaggaaacattcaggtcactggtgtaacactgaagcaaattaa

SEQ ID NO: 20196 - DNA, 121 bp, Artificial Sequence
  Synthesized
  misc_feature (61): n=a or g
tgctgtcctcacacaactaacttaacagtatgactttcaaagacagaggttgacaaagtanttcaacaattgttatttttaagtattttctttgtaagccataaagagtccattttcaagc

SEQ ID NO: 20197 - DNA, 121 bp, Artificial Sequence
  Synthesized
  misc_feature (61): n=a or g
gcagagaggtgggtgattctgttgggttttgcgcagcggcagatgggtctctgaccttgcngctctcattcctggtggagaacctccaaagatgggcctggaactgcgtctgtctgatcct

SEQ ID NO: 20198 - DNA, 121 bp, Artificial Sequence
  Synthesized
  misc_feature (61): n=t or g
gatgagtggattctgaaaacaataaaacagtgatagaatgctgccagttagcaggttttancttggcaagaaacttgttctcatctgccttaatgagcttgaatgtaaaataagcaaaagc

SEQ ID NO: 20199 - DNA, 121 bp, Artificial Sequence
  Synthesized
  misc_feature (61): n=c or g
gatgtttgcttgcgtcagtgtttatattcagaggctataataaggtaacttttttgtcagncgtgacagggtagtgcttttcctcatctgagaagtcctgtgtgaatattgctggctgagc

SEQ ID NO: 20200 - DNA, 121 bp, Artificial Sequence
  Synthesized
  misc_feature (61): n=t or c
acctagatatatctgttggtactaattcttgctgccgttagacgggcttagagttgtttanacagacttggccaaaccctcagtagctgtaagtcagaatagctctaattaattcaatgaa

SEQ ID NO: 20201 - DNA, 121 bp, Artificial Sequence
  Synthesized
  misc_feature (61): n=t or c
tgttgatttctgacaggataaaagccagcactctcagacctcagcggactcctacatttgngtggtagggagagaggctattgcagaagtgcttgtatgctccttaaggaagtagcaaagt

SEQ ID NO: 20202 - DNA, 121 bp, Artificial Sequence
  Synthesized
  misc_feature (61): n=t or c
atttttataattgtattgaaataggctgtaaacatgaagtaggagagtagaattcatcagnttctgttggatccactgagctggcaggaagcacatgcagagaagtaatttagtgtatgtt

SEQ ID NO: 20203 - DNA, 121 bp, Artificial Sequence
  Synthesized
  misc_feature (61): n=t or c
ctgaaacagaagggaaaacttccatgaatttgtgaagagctctgattagagcttttatccngagaatctgccaagcaagggtccttctaccagctccaagtttgctattcatgaaaatact

SEQ ID NO: 20204 - DNA, 121 bp, Artificial Sequence
  Synthesized
  misc_feature (61): n=t or c
caccagatgacatttaaaggcctcttcctaccccacacaagttgctgttcagctcttgaanctttaactggaaggagcagcctcatcacagggcactcctggatgctccattcatgtcctg

SEQ ID NO: 20205 - DNA, 121 bp, Artificial Sequence
  Synthesized
  misc_feature (61): n=t or c
gaaaagatttttccttgatattttgcaccagttgcagtgagaactgcaggttttgtagaanaattcaaccctgtaaataataaggaatgttacatccatgcaagagaacttgagctatctg

SEQ ID NO: 20206 - DNA, 121 bp, Artificial Sequence
  Synthesized
  misc_feature (61): n=t or c
attctaaaattcttgctttatctttgctccttagacaagcaaatcctgctcccaaggggtntggaaaaaggcatagctctgcagtattttgcttcagcgtcaaagtgaatcagatcttgga

SEQ ID NO: 20207 - DNA, 121 bp, Artificial Sequence
  Synthesized
  misc_feature (61): n=t or c
aagttagtttgtatgaatttaaaaaatgtaatactacatatgaatacctatgttaatagcntcagtctcatacaggtcccttcattttcaccaagagcacaggtgcatactcactgccagt

SEQ ID NO: 20208 - DNA, 121 bp, Artificial Sequence
  Synthesized
  misc_feature (61): n=a or t
aatgttgagtgagtccattttatatccttgattcttttcactgactttgaaaatatatacngattataacaagtctgacattcaggtgtgacagtgtggtctggttttgttgttttaagac

SEQ ID NO: 20209 - DNA, 121 bp, Artificial Sequence
  Synthesized
  misc_feature (61): n=a or g
cagccacatcaggcagttccttcaggacccagggaagcatattttctgacccataaacttntacacatgcggtctcaagaggccttctctctttgctctcctcttatagtggaaaggattt

SEQ ID NO: 20210 - DNA, 121 bp, Artificial Sequence
  Synthesized
  misc_feature (61): n=t or c
tcctcttcttctatatctgtcagctgtgtgtttattactaacagcatgccctgtatgtganagtgggtccaagtttgtcaagccttttcccatcagtcttacattctgccttactgcttag

SEQ ID NO: 20211 - DNA, 121 bp, Artificial Sequence
  Synthesized
  misc_feature (61): n=c or g
aagttttgtgattccaggatttctcacaacctacatatgcaacagtagaaaagcatccatntctggcaagcccatcttccaaagtaatcagaatagacagttttatatacaagttggacat

SEQ ID NO: 20212 - DNA, 121 bp, Artificial Sequence
  Synthesized
  misc_feature (61): n=a or g
gaacactgagcagactgtcatccctggggtgttcgcaagtgtgtgctttgccaccaagccntcccaggcagaccctgtgtgcagaactgtgaagttgctctgtatgcatcttgaaatatcg

SEQ ID NO: 20213 - DNA, 121 bp, Artificial Sequence
  Synthesized
  misc_feature (61): n=a or c
aaaaaagagagagagagaaaaagaagttctatcaccagagcaacaagcacacctacacagntctctcaaatactcttggtgttataagcttcgcttcgaataagtgtgaataaatcagcag

SEQ ID NO: 20214 - DNA, 121 bp, Artificial Sequence
  Synthesized
  misc_feature (61): n=a or c
attcataagcactaagaaggaacagctgcctctcacatacagcctgtgatggggctgaagnagagccaatgtgttatcctttactccagcacaactgcaacctggtatttcattctgttcc

SEQ ID NO: 20215 - DNA, 121 bp, Artificial Sequence
  Synthesized
  misc_feature (61): n=t or c
gacactgtgcccaggcaggaatgccagctggaccttgggctgtctttatgggtatcttccngctggggtattctatgcctccgtgattctacttcatgggttttcctgctgataaacccca

SEQ ID NO: 20216 - DNA, 121 bp, Artificial Sequence
  Synthesized
  misc_feature (61): n=t or c
ttaagaagtttcttccgattgaagttgagtggcatttttgctgtcacaagttcagacatanggaagaatttttgccccacataattatatttacacatttatcaaaatattacatgtagtt

SEQ ID NO: 20217 - DNA, 121 bp, Artificial Sequence
  Synthesized
  misc_feature (61): n=t or c
tctgctgcctctctttgctgctttcagcccactgattttctcgtttcacctcgtttctagngattatggcccttctgaaaggctttgtcgtgctggcacagtaatagctctccctaaaagc

SEQ ID NO: 20218 - DNA, 121 bp, Artificial Sequence
  Synthesized
  misc_feature (61): n=a or g
atagcactctgtggtggactaatctgaaacacagcaacacaatggagcaatctccaaaccntcgtctaagcatacaacatgcaaaggggcacatttcttgcccagtcaggagactcctagg

SEQ ID NO: 20219 - DNA, 121 bp, Artificial Sequence
  Synthesized
  misc_feature (61): n=a or g
tttgaaatcaattttggtttggatttgtgaatatgtgctttgaactgaaatttactgtcanattaccaacttgaaataaaatggatctataatcagaatagcccaggctatcagctgcagt

SEQ ID NO: 20220 - DNA, 121 bp, Artificial Sequence
  Synthesized
  misc_feature (61): n=t or c
atatatttgactcagagtttcctgatgaagttgcatctaacaggaaggccagaaagatttnttacacatttagaagtttcaaataatatatgttttttcagtctttaattgtctgagtcct

SEQ ID NO: 20221 - DNA, 121 bp, Artificial Sequence
  Synthesized
  misc_feature (61): n=t or c
ttgcaggggtatctggtgcagaggggctacactttcttcagacaaatgatggatttgtacngcactgcactggagaaaaaaactaactgcattagcggagagaatatgtatttggtctgtg

SEQ ID NO: 20222 - DNA, 121 bp, Artificial Sequence
  Synthesized
  misc_feature (61): n=c or g
gtgctcacaatgtaaagctgtagaaaagaagaattctggggacgcccttcttaggacatanaactttactggatgatggggctgcaagtgaataaacttgaacttgtggactcaatactct

SEQ ID NO: 20223 - DNA, 121 bp, Artificial Sequence
  Synthesized
  misc_feature (61): n=t or c
ccacgtcacaagcaagttctgctaaagggaagcaggcagtgtggcatctctccccggatanatttcctctccctgccacaacagcagcaccagaaacctgagaaataaaccccgcagagtg

SEQ ID NO: 20224 - DNA, 121 bp, Artificial Sequence
  Synthesized
  misc_feature (61): n=a or c
ttattggaggaataaataaggatcacaagagctctgttgcaggaaagagttctgacagatngcagaggagaaggaaggcagcaggtcaagcaccacagggaagaaggaaagatattgtact

SEQ ID NO: 20225 - DNA, 121 bp, Artificial Sequence
  Synthesized
  misc_feature (61): n=a or g
gaaacagatgtaccctgaaaaccaaaggtgacagaggacctctgggatgcccaattgcacnagcttgcacgttaatcccaactttgttcagagatgccaaggcacacagatttgatgcctt

SEQ ID NO: 20226 - DNA, 121 bp, Artificial Sequence
  Synthesized
  misc_feature (61): n=a or g
tctacgaaggacatcccaaaactgactccccacaaatggcgcaccgataaaggacaccccncaaaggacaccccacaaaggacaccccataaaggacaccccagaagtgacaccccacgga

SEQ ID NO: 20227 - DNA, 121 bp, Artificial Sequence
  Synthesized
  misc_feature (61): n=a or g
ctaaccaaatacactgaagtgcacagtaattgaagacaaggaaaatccttcaaatggttcngcggatttaactgttaaatgataagttacagaatagagagcacatcagcagatttaaaac

SEQ ID NO: 20228 - DNA, 121 bp, Artificial Sequence
  Synthesized
  misc_feature (61): n=t or c
aactgcagtggcaaacggacaacatggcatgcagcaatgttacttcccattcagtagttanaccttgtctctgataaaggtcagtgtcatttagcttgttacccacattgctgaagtgcat

SEQ ID NO: 20229 - DNA, 121 bp, Artificial Sequence
  Synthesized
  misc_feature (61): n=t or c
tatcaatgagtgtgagcgagacccactgctgtgccgaggtgggatctgcatgaacactganggcagctttgaatgcatctgcccccctggacatgagctgacttcagaagggaacacttgc

SEQ ID NO: 20230 - DNA, 121 bp, Artificial Sequence
  Synthesized
  misc_feature (61): n=a or g
caacagcttaagagtgatgctattcaagttaaataattgtatgggtgccctgaaaaatcantgctgcccgtggcatattctcttgatttagagggaagtttgatgggacccagctggaatg

SEQ ID NO: 20231 - DNA, 121 bp, Artificial Sequence
  Synthesized
  misc_feature (61): n=a or c
tctgggaaaacagtgagggagaaattaaacacgtgtgttaaaagcaacaaagcgtgtatanatacaaacctcttcacaacgtgctcagcaaatacagtgtaaataaacctttaagagtgca

SEQ ID NO: 20232 - DNA, 121 bp, Artificial Sequence
  Synthesized
  misc_feature (61): n=a or g
gctggagtcagggacagaaataaccatgacattacattagacttgggcaccgttctgactngcgtgctttggtaacgttgacatctaatatttttaagcagacttcagtgtttgagttctg

SEQ ID NO: 20233 - DNA, 121 bp, Artificial Sequence
  Synthesized
  misc_feature (61): n=t or c
tggtgacatgaaagggcatcagggtttctgcaagaattagaacctgagctctgcagcctcntggtgcagtttcactgctgctgtgcccctggcacttgtctttttctaacatgactttcag

SEQ ID NO: 20234 - DNA, 121 bp, Artificial Sequence
  Synthesized
  misc_feature (61): n=t or c
aaggccaccgtgtctcacgttgccattacctgtgctccttggggtgggggtctttacccanccagcttccctcctccaccaaaatcccagccaacctgggcacccccctttggctgcccgc

SEQ ID NO: 20235 - DNA, 121 bp, Artificial Sequence
  Synthesized
  misc_feature (61): n=c or g
acagtgagacctcttgggaaggaaggaaaagcagatcactgcagctatcagaaatgaccanagctcggtcaacaattctttacaataatttgctggatatttttctttattctagaaatca

SEQ ID NO: 20236 - DNA, 121 bp, Artificial Sequence
  Synthesized
  misc_feature (61): n=t or c
aacatagctgggtgcaaagtatgccagataacttcaagggtccttttgggtctgacctggngttggatcaggattccctcagcgagatcgacaggtagatgaagttttaggtcattacgaa

SEQ ID NO: 20237 - DNA, 121 bp, Artificial Sequence
  Synthesized
  misc_feature (61): n=c or g
gtttggagagatcatcccaggcatcacccactcagcacgaacaaggacagcacactgaaanacagccagcctcagaacaacagccccctacctgcaggcagaaggatggataggaggagga

SEQ ID NO: 20238 - DNA, 121 bp, Artificial Sequence
  Synthesized
  misc_feature (61): n=a or g
tcagaagaaatcaggccccttttggcaaacactggagagcctcatctttgataccacaagnggctgtaggactgaagccttcccaccctacacttatctctctcccatgtcaatttggggc

SEQ ID NO: 20239 - DNA, 121 bp, Artificial Sequence
  Synthesized
  misc_feature (61): n=a or g
tttaatgctatagtcacataaattggaacttaactttgccagttccatagctctttggacnctgttttatgagttaatgctattggtttactaaggactacagacttttcaagcagagatt

SEQ ID NO: 20240 - DNA, 121 bp, Artificial Sequence
  Synthesized
  misc_feature (61): n=a or t
ttctggtttgtttgatactacagtgacttgactgttaactaagaacaatatattccaggtncctttttagacacacagacaacatggaaaatctagccatgacagttgtgggtgcttagag

SEQ ID NO: 20241 - DNA, 121 bp, Artificial Sequence
  Synthesized
  misc_feature (61): n=t or c
cagcacctttccccaacgtatttctgaagctttttttgaggcactactttgaatgatacanggaactctgaagacgaggttatattatattacacagaattctgtacagcctcagagccac

SEQ ID NO: 20242 - DNA, 121 bp, Artificial Sequence
  Synthesized
  misc_feature (61): n=a or t
gtttgaaaccgtgccttaaattccaagtgagccctaaatatttgatcttaaaaataactanctaactaattaaagagttgtaatgaaaacacctcaccttccatctctgaggtcttaaaat

SEQ ID NO: 20243 - DNA, 121 bp, Artificial Sequence
  Synthesized
  misc_feature (61): n=a or t
atgaagcattgatcttctgggctctatcgaatgtgcagactgaagttgggtggaattagancagatttgtttgtaatgaacatcagcagaaagactcgtttgtttctgctgaaccccatct

SEQ ID NO: 20244 - DNA, 121 bp, Artificial Sequence
  Synthesized
  misc_feature (61): n=a or g
gtaaaattggacatttctcacaagaaggctgctgcatctgagcacttaaatttaatacgcnttcccccttcccaaaagatgttttaaatgaaagtctctgcagtggttcatcacaaaccag

SEQ ID NO: 20245 - DNA, 121 bp, Artificial Sequence
  Synthesized
  misc_feature (61): n=a or g
tatagactgtaagaaatatcccactggtatacccagcccagaatgcctcattgtgtggccngattacccaggtagaagaaaaatcccatcctcctcagcccccccaggccatgtttgagcc

SEQ ID NO: 20246 - DNA, 121 bp, Artificial Sequence
  Synthesized
  misc_feature (61): n=a or g
cacttcttacaggatatagctaattagaagtgtttctgaaatattccttgggagaacaacnatgaaggagctgtaagctgaagtcagaattgtaggacaaaccaaaggtacgtcagggaag

SEQ ID NO: 20247 - DNA, 121 bp, Artificial Sequence
  Synthesized
  misc_feature (61): n=a or t
aataacaaaaagagattcacagtataagttttacacaaagcaaatgagtacacttcataanaaccttattacctagatccatctattaaaaccatctctatttctgtctctgagtctcaga

SEQ ID NO: 20248 - DNA, 121 bp, Artificial Sequence
  Synthesized
  misc_feature (61): n=c or g
cggccctgagactgctggacaccccttcagcaagggcacgtagtatttgtgttgctcatanctgtacctgagcttgcagctctcagcacttgcagggctgtgcgagctttctcatcaggcc

SEQ ID NO: 20249 - DNA, 121 bp, Artificial Sequence
  Synthesized
  misc_feature (61): n=t or c
agggaggacataaaaaaaatcggtattgatcagatggtaataaaaccaaagaattccatangctaaacattctgggattcatcagcctctcttctcagctctctaaaaccagtggcatgct

SEQ ID NO: 20250 - DNA, 121 bp, Artificial Sequence
  Synthesized
  misc_feature (61): n=a or t
gcctggactagatctactatttctgtttttaaacgtgttttcaatgattgttggtatgctnctaatatttgcaagaagctgcaagagtcacaagatatgttggtgtgcagcttgaaaatta

SEQ ID NO: 20251 - DNA, 121 bp, Artificial Sequence
  Synthesized
  misc_feature (61): n=a or c
aaaactatctgaagaataaacaaattggctatagactgagatttagtaaggctatagattnaagatcttttgattactctgaatctttcccaaataatctgagtagaaatatatcaacacg

SEQ ID NO: 20252 - DNA, 121 bp, Artificial Sequence
  Synthesized
  misc_feature (61): n=a or g
ctgcagaaattctaataccatcctgttgtcagagaaatctccctttgttaatatgctacanatcacagtaatacactgttgttgaacacacatacgccattttctactcggttgcacaagt

SEQ ID NO: 20253 - DNA, 121 bp, Artificial Sequence
  Synthesized
  misc_feature (61): n=a or c
gataagaaacagctgctctcagcttttgggcttctgccaaaaatggaatgattattcttgnagcatagctgtaaaaagtaccgcatattttgtcaactcaaatttgggcaaggctggaatc

SEQ ID NO: 20254 - DNA, 121 bp, Artificial Sequence
  Synthesized
  misc_feature (61): n=t or c
gggcttcctttgcagccctgcaggaacagggcaggtgaaatagaaggggaagctcactcgnagaacaaacacgttgggttcttcctaagctcagagccaagagcagacagggtgggtatct

SEQ ID NO: 20255 - DNA, 121 bp, Artificial Sequence
  Synthesized
  misc_feature (61): n=a or g
gtagtggtactctggagtgtgatagatgaatagaagtagcaccttagtagtttgctttccntactcttgtttgtatgtgccagcaggctaaggtattgctgattatttgtaagtgctgttg

SEQ ID NO: 20256 - DNA, 121 bp, Artificial Sequence
  Synthesized
  misc_feature (61): n=t or c
ttgctgtcagcagaggccagctccaggtgtttagtttagtttcttggtatccaccactacncttttttcatgacaccataaaataaagaagctcctcatttgccttctcaagagcatcgct

SEQ ID NO: 20257 - DNA, 121 bp, Artificial Sequence
  Synthesized
  misc_feature (61): n=a or g
aaaccagcctcttctgcctgtagacacagctgggaaagctttgccctgcctgtgttctgcnctgaaataactgctcagtataccactgatgccagaaagtgctgttaccatggatgggaat

SEQ ID NO: 20258 - DNA, 121 bp, Artificial Sequence
  Synthesized
  misc_feature (61): n=c or g
atctcgcttctgcctgccagctgctgcagtgctgttcccagcctcctcagtattcgtgctntcatgctgagtacacctttgtgaaattgagaaacgaatttgtttccaaataactgcgctc

SEQ ID NO: 20259 - DNA, 121 bp, Artificial Sequence
  Synthesized
  misc_feature (61): n=a or g
gggaaatggggagatgagaaggtagggagagagacagacaaaggacgggaatggggttagngtggtatagggaaagggttgggaacagtaatagggatgaggagacagaggaggggagaag

SEQ ID NO: 20260 - DNA, 121 bp, Artificial Sequence
  Synthesized
  misc_feature (61): n=a or c
cttcctttcctgttgataatttcacacagataggtattagactcaaataaaggaaatgtgnaataacaaacatacaagacagagccaagcttgttttcagcaaaagagtattttcaagttt

SEQ ID NO: 20261 - DNA, 121 bp, Artificial Sequence
  Synthesized
  misc_feature (61): n=a or g
ccagtaaaaataagactgctggcaaaaattttgaggccaaagtgcagttgtcttctcctcnactcaaaacagacaagaaggcagaagtataattttacagaggttaaaaagaaaaacaaaa

SEQ ID NO: 20262 - DNA, 121 bp, Artificial Sequence
  Synthesized
  misc_feature (61): n=a or g
tgtttgtataaggctatgtgacatcacctgcaccctcttcataaacagataattaaatacnttcacaaaacaccatgaaatgttacatagtttgcctttactgaatatcctctccctgtcc

SEQ ID NO: 20263 - DNA, 121 bp, Artificial Sequence
  Synthesized
  misc_feature (61): n=t or g
aaaaatggaaacaaaaacaaaatagacaacagattttataatgtctgaaggcagtcagtgnctgtgtttgaattagaaaacttttgtcaaattttatctataccataacctacatgaattt

SEQ ID NO: 20264 - DNA, 121 bp, Artificial Sequence
  Synthesized
  misc_feature (61): n=t or c
ctcccatgacacagccctgcacctgagcagcacgcagatctcaggaccatgcttctacagncaaaaaccttttcatggtgccaggacactgagcttttacactgtccagatgccatggaga

SEQ ID NO: 20265 - DNA, 121 bp, Artificial Sequence
  Synthesized
  misc_feature (61): n=c or g
gagatagggattctgtgataacaaatgctttgtattcatatgaaacataggtatatcaganctccctgtacagactctgaagtatttatatagttttacatctttttagagttgcatgtgt

SEQ ID NO: 20266 - DNA, 121 bp, Artificial Sequence
  Synthesized
  misc_feature (61): n=t or c
agttcagtaggtgatatggaacaggcttgcacgcaacacctttttagatgttgtgaatatntttttgtgatgtatgcagatgtcaatgggattcaattagtacagagagacacaaatgatt

SEQ ID NO: 20267 - DNA, 121 bp, Artificial Sequence
  Synthesized
  misc_feature (61): n=t or c
cactaagggagctcaggctgatgcaaaaataaagcttgttccataattgttctttctgtanggtggtgacggcgggggtggacagacccaagcagagccatggtaatttcatgctgatgtt

SEQ ID NO: 20268 - DNA, 121 bp, Artificial Sequence
  Synthesized
  misc_feature (61): n=a or c
acaaagtttacagtgccgtgagaatgaaatggctaaaaatctccataaccagtaaaaaaancccagaattttcataaacatcagcttctatgcatttttcaggcagataccttcataattc

SEQ ID NO: 20269 - DNA, 121 bp, Artificial Sequence
  Synthesized
  misc_feature (61): n=t or g
gtggaccgctgtggtgctgtatgtctttagggcctaaaaagtccttcttagtttaaacatntaattcaaagatataaaacctttagtgttgttgttttgaattactgaactaataccctga

SEQ ID NO: 20270 - DNA, 121 bp, Artificial Sequence
  Synthesized
  misc_feature (61): n=a or g
gaaagcagaagtaccagagtgctgctgtgcaagaaaggcatttgttccccacgtgaaagcntgatcacgggtgtcggggtcccaaaaatactttgcagcttggcaaaagggtacagagccc

SEQ ID NO: 20271 - DNA, 121 bp, Artificial Sequence
  Synthesized
  misc_feature (61): n=a or g
gttgctaacttaaagcttgggtttaagccttgtgctttcagtgggattgccctggtgaccngatacatgcaggggagtgcccacaggaatgattgtgctgtcaagggagtttggagatctt

SEQ ID NO: 20272 - DNA, 121 bp, Artificial Sequence
  Synthesized
  misc_feature (61): n=a or g
agatgcaggatcactctgttgaggttctgaccacacagataggttctgctctttagagaancccatgtatggttgacactacagagacagcgaaggcagttccttatagctgcagactgtt

SEQ ID NO: 20273 - DNA, 121 bp, Artificial Sequence
  Synthesized
  misc_feature (61): n=a or g
gtgccttcaggcaagacaagtgattaaagcctctttggcatggaggacgatggctgaaatntaaatacagggaagccacgtccagctccatgtgcttaaaatggtggaagcaagcactggg

SEQ ID NO: 20274 - DNA, 121 bp, Artificial Sequence
  Synthesized
  misc_feature (61): n=a or g
ctctaactagaagagggggctgtggtctgagtgacatgcactgtgtgacatggtggtgacnacaacagctgtatctcaccacactgctgaacaccttacagcatgtgactctgggtgctgt

SEQ ID NO: 20275 - DNA, 121 bp, Artificial Sequence
  Synthesized
  misc_feature (61): n=a or c
agagaatcatgaaaaaaaaagcagaggacaggatcactcttctgttctatcatctaaactnaataaagctcttaggacaagagatgttatcttcagcaagaaatagggcagtgtggatttt

SEQ ID NO: 20276 - DNA, 121 bp, Artificial Sequence
  Synthesized
  misc_feature (61): n=a or t
agctcttctgatataccacaaggtaatttgtgttaatgaatgtcagaactgtagatgcttngctgctgagcattttacagactgcacatagagacttcaagcaattggcatgcatttgtct

SEQ ID NO: 20277 - DNA, 121 bp, Artificial Sequence
  Synthesized
  misc_feature (61): n=a or g
tgccaggagatgttaaaccaacatgcagaaaacctctgtattgctgaacaactgcacagcnccccaaaagtgatgctgaaagcatggggtgggatgagggagaggcatctgtaggttcctg

SEQ ID NO: 20278 - DNA, 121 bp, Artificial Sequence
  Synthesized
  misc_feature (61): n=a or g
acagcgggtttcagttagcagagcagcaataatttgcccccaaatccactaccaggctgangagcttatttctgtgggatattgtgaaggctgagctatcttttgaagcatagacccatta

SEQ ID NO: 20279 - DNA, 121 bp, Artificial Sequence
  Synthesized
  misc_feature (61): n=a or c
ttaaaaaacctgatgtcagaagcaaccacatcaccttgtcctttcataaactaatctgaanaattccttcatgaatcactcgcagaacactccatgaaggttcagaattctctcagcccga

SEQ ID NO: 20280 - DNA, 121 bp, Artificial Sequence
  Synthesized
  misc_feature (61): n=t or c
aacagtcctattcaggcactatttgtaataacgttatttgttttagagctgaattttggcntctcctgctaatgttgactgtccaaattcatttcccctggatgtagatttaggttgcctc

SEQ ID NO: 20281 - DNA, 121 bp, Artificial Sequence
  Synthesized
  misc_feature (61): n=a or t
tagcaatttattactgctaataaagaatgtaaaaaattgtgtccgtagcttcagggagctnaatgttttgactcttgctccttgaggaaaagattcaatttataaaatctcctaagaaaat

SEQ ID NO: 20282 - DNA, 121 bp, Artificial Sequence
  Synthesized
  misc_feature (61): n=c or g
tttgaactcccacagatgagagcagaggagagtcagaacaaatgaggaaagcagcaattgntgaagactgctctgactctcaatggaggtccaccacagcacagcctgagctagactagat

SEQ ID NO: 20283 - DNA, 121 bp, Artificial Sequence
  Synthesized
  misc_feature (61): n=t or c
gtccaacacaagatctcatctacgcatgaagaaatgcagcatatctcacatcatacaagantggccttttccataaacacctcattgtttctatttttgtaatctgatgaaagtaatccat

SEQ ID NO: 20284 - DNA, 121 bp, Artificial Sequence
  Synthesized
  misc_feature (61): n=t or c
gcgtttcttcataaagacatgcagttttgattagaacttgtgttgttagcgaagcttgacntctgctccaatattttgttgcaatacttaagctcctgttaagcgctgtgaaaatctgagc

SEQ ID NO: 20285 - DNA, 121 bp, Artificial Sequence
  Synthesized
  misc_feature (61): n=a or t
agaccggtgctcagtgagtgggctgtaaaatgaaaagccttgggtacgtcagtgtgtaagngcaaacacagctctatgggctgatgggcaatgatgcaatggggcatcccattttgttgtc

SEQ ID NO: 20286 - DNA, 121 bp, Artificial Sequence
  Synthesized
  misc_feature (61): n=t or c
aggtgtgggcctccagaacaagagctcgggctgtgacctgcccacagccgtgttctggcantgtggtcactgctttgaggaagcaaggagggacttctgttcattcctattgaaaacagca

SEQ ID NO: 20287 - DNA, 121 bp, Artificial Sequence
  Synthesized
  misc_feature (61): n=t or c
ggaaactgccaaagagaatgagtgctgctgtgtaattacaagggctggcagcgctggtagnaacacaactggaatctgtccaagctgcagtgcaacatcccagttactgtcagtgggaaat

SEQ ID NO: 20288 - DNA, 121 bp, Artificial Sequence
  Synthesized
  misc_feature (61): n=a or g
aaacaaaatcccagttttgcatcaaggccagatttcaaataccaaacatcatcctgaggtntaaccttgtagctctacgtggttgtgcgtgagcttccacttggaccttgaggcagagcca

SEQ ID NO: 20289 - DNA, 121 bp, Artificial Sequence
  Synthesized
  misc_feature (61): n=a or g
ttatcagcactgagcagtccctcatgttttacaaccccttgctcttggagtattaccagangtttaactcactggcaggatagcctataacatgttgctgctgtttagttgcttttcactg

SEQ ID NO: 20290 - DNA, 121 bp, Artificial Sequence
  Synthesized
  misc_feature (61): n=a or c
gcgcgaccttctacatggggatacttccaaaccagagaagccaacaccaaggaagtcagcncacatgtttggcagcctctggcaatgagagatgcaggccgatgcaaacctgatgaaacca

SEQ ID NO: 20291 - DNA, 121 bp, Artificial Sequence
  Synthesized
  misc_feature (61): n=t or c
gtgaattgcatcagccactccatggctgagtcaatctcagtgtctctcttggacctgtcanaatctatgttatttctctcatactgtgttaacatggtacagaatcctgtacactgtgaca

SEQ ID NO: 20292 - DNA, 121 bp, Artificial Sequence
  Synthesized
  misc_feature (61): n=t or c
ttctataatataagcctccctgccccaaaaaccaggaattccaaacctgagatcttacatnttactatcccagtgtccttgtgactttcttttgtggactttctctattgatttttgaatc

SEQ ID NO: 20293 - DNA, 121 bp, Artificial Sequence
  Synthesized
  misc_feature (61): n=a or g
aaaagagtatttcagatttgtcagaacccaaagcacactgagaattccctcaatctctttncaaactgtgaccaagaaatggtttagttcttaggttcaaaagatattcacaagcatgctg

SEQ ID NO: 20294 - DNA, 121 bp, Artificial Sequence
  Synthesized
  misc_feature (61): n=a or g
tccaagttcctaaatcttagtgcacagctgcagttgcaaaatcaaaaatcagtgtgtcctngagatgcctcaaatttgcttgagtatttttctaagggtgaatcaaggaacacttacttaa

SEQ ID NO: 20295 - DNA, 121 bp, Artificial Sequence
  Synthesized
  misc_feature (61): n=t or c
ttggatgcttttgtttgctaaaccttttgtgatagacagacgaaaccttattgctttgcantgaaattttgaatggaggctcttaacagaagttgaactgatagagaagcccttccaggtg

SEQ ID NO: 20296 - DNA, 121 bp, Artificial Sequence
  Synthesized
  misc_feature (61): n=c or g
gaggcctggttctgatcttgtatttaggagacaaatgacttgtgcagagctggagagatanaacagagccaatgttctctggtagcttcgctctgctatgaacaggtgggaggtgttgctg

SEQ ID NO: 20297 - DNA, 121 bp, Artificial Sequence
  Synthesized
  misc_feature (61): n=t or c
atgttcccggaaatattctcatcgtgaagcgtgggaatttttacaggaagctctcagctanttttggttttgttgcttattgagtgctgttagagcccttcacggggagatgcaataactc

SEQ ID NO: 20298 - DNA, 121 bp, Artificial Sequence
  Synthesized
  misc_feature (61): n=t or c
cctgggtgactgtgggcaggatgacatagagaccgcagagcccaaaagcccatctgcttcntccagctatcacagcttcatgcatggaattacatctcatcgctaaacttgcaccctaatt

SEQ ID NO: 20299 - DNA, 121 bp, Artificial Sequence
  Synthesized
  misc_feature (61): n=a or g
aaacaagtttatttgaataacagcatctcaactcaatcatcagatcctgcagtttatcagntgtttccgtgctgcagacatggatgtagaattcactaggagagacaattaaattcacaat

SEQ ID NO: 20300 - DNA, 121 bp, Artificial Sequence
  Synthesized
  misc_feature (61): n=t or c
aacctgaagtagcctggtcacttgtaaacacacaggaatcttccattcacaggcatgctcntaaccatccagactgcttgtaaaagcaagaaaatatcattggaaaatggaaacaatagct

SEQ ID NO: 20301 - DNA, 121 bp, Artificial Sequence
  Synthesized
  misc_feature (61): n=a or g
tcataagtttctcttgcaaatcattgtttttgcacagtaaactgacatggttaaaaacatntaaacggtaaactttggagaactgcaatctttctgtagacaagtttacaatgaagaaata

SEQ ID NO: 20302 - DNA, 121 bp, Artificial Sequence
  Synthesized
  misc_feature (61): n=t or c
tgttcatttagctgggaagaattcaggaagtttgaagggctggttagtcacttagttcccngtgaagcagcagtctctgggtttgcttacactgaacaggaacagatttaatattcaaaag

SEQ ID NO: 20303 - DNA, 121 bp, Artificial Sequence
  Synthesized
  misc_feature (61): n=t or c
ataggactaagtttcttgtggtacatttgaatcagagttcaacttagctttcatttcacanccttggcccttgtgtttgacacaatcgtaacacttaatgtcagcggggaaaaaaacatta

SEQ ID NO: 20304 - DNA, 121 bp, Artificial Sequence
  Synthesized
  misc_feature (61): n=a or g
gaagccccgcacacagatgagccctgttgcaggctggcacagcagcccaggacctgagganggaaagagcagagtcagccctcaaagaccatttacctcctggctggtacagtcatgatag

SEQ ID NO: 20305 - DNA, 121 bp, Artificial Sequence
  Synthesized
  misc_feature (61): n=a or t
attgcatatccacatccacttttgtttggttttatcgagatctaatccataatggcttacngaactgttgtacaaagacactaaagtagaactgaaataagaagagtgacatgcttgagtg

SEQ ID NO: 20306 - DNA, 121 bp, Artificial Sequence
  Synthesized
  misc_feature (61): n=t or g
tctgatgaaactgaaaaagctcttacatttcaagttggtcatctgtatttccaagtcaaancctcaaaaaaataagttagatcaaattgcctttgaagtctgttgaaggaaaagcaagttt

SEQ ID NO: 20307 - DNA, 121 bp, Artificial Sequence
  Synthesized
  misc_feature (61): n=a or g
ccaaagggaaggctcccatttaatctcctgacctttgctgctgtgaccagatgacactgtnacaaaagctggaaaaccttgcagctgtgctaactcgggatggccaagtccacaccacaca

SEQ ID NO: 20308 - DNA, 121 bp, Artificial Sequence
  Synthesized
  misc_feature (61): n=a or g
gagttctcaggctctctccttacctgttgcaggattcgttacccggcagtcattttgcacnttgcttttaagaggacacgcagcagcagtgaaccataagaagctgtattcacaatcttca

SEQ ID NO: 20309 - DNA, 121 bp, Artificial Sequence
  Synthesized
  misc_feature (61): n=a or g
tcatacttcaatctgtgttgatgtcccatttctataacaatgttctgtgaggccataagcncaactttcatttcagggtaaatatgggaatcaggaagtgactgacaaagctcttatttaa

SEQ ID NO: 20310 - DNA, 121 bp, Artificial Sequence
  Synthesized
  misc_feature (61): n=a or g
gaacatggttgagagctgggagattcaaaatgtgaccccacaagtctgcaaagcagacatntaactgtttaaatcttgacaggaggtaaaataaaggaggattgcactcctactcccactc

SEQ ID NO: 20311 - DNA, 121 bp, Artificial Sequence
  Synthesized
  misc_feature (61): n=t or c
tacgcgtgtaacttctactgggtgcatttggtttaatatagcagtatacttcaaaggtgtntttggtctaaatgctattatggaaatgcatattttatacagaatgtaatccaagacagaa

SEQ ID NO: 20312 - DNA, 121 bp, Artificial Sequence
  Synthesized
  misc_feature (61): n=a or g
gcgggcacagctggaacactgacttgggtccatactgcaccaaatagggaaaacaattcantgaactaagttggcttggaagccagcctcacctacaaagcagacccaagagcaaactgca

SEQ ID NO: 20313 - DNA, 121 bp, Artificial Sequence
  Synthesized
  misc_feature (61): n=a or g
gtgtctcaatgcacctggaggttaccgctgcgaatgtgagatgggcttcaatcccacagangacagcaaggcctgccagggtaagtaacctgagttttgtttgctgctccaagagatgcag

SEQ ID NO: 20314 - DNA, 121 bp, Artificial Sequence
  Synthesized
  misc_feature (61): n=c or g
attgaacttttattttcctttactatttactttgactccgatcaatcaattatttcttaanctttccatgaattgtatcaccaagagagaaggaggtattaagagtgtggacaaccagacc

SEQ ID NO: 20315 - DNA, 121 bp, Artificial Sequence
  Synthesized
  misc_feature (61): n=a or g
agagcttgcaacagcagcatggcaacttctggcagttttgggtgaggaatttgatcattcncactgatgggaagacagcagaacacttttcgaaatacataaataaatacataaatacata

SEQ ID NO: 20316 - DNA, 121 bp, Artificial Sequence
  Synthesized
  misc_feature (61): n=t or c
tttgcatatgctctgatagcatacactcaggagattatcacaattaagaacagaattgtangcaaatatttagtgtaatatgacaagggttttaagcaagatgaggggatatttagatttg

SEQ ID NO: 20317 - DNA, 121 bp, Artificial Sequence
  Synthesized
  misc_feature (61): n=t or c
atgaagaaaacaaatggtccaatcaggccctcagaatggggattttcctactggctatccntacatcgatatgagcataaactgtaaatcccaatggttaggctcccagcttctaaaatct

SEQ ID NO: 20318 - DNA, 121 bp, Artificial Sequence
  Synthesized
  misc_feature (61): n=a or g
gccccacacccgcgagggcgagcagcagaactgctgtggttccctgcttccctgacacccncagtgcccaaaaccttctgtacagggctgagttggtgttgttgtgcccagcacctccgat

SEQ ID NO: 20319 - DNA, 121 bp, Artificial Sequence
  Synthesized
  misc_feature (61): n=c or g
tccaacaatctttctttctctacatgctatcagagtttacctgtctctgagataaagtgantatctgcactttgggtatatattactaagctgtactagctagtgatatatgcagaagtgg

SEQ ID NO: 20320 - DNA, 121 bp, Artificial Sequence
  Synthesized
  misc_feature (61): n=a or g
atctaggatgggtatcagctccacatggagacacccacacttagatttctacctatatctntgtttagtgtctaaagttctggttataatcagtaaacctagaagtctgatatactgccct

SEQ ID NO: 20321 - DNA, 121 bp, Artificial Sequence
  Synthesized
  misc_feature (61): n=a or g
ttcactgagtacctggaactgcctggtggcacacagaccatagcaaacagcatgagcagcntccaccaaatcacagccatctttggtgccatcgcagtcactgagacacgaagcacagctg

SEQ ID NO: 20322 - DNA, 121 bp, Artificial Sequence
  Synthesized
  misc_feature (61): n=a or g
gaggtggtgaatgttaaacctcaggtgagacagcccatgtagaaggcatcctgatagaacnatgtgattgcaagtcagtgtctgatgccagaatgggaagcattttttttcagatgtttct

SEQ ID NO: 20323 - DNA, 121 bp, Artificial Sequence
  Synthesized
  misc_feature (61): n=a or g
cttcctcatcaattaatattttgaggcaattctttgaaattaatgaaggcttcagctaacntttgctaagactaaacatcgcttcagaagaccttaaaagactagaaagggtaaatcaagg

SEQ ID NO: 20324 - DNA, 121 bp, Artificial Sequence
  Synthesized
  misc_feature (61): n=a or g
agttacaagttttcacactaactcactagatgagatactcaggctcaggtttcagaagganctccatgattctgggagtacaaacctccgaaagatatcttcttgagagccatttgggtat

SEQ ID NO: 20325 - DNA, 121 bp, Artificial Sequence
  Synthesized
  misc_feature (61): n=a or g
gatttcagaaggcacagaatcattttgcaaggaccccagcttatagctcacaaataagacncatgctttctgcttcaattttctgctttttcttccatgtgccacttttctctaaatcttc

SEQ ID NO: 20326 - DNA, 121 bp, Artificial Sequence
  Synthesized
  misc_feature (61): n=t or c
aataaagaagggtgtgtttcccatatagtgaaacttacgtgcttacaagctatgtttacangtaggtgacatgattaagcaggagggataggtgacatttctacataattttatcagacaa

SEQ ID NO: 20327 - DNA, 121 bp, Artificial Sequence
  Synthesized
  misc_feature (61): n=t or c
tgaatggacctaaaccaactgttcccaaatggaaggatgctcaagggggccatctgaatcncaatccaactctgcctcagtgcgtgcaagaatgtgatttgggctgacccctaatgtcatt

SEQ ID NO: 20328 - DNA, 121 bp, Artificial Sequence
  Synthesized
  misc_feature (61): n=t or c
gctgcccttcgcagcagctttgcttcagtgctacagaaacctggtgtccattgcaatctantgcaaggtcactgcaggcgcaaaaacccaaaccaacccacgctgagtccttcctgtgtgc

SEQ ID NO: 20329 - DNA, 121 bp, Artificial Sequence
  Synthesized
  misc_feature (61): n=a or g
ttacatatttaggctgagggaggaggtgagtaagaatatttttgtggtgtaattgtgttcnataacaaagtaattgcacagtgctcaaatgctgtggaaacatgggggctgcacaaactct

SEQ ID NO: 20330 - DNA, 121 bp, Artificial Sequence
  Synthesized
  misc_feature (61): n=a or g
taaccacctctatcaccccacataaaacacacagcaacgactgctcttcaagcaagaaacntcactgcttgtattttctgcaagaaggttgacattacaccaaactgacaagctgttcctg

SEQ ID NO: 20331 - DNA, 121 bp, Artificial Sequence
  Synthesized
  misc_feature (61): n=a or g
cacactgggctacatgtttttcatgtccagtgtctgatatgtggctgatgccatacctaanacacttcattgccacctctcctctactttccttcactttctttctgcacttgaagccaca

SEQ ID NO: 20332 - DNA, 121 bp, Artificial Sequence
  Synthesized
  misc_feature (61): n=a or g
ggaaaaaggaagtgagaagggaaataatgtatgttgtaaagtcatgtcttactgagttacnaaataccagcatctaactaaattactttcacttctggtttcaaataatcaacttgacatt

SEQ ID NO: 20333 - DNA, 121 bp, Artificial Sequence
  Synthesized
  misc_feature (61): n=c or g
atgcagagcttaattaaaactgtggctgtgtgatttgcaagtgacagtgcagggaagcctntgagagcagctaactccgggatctctggcctgtgttaatgtcttagcaatatctgttgtg

SEQ ID NO: 20334 - DNA, 121 bp, Artificial Sequence
  Synthesized
  misc_feature (61): n=t or c
agccaatactttgggatgagtacatgtattgttgtttgtggctgaaatgtgatgaccattnatcacacaagtcaagaacttttatttttaacctctctgtgcttcagtgacttttgtacaa

SEQ ID NO: 20335 - DNA, 121 bp, Artificial Sequence
  Synthesized
  misc_feature (61): n=a or c
attgaggccagtgacttacattcattctcaaggtaacttgcataaacactgctaacacttntagacaatttcttttcagttgttaagccagcattcatctttgtttgtattataacaaaat

SEQ ID NO: 20336 - DNA, 121 bp, Artificial Sequence
  Synthesized
  misc_feature (61): n=a or g
tatttcttactttggttcacatgtaacctacctacatagacactaagaataaacaaagtcnagaagagtcagctattgatctataccacttgggggaaaaatttgattgaacgaaggagtc

SEQ ID NO: 20337 - DNA, 121 bp, Artificial Sequence
  Synthesized
  misc_feature (61): n=a or g
ccagtgatcatcactagttgtaaaggaaagtttggggctctgaaaggattattatttggcnttttacagagttgctggtgaaaagaacttaaacagctgattgattaattgcatacatttt

SEQ ID NO: 20338 - DNA, 121 bp, Artificial Sequence
  Synthesized
  misc_feature (61): n=a or g
agatcagcgaactacagaaatgaatttgacaggaaatcttcccttaaaaacatcagctganaggtctgtattttcaataagttgaaattccaagatgtaggtacatgcctacatacatatt

SEQ ID NO: 20339 - DNA, 121 bp, Artificial Sequence
  Synthesized
  misc_feature (61): n=t or c
tctgtctccttgctgctgggctgtgctgtgctcataacagctcttcagttttatggtgtanggaagagagggaacacaagttaattactaggctcttcaaattcttctcagttctgagcgg

SEQ ID NO: 20340 - DNA, 121 bp, Artificial Sequence
  Synthesized
  misc_feature (61): n=t or c
ccttgtcacccaggatgtatctgggcttcgtgtcctggtgtttactggagacacaaagagnaacatacacttgatgatcatctctaagcaaacattccctaaggacttgcttaggcaaggc

SEQ ID NO: 20341 - DNA, 121 bp, Artificial Sequence
  Synthesized
  misc_feature (61): n=a or g
atacaactaagcactacagttgatatagacacagattatacttacctgagggaaggattcnaaagatttcttttgtgataacttcttttgaattatcacggtaatttgcgaaagaaaagta

SEQ ID NO: 20342 - DNA, 121 bp, Artificial Sequence
  Synthesized
  misc_feature (61): n=a or g
cctgtttcagaactacattgactgtagtgtcttcctactgatgcaggtattagcatgatcnaggcttgggcaaagaagttcaagtactgagataaaaatcagagttcaaggttttgagtaa

SEQ ID NO: 20343 - DNA, 121 bp, Artificial Sequence
  Synthesized
  misc_feature (61): n=t or c
gccccctgcaaataaatttcacctttgcaaaacacacattaactcaattattgttcaaaangtactgcctctgttatatttacacccagatgaatttcaagtcattaagcagcagaaaaac

SEQ ID NO: 20344 - DNA, 121 bp, Artificial Sequence
  Synthesized
  misc_feature (61): n=t or c
gcaaccccgttctgaatccaaggcaagcaaagcacgatccacctcctgataggctaattantccgtgtttctcgagacaatacttcaagtgcttgaatacggctctttttcctgctcatct

SEQ ID NO: 20345 - DNA, 121 bp, Artificial Sequence
  Synthesized
  misc_feature (61): n=a or g
caaggctgaatgtacttgctagtgcaggacaactaccaaatacctttggcattggccagangtagacaagttcccattcaattgagtccttctcatgttgcattagatttacacctgaatt

SEQ ID NO: 20346 - DNA, 121 bp, Artificial Sequence
  Synthesized
  misc_feature (61): n=a or g
cccttgtagcttaagagtgttccagtatttactctcccattgcattttgtaaattaaatgnaaggagacttagaatactgtcaacacgatagacatcctagctagtgggtcctggcaatta

SEQ ID NO: 20347 - DNA, 121 bp, Artificial Sequence
  Synthesized
  misc_feature (61): n=a or g
aaaaacaaattcaggaagacaatgatgaagactaataagaaggatctaagaaataaagctnctttgtaatctagaaaaaaaattcacattttgttttccactatattctgttatgctgttt

SEQ ID NO: 20348 - DNA, 121 bp, Artificial Sequence
  Synthesized
  misc_feature (61): n=t or c
ggaattgtgttggcaaagtcctgtgcaaagcagaaaggattacattaaagttccagatgtncattacctgtatttacttaagtatacctatgtgccacgctcctaccccttctctaattct

SEQ ID NO: 20349 - DNA, 121 bp, Artificial Sequence
  Synthesized
  misc_feature (61): n=a or c
agctagatagagaaaaaaactgcttcagaagacagatcctaggaatgtctaaactagtttntgccagctgcccagagacttttactgttatcacattatgctaacaaatattaccatccta

SEQ ID NO: 20350 - DNA, 121 bp, Artificial Sequence
  Synthesized
  misc_feature (61): n=a or g
catctgtcacatgcctactacaagcccagctacaacagtactgaacataaatgctacttcnagaacccagattagttatttaagctagtttaactacttctgttctttcttgcaatctgat

SEQ ID NO: 20351 - DNA, 121 bp, Artificial Sequence
  Synthesized
  misc_feature (61): n=t or c
tcatacttaccttacattttctgcaatgccatcgccccagaagaagcttaattccactggngggtacagggtttacaattaaatgttcaattaagcaatggattttttttcctcactcaag

SEQ ID NO: 20352 - DNA, 121 bp, Artificial Sequence
  Synthesized
  misc_feature (61): n=a or g
tggcttgtgttttccattcccatccaaacctcatggttttcaggaatgtctagccactagnaaatactaggaacagagggcatttgaatgtggttctgtgagatcaacgtaaccttaaaaa

SEQ ID NO: 20353 - DNA, 121 bp, Artificial Sequence
  Synthesized
  misc_feature (61): n=t or g
aagaatatgacttgaaaacaaaggtgtttcattttgcaaaggcttcaagaaagcttttccnattctgaaatgtttgtaagaattttcttgaaattacttacctacatgttatctaaaattg

SEQ ID NO: 20354 - DNA, 121 bp, Artificial Sequence
  Synthesized
  misc_feature (61): n=t or c
agttgcaaaaaggtctgtgggtaggatataaaccccatgcattcacccagcaaacaatacngtcatgtagttaacacggcagaaatatttaattagttgcactttcagcttttaaatgaga

SEQ ID NO: 20355 - DNA, 121 bp, Artificial Sequence
  Synthesized
  misc_feature (61): n=t or c
atccattccagcacttccaatcttttcttcttttgccatattttaaaaacacggagacttnagagcactttctggccaaaaaattgacaaagtctcgtattttccatagtaaataaactgg

SEQ ID NO: 20356 - DNA, 121 bp, Artificial Sequence
  Synthesized
  misc_feature (61): n=t or c
ctgtaaagagtcaaagaattgataggccaccgtactgtctcgcaattagctgcaaatgtgngtataggagagtgcttgaagttcagtgcagctgttgttggggcaatggcagagcagcaag

SEQ ID NO: 20357 - DNA, 121 bp, Artificial Sequence
  Synthesized
  misc_feature (61): n=a or g
gtcagagcagagaaacaacagtgacagagccatgggcattaatgggcagaaaatgacagcntgagtttctatttagaaaaatacacattaaaaacacacctcaggagataggattccacag

SEQ ID NO: 20358 - DNA, 121 bp, Artificial Sequence
  Synthesized
  misc_feature (61): n=t or c
agggtatggacatggctgacgtgtgtagcagaagttgtccacaaatacaccaggatccatnactaactaacatgccttcacagagaagctctgctatgtatgggagaagtaaaaccaaaag

SEQ ID NO: 20359 - DNA, 121 bp, Artificial Sequence
  Synthesized
  misc_feature (61): n=a or g
aagtaaatgcaagagtttgttgttgacttggagacagcttgctggtattttgcaggttggnatttgttgaagccattgcaaagtaaaatgttggaattgtgtttagatggacttgtaggat

SEQ ID NO: 20360 - DNA, 121 bp, Artificial Sequence
  Synthesized
  misc_feature (61): n=a or g
tgtttcttacattcgccaggcagcacatcagaattcacttaaaatcagccagcaggtcaanatgctacagaatgtctgttttgatgttcattttgcataaatgagaagatcctagcagagt

SEQ ID NO: 20361 - DNA, 121 bp, Artificial Sequence
  Synthesized
  misc_feature (61): n=a or g
ttttccccatagtgacaaagcaaactgccaggaggaataaaaacaaacgtgactacctgcngtatattgtgtacaagaataatataaaaggtctgatattttgataggcttttcttttgat

SEQ ID NO: 20362 - DNA, 121 bp, Artificial Sequence
  Synthesized
  misc_feature (61): n=a or t
cctcagcacattgtaggattagacacatacttggcagcaaacaccaaaacaactagtaagnattgccaaaggcaagctggtaacacatccagcatggccaaggctctgtgtttgtgttaac

SEQ ID NO: 20363 - DNA, 121 bp, Artificial Sequence
  Synthesized
  misc_feature (61): n=t or c
gttcaagtctggatggatgaatatcaaatgatgtacttttgtaagtctgaaacgtcttaanctgacacatccataaaataattctgtcttttcaaaataagatgaaatcattgttctttgt

SEQ ID NO: 20364 - DNA, 121 bp, Artificial Sequence
  Synthesized
  misc_feature (61): n=t or c
tacactaacatttttccgctgattaccctggactaatttttactaactgagaatgaagctngtcacgtcactatactctatgctatacaactcaaagacagatatactataaatatagatt

SEQ ID NO: 20365 - DNA, 121 bp, Artificial Sequence
  Synthesized
  misc_feature (61): n=a or g
cttaaaatatgtttcctttgccactttagttgaggaaaagtgcaggaaggtgctgaagtgnagcaacctaactttcttttatcatagactgtagagatttagctcagaaggaagctctgaa

SEQ ID NO: 20366 - DNA, 121 bp, Artificial Sequence
  Synthesized
  misc_feature (61): n=a or c
ccaagggggcaagaaaatgatgagaataaacttgcataataacatagtggaaaccctcaanagagcttgcctttgtgtaaagtttaaatgtgcctgttgactatacgcacctctcagtacc

SEQ ID NO: 20367 - DNA, 121 bp, Artificial Sequence
  Synthesized
  misc_feature (61): n=a or g
atatgacagaagagcagcttcaacagggaaaaatgtgtatggtttgagtttaaaaccaganctcatttacattaagagatcaatcagtgggaaaacccaatcggctgtgctggcccatcag

SEQ ID NO: 20368 - DNA, 121 bp, Artificial Sequence
  Synthesized
  misc_feature (61): n=a or g
gtttttataatttaattctccttccgaagggtaaccagcagattttctcattcagtttccnaataaagaaagccagcttgaggaaccaagggagatgaatattgggactgttcactccaaa

SEQ ID NO: 20369 - DNA, 121 bp, Artificial Sequence
  Synthesized
  misc_feature (61): n=t or c
tctgtgcactgcaacaaactgcctcgtacagacagacaaacaagaaaagatcatgtggttnttagtttactgcagcttgctaaaattgagtgtgaacactaagaacattcagaatggctct

SEQ ID NO: 20370 - DNA, 121 bp, Artificial Sequence
  Synthesized
  misc_feature (61): n=t or c
aaaatgagatgttggatttacacaatgaagatttgctttgaacgtttctcttaagagtttntccttccaggtaaagaacagatcgtacctagtgaaattacacaccttttattttgattat

SEQ ID NO: 20371 - DNA, 121 bp, Artificial Sequence
  Synthesized
  misc_feature (61): n=a or g
cacgtgcaagtataaaggaagggcaagccaatacaaactcacatatctatttgcagtttcntgttccaaatcagccaacagagataattaaagagaaataggaatatttgttaattttgta

SEQ ID NO: 20372 - DNA, 121 bp, Artificial Sequence
  Synthesized
  misc_feature (61): n=a or g
aattgcatgcactgctctctatccttcttgttcagctctaatcactgagctgtatgttccnggttgttcccatcaacgtgtcatctgctgtgtgcctacccacagacctttattgaggagg

SEQ ID NO: 20373 - DNA, 121 bp, Artificial Sequence
  Synthesized
  misc_feature (61): n=a or g
agtccccagtagctttatgccaagttttgttaaggattgtggatgttaagtatgtgccctnggtatcttttttgggatatcgaactaagtatgaaaagctcattaacttagagccatgatg

SEQ ID NO: 20374 - DNA, 121 bp, Artificial Sequence
  Synthesized
  misc_feature (61): n=t or c
gaggttgtaatgctaagaagcaagagggacaaaataaggaacaccagcagaaaggaaggcngtgactgaaggtcacaaagaaacaaaaacggttcccctgaacatattttgcgttgaaaca

SEQ ID NO: 20375 - DNA, 121 bp, Artificial Sequence
  Synthesized
  misc_feature (61): n=t or c
aaaaacacatagcatctccatgctgctcttttgcctgtgatactcaagtcaacaatatttnctagtggtactggaatgcagggttaatatacatacagtaattgtaagtgtccagcatttt

SEQ ID NO: 20376 - DNA, 121 bp, Artificial Sequence
  Synthesized
  misc_feature (61): n=t or c
tctttgggtatatccctacttagtcagcccaaatacacagggagccaacttagctcacttnggaaaaactgatgtgcttgctgctgcttgtctgcaaacagggagagggcagggaacaccc

SEQ ID NO: 20377 - DNA, 121 bp, Artificial Sequence
  Synthesized
  misc_feature (61): n=t or c
ccagcttttgtactttgtataacagtagattgttgccatcctccagaaattaacataaagntagagataacaaattctagcaaaccaatttagaaccccacagcaaaataattgataaatg

SEQ ID NO: 20378 - DNA, 121 bp, Artificial Sequence
  Synthesized
  misc_feature (61): n=t or c
aatactgtaatctatgggaaagtattttatgtttctttcatcttaaaacttataactgttnataccttaaagcagtggatatgtcctgcagcagcaaacaagaagtcagaatggcagaaac

SEQ ID NO: 20379 - DNA, 121 bp, Artificial Sequence
  Synthesized
  misc_feature (61): n=t or c
tatctccttatcaccagtcttgagctctttaatcatgcaaacaagctccagtgggcaagcntgagaaagtcagtgaccgcagtcacagatgacacagtagcagaagtcctgaggttacagg

SEQ ID NO: 20380 - DNA, 121 bp, Artificial Sequence
  Synthesized
  misc_feature (61): n=a or g
gttttgtttcctgtatatgaggacatacagttttcaaaggaaactggagccacaaatttantgctagaaaactacatgatcagagcatgaagaattaccttttctccatttaattctcagg

SEQ ID NO: 20381 - DNA, 121 bp, Artificial Sequence
  Synthesized
  misc_feature (61): n=a or c
taacacagttctgtgatttgaggaaggacacttctttcaaatgacaggaatgttgcagctntgctttttgagataacttgaggttcttttttcagcaacatggttcagttataagatcttc

SEQ ID NO: 20382 - DNA, 121 bp, Artificial Sequence
  Synthesized
  misc_feature (61): n=a or c
ttcttgatgtagaaaatgttaagtatagttaaagacacatgggcaatcatggtcttttgcnttattttcaatgtgtacactctcacacagtctgtattttgcaacagtattaaatttgctc

SEQ ID NO: 20383 - DNA, 121 bp, Artificial Sequence
  Synthesized
  misc_feature (61): n=t or c
cacaaaattaactaactatcgctcatatggattacgatgcacgccttaactatacgaccanctacagtatttcttaaacactgcagcacctccaagacatctcccccagaataaaagtaca

SEQ ID NO: 20384 - DNA, 121 bp, Artificial Sequence
  Synthesized
  misc_feature (61): n=t or c
cagtgtagggtgaaggacagtgggaagatgcagacacccctaccctgattctgttcaatgngtgcagctcatgaagtttctgagcacctaccattgactgaatgtaccttttgaaagatgc

SEQ ID NO: 20385 - DNA, 121 bp, Artificial Sequence
  Synthesized
  misc_feature (61): n=t or c
caaaggttggtggatccaattactgagtctcaaagagtccactgatagcctcctgtacctngcctagccaccaaatcagctggcttgtgcttcatgaaatgtagttagttttagtctgttg

SEQ ID NO: 20386 - DNA, 121 bp, Artificial Sequence
  Synthesized
  misc_feature (61): n=t or g
tggaatggccctggaagccattttctaaggcttaagttcactacatgcttcattctctcanataagattcccagagggcaggtacatgccgtattttcacagagatgattaaagcaggcaa

SEQ ID NO: 20387 - DNA, 121 bp, Artificial Sequence
  Synthesized
  misc_feature (61): n=t or c
ggggttcatcttccctcttagaagcacagactgcagtactgctgtgttggtccagtcactnttctcaaagtccagtgacctcagttaatgtgggtccagttgtgggtcgggccagcccagg

SEQ ID NO: 20388 - DNA, 121 bp, Artificial Sequence
  Synthesized
  misc_feature (61): n=t or c
aacccaggccattctatgattttatcatctcagtaggtacgtgtgctctgtggtgggtgtngtgataacagctagaaacatattgtaaggagcttaattggcagtgacccaccacgatgaa

SEQ ID NO: 20389 - DNA, 121 bp, Artificial Sequence
  Synthesized
  misc_feature (61): n=a or g
tttatgtgtgactccaaaagaccctaacaaggaaaagttttgcctccatccccacaggtcncatcagtgctcctgggattggaaatctactctgctacccctttcttttgaccttaggaag

SEQ ID NO: 20390 - DNA, 121 bp, Artificial Sequence
  Synthesized
  misc_feature (61): n=t or c
ccttgcttttctgttgagatgcgtgtctggccaagggtagctgcaccctgtaagtaaactngtctaattggagcctctacaaaattccttgattgtctgcttttcagtcctgaaaacgcag

SEQ ID NO: 20391 - DNA, 121 bp, Artificial Sequence
  Synthesized
  misc_feature (61): n=a or g
ttgctgcgtgccagtttgtcttttctggggagaaggctaaataagaacattctgtatactnaactgttggatatctgatgctttcagaggcttagtgcaagaaactctttatcagagacct

SEQ ID NO: 20392 - DNA, 121 bp, Artificial Sequence
  Synthesized
  misc_feature (61): n=a or c
caaacaaaaaccaaagcaaagcatcaggctggaggaagagcacactgatgccatgtctagntccaggacagcacctccacgtgatgagtcagttcagaaactctgcagatggtggactcag

SEQ ID NO: 20393 - DNA, 121 bp, Artificial Sequence
  Synthesized
  misc_feature (61): n=a or g
acagtcttaaggatatttgtttgaaaagtaaccaaatgggaagcagaccttttccgttccntagctgtgcactgcagtgacgagcactagctgtttcaatatatccctcttccaaaaacta

SEQ ID NO: 20394 - DNA, 121 bp, Artificial Sequence
  Synthesized
  misc_feature (61): n=a or c
gatgctactgctgctactattagcaatagctaagctgtactacttgcaacacagatgctgngttaaacaaaatgagacatagtatcactcaaaccactgaaagtgctaagactctatatta

SEQ ID NO: 20395 - DNA, 121 bp, Artificial Sequence
  Synthesized
  misc_feature (61): n=a or g
ctcagctctccaccacctcccatctcatcacacacagaaatggcacggagttgtgccttcnggtacctgcagggcaggagcacactctcttctcctgtaggaatcacctgtggaaatgcac

SEQ ID NO: 20396 - DNA, 121 bp, Artificial Sequence
  Synthesized
  misc_feature (61): n=t or c
acatgtacagatgtttagttaatggtaaaatagtcatagaaaacttacagtcaagttcatnactttcagaaagactgttgcttctcttttcacttacccaacactgctttacatgttcaag

SEQ ID NO: 20397 - DNA, 121 bp, Artificial Sequence
  Synthesized
  misc_feature (61): n=a or g
gagagatcagtctagaattcctcttaaatcaaattatcccatgccatttcaacccacaacntcattgtcacatctgtcataaatatgggcagataagtgctttaatactggaatatcatga

SEQ ID NO: 20398 - DNA, 121 bp, Artificial Sequence
  Synthesized
  misc_feature (61): n=t or c
ctccctgcttgtgcagattttccatggcttcaagtgcaaagctggccacacagtggtccangggcacctcccagatgagtcctgctgcccaaatgaagcagaggatgggcaagcaagagct

SEQ ID NO: 20399 - DNA, 121 bp, Artificial Sequence
  Synthesized
  misc_feature (61): n=a or g
gatggcagtggctatgcagagcaggatgcgccattcccagcatatattttcctgctaatancgccgtgctttaatatccagcagtgacaagaagggaggagaaaaggatagagcatttcag

SEQ ID NO: 20400 - DNA, 121 bp, Artificial Sequence
  Synthesized
  misc_feature (61): n=t or c
gcaacaaatgagtatttccacagtccttttgaatgacacagtgaaaagtgaatgacacaanggaaagtgaagtgaacttctagaaacctgcgatgtccatcttttttcacctttctattgc

SEQ ID NO: 20401 - DNA, 121 bp, Artificial Sequence
  Synthesized
  misc_feature (61): n=a or g
taaaattcttaaactgttttgtatgtgcacgtgtctcttgccaccgtcactagcaggtccntgtggacatacagcagagttcttaacagcagaggaataaaatagtcaagtcattcaggac

SEQ ID NO: 20402 - DNA, 121 bp, Artificial Sequence
  Synthesized
  misc_feature (61): n=a or c
ctgcctaatcttactctctgagcctagagaagggactcttcctccttctcagcagccctgnagattctgcccctcctttctacattactggagcaatggtaaggtattcctttgggtagca

SEQ ID NO: 20403 - DNA, 121 bp, Artificial Sequence
  Synthesized
  misc_feature (61): n=a or g
cagtttttgtgaaaacatgggaacaaatcagacaagggcttctccgagagtgagtttgaantgctgtccaggctgactgtgccaggaagaagcatgccagcttctgcactcagtggcacgg

SEQ ID NO: 20404 - DNA, 121 bp, Artificial Sequence
  Synthesized
  misc_feature (61): n=a or g
gatctcttactaatactcccgctccttccctttctctatcctcctataattaaggatcacntgctctgcttggctaccctatcaaatacaacgtctgtacagaaaaacatcacctaaaggt

SEQ ID NO: 20405 - DNA, 121 bp, Artificial Sequence
  Synthesized
  misc_feature (61): n=t or g
aagaggtctgtcggcaggtgtggcttttttggagttctatgtaactcctttctaattcctnagcaccagtaatctttgaattttcaggtagccagtcagcagttgcaagcaatgtggacaa

SEQ ID NO: 20406 - DNA, 121 bp, Artificial Sequence
  Synthesized
  misc_feature (61): n=t or c
cattgacttctggaatactaaaaatcatcaggaataaatataataaaaatttagcaagagnacaaacactgaggattttggaaacaggattctttgatgggctatttttttaattctgaat

SEQ ID NO: 20407 - DNA, 121 bp, Artificial Sequence
  Synthesized
  misc_feature (61): n=t or c
tgtctaaaattcactcatctgtcgctacatcattgtgcattttctaacaacaggtgttggnactgggacagttagtactatgaagtactgaagggatgttgaggatcctatatttttttgg

SEQ ID NO: 20408 - DNA, 121 bp, Artificial Sequence
  Synthesized
  misc_feature (61): n=a or t
gtacgcacttaagagatgaacataaatgactctgtttagtgaggcaaatctggattacatnagagtgaaacacaaaatttgtgaaaactgtgagggttgtttcttgcaaggctgatcaaaa

SEQ ID NO: 20409 - DNA, 121 bp, Artificial Sequence
  Synthesized
  misc_feature (61): n=a or t
tgcacgtcctttggtacttcatacatctggtagagccaaatgctttcttggcaattcctanccactgttaggaattcagtgttctctacacagtcaggccaagaggttttaaaaatacaga

SEQ ID NO: 20410 - DNA, 121 bp, Artificial Sequence
  Synthesized
  misc_feature (61): n=t or c
tagatttcagaaatgaagtaaatagcctgaagtatttcaatggaagtgtatactattccangtaattgagtctaagagaaaagaaagtatttcattgttaaataggggagtaccattgtgc

SEQ ID NO: 20411 - DNA, 121 bp, Artificial Sequence
  Synthesized
  misc_feature (61): n=c or g
tataaaaagtgattcacctgtgtggaaagtaagtattgtaacaagaagtcagttgtttcantaggaattcaccttgtcacctcactgtttcactaatagtttaccttgttgccttcccatt

SEQ ID NO: 20412 - DNA, 121 bp, Artificial Sequence
  Synthesized
  misc_feature (61): n=a or g
tccatctctctgacataattgtgaaattaaaactgtgtgtacccatgtatcttgacacaancagtagttacaagaatgcacaagaacaatgtacatacccatcctctttaaaattattttc

SEQ ID NO: 20413 - DNA, 121 bp, Artificial Sequence
  Synthesized
  misc_feature (61): n=t or c
cttcaggttccttgtgaagactccaaaatgcaaaaccattccagcgatgttgttatattangtatgcttttctgaagggtgatgttactgctgtaacacttcagcttttggactttgaacc

SEQ ID NO: 20414 - DNA, 121 bp, Artificial Sequence
  Synthesized
  misc_feature (61): n=a or g
tcattaggtgataaaactgaaatacttggcaattcagcaataattatagataaagtacagngggagacccccaaaatcccggtaattacattcaatagcttcaaaattgcttggtgatgtt

SEQ ID NO: 20415 - DNA, 121 bp, Artificial Sequence
  Synthesized
  misc_feature (61): n=t or c
ggcagctaggcatgttatctaaggaatttcctttatacttctgaacagggtacatttctangtggtagtagggatgtttgtagtggttacagtgcatgtgatttttagtaaaatttctgaa

SEQ ID NO: 20416 - DNA, 121 bp, Artificial Sequence
  Synthesized
  misc_feature (61): n=a or g
tctcttgtatttagttttcaatggtaggaatggcagtggacactgtttcctaaccaacatntttagtgcctttagagagcatgtgtggtgtgttaaaacatacgcaacgcatctctgatgt

SEQ ID NO: 20417 - DNA, 121 bp, Artificial Sequence
  Synthesized
  misc_feature (61): n=t or c
aaggatgttccaagtaaatagagttttcaaataaatagcattccatgattgaaataagcanctgtgtttttaaacagcaaacccaagaggaacatgctatgagacatggcaacaccactga

SEQ ID NO: 20418 - DNA, 121 bp, Artificial Sequence
  Synthesized
  misc_feature (61): n=t or c
aattcttctttttcccccatccagcttctgcatcattccaaatttatatcttgattagctnctctgcagccttagttttccatcattgaaggttacagattattttctgtagaaaaataac

SEQ ID NO: 20419 - DNA, 121 bp, Artificial Sequence
  Synthesized
  misc_feature (61): n=t or c
agtgctggacagcgcctcgggggctctgggcgttgcagatgggagatggggctgaaccccnctccctactcagtgtctgtgatgatgcatttctggagctgtgagatgcagtgcccaaatg

SEQ ID NO: 20420 - DNA, 121 bp, Artificial Sequence
  Synthesized
  misc_feature (61): n=t or g
gttaaatgttatttcattttttgagctacgctaaatgaatgaaactgttttaatgggatangcaactgatacacaaatagcatcccatgctgatgctttagcactgaataagctaaacggg

SEQ ID NO: 20421 - DNA, 121 bp, Artificial Sequence
  Synthesized
  misc_feature (61): n=t or g
tctacatacaaaatactttctgactgcactctagccagggactatttgatcagagtgtcantccagatagatctacacctctgatctgtctcatttgagatatttcagagaagagaaggat

SEQ ID NO: 20422 - DNA, 121 bp, Artificial Sequence
  Synthesized
  misc_feature (61): n=t or c
ggtttgcattttcaaaaaatattaaacaattataggagtatcagattttaagcagctaatnttgaaagctttaaaagtaacctgatcttcacaactgaatagcgcccacagtctacaaaat

SEQ ID NO: 20423 - DNA, 121 bp, Artificial Sequence
  Synthesized
  misc_feature (61): n=a or g
tctcttgaagtagaaaattgcactgctatttacaaatctgacttgcactgtttgttcattncactatacatctgtaattgagttaagtcgcattttccaaagctctgaagtcaccttcaag

SEQ ID NO: 20424 - DNA, 121 bp, Artificial Sequence
  Synthesized
  misc_feature (61): n=a or g
tcaaaagagaagtgatctgctggggagaaaaatccaagataggcaaacagcatacagaagngacaggacatggattaaaatgactgcactcaagggtcttttctgtcagacttttccttct

SEQ ID NO: 20425 - DNA, 121 bp, Artificial Sequence
  Synthesized
  misc_feature (61): n=a or t
ggtatccagacacacagcttttttaggccgcaggtgcttttgagcaagcacaagacttatncacttggattctttaaagatggaaaaaaggtccttcgatattttagtacctttggagcta

SEQ ID NO: 20426 - DNA, 121 bp, Artificial Sequence
  Synthesized
  misc_feature (61): n=t or c
gaatgaatttgagttttgatcctgaaaatgattaactcctttgtcaacttctcatatatantttttttaagacaagaagactaagaaagtcgcacagttaatcgcaggagaattttattct

SEQ ID NO: 20427 - DNA, 121 bp, Artificial Sequence
  Synthesized
  misc_feature (61): n=a or g
gatctgcatcaggagatctcatgagatttcttctttcagagaagctttctgtttcaacctnaggaaactgcctggggaagaccccacaaaataccatcttccatttatatcccaatgactt

SEQ ID NO: 20428 - DNA, 121 bp, Artificial Sequence
  Synthesized
  misc_feature (61): n=t or g
gatttagagagagccaggaaaatacaaagtcattatggtaactaaattgatggggtttttngttaccaagttactgatcagtctctgttctgttctagtggtcagcattttctgaaatact

SEQ ID NO: 20429 - DNA, 121 bp, Artificial Sequence
  Synthesized
  misc_feature (61): n=a or c
ctagtattcatttcacagaatcaaattattcaccacacacattaactgagacaattactgnaacactgagatcagatcagctactgtatcttgaaaagaaagaaaaaaggaaagaaatgac

SEQ ID NO: 20430 - DNA, 121 bp, Artificial Sequence
  Synthesized
  misc_feature (61): n=c or g
catgcttactgctgttaaaatgtaacagcaattctgtaaataactggaatgttcttcaggnacaaactggatgtagtagaaaatgttgagttaccgtaaagtcaacctcagagcactgttt

SEQ ID NO: 20431 - DNA, 121 bp, Artificial Sequence
  Synthesized
  misc_feature (61): n=c or g
tctgctttagttaccaagcaggccgccatctgcacctccaaaaccaggcagcaaaatcctntctcttcccagcccattcatgaatttcatattgcagtattctttcattcttagtgtttaa

SEQ ID NO: 20432 - DNA, 121 bp, Artificial Sequence
  Synthesized
  misc_feature (61): n=c or g
agcccatctgccccaagctgtgctttaggagttagctttctggcagcagcttgccaccttnttgttagatctgcagcagcgttgggctggctcagagtgagcaaaacgaatccagcagtca

SEQ ID NO: 20433 - DNA, 121 bp, Artificial Sequence
  Synthesized
  misc_feature (61): n=a or t
gttgcctggactctgaaatgggagtttatcaaggtgcatcagtatgttaaagctgtatttntgggttctagtctcactgctgtgagaactgaagatcaacagtaaggaaatcataattcac

SEQ ID NO: 20434 - DNA, 121 bp, Artificial Sequence
  Synthesized
  misc_feature (61): n=a or c
cagcgtgaacttggcctacgtttatcctcttgctgtctacctagatgctctaagtttctcngttttgcatttctagtagtaggcactcatgagatttttttttttatgttgcattactggc

SEQ ID NO: 20435 - DNA, 121 bp, Artificial Sequence
  Synthesized
  misc_feature (61): n=a or g
gccagaccttgcagtcttggcagctttagcaccagaacagtagtacgcatctgtgcccacntgctatgcagtcatgatgatcaggtgtgttgaatcacctgaacctttgggaaggaagtac

SEQ ID NO: 20436 - DNA, 121 bp, Artificial Sequence
  Synthesized
  misc_feature (61): n=t or c
ggccagaagcacggcagggaggcttattaggcaatggcagtagtggcaagccagagaaacngttctgtaaacatattataaggtcttaaagattttctgtggtcatgcagatctgctactt

SEQ ID NO: 20437 - DNA, 121 bp, Artificial Sequence
  Synthesized
  misc_feature (61): n=a or g
tcagctttcttgcaggaaagactgagcttattttgtaagcagttgtataaggaagcagganacggagggagatgataaatgcaaaaggctgcagagcacttcagtgccaaagcagaattgg

SEQ ID NO: 20438 - DNA, 121 bp, Artificial Sequence
  Synthesized
  misc_feature (61): n=t or c
ttttgtccaacatgcttcacttcacaaaggaagattcaatagtttcatttgaatcctgcgnctcttttgcaacatctgatggataagagggaaaaggctctcttgcttaaactctgaaata

SEQ ID NO: 20439 - DNA, 121 bp, Artificial Sequence
  Synthesized
  misc_feature (61): n=c or g
actttccagatggagtcagttctatgaaagactaaaatcctggatgttatacaggcaaaantgtagtgacctctgggaagtgaaatatagttgcttttgtcgttatcaattaccttctatg

SEQ ID NO: 20440 - DNA, 121 bp, Artificial Sequence
  Synthesized
  misc_feature (61): n=a or t
gtgatggtgctggggatacccatttggtcaagtcccttgccctgtgtgaatgttatctcanttattaggatcagtcacatctttttatcccttttagagcacaaagtctaggagatgatag

SEQ ID NO: 20441 - DNA, 121 bp, Artificial Sequence
  Synthesized
  misc_feature (61): n=a or g
caatggctgttagaagccaactgctgcttttcatctttgttctaaatgtctttgaaaaacnatatgattcctcttctttcatttaaaatctatttgttctttgtgtttgttgttgattttt

SEQ ID NO: 20442 - DNA, 121 bp, Artificial Sequence
  Synthesized
  misc_feature (61): n=t or c
cgggactggaaaccctatgatgggactggagcctcaggatgggactggagccttgggacangacacggtgctgagcagggcatcccctcacacccacccatacatgctgcagaccccaaca

SEQ ID NO: 20443 - DNA, 121 bp, Artificial Sequence
  Synthesized
  misc_feature (61): n=t or c
ttctttttattacttggtttggaatagctcttatagtgtttgattgtttttattccactgngtggatatttgctaaatactaaatcaagttgttttattgattgtgttttcaagtttccct

SEQ ID NO: 20444 - DNA, 121 bp, Artificial Sequence
  Synthesized
  misc_feature (61): n=t or c
atttccagcaagcagttgacaaatcaggtcaggggtggctgaatatctccacgtatgagcnatgtagcagttatttctatggaggggtcaaacgcaggaagaagttgccagaggtgttgtg

SEQ ID NO: 20445 - DNA, 121 bp, Artificial Sequence
  Synthesized
  misc_feature (61): n=a or g
tcaggattttgctaaacagccctccccaggaattcatgctcactatccacctttctttcantaccttgtcaacttgcccatttcctccttccgaaaagatgtactgctactgtggaagact

SEQ ID NO: 20446 - DNA, 121 bp, Artificial Sequence
  Synthesized
  misc_feature (61): n=t or c
caccttcttctcaaaagcgccatctctcacattaccaaaaggacaccaaaacaggaatgtncacaatctccccacgtactacaaaaacctggatgttctaagccctgcctatggggcaagc

SEQ ID NO: 20447 - DNA, 121 bp, Artificial Sequence
  Synthesized
  misc_feature (61): n=t or g
acagaaaatggtagttggctcaagaaaggaaaaattaaatgggcaattaaatcttaatcanatcttaaaccagtttctgttgctggtgcttatggctttggagcttggtgtcatcatttct

SEQ ID NO: 20448 - DNA, 121 bp, Artificial Sequence
  Synthesized
  misc_feature (61): n=t or c
ggagcgtatcttccagcttgtttaggggaagcccagtctttattcaccaatactacttgcnagcatgaaccacagcagactgagtagcaatgtttgcttttccaaccctctcagtgactta

SEQ ID NO: 20449 - DNA, 121 bp, Artificial Sequence
  Synthesized
  misc_feature (61): n=a or g
ctctctaattaaccctccaccagcattgacacactgttattcctttatatggacagatgtnactttgctgatttgcctcttggattaaatatacaaataatcctccatctgaaattatttt

SEQ ID NO: 20450 - DNA, 121 bp, Artificial Sequence
  Synthesized
  misc_feature (61): n=t or c
aagcactgggatagctgcagaacggcacagatggcccttcctgacacggtggagatttaanggcaccaaaactccaactcttctctctggaaaagagatatctcatcttcgaaatcaccgg

SEQ ID NO: 20451 - DNA, 121 bp, Artificial Sequence
  Synthesized
  misc_feature (61): n=a or g
ctgtaaaaatctgtaactcatgacaagatcacaggtgtcactgtcacagtgatcagaaacnaagccaatatgtggaaaccaggatgcaagtctggctgaaactgacctacactctattatg

SEQ ID NO: 20452 - DNA, 121 bp, Artificial Sequence
  Synthesized
  misc_feature (61): n=a or g
gggcccttgctaggtacaaaaatagcaaagcaggccagacatctagtcggcaagatgctcntgttcctcaccatggaacacagggcagccatttgttatgagtcgtcactgggaggattct

SEQ ID NO: 20453 - DNA, 121 bp, Artificial Sequence
  Synthesized
  misc_feature (61): n=a or g
caagcagatatgcttgtgctgagcccttccaatctgaattactgcatgatcccacctttcncaaacccagctgtatggaagacaattccttcctttacctgacagctgtggttttttggct

SEQ ID NO: 20454 - DNA, 121 bp, Artificial Sequence
  Synthesized
  misc_feature (61): n=c or g
aaatgttgttgttaatgtactgtctatatggcactaggagacctgtgggattggttaaatntcaatgtaatatagagaatatctctgcctacatctttctgtcaggccctggcttgggtga

SEQ ID NO: 20455 - DNA, 121 bp, Artificial Sequence
  Synthesized
  misc_feature (61): n=a or g
tcaagtagtttgggtagacatttgctacttctgtctttagtgagagagggaagaatatatnacaagaatgggatattctgccttcctggtcttgcctttctgccattttccttctgtcctt

SEQ ID NO: 20456 - DNA, 121 bp, Artificial Sequence
  Synthesized
  misc_feature (61): n=t or c
acaacaaatatttgttcccaagttctccaaccagcatgagctcctccttatgccagccagntgcttggcaagagttgcttcctgttgttctcatgcatcaaaatgcttcagctaggccagt

SEQ ID NO: 20457 - DNA, 121 bp, Artificial Sequence
  Synthesized
  misc_feature (61): n=a or c
tagtttcgtcttatctgcagacataatgagggacctactgaaggtgaagaatactggcacntgtcctattgtgtcttgcaaatacaccaaatatgtaattccttattattactgctgtaat

SEQ ID NO: 20458 - DNA, 121 bp, Artificial Sequence
  Synthesized
  misc_feature (61): n=t or c
ttctgttcaatgtgttcacggtctccataaaaattagtaaagacagaatataatcccaaanacagtgcatttgctcacgtgtactcatgtggatgttgttggtccacatctggttaaaata

SEQ ID NO: 20459 - DNA, 121 bp, Artificial Sequence
  Synthesized
  misc_feature (61): n=a or g
agtcaagacagcaaatctgattgaggtcccttggaagcaaagccccgcttcaggtctaacnctcaggattttcatcaactgcctctgcaagcagaggggaatgcaggtattaaactgaaac

SEQ ID NO: 20460 - DNA, 121 bp, Artificial Sequence
  Synthesized
  misc_feature (61): n=t or c
cctgtgctctggataagcaaagggtggtaggatttgatccattcacatacttcaagaccanggctttttttagctgtgacatatggcagtagtggaggaacagcttgacagtttccgttca

SEQ ID NO: 20461 - DNA, 121 bp, Artificial Sequence
  Synthesized
  misc_feature (61): n=c or g
attaacgttgccatgttaatcagtttgccaggcaccaaacagagctgttctcagagccatnaactgttggaatgtgaaggaaacagaaaaccagttaacaggttttcagtaaggacacata

SEQ ID NO: 20462 - DNA, 121 bp, Artificial Sequence
  Synthesized
  misc_feature (61): n=a or g
tttaccaccaaggttctaccttggttcttctttgttttgtcgaataacctgatgtctgttncaggaactaactttcagagagatgtctcaaatatttaatcacagttcatactttcataac

SEQ ID NO: 20463 - DNA, 121 bp, Artificial Sequence
  Synthesized
  misc_feature (61): n=t or c
gttgcagtgtttagacagtccgtgttattgctgcaatacattttgtctctctctttgaagntaatatcaaaatgtgagtgacacagaggctctctgccatcccagcatcctgtgcaggaca

SEQ ID NO: 20464 - DNA, 121 bp, Artificial Sequence
  Synthesized
  misc_feature (61): n=a or t
actttcaattcccattgttactaagagccacatcctgcccacatggcttttgccacgaaangactggaggacaacatttgactcaccccagatgacatccactatttccacaagatccaca

SEQ ID NO: 20465 - DNA, 121 bp, Artificial Sequence
  Synthesized
  misc_feature (61): n=t or c
ccaaaccacactccactgggtctgttttcattggctgggctcttttctatggtgggaatcnaaactgtgcgctgcacacgaagcaagtcaggttcctgcagggccacagacgtgcagggaa

SEQ ID NO: 20466 - DNA, 121 bp, Artificial Sequence
  Synthesized
  misc_feature (61): n=t or c
gtaatgttaatgagaatcactccatttctttgacactattaaagacacaaggattaaaaantgtatagaaatagtagattttcttgttagttatgtaacaacatccttaatctgaatggtt

SEQ ID NO: 20467 - DNA, 121 bp, Artificial Sequence
  Synthesized
  misc_feature (61): n=a or g
cacggaatactagcacattctcaaaaacaaagaagcaaacatgcagccaacctgttagccntgatacaaaatctttctagattggaacgtacgaacgaaaacatgctgatctgcagcttgt

SEQ ID NO: 20468 - DNA, 121 bp, Artificial Sequence
  Synthesized
  misc_feature (61): n=a or g
cacataggtgcagtgccagaggactgcaggaaagctgcagtaagtgaagaaacaaacaacnaaaacagccaccacaaacaactcttccctcactcaaatcaattattaagatgcctcagtc

SEQ ID NO: 20469 - DNA, 121 bp, Artificial Sequence
  Synthesized
  misc_feature (61): n=a or g
tggcaacattttgggtacagctttcataatgtgcaaaatctgataagcaattcattttacnctaaggaatttaacccaataccaaagagattgtaagaatatatttgttccaaaaacttaa

SEQ ID NO: 20470 - DNA, 121 bp, Artificial Sequence
  Synthesized
  misc_feature (61): n=a or t
tctaaagatgtgcatgctacataagccatcttttaatccaagcaatttagctgtggatgcncttgccatgtgtgctcaagtgaaataatctcctgctctgactgtggttgacaccttttct

SEQ ID NO: 20471 - DNA, 121 bp, Artificial Sequence
  Synthesized
  misc_feature (61): n=t or c
ctgacattttagatcactgtgctattacaaatgcttgtggttgctgtaagtttgttggtgnctgtatgagtcagtacatcattacctattatttgccttaattaaaaaggatctcaagtat

SEQ ID NO: 20472 - DNA, 121 bp, Artificial Sequence
  Synthesized
  misc_feature (61): n=a or c
acctgggaccagaagtggagctgaggtggagaagcagaaaggaggaaggcaagaggatggngtgggtgacccaagcatcatcctgcaccaggaccccagggatgctcggagccatgggatc

SEQ ID NO: 20473 - DNA, 121 bp, Artificial Sequence
  Synthesized
  misc_feature (61): n=a or t
tatttaaatagttttcagaaatatatcaaaagtcttatttcattggtgagaaacaagttcngtgaaaaacacattatcattagtgacttagaagacattgtaagacaatctatgtgattca

SEQ ID NO: 20474 - DNA, 121 bp, Artificial Sequence
  Synthesized
  misc_feature (61): n=a or g
gaagaagagagcatctccattgaggtggatggcgatgctccactccagagtgctcataacntgctcagagatccttgacaaaaggagcaatgcaatatacatgtgaagtgttgttattatt

SEQ ID NO: 20475 - DNA, 121 bp, Artificial Sequence
  Synthesized
  misc_feature (61): n=t or c
gtatccaattaaaaagctggtagccacaacgagaagagggtcagtggttcactgctaatgnaagcagattttgttctgattcattaagtcattaactcccttttaattggaactcctttat

SEQ ID NO: 20476 - DNA, 121 bp, Artificial Sequence
  Synthesized
  misc_feature (61): n=a or g
cacatccttgctacctttcatctttatacaaaatgacagtgaacaagtcaagagagatatnttacagagccagaagactttgatccacagcactctcaccagctcagttcttaaggcaatc

SEQ ID NO: 20477 - DNA, 121 bp, Artificial Sequence
  Synthesized
  misc_feature (61): n=t or c
tagttccttcttcacttcctcggttaaataactcggaaaaaaaaatgaggcaaatcagctnagatgtggaaactcacgagtggcatagttttttcaagcagccttaacaggttctaggtgt

SEQ ID NO: 20478 - DNA, 121 bp, Artificial Sequence
  Synthesized
  misc_feature (61): n=a or c
gcctgaacttcttcgtagcattaccaaaatagctgaagagctagtagtttaacctgccctnatcataattgaagaatgttaatgaggagcagctaagggaactgggatcgttcaggctgga

SEQ ID NO: 20479 - DNA, 121 bp, Artificial Sequence
  Synthesized
  misc_feature (61): n=t or g
gaaggggcactcttttgcttatggttttctgtaaacaagcagaaatctgaacttccatgcntctcttctcccttacagcgtgcttgtgttatgggaagagaggagtgggacagcagcagcc

SEQ ID NO: 20480 - DNA, 121 bp, Artificial Sequence
  Synthesized
  misc_feature (61): n=a or g
aataggagcaagagggaacatattgcaagaggtcacatgaagccaaaagaatatgaagtantgaaagggtcaataaagatcagtgaagagccctagaatgtgaagaattcctgggcataat

SEQ ID NO: 20481 - DNA, 121 bp, Artificial Sequence
  Synthesized
  misc_feature (61): n=t or c
aaaaaaaaaccaacaaataagcaacaaatctatactagtgattacagctcaaatgctgagngtaagctacttggcagcaccccctaagagagggggaacctgccctatagaacacctgccc

SEQ ID NO: 20482 - DNA, 121 bp, Artificial Sequence
  Synthesized
  misc_feature (61): n=a or g
ggcttttgctgtatgggtttgggtttcaacaatgctctggttgctttgtacctatgtatgnctcttggaagccttgagaagcagatgagctaagttttggctattggtggctttttctttt

SEQ ID NO: 20483 - DNA, 121 bp, Artificial Sequence
  Synthesized
  misc_feature (61): n=t or c
ctagagcatggagcaggaggggttaaaagcacttttgccctctggggaaagagtagtcagntctatctgatcatggcttcaggcctccagtcctttccatcttatcgctgaaccaggccct

SEQ ID NO: 20484 - DNA, 121 bp, Artificial Sequence
  Synthesized
  misc_feature (61): n=a or g
accgtctgcctcattaggggaaacttgccttggtgatatctgcaggtagcaggatatttgnaggagcagaatttgaaaatactgcgtttgatgataatgggtggttttaaaaatcaccact

SEQ ID NO: 20485 - DNA, 121 bp, Artificial Sequence
  Synthesized
  misc_feature (61): n=a or g
gtccttcctttgtattgcaccaaagaagagtaaaataaacatccataattttctttccagnttcgctacagtgagtctgagtttctgtcccctaagttttgcacagtacgtttgcactaca

SEQ ID NO: 20486 - DNA, 121 bp, Artificial Sequence
  Synthesized
  misc_feature (61): n=t or c
tttacttgtcaaaagtgtcttatataaagctaatagcttttgttattacttgaattgaaangaagtattggtttagaggactgtttgtcaatactttgttataaatcagtaagaggggtta

SEQ ID NO: 20487 - DNA, 121 bp, Artificial Sequence
  Synthesized
  misc_feature (61): n=a or t
agaaaaacacatgactctaggagctgaattttaaaccttgaagcaaaaggttagatgcaancctcaagagagaaatctcagatgttggcagtgctgttcctggaggcagaaaatgagtagg

SEQ ID NO: 20488 - DNA, 121 bp, Artificial Sequence
  Synthesized
  misc_feature (61): n=t or c
ctgcaggtgatgtgcattgatttacatcaactttttgttggaatcccttatcaatctgttntgaatctgagcaaatcttaccttgtaaactgtattgagctcctgtttgcaccatactgca

SEQ ID NO: 20489 - DNA, 121 bp, Artificial Sequence
  Synthesized
  misc_feature (61): n=t or c
ccccaatggctgacagcgtgccctctaccaaagctcagggctgtacggacaagcagatggngggcagtgtgccccggagcaaacagtacctggggaggaactgcctttctgttgcagcttt

SEQ ID NO: 20490 - DNA, 121 bp, Artificial Sequence
  Synthesized
  misc_feature (61): n=t or c
cacatgaaggagtgggatacaagcacagttcaagtactcaccatttaagtgccagtgctcnagtcagagaaggttctttagtttcagatgttagcccacaaagcagaagatttggtgcctg

SEQ ID NO: 20491 - DNA, 121 bp, Artificial Sequence
  Synthesized
  misc_feature (61): n=t or c
ttagtgtgctttgtttagttaaaggagcacagcagactccaaataatataacttggagttngattctccctttaacagaggagtaacagattcagcaatgccaataaaatgaatcccagtt

SEQ ID NO: 20492 - DNA, 121 bp, Artificial Sequence
  Synthesized
  misc_feature (61): n=t or c
ctagaaataaaatgcctctccagaagagcttgtatctgcttgtttcaaagtggaaaatgangagtagctcatgtgaaacaatatgctcttagcattgcactttgttaagaactgatgactt

SEQ ID NO: 20493 - DNA, 121 bp, Artificial Sequence
  Synthesized
  misc_feature (61): n=t or c
caagaaactgttgcagtaaaaatacagctgaaaactaggtcatgatgttctgagggagaangagactccaagaacacaaataccttttccaagctaagtgtgattccactgatctataaaa

SEQ ID NO: 20494 - DNA, 121 bp, Artificial Sequence
  Synthesized
  misc_feature (61): n=a or g
tttgcttccaccttacagtctgaaaacatggaagccctcataagaatgataagaaatcagnagctatttggaatatctcatcttccagtgagaacagacctggaactttccttcagatcca

SEQ ID NO: 20495 - DNA, 121 bp, Artificial Sequence
  Synthesized
  misc_feature (61): n=a or g
gcaagccacctgcatttgatttgctgtcagcaggactggttagcagtttagcttgaaaccnggccaaggtggagagagcttccctcctgccatcccccgtcatgctgcaaatacctcctgc

SEQ ID NO: 20496 - DNA, 121 bp, Artificial Sequence
  Synthesized
  misc_feature (61): n=a or g
ttgtaggcaaaggggagaaagggagaagacaaaggagtaacaattctgtttagataataanaaatgagaaaggtgaactgatgaattaacaccgtcctgcagtcgtgcttcacactacctt

SEQ ID NO: 20497 - DNA, 121 bp, Artificial Sequence
  Synthesized
  misc_feature (61): n=a or t
acagcaatcaaccaactgaccaagaagcagacaagtagccccacagcatctcacagacatncattggccgtaaagtgcccagtcagataggtacaggacttaccacaaaatagccacattc

SEQ ID NO: 20498 - DNA, 121 bp, Artificial Sequence
  Synthesized
  misc_feature (61): n=t or c
gtgtttttgcatgtatcaaatcgttaatgtgagctgcagtattcacagtgtaatattaagngtaggtgtttaaaaactctatcacgtgagatatatggtcatgcttgactttttaaaaaaa

SEQ ID NO: 20499 - DNA, 121 bp, Artificial Sequence
  Synthesized
  misc_feature (61): n=c or g
aacatgataacatcaaacactataccacttagaagaccatggtgcacattgacaatcttgnctgaacagcccttccaaaaccactgtatagtctgtaaatggcacctttagacttccatct

SEQ ID NO: 20500 - DNA, 121 bp, Artificial Sequence
  Synthesized
  misc_feature (61): n=t or g
cagcgcggtaggggagaaggaagaagaaagaaggtaaagtccattttcaggagcttcattncaaatgcatttttgtgcatgaagtggtgaggctgttagaaactagtaaattattgcatga

SEQ ID NO: 20501 - DNA, 121 bp, Artificial Sequence
  Synthesized
  misc_feature (61): n=a or g
ctataatgcagtttgtgccaaaggatggactgctttctctccccaggtctgaaaacttaantgaaagtaactttatgctttatatgattgacatggttaaattatttttatacattcttgc

SEQ ID NO: 20502 - DNA, 121 bp, Artificial Sequence
  Synthesized
  misc_feature (61): n=a or g
aggagggatggatgtgcattaaggggggatggatgtacagtggggttggatggatgtgcantgagagggaaggagggctgtgtgctgatgtggggaagcagatgagcagccgtcagagtgt

SEQ ID NO: 20503 - DNA, 121 bp, Artificial Sequence
  Synthesized
  misc_feature (61): n=a or g
ctgtttggttctgctgcctggtcagggctgagaggaaatgcccaagagtgtggcactggantctgcacctgggaggagccttcaggtgcatctctagcacctgcattgcagcactgtgact

SEQ ID NO: 20504 - DNA, 121 bp, Artificial Sequence
  Synthesized
  misc_feature (61): n=t or c
gagttcaggctgaatgttggctttgcaaataatcattattttcacttggagacctcatgangcacattcaggatttgttccccaggtgttaaaagctcaagcactctcatcccctgcacct

SEQ ID NO: 20505 - DNA, 121 bp, Artificial Sequence
  Synthesized
  misc_feature (61): n=a or g
agctagaaaagacaccaggtagaccttgtctagtcttacagctgattctactttgaatacnagttcagtctatatgacttctggatgctatctcttccaacttgaattatcccatgatgct

SEQ ID NO: 20506 - DNA, 121 bp, Artificial Sequence
  Synthesized
  misc_feature (61): n=t or c
agatgaccataagagcttggtggcaactgcaaaagttcctgattctgaaaggattcacatntgcttaccactactgcgcacaggtgcaatggcaagcaaaatcgttactagcagtgtaaca

SEQ ID NO: 20507 - DNA, 121 bp, Artificial Sequence
  Synthesized
  misc_feature (61): n=a or c
tgagagttctgtcagatatgctgattttcaaggaatcatgtccttctttccatctagcttnattaaagctactcaggtgtaagtacttcaaaggcacagctttttaaaatggaggaagctt

SEQ ID NO: 20508 - DNA, 121 bp, Artificial Sequence
  Synthesized
  misc_feature (61): n=a or g
atgacagtgtacaaggaacaagaagaactaggcagatgaatgtgagttagtgaggagcagncttccaaagcaggaaaaccaaattgagagtgtaaaccattatattcagaggaatctgata

SEQ ID NO: 20509 - DNA, 121 bp, Artificial Sequence
  Synthesized
  misc_feature (61): n=a or g
gtcttactactgaaagcaggtagcaggggatagagaaggtaccctgaagccctgtatgtgnatatctggtcagtacatcctttttttatttttcctcccgtttcctaatcatccagattta

SEQ ID NO: 20510 - DNA, 121 bp, Artificial Sequence
  Synthesized
  misc_feature (61): n=t or g
caaagaacaaagggttgatctaaaagatctccagtgtaggtggtggggtgcagaatgctgnttcctacttggctttacctaagtttggacactgttagatctgagagtgctgttttttaat

SEQ ID NO: 20511 - DNA, 121 bp, Artificial Sequence
  Synthesized
  misc_feature (61): n=t or c
cctaggcctgaagtctaactgccaggataaccatggctaaagataattctgtgctcaccgngagctaccaaagccaggacacagcagcaccagcagtaggagacccgcagagatggcgtcc

SEQ ID NO: 20512 - DNA, 121 bp, Artificial Sequence
  Synthesized
  misc_feature (61): n=t or c
atgttcccacaacacttctctcaattcttcagacccctctgatgccttgagccacaagcanacccttccaagaaagaaatgccacatcattgggttaccagcacttactctacaagccaga

SEQ ID NO: 20513 - DNA, 121 bp, Artificial Sequence
  Synthesized
  misc_feature (61): n=t or c
ttgcccaccccgagtgcttcactactgaacaagaaccctttttgggtttcttttttagccngtgaacagcagctggatggattgtaagtttacaggtatgttttgtacctcagaggcacaa

SEQ ID NO: 20514 - DNA, 121 bp, Artificial Sequence
  Synthesized
  misc_feature (61): n=t or c
aacagtatttcactgtatcacggtattttgctgtttgtgtagctgcatcttttagacattncatttcccatttggtatgtgcatgatgtgccaagtaacggttcgccagtggtgttgactg

SEQ ID NO: 20515 - DNA, 121 bp, Artificial Sequence
  Synthesized
  misc_feature (61): n=a or g
ggaggatgagctcccctggttagtgacaagccagggcttacgctagtccctgacgtggcanaacttgggacttccttgtcctgctgggaagctgacgcttcatgccgcaatgctgtcatgc

SEQ ID NO: 20516 - DNA, 121 bp, Artificial Sequence
  Synthesized
  misc_feature (61): n=a or t
ttagattacctgtgtaaccttgtgtcacgtcccccacatatctggataaagctacagtctntaattatgccctgagcattttatctgcaataggtcctacctgggctaaacaatagacttc

SEQ ID NO: 20517 - DNA, 121 bp, Artificial Sequence
  Synthesized
  misc_feature (61): n=a or g
tgctgtccacctccttataagaggatacagaaaagatggggctagactcttctcataagcntgtggtgatagggagagaggcaacagatgcaagctggaatgcaggaaattgcagttagat

SEQ ID NO: 20518 - DNA, 121 bp, Artificial Sequence
  Synthesized
  misc_feature (61): n=t or c
gagatcctgtagttttcatgtcgactaaaatacacttgactggcaagcagaggcagtgtgngctgggataaaacatctctagctgtaatgtttattgctttctgccaccataagcgctgtt

SEQ ID NO: 20519 - DNA, 121 bp, Artificial Sequence
  Synthesized
  misc_feature (61): n=c or g
gttctacaaatacagtacacatccctattttcctgcaatgcacaaagttcccctacctggntgtaaggagctgccttgtttgatacacatggcgcagtctgtgctcctgaaacagctgttt

SEQ ID NO: 20520 - DNA, 121 bp, Artificial Sequence
  Synthesized
  misc_feature (61): n=a or g
caaaatatttatagttagtaattcctttttgttttgtgaatctacaccactgtgtcagctnaggatctggcccatgctgagttattttcctcaggcagtcaggcagagaaacttaccataa

SEQ ID NO: 20521 - DNA, 121 bp, Artificial Sequence
  Synthesized
  misc_feature (61): n=t or c
atttgcacagacagccatcagtgtttgtagaagtgttgcctacaaaacctgacctcagcanttggccttagcttcatatttcactgcagaaatgccaaactgttcccgtgttgagtgagca

SEQ ID NO: 20522 - DNA, 121 bp, Artificial Sequence
  Synthesized
  misc_feature (61): n=t or c
agttctctagagtcttagagggtcatcatcactgtcatacagtgactttgtgtacaactcnctatattttcaccttgtggagctattttttcccctcttttttttttttttattattattt

SEQ ID NO: 20523 - DNA, 121 bp, Artificial Sequence
  Synthesized
  misc_feature (61): n=a or g
ctggcccctcttccactcctcttcaggaaaactccacagctatctccatgctttcaaagangactcaatgcttaaggaaggtcagatttattccagagcagaccttgaaattcaagtacaa

SEQ ID NO: 20524 - DNA, 121 bp, Artificial Sequence
  Synthesized
  misc_feature (61): n=t or c
tttcatctgatgtaaataaggatatacacagtagctctgagaatcccacgctgtcatgcangggctgtggttctttctatgaaatccaatatgagtcttcagagtatcctttgaagattat

SEQ ID NO: 20525 - DNA, 121 bp, Artificial Sequence
  Synthesized
  misc_feature (61): n=t or c
ccaacaagtgcatgtattactccgcttctcctgaatcagcattctctgggactggtcttcnagagactttgcttctacactactaattgtcccctagatgtttgttgcattatgaataagc

SEQ ID NO: 20526 - DNA, 121 bp, Artificial Sequence
  Synthesized
  misc_feature (61): n=t or c
cattgctctggtgctcactgtgtccattttccgttcccctctgatgcaccaggtgtgattngctgcttgataacagcctggctgcctgcactggtgcttgtgtcagtgatgtgattgctgt

SEQ ID NO: 20527 - DNA, 121 bp, Artificial Sequence
  Synthesized
  misc_feature (61): n=a or g
aaccttatatcccctccccaacccacatcctctcccactcctacatcctcttttgaccccntgtcttcttccaaacccacatcctcccaaaactccatcccacatcctctcccaaccccaa

SEQ ID NO: 20528 - DNA, 121 bp, Artificial Sequence
  Synthesized
  misc_feature (61): n=a or g
ttgtttgagaactatagactttcttgctttggaagcaaatgatcatatatgttaaaccatntcttttaaaatctggagtccagaatgctttgttttcatcttggaagaattgaaataatat

SEQ ID NO: 20529 - DNA, 121 bp, Artificial Sequence
  Synthesized
  misc_feature (61): n=a or g
caacactgccattccctctttcaaaccaatcatgctccatacccagcctaaagctcagccntcaagggctctgctaaaggaaatgagctttttccccagcttcctcaaagtgtttaatgac

SEQ ID NO: 20530 - DNA, 121 bp, Artificial Sequence
  Synthesized
  misc_feature (61): n=t or c
tcgattttcctcttgacgatagcccttcacctagatgcctccccaggcagctgtagtgaanggatctggccacagagggaatctggcccaccgaattccttttctttctgtgcaattgaat

SEQ ID NO: 20531 - DNA, 121 bp, Artificial Sequence
  Synthesized
  misc_feature (61): n=a or g
acattatttaaacattctaacatgcagcaggtgactcatcagaataaaagtggagtgtacngattctagaaggatgctagaggtttctgatgccagttgtggcataatgaggaaagcacca

SEQ ID NO: 20532 - DNA, 121 bp, Artificial Sequence
  Synthesized
  misc_feature (61): n=t or c
agaagcaattttgacaatattaaaagagttggtaaggggtagagaaagaggattcaagcancgtgtttcttcaaggataatgaatcctgctttgcaagaaagacaaaaggcaataataaat

SEQ ID NO: 20533 - DNA, 121 bp, Artificial Sequence
  Synthesized
  misc_feature (61): n=t or c
tgggaacggagaggtaaaactacagggaagtgttttgtgattgcattgctcagcatcagcnggagcagagcgcgaaaatcactcctttgaggtgggagtaaaccaaggatgtgaaacacaa

SEQ ID NO: 20534 - DNA, 121 bp, Artificial Sequence
  Synthesized
  misc_feature (61): n=a or t
cccgtgctatgagaacaacaatggaaaccatccaacctgttgcactttttcctatggaagnaagcagacaattcccctgaagccatccttcgaggagaaagtccccctttgtctcattccc

SEQ ID NO: 20535 - DNA, 121 bp, Artificial Sequence
  Synthesized
  misc_feature (61): n=c or g
acagcttaacatctgtctgatgagagacgtctggccttggggaacaatcctgctacctgtntcagctgtcttaccaatttctgagtgttcttagcattcaccctggatatacccatgttgt

SEQ ID NO: 20536 - DNA, 121 bp, Artificial Sequence
  Synthesized
  misc_feature (61): n=t or c
ggaaatgtgttggaaaggtataaactcttcaggaggtacaatttttggttattcatggccngagctataatttagagagactcaaagaccaatcatgattagtagtcaccatgtctaatgt

SEQ ID NO: 20537 - DNA, 121 bp, Artificial Sequence
  Synthesized
  misc_feature (61): n=t or c
tggccagaaaggacttttgcatctctagactacaggtaactgcactggttatttaggatgnacataagacttacttgcataggtcaccatgaaagattgagagcaacgtcccactgctgct

SEQ ID NO: 20538 - DNA, 121 bp, Artificial Sequence
  Synthesized
  misc_feature (61): n=t or c
aaaagtgtcttaaagcagtcaggtagttgatgacacacacgcccatactttggcaagacangagcatatgttcttagctgtggtcacttcccacccagcccatgcctgcttgacacacaca

SEQ ID NO: 20539 - DNA, 121 bp, Artificial Sequence
  Synthesized
  misc_feature (61): n=a or c
atgtatagaaaaggtcatgaattcatactcactctgggatgaatgttacagtgtatatgcnagaggtgaatggcatttgtgttatgtgatactgctatggaagacagtaaatcataaaatg

SEQ ID NO: 20540 - DNA, 121 bp, Artificial Sequence
  Synthesized
  misc_feature (61): n=t or g
agataagagtatagagctggattaaccttgatacctactgaatgactgagactttctgagnatgttggagaagacagtgcacctctgctccttttttagaataagattactttcttgcctg

SEQ ID NO: 20541 - DNA, 121 bp, Artificial Sequence
  Synthesized
  misc_feature (61): n=a or c
tggaatctctgtggtgccccggcaatcacaagtccctgctctctcttttaaaacccattangaacttgggaggtttaatttcaaggtatttctaagcacagtccttagatttcttgtacta

SEQ ID NO: 20542 - DNA, 121 bp, Artificial Sequence
  Synthesized
  misc_feature (61): n=a or g
ctgcacagcaagaaaccacgatgtcttaaaggaggctgagagctgagaaggatgcagaaangaggaaaaggatttaaatggagagagctcagattgcgtagacttgccatgaacttaacta

SEQ ID NO: 20543 - DNA, 121 bp, Artificial Sequence
  Synthesized
  misc_feature (61): n=t or c
cacctcatgggaacgtttcagagctatatgctgtaaatgagatatgcattttacagccctncttttgcatatgatgaactgttaaaccccatgtctaaacaggagaaagaatggctttgat

SEQ ID NO: 20544 - DNA, 121 bp, Artificial Sequence
  Synthesized
  misc_feature (61): n=t or c
tgactccgtttcaaaagcacacaccacctcatggctttaggatattggaatgtgaatgtanggtatggccaactttttgtgaattcctacctaaacataaaccagggtaaatggcttctgg

SEQ ID NO: 20545 - DNA, 121 bp, Artificial Sequence
  Synthesized
  misc_feature (61): n=a or g
ggaggattatgggagaatataaagagaatctgcagacagagaacagaatgacacacaactncagaagggactggatgactaacaaggtaactatacatttattagtcaatttgtagtagga

SEQ ID NO: 20546 - DNA, 121 bp, Artificial Sequence
  Synthesized
  misc_feature (61): n=t or c
tgagcgaatgggagaaatggtactgatgtgcacagaagaaagcaaaaatcttatcttgtgngtgtttcatttcagctgggacggaccctccgaagtcccttcatgaagtttgtggcacacg

SEQ ID NO: 20547 - DNA, 121 bp, Artificial Sequence
  Synthesized
  misc_feature (61): n=t or c
taacctgtatgtctgaaacaactcttttctgatgctcttccttgctattgcagtgttattncctttctttattctctgaggaggaaagttcatgaaaattcctcagatcattcctcagatg

SEQ ID NO: 20548 - DNA, 121 bp, Artificial Sequence
  Synthesized
  misc_feature (61): n=a or g
ttcaaaagggcaaaattccatataccatcccattttgccctctttcctagaaaaataaaantgtctttgagatacaaagctaatgacttgagaacacatgccaattcacgcttcatatatt

SEQ ID NO: 20549 - DNA, 121 bp, Artificial Sequence
  Synthesized
  misc_feature (61): n=a or g
aagaaggggaaaaaaaaaaaaggaaaattgatctttctgataccgacactttaaaacaacnacaaccaaaaaagccttttgaaattggtatttttgctaagggctggcgtgagaggaggaa

SEQ ID NO: 20550 - DNA, 121 bp, Artificial Sequence
  Synthesized
  misc_feature (61): n=a or c
gctcttttacagtctgtaaaagaggtgttatttcacagctacttggtcctttccctcttancattcagtagtcaaaaatcttatacagttcatcttcaggatacaagcaactcccccaaag

SEQ ID NO: 20551 - DNA, 121 bp, Artificial Sequence
  Synthesized
  misc_feature (61): n=a or t
atggttaatgtcccatacttgtcagtgttcaagaggcatttcgataatacactcaataatnaacttttctgttatccctaaagtggtaggctgttggactccataatctttgcagatccct

SEQ ID NO: 20552 - DNA, 121 bp, Artificial Sequence
  Synthesized
  misc_feature (61): n=t or c
cccgacaacgccccaaccctatgcaccccacaactctaagctcctataaacctcagtgctnacctcaggagcctagacacactcaacaccacaccgccttgcccacatcccatcccacagc

SEQ ID NO: 20553 - DNA, 121 bp, Artificial Sequence
  Synthesized
  misc_feature (61): n=a or g
atcctgggacctctttgcttaacacagatccagataaaattcaccaacttggttgtgtgtnatgagaaagtacacgtaatgatttgatacacagtctttcatgctctttggagaacgcttt

SEQ ID NO: 20554 - DNA, 121 bp, Artificial Sequence
  Synthesized
  misc_feature (61): n=t or c
ttacttttaaaataactagcagaatatgtcattcattctgatggcaccacaagtattctantgatatattaatgactctactgaatttaaagaattttttttctaaaaatatatgcaacct

SEQ ID NO: 20555 - DNA, 121 bp, Artificial Sequence
  Synthesized
  misc_feature (61): n=a or g
cttctttggtgacattcagtattttcagatgggttacattggcatctactctgtctattangtacttatccaacatcagggagtcgttgatggcgatctgaaaataaaaaattcattaggt

SEQ ID NO: 20556 - DNA, 121 bp, Artificial Sequence
  Synthesized
  misc_feature (61): n=t or c
ttctctttaggtgacctaacagggataccattgtttataaataagcattgtatctaactcncttatagcatacagcatgtggctgaaaaggctcatagaaaaatcagagaaaattcaaaat

SEQ ID NO: 20557 - DNA, 121 bp, Artificial Sequence
  Synthesized
  misc_feature (61): n=a or g
agctcactaccacctccctgagccccaacacccacgtgcaccagaatcacatcaggcattncaccagcagtctctaccttaacaggaaaacagagggaagagacaggcactcgggtaaggg

SEQ ID NO: 20558 - DNA, 121 bp, Artificial Sequence
  Synthesized
  misc_feature (61): n=a or g
gatccctggggctgccttcagacagcactgcccaggctgtgcttccacttgctgatttctnttgattcaaagggcacttacttacctttctccgctcttacaccagccccatgggtgtctc

SEQ ID NO: 20559 - DNA, 121 bp, Artificial Sequence
  Synthesized
  misc_feature (61): n=t or c
gacctcagtggtgcacaagtcatttgctgccctttgtccaggcgtgaatttcctcagcatnctttacactgaaaaagtcaactgactgagcttggcaaatggtcacactgagcccaattct

SEQ ID NO: 20560 - DNA, 121 bp, Artificial Sequence
  Synthesized
  misc_feature (61): n=a or g
tcaggaaaggtccaacttcacatgtgtatgtttctggcaggtgattcgttattctggagancctaagctactttgatcctctttttgtcccaggccctagctctggctggccaaggctggt

SEQ ID NO: 20561 - DNA, 121 bp, Artificial Sequence
  Synthesized
  misc_feature (61): n=t or g
atcttctttatacaaataactcacacatgaagttgttaattaactttagaaaatgactatncttagtctaactgtaatttctcattgcaactaacattaaaggtctgaaactggtatttcc

SEQ ID NO: 20562 - DNA, 121 bp, Artificial Sequence
  Synthesized
  misc_feature (61): n=a or g
aaagagtatttacaacagctgtgaatacaaataataccttgctgcaaaaggagataaatgnctgactggacaccatattcaatttgctttgaaactgggtactaaagaacatgcaacagag

SEQ ID NO: 20563 - DNA, 121 bp, Artificial Sequence
  Synthesized
  misc_feature (61): n=a or g
agactttactctttgaattgctgggagaaaaatcaatcatgataaatgctatctgttttcngcataaactcaagagataaaagcagtgtatctgtcaagtaattgggtgggatgtaaggag

SEQ ID NO: 20564 - DNA, 121 bp, Artificial Sequence
  Synthesized
  misc_feature (61): n=t or c
gaaatgtaagagacacatgttgatcctgaactccctcattactacttcagcaatgaactanagccccttcttcatcagcaaattggactaaaaaagccaatcaaatgaaagctgatctttg

SEQ ID NO: 20565 - DNA, 121 bp, Artificial Sequence
  Synthesized
  misc_feature (61): n=t or c
tcagagggagatggacagaccttatcttaggaagcttagactctgttctgtaatggcaacntgaaagtgacagtcttcttcccaggccacctgcctgtacatctgccaaggctttggggtc

SEQ ID NO: 20566 - DNA, 121 bp, Artificial Sequence
  Synthesized
  misc_feature (61): n=c or g
tcatcacgttggggatactgactgagggctgacatacttcagcaggtgactgctgcgtctntttcacctgtgccgcagaagcaaacactgggaattgaagggttttcattatccacacttt

SEQ ID NO: 20567 - DNA, 121 bp, Artificial Sequence
  Synthesized
  misc_feature (61): n=t or c
ttagaaaatagagtgcaatttcttaagcatctaagtaaagttcctgcagaaagactgcaantccaatgctcaaagatgaaaaatgaagaaacacattggtacagccccagtttctgacttc

SEQ ID NO: 20568 - DNA, 121 bp, Artificial Sequence
  Synthesized
  misc_feature (61): n=a or c
ataacaatggctctttctcatctctgcccatcctctctgtcccagttaaatgagctgtttnccagacaaataaaagactggagagactgccttcagcaggggtagaaggctggggattcgg

SEQ ID NO: 20569 - DNA, 121 bp, Artificial Sequence
  Synthesized
  misc_feature (61): n=t or c
ccatgggctgtagcacatagcaattacctgatactctctctcaccctgagagccaaaacanatcagtcaaggacacttgagttccagtagccaagaagggaagtaatcttaggctgagaca

SEQ ID NO: 20570 - DNA, 121 bp, Artificial Sequence
  Synthesized
  misc_feature (61): n=a or g
tcataacttagtctgactttcagcttcttatttgcatggaagatggcatactttaacacanactagttccataaaacctgtagtcttctcacaagttgttgtagctctcctgaaaaatgtt

SEQ ID NO: 20571 - DNA, 121 bp, Artificial Sequence
  Synthesized
  misc_feature (61): n=t or c
gtcaaactatttacaccaaaatgttaacacttgaatggcaaatgggtttctgctattttcngcatgtctgctttcagactcttgggcatagatttgtacatgtgctcagaacacagtgtta

SEQ ID NO: 20572 - DNA, 121 bp, Artificial Sequence
  Synthesized
  misc_feature (61): n=a or g
tgtgaaggtcacccacccccaaatccacctcatcccgtactcggatcattcatccttttcngagttgtgtgagtttgtgaagtggttgaaaccctgctcagtcatccccattgtgaagggc

SEQ ID NO: 20573 - DNA, 121 bp, Artificial Sequence
  Synthesized
  misc_feature (61): n=t or g
gactgtagggtgatatctgaaagctgacagtaggaaacacaggactttgaggtcagtttgnaggattcagagaaagtatcctatgaggagcaataccacattaagaacatagtgggagaga

SEQ ID NO: 20574 - DNA, 121 bp, Artificial Sequence
  Synthesized
  misc_feature (61): n=t or c
gcttcttttggtgaagttcagctcctaccaaaaaaccctcactctatgacaatgtacttantaactgcaatatgactgcagtaaaaacctttggcttctaacaaagcagttatttaaaaac

SEQ ID NO: 20575 - DNA, 121 bp, Artificial Sequence
  Synthesized
  misc_feature (61): n=t or c
agtgtggacgtcaaaagaaaaagagctcagctatgtaaatactgatgttctctattaacangttaggatgatggatatggaaacagggcagattgtcacggaattttcctaaaagcaagat

SEQ ID NO: 20576 - DNA, 121 bp, Artificial Sequence
  Synthesized
  misc_feature (61): n=a or t
tatctgtgcccatgggtgtatagtcccttcttccttgtttgcaaatggtttgtttacctcncagaaagtgcaccaagcactaatctcattgtagtagaggcaaaacatttccccatccccc

SEQ ID NO: 20577 - DNA, 121 bp, Artificial Sequence
  Synthesized
  misc_feature (61): n=a or c
ttattaaagtgtttgaaaacccatgataatttggagtgctctataaggagaacagtacaantgagcctttcccaccaagaagctgagtaagaggtaaaccaggaacaaaagttggatgttt

SEQ ID NO: 20578 - DNA, 121 bp, Artificial Sequence
  Synthesized
  misc_feature (61): n=c or g
ccttctctagacccattcgaagagctctgtgtctttcttgtatttctgtctttcttatatntgagtataaccattaaaaaaatcacaaaagctcttggttctctttgcccacaggtgcact

SEQ ID NO: 20579 - DNA, 121 bp, Artificial Sequence
  Synthesized
  misc_feature (61): n=c or g
cggtaagatcaccaagtccaaccatcaacccatctgcatataatcacatttcttccaaaantctgtttctaaaaagaactggcaatctattagttcagaaatcctagcaagtatttcatca

SEQ ID NO: 20580 - DNA, 121 bp, Artificial Sequence
  Synthesized
  misc_feature (61): n=a or g
ccctctttgttctctgacctctgaaattatacagcctgcattgcatggatattttgtgccntttctccctgatgtgaagtggatgctttcattattctgcactcctgcgctaaaagattaa

SEQ ID NO: 20581 - DNA, 121 bp, Artificial Sequence
  Synthesized
  misc_feature (61): n=t or g
atcttttttcccaactggtctccaggatgcagctgtttgacttctgttgcttccgtggcgntttgaattaactgagctataaaaggtttctcctttttcatcacttgactacatctaaatc

SEQ ID NO: 20582 - DNA, 121 bp, Artificial Sequence
  Synthesized
  misc_feature (61): n=a or c
aatttttaaatcatcatcccgttgtctcaagagcagggacatatgctgttgtcttactttnatataataaccatcattcaaaaagtttcctcccccataattgccaaagatttcttctaga

SEQ ID NO: 20583 - DNA, 121 bp, Artificial Sequence
  Synthesized
  misc_feature (61): n=a or g
gacagattgacggagacccaaccgaagtgggaggaaggctttcctttcaggaaacatgggnggaagtgtaaaatgcaatgctaacatacaaaatacctttgccctcataaaaaggcctaag

SEQ ID NO: 20584 - DNA, 121 bp, Artificial Sequence
  Synthesized
  misc_feature (61): n=a or g
aacagatgacagttttgcaggtatttggttgtgcttcagttttccgctcctacccattccntacacgccagagacttaccccttttatgaagcaagttttagtaagtacttcatagtccca

SEQ ID NO: 20585 - DNA, 121 bp, Artificial Sequence
  Synthesized
  misc_feature (61): n=a or t
tactggttttttccttagatttgtagagaataagcaactgctattacataagaaacgttancagtgatgctggaacagaacattcaggaaactgaataaaatacatgataaatggccttaa

SEQ ID NO: 20586 - DNA, 121 bp, Artificial Sequence
  Synthesized
  misc_feature (61): n=a or t
tgattttcccacaacatgcagaaagataattggaagtgggaacatatgagacaataagatnaggacattcagtccatatgaaatttagcattgatttatcctgttctagaaaaggtaaaaa

SEQ ID NO: 20587 - DNA, 121 bp, Artificial Sequence
  Synthesized
  misc_feature (61): n=a or g
agtctgctggtgtgtgagcagtagttttgttagtttcagaacagttctagtcaaaactgcnggatgtaagcagaacccaggaggggaaaaggaaggatctggggagaaataatccctaccc

SEQ ID NO: 20588 - DNA, 121 bp, Artificial Sequence
  Synthesized
  misc_feature (61): n=t or c
ctgctcagaagagcaacagagacaaatttctcacccctctgttttaaagttgctgggtttnttaaactgattacggtgttaccataaagacggtgggtaaccacagaaggaagggagaaca

SEQ ID NO: 20589 - DNA, 121 bp, Artificial Sequence
  Synthesized
  misc_feature (61): n=a or g
acattggaaagatcctgcccatatattgctcagaagtgctcagaaaagattgatgaggtanagatgaaagagtttggttcctttttatttttgatggtttggttttgttgccttttagtta

SEQ ID NO: 20590 - DNA, 121 bp, Artificial Sequence
  Synthesized
  misc_feature (61): n=a or g
caagtataaaaccatgtaatctgcagtatattccatagggggcacattggcaacacgggtntgtcagaagtagaaaaacatatttaccataccaaagtatcactagcacgtaagaagactg

SEQ ID NO: 20591 - DNA, 121 bp, Artificial Sequence
  Synthesized
  misc_feature (61): n=t or c
gcagcaggaggtggttcctgcagtaacaggacacggtgctcgagtgggaggaatgtccagntgtccatctgcagcctcaaggacagatagctgagtgtggtgagctcctgtctttgcagag

SEQ ID NO: 20592 - DNA, 121 bp, Artificial Sequence
  Synthesized
  misc_feature (61): n=a or t
gttaaaaccaattgtttggtaacttcccagccaggcaacattttctgaacttttccctgtntggttttctgtggtttgaattatcatttgttaaatatattatgacatactgtttaccaca

SEQ ID NO: 20593 - DNA, 121 bp, Artificial Sequence
  Synthesized
  misc_feature (61): n=t or c
gctcaatcccctttattgtctcacaaaagaacaaacttctccctcttccagctggaggagnggagattactgtgacaatcactggcttacacacaaacataacacagtgtccaaagagcca

SEQ ID NO: 20594 - DNA, 121 bp, Artificial Sequence
  Synthesized
  misc_feature (61): n=a or g
aataaaactgactatcccccttcacagataggaactcctgaagagagaaatttgtagcaangattttcagatgtttaggtcctaacccagagagctgaatattcaggtaacatgatgaaat

SEQ ID NO: 20595 - DNA, 121 bp, Artificial Sequence
  Synthesized
  misc_feature (61): n=a or g
tgatattcaagatccatgagttttccactcttgatttatacgcaagtattccctaactatntaattcccacatgataaatagtccaaaattaaagatactagcatttttgatttatagttc

SEQ ID NO: 20596 - DNA, 121 bp, Artificial Sequence
  Synthesized
  misc_feature (61): n=a or g
aacataaatgtataaaacctacagtatcactgtgctttttaaatgcaaaagcagctctatncactcccataatgagcagtcgtaaagtaatattgttccatgagcttgctgggagagttgg

SEQ ID NO: 20597 - DNA, 121 bp, Artificial Sequence
  Synthesized
  misc_feature (61): n=a or t
tttttagagcaatcatgaaacttcctatgtggatctgtttgattttggagcagagacggangctgtttgaacaggttcgcttcccatcacgaatgcttcattgatctgtgctggaaacagt

SEQ ID NO: 20598 - DNA, 121 bp, Artificial Sequence
  Synthesized
  misc_feature (61): n=t or g
tatttaaaaaaacaaagtgccagggacagtttgtgttcatgagaaccggaaaaaaagttgngagggagaattaaaggctaaatgatgaaacaaagaactgagctcagttctgacttaattc

SEQ ID NO: 20599 - DNA, 121 bp, Artificial Sequence
  Synthesized
  misc_feature (61): n=t or c
agtgaagcaatcaagtgcaaagctggaattttcttttctccatttgcattgatttccaggncctgtttggtgggagcaataaaaaaccagggtgcaaccctcagagtggctttggacaccg

SEQ ID NO: 20600 - DNA, 121 bp, Artificial Sequence
  Synthesized
  misc_feature (61): n=t or c
tggaccagatgaccttcagatgtcccttccatcctcagcccttttgtgatgctttgacttngacagagctgctcacatcaaatagggtcaatgaaacccacactggttcagtgccaaattt

SEQ ID NO: 20601 - DNA, 121 bp, Artificial Sequence
  Synthesized
  misc_feature (61): n=a or t
cacatgccccataccttgaatcaggagttagtgacctggtgcacagaccacttcttatttncacagaataaccagtgtccctagtataacatttcaacacaggactgtgaccaagtgagct

SEQ ID NO: 20602 - DNA, 121 bp, Artificial Sequence
  Synthesized
  misc_feature (61): n=t or c
gatccattctagggaggaacacattttaaggtgtttgattaaacagctgtcctgagcatancacgtaaaccactgagttttttgttaaagcatctcctgctgcagtctacagcagagaatc

SEQ ID NO: 20603 - DNA, 121 bp, Artificial Sequence
  Synthesized
  misc_feature (61): n=t or c
aactcacttgcaattttgtcctccaactcccttcctttgtggaaagggcaatgtttccttncttctaccccttggttatcttatattctgaggattataaactgcatcatgtggaaatgct

SEQ ID NO: 20604 - DNA, 121 bp, Artificial Sequence
  Synthesized
  misc_feature (61): n=a or t
tgaatcacaagcagccagataatgtcatacagtatattaggcaaatctttttcttacttanatcaaactcatttgttcgtggatttacaccaaatcaatccatatttcttggctgcaatac

SEQ ID NO: 20605 - DNA, 121 bp, Artificial Sequence
  Synthesized
  misc_feature (61): n=a or g
taaaacgcactatgtctagatatttaattatttattttctaaatcccattgtttacctatnttctgtgcactaagtccattgtttctcctttgccaggactgccatgccgtatgggggtta

SEQ ID NO: 20606 - DNA, 121 bp, Artificial Sequence
  Synthesized
  misc_feature (61): n=t or c
caaacactatctcacagaccatcaaaagctttggcctgatgttggaactgataggcaaagntcatccatttcatcctgaaggagaagtctgaagtgctggaagcccaagaagactgtttgg

SEQ ID NO: 20607 - DNA, 121 bp, Artificial Sequence
  Synthesized
  misc_feature (61): n=a or g
atataattaaggaaaggtttatttctgaaatttgggcaaaactggaataggtttacagaantctgcaggtgttcagcgacgtattggtaaatttaactttttcctgtagagaaaatagcag

SEQ ID NO: 20608 - DNA, 121 bp, Artificial Sequence
  Synthesized
  misc_feature (61): n=a or g
ggccaaggcacaattgttaggacacaccaaggtgacaagtccaagactggtagactatganggagggaagaccatatggcttgacaagctgtgactatgcatcacatgtgacactaaaaag

SEQ ID NO: 20609 - DNA, 121 bp, Artificial Sequence
  Synthesized
  misc_feature (61): n=a or g
ttgccaaagccgatggtgtaattggaggtgagagcttgcaggaactcggctgggagagagnaatagatgtgaaagaagataagcccaataggttgctgctccacagaaaggcgttctttct

SEQ ID NO: 20610 - DNA, 121 bp, Artificial Sequence
  Synthesized
  misc_feature (61): n=t or c
gagtataacagggttgaaactcttcagtgtgcacctcagctcatgtgaactagcaatcatnaccatgcttccacacagatgctcccacagacacttcccacaatctcttgttctcagacat

SEQ ID NO: 20611 - DNA, 121 bp, Artificial Sequence
  Synthesized
  misc_feature (61): n=t or g
tatattcattcagtactgaagcaggataacccatctttttggaaatatctgtagcctgccnaacagttttcctgcggaagctcaagtggaaagctttgtttagggaaactggacgctcctc

SEQ ID NO: 20612 - DNA, 121 bp, Artificial Sequence
  Synthesized
  misc_feature (61): n=t or c
aagttgcattgggttggtggtccaaggtgaaagctgtgccgatatgctctggagatgtcantgaagtataaacaggtgattaaaaacagtttgtccccttgaatgattgcttcagagctga

SEQ ID NO: 20613 - DNA, 121 bp, Artificial Sequence
  Synthesized
  misc_feature (61): n=a or g
atttatttgcaaagagatacagaagggctttctggagttgagtataggtatgtcaaaacancaggtaattatgcctgtaaatatcatggaatcatagaatcctttgagttggaagggacct

SEQ ID NO: 20614 - DNA, 121 bp, Artificial Sequence
  Synthesized
  misc_feature (61): n=t or c
ggcatatgctgcaatgcatgcacagtttgtcacgtgccatttttcacaagattttccacancagacaatgcaagatacctgatacacatgaatgcttgcagcaacagcacaaaagaaggag

SEQ ID NO: 20615 - DNA, 121 bp, Artificial Sequence
  Synthesized
  misc_feature (61): n=t or c
gaaacaacatgttggaggttttcaaattgaaagtcaaagtccacctctgagtctgtaactntggctcaagctatttaatcttgcaccacccaaagtattttttataactatgtcacccttt

SEQ ID NO: 20616 - DNA, 121 bp, Artificial Sequence
  Synthesized
  misc_feature (61): n=a or t
gtagattcgtagatacactccactcttattttattaaagtgagctgagagaaaagtcctcntgctaacatgtctggaaaatatcaaggtcatttccactcaaaatatttcattctctgata

SEQ ID NO: 20617 - DNA, 121 bp, Artificial Sequence
  Synthesized
  misc_feature (61): n=t or c
actaaatgaaagtaacttattgcattgtgctgttgcttgttcttttttttactgattaccnctgcatttgtcacattctccatattctgggccaatctcacaatgtgaagaagaggatcct

SEQ ID NO: 20618 - DNA, 121 bp, Artificial Sequence
  Synthesized
  misc_feature (61): n=t or c
gaagttttctttcaatattttttagctgctttccaaaactgatacagctctttccttctcngaccaccagaaagaccaaaaatacctttggccaattctgtatttcgttagatgagacaga

SEQ ID NO: 20619 - DNA, 121 bp, Artificial Sequence
  Synthesized
  misc_feature (61): n=c or g
aggaagggtaggaagcaggaatgtgaaaagagagggcaattgagagatgcagaccggttgntttggccatgcattgcagtttccctatacctggtgccaaataacaaggctctgtttttcc

SEQ ID NO: 20620 - DNA, 121 bp, Artificial Sequence
  Synthesized
  misc_feature (61): n=a or t
cacatttgcaggcatgagaataccacagaacctcagcctgagtaagagaaacgtttgttancacccaggagtggtacaaaggaggagaatcccccgaggctgtgagtcctgaggagccata

SEQ ID NO: 20621 - DNA, 121 bp, Artificial Sequence
  Synthesized
  misc_feature (61): n=t or c
gccaacagcactccaacaagtccacatggagaaaggctgcacaagcacgatgctgttgtgntgttcctgctctgccctctccaaagtcctcaaagaaaattttcttaaggaagaaccactt

SEQ ID NO: 20622 - DNA, 121 bp, Artificial Sequence
  Synthesized
  misc_feature (61): n=a or c
actttaaaccaggtagacatatgcgttatcaccaaaagagggtattctctttgtttctggnattcaggagcattacagtcaggtgacatcacctgctggtcatgcagaaacgtgaaattcc

SEQ ID NO: 20623 - DNA, 121 bp, Artificial Sequence
  Synthesized
  misc_feature (61): n=c or g
agaatagcatgcaattatgaggcttgcaaaaattattgtttgaatacatatttgacatggnattcaaagtttccctttgcagctactaaatagacaatggactttcactactactgctgta

SEQ ID NO: 20624 - DNA, 121 bp, Artificial Sequence
  Synthesized
  misc_feature (61): n=a or t
gcccttaacaggtataatttagcacgtgctttggctttctatcagaatgtgagggaaaatncatctggacgttctgcaccaaaactacatctcaatgttttggaagtagccggatagccca

SEQ ID NO: 20625 - DNA, 121 bp, Artificial Sequence
  Synthesized
  misc_feature (61): n=a or g
gcaaacaccagtgcagaaaaatatgaaataacagaaggatttaattgtaaaacactaacantacctcatattaaattctatatagagactgtggttagaaacaggaaaggcatttagcaat

SEQ ID NO: 20626 - DNA, 121 bp, Artificial Sequence
  Synthesized
  misc_feature (61): n=c or g
catcacgcttgcctgactgcagatccagtcatgaataggggctcatacttggaaggttatntacccagccatgagagtaggacttgctttcactgaggacgtatattcttcagaaattgat

SEQ ID NO: 20627 - DNA, 121 bp, Artificial Sequence
  Synthesized
  misc_feature (61): n=a or c
gcgtaatgcttgctgcctggaaatcagagtataacggccttcaaaaaagctaaacagcctntgtgatcaggtaagcagcaatacctgaggcagcaggagggacaaatgagctcaatatttg

SEQ ID NO: 20628 - DNA, 121 bp, Artificial Sequence
  Synthesized
  misc_feature (61): n=a or g
ttgaaacgtaaccctgaggaatatgaaagagtgcaaggagaaagagaaaataaagacagcnccgagaaggtaccaatgagtgtcttgttctgtcctataactttgatctgtacaaggttcc

SEQ ID NO: 20629 - DNA, 121 bp, Artificial Sequence
  Synthesized
  misc_feature (61): n=t or c
tggtagatttctaccccttcatcttacaccttagtataaacattttcagcaaaaccttttnttcacagtagttctaattatctgttgatcttctcttctttcacttctactatcatgctca

SEQ ID NO: 20630 - DNA, 121 bp, Artificial Sequence
  Synthesized
  misc_feature (61): n=a or t
gcagtccagctgcaatgagacccataaagggatttcactctgctagcaacttagtcctttngatgaggtactttcaattttgctgccaccacccctctgttgttgatcccaatctaataca

SEQ ID NO: 20631 - DNA, 121 bp, Artificial Sequence
  Synthesized
  misc_feature (61): n=a or g
taagtaattagaagctttccagtctgacacacagatcaaatgaacaaatatctgtctaaancatccactacacaaaaatccaaaaatacttcctggaagctcagaaattgtttgttttttt

SEQ ID NO: 20632 - DNA, 121 bp, Artificial Sequence
  Synthesized
  misc_feature (61): n=t or c
ttcaccccattgaaaaccaaaggctgaagggattccagtgattgtttccatgaactgcagncaaggtctgctgctcagcaccccaagttcacatacaacgatatgtgccgaatcacagagg

SEQ ID NO: 20633 - DNA, 121 bp, Artificial Sequence
  Synthesized
  misc_feature (61): n=a or g
ttttccaattgagcgattttgtctacaagttacatattgttactgttaatcaacttcaagngattcagaccatatcagaacagaatgtatttaagtagtaaaagtggcagctacattgcct

SEQ ID NO: 20634 - DNA, 121 bp, Artificial Sequence
  Synthesized
  misc_feature (61): n=t or c
gagcagtcatgcagttcagggtgcagttttgtcctccaagaccaaagactgcggacaccanagattctttgcctggtgcaatgtgggatgaccgctgtcccccgtaagcacccaggcttta

SEQ ID NO: 20635 - DNA, 121 bp, Artificial Sequence
  Synthesized
  misc_feature (61): n=t or c
catcttttaatttaaggaaataatggcacagagcagtgtggaaaataatagagggaaaacngactttgcctaagaaacataagaaatacaagaaatattgatggctatcagttgctaacca

SEQ ID NO: 20636 - DNA, 121 bp, Artificial Sequence
  Synthesized
  misc_feature (61): n=c or g
acatcattgcagttcttcactgtaaagtaattctactacagctgacaccaaaaataaaatnagaaaatagggagaacttttaaagagctgcctcttctgtgattctttcacacacagagtg

SEQ ID NO: 20637 - DNA, 121 bp, Artificial Sequence
  Synthesized
  misc_feature (61): n=a or c
gttacaaacagtgactatgatggagactcaagcagttagggaagaggtgcagatggaatgngaagatctaaaaagccagcgtgctcattacattgaaatatatctggtctttatcctaatc

SEQ ID NO: 20638 - DNA, 121 bp, Artificial Sequence
  Synthesized
  misc_feature (61): n=t or c
tcttttttaaactgccaatcactgatgtttttattaactgtttgttcatcaaaaatagcanagaatttaaagaaagatgagagaggcaaaaaattcagtgggctattttttttttctctgc

SEQ ID NO: 20639 - DNA, 121 bp, Artificial Sequence
  Synthesized
  misc_feature (61): n=a or c
caaacctgatcatagactgagatcctaaattaaattactgtattattaaggctgatttctntctgtttgattttgcataagtagaaaagccttgaacattgctgtatctcaaggccacatc

SEQ ID NO: 20640 - DNA, 121 bp, Artificial Sequence
  Synthesized
  misc_feature (61): n=t or c
tggcatctgatgccaccactgtttgttggccataacattttctgtcgtctcctgaacatcnggccccactgcttaacatggtgaccttctgcaagatggaattcaatggggcgaggcaact

SEQ ID NO: 20641 - DNA, 121 bp, Artificial Sequence
  Synthesized
  misc_feature (61): n=t or c
acagcatctaccacaacaacacattagttaaaagcaaacaggacagtttattgagacaaanttcagaacagcttcagaagagttcccaaactgatgggaaatgggaaaattacaggagtta

SEQ ID NO: 20642 - DNA, 121 bp, Artificial Sequence
  Synthesized
  misc_feature (61): n=a or c
gagctctgtgtgccacacatagtgcattatatcatgaccatcatcccgcaaagacatacangtggctttacttacacagcggatagatgcagttatctgcagctctggtgtgaagttacat

SEQ ID NO: 20643 - DNA, 121 bp, Artificial Sequence
  Synthesized
  misc_feature (61): n=a or g
cgttgtggtccttcacagtgtaatggcaaccacagcaccttgctgaaggaactggacaccnaagcgtctgtgtttcaaaattggacatgaggagtttgtataaggaagcatcacaactgct

SEQ ID NO: 20644 - DNA, 121 bp, Artificial Sequence
  Synthesized
  misc_feature (61): n=a or g
tcaccacatctgagcaaccagattaatatgatacagaaaattggttatttctcaaaatacnatctgaatacatcatcatctgacatctacatacatctgaatacttcatcatatttattgg

SEQ ID NO: 20645 - DNA, 121 bp, Artificial Sequence
  Synthesized
  misc_feature (61): n=a or g
acatataagctaataactttcctctagccacctatctgttgaacataaaccacagcgtacnactcacgcttgcaatgttcacagtgccagtgtacagcagtgctgagacaactctgcagaa

SEQ ID NO: 20646 - DNA, 121 bp, Artificial Sequence
  Synthesized
  misc_feature (61): n=a or g
cccaactaatgcactgttttcataggaaggtgaaagttattagaagaaaacttctaaatgnattctgtaagcagtacacaatctgggaaattaccacagaagtacaaagcatgcactggaa

SEQ ID NO: 20647 - DNA, 121 bp, Artificial Sequence
  Synthesized
  misc_feature (61): n=a or c
aaatggcaaggaaaaacagaaaaaagtcatcacgtgggagaactcctttcaactgtgaaantccataaataaacagagatatttctgctttgtcacagagcagtcccaccggggaggaaat

SEQ ID NO: 20648 - DNA, 121 bp, Artificial Sequence
  Synthesized
  misc_feature (61): n=a or g
gagaatgctgcgatacctcccagccatccagaaagcagttgggtgagctctgaagctcccnggtgggctctctgccactgagcccagtgaagctgtcacttgacaggtgacacctccatgc

SEQ ID NO: 20649 - DNA, 121 bp, Artificial Sequence
  Synthesized
  misc_feature (61): n=a or g
ctcttaaccttactgtggcttatgggttagcagttggaattttatccttagggatatggtncagatgggcccagaccatccactagctatgggctaacatgtttcatgataattgcacaca

SEQ ID NO: 20650 - DNA, 121 bp, Artificial Sequence
  Synthesized
  misc_feature (61): n=a or g
tcgctttggcaggtcaagagaggtttgatacaacagctttcttactgccataaccttggcngaagaaaaagccaggaaattggctacagagggtagttgtgatggtcaatacgttctggat

SEQ ID NO: 20651 - DNA, 121 bp, Artificial Sequence
  Synthesized
  misc_feature (61): n=t or c
gtaaaaggagagcttacacaaagttgagtacaccaccagttagatttttagtattgcagangtaatgattttcaacccaatccaacatgtacttacagcactacacatctggaattaaaca

SEQ ID NO: 20652 - DNA, 121 bp, Artificial Sequence
  Synthesized
  misc_feature (61): n=t or c
atgcgagtataacttgacgctttaaaaccttgatgtcagttctcattacatctgcatttgntcttttgcagaagtttcattaaagcaattcagatttttagcagattctattccattaaaa

SEQ ID NO: 20653 - DNA, 121 bp, Artificial Sequence
  Synthesized
  misc_feature (61): n=t or c
gaatttaatttattaacacttgaattgtttgtaaaaagatctgtatcaggagtagcgaggnattattaatgattttctggcttagaatttgcttgaagggcagacaagcaaattcaaggtg

SEQ ID NO: 20654 - DNA, 121 bp, Artificial Sequence
  Synthesized
  misc_feature (61): n=t or c
ccggagcatgagccttcaatagactgcccaactatctgtgcagatttcaatgcactattgnctggatcttgagttagaaccatttatgtggcttgtagctcagcccactggctaacccatc

SEQ ID NO: 20655 - DNA, 121 bp, Artificial Sequence
  Synthesized
  misc_feature (61): n=a or c
aaaagcatctccaattgggctgaacgctactacaatatggagattttctttgcagcagttnacaaaaaatgcaaataaggccaagggactgagttcttcatgtttattaccagcttgagct

SEQ ID NO: 20656 - DNA, 121 bp, Artificial Sequence
  Synthesized
  misc_feature (61): n=t or g
tctacacatcatcaaagtaaatcataaaacaacactagagcccagcgctgaaagagctctntagttagctttgccttctggagaccaaaatctaggggaaaaaaaatagaaagacagtaat

SEQ ID NO: 20657 - DNA, 121 bp, Artificial Sequence
  Synthesized
  misc_feature (61): n=t or c
tgccaagtactgaaagacgtgttaataactggaaatgaggcagaagtgtgatctgtaatcncttcgttactctaaatgactttttggacttcaatatagttgtgtttattccctgattatt

SEQ ID NO: 20658 - DNA, 121 bp, Artificial Sequence
  Synthesized
  misc_feature (61): n=t or c
acatgaaggaagtaagtagccattgtgctgctaaggctagaccaatttccattagctatangaagacataattaaagtttgctgttcagatctacgttttccccttttatctctcaatggg

SEQ ID NO: 20659 - DNA, 121 bp, Artificial Sequence
  Synthesized
  misc_feature (61): n=a or g
tctcattttcagaacctgaaccaattcttcctgttatgtgaggttgagttcctcacacagnactagggtaaaccatatcacctgtatatcaacatggcacttctatggcgtcctacatcag

SEQ ID NO: 20660 - DNA, 121 bp, Artificial Sequence
  Synthesized
  misc_feature (61): n=a or c
agctgttgagttaaaggacatgctaggaggaactctgttatagtccttccagagggtttcntaagcatacctccttgtatgtctttggctagaactgatttgtctggggcaatgtcttcta

SEQ ID NO: 20661 - DNA, 121 bp, Artificial Sequence
  Synthesized
  misc_feature (61): n=a or g
caattagagaagcaaacatgtgaagttcatgcctgcttcctcctagactgctaacactcangttgaaagtggtgttatcacagtaaatggcagataaatatttccatggagctgaaggtgc

SEQ ID NO: 20662 - DNA, 121 bp, Artificial Sequence
  Synthesized
  misc_feature (61): n=a or g
tgagaataaaaagaaacgttgctgaaaatgggaactggtgatttatacaggcagcaatacntatagttgtgaaatatccacaagagaaatgaagaaagaatgaagaccaaatgagttaatt

SEQ ID NO: 20663 - DNA, 121 bp, Artificial Sequence
  Synthesized
  misc_feature (61): n=t or c
gatttggcttttcctgcagggcccaggagaataaagaggaatctgggaagggagtggcacngtgttggcatcctcacattgccaactcccatgctgtgagaccaaccagtgcttcaggacc

SEQ ID NO: 20664 - DNA, 121 bp, Artificial Sequence
  Synthesized
  misc_feature (61): n=t or c
ctctatgcttcaggggcatgccatacactcaccaaaggacaaagaaggggaccttcctatngaagataatgttgctgttagtacaaaaatacttacacaaacacaaactctcagtttattg

SEQ ID NO: 20665 - DNA, 121 bp, Artificial Sequence
  Synthesized
  misc_feature (61): n=a or g
ttatgtttttcttctgctctttgtctgcttgtagggtcggtatttcgagaatcctcaggtnattcctgagaacactattcctcctcctgagatggttggcatgattacaacaattgtggtg

SEQ ID NO: 20666 - DNA, 121 bp, Artificial Sequence
  Synthesized
  misc_feature (61): n=a or g
tcaacgaagttacaaaggagaccttgctgaggaaggcaaagctcatccatcacttcttgtngcaagctgtacacaaagacccggtttttccaatttcctttctcttttgaaaccttgagta

SEQ ID NO: 20667 - DNA, 121 bp, Artificial Sequence
  Synthesized
  misc_feature (61): n=t or c
atagatcaacttattcaatcagaaaactcttcttctttcaccaaaatcaaagaactggggnatcgtgactagccgtccacttcctacccacttacccacaccactttgagaaagaatgaac

SEQ ID NO: 20668 - DNA, 121 bp, Artificial Sequence
  Synthesized
  misc_feature (61): n=a or g
gtttaagatcctatcaggtgtcacaaaataaactgtatccagaagagccaatacttaaacnctttaaatccaagcccaggaaatactgttagagaataggtaggtatcgctcttcttttag

SEQ ID NO: 20669 - DNA, 121 bp, Artificial Sequence
  Synthesized
  misc_feature (61): n=a or g
aggtgaaatataacgccttcattttccacaagccctttttcagttatctggttctgagcanatacatccttgatagaaagatcattatttgcagtaatgttctttcccttagaaaataacc

SEQ ID NO: 20670 - DNA, 121 bp, Artificial Sequence
  Synthesized
  misc_feature (61): n=t or c
ttacagtacttcaaataaattgtaatactgagctcccaagtactgggaagagctgggtttnctgtgctattcagagcagcacctgtagctcaagccaggggaggcatcaccacccagggcc

SEQ ID NO: 20671 - DNA, 121 bp, Artificial Sequence
  Synthesized
  misc_feature (61): n=a or g
tcacccttttcatttaaacaaagaaatccaacagcagaggactagagttctttactatacntgtccccagttgccactaagtattgaagtctgatttggaccaaggccagaatagatgcct

SEQ ID NO: 20672 - DNA, 121 bp, Artificial Sequence
  Synthesized
  misc_feature (61): n=a or g
acatagcataatgacagttgctgggtttcagagcttaaatggtcaataagttgggtccccngcttggatatgagcacgggctaactattaagacaaaacagtcattgtaaaggctgagaat

SEQ ID NO: 20673 - DNA, 121 bp, Artificial Sequence
  Synthesized
  misc_feature (61): n=t or c
ctgggtgcctttgctgcagggagatgccatgctggcagctgcacacagatggggtcagatnggtatcctgccctcccccactccttctcgtaagggaggggatgacattttgcatctgaaa

SEQ ID NO: 20674 - DNA, 121 bp, Artificial Sequence
  Synthesized
  misc_feature (61): n=a or t
ttagtaaggaaaactgttctaagaacactaaataacaagaaaaaaattgcataatactttnatctggactaacgcaaagacttaatttttcatatcacagggatggttacttcagagagaa

SEQ ID NO: 20675 - DNA, 121 bp, Artificial Sequence
  Synthesized
  misc_feature (61): n=t or c
acagaaacacagtctgatccatccccaaacatgactgggttcgttctgacgtgacacgttnggatgctctgcattctgccactgcactttcagttagagccttgtaaaagagctgagctgc

SEQ ID NO: 20676 - DNA, 121 bp, Artificial Sequence
  Synthesized
  misc_feature (61): n=c or g
gaatttagtctaaaaagatatgcagatatggaagggaggaaagtgatagtaagcatgcaantagcagccaacttgaggtgtgaatgctaagctacatccacagagatgtcttttcagtggg

SEQ ID NO: 20677 - DNA, 121 bp, Artificial Sequence
  Synthesized
  misc_feature (61): n=a or t
atccctatagaggctggggagcccagtcaggcattcagtcagacacttcccatttgcaaangctgaaggatacattcatagattgtgggcgaatctttcagaattcatttaaaatcatcca

SEQ ID NO: 20678 - DNA, 121 bp, Artificial Sequence
  Synthesized
  misc_feature (61): n=t or c
cagtggattttaggtgcttttttatttaacattcataaactttatgaaggcatgagtgagntggaacagaatgaatgatggagtcttgatgactcctgaaagcaggttgcattaccagctt

SEQ ID NO: 20679 - DNA, 121 bp, Artificial Sequence
  Synthesized
  misc_feature (61): n=t or g
accacagctctaatgaagagacaatggagctaatttgattaggagagccattgatgagctnggaagattctaaattggttttatattcagcagcatgaagaaatagatgagaatgcctgat

SEQ ID NO: 20680 - DNA, 121 bp, Artificial Sequence
  Synthesized
  misc_feature (61): n=t or c
gcattccaccagctggggctgaacaagggctgacaagttattccactccctcagagaccanctcttggaagcagaaagggcaatcaatggatttgaaggaaagtgtagtgctttcgtggaa

SEQ ID NO: 20681 - DNA, 121 bp, Artificial Sequence
  Synthesized
  misc_feature (61): n=a or t
aaaaaatgacttcatgaggcttagcagagattctaactgcctttacaccagctttgcattnattgatgtgactggtaatttacggtacaaggcacaaatgaactgaagctagtgagaaaat

SEQ ID NO: 20682 - DNA, 121 bp, Artificial Sequence
  Synthesized
  misc_feature (61): n=a or g
gcatttaaaaatctacttggcgtgttcttggtaagatttctgttcacttctcatcgctacnttcttgttacacgtgataagattccagcatagttcatttaacattaatcagagaatgcag

SEQ ID NO: 20683 - DNA, 121 bp, Artificial Sequence
  Synthesized
  misc_feature (61): n=t or g
ccacacagagatggtagctacaaaggcttgaaagtttacatttatcatactgatctgcaanccactctttggaaacaaaacattaagccaggtatttttcaaatcacttcttgcaaagaca

SEQ ID NO: 20684 - DNA, 121 bp, Artificial Sequence
  Synthesized
  misc_feature (61): n=a or g
aaatttgaatagatatccatactcagctcaagatgtaagtggaattaactccactatcaancaacagcaggaactttgtcatggtctaatctttattgagggtagtttttaagcttaccta

SEQ ID NO: 20685 - DNA, 121 bp, Artificial Sequence
  Synthesized
  misc_feature (61): n=a or g
tgccttcgggatccttccccaagcagcagcatccctgcagtgatcccaaagcatcaggaangctccatgaccgtaagcaaagggctgtgaggaatccctatgagaaagggataccaataga

SEQ ID NO: 20686 - DNA, 121 bp, Artificial Sequence
  Synthesized
  misc_feature (61): n=a or g
catcctctacattagctcctttagacctcccagcagaatctctcttcagttctgttagccntatgctattttgttatataatcgcatctgtcagcctggattaacccttctttaatcatag

SEQ ID NO: 20687 - DNA, 121 bp, Artificial Sequence
  Synthesized
  misc_feature (61): n=a or g
cagacattctgacagagtaaaacagcatgaaaagcagttctctttgggcaaggaagcctcncaacctgaaactcaccaatcacatgggctggcaggcttagaggaggcagatgatggctct

SEQ ID NO: 20688 - DNA, 121 bp, Artificial Sequence
  Synthesized
  misc_feature (61): n=t or c
tatacatataatcgttaattccttagtcatgatataaacatttcagatgatagcagtctantgtgttaaagaaactgcttgaaagatatattacacttatgatctttattgttaacaatta

SEQ ID NO: 20689 - DNA, 121 bp, Artificial Sequence
  Synthesized
  misc_feature (61): n=c or g
caccaccagctgaacctgggttgcttgctgtcctcaagtcttggcactggggacctagttnagcattcagttttgctcactcctgagcaaaattcctcctcagctaagtcatgcagaatca

SEQ ID NO: 20690 - DNA, 121 bp, Artificial Sequence
  Synthesized
  misc_feature (61): n=t or c
cgaggtctcctaccagatcggtgagaagggctccgttaaggtcctctacctggatgacagngagggctgcagcgctgctgagctggacaaagaaatcaagagcagcttcaaccctgacgcc

SEQ ID NO: 20691 - DNA, 121 bp, Artificial Sequence
  Synthesized
  misc_feature (61): n=t or c
tctaacgattcatacagtttcacagtgtatgtcatgcactctcctggaagagcacaaagangctgaaataacggctttaatttacggtaccttatggattaagtcacctccacgaatatta

SEQ ID NO: 20692 - DNA, 121 bp, Artificial Sequence
  Synthesized
  misc_feature (61): n=t or c
ttttcagggcacatcaagtgctgaatgccaggttaacaataaaggcaagtcagctctacanagtaaacaacaacatgagggaaagcgatccctggctgataaagtgattatagtgagtcag

SEQ ID NO: 20693 - DNA, 121 bp, Artificial Sequence
  Synthesized
  misc_feature (61): n=a or g
actaactaaattttttcaacatggatcctaaatcattataggcagccagacatggagtctntaatctgtagaggtaaaatactaattttcttttattaaaaatcaaaagtatttgattgga

SEQ ID NO: 20694 - DNA, 121 bp, Artificial Sequence
  Synthesized
  misc_feature (61): n=a or t
ggggaaagaaaaaaagtataacataggccaatagtctgcctttatattataaatcaacagnctggttactgatgaacacatgaagattaattcatcaaaatctgtggattatttctgacaa

SEQ ID NO: 20695 - DNA, 121 bp, Artificial Sequence
  Synthesized
  misc_feature (61): n=t or c
ggcattcactaatcaagttgtattttatgtactgtatttgagtgtttgagtttatgtatangtatttgagcatttgttgtatttgtgtttgagtactaatcaaactgcttctactattaca

SEQ ID NO: 20696 - DNA, 121 bp, Artificial Sequence
  Synthesized
  misc_feature (61): n=a or g
gtgctgaaagctgacacacagtaggtttgaggatgttcatggtcaacctctgccttaaganaagtggaggcaaaagagatacatttgatgaagtctctccaaacaattgctgggctggaaa

SEQ ID NO: 20697 - DNA, 121 bp, Artificial Sequence
  Synthesized
  misc_feature (61): n=c or g
atgtattatcaaaatattaacttcagccttctgtatgaattgagttgaaaatccataagtntcattcaaggggaaatactcagataaagtctaaagtaattatcttggaaaattacatttt

SEQ ID NO: 20698 - DNA, 121 bp, Artificial Sequence
  Synthesized
  misc_feature (61): n=a or g
gcatgcttatctgcaggagatcatcagctccaacaggtggtagagaaaagcacatcaactngttaagaacactacagttctcgttcacccttaccactctcctgctagaaaagttagaaag

SEQ ID NO: 20699 - DNA, 121 bp, Artificial Sequence
  Synthesized
  misc_feature (61): n=a or g
aaagacttcttagttggccacaagcagtaatttgaaggcagctattaatatgaaaaactgnaaaattaacaatgtgcagagcggggttcttttttctttgggaggagaggggggtagaatt

SEQ ID NO: 20700 - DNA, 121 bp, Artificial Sequence
  Synthesized
  misc_feature (61): n=a or c
tactagagattcatcattatgtattttcactttaatgcctacagcagagtagaaaaaaaancacatcattccttctctaaagctcagttcagttcttccttagggcagaacattcagaaat

SEQ ID NO: 20701 - DNA, 121 bp, Artificial Sequence
  Synthesized
  misc_feature (61): n=c or g
gtatcagcacatcagtttaaattaagaaggagcaagtggaaactaattaagacacaggttnaaaccaagaaggccaattattttcctgtatatgtacaatgcaagacacatacattgacta

SEQ ID NO: 20702 - DNA, 121 bp, Artificial Sequence
  Synthesized
  misc_feature (61): n=a or g
aattctcatgccttgcttttaaagggatgggataaaaaaattcagagtgcatgctcagtgnagagtggttgtgcctttgggatggtagcttctgggatggaggtatgtcttggtattataa

SEQ ID NO: 20703 - DNA, 121 bp, Artificial Sequence
  Synthesized
  misc_feature (61): n=a or g
gtataccgagggtgattatttcctattgtttggagtaaacaatgagtctgccaatctgtgncgaggcaaaatcagcataatatatggtagtaggaaagcattctagtttgatgagaactag

SEQ ID NO: 20704 - DNA, 121 bp, Artificial Sequence
  Synthesized
  misc_feature (61): n=t or c
gttaagaacaaaatgataaaaatattctctattgaaatagtttcccttcaaaataaattanccaaactacaacaagaagtccgtgtaaaataatgatctagaaacttctgaagaggtcttc

SEQ ID NO: 20705 - DNA, 121 bp, Artificial Sequence
  Synthesized
  misc_feature (61): n=t or c
tataaatgcagtgttctctttcagctttgaagaaattgcctttgggtcagtgaccctttcntttctaccgtcttgtcctttgcacgctatgcctgacatgtttcctctcgtctgctttctg

SEQ ID NO: 20706 - DNA, 121 bp, Artificial Sequence
  Synthesized
  misc_feature (61): n=t or c
aagatacatataattaaacactgaaatgtgatttatttttcttaaggagaattatttatgngttcaatctgtggcctgctgcaattccatactttgttgttgttgctgttattttataata

SEQ ID NO: 20707 - DNA, 121 bp, Artificial Sequence
  Synthesized
  misc_feature (61): n=a or g
attgtgctctactgtgagaacacattgctaccagcttcaggttagccaaccttgaccattnctaccaaagcgcagtgcttcttcacgttattacctttcaccaacaaaaagggacgatggc

SEQ ID NO: 20708 - DNA, 121 bp, Artificial Sequence
  Synthesized
  misc_feature (61): n=t or c
agaaaagactctcagcagggagagagtaaaggcatggaatgagcccttgtgcaccacctgnctgttcctcaacttttcccttccaaccacttctcatttcattgctcacattgcaaagaag

SEQ ID NO: 20709 - DNA, 121 bp, Artificial Sequence
  Synthesized
  misc_feature (61): n=a or t
cagaatgaatcatttgatttcctatgttgaaactggaacgaacattccaaaacaattttgnccgcatgcatttttgtgcccataaacataaaacagagccatacagctcaatgcctgtctt

SEQ ID NO: 20710 - DNA, 121 bp, Artificial Sequence
  Synthesized
  misc_feature (61): n=a or t
tccaccacaatgattttaggaacagctgttcagcaaggtttaaaaaagtaaaacaggcagnaagtgaaataaatagtgaaatctctttgtcttacttttttttttggggggggggagggga

SEQ ID NO: 20711 - DNA, 121 bp, Artificial Sequence
  Synthesized
  misc_feature (61): n=t or c
gctcatgattaatgtttaagtggaaaaaaagtctagcccagacagagagcctaccagtgcncagcagcaccaggctgtcccctacatgtgacagcagcgtcatggactcgagcattaccca

SEQ ID NO: 20712 - DNA, 121 bp, Artificial Sequence
  Synthesized
  misc_feature (61): n=t or c
ttctccagtgctgctgcagacaactggtcaggggtgtgaaacctccacctccttgctttgngggctctggtgggagcaagcaccaggtatcgtgtcctgcttttatcaatatttcatatca

SEQ ID NO: 20713 - DNA, 121 bp, Artificial Sequence
  Synthesized
  misc_feature (61): n=a or g
aacaatccccagaggaactgaagctcccaggcggcaagtttccatggaggcaccaggaccnttagaggcttgcttagtcttacaagttcgtccatgtttctgcttctctaccagcaaagac

SEQ ID NO: 20714 - DNA, 121 bp, Artificial Sequence
  Synthesized
  misc_feature (61): n=c or g
gagccaggccctggttgtgctgctgttggggcaatctgaaggaattattgtccagtcaaantatttattaaagacttacacaagcgtagccgagataacaatccatccccagatgtatgca

SEQ ID NO: 20715 - DNA, 121 bp, Artificial Sequence
  Synthesized
  misc_feature (61): n=a or g
ggattttgcatttaattgaattttatccctcattgtcccggagtgtcactgagagatgatntgtcttttatagcttctctgaagcactatcttcctggaacaacagtgagtgcaaagagat

SEQ ID NO: 20716 - DNA, 121 bp, Artificial Sequence
  Synthesized
  misc_feature (61): n=a or c
ccattcaatatattttgataatggttaatatctgcagaaaatttcactcatgtaccatgantctcagcattacgtacatgcaggttttgtacctcttactcaggattaacaattaataaat

SEQ ID NO: 20717 - DNA, 121 bp, Artificial Sequence
  Synthesized
  misc_feature (61): n=t or c
tcaaaatataccatctgtctgtggactgacttctggggtgtgagtgctcctgtatacccanagagaatccgacagaagaaccttgcctttgggaacgtacttctgttcctataaacttact

SEQ ID NO: 20718 - DNA, 121 bp, Artificial Sequence
  Synthesized
  misc_feature (61): n=t or c
caattagctcagcaataacatctctgcacaaacttcccatgaatcctcagagaatggatanatacttagaaatgaaaggcattttcagtcctccgcagctgaagcacaaactcttcagttt

SEQ ID NO: 20719 - DNA, 121 bp, Artificial Sequence
  Synthesized
  misc_feature (61): n=a or c
atgagcaaccgctttgttttgctctctgatctctttgcctatacatcccttggtgcccagnacaccactccaatccagtggttattcttaacagtcagatacagagcatgtaatttgaggg

SEQ ID NO: 20720 - DNA, 121 bp, Artificial Sequence
  Synthesized
  misc_feature (61): n=a or c
gagaccttaatctggatcatccaagagtttctttggggttcttattccagatcccaataanagaaaagataaagggatgggagctgaagtatttgcttttgcagtcaggtgttctgcagta

SEQ ID NO: 20721 - DNA, 121 bp, Artificial Sequence
  Synthesized
  misc_feature (61): n=t or g
tggcagactgttggaaaagctcctgccaagctctagctgcagagcccagccatgtgtttanaggctatttgctagtgttctctgaggtggtaattaaggctttgcattgggaatatgaggg

SEQ ID NO: 20722 - DNA, 121 bp, Artificial Sequence
  Synthesized
  misc_feature (61): n=t or c
tatgaaaaactgcagctggcttttaaagaaagctgtgtaatgaggggtgtaattagcacanacatccacaactgctactaagacgaggccagcaaaatctgctatgttcactggagctggg

SEQ ID NO: 20723 - DNA, 121 bp, Artificial Sequence
  Synthesized
  misc_feature (61): n=t or c
ttctcatgtaagaactagcccaattaaatattcagctggcaagacacgtccctccaaacanagagttcagcaattcagttcatctagtcaaaagcaacacaactgatacattgacagtaca

SEQ ID NO: 20724 - DNA, 121 bp, Artificial Sequence
  Synthesized
  misc_feature (61): n=a or g
gagattgttttttttttctttttcctggtaaaatattggcaagaatgttttctctgctganccggaagtgttgtttttggcttgaatctcctgttttatatcagactagaaaaacctgagt

SEQ ID NO: 20725 - DNA, 121 bp, Artificial Sequence
  Synthesized
  misc_feature (61): n=c or g
tgccttggatacagggttggcaggacatgacagtccagcatttggacctaagcccgctctnttgtgtggtacacaactaagttagtaagtcctcctggatccatcagcgcttgcaaatacg

SEQ ID NO: 20726 - DNA, 121 bp, Artificial Sequence
  Synthesized
  misc_feature (61): n=a or c
aaattatttcttaatcacccactactgttttttccacattatgttattaggaccttaattntgatcccatccctgagttgtcactcaaagtgcatagtggtttagattttttttagaggaa

SEQ ID NO: 20727 - DNA, 121 bp, Artificial Sequence
  Synthesized
  misc_feature (61): n=t or c
cctgacagcggctggccagaccgggtgagatgttgcttgcagctgccacacagttgtaagnctctgccaattacagttctccttaaagttttcaatttttggacagtgcacttaaaataat

SEQ ID NO: 20728 - DNA, 121 bp, Artificial Sequence
  Synthesized
  misc_feature (61): n=a or g
atgttttgcaacgtaaaaggtaaagtgactgtaacaggcagagctaccactcaccaccacngtggtaagaaaactacctgccttcaagaacttactgtctgattaggtaagggtataataa

SEQ ID NO: 20729 - DNA, 121 bp, Artificial Sequence
  Synthesized
  misc_feature (61): n=a or g
gaacaggtattctatctcttctgtactatttagatgcaattaatcatggcatgtttcagtnttacatatgctctgcaccctgcgaatttcagagtctgttgatcttgctcactttttttcc

SEQ ID NO: 20730 - DNA, 121 bp, Artificial Sequence
  Synthesized
  misc_feature (61): n=t or c
ttaataaagctccatactcaaactcacccttaagtcacacagctgttacagccaaatgcanttctacatcagaaacacatcttgaaaaagcgatgttcatttccaccttatttttagccca

SEQ ID NO: 20731 - DNA, 121 bp, Artificial Sequence
  Synthesized
  misc_feature (61): n=a or t
cctagcccagaatggacgagggcttgtctgtgttcatgccttcagaagtatatttctctgngcttactggttcttggaggtgttgatgtgcaatgtgccctgtgtggctggtccctgtgct

SEQ ID NO: 20732 - DNA, 121 bp, Artificial Sequence
  Synthesized
  misc_feature (61): n=t or g
tgaatccagacgaacattactgatgtgcttcaagtgttcaaatccactggactcatgcatncttccctatgctgctgtgcaatgacaaagtactgaagagatctaaccttccttccatttt

SEQ ID NO: 20733 - DNA, 121 bp, Artificial Sequence
  Synthesized
  misc_feature (61): n=a or g
aattttgtcttctgtgttttgtacaaataattcacatggttttatgctagacagctcctcntatttctggagtatctgtacaaatgatcttgaaatgcatatattgtaataaacagagagt

SEQ ID NO: 20734 - DNA, 121 bp, Artificial Sequence
  Synthesized
  misc_feature (61): n=a or g
atttacattaaatatcttgcatcacccacctgatttgtgtgttatacttgaacttctgtgngatcagatggccttatacatttttgtggaactcttataggtccataagaataaatgaatt

SEQ ID NO: 20735 - DNA, 121 bp, Artificial Sequence
  Synthesized
  misc_feature (61): n=t or c
cacagatgattatttattgtttggatagggacaaatgacaaacaaagcatttcagagaacnatatcttctgccaaggcagagtttctagttgaggcttggttggaatcctttgttttttca

SEQ ID NO: 20736 - DNA, 121 bp, Artificial Sequence
  Synthesized
  misc_feature (61): n=a or g
aacaaaacggaggaaatgatcaccagaagtgccatgacgtaccagagaaatcagtatttcncacaagtttatagctacagaaaatggttttgcccttccactcagcagtctgggaatgttg

SEQ ID NO: 20737 - DNA, 121 bp, Artificial Sequence
  Synthesized
  misc_feature (61): n=a or g
aagtgaagaaatgacgttagatgttggctttctgttaggaagggattgcctaggaggatgnaagggtctgcactggaggtttttggaagctcagatcaaccactgttgagtgctttgtgtt

SEQ ID NO: 20738 - DNA, 121 bp, Artificial Sequence
  Synthesized
  misc_feature (61): n=t or c
attttttaaaatattttttaacaagaagtagtaagtaagcaaacatcaattcaaagtgagngttttgaatgtgtgaattagaaggtaaagtgactagcagttcaggttttttaataggctt

SEQ ID NO: 20739 - DNA, 121 bp, Artificial Sequence
  Synthesized
  misc_feature (61): n=c or g
gattgttttccttgcagttaattatttgtatttattttttcttcttaatcctaaacattanatgatggtttgaagaatacagagcttatctaagtacagtcatcttgtgactggcttgcat

SEQ ID NO: 20740 - DNA, 121 bp, Artificial Sequence
  Synthesized
  misc_feature (61): n=a or g
tactgctaaaagttatattcgcttttgcattttgaaaataaaacgtttaaaactgtgtatnctgtatggtaaagttttaggaaaacttgtgaaaattatgtgggcccttattctatataaa

SEQ ID NO: 20741 - DNA, 121 bp, Artificial Sequence
  Synthesized
  misc_feature (61): n=a or g
tccagtgctaccaaccagagcaggtccactcctgccacgtgctaaaggtaaagaaaatccnactggtaaaactgcatgacatggagcaccaaatggcatttcccattaacaacaacaaaag

SEQ ID NO: 20742 - DNA, 121 bp, Artificial Sequence
  Synthesized
  misc_feature (61): n=a or t
aaagtcttacctcttgaactttcttacagttcttttctggtttggttttcttctctttagngtagtggcttgtgactgggtgccattacagtacttctcgttactctggtctgggagcagt

SEQ ID NO: 20743 - DNA, 121 bp, Artificial Sequence
  Synthesized
  misc_feature (61): n=t or c
caggtttgcatgcatgaattcctgagaaatttaaggaaaagctaacactaaaaacatgtangttcttccttaaagagaatcagcatcacaaaccactatactgcttgatgggctggccctt

SEQ ID NO: 20744 - DNA, 121 bp, Artificial Sequence
  Synthesized
  misc_feature (61): n=a or g
tatgtaagaggagtggggcattttttatataatcgtgataaacagtgaaagtctaccacantccataaacaggacataagaaacatgattccctttatagaaagtgtcagaaaagacaaga

SEQ ID NO: 20745 - DNA, 121 bp, Artificial Sequence
  Synthesized
  misc_feature (61): n=t or g
gggcagccaggaggttacactgcacttccacatcttctcccagttccctgatcctctcctncaccccttagggactctcttatgggagcttcatggataggttgatggttggactgcacga

SEQ ID NO: 20746 - DNA, 121 bp, Artificial Sequence
  Synthesized
  misc_feature (61): n=t or c
tctttaataacatgtccaactggtgacagtgtacttatgaagaacagacaggagatagtanatgggcaggtgttcaaaggatcccatttaaattgtctacctttatttcttctgttcctaa

SEQ ID NO: 20747 - DNA, 121 bp, Artificial Sequence
  Synthesized
  misc_feature (61): n=a or g
tgagccgtatggatattaaaagatatgactgaatcaaaacaaccatctaatattaaaatgnattttgcaaacttcttgggttaatttttcctatgtagccaacatccaagggtcaatttct

SEQ ID NO: 20748 - DNA, 121 bp, Artificial Sequence
  Synthesized
  misc_feature (61): n=a or c
cgcccatgaccacgttctctaggtttccataaccgaggccagcgtgtttcacccagcacancttggagcaagacctctcactgctaattcaaaacacttcatttcaagagttggagacagc

SEQ ID NO: 20749 - DNA, 121 bp, Artificial Sequence
  Synthesized
  misc_feature (61): n=a or g
gaatggcatagagatgaaaagacaatcatgttcattagggcaccctaacgttagttctacnggaataaagtgtatttccccaaaacaatgccaaacagatctgcttagaaaacagacacaa

SEQ ID NO: 20750 - DNA, 121 bp, Artificial Sequence
  Synthesized
  misc_feature (61): n=t or g
atctgtgatgctaatgacagaggttttgagattttaggtagtgcatttcacagactgaatnagatattgtacgaacagagtcatgccaagcgtaccagggagatgagcacgtgcttgcagt

SEQ ID NO: 20751 - DNA, 121 bp, Artificial Sequence
  Synthesized
  misc_feature (61): n=a or g
ttatatctagctggcttaggctcttggatatagatcagacaacttagatcttttgtctgcngttcatatactagctgaatgaattgttagaggttgaatattgttgtactttggtctctga

SEQ ID NO: 20752 - DNA, 121 bp, Artificial Sequence
  Synthesized
  misc_feature (61): n=t or c
aaataattttaactaaaatgaaaatctacactgaaatcttgcatttcacaaactacagaanctcaagcgagtttgtgcagaaattgttggaaatttttcttaattttggtttatgttttag

SEQ ID NO: 20753 - DNA, 121 bp, Artificial Sequence
  Synthesized
  misc_feature (61): n=t or c
aataacagatcgctgtcagatatcagaccttaacttaccttgcagatgatgtcttctcatngtaaaatctctttcccctttaggttcttggataaaagatgtcaagaactctatttcctag

SEQ ID NO: 20754 - DNA, 121 bp, Artificial Sequence
  Synthesized
  misc_feature (61): n=a or c
tctaatagcgctgtgcagaagtgttgctcggattatgttgcatctggcttcacagtccagntgaaatcaaatcactcactgacccaacagaatagctgcagagtctagcagctgaacagcc

SEQ ID NO: 20755 - DNA, 121 bp, Artificial Sequence
  Synthesized
  misc_feature (61): n=a or g
aacacatatgtaagggaagcctctggtgatacatacgttgtacagagcccaaagcgtgagnctgggtgggtctgggctgcgttcacaaacttctccagaagttgggagttaagagattttg

SEQ ID NO: 20756 - DNA, 121 bp, Artificial Sequence
  Synthesized
  misc_feature (61): n=a or g
cgctttaaatagcccttagcaataagctgggataaagagcttaaaagtttgcaacgcaacntgcgaagcaccccgcaactccgccagccccaggtgagcacctgagggcacagcacacagc

SEQ ID NO: 20757 - DNA, 121 bp, Artificial Sequence
  Synthesized
  misc_feature (61): n=t or c
ggttaaaagaaaggccacgagctgtaggttcaagatggtgtcatgaccacacctctgaacnaccatggcattgagcaccagcactgctggcagccagcactgcctagttctcaccaggcag

SEQ ID NO: 20758 - DNA, 121 bp, Artificial Sequence
  Synthesized
  misc_feature (61): n=t or g
ataaacatgactcagttgcagacagcctgctgcatgcgtgtgtgccgtgttcctccttganttcattcatctcagctggaaataggtctgagagaggcagaatgcactggtaagtaaaggg

SEQ ID NO: 20759 - DNA, 121 bp, Artificial Sequence
  Synthesized
  misc_feature (61): n=a or t
cagacatatatatgaccacctgtattatccagaaggatctaggagttaagtagctttacangatagtgaaaagtgactattttgtcaactgaaggaaaaaaaaataaaaatacctaagact

SEQ ID NO: 20760 - DNA, 121 bp, Artificial Sequence
  Synthesized
  misc_feature (61): n=t or c
acatctataatgactgagaaatagtgaactgttcttctgtgggtgtcccagaagtttacantgaaggaaattcagaaaaatagtatctttcttttcctcccacttgctctttccacctttc

SEQ ID NO: 20761 - DNA, 121 bp, Artificial Sequence
  Synthesized
  misc_feature (61): n=a or g
aaaatatgacttgagctctgctctgaccattgatttacacagaggcaaaaatggttagttngaagctggagcatacatatgtgacagcatttgccactgtaaacatgtccataaaggcttc

SEQ ID NO: 20762 - DNA, 121 bp, Artificial Sequence
  Synthesized
  misc_feature (61): n=a or g
tcttttgggaacgtgtgattgacacagaggaaggcagatcagcttattgaacactcattcngctgcagtcttgttccagggaatatgcttagtttatagacttctggggttattctgtgtt

SEQ ID NO: 20763 - DNA, 121 bp, Artificial Sequence
  Synthesized
  misc_feature (61): n=t or c
acctgtattaaaaagaacacatgagatgaatcccagatgttttaatatggcactactttcnagactaactggatcatgatgagaaacaaatgaaagtaaatgtttaaaaaataaagaccta

SEQ ID NO: 20764 - DNA, 121 bp, Artificial Sequence
  Synthesized
  misc_feature (61): n=c or g
cctggctttcatcttcagagaagaataagttcttctaaaacataaaattgtaaagacacantacattttagcttttgtatccaaaagattaaaaaggcattcgaccaatttttaactgact

SEQ ID NO: 20765 - DNA, 121 bp, Artificial Sequence
  Synthesized
  misc_feature (61): n=t or c
atgaaaaatttgacttttaaaaacctgtcacatttctgaaactggcaaaaaaagtacccangaatgaatgtgcttatgcatctctcacagacagccttgcacttatgaattttaatattcc

SEQ ID NO: 20766 - DNA, 121 bp, Artificial Sequence
  Synthesized
  misc_feature (61): n=a or g
taatatcccagctagccataaaaaaattcctttaggttttaaataaatatcttttagagcnattaaaaaacatgagtgcaaagtgtaagtttcattgcatatgaagtgatgaaatgagtgt

SEQ ID NO: 20767 - DNA, 121 bp, Artificial Sequence
  Synthesized
  misc_feature (61): n=t or c
cttctgaagaaaattagtgttacatgccaatacacttcttggattaaactgattaaagcanataaagaagctgttacttttcaatgaataagaagttgtgttagttaaagagagtagctaa

SEQ ID NO: 20768 - DNA, 121 bp, Artificial Sequence
  Synthesized
  misc_feature (61): n=a or c
ccttgctaagcctatggcagtaacacaaaactgtttaattaggtaacgttattaattcacnatgaggtgaagttcaacccacttatatctactctaataacttaaagagctttttaaaaaa

SEQ ID NO: 20769 - DNA, 121 bp, Artificial Sequence
  Synthesized
  misc_feature (61): n=a or g
tacagatccccactgagcaatttctgacctgtagcttctctctgttgtgagactgcttgcnggtaaacgtccagttttaatgacaagataaacagtgatcatagaatcatagaatcacaga

SEQ ID NO: 20770 - DNA, 121 bp, Artificial Sequence
  Synthesized
  misc_feature (61): n=t or c
gttaacactctaaactgataggttgactggttttgctagtgtaaagttcccctgctgtctngaacttctggttatggagttaataaaaccagtatttctgtttactgtaatgtaaatgtga

SEQ ID NO: 20771 - DNA, 121 bp, Artificial Sequence
  Synthesized
  misc_feature (61): n=c or g
tagcctgctgatatcaatgaagtgctagtagcgcttagaatatcgtatgaacacgtccctncccccctttttgttaatacagaggaagcctgcactaggtacagtctctttgagaagtgtt

SEQ ID NO: 20772 - DNA, 121 bp, Artificial Sequence
  Synthesized
  misc_feature (61): n=a or g
ggccactgcttgccagatcctcgtcaaatcctcagcagcagcactcctacaagtgaggcancttggcatgccaaaaagctttacactgaaaatacttccttaattggtcaggtcctgcctg

SEQ ID NO: 20773 - DNA, 121 bp, Artificial Sequence
  Synthesized
  misc_feature (61): n=t or c
attctacgattcatagaatcactaaggttggtaaagaccactacaatcgtctgttccaacnatcaacccatgacaccacacccactagactgtgccacaggtgcgaagggagatgggtagt

SEQ ID NO: 20774 - DNA, 121 bp, Artificial Sequence
  Synthesized
  misc_feature (61): n=c or g
gaatagttacaacactccacaaaagtatttctaattacagtgtccttaaatgcaagtactnaggatatcagaacagttttctttttatgtagctgcataaccatttgcagcacagacctta

SEQ ID NO: 20775 - DNA, 121 bp, Artificial Sequence
  Synthesized
  misc_feature (61): n=a or g
aattcctgaataagatcaccaaacacgctaagactatcccatttcacactccattatgctnagctttatttaactcttcatcattcggttctttcctcatcatttagttaactttcatact

SEQ ID NO: 20776 - DNA, 121 bp, Artificial Sequence
  Synthesized
  misc_feature (61): n=t or c
ctgaagtctaaagtttgtatgtttactaaagaaaatgaagagaaccaacagccagagaacngggaaaaaatcctcactgtacatataagatgctcctaggaagggaaattttccagtctgg

SEQ ID NO: 20777 - DNA, 121 bp, Artificial Sequence
  Synthesized
  misc_feature (61): n=t or c
ctccacggccgttgcccagttgctcagcgtgatccttcctgtagggaaaagggaaagccangagaccagtggctgaaaacacgtaaagactgtcacccccaggtgctatatagggccagac

SEQ ID NO: 20778 - DNA, 121 bp, Artificial Sequence
  Synthesized
  misc_feature (61): n=c or g
gcaagaaaactgacaaaggttttgtactgtctgaactttccaagctgtcgctagctgaganactaaatgtaatggtatgaaagagagcactacagagctgtagtagttgtaatagtcaatt

SEQ ID NO: 20779 - DNA, 121 bp, Artificial Sequence
  Synthesized
  misc_feature (61): n=a or t
atctttggatcttattcatttggcttctgcttttttcagaattgcatgttgtttcactgtngaaatatgcatatgcttccattgttcattaataaaattcactgcaagtaaccttattttt

SEQ ID NO: 20780 - DNA, 121 bp, Artificial Sequence
  Synthesized
  misc_feature (61): n=t or c
aaaataatctaacggtcatagaaacacatttttcaccagggggttcttcattagccctggnttcctctcacagctcgtttcctggaagcgctttttgctgacagaggtgggcaggagctat

SEQ ID NO: 20781 - DNA, 121 bp, Artificial Sequence
  Synthesized
  misc_feature (61): n=t or c
gtggtcctggggtcaccctgcttgccctcccgagttgctccctgttgttcagctcactgcnttgccatcttcttggacaagttttcatggtattgcttgtttattttattacagagatatt

SEQ ID NO: 20782 - DNA, 121 bp, Artificial Sequence
  Synthesized
  misc_feature (61): n=a or g
catgagcactgagctgtgaacctcctcactttgtgagacagatgagcaactcgggtaatgncagctcagtgtgctgaccaaccccaggttcagatgcatgctttaagacctcctttgtccc

SEQ ID NO: 20783 - DNA, 121 bp, Artificial Sequence
  Synthesized
  misc_feature (61): n=a or t
cgctggctaccaggggctgcaatcagaataacttttgctttgtagacctttgatatccaanaaaacactccataggttactaaccactgttatcatcattttacgggagagacaaccaagc

SEQ ID NO: 20784 - DNA, 121 bp, Artificial Sequence
  Synthesized
  misc_feature (61): n=a or g
acacactaagccaatggtggaatttgcaagaattcggtggcaaatctcctgagctttggcngaggttaggccattgggagtgggccatcccagtgggagttttatccgaatcccttcaaaa

SEQ ID NO: 20785 - DNA, 121 bp, Artificial Sequence
  Synthesized
  misc_feature (61): n=a or t
ttttaaaatgctgaaataaatagcggttttgtttgtttgttgatttttgtctgctttatcnctgtgggaattccatgcccagtctgaagagccggacaagtcagaatctgaagcaagtcgg

SEQ ID NO: 20786 - DNA, 121 bp, Artificial Sequence
  Synthesized
  misc_feature (61): n=t or c
tgtaacctccctgctgtgaaagagcacagagggaagtctaacttctgcactgccattttgntttctacacataagcatgccacgccctgtcctctgccatccctcccccatacttaatgtc

SEQ ID NO: 20787 - DNA, 121 bp, Artificial Sequence
  Synthesized
  misc_feature (61): n=t or c
cttgccacaggaccttccatctcagttacgttttctttactctgatgtttcctccaccttnatgctcccttgccccatggctggttcataattcaatttcttttagttaaaaaattggaag

SEQ ID NO: 20788 - DNA, 121 bp, Artificial Sequence
  Synthesized
  misc_feature (61): n=t or c
aactttgtttgtacctttcagcactgttttcaatgatcggcacttttcttgtgaaaactgngatggctgtgtcagcggtggttttgattctgccacttctcaggtaggtactgaactagat

SEQ ID NO: 20789 - DNA, 121 bp, Artificial Sequence
  Synthesized
  misc_feature (61): n=a or g
tctgcgtttccaagtcacataactgcaattcatacagatagatgtataaatgctaagtaanagtatacagtatccagaaatacttgtggtatttgaagcatagaaaacagagtaaaataag

SEQ ID NO: 20790 - DNA, 121 bp, Artificial Sequence
  Synthesized
  misc_feature (61): n=a or g
tgccacaaggcatgagggcatgtcatttaaaccaaaaatcctccttcctctatgaaggatnccctatgaaaggccttcaggaaaaacatccaagtttaaaaaaaaaatgatacatgagtgt

SEQ ID NO: 20791 - DNA, 121 bp, Artificial Sequence
  Synthesized
  misc_feature (61): n=t or c
ttcatttcctacctttcctaatgtttcctttggggtggagattaagagacaagacaaagantggcctagtagtagtgactaaattcttaataaatactgggatttatcatatcttatcatc

SEQ ID NO: 20792 - DNA, 121 bp, Artificial Sequence
  Synthesized
  misc_feature (61): n=a or c
gcagaaaaacttcaagttattaagaacccttgtctttcctttcaagacaggcagcttaaanaataaatgttactcagtgcatccttcctgaagagcagtccctttctctcacttgtgagta

SEQ ID NO: 20793 - DNA, 121 bp, Artificial Sequence
  Synthesized
  misc_feature (61): n=a or c
ctctctgcatgatctcttttaatggaaatacgtgacagctacccactgctgggtcctgagncacaggctgatgtggccatgggatgttggcgtgctaacaaacacttcacagcaggattca

SEQ ID NO: 20794 - DNA, 121 bp, Artificial Sequence
  Synthesized
  misc_feature (61): n=a or g
tatcactttctctccagatggtagcaagttccaagtagctggttctcatttccacacaccntgacacatgccctgaggttgttaggactccaatgcttccaacagggcttttgttagacta

SEQ ID NO: 20795 - DNA, 121 bp, Artificial Sequence
  Synthesized
  misc_feature (61): n=a or g
gatgttgtaccagacgtgttttgctacatcaaaaatctttgttttttgcaagggatcatancatcaagtacttaaagaactttcttgcttagcgtttctaaaatttgccagcttattcaat

SEQ ID NO: 20796 - DNA, 121 bp, Artificial Sequence
  Synthesized
  misc_feature (61): n=t or c
cacaacatgctaatgctgcaatttgcttttcccataatctaaactcaaagcattggcttgntcttccagggaaagagatggtggattacatttgccagtacctgagcaatgtgagagagag

SEQ ID NO: 20797 - DNA, 121 bp, Artificial Sequence
  Synthesized
  misc_feature (61): n=a or c
gtcaaatcacagaaaattttaccacttcaaaatagaaatggtgtgaagcaattctggagantgtttaatatttaacaattagtcaaagcagcctgcttaaaaaaaaaaaaaaaaaaaaaaa

SEQ ID NO: 20798 - DNA, 121 bp, Artificial Sequence
  Synthesized
  misc_feature (61): n=a or t
agtggagaatagccagactgctgctgccttggtggtccggccaatgcgtttctaatggagnagcaaaggaattaaaatcaaatgcagaacgtgtttttgcaacaacaacaacaagaagaag

SEQ ID NO: 20799 - DNA, 121 bp, Artificial Sequence
  Synthesized
  misc_feature (61): n=a or c
ttatggcttttttctgaagggatgaaaatatatttcaaaaatatagccaaaataccatagncagatggtgcacgttttgctacagttagtgtcattactgaattcttgtttaaaagccttg

SEQ ID NO: 20800 - DNA, 121 bp, Artificial Sequence
  Synthesized
  misc_feature (61): n=a or g
ctcctaaggtcacccaatccttgcagtatgatgttaaacaacatctcccacttttatgccnctggtgtatcattaacattacatctccttttctctcctcacctcttcaatacacaacaaa

SEQ ID NO: 20801 - DNA, 121 bp, Artificial Sequence
  Synthesized
  misc_feature (61): n=a or g
taaccttaaagtaatccatatctcaaagaactgaagttcaactgagcatcaatacagtggnaagaaacaagtgcttctgttatccgagagagagacaactacagagaatgcaggcataatt

SEQ ID NO: 20802 - DNA, 121 bp, Artificial Sequence
  Synthesized
  misc_feature (61): n=a or g
tctattggtttgtggaattccctccaattttctttcttaaaggactctcttcagtccttcnttatcctcagtcatgtcctgaatcattatgttagattatgccttataaaaatggagaaaa

SEQ ID NO: 20803 - DNA, 121 bp, Artificial Sequence
  Synthesized
  misc_feature (61): n=t or g
atctagattttaaatataacagctcattcccatatagtgtttagtattaacattttctcangttacattacagatgttatcttcatggccattctcatgttaacgaaacaggacacagaaa

SEQ ID NO: 20804 - DNA, 121 bp, Artificial Sequence
  Synthesized
  misc_feature (61): n=t or c
agaagatttggaagaaaagggagaatgattcaggtctagggttccattacaagtagttctntttatccctgcctgctcatttcatttagctgatgcgtgaattgtgtcagaataacttgca

SEQ ID NO: 20805 - DNA, 121 bp, Artificial Sequence
  Synthesized
  misc_feature (61): n=t or g
tcttacctgaatatttgggcattgttttgtctcatcggatatttgagaaaaaaagggatanggcaacagtaaatggaaataaatttttatgtgtaggaatgctggctaagcttgagttcag

SEQ ID NO: 20806 - DNA, 121 bp, Artificial Sequence
  Synthesized
  misc_feature (61): n=t or g
ctgccttcaaatagtagaagatcccataactgcatggatgggacaccattaagaacctttntatacttctgaagtgaaacagactaaccaggatcctagtaaatggaatcatcttccaatt

SEQ ID NO: 20807 - DNA, 121 bp, Artificial Sequence
  Synthesized
  misc_feature (61): n=a or t
tctggaaaacccagtcctagaaattaaatttggataaagcaggtgcagtaaattttatttncatggttctccaacaaaacagcatctgtcttcaatccttttaaatttcagttcaatttaa

SEQ ID NO: 20808 - DNA, 121 bp, Artificial Sequence
  Synthesized
  misc_feature (61): n=a or g
caaggtttagtgtgttgaaagactatcctatttgtttaaatttgttgaagcccaagaaaantatgtaaggggttttctttatgttcccatgattttctatcccattttaaataaaacaaag

SEQ ID NO: 20809 - DNA, 121 bp, Artificial Sequence
  Synthesized
  misc_feature (61): n=t or c
gttttagtacatttagccacgttatcaagcacaagagctgtttacttcaatgatggccttngtttgttttgaaatatacctttcatatcaattacagcaaccctttaatttgcttcatcac

SEQ ID NO: 20810 - DNA, 121 bp, Artificial Sequence
  Synthesized
  misc_feature (61): n=a or g
tgtgtactttgagatgaatgggtgtgagcagaaaagcaaagcagggtttgtccagctcacntgcagggaacagaccatgtaagatgcctacaacagtaggtatgggactaaaagcaccagc

SEQ ID NO: 20811 - DNA, 121 bp, Artificial Sequence
  Synthesized
  misc_feature (61): n=t or c
gtgctccagtgtgtccatatcgctcagcaggtttatagaaggctagctctgttatgaggantgtgaggaagccccttaaaatgggtcacctgcagctctgctggcagctttgtttctgacg

SEQ ID NO: 20812 - DNA, 121 bp, Artificial Sequence
  Synthesized
  misc_feature (61): n=c or g
attaactttaaaggtcccttccaattcaaacaattctataaccatgattctatgacacagnacaggagggtgacacttcagttctgtaggagctcagtttgtccagaagccctgggtgggg

SEQ ID NO: 20813 - DNA, 121 bp, Artificial Sequence
  Synthesized
  misc_feature (61): n=c or g
cacatagaagaaaacatctcagatccagattcagtggcattatagattgcttagcgttgantggaaatatatataaggatgcttccttatgctgactttgaaatgtgcttctaatgaaatt

SEQ ID NO: 20814 - DNA, 121 bp, Artificial Sequence
  Synthesized
  misc_feature (61): n=t or c
tggttatggttacataaattatgcctttaggcattagcctttcctcttggagccagtccantgtagataagcaaatattcagagaattataggtagctccctagtctaatagctgaaactc

SEQ ID NO: 20815 - DNA, 121 bp, Artificial Sequence
  Synthesized
  misc_feature (61): n=t or c
aatgcccctgtaactcttacacaggaccaggagggtgtttcttcaagctccctgagcagcnctgagaagcctgatttcctctgaaatactcttcagaggctgacttccattcccacctccc

SEQ ID NO: 20816 - DNA, 121 bp, Artificial Sequence
  Synthesized
  misc_feature (61): n=t or g
aagcaaagcgagcggaatcaagagtgtgtgtaaggagtgtcactgtgtcagagtaagtganaaaatgttaccgtgggcatttaaatcccatgtgatcattactctgtcagtaaagcatagg

SEQ ID NO: 20817 - DNA, 121 bp, Artificial Sequence
  Synthesized
  misc_feature (61): n=a or g
ctcaggcacacgatcacctgctcatctgtctgaaatatggtcaggtctcacggcagcatcncctttatattggtacaaatctccaacccatcattaccattaaacaaatgacagcctgtct

SEQ ID NO: 20818 - DNA, 121 bp, Artificial Sequence
  Synthesized
  misc_feature (61): n=a or t
gcaaaagatctttctctaattccagcagcagatgtaaatactaacaattgtaacaaaaaantaactgcagcagacagagcaaaacctgactagcttagctgtgtgctgtgcttcaatgcaa

SEQ ID NO: 20819 - DNA, 121 bp, Artificial Sequence
  Synthesized
  misc_feature (61): n=t or c
tacgtacacttacatcaccacctaccaatcaaagcaggacagagttcacgcattaagccangcaccctttggaagataatgaaagaggtgcaagcataaagcagaaatcaatcatctatga

SEQ ID NO: 20820 - DNA, 121 bp, Artificial Sequence
  Synthesized
  misc_feature (61): n=a or g
atggagttcagattccctcttgatggagtatgtggatgctatgtagattcctgggagactntaatcagaacacacatggagaaatcagaccttgcagatttcaattctgtcttggtctttc

SEQ ID NO: 20821 - DNA, 121 bp, Artificial Sequence
  Synthesized
  misc_feature (61): n=a or c
acactctataaaatagatgttattgcaggacccaccatctctaaagctttcagaacatgcncaccacttttttatccaaggaatgcagcaagcagggaagatgcacagcattaccaccctt

SEQ ID NO: 20822 - DNA, 121 bp, Artificial Sequence
  Synthesized
  misc_feature (61): n=a or g
ggtgatttaaccttctgtattctaggatttgtgtgtctttcctaccatgtgatgcctatanggcatggttttcactcaatgtattaatgaaaaaggtctttccatttctgtgtaactatgt

SEQ ID NO: 20823 - DNA, 121 bp, Artificial Sequence
  Synthesized
  misc_feature (61): n=t or c
atttccaagggcttcctaagtcttcctcattgcctctactgccagtctgcccttcatctangcaggatgctggactgggtcagcactgttgttggttttattctgtctggggaagagggca

SEQ ID NO: 20824 - DNA, 121 bp, Artificial Sequence
  Synthesized
  misc_feature (61): n=t or c
tacctgctagatgggggaactgaatgaagcacttgggagctgttttttcagagtacttagngttgtctgtcttcaaagcagaggtctgacttaaatttcactgtaagtgcaagtggagcac

SEQ ID NO: 20825 - DNA, 121 bp, Artificial Sequence
  Synthesized
  misc_feature (61): n=t or c
gccaagaacattttccccagaggtgaaggcacacaagactagatttactttttaagatacntgttagctgtgtttgaagcccatcttaccctttactgattccaccactactactctgtcc

SEQ ID NO: 20826 - DNA, 121 bp, Artificial Sequence
  Synthesized
  misc_feature (61): n=t or c
tctgtttcatgagaaggaaaacaaagctaaagaattgccatttcatatctcgcacattcangttatgtatgtgaagaaaatttctggctaagcaagtttgtggtgtgagttctcagttcca

SEQ ID NO: 20827 - DNA, 121 bp, Artificial Sequence
  Synthesized
  misc_feature (61): n=a or g
atatggagcttttcagcctgcaagagttcccactgacagccctaaaggcaccacagacccncagagagaaattacaattctctgctcttttgtcttacagtttttctctctctcttttttc

SEQ ID NO: 20828 - DNA, 121 bp, Artificial Sequence
  Synthesized
  misc_feature (61): n=t or c
aatcagttcccaaaggtgtgaggtatgtgcaaattagttccctgctgtgtgtgtatctctntcctaattcttctgagtcagagaaacgcaggaactccgaagaactgtatatatcttaatg

SEQ ID NO: 20829 - DNA, 121 bp, Artificial Sequence
  Synthesized
  misc_feature (61): n=a or g
aaaggttttggaataattcaggaactctttgagcttcctgcagtccttgtaggatatgagncaggagaaactgggcagtagctgtgtaacagcagcaggatatgttttatcagtgttatgt

SEQ ID NO: 20830 - DNA, 121 bp, Artificial Sequence
  Synthesized
  misc_feature (61): n=t or c
aactcttttacatgtgaaatgatactaagtcactggaaatgagaaggtcccaccatgaagnagcaaatgaaaacaaattcaaatgggaaggcagactttaaaaagcagattttaaaccaag

SEQ ID NO: 20831 - DNA, 121 bp, Artificial Sequence
  Synthesized
  misc_feature (61): n=c or g
taaaaccacaaccaactcaagtatctgagtaccttcatgtaggtcttcagcacaatagtanagaatcgcctaaactagcttctctaagcaataaaggctgctataatattgtttccctagc

SEQ ID NO: 20832 - DNA, 121 bp, Artificial Sequence
  Synthesized
  misc_feature (61): n=a or g
tgtaaaagcagccttagcacaatgggcatgcattcaacatcaaatctttcttgaatcaaangcctgagcttaacgccttttagcacaacatttcagccaagttcacaattactgctcagaa

SEQ ID NO: 20833 - DNA, 121 bp, Artificial Sequence
  Synthesized
  misc_feature (61): n=t or c
ccagctgtgtgtacagtgtgggcaaggggttggggtgtagttcctggtggtgaatgaggcnggactcctcaccagaccagcaacctgctgatataatctggtttctctggggctagatcac

SEQ ID NO: 20834 - DNA, 121 bp, Artificial Sequence
  Synthesized
  misc_feature (61): n=a or c
tatccacctttatttctttacatctgtgtatctcttattccttagtcctgcgagttggganagaaaaagattccaaagtaagggattttacattttggatcatcttctgaggataaacagc

SEQ ID NO: 20835 - DNA, 121 bp, Artificial Sequence
  Synthesized
  misc_feature (61): n=a or g
cctagctaggaactgctgttcctctgcatagtccagcttgccttaggatggtacattacantaaccctagctacaggcctgcagtcagaaaagattctgggaatagaaatgtatagtggtt

SEQ ID NO: 20836 - DNA, 121 bp, Artificial Sequence
  Synthesized
  misc_feature (61): n=a or g
taaactggacaaccatttagaacaatttaataacatggccaatgaattgtgctactgtacnattaacatctgcattttagtaagttttaattaaaaatggaggatcctgtgtttgtactct

SEQ ID NO: 20837 - DNA, 121 bp, Artificial Sequence
  Synthesized
  misc_feature (61): n=a or g
gctgttttctaggaacagattggaaatgctgagttttatgacaatagattgagctgccgtngtctgatttctttgtgcacactgcagtagtgcatcagcagctgaaggatacgtggaatta

SEQ ID NO: 20838 - DNA, 121 bp, Artificial Sequence
  Synthesized
  misc_feature (61): n=t or c
cagattagaaatgcatgctgtttgctgtttctcaactcatacaaccaaagactgtttctgntgtacaagaacttgctattttttgttaactactattgaacataagttctgtgagtgaatt

SEQ ID NO: 20839 - DNA, 121 bp, Artificial Sequence
  Synthesized
  misc_feature (61): n=a or g
tctaatatactgtatgtatagttattgtattttaaatgatgtataatttttcagtttctgntgagcaaacgtctaggaagcaccttgaaaacagcttctgccattgctgttcttggagttt

SEQ ID NO: 20840 - DNA, 121 bp, Artificial Sequence
  Synthesized
  misc_feature (61): n=a or c
gctgcctttggtatagccacagtgtcactcagtgagacaataaagtcaattctcggtaganaggagattatgctcacctcagctgatgttggtctcagtgcttataagactacactctttg

SEQ ID NO: 20841 - DNA, 121 bp, Artificial Sequence
  Synthesized
  misc_feature (61): n=a or t
tgggtacgtcttgtgtagaaactcactgctcatcttttggcatggagcgtcacagtgtagntagcaaggatgtttcctaggattctcccatcataaaacgacaacacagaccctctgtcat

SEQ ID NO: 20842 - DNA, 121 bp, Artificial Sequence
  Synthesized
  misc_feature (61): n=a or g
gtgtgtgagccaagccctcaggctagacacatttctagtctacaggaagcctttcaaaccntacagaccttcatcggtgccagaaatctaggttgatttcaggctcagctaatgaagtttt

SEQ ID NO: 20843 - DNA, 121 bp, Artificial Sequence
  Synthesized
  misc_feature (61): n=a or g
gaccatcaaagcttgagctggatgattgctctgaagtacttgttggcagtgcctgcatcantggcgcaaggtgtttgcactgacgatgcagaagggtggttggggggattttcaactgtaa

SEQ ID NO: 20844 - DNA, 121 bp, Artificial Sequence
  Synthesized
  misc_feature (61): n=t or c
cagaagcagttccataagaagctaactggtgaccacatcattttaacttaattgctccaanctactcagcagcaatagctacgcctctgaaaacacagcagaaccttttctaacccacaag

SEQ ID NO: 20845 - DNA, 121 bp, Artificial Sequence
  Synthesized
  misc_feature (61): n=t or c
accagtacattttgtgtgtaagcatagcactctaactcctttaacctaagccttctgctgntttaatgctaacattagtaggggtagccttcaggagttctgaagttttcttacataatct

SEQ ID NO: 20846 - DNA, 121 bp, Artificial Sequence
  Synthesized
  misc_feature (61): n=a or c
acaggttccttcagctgaaatgtctttgtcttccctacagtaggactcaacaaccagctgnatttcttccccagttgctcaggaagatgcatgaggagcaccttgctggtgtctgagctct

SEQ ID NO: 20847 - DNA, 121 bp, Artificial Sequence
  Synthesized
  misc_feature (61): n=a or g
tattcaccttcttacaaaggaagcctggaatcccattgattcctttgcaaacctcccaccncccaagacctccacaactgaaacaccgtgttctttactccccggcacttctcccttgctg

SEQ ID NO: 20848 - DNA, 121 bp, Artificial Sequence
  Synthesized
  misc_feature (61): n=c or g
atttgatgttgtatgtttagatttagggtgatgctgttgatgcctaatcccatgtggagancttggcagtaagatggctatgttactatgtattgcagagacctggagaattttttcctct

SEQ ID NO: 20849 - DNA, 121 bp, Artificial Sequence
  Synthesized
  misc_feature (61): n=c or g
acacttctttaccactgctagtcccaagacaagtgatttttaggcatgtgccattagcctnactgcagtccaaacccagtagcacaaagctctaagctggcaaatatcaagatgaatttgt

SEQ ID NO: 20850 - DNA, 121 bp, Artificial Sequence
  Synthesized
  misc_feature (61): n=a or c
ctattttaggcagtttggggtttggacagctgcttggatacaggtcccatttaaaacatcngtgtctgatggcaagctttcactatgtgataggttttactacatttgctattctgttaga

SEQ ID NO: 20851 - DNA, 121 bp, Artificial Sequence
  Synthesized
  misc_feature (61): n=a or g
gaattgagccagaccccagggcattttcatcttgccttcggatggctaaattctcaatccntaggcattgggaattatattttctgaagatggataacgtgtttcctgacccgagtgatgg

SEQ ID NO: 20852 - DNA, 121 bp, Artificial Sequence
  Synthesized
  misc_feature (61): n=a or g
ctgctactaatccgtcctagggatcaaattatgggctctagtttgctcttgcacaaaaccngggcaatttgagagttccttcttgtactgctatatcctcatttccacagaactcgtattt

SEQ ID NO: 20853 - DNA, 121 bp, Artificial Sequence
  Synthesized
  misc_feature (61): n=c or g
tggtgccttttcactgcgatgcccttttggccttttttatttctctctccaaagacaaaanctgtctgctcactcttgctcaaacttctgccattcctctttgttccttttctaaagagga

SEQ ID NO: 20854 - DNA, 121 bp, Artificial Sequence
  Synthesized
  misc_feature (61): n=t or c
ggcaaggcctccccaggtgagtgtgtgccccactgctgcattgacagttggactctgtganctgagaggtcctgagtgatgccgtgattctaaccccctgtgtctgggggatcctgagcat

SEQ ID NO: 20855 - DNA, 121 bp, Artificial Sequence
  Synthesized
  misc_feature (61): n=t or c
tgcattaagcaacagcttccactaagctcaagagcccgtgccaattgtgtcccaacagaancaacgcactgctcccaaacgctcaggtttaaggacttcctacactgtttccatatttgtg

SEQ ID NO: 20856 - DNA, 121 bp, Artificial Sequence
  Synthesized
  misc_feature (61): n=t or c
gaaaggatcatggatgtagggcaggaaattggaggagatgtaagagagctcccctaggcanggagcactgagcaggttcattgcatgggcatggcaggaccatgcagccttcctttaggaa

SEQ ID NO: 20857 - DNA, 121 bp, Artificial Sequence
  Synthesized
  misc_feature (61): n=a or g
gggcatttttacaaatgttcgtagcttatacttgaacagcatctcagggtttgttactgcntagaagaacaggattaaagtcaggtggcaaagaatgggatttccaaagccttcaaaactg

SEQ ID NO: 20858 - DNA, 121 bp, Artificial Sequence
  Synthesized
  misc_feature (61): n=a or c
agttcaataaaattgaatggatttcactttagataaacaaaatgcaaatgagccaaaaaancccccacaaactgcagaaatttcccaaacatctgcacgagagtcttgtatgtgcagtata

SEQ ID NO: 20859 - DNA, 121 bp, Artificial Sequence
  Synthesized
  misc_feature (61): n=a or g
tgtttcaaagctcaaaactataggatgggtgaacacatagacacaagcagcttccacagangtactaagcacagagattaacccctcacaatgaggaaacagtgaggacagcaggcatacc

SEQ ID NO: 20860 - DNA, 121 bp, Artificial Sequence
  Synthesized
  misc_feature (61): n=t or c
gattcggtgcagttctttgcacgggggcttccctgcaggcaggaccagtttcacatcacanccacctcattcagacctcactcttgagacaaaatgtcgcagtgtggccccattgcctcct

SEQ ID NO: 20861 - DNA, 121 bp, Artificial Sequence
  Synthesized
  misc_feature (61): n=t or c
ctgaaatgattttagtgagctgcagagtttcctgtcagtgtgctgctaatgatttttgttnttaagatggctccagagataatgacccattttacatgatggaaatagtttttcctatatg

SEQ ID NO: 20862 - DNA, 121 bp, Artificial Sequence
  Synthesized
  misc_feature (61): n=a or g
cacacaggatattctcaggctaccaagagaaaccagaaaacacttcaatgagaaacaagcntgacaaacagggcttttagaaaactattgagtgaaagctactgaaaacagggtaaacgtg

SEQ ID NO: 20863 - DNA, 121 bp, Artificial Sequence
  Synthesized
  misc_feature (61): n=a or g
cacagagactgagacggagctgggaacctgaagggaacctttcccatctcttaccataacntggttcatttactatactttggagataatgcaggaggttatgacccgtgtagacatgttt

SEQ ID NO: 20864 - DNA, 121 bp, Artificial Sequence
  Synthesized
  misc_feature (61): n=t or c
gaaaagcaccaccatttcagcatctacttactggggcatgatatgtattagatcatcaaancttggagtaagacgcagtaattttggagaactctagtatactacattggtgtatatttaa

SEQ ID NO: 20865 - DNA, 121 bp, Artificial Sequence
  Synthesized
  misc_feature (61): n=t or c
ccagtttaaaacctaaatctaaatcctcaaatccaacattcagtactaggaatatacaganctgtttcagattcctgcagagtttcaaaatgtaagggcgtcaggatgcttaggccttggt

SEQ ID NO: 20866 - DNA, 121 bp, Artificial Sequence
  Synthesized
  misc_feature (61): n=a or g
acgcttgcatgccattacacactgttacacacgcttacccactgtagcactctgttacacncgtttgcacgccggaacatgccgttacacacgcttgcacactgttacaaaggctcgcacg

SEQ ID NO: 20867 - DNA, 121 bp, Artificial Sequence
  Synthesized
  misc_feature (61): n=a or c
tccttaccactatggtttttggtcaggtctgaagttgctttggagatacagagcactgtanaaacatgctagatgtaaacagattatttcacaaaggttttcttcataattgcattgaaat

SEQ ID NO: 20868 - DNA, 121 bp, Artificial Sequence
  Synthesized
  misc_feature (61): n=t or c
catctttttcagacttagacaatgatagctgcaacttgaaacaggccggtaaagaggttcnccttgtttcagagaactgaaaaagaacagcccaactgacagaggcattgcccatctgtat

SEQ ID NO: 20869 - DNA, 121 bp, Artificial Sequence
  Synthesized
  misc_feature (61): n=t or g
tggctttaatggttggtatctctttggccacccagatctcaggacaaatccttcagacagnctcaggccccaagaagtcagcagacctgttcacatgactgagaaaactttgagttaatac

SEQ ID NO: 20870 - DNA, 121 bp, Artificial Sequence
  Synthesized
  misc_feature (61): n=t or c
ctgcctttccaatgtccatgtctatgaagtcctctggtgagtcttgtgtgccttccaccangcttccctccgcacctgctggctgctggtggcacatcccaaccttgcacggtctcaccaa

SEQ ID NO: 20871 - DNA, 121 bp, Artificial Sequence
  Synthesized
  misc_feature (61): n=t or c
tcagtatttttaactttttgttacgtggtcttttccgttttctgcgttgtgttgaatgaangacttaacacaggtaggaaaaaaaaccgtgagagagctctttgccgggataattccattt

SEQ ID NO: 20872 - DNA, 121 bp, Artificial Sequence
  Synthesized
  misc_feature (61): n=a or g
aatcacttaacaaaaacggaattgaagtattcctattaagactattgcatgtcaagtatgngcacagaaaaaagccaaagacaaatttgtttcaataactgaattacagtagaagatgtta

SEQ ID NO: 20873 - DNA, 121 bp, Artificial Sequence
  Synthesized
  misc_feature (61): n=a or t
gcagtactggactccatcttaacacattaaaatttaacccatttatcttctggaaataatnggtgctgccagatagaaacctttcttccaggatgattgtagcttgaataattgggtaaat

SEQ ID NO: 20874 - DNA, 121 bp, Artificial Sequence
  Synthesized
  misc_feature (61): n=t or c
tgtctgagtgtggcccttcctgcaacctatgaactttttgtcatcccatagacaccttccnagagcatcttggtcagcactgtggagtgagctgaagtcagtgtttgacttacatcagaca

SEQ ID NO: 20875 - DNA, 121 bp, Artificial Sequence
  Synthesized
  misc_feature (61): n=a or c
tggtcttttactactactatactgaataatctgattacatattcctatatggcaggaaatnccacatggtgcgttaagattactggttaaaagcatcaatttgtttttacctctgatgtct

SEQ ID NO: 20876 - DNA, 121 bp, Artificial Sequence
  Synthesized
  misc_feature (61): n=a or t
tttgctctatctggtcacagcacactgcaggctgagtaacgtctttgtcaattacaaagcnagaaatgttgaggctccctgaatattttcttagattcttgcacagggtgaacagaacctt

SEQ ID NO: 20877 - DNA, 121 bp, Artificial Sequence
  Synthesized
  misc_feature (61): n=a or t
gatagaaagtcagatgtgtagtgtattttataagccttagaaacagccattgccttctgtnctctaggcaaagaagttgacatagcatttctgttgggctaacaatgttggatgaatgagt

SEQ ID NO: 20878 - DNA, 121 bp, Artificial Sequence
  Synthesized
  misc_feature (61): n=a or g
acagccctcccagacaaatcccatagaggaagcgctcattaaaacaacagggctacttacnggatttccgcaggatgcttccgatgcagtgaggggcttaacctgacagcaccctgcatct

SEQ ID NO: 20879 - DNA, 121 bp, Artificial Sequence
  Synthesized
  misc_feature (61): n=t or c
taattattttactttaaaatgttcctgttttcatgcaatgacagatagtgctatccagaanggacacgagagggcagaagtaaaacaacctacaatttgctgactttcaaacaactaaact

SEQ ID NO: 20880 - DNA, 121 bp, Artificial Sequence
  Synthesized
  misc_feature (61): n=a or g
tctttcatttctcagaagaaaaaaaatgtatatttgccaaatatttcattgcaatttctanttgctaggatttaattactctgtatttatgcaatgtactacttagtgttcaatagcaaac

SEQ ID NO: 20881 - DNA, 121 bp, Artificial Sequence
  Synthesized
  misc_feature (61): n=t or c
cttttttgcatcacccttaacaggctgtagttgtttgtttccaccaatgtgaggaagaganaaagattctttatcagttgctattatctgattgttgcaattagccctgatgtggggacag

SEQ ID NO: 20882 - DNA, 121 bp, Artificial Sequence
  Synthesized
  misc_feature (61): n=a or g
aggaatctctagctggatacccaaagctcggcattcaaaaactacatactatttctgcacnttttacttctcacggtaagaaatttctcaacagcaaatataacagcatactgtggtatat

SEQ ID NO: 20883 - DNA, 121 bp, Artificial Sequence
  Synthesized
  misc_feature (61): n=a or c
gagccctcaaaccgtcccacatgtctgcaaacaaaagtcaacccccaggagcaggcacagngccaaaggctgcgctcccatcccagaacacgggtaccgtggccaacagcgctgctaagaa

SEQ ID NO: 20884 - DNA, 121 bp, Artificial Sequence
  Synthesized
  misc_feature (61): n=a or c
agaaatgctcatctgtttgtgagaatgtacataggggaaaatacagtgctctgcaccctgnattgggatttcaggcctctcccttcacatgcaggtagaccacgatggcttggctctgggg

SEQ ID NO: 20885 - DNA, 121 bp, Artificial Sequence
  Synthesized
  misc_feature (61): n=a or g
agaacctccctttttctttttcctgtcctgtaagtaaatcaaatcctgatcagaaacgcancctttcacaaacatgcctggtagacagttatagaaaaaaaaaaaaaagacaaaactgtgc

SEQ ID NO: 20886 - DNA, 121 bp, Artificial Sequence
  Synthesized
  misc_feature (61): n=a or t
ataacccataggaactcatatgttaatatgagtttaactgtatacgttgtacaaaaacaancttacttcacactaatttgcttactgaaatcaaatctgtatgtggctacaggttattacc

SEQ ID NO: 20887 - DNA, 121 bp, Artificial Sequence
  Synthesized
  misc_feature (61): n=t or c
agcattcccccctttgccagagatttgctttggggggtccttcccaggcagagctcccagnacctcagcaccacaaaaggatggatcagccccacagcactaatccactgccatctcccac

SEQ ID NO: 20888 - DNA, 121 bp, Artificial Sequence
  Synthesized
  misc_feature (61): n=a or g
catgctcagcatccaccacacagcatcaagacctcacactgtcctgtaaggctctttcccntactcacagctgctctgtatgctgccagccctataggcagtgtgcccagaataggtaggg

SEQ ID NO: 20889 - DNA, 121 bp, Artificial Sequence
  Synthesized
  misc_feature (61): n=t or c
gtacaaagtcatgtacagctgctggcatgaggtttgttgctccttctttcttgtgacttantttacttcacttgcaatgtggatctgaaggctatccttgatagatagataggtatccttg

SEQ ID NO: 20890 - DNA, 121 bp, Artificial Sequence
  Synthesized
  misc_feature (61): n=t or c
ccacaccatcatttatgccgaagagcagcaaaaaacctcaggtcaccgaaatgtcattcanagaagaatttctttgtcagcgcagtgctttcaaagctgagacagtagactcacctgaaac

SEQ ID NO: 20891 - DNA, 121 bp, Artificial Sequence
  Synthesized
  misc_feature (61): n=t or c
tctaatatctgttctttcagcctgctttgagtaaacaatgaatattaagcagccaggtctngagaccaacgttcacttaataagaaaacactgctcacgtaagaagagtccatgtgagcaa

SEQ ID NO: 20892 - DNA, 121 bp, Artificial Sequence
  Synthesized
  misc_feature (61): n=a or g
ggcttccacctgctgagctgttacctgcctgtcatttcatacatgccttagtgagagatgngtgttcaggagggactagaagaggaagaaaagttgcaggcttcaaggtctgggttgctct

SEQ ID NO: 20893 - DNA, 121 bp, Artificial Sequence
  Synthesized
  misc_feature (61): n=t or g
cccattggctcccattgtttccctccatttcaacagaagagccagagctcattggttaggnatgaggaagtgctaggtttcatttttaagatgctacggaggaagcttagattatagctgc

SEQ ID NO: 20894 - DNA, 121 bp, Artificial Sequence
  Synthesized
  misc_feature (61): n=a or g
gcaggtatttggcccctctgtgggcagagttgagaggtgagccccagctggcatgtctgcncatctctgtaagttcactgcatttgcctcttcaaatgcagctcccctgaatgtttctgtg

SEQ ID NO: 20895 - DNA, 121 bp, Artificial Sequence
  Synthesized
  misc_feature (61): n=a or g
ttagaaatctgtagtgttaattatacaaacattttttattctatcctcctcaaagctatcngtgaaagataagtagtatcatgggaatgaaagacataatgtttaaatagcatactgaaaa

SEQ ID NO: 20896 - DNA, 121 bp, Artificial Sequence
  Synthesized
  misc_feature (61): n=c or g
ttcagggataggccttcctgaggcatcaagagaaagacaagatagatgccagctaaaaatntttggtgtaaccagctcatgaatttctgtgagctgaaccacacaggaagctctggtaaac

SEQ ID NO: 20897 - DNA, 121 bp, Artificial Sequence
  Synthesized
  misc_feature (61): n=t or c
tgtataaatatggtaaatcagagtagatcagagtagctgtttaccttcactgcagggattntttggctcttatgctttagcactatcttatgaatagatctatatatactcctgggtgtct

SEQ ID NO: 20898 - DNA, 121 bp, Artificial Sequence
  Synthesized
  misc_feature (61): n=t or c
gacaaagctcagcttactgcctctcctaggatcagtcacatgagtacctcaaatcaaaggntgcctggggcagaagcactctgagtacatctgaaaggatttcaaaaggatgctgaagctt

SEQ ID NO: 20899 - DNA, 121 bp, Artificial Sequence
  Synthesized
  misc_feature (61): n=a or g
cactttacagctcaaactaattttaccttagctctcttgcagctgctcttggtcagctcanttatgtctgtgagatatgggattttatgggaatggttttaaactgagacaggggaggttt

SEQ ID NO: 20900 - DNA, 121 bp, Artificial Sequence
  Synthesized
  misc_feature (61): n=t or c
aaaaaatgtgatgggaataagtgcatatacatagcactcagaacagaactgtattgatgcnggtagattttgcagtagcatccggagctccaatatcacaaaaaaatgtagagtcccattt

SEQ ID NO: 20901 - DNA, 121 bp, Artificial Sequence
  Synthesized
  misc_feature (61): n=a or g
tgacttactatacttctttgaagttctttgatggatatctgatccttaaaacagtgccaanttctgtgcacttaaacctgtctgctatgggcttttatactcatcataactatttccctgg

SEQ ID NO: 20902 - DNA, 121 bp, Artificial Sequence
  Synthesized
  misc_feature (61): n=t or c
tcccatgcttgctagctgtttcttgtgttggctgctcagcctaacaaccgtgcagagctgncctttgcactcctaccgtacagctgttagtatagcattttctaattgattttactcaatt

SEQ ID NO: 20903 - DNA, 121 bp, Artificial Sequence
  Synthesized
  misc_feature (61): n=t or c
cagtttaggacacttcatacgtgaaattctaggctagcaatactcattttatttaacgttnattgcaaaccgagactcccacccaccaggacctttcttgtagcattgtgtcttttgtgtc

SEQ ID NO: 20904 - DNA, 121 bp, Artificial Sequence
  Synthesized
  misc_feature (61): n=a or t
attattcttaaattatgcagtctatatatcaatagtggcatataagggaagtgttagctgnggtacagcactggatccagctcagtaaggacccactgaagtcattttttactatttctgt

SEQ ID NO: 20905 - DNA, 121 bp, Artificial Sequence
  Synthesized
  misc_feature (61): n=a or g
gagctgtgctccggatggatgtcaccctgattgccacttgggtgaagttttccaatggaangaggagctgagcacgtggcagatgtgaccacacatctccaggcaccacgcagccgcgctg

SEQ ID NO: 20906 - DNA, 121 bp, Artificial Sequence
  Synthesized
  misc_feature (61): n=t or c
gcctatgctaaaagagtttgctctggggtgtaaaatcatcttatgtgaagcagaagtgctnatgcactgtacgcagatggagtccaagcacaaacttaagagtcggtgtagagctgttcaa

SEQ ID NO: 20907 - DNA, 121 bp, Artificial Sequence
  Synthesized
  misc_feature (61): n=a or g
cactataaagaactgggatatgagacaccttgccttcatttaagcaccccacaccacacanatgctttttgcatggttgatggctcacagccagaagaaaagtcccctagccttcccattc

SEQ ID NO: 20908 - DNA, 121 bp, Artificial Sequence
  Synthesized
  misc_feature (61): n=a or g
tccaatggtataaatttaactacttgatcttagcagtggctgaaggaagtttagtgttatntttgcagtcagcaacaagataaaatgaacattttttatttcttttttttttttttttaag

SEQ ID NO: 20909 - DNA, 121 bp, Artificial Sequence
  Synthesized
  misc_feature (61): n=t or c
gatgagcccattggggttgcggggctcctgccagcgcaacagcacgctgttcttgctggcnggttcccaggtcacattgccaggaatgttgtcagcttgcactaggcaggacatagatggg

SEQ ID NO: 20910 - DNA, 121 bp, Artificial Sequence
  Synthesized
  misc_feature (61): n=a or g
tactaatcccttaaatagggacttgactaccctagaactctcattctgccacaccaacatncattcattctactacataactcctactcttcaggagctattcctgactttcacagctaag

SEQ ID NO: 20911 - DNA, 121 bp, Artificial Sequence
  Synthesized
  misc_feature (61): n=a or g
ctgttcctctaaccactttgatctacagacttaagcatctccaagctccctctgtgcactngatagaaggactctgccctgtgcttctctcgaaatgcaataattaagtatggtctgtttc

SEQ ID NO: 20912 - DNA, 121 bp, Artificial Sequence
  Synthesized
  misc_feature (61): n=t or g
ggaaattctgctgcaattctggtgttgatcatcagactgtgaatcatttgtgttaaacttnaaaatctgagcattttaattcctgtctgatatttttgtatgaaaacttaagttagtatat

SEQ ID NO: 20913 - DNA, 121 bp, Artificial Sequence
  Synthesized
  misc_feature (61): n=t or c
tagcattcatattgccttggaacagagtaaaaggagtagatgatctctcaaaatctctacngtgattattgtttgtaactgaagtgttgatttcctcagagtagtctccaaaacggaacat

SEQ ID NO: 20914 - DNA, 121 bp, Artificial Sequence
  Synthesized
  misc_feature (61): n=a or g
cttgtcctgctagaggactacaaccaccttcacacctgctgcaaaagttgcacagcaagcngtaggcaattcaggaggcttctggaatgtattgaggataacttcttgagccaagtaatgg

SEQ ID NO: 20915 - DNA, 121 bp, Artificial Sequence
  Synthesized
  misc_feature (61): n=a or g
atcattaaatcaataattatgtttaaaaatgtctttcacaaatgtttccatttgatgtttngtccatttttgtacttttaaccgactacctaaattgtatagcacaaatatctttcattct

SEQ ID NO: 20916 - DNA, 121 bp, Artificial Sequence
  Synthesized
  misc_feature (61): n=t or c
aaacagagctggaaggtgtgctctaggaacagacagaatgtcaagcagctgctcaggtaanctgattgaacccacagcagtcctccctcaccagtcccaaatggttgctcttagcacaacc

SEQ ID NO: 20917 - DNA, 121 bp, Artificial Sequence
  Synthesized
  misc_feature (61): n=t or c
cctaaatctggtgttgctgctcagaatgtacagcaggtgcatacaaagtacaaatccgcanggtgtaagctcatacaggatccggtgtgcttagataaaagagaagcatcagactcataaa

SEQ ID NO: 20918 - DNA, 121 bp, Artificial Sequence
  Synthesized
  misc_feature (61): n=t or c
gataatggaacagggaggttgctagaaggcagaaacaaaaaccagcaaaccctctgaaaangtgtttttacaaacttaaggaaagctttatctgaagatgaactgcttgttatgatgcctt

SEQ ID NO: 20919 - DNA, 121 bp, Artificial Sequence
  Synthesized
  misc_feature (61): n=a or g
ctggggctgacttcaaaacagccttgcatcacaccctgctttacaggtgaactcaaagaancagtcttaccattctaagtggatgaatatgccagggtaactgctctggatagagcatgtc

SEQ ID NO: 20920 - DNA, 121 bp, Artificial Sequence
  Synthesized
  misc_feature (61): n=t or c
tactgggcaaacttttatttatactacaaactttacaggaagattacacgcttagattctngctatgcctcggaccaggtagatccaagaacagtttgggttgtgcacattgttgtgcaca

SEQ ID NO: 20921 - DNA, 121 bp, Artificial Sequence
  Synthesized
  misc_feature (61): n=a or t
ttttgaagttgaacttgctgttgattttgatttttaattggttaattattaatgtgcaggnaaataaaactgctgtcttgttacatttgcctttttaacaaggtctgatacaaattatgta

SEQ ID NO: 20922 - DNA, 121 bp, Artificial Sequence
  Synthesized
  misc_feature (61): n=c or g
ctgtcctacctgtacaggggaagttgtatattggtttcagaagaacagaggcagtcctgantgtgctgtaggtatgagtggggaaacctgtacccaagatgtgtttgaagggctgctgtat

SEQ ID NO: 20923 - DNA, 121 bp, Artificial Sequence
  Synthesized
  misc_feature (61): n=t or c
gatcttgctcaggacctctttaatgcagtgacattaaactcttcttcctagaggaggagantagaagaaggtattgcttgcacacacacgcagaagaagttggagggagaaacagaaatct

SEQ ID NO: 20924 - DNA, 121 bp, Artificial Sequence
  Synthesized
  misc_feature (61): n=a or g
gcaggaagaaacccagccaggagggcagtagctttaaaactttaatcctttcaagcaaatncagaatacatgtgattcagctggagaatgaatcagaggtgattcccagatatccctcatt

SEQ ID NO: 20925 - DNA, 121 bp, Artificial Sequence
  Synthesized
  misc_feature (61): n=t or c
caagggaaagtggaaaaattgtggtcttcgggaactttttgtaagaggtggtataaagggntgaagtatacagtactgtggtggtgaagatgtacggaacagtttctctagtaatagtagg

SEQ ID NO: 20926 - DNA, 121 bp, Artificial Sequence
  Synthesized
  misc_feature (61): n=c or g
aacaaacattctcccatctacattaattgaatgttcagctctcattcctagcacttggctntctacgctttaatgtttctcgagtgctcttgactttatcacagcatttgccctgttgagc

SEQ ID NO: 20927 - DNA, 121 bp, Artificial Sequence
  Synthesized
  misc_feature (61): n=a or g
gaggagaggaagttcaggaggagaccaatggtgctggctgagagagaagagctcggttggntgatccaagcaaggcttacaatcatagaatcattcactcacacaatggcctgggttgaaa

SEQ ID NO: 20928 - DNA, 121 bp, Artificial Sequence
  Synthesized
  misc_feature (61): n=a or t
gaaggtcagtatccagatgctgaagggaaatgtcttttatattcttgcaatgaattgattnggtacttgagtgcatttgattataataatatcaacctcaggaacagccaccaaggaaaag

SEQ ID NO: 20929 - DNA, 121 bp, Artificial Sequence
  Synthesized
  misc_feature (61): n=c or g
aatgggatcatttgggcattctggaacacttgtggcaccgggcttaagtcatctaaggagnctggcaagggttcgtgaccttccatttgcaaaagcctgcagaagccttgcagtgcagcac

SEQ ID NO: 20930 - DNA, 121 bp, Artificial Sequence
  Synthesized
  misc_feature (61): n=a or t
tcagaacagctgaatttgaagtatggctttagttgaaaaccctggtaactgatggttaacnctgctgggactgtcagtgctcctgctttgctggtagaggtaagtaattcctataggagac

SEQ ID NO: 20931 - DNA, 121 bp, Artificial Sequence
  Synthesized
  misc_feature (61): n=t or c
ttttttttaatgagatctacatgaaacatgcacgagtgttctaaaagaaaaaaaggtattngagtaagcacaaccaaataatacaggttttcagtcatttacactaagagttttaagtgat

SEQ ID NO: 20932 - DNA, 121 bp, Artificial Sequence
  Synthesized
  misc_feature (61): n=t or g
agaaagaggatttacatccctttaatttcagacctcttcaagatgccttcaccccactttngctttgcttgaggtcccgtaagacataacatgtgtgttatttgctgagcagtaacaggag

SEQ ID NO: 20933 - DNA, 121 bp, Artificial Sequence
  Synthesized
  misc_feature (61): n=a or g
accataatgcttactttttctgaagtggaacgagcagggctgagcagtgggtcaaattgcnttctcactacctgtattgaccttgtgcttgaccacagaaacagactccatctcaatctct

SEQ ID NO: 20934 - DNA, 121 bp, Artificial Sequence
  Synthesized
  misc_feature (61): n=a or g
cagacataatctgcaatgattcaaagagtgtaaaagaaccatgtggatgtaagtgtcccanctaaatgcgtcagcctctgtacctccggcctctgtgcctcacactgatgtgctctgccag

SEQ ID NO: 20935 - DNA, 121 bp, Artificial Sequence
  Synthesized
  misc_feature (61): n=a or g
ccttggcgttatggggacttggggaaaaaaacccactcatccaaacattcagagcaagacngctaaaccttgtgaagaatggggaaactgttgctactggatggcattcccagttctacag

SEQ ID NO: 20936 - DNA, 121 bp, Artificial Sequence
  Synthesized
  misc_feature (61): n=a or g
agggttgccttctaatagaatgtgttactgttgttgtgttactggatcccacacaacagcncaatccctgcgtgcgtttgttctcttaggtgagcttcacttttcttgctgcttcttagca

SEQ ID NO: 20937 - DNA, 121 bp, Artificial Sequence
  Synthesized
  misc_feature (61): n=a or c
attttactgctaaacagagtacaatgcattaaaaaagaaacaacagccacaccaacttganacctaattttgatgctacacatgcaaataaccatccaaaaaagtcatttaagttgcctta

SEQ ID NO: 20938 - DNA, 121 bp, Artificial Sequence
  Synthesized
  misc_feature (61): n=t or c
ggcatcatacctgcctgcagctcccagtccttcagagttgaacacactacagtaagagggnacagactatatatatgtggcagcatccatacataaacacaccaacatttctttcatcaca

SEQ ID NO: 20939 - DNA, 121 bp, Artificial Sequence
  Synthesized
  misc_feature (61): n=a or g
aacgacttaccttagcagttaagcaggtgtggtaactttccctccgtggctgcaaaacgtngaatctcagagcttctgtgaacagcaaggtgaaggtgagcgcaggaagaggagggtgcac

SEQ ID NO: 20940 - DNA, 121 bp, Artificial Sequence
  Synthesized
  misc_feature (61): n=a or t
ctgaacttttatgttgtcagaaagctttgcctggtgttccaatgccagtgtcatagttcancagcatgtgacaaccagatgaattcaccaattctgaaaatgtcctaatagtttgacatga

SEQ ID NO: 20941 - DNA, 121 bp, Artificial Sequence
  Synthesized
  misc_feature (61): n=t or c
ctgcgcagctgcccagttgctgcgggtgggttacgtgctttgctgaagggtttggtaatcngtgctgcttcccttctccgagttccacagggctggcaaagcaggaaagcgctttggttcg

SEQ ID NO: 20942 - DNA, 121 bp, Artificial Sequence
  Synthesized
  misc_feature (61): n=t or c
gataatggagacctggtacttaatttggagagtactaatgacagtcacctgcatttggaanagcttctagatactgttaaagcacatgcttatgttgactactgaaaactgttgagattgt

SEQ ID NO: 20943 - DNA, 121 bp, Artificial Sequence
  Synthesized
  misc_feature (61): n=a or g
cactggaaaggtcaagagcagcagctttccaattacacatcatttctccatatcagaaagnccagttgtgcttcttaaggcaactaaatcttccaaagaaagaaatttgaaaaagtgcatt

SEQ ID NO: 20944 - DNA, 121 bp, Artificial Sequence
  Synthesized
  misc_feature (61): n=a or g
gatgacagatctggccaagcagctttatcttttgcaatacaaccagcagcagtctaggaanggtcgttaggcctgtcgcacatgacccttcactctgcattttctcagaccagaagagctt

SEQ ID NO: 20945 - DNA, 121 bp, Artificial Sequence
  Synthesized
  misc_feature (61): n=c or g
gtggagactttaccagcacatgccagtgtactacgtggatgtttggagtctttgctcaganttggctgttaccttgaaccaccctcagtggtggctgaaggcagcctaactgtttgctgag

SEQ ID NO: 20946 - DNA, 121 bp, Artificial Sequence
  Synthesized
  misc_feature (61): n=a or g
acaagcaggcaagccctctgtatccacccccataccacagcatcagtccttggctttacancctcagccagagtccagctccaacagctttaacccttcactgcctccctaaacctctgct

SEQ ID NO: 20947 - DNA, 121 bp, Artificial Sequence
  Synthesized
  misc_feature (61): n=a or g
tatttctgtttgcattccaggatgggtatattgcagaattgttcaggactcagagtagttncctgcactgtataacaatttcacaacaaaacccaaagacagactcagatctcacgtctta

SEQ ID NO: 20948 - DNA, 121 bp, Artificial Sequence
  Synthesized
  misc_feature (61): n=c or g
cctctgcctcgctctgaacgtaagaaaaatggttttggttcttagttgggcagaactgatncttcgaatctacgtggcacaacactgggaagttactgaggaagttctctggcagctgtgt

SEQ ID NO: 20949 - DNA, 121 bp, Artificial Sequence
  Synthesized
  misc_feature (61): n=t or c
taaactgcacggatcttgggagtaactggtaatcgtattactgaaaacatttatgacaagngatatttagactaacagtgcccctttaacttcatcacagtgaaaacaagttgaaataaag

SEQ ID NO: 20950 - DNA, 121 bp, Artificial Sequence
  Synthesized
  misc_feature (61): n=a or t
gattctcatgctgttctctgaatttcatgtacagatgtaacacagctctaaagaataagcnttctgccaacagttaatcatgtgcagttaatatcaaatatatatgctgcttttatttaaa

SEQ ID NO: 20951 - DNA, 121 bp, Artificial Sequence
  Synthesized
  misc_feature (61): n=a or c
tacctactgatattgcctatgtaagtggtaaaaatggatatgctgatttctgccccttagnctggaaccattgctacaggaaaggcacaaaaaagtgtgaggttctgctagcttgaagcag

SEQ ID NO: 20952 - DNA, 121 bp, Artificial Sequence
  Synthesized
  misc_feature (61): n=t or g
ccatgtatgttcagtttgggagaattagccctcttgaacagattcttccaataaacttgcnatgttttctcttgttactgctctcaccatccttaaatgtacgtttcataacatggtagac

SEQ ID NO: 20953 - DNA, 121 bp, Artificial Sequence
  Synthesized
  misc_feature (61): n=a or g
aagtgcagtggaaggtctgtaaacatgctccttagcagatagctaagctgccttgtttgcnggatgagctcttgtgtgctggagtgggtgacaccccttctcagagcaccttcctctgctc

SEQ ID NO: 20954 - DNA, 121 bp, Artificial Sequence
  Synthesized
  misc_feature (61): n=a or g
ccatatttgactgatgaactaaagaggcctaaatgagtaacacaaactggactaaagcatntgacctacaaaaaagtagaccgtaagtggctcatgtgtccttgaagcaaccttacaaaga

SEQ ID NO: 20955 - DNA, 121 bp, Artificial Sequence
  Synthesized
  misc_feature (61): n=a or g
cagtgcttcctggcagtatcggcttcccagcatgttatgcaaaggaaattatatgggatcnattttatttactagcagcctgaaacacaatgtcatcattccagtaccatcttcacgtctg

SEQ ID NO: 20956 - DNA, 121 bp, Artificial Sequence
  Synthesized
  misc_feature (61): n=a or g
gttctcttccagcctttgatgcattgttatttgaggaaatggtatgcaatcctaaccttcnctgctagtctgtaggctgtcctgtctgtctgagagtcttttgggtgatagcaggaatggc

SEQ ID NO: 20957 - DNA, 121 bp, Artificial Sequence
  Synthesized
  misc_feature (61): n=a or g
ccatgcagtataaacaggcattttcatcacatattgaataaccattaagatgctatatatntaagcagcattccctttgtattgttttccttgatgatgtcgttagaatctgacctttgag

SEQ ID NO: 20958 - DNA, 121 bp, Artificial Sequence
  Synthesized
  misc_feature (61): n=t or c
tagagttttgtatatggaagatcagacctatgtaggctttctgatgcaggatttgtgaggnatttaatctctagattacataaggtgcccagatgcctagtatattctctgaaacttgtgc

SEQ ID NO: 20959 - DNA, 121 bp, Artificial Sequence
  Synthesized
  misc_feature (61): n=a or g
ctttgcttccaagtcatggtacttatcaattggtttagggaaagggccgtacagaggacangagtaaaaacaaggacaaactttagcaaacacagccatgaatttggcaatttgtttctgt

SEQ ID NO: 20960 - DNA, 121 bp, Artificial Sequence
  Synthesized
  misc_feature (61): n=a or g
tccccccagttactttcaaccagatttatccttaaggaaagaagttaaagcaaattatacnctctgctaccatctttacataacctgaacactttaatagttggatgtcttgtccaattat

SEQ ID NO: 20961 - DNA, 121 bp, Artificial Sequence
  Synthesized
  misc_feature (61): n=a or c
caaatgcaatttctagtaggctgctattctttcaaagagaagtggaacttctaatagttcntcttagtctgaaatgagttctctaataaagtttactattgtgtgctttgagtcatttttt

SEQ ID NO: 20962 - DNA, 121 bp, Artificial Sequence
  Synthesized
  misc_feature (61): n=a or g
cacagacactgccttccaccccactgaacaacaggcagggattttcctacctagctcactntaaccatttctgatactgtccagcatccaaatttagggtcatttcaaaatactctttccc

SEQ ID NO: 20963 - DNA, 121 bp, Artificial Sequence
  Synthesized
  misc_feature (61): n=a or g
tctgccactgaccccattgagactgggagatcaagagcatcgcctgatgcagccaagtctnctgtgggttttgtgtcccctggcatctcttactcttcttgaaccgctctgaggagataca

SEQ ID NO: 20964 - DNA, 121 bp, Artificial Sequence
  Synthesized
  misc_feature (61): n=t or c
cttaatatgctaactataagtcaatttgctgctggggaaagggctggtggtttgtaaatgngatttgtgagtatggtatgaaatgtctttatggccagagttagatgtttgagaagtaagt

SEQ ID NO: 20965 - DNA, 121 bp, Artificial Sequence
  Synthesized
  misc_feature (61): n=t or c
atctcctaatattagagaaaaataatttgcttcgggtcaaacagcaagtcagagaaagggnaagtcactatttctttgcagacacacagctaacatatttaaaaagaaaacctgagaatct

SEQ ID NO: 20966 - DNA, 121 bp, Artificial Sequence
  Synthesized
  misc_feature (61): n=c or g
ctagctgaactataaagaaggctgtcacctgaacagcagatttaagatggtgtcttgtagncaccttccttttacttccagtcatgcacaatggcagcatgtatctcactaaagggaaggt

SEQ ID NO: 20967 - DNA, 121 bp, Artificial Sequence
  Synthesized
  misc_feature (61): n=a or g
aaacagcgtgcatcttgcattcattctttggatattaacttatgtagctctgttgctacantgccctggattcacattgctgagtaaatattgatggatacagagactggtcttgctatgg

SEQ ID NO: 20968 - DNA, 121 bp, Artificial Sequence
  Synthesized
  misc_feature (61): n=a or g
catacatgaagctgtgttcgaaaagatgtaggattacctgcagttaataaacttcccagcngttcagacaagaatctgctaaaagctgtatctcctaaatctgatcctgcatttcagtaat

SEQ ID NO: 20969 - DNA, 121 bp, Artificial Sequence
  Synthesized
  misc_feature (61): n=t or g
agttcttacctagtctgtgccttactttaagggtctgtttaccaccatcagacttgcactntgaacatcactgtcatagtaaatactgtggccttaaaaccccatcaaaatcagctgatca

SEQ ID NO: 20970 - DNA, 121 bp, Artificial Sequence
  Synthesized
  misc_feature (61): n=a or g
aactgtcttctgtctctttttcttagtcagaggcactcttttcagccagatcatttatacnaaggtaattatgaatatttcatatactcacaatatattgttggtacaattctctcacttt

SEQ ID NO: 20971 - DNA, 121 bp, Artificial Sequence
  Synthesized
  misc_feature (61): n=a or g
tgaaaatggtttcagtatgcaagtaggaatgaaaagacagtgagacttcaaagtgctgganaagcacatgggattcctgttgtgatctctcgaggctgctggtctgtcctaatctatcttc

SEQ ID NO: 20972 - DNA, 121 bp, Artificial Sequence
  Synthesized
  misc_feature (61): n=t or c
cacgtacactgctgggatacataagcaagttcacctgatttatggcttttacctgacttanggcttgtgcctccctgcttttcctgcttcagtttaacattctgcacttctataataaggt

SEQ ID NO: 20973 - DNA, 121 bp, Artificial Sequence
  Synthesized
  misc_feature (61): n=t or g
tgtaaatgactatctaatctgcatatacaattgagtaattagatgccatatgtaagagcanttatttataggtgcagaatcagagcccagtccttgtaacgtattatctcacaagccagat

SEQ ID NO: 20974 - DNA, 121 bp, Artificial Sequence
  Synthesized
  misc_feature (61): n=a or g
ggttggttatttctctgtgcagctgccacagtagttggaaataactttatccttttgaccntccctctggcttctggtcagacatctccttgtgtcacttccccctgaaatgcagtgctct

SEQ ID NO: 20975 - DNA, 121 bp, Artificial Sequence
  Synthesized
  misc_feature (61): n=a or g
ataaaagcatgaatggcagctaaatgactgctcaaaaaatgtttaacctaatcagagatantgagccttagtgctttaaaaaatggttataaacaacccaatagtagtcacaaaaattctt

SEQ ID NO: 20976 - DNA, 121 bp, Artificial Sequence
  Synthesized
  misc_feature (61): n=t or g
gtctaactaacacttacctggtcctccaagaagttgttcaaggtaaaaaagcaaagcaaancctttctcatatggaacagacgaataggcaacatcaggatctatttcattcagattgggg

SEQ ID NO: 20977 - DNA, 121 bp, Artificial Sequence
  Synthesized
  misc_feature (61): n=t or g
aaacgaaaggacaccgaggaagcgttaattacccgcggaaacactcggggaatgttgcttnaatcagggcaaagatgaatgctcacacaagcagtggctgtgactttggtgcgagctctcc

SEQ ID NO: 20978 - DNA, 121 bp, Artificial Sequence
  Synthesized
  misc_feature (61): n=a or g
tctcttcaaacatcattagcactcaactttgcgttgaagggaggagtaaactgaggtcaancgattctcaatttcacttgtttccaaagtttctcagctcacgtttactttaatctttgtt

SEQ ID NO: 20979 - DNA, 121 bp, Artificial Sequence
  Synthesized
  misc_feature (61): n=a or g
ttcatccaaaatctttgattaatcagccataggactctgtacatgtactaaatccaatacngatctctagatgtaagaaattcactgtagtggcaaaatgccactttctccattctcaaat

SEQ ID NO: 20980 - DNA, 121 bp, Artificial Sequence
  Synthesized
  misc_feature (61): n=t or c
gctggatggagaactgcccctcacatccacagcctcctgtgtgagagccaaatgtccactngatagggacctacctgaatgtgtcagatcatggcagagcaaaatgctttagagaggatac

SEQ ID NO: 20981 - DNA, 121 bp, Artificial Sequence
  Synthesized
  misc_feature (61): n=a or t
gcacaggagaaaaatacccttcttttctcagtttttaccaggaaaccatagcacaagaacnggatgagccctgagcagaatagcagcattccctcccccgtaactgtgtggggataactgt

SEQ ID NO: 20982 - DNA, 121 bp, Artificial Sequence
  Synthesized
  misc_feature (61): n=t or c
aaaaaatgtcccagacaatatccaagtaaactcagacacaaaataaacatctaaccttatnctgaattagtaattttgcatttaatgaacgacatggacacagctccatctgttcattctt

SEQ ID NO: 20983 - DNA, 121 bp, Artificial Sequence
  Synthesized
  misc_feature (61): n=t or c
agggatggaaatgtgtatttagattcaagagcagttacataatgaacctctcatgaagaanatctaggttgaatatttcaactctaatttctaaatgaattgaaattacagaagtcttgac

SEQ ID NO: 20984 - DNA, 121 bp, Artificial Sequence
  Synthesized
  misc_feature (61): n=a or c
agagatcacattttcaattggtgagttttctctagtagcaaaaggtcattttagaacatgnatttaatggattagagaagcctcttaggcatcagccctgtgcctcataaaattcttgagg

SEQ ID NO: 20985 - DNA, 121 bp, Artificial Sequence
  Synthesized
  misc_feature (61): n=a or g
gcttcattttctaatagactttgtgtcttctccagactatcacctctgcaaactattctcntacctcaggtagaaattttttcttctttggaattttcttcttttcactcagagggtggtg

SEQ ID NO: 20986 - DNA, 121 bp, Artificial Sequence
  Synthesized
  misc_feature (61): n=t or c
ctgcagcccaaggggatggatcaaatggctcctggagagcttggtagtggaatccagtagngtgcagccagatggatgggcaacgtgcaggtgagagctgatcttcagcagaaatcatgta

SEQ ID NO: 20987 - DNA, 121 bp, Artificial Sequence
  Synthesized
  misc_feature (61): n=a or g
aacctctactttcaaacctgatccaagacagaaagacacagcagaaccactggtgaatgcnggaacgattcccttttgcccaatctccccatgacaccttccctgaataattaactgcaga

SEQ ID NO: 20988 - DNA, 121 bp, Artificial Sequence
  Synthesized
  misc_feature (61): n=a or g
tgtcattctataatttatattgtaagtagattgtttacttagtttaaaaggaatctcatcntgataattgatgcatcttgatatgaacttagactatgttgaatgagacatccttataact

SEQ ID NO: 20989 - DNA, 121 bp, Artificial Sequence
  Synthesized
  misc_feature (61): n=t or c
cagtcaacttaaaacctctcatttctctatcaacattagactgtggaaggttgggccatgngtatgctaaaaccagcttatagctgaatctcctcagggttacactatcacgtttggagga

SEQ ID NO: 20990 - DNA, 121 bp, Artificial Sequence
  Synthesized
  misc_feature (61): n=a or g
actcctgataaagtcacaggattcactctttcctctatagagttgcacatttgctctccancttctctgttcatactcctgctgcaccattggcaagtgcaagctgactccttaatctatg

SEQ ID NO: 20991 - DNA, 121 bp, Artificial Sequence
  Synthesized
  misc_feature (61): n=a or c
ctgtaaccaaaattcagaggggggcaggatggatattccccttttgatcaccgtttggggntcgccatctctgctgtgtttgtagaactttactccctttgcagtatgctgccaaagttct

SEQ ID NO: 20992 - DNA, 121 bp, Artificial Sequence
  Synthesized
  misc_feature (61): n=c or g
gtcaaagaggctttgtaatgctgctttactgaaggacgaacaaggataattttcagttgantactttaaagttttgctcatacactcccgctgctgtggaaggatgtttcaagtgcatcca

SEQ ID NO: 20993 - DNA, 121 bp, Artificial Sequence
  Synthesized
  misc_feature (61): n=t or c
agttaactgttttttttacaacagagatgcttccatcatctgtttgctgtgaatgcaactncttgagttggaaaaatagagactcttgagcatgtctaggcataatgtacatgtaattagt

SEQ ID NO: 20994 - DNA, 121 bp, Artificial Sequence
  Synthesized
  misc_feature (61): n=a or g
tgtaggcaataaagtccagattttttactatcctggaaaacaagcagaggcagttaatggngggaggtgcaagactctcatgttccatttcacactgtaaataaagcctggagaacagttc

SEQ ID NO: 20995 - DNA, 121 bp, Artificial Sequence
  Synthesized
  misc_feature (61): n=a or t
ctggaataatagctgcagtacttttattggtactaaagccctgacatccttctgattttantttttttttgcatactttgtttctgtaactgatgcttacagcagtcattgtctggctaga

SEQ ID NO: 20996 - DNA, 121 bp, Artificial Sequence
  Synthesized
  misc_feature (61): n=t or g
ttctgtctgaccacagagtccatgctcttaccaggaagaaactctggggaagctcaaatancttttagttaggagctgtgcagcacttctggtttgtagactataaaatatgtattggaaa

SEQ ID NO: 20997 - DNA, 121 bp, Artificial Sequence
  Synthesized
  misc_feature (61): n=t or c
ttaccccttcagatacaccaatatttatgtgtctaaaggagctgttgtatttcaggacttngacagagacaggtcacataaaaatggctcagtcccatctggtgggaccagactctaaagg

SEQ ID NO: 20998 - DNA, 121 bp, Artificial Sequence
  Synthesized
  misc_feature (61): n=t or g
tgaagggagattggtcagtagtgggggaaggaaaaccagattccggcaaagctttttagcntagggcaggcagaaggcttccccgtgttgtgtcttcattcatcattgggcattttgcatt

SEQ ID NO: 20999 - DNA, 121 bp, Artificial Sequence
  Synthesized
  misc_feature (61): n=t or c
ctgcctgtagacatgcttgtatgtgtatgcctatacacacactctaatatctagagtgggngaggtattgttggcccatttatttaataaattgcttcttgttgctgcttcagagcaaaat

SEQ ID NO: 21000 - DNA, 121 bp, Artificial Sequence
  Synthesized
  misc_feature (61): n=a or g
ctaagagaaaatagacaaaatagcacagcacctggataagcatgatcatcttctccccatncacagggtaaggaacaagctctttaacaggcaacctaaaatgttatagaactaaactctg

SEQ ID NO: 21001 - DNA, 121 bp, Artificial Sequence
  Synthesized
  misc_feature (61): n=a or g
catactttcccagtagttgcaccttgagatggggacttgctgctgagattttgcctttgtngagtcagcttggtgggtgccattcctgtgagagcatccctggagcttgctcagaggcggc

SEQ ID NO: 21002 - DNA, 121 bp, Artificial Sequence
  Synthesized
  misc_feature (61): n=a or g
tagaagctgtgtaatagagatggcaggaataagcagctagctgttacactgacctaggctngtgtggaatcccagtctcgtcgtgttggtcagatgacatggagtgttgctgcagtggtta

SEQ ID NO: 21003 - DNA, 121 bp, Artificial Sequence
  Synthesized
  misc_feature (61): n=a or t
tggctttccctgcagatcctggctctgtaagcttactgccttttctactgaggtttttttnttcagcctaaagtgcacgcagtacgtagtcctaggcagcatagtttgaagcaagagccta

SEQ ID NO: 21004 - DNA, 121 bp, Artificial Sequence
  Synthesized
  misc_feature (61): n=t or c
ccagcaccactgtttgtcaaggctcagagcaagttacaggtttgcacgttgtaaccacatngtcacttctacagaaatcacatttacagtcctttagatccccatcgttagttaatatcag

SEQ ID NO: 21005 - DNA, 121 bp, Artificial Sequence
  Synthesized
  misc_feature (61): n=t or c
aaccaggttttgtatttcttcagaatgtttgttgtcattttagtgggggcattaggctganttggcctgtctgaagtccctataaactggaacattgtaattgactttggaaatcataaat

SEQ ID NO: 21006 - DNA, 121 bp, Artificial Sequence
  Synthesized
  misc_feature (61): n=a or g
caatcacatataatgcacatatgctctttggcacaaggaaacttttgaaatctgctcagtntaattgcaagacacaattccaagtttagtctgcctcttgatctgttccatattcagaaaa

SEQ ID NO: 21007 - DNA, 121 bp, Artificial Sequence
  Synthesized
  misc_feature (61): n=a or g
ctgaatcaacttgtctccaactggttttgagcctgtgttgatcggcctgtgaaagagaaancagtttctcctaagtgtgctgcgctctcactgaaatctgaagcccaactgtgctcactta

SEQ ID NO: 21008 - DNA, 121 bp, Artificial Sequence
  Synthesized
  misc_feature (61): n=a or g
ccaacattagaagaaatgatgagtttaattagaccagctgtggcatcatgccagctacttncattcaatggttctaccttcacccgtttggactcccaaaacacatacacacgtacctcca

SEQ ID NO: 21009 - DNA, 121 bp, Artificial Sequence
  Synthesized
  misc_feature (61): n=t or c
tcactgcactgtattagctaaatcaacctgaaaacagatgcagttctttaccttcccctcntgatttctgttacacaggcaagtcagtatcaacaggacccagtccttacttctctgcacc

SEQ ID NO: 21010 - DNA, 121 bp, Artificial Sequence
  Synthesized
  misc_feature (61): n=a or t
tgactggcatcaaggatattatctaatagaatttatattaaacgtcacctgggagatatanaaaaggaacttgcatataccatcactgtttagatattttgggagataagaaagagcattt

SEQ ID NO: 21011 - DNA, 121 bp, Artificial Sequence
  Synthesized
  misc_feature (61): n=a or g
aagaaagcatggagagctaagacctatgaaaagctcgatgcatgtggagtttcatagcaantgttacaagacacagctcaatttcacttctaagataaacaaaggaagggcccaagctttt

SEQ ID NO: 21012 - DNA, 121 bp, Artificial Sequence
  Synthesized
  misc_feature (61): n=t or c
agaagagtaaaggagaaaaaaaaatcttggtgtacctttcagatctcatgttttgagcatnctgttcaatcacttcagtctgtagctagttcaatgaaatcagaggagttgtgctgtggtc

SEQ ID NO: 21013 - DNA, 121 bp, Artificial Sequence
  Synthesized
  misc_feature (61): n=t or c
gaacctggtgtacgcacagagaggcagatggaggaggactgttctttgctctgcatcctgnaatgccactgtctgctctagtggcagctctgcccaaggccccttcacctctctcctaagt

SEQ ID NO: 21014 - DNA, 121 bp, Artificial Sequence
  Synthesized
  misc_feature (61): n=t or c
ttgttttgttttctttaagtatacttttggcaaataaatgtataggactcaaagtttgttngttgtttttttaaggagcaaaccaggcaagacccgtaagaaagatattacaagatatata

SEQ ID NO: 21015 - DNA, 121 bp, Artificial Sequence
  Synthesized
  misc_feature (61): n=a or g
cttcattttaataggtagactcagattttgttctcattctcatactttcctttttaagagntacaaacaggttatacctttctgcttttactttcaatttgttgaactttcagtagatgtt

SEQ ID NO: 21016 - DNA, 121 bp, Artificial Sequence
  Synthesized
  misc_feature (61): n=t or c
tgaaggctagtagagttgcatctatcaagttgcaactatcaagttgtcatgacataagttntctaaggcagaaatcagaccatttcattagcaatcatttaagtgaagcaggtatcattac

SEQ ID NO: 21017 - DNA, 121 bp, Artificial Sequence
  Synthesized
  misc_feature (61): n=t or c
ccctgctgcagccaggaatcgacgtcaagttgagtcgtcatattgtttgaattacaccaanatgaaaatatatgaaagccacagggagccagcattttcccttctatataaaatggggtta

SEQ ID NO: 21018 - DNA, 121 bp, Artificial Sequence
  Synthesized
  misc_feature (61): n=t or g
gacaactgatttgtgtgttctttgtgacaaaagaaaaggaagattttaattgataaaaatnttagatgtcactggatttgtgatatgaaaaacaccatcaatgaagtgtaaagccaatatt

SEQ ID NO: 21019 - DNA, 121 bp, Artificial Sequence
  Synthesized
  misc_feature (61): n=a or g
gacacagtgcaggtaggcagctgcagacttcttcagagctccggatgtcagaaaggtctcngggaaatcctgagttcttacggtcatgcaaatgatcacttttgcttgggaggctgtagtt

SEQ ID NO: 21020 - DNA, 121 bp, Artificial Sequence
  Synthesized
  misc_feature (61): n=a or g
tcaataggagtggtattcgtttgtactttgagaagtcaaaatcaaaaaaagcatgagagtntatttaggtagctgtagctcaacgttacgtatttcctgaaagtgggaattgtgagacttt

SEQ ID NO: 21021 - DNA, 121 bp, Artificial Sequence
  Synthesized
  misc_feature (61): n=a or g
ccaaacagccagagaaagtggcagcaacacggcaagagatattccaaggtaaactgatgcnaggcctctcctacacctgtacgtgagaactgtacctcttctagctgagcctgcctatcca

SEQ ID NO: 21022 - DNA, 121 bp, Artificial Sequence
  Synthesized
  misc_feature (61): n=c or g
gttcataaagtattctttcatgccagccagatccatcaaggcttgttctatagctacggtnttggtttcttgaaaaaaaatagatagcattgccttgtaagaactcttcctaaactgtggt

SEQ ID NO: 21023 - DNA, 121 bp, Artificial Sequence
  Synthesized
  misc_feature (61): n=t or c
ccacagcatcaaaaagatcagttccctttgcttggagtcatctgtgttgaagaactgcctngcagagcaaggtggtacgacttggaggtttcagtggaagagaacagctcatttttttcag

SEQ ID NO: 21024 - DNA, 121 bp, Artificial Sequence
  Synthesized
  misc_feature (61): n=t or c
taaaatgggaaccctctggccactttcaaatatactaaacaaaggatgctacaaatttccngtagtttacctgaaaagaggtgaccatgcaaagaaagaaaaaacatatttggaatgtagg

SEQ ID NO: 21025 - DNA, 121 bp, Artificial Sequence
  Synthesized
  misc_feature (61): n=a or t
gtgtgcaaggagctttctctaaaactcatataaagcaacagcaggttttgaagctttctcntataaatcacatggaacgtctctctgtataccgtatattgtatttgtgattctgagaagg

SEQ ID NO: 21026 - DNA, 121 bp, Artificial Sequence
  Synthesized
  misc_feature (61): n=a or g
taaatgataataggtaacttttacaatgcaatagaccatttcttctccatttatcatattnactaaaaactggtggatttttgcttgcagcttggcattcccaattctaggctgcggtatt

SEQ ID NO: 21027 - DNA, 121 bp, Artificial Sequence
  Synthesized
  misc_feature (61): n=a or g
agtgaccacagtacttgagagagtgtggacaaattgcaggttgaacatgaaacatggctangtgttatcaattctccaggcgtcccttaataccagagccttctgggccattatctactga

SEQ ID NO: 21028 - DNA, 121 bp, Artificial Sequence
  Synthesized
  misc_feature (61): n=a or g
ctgagggagaggtcatctcctgtcagctgcagggtgttgttataggaaatggtgagtcacngtggcttgtgagcatgccttggtctccaccttctagaagtctattaaaaaaatctcatag

SEQ ID NO: 21029 - DNA, 121 bp, Artificial Sequence
  Synthesized
  misc_feature (61): n=a or g
cgttctgcttttcagctttccatttctaaaatcatagtaactcctacatatctctgccacnggaggtactatgaaaagatatgatttaaatattatcatacatcaatgcattgcagtaata

SEQ ID NO: 21030 - DNA, 121 bp, Artificial Sequence
  Synthesized
  misc_feature (61): n=t or g
ggagaatgcagcaacaccatctgcttccctaagagctactgtattaaagtgcaggttaccngaggttggcagtaggtcaacaataggctaagtttgcagctttaaaaagggatcccaacaa

SEQ ID NO: 21031 - DNA, 121 bp, Artificial Sequence
  Synthesized
  misc_feature (61): n=a or g
gttgtactctactttccaaatgcagcaggcatttatttgccttctgttgcaggtaagatgntagcagataactcagcagtttgtagcctgctggccaaaagaaaaaatgtttgtatttgtg

SEQ ID NO: 21032 - DNA, 121 bp, Artificial Sequence
  Synthesized
  misc_feature (61): n=a or g
gcttcactaaaaaccattttttttttttgtgagatctgaggttgtctgagaagaaaacacnatctgttcagctttcacctaatggtaggagtcattgagatcgtctcattccttgcgtgag

SEQ ID NO: 21033 - DNA, 121 bp, Artificial Sequence
  Synthesized
  misc_feature (61): n=t or c
tttttcttaggggaagctcttctgtcttccatccgacagctgtggttgtgccagttttcangtgcagctcaaccctttgccaggtgttactggtgggtgtttgctggtaacactcagagcc

SEQ ID NO: 21034 - DNA, 121 bp, Artificial Sequence
  Synthesized
  misc_feature (61): n=c or g
tgcacagcctttttactcattgctgaaactgatgctttggatgctaaaccatgaatctttnatgtgagaacttggctttgtcagtgtcctctgctaaatgcagtggcatatgtgtgtgggt

SEQ ID NO: 21035 - DNA, 121 bp, Artificial Sequence
  Synthesized
  misc_feature (61): n=a or g
ctgtatttatagtaccgaattgggcatcactcagaatcttaccccatccaccatcagtccngctgatacctgaggacaagctggaaagagggagtttattttctgacagactttttatcct

SEQ ID NO: 21036 - DNA, 121 bp, Artificial Sequence
  Synthesized
  misc_feature (61): n=a or g
ggaacagattttaagcttggttcaactattacttaccagtgtgactctggatataaaattnttgatccttcaactattacatgtgtaattggtacagatggaaaaccagcatggaacagag

SEQ ID NO: 21037 - DNA, 121 bp, Artificial Sequence
  Synthesized
  misc_feature (61): n=t or c
aatctaaaggcacacactgctatccagcctggagaagatggtagcaagctcacactaaagnagaaaaatcaaaacatgaactccctctctttccacgcacaggacaccttaaatagctgtt

SEQ ID NO: 21038 - DNA, 121 bp, Artificial Sequence
  Synthesized
  misc_feature (61): n=a or g
ttgtcacatctcagatatttcagtatttaactcgtattagcagcagaatcacagaagcacntgcattattgaatcttctttttgttggaataaaaatttatgctgttgttaagaaatatta

SEQ ID NO: 21039 - DNA, 121 bp, Artificial Sequence
  Synthesized
  misc_feature (61): n=a or g
ttttcaaaaagtcatctggtgcagttctcatcctctttcaggaaaagacaagagattactnaagtctggctttctgcagttgtctccaagtaaggcttacttgatagctttagaagatatt

SEQ ID NO: 21040 - DNA, 121 bp, Artificial Sequence
  Synthesized
  misc_feature (61): n=t or c
acgctacactttgagctgctgtcagactgctgggttttattttttctttgcccagactccnttctcagaaaatgctctggcagaaaagctcgcaggatggaaagagatgcagaagaagcag

SEQ ID NO: 21041 - DNA, 121 bp, Artificial Sequence
  Synthesized
  misc_feature (61): n=a or g
cactgagttgaaatttttaaggatattagctcctgtggaatttcatgcacatctttacaantcctaccttcagtatccccagattctgatgtcatggcttgactattttgcaattgccaga

SEQ ID NO: 21042 - DNA, 121 bp, Artificial Sequence
  Synthesized
  misc_feature (61): n=t or g
cagctctagctacaagtactgctttccttaaaactgtcatatggcccatggttctagtcangtagccatccaattatgttcccagaatcccttgttccaatgcaggatcattctttggtca

SEQ ID NO: 21043 - DNA, 121 bp, Artificial Sequence
  Synthesized
  misc_feature (61): n=c or g
acattgtaaagaggcaggaacaacgggctgagggacagaaagactggtgatgaacctgtcntcacatagaagactaagtgcccttgaaaacagaggctccagcaactcagcacccacagct

SEQ ID NO: 21044 - DNA, 121 bp, Artificial Sequence
  Synthesized
  misc_feature (61): n=t or g
attttctgaattcatcaaggagaagctcaaatatgaaaatatttacacattggttcttcancatcaggaattaattgcaaatatagttgttcttcttgcagaaacatccaaaaaagagtct

SEQ ID NO: 21045 - DNA, 121 bp, Artificial Sequence
  Synthesized
  misc_feature (61): n=a or g
tgtgttctccaggaggatttctgatctagattagaaagaaccaaggacagatcaggatacngtctagtttgttcatagtcccccactttgaactgaaatgttctcttctctgcatcttaag

SEQ ID NO: 21046 - DNA, 121 bp, Artificial Sequence
  Synthesized
  misc_feature (61): n=a or g
cttaggacatgttgcagatgcccacccctggccacaccaagctgaacccttatcaggatcntaccaagcactgcaggcagtcctgaagggcatcacttaatttcattgcagggaaattctt

SEQ ID NO: 21047 - DNA, 121 bp, Artificial Sequence
  Synthesized
  misc_feature (61): n=t or c
ccttccacctccatttttttcttactagacagatagcagaccaatttgattaaaaatatangtgtgtgtaatgagaagtcactgctgaactccatcagcctacagggcaatgtgctgaaca

SEQ ID NO: 21048 - DNA, 121 bp, Artificial Sequence
  Synthesized
  misc_feature (61): n=t or c
tattaattataagattttacagtgatctgacttattttcaagtacctggcataggaaattnttctttcgcttgcacaaaagcacataaagcaatagatatgttcatttagtctccagctta

SEQ ID NO: 21049 - DNA, 121 bp, Artificial Sequence
  Synthesized
  misc_feature (61): n=t or c
aagagactgaggcacacctaaggatacggcggctcggcgggcacgttgcgtgttgcatcgntccttttcccactcgaaggcgaggttctccatgcccacccaaacctccctccgtctggag

SEQ ID NO: 21050 - DNA, 121 bp, Artificial Sequence
  Synthesized
  misc_feature (61): n=t or c
ggctccattctctaccaccaaacttcagattcctgctctcctgctcttttcctaggctttnttcagttctccattcccatggaccaggtccagggagcctcagagaatcagaggactgtga

SEQ ID NO: 21051 - DNA, 121 bp, Artificial Sequence
  Synthesized
  misc_feature (61): n=a or g
gaaagaataaagttttctactgccacttccatgagtacagaaatgctactccgtgaggtcnaagtccatgatgaggtcagtaggaactaccactttaaaaacagcacgaaaataaaaaata

SEQ ID NO: 21052 - DNA, 121 bp, Artificial Sequence
  Synthesized
  misc_feature (61): n=t or g
agtttctcttactgtgaagcgaaagcctatgcattaaaattacttggagaccaaatacatngtttgttgcatgctctgcaaacctacactgaaaggtatcacagtaatgcaaacaaatgtg

SEQ ID NO: 21053 - DNA, 121 bp, Artificial Sequence
  Synthesized
  misc_feature (61): n=a or g
ccaacctggccacagaacttcacttcctcctcagtgccgtaacagcaaggcattcctcacngggcactgttctttgtgttgttttaacgttattaattgtcttcggtgacacttctaaatg

SEQ ID NO: 21054 - DNA, 121 bp, Artificial Sequence
  Synthesized
  misc_feature (61): n=a or c
tctcttttctgttaaaatttaaagaggattttagaattatatttcttggaagcaagcaagnacttgctttattgtgaactacatattaacatagaggggctggaatatgtgggatattttc

SEQ ID NO: 21055 - DNA, 121 bp, Artificial Sequence
  Synthesized
  misc_feature (61): n=t or c
ccactcaggagtgaggagatgtggatggcactggagcagcatagcgtgtcaccgggtgccntctgctctgcaccatgtggcaaaccatgtttgccaccatacagctggcccaccaaaaggt

SEQ ID NO: 21056 - DNA, 121 bp, Artificial Sequence
  Synthesized
  misc_feature (61): n=c or g
ttcttggcacgctgtatcctaaggtctgtattaaggcatcaggaagtacgcaggtggtcanttgggcaactctggtgagacaaagggattgcgttttggtgtaacgaatccagcctacatg

SEQ ID NO: 21057 - DNA, 121 bp, Artificial Sequence
  Synthesized
  misc_feature (61): n=a or g
gtatatgtgtgtttacgccctctgttcttacgtataacccatagctttgttcacggatacnttttcacttaaatacaaactgagactacttgcaagaaggaatggagcacatcctttcctc

SEQ ID NO: 21058 - DNA, 121 bp, Artificial Sequence
  Synthesized
  misc_feature (61): n=t or c
tgctctgcgtgctggaacaacattaactgagccctgtgtttacctgtgtttgcaattcttnaacttgccgctctcacctctgaaggactttctgttccacttcaacctgtcctgcccttgt

SEQ ID NO: 21059 - DNA, 121 bp, Artificial Sequence
  Synthesized
  misc_feature (61): n=t or g
cagaatttgttcctgaaggggatgctgacagtagatcttggttgccttgctcaggatttcnctgagctgatctctgaaattctgtcaggtgtcgtagccacgttaccatagtcatgttctg

SEQ ID NO: 21060 - DNA, 121 bp, Artificial Sequence
  Synthesized
  misc_feature (61): n=t or c
aagtgctttataacactggtgattctaagaacagttcaacaacatgtggtcaagcaataangctctagcagtaatgactaaatagttaaacattaagtacaaagctcaggttcataaagac

SEQ ID NO: 21061 - DNA, 121 bp, Artificial Sequence
  Synthesized
  misc_feature (61): n=c or g
tagctagtgcctggtacttgcactgcaccccaagctgctgtcacaccatcagtgcacttangtacacttctgaagcttttaaagagaagaaaaaaaccaaaacaaaaccaaacacacaaaa

SEQ ID NO: 21062 - DNA, 121 bp, Artificial Sequence
  Synthesized
  misc_feature (61): n=t or c
aaacagaccaaacacaactaggagatacatgttaatctcaattattttagctttgattatncagaagtcatattgcttgaaatgtggacatattgttcctctccgatttcaaaactcagat

SEQ ID NO: 21063 - DNA, 121 bp, Artificial Sequence
  Synthesized
  misc_feature (61): n=a or g
gtaaaatagagattttagtgcagagctaaactgactcacattcagaagctgtagtgtcagntttcttgaagcattccagtatgatcactgagtcaagaagaaacaggaggcatgagtgtag

SEQ ID NO: 21064 - DNA, 121 bp, Artificial Sequence
  Synthesized
  misc_feature (61): n=a or g
attaagcaacacacagcacagctacaactcagtgttccacaggcagcagtgaggtattttnaacttcatgtaaatacacttgtttatgtttttcactgaaacaaataaatttggcacttta

SEQ ID NO: 21065 - DNA, 121 bp, Artificial Sequence
  Synthesized
  misc_feature (61): n=t or c
cccactgtatccgagccctggctgtacagtcagccgccatgggacagagaagaagaaactnccctaaggagacccagcaacacgtgagggtgagagagcagagcaggggagcccagccctg

SEQ ID NO: 21066 - DNA, 121 bp, Artificial Sequence
  Synthesized
  misc_feature (61): n=t or c
tgttattctctagaactttcctagagataaacaggtaaatatttgttccccttctctattntgtatttaagcacagtttattcatttgacggagagttttctaaattatattcatcctttt

SEQ ID NO: 21067 - DNA, 121 bp, Artificial Sequence
  Synthesized
  misc_feature (61): n=a or c
caacagtaataattattgaattacctaaatgtgaccagatgagcatccggagttcacttantccaacctatggatttgagacatatttggtttcagtgtcacagaatctctaccatgaata

SEQ ID NO: 21068 - DNA, 121 bp, Artificial Sequence
  Synthesized
  misc_feature (61): n=t or c
tctgggttctagttccctaacagcccagagcagagacctgactagattcctccaagcttgntccagactcaacatactgtttcagtacacccagaaaccaaaatgtggagaaaaatggcag

SEQ ID NO: 21069 - DNA, 121 bp, Artificial Sequence
  Synthesized
  misc_feature (61): n=a or g
atttaggattcacccaaatttagagattctgcttcacctggaggcaccttgcaacaacagnttttggttgtttccttctttcagtataatcattctttctaaccacatactcaatgtttta

SEQ ID NO: 21070 - DNA, 121 bp, Artificial Sequence
  Synthesized
  misc_feature (61): n=t or g
ctgaccagacataaatatgatggacattctctactttggacagtcagaagggcagagaagnagggagcaagcagaaagacaaggaacaattgaatgctattctttggctcagatctgatag

SEQ ID NO: 21071 - DNA, 121 bp, Artificial Sequence
  Synthesized
  misc_feature (61): n=a or c
aaaagacagacaagaattgcccaggatggggaagcagcaggcagatcaatgggcgtaaggnagagccctactagcctgccacgttcctaaccctcctggttttcagctggccactcagctc

SEQ ID NO: 21072 - DNA, 121 bp, Artificial Sequence
  Synthesized
  misc_feature (61): n=a or g
gtgctgccattacttgtagccagattctaccatttttatcttggctcatgtctactgtacntgcaattccactgatgcactcattaatcactttgatacaatagtacccccagatttaaga

SEQ ID NO: 21073 - DNA, 121 bp, Artificial Sequence
  Synthesized
  misc_feature (61): n=a or g
agtatgtgaaagcccttcagtgagccaagtgcgacagtttactcaatctcctgtaactccnctgatctgtcttgttcaaaggaagcttttttttttttcccctgattccccccactctttt

SEQ ID NO: 21074 - DNA, 121 bp, Artificial Sequence
  Synthesized
  misc_feature (61): n=a or g
catttctagatgtccaaaacaatgaataagtttcctaacagtacttctacattgaataagntcagcactggatgaattacatatcaccatatacaacaacaacaataataaataaataaat

SEQ ID NO: 21075 - DNA, 121 bp, Artificial Sequence
  Synthesized
  misc_feature (61): n=a or g
tctaccttgacagcttgaactattcatgtaaaataagttttcagcaaagaaggtctggagnccgaaacgtaacaaaacagtaatctcattagaagaagcaatagcacttttagggcaaagg

SEQ ID NO: 21076 - DNA, 121 bp, Artificial Sequence
  Synthesized
  misc_feature (61): n=t or c
atcgagcagtctaaaggaaggtcaaatctgtacctgctttgtttgataacatccctttcanggaagtctgctgctaccctgattgatgctggtcagctcagagcatctgtcccagaggtcc

SEQ ID NO: 21077 - DNA, 121 bp, Artificial Sequence
  Synthesized
  misc_feature (61): n=a or g
ttagttctacagataccactccagaactgcatttgattcctttttctcttgtgcttcacantacagttttgcacagtagcttgcacctctgaacatagcagttctgcagcctctactgtct

SEQ ID NO: 21078 - DNA, 121 bp, Artificial Sequence
  Synthesized
  misc_feature (61): n=t or c
atactactcttgaaggacctccctgacagcaccatctttggggtgtacaaaacctgcctgnagcatcaccctggaatggatttattgcagcatatacacagggcagtgctcggaggctcca

SEQ ID NO: 21079 - DNA, 121 bp, Artificial Sequence
  Synthesized
  misc_feature (61): n=a or g
accctctgggcacaagaaggtttcctgtccttctctccctatactctcttaccatatcctnccaatttttgaagattgatctcttttctcaagtgacaagtgataggacttgaggaaatgg

SEQ ID NO: 21080 - DNA, 121 bp, Artificial Sequence
  Synthesized
  misc_feature (61): n=t or c
tctcatggaaaatatcagtgctgggagcacctacgtgccttgtatggaagtgtggggttanttccatagagaaccctggaaataaatgcatgtgttccctctgaccacttccagacctcgg

SEQ ID NO: 21081 - DNA, 121 bp, Artificial Sequence
  Synthesized
  misc_feature (61): n=t or c
aacacttgtttaaagcttattccaaaatgatttgatacatggaaactcatggttttaaaangtaaaataaaactgcctttgagtatagtgagtgttaccgctaagaaaagcattttaaaat

SEQ ID NO: 21082 - DNA, 121 bp, Artificial Sequence
  Synthesized
  misc_feature (61): n=a or g
aatggtagtcatgtagacagtgagtttgcataatttgtgcacagccttgacacttttatangaaaataccttctgcaatgttgttgctgtatgtatgccttgtgtaaagaggtttgtacat

SEQ ID NO: 21083 - DNA, 121 bp, Artificial Sequence
  Synthesized
  misc_feature (61): n=a or g
cggtgtgacttgatgcatgactaatgcgtttgtgtatttaagagtctgttgatgctaatgnaagttacagagctgtatctataaaagaaggcacttcagagcataccggttcattaacttt

SEQ ID NO: 21084 - DNA, 121 bp, Artificial Sequence
  Synthesized
  misc_feature (61): n=a or g
aactcttgaggtctgctgagtgcccggcgctcgttggaaccatccggagagagcactgaantgtagcgccagtagatggcactattttacactttatggggacatagaacaggtagggagg

SEQ ID NO: 21085 - DNA, 121 bp, Artificial Sequence
  Synthesized
  misc_feature (61): n=a or g
taatggtcctgaagtggatcctgatgttccagttgagaagtaaatgaatgtgtacaaatancagtaagaagctgcatttacgataaattaagggaaaaagaagaggtgaaggtggccaagg

SEQ ID NO: 21086 - DNA, 121 bp, Artificial Sequence
  Synthesized
  misc_feature (61): n=a or g
gcaaaatgttaatgaagtcttcatgcatttgtagaattgagtttgtggggaagggtcaccnctttgacacatatctgaaggtattgaggttatgaggttggtatatggtatacgaggttat

SEQ ID NO: 21087 - DNA, 121 bp, Artificial Sequence
  Synthesized
  misc_feature (61): n=a or g
ttttatttgcagatttgacatgtctggcaaagtggttgtgaatatggttatccctaatttncagatgagtgatcctgggtgatacaatttgttggaggtcagagaaaaaattttaataggg

SEQ ID NO: 21088 - DNA, 121 bp, Artificial Sequence
  Synthesized
  misc_feature (61): n=a or g
caaagagaggtcagttgtttacctgtgtgatcgggtccaaccaaccctccacccagtgagngactccaagcaaaactactggagaaccaactagtcgtggggaaaaacctcccaggctcga

SEQ ID NO: 21089 - DNA, 121 bp, Artificial Sequence
  Synthesized
  misc_feature (61): n=t or c
gctgcactggatacagaatacggagctgaaatcacagggataaggaattgctctgatgaanttccacgtacctgaaactggatagatctccttcagaggatagatcacctgttttaacaaa

SEQ ID NO: 21090 - DNA, 121 bp, Artificial Sequence
  Synthesized
  misc_feature (61): n=t or c
gaaggcactaccgtggcggccgctgagcccggatttgttcttgacaatgttgctgatgttnttcagctgcttgtagcacagcctgcatttatggagcctgtgaaaacagcagacacagcac

SEQ ID NO: 21091 - DNA, 121 bp, Artificial Sequence
  Synthesized
  misc_feature (61): n=t or c
ctgagtaggagatgcctgatgcaaatgggtaacctgctgggaaggagtttgttttgaaganggtatatgtctaagaggattgcatttttagctttccttctaagggttatgtgtttttgcc

SEQ ID NO: 21092 - DNA, 121 bp, Artificial Sequence
  Synthesized
  misc_feature (61): n=t or c
ggccaggagagcaaaggctgcaggacaagagagagaaggaatatgagttgagatctttttnctttgtgcagcatctcacagggagacactgttggtggttgacctcttggacaagcaatac

SEQ ID NO: 21093 - DNA, 121 bp, Artificial Sequence
  Synthesized
  misc_feature (61): n=a or g
aagaggagaaaacgcactgttagcagcaggaacagcatcaggacccggttacagcagcacngctcagactgagagggatttctgccctcagcctccatcgctggctacagctcgctgcagt

SEQ ID NO: 21094 - DNA, 121 bp, Artificial Sequence
  Synthesized
  misc_feature (61): n=a or g
gattcactctttgaagagttagttgtttacagctgtctatacatttgttcactgaacagtncagttgtgtctccatggtcagctgttcctcaaggtgctgtcataaacagctacaagtaaa

SEQ ID NO: 21095 - DNA, 121 bp, Artificial Sequence
  Synthesized
  misc_feature (61): n=t or c
ttgagcccgtttgaagggctggggatatggcagtgtaaggatatagcttgatagaacttcntgagcaatagtcattgttagcctgtctgggaaaccgaacaacttgctttgagcaacttag

SEQ ID NO: 21096 - DNA, 121 bp, Artificial Sequence
  Synthesized
  misc_feature (61): n=c or g
cgtttgtctgaggaagacaactgaatcttgtaagttgaactactcaggaagagaaagcagnaatgctcacactagaagactgatactgggaacttagttttagagatgaagaggttgggat

SEQ ID NO: 21097 - DNA, 121 bp, Artificial Sequence
  Synthesized
  misc_feature (61): n=a or g
agtgactgggcctgaagaggcatacagaagaaagaactgtaatggtcttaagctttgtccncaactgataaggttaatgcacttaaactgcagtttaagtccttagtggcatgatttttta

SEQ ID NO: 21098 - DNA, 121 bp, Artificial Sequence
  Synthesized
  misc_feature (61): n=a or g
agcattctcagggaggaactgatctcaaacgattacacttgccttgacagatagagttgantcataagctgagattttgtaagtttcacattaactatttgagctttttattaactccaga

SEQ ID NO: 21099 - DNA, 121 bp, Artificial Sequence
  Synthesized
  misc_feature (61): n=c or g
accctcagcggtttgcagatgacccctccactcacacaggcacagccacactgtctcaganacaggacacagcttcgcatgggcacagcaataaggggaggccaggcctggcaccaggaaa

SEQ ID NO: 21100 - DNA, 121 bp, Artificial Sequence
  Synthesized
  misc_feature (61): n=a or g
aggatgtaattctggactttgacagttctttgttgctgttctcagagactgtgctcacacnctgaataaaccaagtggttaactatcagtctacaaagtctgatactcttgggtaaaaacg

SEQ ID NO: 21101 - DNA, 121 bp, Artificial Sequence
  Synthesized
  misc_feature (61): n=t or c
gagaaaagagtagatactgtcagcaaagcactaatcagcaaagagttacaaaggtaggttntacacgtaagaacaagcagcacccctaaactcactcatattatttgtctccaatggccaa

SEQ ID NO: 21102 - DNA, 121 bp, Artificial Sequence
  Synthesized
  misc_feature (61): n=a or g
gttatgattgttcgtgagtacatagaattgttattaacatgtaattatgtagagatgaganacattttagttataagggcttacttattagtttagtgcttccaagatatcagtgcagttt

SEQ ID NO: 21103 - DNA, 121 bp, Artificial Sequence
  Synthesized
  misc_feature (61): n=t or c
cggcagtcagcaccgcgatttgttcgctcttccctctctcagactcccgtttacccgcagnacgggcttcaaagagagacgggttaattctcgccccgggattcacgtgccactaaattaa

SEQ ID NO: 21104 - DNA, 121 bp, Artificial Sequence
  Synthesized
  misc_feature (61): n=t or c
ctttgacttccagtagactgatgagataatcatgtatctacaaaacatcttctcctttgtngcttctttaaaatttagccaaccatcttgaaaacctttggaaaattggtctggaagagcc

SEQ ID NO: 21105 - DNA, 121 bp, Artificial Sequence
  Synthesized
  misc_feature (61): n=a or g
gctgtaaaattgacagcactacctcactggtgcatctgtcactcttgctgatgggtgaccnaagacagaaggttgcagggagacattttcagacatcattacctaaaaattaatctatcta

SEQ ID NO: 21106 - DNA, 121 bp, Artificial Sequence
  Synthesized
  misc_feature (61): n=a or t
tcagctaacgacactccatgtgttgttttcctcactccctaccaatgtaagagaataaacngggagtcaggtggtagctgacagtatctgagattcagattcactctatgcctttgacagg

SEQ ID NO: 21107 - DNA, 121 bp, Artificial Sequence
  Synthesized
  misc_feature (61): n=a or g
ccattgtaccattacagaagagccctaagcaggaatacagtagttcaatagaaccacagcntcagggaaaaaatgtctagcctgtatgaacattctcatcgctgccaggtgccttgtgcct

SEQ ID NO: 21108 - DNA, 121 bp, Artificial Sequence
  Synthesized
  misc_feature (61): n=t or c
aaaaaaatcttattttctttgcttctcaaagtctccacttaatggtctgacacacaaatgnattatccaaatgatacaatattttctgtgagtgtttaaaagaatagccctgcacaagtta

SEQ ID NO: 21109 - DNA, 121 bp, Artificial Sequence
  Synthesized
  misc_feature (61): n=a or g
tacagtgctccagatgaatgctgtagtctggttatcctagaagctacacgaagcacaacanttaaccatggttacatgaagcaggaagaacaaagacagtcttgcaaagtctgccaggagg

SEQ ID NO: 21110 - DNA, 121 bp, Artificial Sequence
  Synthesized
  misc_feature (61): n=t or c
tcttgctgccttgcagacaggaggagtacagtgtttaatgaaagttcaccagtgggaagcngagctgcctgagcacagagggtagttgttacggagtatgtgtttccagcttcagtaatgt

SEQ ID NO: 21111 - DNA, 121 bp, Artificial Sequence
  Synthesized
  misc_feature (61): n=a or g
cttatgagagttgtctcttacttcctatgccaaacctgtcccaaatgctggacacagcagncaggccccaggctctccagtgctcaaaccaacctcctgcaatccagaatgcagagtcact

SEQ ID NO: 21112 - DNA, 121 bp, Artificial Sequence
  Synthesized
  misc_feature (61): n=a or g
agaatttgagattgtaggagcagatgtttatgtgccaataactcttatgtcttttcccaanagaatacttcagctctgaacaagagttcactgtttcttgcagaaatttactgtatgttgc

SEQ ID NO: 21113 - DNA, 121 bp, Artificial Sequence
  Synthesized
  misc_feature (61): n=a or g
acgtggaaaaagaagtcacagtgatgcacacagtgactgaagcctgatgttgcagacaccnaaagctcagtgatgaagcagatgccccacgtagccacgcatcactgtcctgaatgcagaa

SEQ ID NO: 21114 - DNA, 121 bp, Artificial Sequence
  Synthesized
  misc_feature (61): n=t or c
atcatccgtccatagctcctttgatcctaaatacatatttatgtctttgcatacatttatnggaactgcggggagatgcaattgaaaggcactttcagaagttgttacctccagcttctca

SEQ ID NO: 21115 - DNA, 121 bp, Artificial Sequence
  Synthesized
  misc_feature (61): n=a or g
atctcatggttagactccaaacttccaaacaaagtgaggaatgaagatatattactaagtncatcagtactgtacatgacagctggagggtatgtttgggtacaagtgggaagaaactttg

SEQ ID NO: 21116 - DNA, 121 bp, Artificial Sequence
  Synthesized
  misc_feature (61): n=c or g
acttcccaacatggtaccttctaacaatcaaagtccttctttatatccagactgcgcgtgntttgattggaaccccgttttacagtccactctaaaaaccctccacaatcctggtgataaa

SEQ ID NO: 21117 - DNA, 121 bp, Artificial Sequence
  Synthesized
  misc_feature (61): n=t or c
aatttttagggcaagctttttggcaagcctgttttggcagacgaatccataactccttagnaggatttgttacagatgcagattcccagttaaccctttgcaactccaatggaagtagcaa

SEQ ID NO: 21118 - DNA, 121 bp, Artificial Sequence
  Synthesized
  misc_feature (61): n=a or g
gccaaagacatccacagaactgtctcggagaagatggttctgttagcagggatgtttccantgcaactcaaacgtctcatgcttgcataaagcttaggtcagcaaaaaaaaacccagccag

SEQ ID NO: 21119 - DNA, 121 bp, Artificial Sequence
  Synthesized
  misc_feature (61): n=a or g
tgataagtgggagacaaaatgagaaagtaatttcagagacacgtgcctaagtttctagcanttattaaaaaatcgtgcctagatggaacacttatgtatacatatgtacaaacactttaac

SEQ ID NO: 21120 - DNA, 121 bp, Artificial Sequence
  Synthesized
  misc_feature (61): n=t or c
agatgttagaatttgtcttcatctcaagtatagcaacactagagaaaataagtgtgtaccnatttgcttataaagtggcttttccctcacttaggcaggcaataggattcagagacaatgt

SEQ ID NO: 21121 - DNA, 121 bp, Artificial Sequence
  Synthesized
  misc_feature (61): n=t or c
tgtacatataagcagggctgccccatcccaggtgcagagtctggctatataaaaagtatangaagcagaagaatgtatttgggctttccatactgccaacattggccatatcctatttcta

SEQ ID NO: 21122 - DNA, 121 bp, Artificial Sequence
  Synthesized
  misc_feature (61): n=t or c
tgtcagtcctcccagacgtgattcattctatacgatactaaaccagacccttgatcctcantttctcatagattctgtcaaaactgaagtttatatagctggaaaattatatggcatgtca

SEQ ID NO: 21123 - DNA, 121 bp, Artificial Sequence
  Synthesized
  misc_feature (61): n=t or c
tcagacagagaaaaccaattacactgctataggcactgttggaaagtctgtgctaactacngccatgaaaatataaagcacgttgataataagaggaaaaggggcactgataaccacactt

SEQ ID NO: 21124 - DNA, 121 bp, Artificial Sequence
  Synthesized
  misc_feature (61): n=c or g
cacgtctgcggtgcatcacctgcggtaggtttcctctaggaatgggttatgtgtacctttntctcctggcattcatgacacctctcagctgcattacccacctgccggctaccattaatac

SEQ ID NO: 21125 - DNA, 121 bp, Artificial Sequence
  Synthesized
  misc_feature (61): n=a or t
agaagtctagctatttagcctgaagtgactgaactcagagaaattcccagagggtttagcntgaggaataataacactccaagtacatgcaaagagctttacttggtttgcataaaactaa

SEQ ID NO: 21126 - DNA, 121 bp, Artificial Sequence
  Synthesized
  misc_feature (61): n=a or g
aacagaacagaaaatgaagtgtaacagtttaaagattccaacagtaaccaacagctaaganaacactggcggtggacaactcttcagtagctatctcaagctttatctagtaccacaatca

SEQ ID NO: 21127 - DNA, 121 bp, Artificial Sequence
  Synthesized
  misc_feature (61): n=t or c
ccatagcaccgaactaaattcatgttgtgatggcccaaatatgttctcagtcacgccagcntcagtctgccagattgcattcacaatttctagagttactccacttttaaatctgagtctc

SEQ ID NO: 21128 - DNA, 121 bp, Artificial Sequence
  Synthesized
  misc_feature (61): n=t or c
ccagatgatgctcatggagaaacaccaagacatccatcatcttaaagtttccttttctcangaaaattatccgagggcctaagcatcaggtttagagatggatcctccctggatgtattta

SEQ ID NO: 21129 - DNA, 121 bp, Artificial Sequence
  Synthesized
  misc_feature (61): n=t or c
ttgttgtgtcaagctggtccctggaattaattttcccttctttcttgcgcctgttgcatangccatatgtcatcgctttcaaactggatagtaccaaggtggatctgctgaatgagtcttg

SEQ ID NO: 21130 - DNA, 121 bp, Artificial Sequence
  Synthesized
  misc_feature (61): n=a or g
agatcagtgaaacgccacacaaagcaaataaagctggagcaagatgatcaagcacagggcnacttgggaggcattcataatgatattttccccttcttctgtggcctgtaatgaaactgaa

SEQ ID NO: 21131 - DNA, 121 bp, Artificial Sequence
  Synthesized
  misc_feature (61): n=c or g
ataataaagtcaaaatgaactatttttcactctcccgcgacgagtttggtgttttgacacnatcaggataaacattttgacaccgctgaaacaagagagtcaaagtggttccgctacgctt

SEQ ID NO: 21132 - DNA, 121 bp, Artificial Sequence
  Synthesized
  misc_feature (61): n=c or g
cacagttctagaaaaaggattgttgcaaattatatgaaactcaaaatgaagagaagagatngcatcagagaaagcttcagctgcactaagaagtgtggagcttctgctacagcatctccac

SEQ ID NO: 21133 - DNA, 121 bp, Artificial Sequence
  Synthesized
  misc_feature (61): n=t or c
agtaatatgtaactgccctaaggccttcccctgggtcagcagccatcagctcaaggcaaantcctcatcacccaaccatcacagaaagcacaagggtccatgtcctcacgcagagcccata

SEQ ID NO: 21134 - DNA, 121 bp, Artificial Sequence
  Synthesized
  misc_feature (61): n=t or c
aactcctttggaaacttctaagagtcctcaaggctttgttctgattttacacttacagtgngaggtttgatattaaagtgacagcaattcttgttccatttcagagtggagaaaagagtac

SEQ ID NO: 21135 - DNA, 121 bp, Artificial Sequence
  Synthesized
  misc_feature (61): n=a or g
gtaatttcatgacactttgaaagcataactaacttacagaggtattgcaaatcagatattntgtttctttattatggcctttctagaaatacttaagtgtagctgtgattgcttttataac

SEQ ID NO: 21136 - DNA, 121 bp, Artificial Sequence
  Synthesized
  misc_feature (61): n=c or g
ttgttccttactgaaaaaggagctgtgtttggtaaatttttggacaggactattgtggttntaagagactgatgcttaggtggtcaggatggatggatgaatggatggagtgactaacttt

SEQ ID NO: 21137 - DNA, 121 bp, Artificial Sequence
  Synthesized
  misc_feature (61): n=a or g
taggtatttcagtgatgggaaagcaaatatttcagtacatatccggaaagcttggacaacnaaggtaggtaatgcaaaccttgtactgttaattaacattagcttctaacccttgccacag

SEQ ID NO: 21138 - DNA, 121 bp, Artificial Sequence
  Synthesized
  misc_feature (61): n=c or g
gcccaccgtggctaagatggtcaacctcggtgtctgggtgctttccatcctcatcatcctncccatcatcatcttctccaacacagcggccaacagtgatggaacggtggcttgcaacatg

SEQ ID NO: 21139 - DNA, 121 bp, Artificial Sequence
  Synthesized
  misc_feature (61): n=a or g
ttagctaagcagagtgtaaccaagatgtttgtaactgcagcttcatgtcagcatttagtcnttgtggcacccactctatgttaaactcatgatcttttaaatgtacatgctgttgttacag

SEQ ID NO: 21140 - DNA, 121 bp, Artificial Sequence
  Synthesized
  misc_feature (61): n=a or g
aaggcatgtatacatgatgtgcattcttctatgatgtctgatcaaataggagtatttaaanagaacagaatccaatccacctggagcactggtgtctcctcatccttattattgtctgttg

SEQ ID NO: 21141 - DNA, 121 bp, Artificial Sequence
  Synthesized
  misc_feature (61): n=a or g
tcccaagagaagttcctgagcaacagccacagagtggcagggaaggttccaaaggacatgnaagtgaggaggactcatggaacagcagacataactgcatacacaacaaacccaaaacctc

SEQ ID NO: 21142 - DNA, 121 bp, Artificial Sequence
  Synthesized
  misc_feature (61): n=a or g
cctcatcgagtttgaggacagggattgtgctcaagaattgctggacaatcatttcagtggnagcgggaaaggtgtggtgatgaatgtgcagttctcagccttgtgctacagagctgggaac

SEQ ID NO: 21143 - DNA, 121 bp, Artificial Sequence
  Synthesized
  misc_feature (61): n=a or g
cggcggcccagcaaaacacacggaatgccactgaatgtaacagaccggagccgtcattccntagatgtatgtttgtgacagccggtgtttgtgtggtcctgctcacagcctgggacaagtg

SEQ ID NO: 21144 - DNA, 121 bp, Artificial Sequence
  Synthesized
  misc_feature (61): n=t or c
cctaactaacttcttacaatctcaagaactcatatacaacttaaatactattatttgcttnagacatatgtcagattctgaaattatcactgtaagaaataatggcagaagaatgactgga

SEQ ID NO: 21145 - DNA, 121 bp, Artificial Sequence
  Synthesized
  misc_feature (61): n=t or c
agcgaatatataaagggcgagatcacaacctcaagaaaggtcatcttgattcccacggttnagtggcaaagtgtttgtctgcatgtaagcctcagcagtgcgggctgctccacttgcttct

SEQ ID NO: 21146 - DNA, 121 bp, Artificial Sequence
  Synthesized
  misc_feature (61): n=a or g
tgcaaccaggccatgatctcaaaagaatataggttctgtaaataagtgtcagggaccaacncaaccaaaccagacagatatcttgaccaatggccactacagatgtggcacaggtcaatgt

SEQ ID NO: 21147 - DNA, 121 bp, Artificial Sequence
  Synthesized
  misc_feature (61): n=t or c
tggtgtgttattcctggtgggttagatgtatgcacacacatttggcaatttgggcatcagnagtaattctctaagacagacttatgtcagatcctcacctgagtgcttctcagctttggga

SEQ ID NO: 21148 - DNA, 121 bp, Artificial Sequence
  Synthesized
  misc_feature (61): n=t or c
ggaagtaaaggagaattacgagcaacctgacttactaagttccgcacaaatccctaatggnatcacaattagcgctacgtgtttgcttcccagtctgatgcaaacagccacaagttcaagc

SEQ ID NO: 21149 - DNA, 121 bp, Artificial Sequence
  Synthesized
  misc_feature (61): n=t or c
tcgttgggttcaaagactcacattcttatttttgaaccaccaagccagagaaatgcttctngaaagtgaacaactgacatttttgttcatgcatagctgaatgctttatttttattattta

SEQ ID NO: 21150 - DNA, 121 bp, Artificial Sequence
  Synthesized
  misc_feature (61): n=t or c
atcttctctgagcaaaagctttgtttaaggaaaacaaatcacctgtcctattttatggacnaatctttgacgtaagttggagggcaaattcaaataaaacctttggaaactttgaaactgt

SEQ ID NO: 21151 - DNA, 121 bp, Artificial Sequence
  Synthesized
  misc_feature (61): n=a or g
tgtatttgcggacagtcaactatagagtctaaaacacttctcctatcttgcagaaatttgntatctaaatattgctcttgatccaaaaaaaaaaaacacctcacttggtatcaaattcttt

SEQ ID NO: 21152 - DNA, 121 bp, Artificial Sequence
  Synthesized
  misc_feature (61): n=t or c
ccaaaaatatcttagtcctaaacatgatttcactcaggattttctgggcagctctgcctgngctccctccatgccatgaaggatgccaggccccagcacagccctgctggctccagctctg

SEQ ID NO: 21153 - DNA, 121 bp, Artificial Sequence
  Synthesized
  misc_feature (61): n=a or c
tcatcctcagcagaaatcctcccactgtttttctcagctgtctggtttctggatgctcagnaattggcttcttggttgctgtttgcaccctgactctctgtgcttatggtggtctaattcc

SEQ ID NO: 21154 - DNA, 121 bp, Artificial Sequence
  Synthesized
  misc_feature (61): n=t or c
gagcatgcagcaccattctcataaaggggctccactgcaacaacgttgtaatgcatggaangcctgaaagacacaaagacattcccttctctgcttacatgtctgtctttacagcactaca

SEQ ID NO: 21155 - DNA, 121 bp, Artificial Sequence
  Synthesized
  misc_feature (61): n=t or c
taccttgtgtctgacagaaactaaagctcacaaatccatgaaatgtcacagcaatgagaangagaataatcttaaggaattggcgagcacgcactttaaatatcatcccgtaccatatctc

SEQ ID NO: 21156 - DNA, 121 bp, Artificial Sequence
  Synthesized
  misc_feature (61): n=a or g
ataagcctgccttctgctcactgtcgtattgtcaggtatttcttggacatggaggcagtanaggaggctctttgctctctaggcagcagccattaaataagttgaggttgcttcagtctaa

SEQ ID NO: 21157 - DNA, 121 bp, Artificial Sequence
  Synthesized
  misc_feature (61): n=t or c
tttgttcgaaggacaagaagttctccataaggccatgaaagacggagctgtgaaggctcangcttgtgattagcacttgcttttgccagtgaaacagctgtaaacatgttgggtattattg

SEQ ID NO: 21158 - DNA, 121 bp, Artificial Sequence
  Synthesized
  misc_feature (61): n=t or c
taagctcatatgggctctatgagacaggtgataacgcacttattgcccgactgagaggaanaagatactgagtggaggctgatgggtgaccgatgagtcaggagccctcatgcacacagtg

SEQ ID NO: 21159 - DNA, 121 bp, Artificial Sequence
  Synthesized
  misc_feature (61): n=a or g
ctttgtttttcttatcttgagtctcattgcttacttggcacaaattggctgccatgcatantggatgttgagtctcaccaacaagttgtctgaaaagtttgttgtttattgtgaaagtctg

SEQ ID NO: 21160 - DNA, 121 bp, Artificial Sequence
  Synthesized
  misc_feature (61): n=t or c
caaaaagttatcattaagcatggaaaataagaaaaacataggattacagccagaacattcntcataatattcttcataagtgcaatggatgatcctctaaccctgacacaggtgcagcaat

SEQ ID NO: 21161 - DNA, 121 bp, Artificial Sequence
  Synthesized
  misc_feature (61): n=a or g
tgtgtgtgcacatcaattttttctgtaactaagacaaaaacacactttagccagtgttccncatatccctaagaatcatattaatgaggaacaaatattaaagaaacttgaactaattaat

SEQ ID NO: 21162 - DNA, 121 bp, Artificial Sequence
  Synthesized
  misc_feature (61): n=t or c
atcaggaaagagggcagaaaaggaaaagattttactgatttgaagataaaacggacatccngacattagtggaagtatgtcagaagaggagctcaaagtatagaataaaacacacctgaaa

SEQ ID NO: 21163 - DNA, 121 bp, Artificial Sequence
  Synthesized
  misc_feature (61): n=c or g
catcatcaaattaaaacatagaaataaaatcaagtttaccctgcttgatttcacctaaccnctgtatgggtacgtcagcacgtttacagattaagaggcttgaacaccattttggctctta

SEQ ID NO: 21164 - DNA, 121 bp, Artificial Sequence
  Synthesized
  misc_feature (61): n=a or g
ggtgggtcagaagatacctcgaggcagtggctttctgcttgtggcaccactaggtgcttcnggagcaaaagtctggttgtgaagctccggcagtgagcagtgtgtgcagcccaggcacagc

SEQ ID NO: 21165 - DNA, 121 bp, Artificial Sequence
  Synthesized
  misc_feature (61): n=t or c
ctggtatttaaatttgggatgcaattctacatcataatgccaactccttcaacttttatgnatgtgtgcatatattaaaaataacaaatattaaatataaaactgtagatcacatgacaga

SEQ ID NO: 21166 - DNA, 121 bp, Artificial Sequence
  Synthesized
  misc_feature (61): n=a or g
ctaccaagggaaagaaaatattcttaagagaactggatacgactctcaccagagctttgtnttgcatatatcatagtgaggagatttgcttatgtgagtctcatgtttgttaattctctca

SEQ ID NO: 21167 - DNA, 121 bp, Artificial Sequence
  Synthesized
  misc_feature (61): n=a or g
agagtcactagatggtactgttgctgtttaatatttatgcctctgtggactggctgcctgnagaactcacatttctgctgagagatgaagaaaggcctcataactcaccaggcaaacacaa

SEQ ID NO: 21168 - DNA, 121 bp, Artificial Sequence
  Synthesized
  misc_feature (61): n=t or c
cacaagaaagtggcttgtatcaagtgtctaaccctgaagacccataaaatacgagcagcgntgttatcaactgtcagttaactcacacagagtagtaaagaagtacatagccaagaagtac

SEQ ID NO: 21169 - DNA, 121 bp, Artificial Sequence
  Synthesized
  misc_feature (61): n=a or g
ttacaacttgacttgatctaatatatagcaactactgatatggtgtcacgttttggaacangatccaagggacagtattcatttgagaaagattgtatagcaaaaactgtacagaaaaact

SEQ ID NO: 21170 - DNA, 121 bp, Artificial Sequence
  Synthesized
  misc_feature (61): n=t or g
attattatcttgcataattcaagaggcatgccacagtctcattcccatccatcctaagatntggggagatttacacaccccagagaaggatgagacattacacagtcttcagaaacgtcat

SEQ ID NO: 21171 - DNA, 121 bp, Artificial Sequence
  Synthesized
  misc_feature (61): n=t or c
gtcacccaaaataccactttgctccccaaaatacctctttcctccagcaatgcgacgtttncttctgcactccttctatagaccagcagggggcgctcgcggattgcctttcctgctcggt

SEQ ID NO: 21172 - DNA, 121 bp, Artificial Sequence
  Synthesized
  misc_feature (61): n=t or c
gactgcagacatctgggaatggttcccagacgtgcttagaactagtctgaggcgcatgcantgccaactggaaggtgcagcttaactctcagcatttcgatgcatgtttgcaaataggcac

SEQ ID NO: 21173 - DNA, 121 bp, Artificial Sequence
  Synthesized
  misc_feature (61): n=t or c
acagctgactttgtgctagacaaactctcagctgtacctcatacagcatagccacaaacantgcaggttcactctttggtttacgccagttttgggcaccgtgatgcatcagaatcctggt

SEQ ID NO: 21174 - DNA, 121 bp, Artificial Sequence
  Synthesized
  misc_feature (61): n=t or c
gttccaggtgtggaaactcagccttcaataatttgagaaaggaaatgccagtctgttttgnatgcttcttaccaccacatactgctgttttgttcaacatatttctacactactgactgtg

SEQ ID NO: 21175 - DNA, 121 bp, Artificial Sequence
  Synthesized
  misc_feature (61): n=t or c
ggaattttagatggtcagttacagatattttcctgtgagaaaagaatggtaagaacgtagnttgaacattaacaaatccacaagcctggtgtagccagcaggtttgaaggggcacgcagtg

SEQ ID NO: 21176 - DNA, 121 bp, Artificial Sequence
  Synthesized
  misc_feature (61): n=a or g
gatatactgtttgaatatctaacatcactatggtctaacgattttagtatttattgaaccnctcctaattacacaactccttactgccttcacttaaatgttctgtctagtgtcccaatta

SEQ ID NO: 21177 - DNA, 121 bp, Artificial Sequence
  Synthesized
  misc_feature (61): n=t or c
tgtcttaaaggccttgaagcaatgatgtggcttctaaatgaacaacttaaaagattaatantgctatatataggaattaccctatgttctgacttgatccttctgtccattggcaatatga

SEQ ID NO: 21178 - DNA, 121 bp, Artificial Sequence
  Synthesized
  misc_feature (61): n=a or g
ataggaaccaagagaaaaagagatttgtctatgttcagagtcccctgcatgacatttaganagggaccagaaagtttcttcgtacaattctttcagtttttcttgctcaggaaaactctgt

SEQ ID NO: 21179 - DNA, 121 bp, Artificial Sequence
  Synthesized
  misc_feature (61): n=a or c
caaagatctctgcataatatgagttttctctatttcctttgatttcacagagaactagagnaattagtctcattaatgggaggtagtttgaagaggtttgagttatgatactataggaact

SEQ ID NO: 21180 - DNA, 121 bp, Artificial Sequence
  Synthesized
  misc_feature (61): n=t or c
ctagatccgagtgtacagccatcatcattagaacaccttcaataactccaacagaagcatnacggactgaagaggcaccacacaaacatcctcagtaaacctactatctgaattcaaagat

SEQ ID NO: 21181 - DNA, 121 bp, Artificial Sequence
  Synthesized
  misc_feature (61): n=a or g
tactatttcatttgcactggtgttgtatttattacaataagcttcttgtgtatttattgcnttacgtattgacgcgagactgtggatgctgaatgtatgtgctaaacacaaaggctaataa

SEQ ID NO: 21182 - DNA, 121 bp, Artificial Sequence
  Synthesized
  misc_feature (61): n=a or g
tgggagatctgagtggtgaagggcactctcatgaagatgtatgaagcaaagtgcatggctnagtctccctaggtttgaaattgccaggatgctttgggctcatgcagagacaaacaccatc

SEQ ID NO: 21183 - DNA, 121 bp, Artificial Sequence
  Synthesized
  misc_feature (61): n=a or t
cttacatttactgtacggtttcagagatgaaattattgtgaaaagacagtctattccagantgtcttacaccgtcttatacatcttagtctgcttatatttatatccatgaagccagaggt

SEQ ID NO: 21184 - DNA, 121 bp, Artificial Sequence
  Synthesized
  misc_feature (61): n=t or g
acatggtcacatacaatgataatgtacctgcacaagggacaaaggtaaaagaataattgantcctcaacttcacaagcacaaaatgaaccataaaaggtgtgtgtttaagtacgtaaatac

SEQ ID NO: 21185 - DNA, 121 bp, Artificial Sequence
  Synthesized
  misc_feature (61): n=a or g
atagctgaaatcaggctgctggccatagatctgcatagctttgccagcaaggcatcctttncctttggcagctattaccttgtgtcatttcttggactgagggccacgactttcatttctc

SEQ ID NO: 21186 - DNA, 121 bp, Artificial Sequence
  Synthesized
  misc_feature (61): n=t or c
cagaatgttttgttaaacacttggcagctttgttttcagaaatatctgatgtgcaaattgntatcttttcattcctagcttcaggctcaaaaagtagttgaacattcattaaaacaattgt

SEQ ID NO: 21187 - DNA, 121 bp, Artificial Sequence
  Synthesized
  misc_feature (61): n=t or c
cacaggaatcatttcccagtctaccctatcaagctggagtcatttcctcccaggcacagtnttcagccaattaacactcctaagtgttaattcagccagttaactcccttttgaaggcaaa

SEQ ID NO: 21188 - DNA, 121 bp, Artificial Sequence
  Synthesized
  misc_feature (61): n=t or c
cctcatgaaggagcagaatttgctggagaccaagctgaggtcctacgagaaggagaagacnagctttgcaccagcactggaggagacccaatgggaggtaaggcccagggaatggagctgt

SEQ ID NO: 21189 - DNA, 121 bp, Artificial Sequence
  Synthesized
  misc_feature (61): n=t or c
ggatatcgaagttggtgaaaactgtacttgagtttattttacggtagctgtgtgctcttangtgaccttaaaagtgcaaatgagaaacttacttggtgtctgttctcatattacttccagt

SEQ ID NO: 21190 - DNA, 121 bp, Artificial Sequence
  Synthesized
  misc_feature (61): n=a or g
gaaatcgactgtatggtctcctatgaagtgctctgcagagctggcatcactctgaagggcnacatggaaaatcagaggcgtgtgggtgggactgttgaaaggaccgtgtaggactgcttag

SEQ ID NO: 21191 - DNA, 121 bp, Artificial Sequence
  Synthesized
  misc_feature (61): n=t or c
ggaaataaacaatttccacgttttcaaacttaacgttgtctagaaaacctgtacaatacantgattgcttcactttttattctcaatctaggaaagtaaatatcaaaatattggcattctt

SEQ ID NO: 21192 - DNA, 121 bp, Artificial Sequence
  Synthesized
  misc_feature (61): n=t or c
caaatgctaacataagcaagaagttcagagcaagaagtcatagcatggagccccagactangaaaatactagaaaacaatactcaagcaaatcctcaaggaagtactgtaatgcatttgag

SEQ ID NO: 21193 - DNA, 121 bp, Artificial Sequence
  Synthesized
  misc_feature (61): n=a or g
gtcataagaatgctcttcatggctcagatcttgggagacacctgggtcagagagactgtcngcttctcttggcttgaaatcccttgtgctgagcagaattgctccacaccggcgggcaaag

SEQ ID NO: 21194 - DNA, 121 bp, Artificial Sequence
  Synthesized
  misc_feature (61): n=t or c
catcccagtctaagggtagtgacactacaaaaatgtctgtccatatcttggctctcattgnctgtaaactacagaaaatttcactccatggaactgatggaaataatctcagattcacaga

SEQ ID NO: 21195 - DNA, 121 bp, Artificial Sequence
  Synthesized
  misc_feature (61): n=t or c
gattttttgggatggagagcactttttgctattgtgctttgttttattagttaatgtaagntgtctcacagtccattctggtgctaagcagccctaataatgccttctaacatctttaata

SEQ ID NO: 21196 - DNA, 121 bp, Artificial Sequence
  Synthesized
  misc_feature (61): n=a or g
ctcagtgaaaacaataggacacagagaggaaatgaaagatgacaaatataagacaagggancacgttggtgggaggtggaaaaaagagaaacgaggaggcacaggggagggctgctgctgc

SEQ ID NO: 21197 - DNA, 121 bp, Artificial Sequence
  Synthesized
  misc_feature (61): n=a or c
gaaaaaaaagacattccatgttgattctgatagtttggcattcgtttttccagtcttaatntgagatcaaacaatagtatttgtaggttgtcttttgtgattgtgtttgctttgaaatagg

SEQ ID NO: 21198 - DNA, 121 bp, Artificial Sequence
  Synthesized
  misc_feature (61): n=a or t
cacagtcacatgatggtaagtatgaaggagtaaactggtgcagtctggatttatctccatntccacaactataccacccaatcagtcccatcagacacgtttaattgcatttgaagtaagc

SEQ ID NO: 21199 - DNA, 121 bp, Artificial Sequence
  Synthesized
  misc_feature (61): n=a or g
ttttagaaattgagtggagcgattatatatattgcaaatgcaaattatttagtattcccantatttgatccagaaatgatcaacaaaataaatcaacattttcttcagttgtatgcgtaac

SEQ ID NO: 21200 - DNA, 121 bp, Artificial Sequence
  Synthesized
  misc_feature (61): n=a or c
ttaaatatttgtccactttttaataggtttattttgaaaaggatagtaaaggtacttaacnggctaggaaaattcagtcaatcaattaattttccaaatgaagatagtgtgcatgattatt

SEQ ID NO: 21201 - DNA, 121 bp, Artificial Sequence
  Synthesized
  misc_feature (61): n=t or c
tatgggcaaaaaaagaaaaaggcaagtgcataatgaggtcatgcattattctgacaagatntagctatgttgcattttgtaatgtttttgaaatttttgtactcattgtttctgcctcttc

SEQ ID NO: 21202 - DNA, 121 bp, Artificial Sequence
  Synthesized
  misc_feature (61): n=t or c
catacaccaagagaaaagaaactcatactttttgagaagtctgtcttggcttacttaaatngcagtaagctgccagaatacaaatctgattctatttttgtagccagtttcacagtgcata

SEQ ID NO: 21203 - DNA, 121 bp, Artificial Sequence
  Synthesized
  misc_feature (61): n=t or c
acctgcacatagcactttctatacatgcatagactttttgttaaatggagatccctaaagnagaagtagtgtaaataagaagtgatgtgcattccagttgtgccaaggctttgaattcatt

SEQ ID NO: 21204 - DNA, 121 bp, Artificial Sequence
  Synthesized
  misc_feature (61): n=t or c
cagtctgtctcttaaaagtaaaataaaattatacataaatgaatatggaagacctgctttncccattcaccagaaatgaattgatattatagttggaaatgttgaaactaaaagtcttatt

SEQ ID NO: 21205 - DNA, 121 bp, Artificial Sequence
  Synthesized
  misc_feature (61): n=t or c
ccttttatgaaaagaacacactttcaaccataacaaaaaataccccactcttcccaaaccntgtcatatccatgtttcacagatttcttttgtgcatccaagttctatatctctgaaatgt

SEQ ID NO: 21206 - DNA, 121 bp, Artificial Sequence
  Synthesized
  misc_feature (61): n=t or c
taatggccacaattcaaactcagatttttaacagtcagctgtaaacacagttctacctgcngcctggccctgaatccatccatgttttattctaaagaagtacgtttgtgattctctgctg

SEQ ID NO: 21207 - DNA, 121 bp, Artificial Sequence
  Synthesized
  misc_feature (61): n=t or c
agaataaatgcaaaaggtaaattttgaccctgaaaagaatatataaaggtgatgggggagnaatcattcagaacatgtgagtgaatggtggagatctctcagatatattctttgttggttc

SEQ ID NO: 21208 - DNA, 121 bp, Artificial Sequence
  Synthesized
  misc_feature (61): n=t or c
gagctgcagctgtatgacacgtctggaactattacagtagtgataaagtaatggactgatnaatattcatgaagtctgagaaaagcaaactatctcagtggaatgtttttgtctttcgagt

SEQ ID NO: 21209 - DNA, 121 bp, Artificial Sequence
  Synthesized
  misc_feature (61): n=a or g
ttggtcacttttttcatttttcttttttatttttataaatatgctaataacctgaagctanatgttaatgtgggtcattctttgataagaataacaattaactggtaagactgcgtagtac

SEQ ID NO: 21210 - DNA, 121 bp, Artificial Sequence
  Synthesized
  misc_feature (61): n=t or g
attggagatgattaaaaataggcctgagaaacacttaccaactgaccagatgaccgcttgngactcactccttcagcttcctccaaaatcttagttgtgagactcttccagttcctttgat

SEQ ID NO: 21211 - DNA, 121 bp, Artificial Sequence
  Synthesized
  misc_feature (61): n=a or g
gcttaaatcatctgtgatgataaagctggctttggcagataatttgacctgtaatttaatngaaaaaggtaagttcaagtacactcaattccatctcttgatgatttcaggtgaacttccc

SEQ ID NO: 21212 - DNA, 121 bp, Artificial Sequence
  Synthesized
  misc_feature (61): n=t or c
acaacgtgactgcacttcagggttcaagtcttatgtaacttctgatagaaaactcaaaaangtgacaagggttccacaagaatctttccacactgtgtaaattgatcttcttatgacattt

SEQ ID NO: 21213 - DNA, 121 bp, Artificial Sequence
  Synthesized
  misc_feature (61): n=t or c
tgtgttcctggctccgtattgccctgctggtttgcagccttgccttcaaatccacgctgtnatcttatgtgcatccttacaggtgcagctgtaatgccacagctcccaggagtgtgggcac

SEQ ID NO: 21214 - DNA, 121 bp, Artificial Sequence
  Synthesized
  misc_feature (61): n=t or c
ggcagcaaacatatcctttccaaacaacaacaaagcgtttccacttcaactgcagctccgngtggctctgcgcttcccagtgtgtttgtaggcaacagtgcagagcccgtggtggcatgaa

SEQ ID NO: 21215 - DNA, 121 bp, Artificial Sequence
  Synthesized
  misc_feature (61): n=a or g
aggtcccttccaaccaaagccattctgtgattctatgatttcagtgatgatggatcacacncttccagaatttttatggtggttttgttaaaactgtcagtcagaaaaacttgagctatgg

SEQ ID NO: 21216 - DNA, 121 bp, Artificial Sequence
  Synthesized
  misc_feature (61): n=a or t
gaaacttttttttttttttttttttgacaacgttaaagttctttttcacatcaaggatcancagagttcccaggtatcactcctgctaaaaatagggacaaactgatgctgtggaagagtt

SEQ ID NO: 21217 - DNA, 121 bp, Artificial Sequence
  Synthesized
  misc_feature (61): n=t or c
gcagaaattcttgtggtttctttttgcagaagaaagctgtgagtgaaatcaaacagcatgntcttttactaggaactgaaggaggactgtatagttttacagttgtagattttattgtact

SEQ ID NO: 21218 - DNA, 121 bp, Artificial Sequence
  Synthesized
  misc_feature (61): n=a or c
tctaataactgctggacagaaactaagtggggatgctcagtatcttaaaaaaaacattatnataacttcaaattgttatggtatatatgagctttgagctctctcacacaaggtctgttac

SEQ ID NO: 21219 - DNA, 121 bp, Artificial Sequence
  Synthesized
  misc_feature (61): n=t or c
caaaagaaaaatgggctcatgtcttaaagaagattttgttgaacaagtttgtaacttatanggaagacatatgcccaagttccaaatgttaaatttcacagctcactcttggagcgtgaca

SEQ ID NO: 21220 - DNA, 121 bp, Artificial Sequence
  Synthesized
  misc_feature (61): n=a or g
tgtcaatctctgtggctttttcaccctgtccccagcaaaaccatgaatgtggagttgtacngagcattgtgtgcaaataaaatgactactcaaaaacatgatcagtgcgagaatccagaaa

SEQ ID NO: 21221 - DNA, 121 bp, Artificial Sequence
  Synthesized
  misc_feature (61): n=t or c
agaggagttatcttcccattccaggaagtaatcctctccttctcacttcctccagcagctnctgcctctgtgtctctttcatcaaaggtcttagcatttgcaataggatgctgaactatac

SEQ ID NO: 21222 - DNA, 121 bp, Artificial Sequence
  Synthesized
  misc_feature (61): n=t or c
cactgtgagcttgctctggttcagactaccaaacattgccaatatctgagctgaagcacangtagctgaagcatgcattttggaggctttttccctgtcctgatagactttcttgcccatg

SEQ ID NO: 21223 - DNA, 121 bp, Artificial Sequence
  Synthesized
  misc_feature (61): n=t or g
tctcggtacaactgtgactctctcaaacctaccaccttgcacattctcctctgttcaaacncttattgacattttatttgaaagactaacaaccttctctaatctctttcttgttcagtga

SEQ ID NO: 21224 - DNA, 121 bp, Artificial Sequence
  Synthesized
  misc_feature (61): n=t or g
tgtaagagcaatatattatcttgctcatttcactattttcactcattttactataaattanactcttgcacaaaagcagcaataatttgggattaaacccatgaaaagatttaagtatagc

SEQ ID NO: 21225 - DNA, 121 bp, Artificial Sequence
  Synthesized
  misc_feature (61): n=c or g
tctctttaaagatctttctagtccgctgagcagtgctgcgtctattagagcaaaataactntgtgtacaccatcttttcttaaacactaccacatgtagcactggctattttatagcgtca

SEQ ID NO: 21226 - DNA, 121 bp, Artificial Sequence
  Synthesized
  misc_feature (61): n=a or g
tgaggtatctggtgcagatctgtacatggctggattaccagaaaggcatgtacagcaggtnctgtgccccatggtttcacacccagggtgtctcctgacaccacctctccttttttaaaga

SEQ ID NO: 21227 - DNA, 121 bp, Artificial Sequence
  Synthesized
  misc_feature (61): n=a or g
ggaggtcctgagcgccggcgccaaatttgcataaagagctacccaggagccctcgcgttcngaaacgggcaaagaaaaggcttgtaatatggaaatactgcggtgaaaagcgtttcaattt

SEQ ID NO: 21228 - DNA, 121 bp, Artificial Sequence
  Synthesized
  misc_feature (61): n=a or g
actgtaacataactgttgattagcaagcagaactcagaaactactattttcactctttaantatcaaaacatttattatttattgttttcctctggtttaagtattttgaattgatctgta

SEQ ID NO: 21229 - DNA, 121 bp, Artificial Sequence
  Synthesized
  misc_feature (61): n=t or g
agtacaaactgtaaagtaatgcttgagcttcatctatagggagtggagaaaaagtccagangatcatctatcctaaggtgatgtcaaggcaggtaatgtgaaactccttctgtagatattg

SEQ ID NO: 21230 - DNA, 121 bp, Artificial Sequence
  Synthesized
  misc_feature (61): n=t or g
ttgttgtttatgttttaataggtgtgccgttcacttttaaatttaatctacttaattcctntttggtgtaatgtctgaaatgtctttgtgcttcactaggacttggcaagccaattgatta

SEQ ID NO: 21231 - DNA, 121 bp, Artificial Sequence
  Synthesized
  misc_feature (61): n=a or g
taccaccagaaactgcgttgcaaagtaaagctgaaacacacagttgcaagatattcacatngcagagataataacaactgtaacatgtgatagagaagtcatggttgtaactgtaatttgc

SEQ ID NO: 21232 - DNA, 121 bp, Artificial Sequence
  Synthesized
  misc_feature (61): n=t or c
acccacatatgccttaaaattaatgttgcccttcatgatcaactgacaacaatgatgttgncatcggggacatgaagattgatttgctgcctgcatcaaagacagacagaaagacggacag

SEQ ID NO: 21233 - DNA, 121 bp, Artificial Sequence
  Synthesized
  misc_feature (61): n=a or g
tttgaacacacattccaacacatttaggataacacatttttaaacacacagcaaaacgcantctattctcaaatattgcctgttattttaaggcatctttacttctaagcaagaaaatacc

SEQ ID NO: 21234 - DNA, 121 bp, Artificial Sequence
  Synthesized
  misc_feature (61): n=t or c
ttaatgtcaagttaatgtgatttacaatatgtactaggaatatgtataccactggaccggnacattgccatagatcccatctcagatcaacagaggatgaaggatttacatgactaaaatt

SEQ ID NO: 21235 - DNA, 121 bp, Artificial Sequence
  Synthesized
  misc_feature (61): n=a or g
gtagtctctcctgatggaagataatggcatagcaaaagacagggagtgagaaggaatgacncagggattaggtcttgggtagtcagcctccctcggctcattctcatgaaggggtgggtgg

SEQ ID NO: 21236 - DNA, 121 bp, Artificial Sequence
  Synthesized
  misc_feature (61): n=t or c
cataaatgggaaagcatgtggctgggtttgggaaggtagttaatgctctgtgacctcccangctgattaaacctggaagtatctgtaaaaattgctgtagtgcctggcatgaggggatgtt

SEQ ID NO: 21237 - DNA, 121 bp, Artificial Sequence
  Synthesized
  misc_feature (61): n=a or g
gctctgacttcatgtcaacaaatgcaccaacaattgtggcagagatttgcatctgtaaagnctgcgatggaagcacactaccactgattttgggggtaggagggatcactaactcaccctc

SEQ ID NO: 21238 - DNA, 121 bp, Artificial Sequence
  Synthesized
  misc_feature (61): n=a or g
ggggtgggaaggccttcttgatggcccccacttgatgatattatgcactggtagtgctttnttgagtcaaaaatgtttagcaagaggcaaagcgactgacccagatgtttgcatggctttg

SEQ ID NO: 21239 - DNA, 121 bp, Artificial Sequence
  Synthesized
  misc_feature (61): n=a or g
acaagggctgcactctcttaaggtactcttcgtgcagtgcttggacacgtaggttcccgcngggcatttgtcgcagatcagctcctggttggtggcacggtccaggtggaggtacttgcca

SEQ ID NO: 21240 - DNA, 121 bp, Artificial Sequence
  Synthesized
  misc_feature (61): n=a or g
tggatatcctgtgataaaggaaggtaatgctaggacataaaggcaataaaatttcagaacntaagacaagactatcgacactatggatttacaggggatttgttccccaaatactgcttta

SEQ ID NO: 21241 - DNA, 121 bp, Artificial Sequence
  Synthesized
  misc_feature (61): n=a or c
cagggccactgatgccaccgccgtggtcacgcctcactgtggtccccattggatcatcgtncctatctcaggggatatcattcctcagctgggaaaaagccttcacagagctcgctggctc

SEQ ID NO: 21242 - DNA, 121 bp, Artificial Sequence
  Synthesized
  misc_feature (61): n=a or g
acagtgcataggtagtattttcaacatcaacacctgtgttaataactgagacacttccctnactctgcaatgtggttagcactgtctaaatattttaaattttagatattttaatgagttg

SEQ ID NO: 21243 - DNA, 121 bp, Artificial Sequence
  Synthesized
  misc_feature (61): n=c or g
tactgatatcagtattaaaaaattttccctgcaacagcatgatagatgaatatgagcttgntaagtttgcatttaccctgatgcagaggattttgaagcttttgtctgtcacccctaccta

SEQ ID NO: 21244 - DNA, 121 bp, Artificial Sequence
  Synthesized
  misc_feature (61): n=t or c
aatcactttctgatcccaacagctacactattcaactctttcctagcataattaaacaagngacaatgaggatactattctgagacatggtaatgagatgctgtgaggcctgaatttagct

SEQ ID NO: 21245 - DNA, 121 bp, Artificial Sequence
  Synthesized
  misc_feature (61): n=a or g
tccttaaggacccttaatgcctcgcatgtcctagagtttgtcctccaaaaagggagaagcntttgtgcccaagttaagcaggaattgtcatcagtgcagaagtggtcatctgggggacagt

SEQ ID NO: 21246 - DNA, 121 bp, Artificial Sequence
  Synthesized
  misc_feature (61): n=a or g
gcaggggagtgctctgagcaccacaggtgtcaccgggctgcacgggcctgaaaatgtgaangaatgtgaaaaatgtgaaagtcatcatgctggctccgagactgcaaacttctggttaatg

SEQ ID NO: 21247 - DNA, 121 bp, Artificial Sequence
  Synthesized
  misc_feature (61): n=a or g
gggccatccatctgataagcagacaaacacaaactactaacattagccttttcctattatnccactacttgctcactgatgtattttattaacttttattattgatatttcaataatcaat

SEQ ID NO: 21248 - DNA, 121 bp, Artificial Sequence
  Synthesized
  misc_feature (61): n=a or g
gtgaagacttgaggcaaatacaatctatgttgttgctacttgagtgaacttctgcttttcnaacacatcaacttggttattgagaccaactctgagggaccgcaactggtttcttataatt

SEQ ID NO: 21249 - DNA, 121 bp, Artificial Sequence
  Synthesized
  misc_feature (61): n=a or g
cctagcaaaacaaatatcatagtagctgcataaatgaacacactacgcttttaaattaganaaaaaccctcgattttaaaaactctattttcttaaaaaaaagaacaggaataagaatctg

SEQ ID NO: 21250 - DNA, 121 bp, Artificial Sequence
  Synthesized
  misc_feature (61): n=a or g
ttcagaaatgtttcagttcttgatgcttaggatcataaatggatgaatagtgtatgtactnttagtgtctgcacaggaaattctttgagaaggaaggatacaagatttttaattgctgatt

SEQ ID NO: 21251 - DNA, 121 bp, Artificial Sequence
  Synthesized
  misc_feature (61): n=a or c
caacacacattttggtagtgctgagattttgacaccatttccacaggacaaaattttaaanatcactgggacaatcaggataattgcttaaggttgaaaaaaaatagcatcctatggagct

SEQ ID NO: 21252 - DNA, 121 bp, Artificial Sequence
  Synthesized
  misc_feature (61): n=a or g
gttgcttcctttatgcatgccctcctttatgtcatccctgccagcctctcattcacatagnctgttgagtgtttggggcctggctgccttctggcacagtgagtgccttctggggcactaa

SEQ ID NO: 21253 - DNA, 121 bp, Artificial Sequence
  Synthesized
  misc_feature (61): n=a or g
cctggcagattgaaatgaagcaagaactgccaccactgctttcggacaacccattcctctnggatatgttctgcaatagggcaagactgtttttgtaaccatttgctaaaattttggaggg

SEQ ID NO: 21254 - DNA, 121 bp, Artificial Sequence
  Synthesized
  misc_feature (61): n=t or g
cacaagtaattcataataatagtacataacagtatttggaactcacttatattggagaaanctaacaagttcacagcatttacttgcacctcagcagagtacatctgtctttttattcaag

SEQ ID NO: 21255 - DNA, 121 bp, Artificial Sequence
  Synthesized
  misc_feature (61): n=t or c
ttcatgttttatctcatcctcataaccaattagggtgacaaattagttcataacaacaaangttttcttgccaaaaactcccatgttttattctcaaataaaataccttacaatgtaacct

SEQ ID NO: 21256 - DNA, 121 bp, Artificial Sequence
  Synthesized
  misc_feature (61): n=t or g
ttagaagcataatacgtagtcatcatagtttgaagaatatttaaagacacattgaatattnttcttgtttactgccattgcatttgcttttcttggtgttcagaaactaagaccttcaata

SEQ ID NO: 21257 - DNA, 121 bp, Artificial Sequence
  Synthesized
  misc_feature (61): n=t or c
caaccttttagtagattggataaaagcttcgcctggtggccttatcgtgtcatctggacangctaccatgataaggctgctctcccttgtgggggttctgaggttactggtggaagatgct

SEQ ID NO: 21258 - DNA, 121 bp, Artificial Sequence
  Synthesized
  misc_feature (61): n=t or c
aagtattaaaataattaattttgggaaaaaatatgaaaatgatatgcaaatctggagcttngacttgatggaaaaagggcatcttgtaaacctaaccttgctggatctcagtgaggaattt

SEQ ID NO: 21259 - DNA, 121 bp, Artificial Sequence
  Synthesized
  misc_feature (61): n=a or g
gccataggtatgcgaggctgctgctttgctgccagggatctctttgcagaagtgtttagtngtctaaaatacctggaactatcttgttctccaaagcccacagcttagtagcttttgtaat

SEQ ID NO: 21260 - DNA, 121 bp, Artificial Sequence
  Synthesized
  misc_feature (61): n=t or c
ttggcagccaacagaggcagaagtctccactcacacaagaaaaaattccttactggtttgntccacccaagcacatgccattactgtttagtcttccacctgctacagaacacaagaaagc

SEQ ID NO: 21261 - DNA, 121 bp, Artificial Sequence
  Synthesized
  misc_feature (61): n=a or t
gtgtcctccttaaggaaacaatcacttcaaaagaaagtgagtttgtagtgacttggtaagnatcctgatttcctctgactgatgctgcctcatggcacagcttctgaatgcaggaacctgc

SEQ ID NO: 21262 - DNA, 121 bp, Artificial Sequence
  Synthesized
  misc_feature (61): n=a or c
attgctttccaaactacgataggtaacataactgcagcttgaagtggtatcagagagcagntttcttacatgacgttaaataggagtgataagaactgcctcctgatatttcaaaattagc

SEQ ID NO: 21263 - DNA, 121 bp, Artificial Sequence
  Synthesized
  misc_feature (61): n=t or g
atttaattgaaaccataactcactgtaagtcttcaagttttaaaaatatcaacagttgcanactaaccaatttcacatttaagttggacaagggaatgatttttattttttttgaagtgat

SEQ ID NO: 21264 - DNA, 121 bp, Artificial Sequence
  Synthesized
  misc_feature (61): n=t or c
cttgcagactcaccttttaactaacattgggagcaacacaaaacctctccggataaaatgngtgaatctttatctaattttagtaagcgtttcaagacaaattaatttagcgtgaatgtaa

SEQ ID NO: 21265 - DNA, 121 bp, Artificial Sequence
  Synthesized
  misc_feature (61): n=a or g
aagaagatggagcccaatctagagctcagaaagcagttgtctggaaagtctgatgttaccntgttggccatccagtaaatactgacttagtcctttggcatcattaaggatagttactcag

SEQ ID NO: 21266 - DNA, 121 bp, Artificial Sequence
  Synthesized
  misc_feature (61): n=c or g
ctgaaataaaacctgggcgaaggaaggactgatcctctctggatttcctaaatgtgcactnatatgtggagcagggggagttgaaggtaatgagaaaggtatgtctgtgggatcagtgtgc

SEQ ID NO: 21267 - DNA, 121 bp, Artificial Sequence
  Synthesized
  misc_feature (61): n=t or c
cagtttatgcatgtcttgtaagtgtaagaaaagccacattaaaaaaatggagaggtgagangcactatagctttaggtgatgcttttcaaaggtgaaaacaaaataaatctgcttatgtaa

SEQ ID NO: 21268 - DNA, 121 bp, Artificial Sequence
  Synthesized
  misc_feature (61): n=a or g
tcctctacaaaattcccctataactatacagcttaggaaaaatagatgagtgagcatagtntgttaagctggaaggtgtagagaccatgatctgtcccgaagagatcctttcccaaaacgt

SEQ ID NO: 21269 - DNA, 121 bp, Artificial Sequence
  Synthesized
  misc_feature (61): n=t or c
aaaaaaaaaaagctagaaatgtctacagtggcaggaaagaaagtgttttgattccaattcnatcctaatggaccagatgcagaaagtttcttttgggtatggtgtcagcattctcttaaac

SEQ ID NO: 21270 - DNA, 121 bp, Artificial Sequence
  Synthesized
  misc_feature (61): n=a or g
ttttaaaaataaagttatgctgtgaaagaaacagtgaagtctgaaccaaaaggattagccntacaaactacgacaaagttaccctaaatcaatcagtctgggctaactattcatctgcatg

SEQ ID NO: 21271 - DNA, 121 bp, Artificial Sequence
  Synthesized
  misc_feature (61): n=a or g
tcgccccacgaagtactctttcatctcactggcattttcagcaagtttctggaggccatcnactcgtgtctcagtgtagaactccatcacacgttcagtctgtgggttcattgacttatag

SEQ ID NO: 21272 - DNA, 121 bp, Artificial Sequence
  Synthesized
  misc_feature (61): n=a or g
ctctttctgccacttgttcattttggaaatcttttctgcaggacatgtcattactattccntatctattgtagagatgcttttgggagttgctgatttgttttgtgcagacaaactcttgt

SEQ ID NO: 21273 - DNA, 121 bp, Artificial Sequence
  Synthesized
  misc_feature (61): n=a or g
agcctcttgtggagatcccagggtcaccctcatgcagatatgtccctcgtcacctagcacntgctgcacagtctgtgcaggaatgtgtatgcacacatgcactgcacagctcctgtcacca

SEQ ID NO: 21274 - DNA, 121 bp, Artificial Sequence
  Synthesized
  misc_feature (61): n=t or c
cacacatgtatggaatacatgaaggagaaaggaattaggagtagtaaatcttaaccaaagntcacacctgttaacaattgttgtaaaatcttctttctttttctaatggacaaaaaaagag

SEQ ID NO: 21275 - DNA, 121 bp, Artificial Sequence
  Synthesized
  misc_feature (61): n=t or c
gctgctggaatttcctacagtagcagcccctctttgccctcatctaaaatctgatacaaantcttctgccacaaaagctgtccagtatgactgttccagcagatgtatttgcagattttaa

SEQ ID NO: 21276 - DNA, 121 bp, Artificial Sequence
  Synthesized
  misc_feature (61): n=a or c
gcttctttcactgctgtctgctgatgggccacttctttcccttcacattatcttatgagcntttcttccttgtcttccctcttatctatctttcaaccttcattttcctcatccctcgttc

SEQ ID NO: 21277 - DNA, 121 bp, Artificial Sequence
  Synthesized
  misc_feature (61): n=a or g
ttcaggatgtgactctaatctaagagaattttttttcagtatcctgggtgttttaaggagnttaatttctgtcccttatatctacagactgaaagtgactgagaggcatttaaaacaaaca

SEQ ID NO: 21278 - DNA, 121 bp, Artificial Sequence
  Synthesized
  misc_feature (61): n=t or c
aattctattagtagaagtttcaacatttgctttatatgagatgaaaggtgcacaggaatgnctcgtctgtgtgtcaatgaactattctctaatctttgcaaattatttggatttggatata

SEQ ID NO: 21279 - DNA, 121 bp, Artificial Sequence
  Synthesized
  misc_feature (61): n=c or g
attcaagtaggtcaatttctcctttgcaggcacctagagcacttgctgctgtaattctatntggagacatcaccagcagaacatctgagtgcgtgcagctgaacagtgatgtgtctgtggg

SEQ ID NO: 21280 - DNA, 121 bp, Artificial Sequence
  Synthesized
  misc_feature (61): n=a or g
cttcttacagcatcagtgtatgcattaccagcactgaaccctgactgatgatttattgacntattaatctaagaacagttctttgaatagttagtaaaaagaacatttcagtagctctttg

SEQ ID NO: 21281 - DNA, 121 bp, Artificial Sequence
  Synthesized
  misc_feature (61): n=t or c
tgtacttgttcccactgtttccagctcttctttggctctttatgctcaaaaccctaatgcntgcttagtaacatttctgtagcccattcagtgatcagagtgcctgtgatcagaaagcagc

SEQ ID NO: 21282 - DNA, 121 bp, Artificial Sequence
  Synthesized
  misc_feature (61): n=t or g
ctggctaagtactttaaatgtaggccaactataaacctcaagaggtttagcaaaactgtgnattagctctgttatacttacatttacttttagtaacttgctgttcagagatgagttttcc

SEQ ID NO: 21283 - DNA, 121 bp, Artificial Sequence
  Synthesized
  misc_feature (61): n=a or g
gaatgacaaatggctgctctcactaagctccactgcacagcagatttaatgagtgctgacnatgcttgtggctgtgtgaactcaagaatgttagggggtgaagaaactcccattggactcc

SEQ ID NO: 21284 - DNA, 121 bp, Artificial Sequence
  Synthesized
  misc_feature (61): n=a or t
attcagaaagtttgtgtgccaaaaggggtctgttctactatgtaaacacaagctacatgcnactaatttctgcaagcatcccattctccagaaatcctccagtctacatccttagaaagta

SEQ ID NO: 21285 - DNA, 121 bp, Artificial Sequence
  Synthesized
  misc_feature (61): n=a or g
gaaggtgagagaacatatccaatttttctcaagcccccagcctaaataatgagtgtcttanattagtcttaataaagattgttagaaacttcattagaaaaggagacaggcagaccagtgt

SEQ ID NO: 21286 - DNA, 121 bp, Artificial Sequence
  Synthesized
  misc_feature (61): n=t or c
tgggtcaagtgtggtggggatgggcaggagaagcttcaggccctcagagccttggcaaagngatagctgaatccctgctttaggtacaagtgcaccctgctttcacacaggtacatctgca

SEQ ID NO: 21287 - DNA, 121 bp, Artificial Sequence
  Synthesized
  misc_feature (61): n=t or c
tggcttgttatgaactctacttgcctaccttgctatcgtttcttattttttccacatgaanaactttcaggagggctgcttgctacatatccatactacagcaaaatgcattattttctgt

SEQ ID NO: 21288 - DNA, 121 bp, Artificial Sequence
  Synthesized
  misc_feature (61): n=a or g
gaacatggatttatcctctgtggagtaaaaggcaaaacaaaagctctatttaatttaatgntgacaatttgttttctgattctatcacttgaacttagatcatctaaaccagtgcatcaga

SEQ ID NO: 21289 - DNA, 121 bp, Artificial Sequence
  Synthesized
  misc_feature (61): n=t or c
aacgggcattaagtaccagtgaaataattgctctggaagaagatgagggattgtttgctantgctactccaccgatggtcccagaccttggccacagaactgccatattcgtgtgtttctt

SEQ ID NO: 21290 - DNA, 121 bp, Artificial Sequence
  Synthesized
  misc_feature (61): n=t or c
tcatctcacatttcactgttaatcaacattcctaagatttcaggatcaatgttccaattangcttgcaatagtcacttcctacccagttaattgtcaccagacacgtaatcttcactgatt

SEQ ID NO: 21291 - DNA, 121 bp, Artificial Sequence
  Synthesized
  misc_feature (61): n=t or c
ttgttcattcatgcatcacaaaatgtgtagcactagaggtcaccagcactccatccttagngagcatccactgcaaaacatggttgagttgggtcttagcaacaagcctgttttgctatga

SEQ ID NO: 21292 - DNA, 121 bp, Artificial Sequence
  Synthesized
  misc_feature (61): n=a or g
aatcatgagaaattttagaccaatgttaaggcctacagcagatagcatgtcaggtccacanttcattttgattttttcagactcctaattttaaccaagtaagctacattttgtggccatg

SEQ ID NO: 21293 - DNA, 121 bp, Artificial Sequence
  Synthesized
  misc_feature (61): n=t or c
tctatttttctcccttctgcaaaaactttatcagctcaatatgttcaggataaatcaatangtgaaaagaatgctagttttatctcctgaggtatttcaggcacttatattcttccctccc

SEQ ID NO: 21294 - DNA, 121 bp, Artificial Sequence
  Synthesized
  misc_feature (61): n=t or g
attctatttaaaaagaaaagaaataagaaaaaagttttgtacttgtgaaaagaagcaaaangctctttaaactgtgtttctaattgacttaatcctgtgaggggatagaaatagcctacca

SEQ ID NO: 21295 - DNA, 121 bp, Artificial Sequence
  Synthesized
  misc_feature (61): n=a or g
ctccaggtttgtgttatgggaggacaaaatcagactgattgctggagatctggagggggtnttcttgtacagttgaatatggcagcgtgttctcctgttagtctgacacattcttctcttg

SEQ ID NO: 21296 - DNA, 121 bp, Artificial Sequence
  Synthesized
  misc_feature (61): n=c or g
ccaagtgctaatgacacaggacatttaggtagcatctcacaggcttgtcttgtgaagtctntgttcagcatccatccgtgtctttagaaaaacagtgcccctggcctccatttaagcatta

SEQ ID NO: 21297 - DNA, 121 bp, Artificial Sequence
  Synthesized
  misc_feature (61): n=t or c
tcaccaccacgggactgaaatttggagagaaataagtatggactctgaggacaaataccantgcttgagttgagatggagtgggagcagagtccaggagggcagagaggatggaagcagca

SEQ ID NO: 21298 - DNA, 121 bp, Artificial Sequence
  Synthesized
  misc_feature (61): n=a or g
gccttgaaaaggtcatttcccttcacgtttccatgacgttctccacgtgcctcataccatnaggtatctgagcagcccaggacaagcatcccttgggatcatctcttccctgaagctctca

SEQ ID NO: 21299 - DNA, 121 bp, Artificial Sequence
  Synthesized
  misc_feature (61): n=t or c
acactgttttggggggcagggaaagtctttagcccagaggcaaattttggactacaaacangtttgccacagaagtcttccagtatctctggagtctgggaacaaggtgatagaagagcag

SEQ ID NO: 21300 - DNA, 121 bp, Artificial Sequence
  Synthesized
  misc_feature (61): n=a or g
tcccagatgtgcaaggcccttcccagagtatttcagaagtgaaagccactgtcactattcntgtttttgctcagtggatggcgctgaatgaattaaagaggcaggaagagataccaaggcc

SEQ ID NO: 21301 - DNA, 121 bp, Artificial Sequence
  Synthesized
  misc_feature (61): n=a or g
ccatgaggctggagcagaagaaatcaaggaagatcaagcaagggccagaatagacatgagngtccctacagagggtgaagccaaagtcgcaatccaatatagaggtaaagccaaagtcaca

SEQ ID NO: 21302 - DNA, 121 bp, Artificial Sequence
  Synthesized
  misc_feature (61): n=t or c
agtgtgatggatttttagtccttttctcctgcagtttaaccctcgcctgtagagaccacantacccaagggttttcttgaatgcattggatgcacccacccactagcacagtactccgagc

SEQ ID NO: 21303 - DNA, 121 bp, Artificial Sequence
  Synthesized
  misc_feature (61): n=t or g
ctgtggtgcttacagaggcgcattagcccaagacactatgagaagggatactacagaacanaagcaaggaaaatgataagaataaaataataatgaaaataattatgcaagcaaagtggca

SEQ ID NO: 21304 - DNA, 121 bp, Artificial Sequence
  Synthesized
  misc_feature (61): n=a or g
agccaccctacgtgcacatcagctgcagcactcagtgcatggctcagttgctggtgctccntgcatacaaactgccccaacactgtctgaggaagcagcgtgcttatgtcaggcctatcaa

SEQ ID NO: 21305 - DNA, 121 bp, Artificial Sequence
  Synthesized
  misc_feature (61): n=t or c
gttttaaaatgtagcaggaccttaaaggaatctctgctcacaagcctacaggattctgagncagtgaacagtgtacttttgctcagaatccaggtggctatgttcaatttcagcattagct

SEQ ID NO: 21306 - DNA, 121 bp, Artificial Sequence
  Synthesized
  misc_feature (61): n=t or c
gaatgtcaactccttattcagctgctgactacacctacctatcacagagtgctagaaattnatgtccccttgtaaggaaaatacttactgtcattccagcaccccaccagttcagcgtgtc

SEQ ID NO: 21307 - DNA, 121 bp, Artificial Sequence
  Synthesized
  misc_feature (61): n=a or g
cttttttaaaattatttttcagatgtaaagctctcagttcacaatgtgatgaatccaggcngtgcctctctccactgtgtgaccagtctggcactagcagtgttttctttcctgctcagcc

SEQ ID NO: 21308 - DNA, 121 bp, Artificial Sequence
  Synthesized
  misc_feature (61): n=a or g
ctttgtggaagaaatggttttggagtgggatatgagaagaagagagggagtgggtcactcntgagacacataagcaaatgctttaggcactgcagcaggaggtgtagtgatttgcagcaga

SEQ ID NO: 21309 - DNA, 121 bp, Artificial Sequence
  Synthesized
  misc_feature (61): n=a or g
aagctgaatattacatctatgttgtagatatctgatgtatttctttgacatggagctgganggtgttctccatcaaagcaagaacaaacctggtatgttagtcattaaatggatgaagact

SEQ ID NO: 21310 - DNA, 121 bp, Artificial Sequence
  Synthesized
  misc_feature (61): n=c or g
gccttctccaggctgaacagttccagttctctctgactttcctcatagaagatatgtcctntaaccatcttcatagcacttttctggactggatccagtttgttcatgcctctcttgaagt

SEQ ID NO: 21311 - DNA, 121 bp, Artificial Sequence
  Synthesized
  misc_feature (61): n=a or g
cagcctccagagggcttctttctatcagcgtatgataacacacagcccacgctgattgctngttctgcctagaggcagctccaggcacacaagtttcacactcagtgtcacttctccagtg

SEQ ID NO: 21312 - DNA, 121 bp, Artificial Sequence
  Synthesized
  misc_feature (61): n=c or g
gtacctgttagtgcatgtgtttatatgtgtgtatgcttgcacgggtgtttgtacatgtgtntgcatgtgtgtacaggtgtatatggatctgcatgtgtacacctgtctgcatgtatgtacc

SEQ ID NO: 21313 - DNA, 121 bp, Artificial Sequence
  Synthesized
  misc_feature (61): n=a or t
aactgtatgcgtatgggccctttagaacatctttctctatcagttttctttccagtacagntatagcactgagatatctaaatctcaattagcgaatagatccatgacctttatggacatc

SEQ ID NO: 21314 - DNA, 121 bp, Artificial Sequence
  Synthesized
  misc_feature (61): n=t or c
tgggaaatgtcactagaatattcatatgcgccatgtgatgtgtacccaacctacttctganacacaacttaataggggacatacaatctggaaaagcgtaatgattattcccccactttaa

SEQ ID NO: 21315 - DNA, 121 bp, Artificial Sequence
  Synthesized
  misc_feature (61): n=t or c
aacaagcatctcacacctttccccactcactgtacctgctggtttaatagagggtattacntctcctaacagcaccgtgtgcaagtaggaggagaaagaatgaattaggctgaacaacctg

SEQ ID NO: 21316 - DNA, 121 bp, Artificial Sequence
  Synthesized
  misc_feature (61): n=t or c
agtgcctggtatggttttttttgcatttggaggcatcatcaataaagtagagtacaaggcnttgtactagaataacttcacaaaggacatttgttctttctaggcatacattttgagggtg

SEQ ID NO: 21317 - DNA, 121 bp, Artificial Sequence
  Synthesized
  misc_feature (61): n=t or c
ggatttcactgtgtgactgcacaaagaatttagggtcctcttgttcttctggcaaatgtcntcccctcctccacttctgactgaccaaagtagtgtttaatgtttctctggcagctggcag

SEQ ID NO: 21318 - DNA, 121 bp, Artificial Sequence
  Synthesized
  misc_feature (61): n=a or g
ccttagtacctaattctgccacaatagcaatgatagatggcctgctcatattggataggcncgtggccagctgagactatggacattattaacatgtctattttagcaatccacctcaaac

SEQ ID NO: 21319 - DNA, 121 bp, Artificial Sequence
  Synthesized
  misc_feature (61): n=t or c
ttttggttttcatttcaggcacaggcctatgcttcagtcctggtagaacaaatatctacangagagggcacatttccctccaactcaactaagaaatcttcattgtttccttgagtgcaag

SEQ ID NO: 21320 - DNA, 121 bp, Artificial Sequence
  Synthesized
  misc_feature (61): n=a or c
tgctgtttgggagatgggagaaataggggtatggtagggcaaacgtggctcaacttctgcnctgtaataaatgctgagcagaacttaaaatagcataaaaaccaggggctttgctgtggag

SEQ ID NO: 21321 - DNA, 121 bp, Artificial Sequence
  Synthesized
  misc_feature (61): n=a or c
cataacctttaatgtccaaaagactatccagatcattttgcagatatacagctgggatcanactcagctgctctttctgtctgacttcagtaaaaaaagagaagcagctgcttcacatgag

SEQ ID NO: 21322 - DNA, 121 bp, Artificial Sequence
  Synthesized
  misc_feature (61): n=t or c
ctgagaggtgacgcttcatcctgagcctcacctgagcaacacctgctttcagttgatgctnttaaagtctaagattgttgcgtacctctgtatgtttgtgttcttcctcactgttctccgg

SEQ ID NO: 21323 - DNA, 121 bp, Artificial Sequence
  Synthesized
  misc_feature (61): n=t or c
gattcagagtgttgatcaggaagtcacacctgagctattttctgcttgttggaatgaaagngaaattcagagtgactacatggatcttaggcaaaaacaagcaaaaaatgccaccacaaaa

SEQ ID NO: 21324 - DNA, 121 bp, Artificial Sequence
  Synthesized
  misc_feature (61): n=t or c
aacaaatagtttctggctgttatagtaactcagaagggaaggaaaagcacagaatgatacnttatgagctgtcagcttggtgaccccatcatcttcatacctgtctgcctgacgaagctaa

SEQ ID NO: 21325 - DNA, 121 bp, Artificial Sequence
  Synthesized
  misc_feature (61): n=t or c
tattcaaatcaaaccatgcacttttacttattttattgtcacagcaggtacacatacaatncattccctctaagaaacaggaggatctgtacatagttaacagaagtaatatattcaagaa

SEQ ID NO: 21326 - DNA, 121 bp, Artificial Sequence
  Synthesized
  misc_feature (61): n=t or c
ctttgtgggtttatggagggcactgagaaagcgaatcgccgtgcatcttttgtatgaagtngaatggtaaacagtcttttaaatcaatgactgctataggccaattcaaaggtaacactga

SEQ ID NO: 21327 - DNA, 121 bp, Artificial Sequence
  Synthesized
  misc_feature (61): n=t or c
ctgtgtggagattgtatgcatccacatttccacaggattttttttgaagtgcatcgtgtantgttgccacgtgtatcataaattgattgcacctgactgtgagatggaaggtatctgtctt

SEQ ID NO: 21328 - DNA, 121 bp, Artificial Sequence
  Synthesized
  misc_feature (61): n=a or g
caacttgaagttaaaaaaaaaggctcaaatcttgcattacattcatgaaagaaagcccagntttgtttgagccagacctgaaggctttagtgtaagtattacacctcgaaaggaaagcaaa

SEQ ID NO: 21329 - DNA, 121 bp, Artificial Sequence
  Synthesized
  misc_feature (61): n=a or c
ttagacacctggaaacttaggactttataaaatatatgtgtcaagtgtttccagaattacntagtaatttcagttatgtacttagactgcagcttgttttccagctgtttaagttttcaaa

SEQ ID NO: 21330 - DNA, 121 bp, Artificial Sequence
  Synthesized
  misc_feature (61): n=t or c
caccccatggctggagaagccccgcacagttgcattgtgacgacctccagcagaaacatgntggatgataacaagcatgccagctcagggacataaatatttctgtaagtcatgaaccttt

SEQ ID NO: 21331 - DNA, 121 bp, Artificial Sequence
  Synthesized
  misc_feature (61): n=t or c
acatatgggctgtgatgagtgtaaaagtttctgtatacaaactgattcagctcctatcaangctttggttgaagggcttcatcatgaagcagccacatgttggaagtcagcttagtctaag

SEQ ID NO: 21332 - DNA, 121 bp, Artificial Sequence
  Synthesized
  misc_feature (61): n=t or c
aacgttgatgttctatgtgttttccatcaaatgctccatttcaataaacagtaccgacttntaaaggtaaaagtattgctaaatcaaagcagaaatttccacttaaattcaagcatttctc

SEQ ID NO: 21333 - DNA, 121 bp, Artificial Sequence
  Synthesized
  misc_feature (61): n=t or c
gagtggtttggattggaaaggatggtagagatggtctagttccaagcaccctactatgggntggggacatcttccactagaccatgggctgctcagtgccctatccagccaggccttgaac

SEQ ID NO: 21334 - DNA, 121 bp, Artificial Sequence
  Synthesized
  misc_feature (61): n=a or g
tccacccactagttttctgtgctggcttctcactgctctgtctgctcttgggctgcctggncttggccagctgtctcttgtgttaacaccgcagggatttgtttgagggaaggtggcagct

SEQ ID NO: 21335 - DNA, 121 bp, Artificial Sequence
  Synthesized
  misc_feature (61): n=a or g
aaaggaaaacgtgggatgttttgtgggatatttttaaaaacactgggtgtctctttcaatntacttgtagtctaattttgtggaaactggcaatagatttgattatcagtaggcacccacc

SEQ ID NO: 21336 - DNA, 121 bp, Artificial Sequence
  Synthesized
  misc_feature (61): n=a or g
gaatgcagtggattttgagtcttcgagtggtttaagaaacacagactactcggcatgcacnggttttgtcagtgatgtaattcaagagaagatgacaaaactaaaagaaaaggagaacagc

SEQ ID NO: 21337 - DNA, 121 bp, Artificial Sequence
  Synthesized
  misc_feature (61): n=t or c
accttcaggatgaaaagaagtagaatttttatgctaccaggctgctgaagtgctatacttnagtatctacagaatggcatataattcttatatctgcaggcattgcttaatcaaacaaatg

SEQ ID NO: 21338 - DNA, 121 bp, Artificial Sequence
  Synthesized
  misc_feature (61): n=a or g
caccttctgaatccccagagaggtgctactccaagcaaaaatccatccagatccattaacnatgagactccaaggtcactggtcccaaatttggtatcacatgctcccataaaagccacga

SEQ ID NO: 21339 - DNA, 121 bp, Artificial Sequence
  Synthesized
  misc_feature (61): n=t or c
tgtgtgtttagcaagtactcttttgccttctcattcactacaagttacagtgagcatctgngaagcagtttgcatgcctaatggacttagacatgagtttgttacttttgtactcaggtgt

SEQ ID NO: 21340 - DNA, 121 bp, Artificial Sequence
  Synthesized
  misc_feature (61): n=a or g
aggaagagagtataaaagaaaaataacttgttttaaagttctgacaagtgcatcattatcnttttactgtgacaaagcatctcaagtgcagaaattacagatttatttctgactgtagtaa

SEQ ID NO: 21341 - DNA, 121 bp, Artificial Sequence
  Synthesized
  misc_feature (61): n=c or g
aagacttaatttggtctcaaaaagctctttatcttggggtaaagtagaatttcttattccncatgactaacaaaaaaccctacctgcttgtaaatgacaactcaaaggaagccagtagagg

SEQ ID NO: 21342 - DNA, 121 bp, Artificial Sequence
  Synthesized
  misc_feature (61): n=a or c
ctctcatcaataaccttaggagagttagaagcaatgagagatttctgcatctaaaagaaancagaagctgtatctaacatacttcattcgtttgctatttccctccatcaccatcgtatat

SEQ ID NO: 21343 - DNA, 121 bp, Artificial Sequence
  Synthesized
  misc_feature (61): n=t or g
catggaagatcattctctgaatccctgaacacaacttctcttttaacgtcgctgaacattntgttgcagataggagaaaattatagaacattatcaaaggctaatgggatataacaaaatc

SEQ ID NO: 21344 - DNA, 121 bp, Artificial Sequence
  Synthesized
  misc_feature (61): n=a or c
cctgaatgcatctcctgaatgcatctgaatgtagccttcctaggtgcaaaaatttgccttntaatttcttcttcacagggcacgagacagctaggcacttaatattcatctgtcttctcgt

SEQ ID NO: 21345 - DNA, 121 bp, Artificial Sequence
  Synthesized
  misc_feature (61): n=t or c
cagaacaaaagccagtgttaatggaatatgcctcacggggtccatccataccagtactctntgacagtagccaaagaagatgctgtctgaggagagtttagacaaagcttagtgttaaaga

SEQ ID NO: 21346 - DNA, 121 bp, Artificial Sequence
  Synthesized
  misc_feature (61): n=c or g
ctcttgtgtcattattccttcttcttaagatcttttctgtttgctttctgagatgtcatgnagtaatgtgataaacgtgtctgaacgtgccagctgtgagcacttattggaaactctctaa

SEQ ID NO: 21347 - DNA, 121 bp, Artificial Sequence
  Synthesized
  misc_feature (61): n=t or c
gctaggtaattttaattctgttgcaacaccaggcatcgatgaaattaggcagaggggatcngtggtaactcagtcttcccctgacctctaattctggattgaccctcagaaacaatcaaag

SEQ ID NO: 21348 - DNA, 121 bp, Artificial Sequence
  Synthesized
  misc_feature (61): n=a or t
cttagagctaaatagcaggaggaggacccagagggtcagattttacccttctctttggtcnggcatattccacagaggaaggcaaaatgtgagtggtcttacacataaaggctgcaaagag

SEQ ID NO: 21349 - DNA, 121 bp, Artificial Sequence
  Synthesized
  misc_feature (61): n=t or c
gctgtggtcatgggagcgttgctactgaatacccacagagaaatagtcctatgtaatctcnggagctgaaaggaaattatgactgtagcaaataatttcagcctccaaagagggagggaat

SEQ ID NO: 21350 - DNA, 121 bp, Artificial Sequence
  Synthesized
  misc_feature (61): n=a or t
aatgcccatttaacaccatagtatttcttatttatagcacccggcattattaaagagcagncaaacatacggatcctgtcatagagaagtatatgataaaagcattttgattactgtaagg

SEQ ID NO: 21351 - DNA, 121 bp, Artificial Sequence
  Synthesized
  misc_feature (61): n=a or c
gacataccacagaaataggggtgataaaaagaaaacttttgagggacccagagaggactanccagagtatgctgcaagcatagcaaagccaagcccataaagccatgccaaatgcaaagcc

SEQ ID NO: 21352 - DNA, 121 bp, Artificial Sequence
  Synthesized
  misc_feature (61): n=t or c
atcagcccttagcgggaggaggaaaaagcccacccaatggcgtgatgacactgggatactngtggtgcccaagtagctccctgctacttctggggggcccccaacaggctttggacccaat

SEQ ID NO: 21353 - DNA, 121 bp, Artificial Sequence
  Synthesized
  misc_feature (61): n=t or c
aaagaaagaaaatcacaagccttcatgttaaaaacataaaggagagggggatagaactaanacataaaactggattaattagactaagaactcatagccacaactgccaactgtgatgatc

SEQ ID NO: 21354 - DNA, 121 bp, Artificial Sequence
  Synthesized
  misc_feature (61): n=a or g
aaataaaacagttagtggcctcttcagtagttatggcttaccctgcagaaaaatcttgctntatatcagctagcattgttttctgtaaagttataacagcttaaaataagtgcacagatta

SEQ ID NO: 21355 - DNA, 121 bp, Artificial Sequence
  Synthesized
  misc_feature (61): n=a or g
ttcaataagccttttcaataagtgaccagcattgagcaggctgtggttgctgcttgaagcnactcttagtgaatgctgcttgtaaggaggggagaacttggcaagggatgctcagaccttt

SEQ ID NO: 21356 - DNA, 121 bp, Artificial Sequence
  Synthesized
  misc_feature (61): n=t or c
acagacttctaaaaagcaaatccctcagcactgggcagaggaagcagtcctctggtacgangtggaataaaacagcagcacacctgcctccagctgctctcctgccatgcagatctcacgc

SEQ ID NO: 21357 - DNA, 121 bp, Artificial Sequence
  Synthesized
  misc_feature (61): n=a or g
gtctggaaagctccatcagactaactgtagaccagctacagctagaaaacagattgcaaanaaacataacgcaaatgagattgttttacaatgaaatagcatagacatctgtagctcagct

SEQ ID NO: 21358 - DNA, 121 bp, Artificial Sequence
  Synthesized
  misc_feature (61): n=c or g
aacttgtataaagtcatgcttcactgatagagctcagggattagagaatgaaaggaaaganctcagggccaaaactttccatagggagcctcaggaaacaccactaggacttcagaaagga

SEQ ID NO: 21359 - DNA, 121 bp, Artificial Sequence
  Synthesized
  misc_feature (61): n=a or t
ttcctattcattgtttcagaaagggaggaaaactcatttagacagcacgctgaccagcaangtgcccctggagtttaattctttcttgagcttagatctctgtgtgcaagtgagataaaca

SEQ ID NO: 21360 - DNA, 121 bp, Artificial Sequence
  Synthesized
  misc_feature (61): n=a or g
ccacgggtagcatgcaggaatgtgggttggagttgttccctgtcctcctgcattttgttcntatgcttccattgcatggggcaagatcttgcgtccacaagcagcaccagcctctggctcc

SEQ ID NO: 21361 - DNA, 121 bp, Artificial Sequence
  Synthesized
  misc_feature (61): n=a or c
atttttaacttgttaaattgcaagcttttgaagagtaagaagtaaaagatgagacattttncacagaggcagctgtcctgatgtactcatttacagattatttctaagaaacgttagaaag

SEQ ID NO: 21362 - DNA, 121 bp, Artificial Sequence
  Synthesized
  misc_feature (61): n=a or c
agggaggtacctcagcagcatgcctccttccacaccctcatgcagtgttccatcctccaanacaccttctccacctcatccatctccgctcttttaatctcgactcaccaaccgagtccct

SEQ ID NO: 21363 - DNA, 121 bp, Artificial Sequence
  Synthesized
  misc_feature (61): n=a or g
atctgctggggagtatttaagcattgcagagtataaaagactgattcttagaaactgccanaaaataacgtgaaagagaaagaaaatccctttaaaatatgctaaacaaatcaagcaaggg

SEQ ID NO: 21364 - DNA, 121 bp, Artificial Sequence
  Synthesized
  misc_feature (61): n=a or c
aaatgtctgccatatttagcactatgaaacagacagaatatttggcaatatctaaaatcanttgtcaatttattaattatgttatcagcagccacacttacccacttatctgaaactgggg

SEQ ID NO: 21365 - DNA, 121 bp, Artificial Sequence
  Synthesized
  misc_feature (61): n=a or g
ttaactgtagcttttcgaaacatccagcatcaaatagacaagcagcctcaggggtttcagnatgagtatttgaatgtgtgataaggttgcaaattatctgtaaacattgcctcaactttca

SEQ ID NO: 21366 - DNA, 121 bp, Artificial Sequence
  Synthesized
  misc_feature (61): n=a or g
tcaagcaggtcaaaattagaacatgcggtgttgggacaggggttggtttcctcgtttccantgatgacgttctgctgttgtttaatgctgagagctgatgtgatttacaacagattgtgga

SEQ ID NO: 21367 - DNA, 121 bp, Artificial Sequence
  Synthesized
  misc_feature (61): n=c or g
ccagcgtcatgtctgtctgctgctgttaatactttgggggtgctaatcttgcattctcaanctgtatgttcacaccagattgctggaggagatcactttctttctttacttagaattttca

SEQ ID NO: 21368 - DNA, 121 bp, Artificial Sequence
  Synthesized
  misc_feature (61): n=t or g
acgtggttgtagctggcctgctcagccgtgaatgctgagcagaactgggtgagagagaaangtcgagaggtaaaggtcttaagttgcaccaggggaggttgaggttgggtattaggagaaa

SEQ ID NO: 21369 - DNA, 121 bp, Artificial Sequence
  Synthesized
  misc_feature (61): n=t or c
tgtagtttctggaaaatggtgtctctatgaacttttcaaacacaaggtttatgtttttcanatgactggtgttccagtgataagtacagcaggtctaattgtttttctgttctgtcagtgc

SEQ ID NO: 21370 - DNA, 121 bp, Artificial Sequence
  Synthesized
  misc_feature (61): n=a or g
ctagcaaggctgtaatcctcaggtctgttttgcagattgcaaggcctggctgcatgcttgncctagagatgtcagtgtagcagaagtcagctgtgttactagagtgatttactactatggt

SEQ ID NO: 21371 - DNA, 121 bp, Artificial Sequence
  Synthesized
  misc_feature (61): n=t or c
ttgaccaatttgatctaaaacatggctgatatttctagcaaaatgtcttctagcacatagnaccaggactgcgaccaacattcttgcttacacacatgtcctattggatgtctcccctgcc

SEQ ID NO: 21372 - DNA, 121 bp, Artificial Sequence
  Synthesized
  misc_feature (61): n=a or c
gccacatggattgcaaactctagctaagcctccagcatatggtttgagaaaattaactacntaacttgcgcatgctaagaaatgaagcagaagcttaaactcttttttcctatttctcatg

SEQ ID NO: 21373 - DNA, 121 bp, Artificial Sequence
  Synthesized
  misc_feature (61): n=a or g
atctggttaacttccttttgattggctgaaacactgcgaagctttaagtaactgagaatancatcctacaggaaaaagagttacgttacttaaaaaaattatacctgctctaccagtagta

SEQ ID NO: 21374 - DNA, 121 bp, Artificial Sequence
  Synthesized
  misc_feature (61): n=a or c
atgagggagcaagggacaaataactcccactcatccttaagagcagatcattactgaaatnctagagacacaatgaatagcaagtaggggtcaatatgcaattgtactcttaatagagctt

SEQ ID NO: 21375 - DNA, 121 bp, Artificial Sequence
  Synthesized
  misc_feature (61): n=a or g
gatctgcgcccctgtgctgaggtttgttctaatagtgaatcgatcgtgcatggggtaaaancagggagaaattgtacccactttctggtttcagcaggtctggcttctgcttccagctttt

SEQ ID NO: 21376 - DNA, 121 bp, Artificial Sequence
  Synthesized
  misc_feature (61): n=a or g
gcagtgaattctctgtctttggcctttacttggaccaaagaaacgcactgaatcatgcccncaggtgattcagaagtcactgctttcagctatgaagtggtagagttgtcaatttaaaatg

SEQ ID NO: 21377 - DNA, 121 bp, Artificial Sequence
  Synthesized
  misc_feature (61): n=a or g
gacatttatattgtttctttcctcgctctgtggtttattttgcagagagcaagtttccccntgcacagtccttggctgaccccactctgcagtgggtgagcatcccgttgtttttagcccc

SEQ ID NO: 21378 - DNA, 121 bp, Artificial Sequence
  Synthesized
  misc_feature (61): n=c or g
ctaaagacaagcattagtcttttgtcagcacaagccctgccatgctctaatctgagctgtnaatgggaaaacacagtcatggttgtatgcaaataaaattcaagaacattggcatggagtc

SEQ ID NO: 21379 - DNA, 121 bp, Artificial Sequence
  Synthesized
  misc_feature (61): n=a or g
gccacgttggctcggactgctgagccctgtagcattgctgctgtgagtgctgccttcatgngttaccgctctgaacccctccagaacaaaagtggaatggatgaagcctacattgcttctt

SEQ ID NO: 21380 - DNA, 121 bp, Artificial Sequence
  Synthesized
  misc_feature (61): n=t or c
agatggtagaatcagatatggtgagatcttggaaattagaagattataaaaaatgggaggnaataggatgatttaggttaaggtaacactcaaagtggacactgatgagaaagaactgcat

SEQ ID NO: 21381 - DNA, 121 bp, Artificial Sequence
  Synthesized
  misc_feature (61): n=a or g
gtgtatgcgagtcagtgggaacagtcacagaaaatttccatatactatccttttcacatanttattgtcatacatttcttccttattcttccttgctgaaaaatcaagtaaatatttaggc

SEQ ID NO: 21382 - DNA, 121 bp, Artificial Sequence
  Synthesized
  misc_feature (61): n=t or c
tccaaaacaggcatcaaatcaaatcagcactcatacaagtaatgtatttccaggtctaganatcatcattaaaaccttagtatgagactgtctcaactttgtcagaatcttgagctccagc

SEQ ID NO: 21383 - DNA, 121 bp, Artificial Sequence
  Synthesized
  misc_feature (61): n=a or g
atgcagacaagccaaacaaaattgtactcagtatctgtgatcagtaacatttgccttgagntatgtcttgttatattaacttgtatgacctgttccttcacctgttctgaaataagagaat

SEQ ID NO: 21384 - DNA, 121 bp, Artificial Sequence
  Synthesized
  misc_feature (61): n=t or c
gcacatggagggctgtccaaaactggagcctgcagtagaacacaacactggagttttcacntccaagctcctgagagttcgtgtcactgtttgtaaaaaaaacctggaaataatcattgct

SEQ ID NO: 21385 - DNA, 121 bp, Artificial Sequence
  Synthesized
  misc_feature (61): n=c or g
ctatggacaactgtaaagtatacagcttggatttgtcactataattatatacacgtatgtntgttttaggtagtgtcatcaggctgttcagtacttttttctggcaaatctgttgcaacca

SEQ ID NO: 21386 - DNA, 121 bp, Artificial Sequence
  Synthesized
  misc_feature (61): n=a or g
ccattcatagtttttcaacagcagtacaaaataacaatactcagtagtttggggctgttcnttttcaactcccatgcaaaatcacaagaccctctcagcttaatctgtgaattattaagtg

SEQ ID NO: 21387 - DNA, 121 bp, Artificial Sequence
  Synthesized
  misc_feature (61): n=t or g
aacaagggaaattaatacgcttcacttcaactttacagggaaaattgtggcaacatatttnaatctattatttactcactaatatccaaaagccacttttttcatacctgctttcttaagg

SEQ ID NO: 21388 - DNA, 121 bp, Artificial Sequence
  Synthesized
  misc_feature (61): n=t or c
gagtgtgggaggtggacattttgtaaacacaccatgatatgtgcctgcattcctcactccnctgacagctgcctcatacttaggtcttctttctggaaattgcatatcattgcatgtcagg

SEQ ID NO: 21389 - DNA, 121 bp, Artificial Sequence
  Synthesized
  misc_feature (61): n=t or c
tccctttggccctaaatcagggacatgagagcagatgactgaaggactatcttgtaaatanatatctttgtgtcttggctcatttttggctcaaattctgacaatataaaaggggtcaagg

SEQ ID NO: 21390 - DNA, 121 bp, Artificial Sequence
  Synthesized
  misc_feature (61): n=t or c
tagtacttttccagtcagttaacaaccattctccagttctatgtaagccactatttcaaanctgtttagtaaacttagggaacactttaaaatattgcttatttctgtgtccagtgcacag

SEQ ID NO: 21391 - DNA, 121 bp, Artificial Sequence
  Synthesized
  misc_feature (61): n=a or g
ctcttcataaagccttctccattcattgtttcagagccacaaactgcttcgtgtgtgcacntttgagaggccagaactagtgcttgcattcagccgttcaagtatccaaccttgttctttg

SEQ ID NO: 21392 - DNA, 121 bp, Artificial Sequence
  Synthesized
  misc_feature (61): n=a or t
tcatgtatattttggtttatgcttgacacagttgatacactgttgatacgtggttcttgtntaacattatttgccatacatattcattttcttgcataaagaattgcagtatttatttctt

SEQ ID NO: 21393 - DNA, 121 bp, Artificial Sequence
  Synthesized
  misc_feature (61): n=t or c
accctcctgtgcccccatgttccatagaccacatccaggttcaccccaacacgatgcagtnggtgagacagcaaagggaagcacggagacagccagccaaacattccgatccatttatcaa

SEQ ID NO: 21394 - DNA, 121 bp, Artificial Sequence
  Synthesized
  misc_feature (61): n=t or c
ctgaagcgaggagtgagcatctgacagaaaaattaagctgttcaaaaacaaaccctttggnttccagacaaacaacatggaaggtgaaggcagtgagcacactgagtagcaggagtgctcc

SEQ ID NO: 21395 - DNA, 121 bp, Artificial Sequence
  Synthesized
  misc_feature (61): n=a or g
aagcacattggtctgcttcgagtgcccaggcaccagtttggcacctgatacatcactgccnctgttctaccaaagaatgtgtaggcacaatggctgtggcacagaaatggttatacttgag

SEQ ID NO: 21396 - DNA, 121 bp, Artificial Sequence
  Synthesized
  misc_feature (61): n=t or c
aactgtaataaaatgatttgccaaggtcaaatactttgttataatactacttgaaatattnctgaaatacctcagtgaaattgtgtgcaagtctaaaataacttcactcctatagtgaaag

SEQ ID NO: 21397 - DNA, 121 bp, Artificial Sequence
  Synthesized
  misc_feature (61): n=t or c
aatcaagagtgaactgttttgtgacacaaatgtattgctgtagccttggttatctgtttangtcgtaatgccatagaaacatgtggcacttggcgaaggctgtaattggcagggctccacc

SEQ ID NO: 21398 - DNA, 121 bp, Artificial Sequence
  Synthesized
  misc_feature (61): n=a or t
catcgctttcatagaaacagtcaaaatgccattatttttgtcccaccaatagcaaactctntttttggtttctttcatttttgctctaagaactaaatggcagagtatgtttaactgagca

SEQ ID NO: 21399 - DNA, 121 bp, Artificial Sequence
  Synthesized
  misc_feature (61): n=a or g
aaaaaccatggagctcacataacccaggaactcaagggaggcaaacggagcctggaagatngccctgagaaattcccctataaacatgacagccttacagtaaaaacacaactgtgactcc

SEQ ID NO: 21400 - DNA, 121 bp, Artificial Sequence
  Synthesized
  misc_feature (61): n=a or g
aaaccacagctggccagctgtgctgccagtggtcccggggtgcagtggttttacagctttntgagcatccagtgtgaaattcagacaaacctgagtgatgaaagagctctgcacgcggtga

SEQ ID NO: 21401 - DNA, 121 bp, Artificial Sequence
  Synthesized
  misc_feature (61): n=t or c
gaagtggaaagttcattttttgaatgtatgacagtcctctaaccaacagcagtggaagtantgagttgtatttgatgtcatcttagtgataaataaaaatgcttgatggaaagaagcaagt

SEQ ID NO: 21402 - DNA, 121 bp, Artificial Sequence
  Synthesized
  misc_feature (61): n=t or c
agttaaggcagctccggtagtttcttagaattaagcattaggtcttctttaaactatctanctccaggtgtgtttgtatgtctgtttaaaccaaagaaaatccaacacacgaagtaatgct

SEQ ID NO: 21403 - DNA, 121 bp, Artificial Sequence
  Synthesized
  misc_feature (61): n=t or c
attagctttctacttgaaaagaaaaaaaaaatcttgaatatttgcaaaactaacacattcncagtggcacaagaagctgttatgagctgagatccacatgcgcgcatcaaagcatgcatca

SEQ ID NO: 21404 - DNA, 121 bp, Artificial Sequence
  Synthesized
  misc_feature (61): n=t or c
gtgcctggaaaaagtcaacttgtgttgttatttttcttggccagatatcttctgctgtttnatacaacagccctgcaggcgtcaagcaacgctgaggtgtctcctggtgcctgcaaactgc

SEQ ID NO: 21405 - DNA, 121 bp, Artificial Sequence
  Synthesized
  misc_feature (61): n=t or c
ccaaagaatggatttagtgaagttttggtttacgtcctaaatgtcatccatatttaacaangagcaccaattctggcaataaaaagactagttaatgagttataacatactcaacacagac

SEQ ID NO: 21406 - DNA, 121 bp, Artificial Sequence
  Synthesized
  misc_feature (61): n=t or c
ttcctgtaatgttacaagcaagttgatatttaggcaactctccaagtagaattttctatcnttagtgctttcaaagcattaaagaaatggttggaagggaaatgctctgttaaatgaactg

SEQ ID NO: 21407 - DNA, 121 bp, Artificial Sequence
  Synthesized
  misc_feature (61): n=t or c
tgccagtggccccagtgtggcactgaaccaatctgtacctgagagtgcaccttcagcctcnccgcaaggagcaaaccattgaatgtggaagtcagttcccagaaatccagctgagttgcct

SEQ ID NO: 21408 - DNA, 121 bp, Artificial Sequence
  Synthesized
  misc_feature (61): n=a or c
acatcctcggggaggttgttccagtcattgactgttttcactctgaaaaatttcattctgntatcaaggtgaagcctctcctggtgcatcttgaatccaatgccccttgtcttctctgtgt

SEQ ID NO: 21409 - DNA, 121 bp, Artificial Sequence
  Synthesized
  misc_feature (61): n=t or c
atctcttttcaagttttgctcatctttcaattaggcatgtgttagtcggcatgcagcagangagccacgtgcctgcagaacgctcagggcagtgtcacagcttggggtgatgtcacagcat

SEQ ID NO: 21410 - DNA, 121 bp, Artificial Sequence
  Synthesized
  misc_feature (61): n=a or g
tgaaggagcattgcaaattctacttcaaaaatttaagtgcaagtaataatctttttccccncttagttattgctgtaaatctgtaacattcaagactttcacttcttcagtggaaaattct

SEQ ID NO: 21411 - DNA, 121 bp, Artificial Sequence
  Synthesized
  misc_feature (61): n=t or c
tataaattgaagtctgctggaaacgagctgagtgattaaagaaacctagcttggaagaagngtaggagttgtctagtgttacttgaatttaagatgccagttttagggcaagttatcttac

SEQ ID NO: 21412 - DNA, 121 bp, Artificial Sequence
  Synthesized
  misc_feature (61): n=a or g
acagagcagcaccgcagaaacaaaacccaggcatttcctccatgtatgtactgaaatcttntgtgcaagagccaaagcctaacatgatattagcttctgagccttaataaatctcttttca

SEQ ID NO: 21413 - DNA, 121 bp, Artificial Sequence
  Synthesized
  misc_feature (61): n=c or g
gtctagttcctccccgcttgtcaactagtggcaagtttcttggactggcatggctctgcantaccactgtgatgataaaagtcatcagcagtaatataaaccacagaaacattgcctttga

SEQ ID NO: 21414 - DNA, 121 bp, Artificial Sequence
  Synthesized
  misc_feature (61): n=a or c
ccgaggaaagctctgtgaacgagaaagagcgagtatttccagtcactctaacgacgcactntacctctctgggctatccagggacgcctccccataccccacgcagccctctgcataacag

SEQ ID NO: 21415 - DNA, 121 bp, Artificial Sequence
  Synthesized
  misc_feature (61): n=t or c
ctagagtaatgtgagtgagaatgcttttcctcctaatcacatctttggggacagcctgtgngtgccctgaaaggtgtcacctctgattttatggtaataaacagacttctgtttacctgaa

SEQ ID NO: 21416 - DNA, 121 bp, Artificial Sequence
  Synthesized
  misc_feature (61): n=t or c
gaatcaacctttattcacaaggttggcaagagtccctgggctgaagcaagaaataaccaanaggcctcttctgtccacagttctgctcacaggctgagcatctcagattactaggaaagaa

SEQ ID NO: 21417 - DNA, 121 bp, Artificial Sequence
  Synthesized
  misc_feature (61): n=t or c
tatgaacagagcagcaattttcatattttcagaagctaccagaatgtataggcttactagngcaaaaatgatacagaaaaacatttccaaagctcatgtcgatgccagtccaagttaatta

SEQ ID NO: 21418 - DNA, 121 bp, Artificial Sequence
  Synthesized
  misc_feature (61): n=a or g
tgagcatggatttcccaaggcttgggacgtccttccccttcaaccacaatggaaaagctcngccaagtcagggtatcattagaatcacagaatggtttgggttggaagggaccctggaagg

SEQ ID NO: 21419 - DNA, 121 bp, Artificial Sequence
  Synthesized
  misc_feature (61): n=a or g
ggggtaacccgagtgcaaagacatggggatgggcaaattctgtgtggcactgcagtcctgngaggggaaggatgttcttgtggagttacagtggccatttgaagttaattaatagacctta

SEQ ID NO: 21420 - DNA, 121 bp, Artificial Sequence
  Synthesized
  misc_feature (61): n=t or c
agttctccttagaatcatttatcacaggagggaccaacattgcctatacacatgcacacangagcaccttcactcgcatacccacactgggtacacctgctgcctgttccatttccagact

SEQ ID NO: 21421 - DNA, 121 bp, Artificial Sequence
  Synthesized
  misc_feature (61): n=c or g
tagcaatttgagctgtacaaaatgtttaactatttgtacagccagaaagtaagcactgctntcttctcacttctttccttcaatgcagactattccattaagtggcttcaataacatgccg

SEQ ID NO: 21422 - DNA, 121 bp, Artificial Sequence
  Synthesized
  misc_feature (61): n=t or c
atcagttcataacaactcctctctgctgtttcttcctcctcacgctttcctctgctccagngtcagtctctttatgggctgcccaggaacctctgttctggcactgggagcatctcctccc

SEQ ID NO: 21423 - DNA, 121 bp, Artificial Sequence
  Synthesized
  misc_feature (61): n=t or c
ctgctgtctgaccgtgccaggccatccctctcgacccttcttctgtctttctgaagctgantctcagtagtatatgtctgattagccccagaagtgatcagctgtctggatcgcatctgag

SEQ ID NO: 21424 - DNA, 121 bp, Artificial Sequence
  Synthesized
  misc_feature (61): n=a or g
tttgtattctgtggcctaactggtccaaataaagtctctgaggttaatgttagtgctaacncagtggcagacagctctcttatctatattgtttatttcttatttatacctttaagttttc

SEQ ID NO: 21425 - DNA, 121 bp, Artificial Sequence
  Synthesized
  misc_feature (61): n=t or c
gtaaggaagtcacagcaaaagctctatgctactagacccaacgaaggactcagaacctganctttgggtttactgtcccaaaaacagatacctggaggagtgccaaggcttcctgtaaagt

SEQ ID NO: 21426 - DNA, 121 bp, Artificial Sequence
  Synthesized
  misc_feature (61): n=t or c
agatgcatgtctcctgtctccccgtgggggattccctgctgttgggtctccagtggtgganatgagttggtgttgctggcctaaccctgcagcatcagtgccagccaaccaagatggcagc

SEQ ID NO: 21427 - DNA, 121 bp, Artificial Sequence
  Synthesized
  misc_feature (61): n=t or c
ttgtgcctgggagtcacatgagaaggcagaatatattctctaggcaataaaagaaagcctnggacataaacacagatttgaactgctcatttccaggattttaaagacttccctatcttgc

SEQ ID NO: 21428 - DNA, 121 bp, Artificial Sequence
  Synthesized
  misc_feature (61): n=a or g
taaaaatcacatctcaaatgtgaaaacttcttacaagaacagcataagacgtagctgaacntgagcagaatgaacaggtagctgagatccatgtctgccttaaagatcactaattagagct

SEQ ID NO: 21429 - DNA, 121 bp, Artificial Sequence
  Synthesized
  misc_feature (61): n=c or g
agacaaaaagagaaaacaatatattttcctttgcctgatacagccttaggaatcatcctantctgctggctgcaaacaacaaagatcaatagctgagctgtcagggctgcacaagtacagc

SEQ ID NO: 21430 - DNA, 121 bp, Artificial Sequence
  Synthesized
  misc_feature (61): n=a or t
gagaagcatagaaggaaaaaaagactggcactaatctgagcaacacgcatcagtacagatnaatgaagaagctcacaaacctgcaaatagaaactcggtacctgttcccatgaaggaacac

SEQ ID NO: 21431 - DNA, 121 bp, Artificial Sequence
  Synthesized
  misc_feature (61): n=t or c
gacaagttgggaactgagcacgaacctcattcagaaaagaggctaaagcaaattttgttanattacagtaaatgaagggcatggcatgtgaagtagagttttaagaggctcggttctttaa

SEQ ID NO: 21432 - DNA, 121 bp, Artificial Sequence
  Synthesized
  misc_feature (61): n=t or c
tgactctgagctagctgtttaaatctagctaagattttgatgccagaacagcagtcacagntatggcttgaagtgtagatgtactatctaaataaaatttctacactgtatttttgccaca

SEQ ID NO: 21433 - DNA, 121 bp, Artificial Sequence
  Synthesized
  misc_feature (61): n=a or t
gcagcgcttgcctgccatagggctttggagtgaaagatcaaaataaagataaacgtaagcngggaaacaaccacaatggatgaaaggtgaaaaaaagccatgtctgtcacagctggactgt

SEQ ID NO: 21434 - DNA, 121 bp, Artificial Sequence
  Synthesized
  misc_feature (61): n=t or c
ttaggtaagtgataccacatacacggaaataaaacttattacagatgattaggaaattacnatacgcaatggcatctcccttctggagtccagtgcagttcagttatacagataataatga

SEQ ID NO: 21435 - DNA, 121 bp, Artificial Sequence
  Synthesized
  misc_feature (61): n=t or c
agctgctacaatttacacgaaaaaaagatgccatagatttcatataaaatgaatataaaanccttttcctctcttccactgtttcagaggaacttatgaattcagaatttaaaaagactat

SEQ ID NO: 21436 - DNA, 121 bp, Artificial Sequence
  Synthesized
  misc_feature (61): n=a or g
tccttactcaacagaatacggaggtgtgaatgtaacagtccttggtttgtgtctatctccnttcatctctaatgtgttaactgaattcctgtatcatttaaattttatacactttcttttg

SEQ ID NO: 21437 - DNA, 121 bp, Artificial Sequence
  Synthesized
  misc_feature (61): n=t or c
ctctagagggcaaaatgttatgaaaataaaaagatgcatcagaaggtaatcagaatagcantgggaggaaattaggactgcagagttgtacgaggaaaatttatccatagaaaggctgatg

SEQ ID NO: 21438 - DNA, 121 bp, Artificial Sequence
  Synthesized
  misc_feature (61): n=a or t
agtggccaggcaagcaggctgctgcccaacagctcacatgaaatctgcctgtcagcatccncagaaggactctgatttgtgtttttttcccctctattcagggcaagctttgcaaaaagga

SEQ ID NO: 21439 - DNA, 121 bp, Artificial Sequence
  Synthesized
  misc_feature (61): n=t or c
acacctcgaggaaacagcgggcaccgctgggagtctcctgcttaagtatcaccacttcttntcaagtacttttttttattccttaaccttcaccacacacatactcttcacttgatgtccc

SEQ ID NO: 21440 - DNA, 121 bp, Artificial Sequence
  Synthesized
  misc_feature (61): n=t or c
caataatttataaatatattttagaatacatttttttgtatagatactccatcagactgtnggtaaagttgtggtcataatttaactggatttgtgattaacagtggaagcactactttgg

SEQ ID NO: 21441 - DNA, 121 bp, Artificial Sequence
  Synthesized
  misc_feature (61): n=t or c
tagctactaaactttacattacgcaataccaaaaagatacatctctatggagtttgtagtnagagttgcttgggagtatgcagcagtacaaggttcagagcctagagcagatctttaagtg

SEQ ID NO: 21442 - DNA, 121 bp, Artificial Sequence
  Synthesized
  misc_feature (61): n=t or c
ctacctctgccctcagcataggttttcctttcttattaatgttgcatacagtgctgcacangtgcagtgtagtgagctacaggctggaaaggataagccctggtacacactgcagcatttt

SEQ ID NO: 21443 - DNA, 121 bp, Artificial Sequence
  Synthesized
  misc_feature (61): n=t or c
caacaagatattgatatttgaggtcttcccttggagaaccataaacaggtgtaaaatacangcgaatcatacatttcagtgggccacaatttgctgggtagaatgaactggccttaagtaa

SEQ ID NO: 21444 - DNA, 121 bp, Artificial Sequence
  Synthesized
  misc_feature (61): n=t or c
cctcccacatcaaaaggagcagctttgccccttctgagcctgccgtcctctagatctctcngctggccctcgctttccatagggccacttctcgcctcactcctcccccttcttttgggtt

SEQ ID NO: 21445 - DNA, 121 bp, Artificial Sequence
  Synthesized
  misc_feature (61): n=c or g
aggcacttaaacagatggcaaagtgttccagcagcactcaggctgggacctctttgaaaanccctggtcagaggttaccgatccctgggagcgttcaaccaaggagtgctgcacctttggt

SEQ ID NO: 21446 - DNA, 121 bp, Artificial Sequence
  Synthesized
  misc_feature (61): n=t or c
caaactgtgcatgtaggaaattgacggtaacaccgcaggtcttgtatactaacagtacggngcttttcacatgttaagaggaattctggtagacgtcctccaactagtttgtatgttttca

SEQ ID NO: 21447 - DNA, 121 bp, Artificial Sequence
  Synthesized
  misc_feature (61): n=a or g
tttataaatgagcagctggtacagttttcttctctgttcgaatacatggattttttgagtntggtttcctcttagcagaagtaataattgtagcctttgcaaccacatatcaaacttaaac

SEQ ID NO: 21448 - DNA, 121 bp, Artificial Sequence
  Synthesized
  misc_feature (61): n=a or c
tcaaaaacttaagtgctatttacaaaaagtttggtctgtctctttgctccttcctgtgaangcactctgggcatcctggaactgattcctaccttttacaaggccagataaaggcttgcaa

SEQ ID NO: 21449 - DNA, 121 bp, Artificial Sequence
  Synthesized
  misc_feature (61): n=c or g
gaagcccacctacatagcttgctgggtacaatcctcaacaaacaaacctcacagttacctntgaccaggaacctggcctttcaacctaaggttgaaagatttttcatctactcaagagccg

SEQ ID NO: 21450 - DNA, 121 bp, Artificial Sequence
  Synthesized
  misc_feature (61): n=a or g
gtgagcctaagacactgaatatttcaggtgacaccaattttctgtttgcatctggggtaantcagcttgattccagagaaaacaaaaaagcaatggcaagtccttctagctgagaatccgg

SEQ ID NO: 21451 - DNA, 121 bp, Artificial Sequence
  Synthesized
  misc_feature (61): n=c or g
ccaaaatacctaccagtcacactgagatcaacttatctaagttaacactagtaagcaaagnctcatttcaatcaggttgcactatgaactgaacattatacaccgtgcattacagactttt

SEQ ID NO: 21452 - DNA, 121 bp, Artificial Sequence
  Synthesized
  misc_feature (61): n=a or g
aggcaacatcaggcgaagtgaagagaccagagcttcaacagacaaagcacttggaaccctncatcctagcacttgtgaagatttctctcctctccatttcatctattccagattcaacaca

SEQ ID NO: 21453 - DNA, 121 bp, Artificial Sequence
  Synthesized
  misc_feature (61): n=t or c
atttcctgcaaatcagaggagctgacagccctcctctggaacattacaactgccgctcccnggggtgcctgcgtgcagcgagaggcggcgatgagatccaatggatgctgctgcacgctgc

SEQ ID NO: 21454 - DNA, 121 bp, Artificial Sequence
  Synthesized
  misc_feature (61): n=t or g
cactcagagggagggaaacagaggctagcttttaaatgctgtgcagaaaatgacacatctncagcttcagcctcttaattgtaggaatgaaaaacaagcttactgagcaaaaaacagtgag

SEQ ID NO: 21455 - DNA, 121 bp, Artificial Sequence
  Synthesized
  misc_feature (61): n=t or g
tagggacttctgctgagtggaaatgtaacactggaaacaaatccttcacaacctttccctnttgtacccagatgtagcaaaacatggttacaaggaagacaaagttagaaaccagaaattt

SEQ ID NO: 21456 - DNA, 121 bp, Artificial Sequence
  Synthesized
  misc_feature (61): n=t or c
tgataccatgcaccctaccagggttccagcatcattacactggtttactgcagcatgttcnatcagaactgggttagatctggacgctgcttggtgatggcaagctcacagggcttcctat

SEQ ID NO: 21457 - DNA, 121 bp, Artificial Sequence
  Synthesized
  misc_feature (61): n=t or c
aagttctgtgcttagaaatcagtttaagcaccatgtctgatctaaagctgtgaatgcagantgtaaacagaagtccattgctggatcccttttttctatcagaatttctttgctgtcctca

SEQ ID NO: 21458 - DNA, 121 bp, Artificial Sequence
  Synthesized
  misc_feature (61): n=a or g
aagctgtgatgtatgatgctggtcacaacatgaaaccaatccaaatacccagtggtatacntgccagtttgttacagtgtaaactgctatgcgttttctcaagcgtctgtatgtttgcatt

SEQ ID NO: 21459 - DNA, 121 bp, Artificial Sequence
  Synthesized
  misc_feature (61): n=c or g
ctaagcttccctaccccatgtcacacagggaacattgcacacaactctgatctgaatgganagtatgtgtctaatgaggtgatctcaaatgactgtttttcatggtctgtgaggttttacc

SEQ ID NO: 21460 - DNA, 121 bp, Artificial Sequence
  Synthesized
  misc_feature (61): n=a or c
aaaagaaatgctgcaggagctctgctgcctgcccagagcacactttcttccttcttcttcnagaagtatcacaagcatacatccaccaatacattttgcacaagctatagaggaaaaaaag

SEQ ID NO: 21461 - DNA, 121 bp, Artificial Sequence
  Synthesized
  misc_feature (61): n=a or c
ccgtgggattcgccttattgcaatttttaaagtagcccacagctctttttgatatctgatnatattttcttcccaaattcaagcttttatgcttctccaaaatatatctaaaatacatcta

SEQ ID NO: 21462 - DNA, 121 bp, Artificial Sequence
  Synthesized
  misc_feature (61): n=t or c
ctgtcctgcatgtggggaggaagtggaccttgcatcttttattgaggcaatcattatcttnttatagactctgaaggggaaagaatgaaacattcaccttctggcaggaagtacactgtgc

SEQ ID NO: 21463 - DNA, 121 bp, Artificial Sequence
  Synthesized
  misc_feature (61): n=a or g
gaaataaatgggctgttgatagaatgctgacagataatgaaacaaatctgaattaggcctnactacatgaaagctgtagagtccctcagatttaatcgttccccccccccccctttttttt

SEQ ID NO: 21464 - DNA, 121 bp, Artificial Sequence
  Synthesized
  misc_feature (61): n=t or c
aacttcaggtcagtaaaaacagcaggaaggaaggagcagtcaacctaagctgacccagctnaccagctcagtgctctggagagtctgcaggagtgaccccagtgaatgcctctcccaacat

SEQ ID NO: 21465 - DNA, 121 bp, Artificial Sequence
  Synthesized
  misc_feature (61): n=t or c
aacaacctaaaagcctagtacatccccatggctaaatttcagtttaagagccctggaccangtacacactcaaggagctggaatcattcaagctggtccctggtaccatatgagtaaacat

SEQ ID NO: 21466 - DNA, 121 bp, Artificial Sequence
  Synthesized
  misc_feature (61): n=t or c
atagacaaattgaagaataattatgagatatgcatgtgcctagtttctaaaaatgcaagcngcactacttctctaaatatatgaaaaacttttatggaagcatctaaaccactagactttg

SEQ ID NO: 21467 - DNA, 121 bp, Artificial Sequence
  Synthesized
  misc_feature (61): n=a or g
ttcaattccagcatcccatccattaacctgaccagctgcaagtacgagagcggtaagtccnaggatgtggccctttggatcgagcccacccacagcaagccatgcaggtggctgttcagcc

SEQ ID NO: 21468 - DNA, 121 bp, Artificial Sequence
  Synthesized
  misc_feature (61): n=t or c
gcaggtgctgcaggagagaagggtgtttgggaagcgccagggcctgtaagccggcagcaanacagctccccaaaagttaggctgaccagcaggaaaataatgctcaggcaccagggcctga

SEQ ID NO: 21469 - DNA, 121 bp, Artificial Sequence
  Synthesized
  misc_feature (61): n=t or c
ggccgttcagaccagatttggaccccaactggcatcgatttagccacaaagcaataacttngtacgctaaattgattcctaggaagggttctgctgggattcctctttcctcatagcctag

SEQ ID NO: 21470 - DNA, 121 bp, Artificial Sequence
  Synthesized
  misc_feature (61): n=a or g
atacacggtaccttatcatggctgtggggtggcaaaataaccctgccataaaggggttgcntttcgggaacccaacactgctccaaagcatccttgcctttaggattttcaatacatgtga

SEQ ID NO: 21471 - DNA, 121 bp, Artificial Sequence
  Synthesized
  misc_feature (61): n=t or g
gaacgaaagaaacacagaactctggttttgggtagacaggtggcacttttactaaattcancagagaaggacttgtatgtacagttatggagaccttttttatattgctgactttctctgt

SEQ ID NO: 21472 - DNA, 121 bp, Artificial Sequence
  Synthesized
  misc_feature (61): n=t or g
tcccaggtggaaaatatgatcatgatgtcagtaacataaacatactgattcctacagtttnggggctgtcagactgacacacacataagtgtgatcctttttttgactgacaagcaaagta

SEQ ID NO: 21473 - DNA, 121 bp, Artificial Sequence
  Synthesized
  misc_feature (61): n=t or g
gtattttatgtcataagtgtgcatagtttaagaagaaaagtcgctaataagaaagaaaccnggaagtctgctttcaggagcaacagctcttaaagcagtgttactcctccataggtttctc

SEQ ID NO: 21474 - DNA, 121 bp, Artificial Sequence
  Synthesized
  misc_feature (61): n=t or c
ttcaaaaactgaaattgggctgagttcaccaaagcaatgcctcacagtgttttgcagcaancaacgaggagctcttttcaagtttaggtgaagtaatatatcctgcatctgttctgctagc

SEQ ID NO: 21475 - DNA, 121 bp, Artificial Sequence
  Synthesized
  misc_feature (61): n=t or c
ggacaaaattaccaaagatgcagtctgaggaaccaaagatagaggaataaacttcaaagtnggtgttaaggactgactgttctccttttgtgtgctgtcgtcacttctccatcgtgtgggg

SEQ ID NO: 21476 - DNA, 121 bp, Artificial Sequence
  Synthesized
  misc_feature (61): n=t or c
tagggatgactccacgttggcagcacgctgctggatacacacactggcaacatccaagcanttccttggacacagaaccttcactgtgatacagcaacgggaacatcagagcaggaatgaa

SEQ ID NO: 21477 - DNA, 121 bp, Artificial Sequence
  Synthesized
  misc_feature (61): n=a or c
taaggtcagttagcaagtgtattagctagattacttaaactgtctcagtttggtcattatngttagatttggggtagatgaaactaaatatgaatctacatagggtttttgtatatagaga

SEQ ID NO: 21478 - DNA, 121 bp, Artificial Sequence
  Synthesized
  misc_feature (61): n=a or g
caagttttatagaaataaatttggattttagctgcgctgttgcttaccgtcttctttaccnttgaaatttttatttgtgactacttggagtaaaaagggtttaggcagtctagatacacat

SEQ ID NO: 21479 - DNA, 121 bp, Artificial Sequence
  Synthesized
  misc_feature (61): n=a or t
atctgaagctcctgacaaaagggatctgtgaagctttgttacacttgtaaatgagtagatnatgagtgtgggcttttagatagcaattttcagggttcaaataaaaagataccacttccta

SEQ ID NO: 21480 - DNA, 121 bp, Artificial Sequence
  Synthesized
  misc_feature (61): n=a or g
taagggctaattacagatctggatggtttccaggagcaaacagcatgggacagtcagggcnctcgcgggctgctgttgcaaaccatgctgtgcatgatgggctctgagcacatcctggtgc

SEQ ID NO: 21481 - DNA, 121 bp, Artificial Sequence
  Synthesized
  misc_feature (61): n=a or g
tacaacatggttggaaaacacacttggaatggcctgcagctcctaactgtgagcaatcctnttccttatactctaataaattaatcagaaacccacattgaaatacagtgattacaagtgt

SEQ ID NO: 21482 - DNA, 121 bp, Artificial Sequence
  Synthesized
  misc_feature (61): n=a or g
ttacaaatgtaagagaaataacatgaaagcagcaaactcctgcagaatctgaaaacaagcncaactggaactacatcatcagcacgtctgtggcaaaacaacaagaggttggtggtagaca

SEQ ID NO: 21483 - DNA, 121 bp, Artificial Sequence
  Synthesized
  misc_feature (61): n=t or c
ctcaatagagatatttattttatgacacgctataacttccttcatcaacctctccacattncacagactataaactacctgtttctttccttctgctgagagagaaccatgttatcatctc

SEQ ID NO: 21484 - DNA, 121 bp, Artificial Sequence
  Synthesized
  misc_feature (61): n=a or g
cacaaagaagcaaactttttaataaaatactgcattattgcttgcaaggttttcctctgcntaatacaaaggttatcactagacaaagcccacattcttaaaatgaaaacagtttcatata

SEQ ID NO: 21485 - DNA, 121 bp, Artificial Sequence
  Synthesized
  misc_feature (61): n=a or g
tgtgatgctgcattcacctttctaccgctaccttctgaggtcagatgaggcagtcttcctnggaggggactcaagcatcaggtgcctgaagtcttctgtcatgcaacattcatctgttgcc

SEQ ID NO: 21486 - DNA, 121 bp, Artificial Sequence
  Synthesized
  misc_feature (61): n=a or g
agacatattagtctctcttatctccgtgcactcgggctggacgaggaactctcagacattntatctcacgtctgtcctgcacagagcgcagcctccctgaggagaaggggagctgctgggt

SEQ ID NO: 21487 - DNA, 121 bp, Artificial Sequence
  Synthesized
  misc_feature (61): n=t or c
gaatcattttctgctatggaaatgcctactcaaagatccatttttagcactatagcaatantgcaggctaactccagagctatttcacagaaaaaatatagctcgactgtgtcaagctgag

SEQ ID NO: 21488 - DNA, 121 bp, Artificial Sequence
  Synthesized
  misc_feature (61): n=t or c
tgatgctgccctttgttcttggttcagttagtttttcttttttgttactttattagatctnggctagagtatcctgacttcaaagaatctcccttgtttgccgtccagacagtctttgtta

SEQ ID NO: 21489 - DNA, 121 bp, Artificial Sequence
  Synthesized
  misc_feature (61): n=t or c
gctgaacttcttacagctgagagcagaattcgtttcccaacacaactctgaaaatcctcangtgagaaggtatttaatacctcggctctaggcaggaatacaattaaaagttaacctagtt

SEQ ID NO: 21490 - DNA, 121 bp, Artificial Sequence
  Synthesized
  misc_feature (61): n=t or c
atcttggcagataccttttatcactgaaacagcactactatatctccaatttcatgacttntgtccatttcaaggccaaaactgagaatgtctatgtaatgaataacctctactaagaagt

SEQ ID NO: 21491 - DNA, 121 bp, Artificial Sequence
  Synthesized
  misc_feature (61): n=c or g
gttgttctttatctgaaaagcacaaagacgactgccagagcagggctggtttcaacataancccataaaatagtcccaaagacctgaatcaccagatccttaatacaagtcttagtatata

SEQ ID NO: 21492 - DNA, 121 bp, Artificial Sequence
  Synthesized
  misc_feature (61): n=t or c
ataaaatctccttatgtaatggttaatgctgcaaaaacttatttgtgtccatactgctaangtgcagcacatatccaactgacatcaccatagctgacagtctttctttacaacagaatat

SEQ ID NO: 21493 - DNA, 121 bp, Artificial Sequence
  Synthesized
  misc_feature (61): n=a or g
actacaaggggcagcttgctttggagagctgtccctgaccagggcacaagaggcatttcantggtctgcctggaatcactgcagctggaggcagggagtgcgcatcgtaccgctgccttga

SEQ ID NO: 21494 - DNA, 121 bp, Artificial Sequence
  Synthesized
  misc_feature (61): n=c or g
gagctctgtaaatggagcaatgcctttcagagaagcttgaaaacagctctaaatgtcttanaacagccaggtggtttaaaaataagtctctttgctccattccgcttcagtgaaagtgaaa

SEQ ID NO: 21495 - DNA, 121 bp, Artificial Sequence
  Synthesized
  misc_feature (61): n=a or g
gcccaaaacagggccccagaggcactcacttttgtggggtaatggggaaccagcaaggagntggtaggagatgttgtggagtgcacagaggttgtccgtgtcctggaggatgtgcagggat

SEQ ID NO: 21496 - DNA, 121 bp, Artificial Sequence
  Synthesized
  misc_feature (61): n=a or g
ttgaggtaagaattcacaatggtaagcatgtattctcacacctctgctttagatcttctcnagtaagggggtaaatgtcatgtaggatgtgtcctatgctttgttgtgctgttaaatacca

SEQ ID NO: 21497 - DNA, 121 bp, Artificial Sequence
  Synthesized
  misc_feature (61): n=a or c
tgtttgcaggtttggtcctctggaacataggcgaagtaaataaaatgctgtcacaacaggnattctctgagcatgttttagtttaggagaaatttattattactatgttattattattaga

SEQ ID NO: 21498 - DNA, 121 bp, Artificial Sequence
  Synthesized
  misc_feature (61): n=t or g
tgctttgtgcttgtgaaccggtttttaccgattaccaccgacagaaaactgaaggaagggnggcagggaaagcttcctgctcagctttgcagaattcatgtcatgagtggggtgacttgct

SEQ ID NO: 21499 - DNA, 121 bp, Artificial Sequence
  Synthesized
  misc_feature (61): n=a or g
ctgaactagggaaaaaagagcatccagtagaggcttccaaagattttaagcctagagtacnctatgctcctcatgtatatgtaatacaggccagtgtctccacacacagatatgtgagtga

SEQ ID NO: 21500 - DNA, 121 bp, Artificial Sequence
  Synthesized
  misc_feature (61): n=a or g
ttgtctgaaattcacaccttcttgagacatccatctacttgaaatccttggatttcccttnaaaataaataaaactctatttgtctttccagtagtgggaaaaaagttagacaacatgagt

SEQ ID NO: 21501 - DNA, 121 bp, Artificial Sequence
  Synthesized
  misc_feature (61): n=t or c
agtttcctcaagaactcttcctcaaaataatttctttttccttttaatacctcagacccantttctgagtcgatttcctaagatcctgcaaaggctgttattgaaaccagaccaagtgtac

SEQ ID NO: 21502 - DNA, 121 bp, Artificial Sequence
  Synthesized
  misc_feature (61): n=t or c
tagaaaggcaattaaggatgtggtgtaaatgtaccatgaagcaatgcaaaagatttcattncaatgaacacatgtttatgtttcacttaatgctatcagaagattttttcccccataatcc

SEQ ID NO: 21503 - DNA, 121 bp, Artificial Sequence
  Synthesized
  misc_feature (61): n=a or g
tactggtttgcatcctgttgtctcagcttggtgctttatgtgcacagctggctaatgacantgttgtattatgtataaagccatttactgtgatatgttcatgctgttaatatgctgtgga

SEQ ID NO: 21504 - DNA, 121 bp, Artificial Sequence
  Synthesized
  misc_feature (61): n=t or c
agccacgaaacgtttatgggagattgaggcaaaaccacaggccattcttagtcaggaaatngtcaatactatgaatttcaaagtcttgtaacaaacctcttcggctgaggacaaataaaaa

SEQ ID NO: 21505 - DNA, 121 bp, Artificial Sequence
  Synthesized
  misc_feature (61): n=a or g
ggcccattatccttacagtgacaaattctaagttccttggaatcctcctctgatgcttctntcttcctctcctccccggtgtggcacagcttgatcacaccccacgctccacgctgagctc

SEQ ID NO: 21506 - DNA, 121 bp, Artificial Sequence
  Synthesized
  misc_feature (61): n=t or c
ttagaaatgtcagtttgaaaccacctctatcacaagtgcagtggtatttcagtttggagtnctgttctaacagtccgtttatgactgattgccccggtcaaaacttcagaatggttgagtt

SEQ ID NO: 21507 - DNA, 121 bp, Artificial Sequence
  Synthesized
  misc_feature (61): n=t or c
tgagtgcctaggagatgtaaagtagaagtatcttgaaagtcagggaaattccaggagaatnaggtgaccagattatataatcagacaagagttactatattttgcatagtctgtcagtaaa

SEQ ID NO: 21508 - DNA, 121 bp, Artificial Sequence
  Synthesized
  misc_feature (61): n=a or g
tgagaaaagaggaaaacttttaaagaaactgcagtcattttctctcctgtgtctgaagtgnatgaagaaagccatccaccccaaatggagaggccaaaaatgttcataagacgtctagatc

SEQ ID NO: 21509 - DNA, 121 bp, Artificial Sequence
  Synthesized
  misc_feature (61): n=t or c
ttgtagcaggagctgccttgatccacaacagaatcacaggggtggcaaggagaaccatccnggatttaaccctttatttcatatcctgtctgttgcagggcctgaatttcactctttgact

SEQ ID NO: 21510 - DNA, 121 bp, Artificial Sequence
  Synthesized
  misc_feature (61): n=t or c
ctttttacctgtggggagaaaaaagccaggaacagttatgtaaagatgtaaggaccgatanactgatcttgtaagcaggtaccacccatgtcactcaaatagttgatgtgggaaaacattt

SEQ ID NO: 21511 - DNA, 121 bp, Artificial Sequence
  Synthesized
  misc_feature (61): n=a or g
tggagtcagactcaaagcatacagaaatatatagttcttcacacagcaaattggcaagctntggaactctggtggatactaaaagttttaagtgcaagaaatattaatttgaattaagttc

SEQ ID NO: 21512 - DNA, 121 bp, Artificial Sequence
  Synthesized
  misc_feature (61): n=a or t
taaggacaccagccatctttaaaggaccactggtttctgaagacgtgcttcagtcattcangggatcctcagtttacctgcaatctgtatatagtcaagcagtacaggtcttcagttccta

SEQ ID NO: 21513 - DNA, 121 bp, Artificial Sequence
  Synthesized
  misc_feature (61): n=t or c
tctttgtgacttgcagagttatgattagctctgctgcctgtgaagttggaatagaggctgngttctggcagtttacacaccatcagctctcacttatctgtgggtggtttattcaggttat

SEQ ID NO: 21514 - DNA, 121 bp, Artificial Sequence
  Synthesized
  misc_feature (61): n=a or c
catgtcttacactgaacacaaagaaattacttactcttatcaatgaactgtcctgataacngtagtcacccaaccttctttcaaggaataaattagttagtataatgtttgacaaatgtca

SEQ ID NO: 21515 - DNA, 121 bp, Artificial Sequence
  Synthesized
  misc_feature (61): n=t or c
tccctgagatatgagaagattcatacgaaacgaagggggaaactcaagcaagttctgcagnccatatttccattatcctggctgctctggaaagggtgaatcagggaagaaatcttttttt

SEQ ID NO: 21516 - DNA, 121 bp, Artificial Sequence
  Synthesized
  misc_feature (61): n=a or g
gaaaatgttcaaagaaatgtgttgttatatgaaactacaacaggggagcatgacatgcaangtgcgtgagggagttcttccagtgctcagcattcgtggcgctccagactgagtcctgttc

SEQ ID NO: 21517 - DNA, 121 bp, Artificial Sequence
  Synthesized
  misc_feature (61): n=a or g
agatttgacccttatcctccccatgtagtatttcagtctcctgcgtaatgttataatttcnggactaagcttcccagagtttgggccctttagcaactgtggaaatggcaagggaaactct

SEQ ID NO: 21518 - DNA, 121 bp, Artificial Sequence
  Synthesized
  misc_feature (61): n=a or g
aaggaagattccaaaatctgaattaagaaggagcaagactagagcatttacagcctcatcntatctgtgacaataaagaatgagaaaacaaaatgactctgtaagaatacatgcaggcata

SEQ ID NO: 21519 - DNA, 121 bp, Artificial Sequence
  Synthesized
  misc_feature (61): n=a or g
acagtgaggcactcagcaccttatgcccccattcccctgcaaagttctgtgcagacactcngggacagagcgtttgttcatacaattaatttattgacatgggttcgcaggctggagcttc

SEQ ID NO: 21520 - DNA, 121 bp, Artificial Sequence
  Synthesized
  misc_feature (61): n=t or c
tttacatacgtaaaataattcattaaccttttcataacatgcactgcccccaaactactgncatggtgttgttaacatacatgtcattttaggtcttaaaataatcacatgaaattctctt

SEQ ID NO: 21521 - DNA, 121 bp, Artificial Sequence
  Synthesized
  misc_feature (61): n=a or g
tccttgtttctacctggatgcctgtcacgagcagtgcagctgtcacattgggcattttatngacacattcaatctcctttcctttcttgaagcctgttaagaatgcactgagtttctgatg

SEQ ID NO: 21522 - DNA, 121 bp, Artificial Sequence
  Synthesized
  misc_feature (61): n=c or g
caatacagtcctatgctattaagaatgcctgcacatcacctttgccctcttaaatagaaanacgtccttcaagctttcaaagtactttgcgtcccctgtgtagagtggtaaagagggggaa

SEQ ID NO: 21523 - DNA, 121 bp, Artificial Sequence
  Synthesized
  misc_feature (61): n=t or g
tatactctccagggcaatctcctcctcttcagtccatgtgtataccaagaatgaagaaacngtcttcaggttgttggaaattccctcctatagctgttcttagaatactaaccaagttgtg

SEQ ID NO: 21524 - DNA, 121 bp, Artificial Sequence
  Synthesized
  misc_feature (61): n=a or c
aaatcaaagcaaaatctccaggaaggaacaactgctgttgtcacatgggatttactgattnatctaacataacaatactgggtatctttccttgttgccccagggaaggttactgtgtgat

SEQ ID NO: 21525 - DNA, 121 bp, Artificial Sequence
  Synthesized
  misc_feature (61): n=a or g
aacatacctccttttaaaaaaaaaaaaaaaagtactgatgaggagaaatatgctgcttcantactgttttctattgcttcccttggtcctcagcatagacagaggaaaaaaagaaaggttt

SEQ ID NO: 21526 - DNA, 121 bp, Artificial Sequence
  Synthesized
  misc_feature (61): n=t or c
tgcaggtgaattctactttctctctttttgaaaatgaaaacagaatgtctactaatatttnataggattctatagttgttgtgctgttgttgtggttggctttttttccagaagtaattaa

SEQ ID NO: 21527 - DNA, 121 bp, Artificial Sequence
  Synthesized
  misc_feature (61): n=t or c
tgcttctgttagataattaggatgccttttttttttaaatgactatttataaaaggctttnggatctcaacttgatgttgtgtaagatcaatgctaatagttgtaatctatagcacccaaa

SEQ ID NO: 21528 - DNA, 121 bp, Artificial Sequence
  Synthesized
  misc_feature (61): n=t or c
aatgcaattacatttttacaagtgcaaataagtcacagcatctgctttcactgttagtaangcacagtgtgcatccatgcgtacagtacatcagagagagcagtcaaatgttgacattatg

SEQ ID NO: 21529 - DNA, 121 bp, Artificial Sequence
  Synthesized
  misc_feature (61): n=t or c
atggtctccagtaactggggacatgaagtgctcaaaacaacactcctatttctgcaagctngtcccagaaagaaatgtttatataaagacacacaacaggaaatgcatcacaccacaggat

SEQ ID NO: 21530 - DNA, 121 bp, Artificial Sequence
  Synthesized
  misc_feature (61): n=t or c
catgagcccaacgttgtgtgctccatgcacaacgattctcagaaggggcaggttgcagccngtactctgtgtgtcttttgggccagcatgtgtgcagtatgagagcacgtggaatttccac

SEQ ID NO: 21531 - DNA, 121 bp, Artificial Sequence
  Synthesized
  misc_feature (61): n=a or c
ataaaaaggaaaaggcaaagttcatgctgaagctatatggagtcatagcagcaatacaganaacaagctttaactatcctgctcatttctcagctgttgtgcacaggagtcaccagtgaca

SEQ ID NO: 21532 - DNA, 121 bp, Artificial Sequence
  Synthesized
  misc_feature (61): n=t or c
aacttattctactgaggccctgtgaagattaagcctctgcactagagcaatacagatgagnaattgttataggaaatcctatattaaaatgaattaggttcatgaacaacaggtggtaaaa

SEQ ID NO: 21533 - DNA, 121 bp, Artificial Sequence
  Synthesized
  misc_feature (61): n=a or c
ccacaccggagagaagccgtttcagtgtgatgtgagttgatctatccctttgtcttcttgncttcagtgcaggagcaaggcttatcttcagcgagaatatggccttgcatccattggctgc

SEQ ID NO: 21534 - DNA, 121 bp, Artificial Sequence
  Synthesized
  misc_feature (61): n=t or c
caaagtaaaaaactgaaattggtcttgaagcggtgaagaatgacagctgtccaccatcacnggtggtagaaatgcacaagaaagagacaaaggcctatattctaagtatcatcaagaggtg

SEQ ID NO: 21535 - DNA, 121 bp, Artificial Sequence
  Synthesized
  misc_feature (61): n=t or c
taaaatatggtccaatttgttaatttaagcgagagaagtagtaaatcatgtcaaacattanggcaccatggtactgcttctgagcaaacttggtttcatgcaaaatgaaaaaattcatttc

SEQ ID NO: 21536 - DNA, 121 bp, Artificial Sequence
  Synthesized
  misc_feature (61): n=a or g
gatctcacaggcagattcttacatcacctaagtgaaatcttgctctccagaccattttcanttccaaaagtgaatgtccttctattcaagttgcttaggatctgacccagcagtcctgact

SEQ ID NO: 21537 - DNA, 121 bp, Artificial Sequence
  Synthesized
  misc_feature (61): n=t or c
agcatcctccaggaattgcctgttcagtgactttgtgacgtggagagactgcatctgttcngtgctaattagccccgataagcctatttcctgtaaatgtgtttgacctttctttgaagtc

SEQ ID NO: 21538 - DNA, 121 bp, Artificial Sequence
  Synthesized
  misc_feature (61): n=a or c
ctagcgacagcacaggtgtacacaaagctgcaccaggaatgaggggatcaaaaccacctanatgagctttatgagcatttctgagttatttgcattcttctccggaccccttttttttttg

SEQ ID NO: 21539 - DNA, 121 bp, Artificial Sequence
  Synthesized
  misc_feature (61): n=c or g
aaccaacccatcacaccagtaccacatcctacatctcacagcagttggtatccatgcatanagattagtaccacaatatatctcatgttcagaacaaagagcaatttgtgcatcagttgaa

SEQ ID NO: 21540 - DNA, 121 bp, Artificial Sequence
  Synthesized
  misc_feature (61): n=t or g
ttttaaagatgccttcatggccctgcatgtggatctagtttagtcattacctctgttttcntgtctttaaaattacttgttgaactggagtatcataaagattgtctcagtggttataaac

SEQ ID NO: 21541 - DNA, 121 bp, Artificial Sequence
  Synthesized
  misc_feature (61): n=a or g
cctgtgatatcacaatgcgtgcccatgagtgcagtcatgagagctggaaagatgactaggngtccccataagcagagtgactgtacctcaggcattactcgtgtgggcttgagctgagatt

SEQ ID NO: 21542 - DNA, 121 bp, Artificial Sequence
  Synthesized
  misc_feature (61): n=t or c
ggaccaaatgtttgagtttcggtggggttggtttggttggatgagacctttgtatgggcangcttgtgcaattggaatggccttaatttgggttatcttactccacttgtgaagtgactca

SEQ ID NO: 21543 - DNA, 121 bp, Artificial Sequence
  Synthesized
  misc_feature (61): n=t or c
tgctgctttaatcttttgcagcttcacatgttcttggtaatggagaataataaatgtaaangtaacattgaggccatcagtaatttatccagggagagcagttcaaaggaagcaccagctt

SEQ ID NO: 21544 - DNA, 121 bp, Artificial Sequence
  Synthesized
  misc_feature (61): n=a or c
tgtttgcttgaggcctgccttaccttctgcttcactggcagacaaagctttttgcagttanttgggccggagaagggatttatttaacttgtgaagtgcctgaggggctcagacatgaaga

SEQ ID NO: 21545 - DNA, 121 bp, Artificial Sequence
  Synthesized
  misc_feature (61): n=c or g
tggaggcttgtttcttttgtagtttaaagctatgtggtcaagcgtcccgatgtaggacagnctttgaacagcagaagtgattttggatgcactccaagctcctagccgacctccttcagtc

SEQ ID NO: 21546 - DNA, 121 bp, Artificial Sequence
  Synthesized
  misc_feature (61): n=t or c
ttattttttttcttcaactgtagggccacaggttgttggggacctcttccttgaagttatnagagccttttattcctactgcaaggatgcgcttggttctgatctcaaacttagctacaat

SEQ ID NO: 21547 - DNA, 121 bp, Artificial Sequence
  Synthesized
  misc_feature (61): n=a or g
tacctcatctgtatccatctactttcaggggaaacagctatctttgtcaagacagacagcncttcactattgagtgtcctgtgctctcagctgggcacaaaaaatgatggtggagctttta

SEQ ID NO: 21548 - DNA, 121 bp, Artificial Sequence
  Synthesized
  misc_feature (61): n=t or g
acaagctttgtttccttaggctgttgttgcccatttggacaccatacaaaccacccagggnctctgcaatccacggagcacaaacccgcactgccgacagaactgacaggcatgcaggaag

SEQ ID NO: 21549 - DNA, 121 bp, Artificial Sequence
  Synthesized
  misc_feature (61): n=t or c
agatctaatccacgttacggtgggcacgtccagcaatcaaatgcatgggatgctgtgagangctcatagcgttgcccctgcgacgtcagcaagctttgggatttgggatgcacaaagtcag

SEQ ID NO: 21550 - DNA, 121 bp, Artificial Sequence
  Synthesized
  misc_feature (61): n=t or c
ttaagaactaagtattgtaacatccatgttcagcagatctgagtgttgagcacttcgctgnggtcttctgctgacctgttctaccaaatggatctatttatttcgtgccttattaagtatg

SEQ ID NO: 21551 - DNA, 121 bp, Artificial Sequence
  Synthesized
  misc_feature (61): n=a or g
ctgtttctcttgaacttgcaaatacactgtgttattacacagctgtactttcaaggcagtnttataatcaaatgaaatctaaggcatcttgctgtggaaatgtccggtatgattgctaatt

SEQ ID NO: 21552 - DNA, 121 bp, Artificial Sequence
  Synthesized
  misc_feature (61): n=t or c
taaacttttataatgcacagaaaagatggtcttggtgtaaatacactagcctaaaaactangtgatctgcattcagttgttccctcggatatagatttcccatgagtcataagtcaaatgg

SEQ ID NO: 21553 - DNA, 121 bp, Artificial Sequence
  Synthesized
  misc_feature (61): n=t or g
ttatcacgtactgtagccaaacaagtacatcaaatctgtgtccttccactgtattgaggangcatatgaccattttcacaacactgatgttgactatatcccctcagttacttctggttta

SEQ ID NO: 21554 - DNA, 121 bp, Artificial Sequence
  Synthesized
  misc_feature (61): n=t or c
tgattcctcttcctctgctcccacactccatttcactttggaacattctaaatattaatgntcatagtcacactcctgttttattcagctgttcccagctgtgttcatattagcaaggagt

SEQ ID NO: 21555 - DNA, 121 bp, Artificial Sequence
  Synthesized
  misc_feature (61): n=t or c
gaagaggaggtggacaggttgtcagagaacagcaaagaatgggggagaaaaaggaggatgngtggaggaggcaacctggtgtgatgacctgggagatgagtttctttgtgacacacagggg

SEQ ID NO: 21556 - DNA, 121 bp, Artificial Sequence
  Synthesized
  misc_feature (61): n=a or g
accagcctttcctttccttttaaacctatttgcaaagcatttgggggactcgaatcccctngattccctctgtctattccctgctttgttttccagcctgccaaacagaagctgttttcaa

SEQ ID NO: 21557 - DNA, 121 bp, Artificial Sequence
  Synthesized
  misc_feature (61): n=a or c
ttggataatctttgcatgtgttcataaaaaaaaaatgaaaccaatgatttggtttacttantacacttattagagaggcccaagatcatttggaataatgattttaaccaaatgcttcaga

SEQ ID NO: 21558 - DNA, 121 bp, Artificial Sequence
  Synthesized
  misc_feature (61): n=a or g
gctgaaaaatttggttgtgtttcagcttgttaaggagtctattttagtgtggtgtagaatnactgagaaatagcatttgttgacagccaggagaatgaatgtggtactggtcactggggga

SEQ ID NO: 21559 - DNA, 121 bp, Artificial Sequence
  Synthesized
  misc_feature (61): n=t or g
acaggcacttctttctactgtatgctgaaatcaccactacaacatccttgagtaccatttngatttaagcatccagaggcctcagcatacaaaaagcacctttgaatacaaaacaaaagta

SEQ ID NO: 21560 - DNA, 121 bp, Artificial Sequence
  Synthesized
  misc_feature (61): n=t or c
ttccgagcctcaaagtaaaaggatgctcagaaaggtcctctgactcctccacagtgccgcnttcctaagtgacaatgaaagggacccattaacatttagcttcatttgtgtttatcagaga

SEQ ID NO: 21561 - DNA, 121 bp, Artificial Sequence
  Synthesized
  misc_feature (61): n=c or g
acccactgactgctttctatttaaaactctcttgtaatactttggttcagccagtctatangttcttgtactgtgcaaaatccctactgagtaacaggcagtgctacttagagaggtgcca

SEQ ID NO: 21562 - DNA, 121 bp, Artificial Sequence
  Synthesized
  misc_feature (61): n=a or g
gcacttgcatgtaattcttccatttcagataatttccagggtttgcagacaaaggttaggnaatgtttactagcacacaaaaaatgttattgatagagctagaaacagttttctgataggc

SEQ ID NO: 21563 - DNA, 121 bp, Artificial Sequence
  Synthesized
  misc_feature (61): n=a or g
ctagtaaaagctttctggattgaaatgagaataatgactacagtgtttttccttgaagcantggatgaagttttaatgaaagcctttgattcacaaaagcgatgcatccattgttatgggt

SEQ ID NO: 21564 - DNA, 121 bp, Artificial Sequence
  Synthesized
  misc_feature (61): n=t or c
cagcatgctgctaattgtcctgtgtaagtggaggatgctagtgggagagactgggaatcanagatttgtggtcatgcaactgagaaggcaaggagaagagccaggcaaacaatccccagac

SEQ ID NO: 21565 - DNA, 121 bp, Artificial Sequence
  Synthesized
  misc_feature (61): n=t or c
ctgttaaattgcctactcatttaactcagttgataccaacttgctactgctaaatactcantatttgattcttgttcaccatcctgaagttttctttgaccatttcatagagaatctctga

SEQ ID NO: 21566 - DNA, 121 bp, Artificial Sequence
  Synthesized
  misc_feature (61): n=t or c
tgaccttcacagacgttcctctctgaaaaacagctccctaacagcaaaaccaaatcttctntgctacagtttaagcccactgcttcttgtgttattcactgtgcacatggaaaatatgttg

SEQ ID NO: 21567 - DNA, 121 bp, Artificial Sequence
  Synthesized
  misc_feature (61): n=a or g
cgagcagcctggccaagcatctggcagcggcagaggagtctgaacttatttgtgacactcnaccaaggaacttcctccaggccatccaaaaattgctcacagagctgaagctcccaaggcc

SEQ ID NO: 21568 - DNA, 121 bp, Artificial Sequence
  Synthesized
  misc_feature (61): n=a or g
atgatactcaattttgataatctttagttgcacagcgttcaccaaaaggatggaacagtantgaccagctgtggtgtgattgaagtatgagaacatgtaacaggagaagtgggatatgtga

SEQ ID NO: 21569 - DNA, 121 bp, Artificial Sequence
  Synthesized
  misc_feature (61): n=a or t
gcgcttcccttacagcatagtgggtgcatgttcccaaaaactgaggctgtctgcatctttntgaaaggttctaagaaaccaataagcttcagcctcagataactacagaggatgaggagat

SEQ ID NO: 21570 - DNA, 121 bp, Artificial Sequence
  Synthesized
  misc_feature (61): n=c or g
actatagcataaagacaagatgtttttctcagctactcttttgcctgctaaaattgttggnttgttaatgtttgcatgtggactcagggctggagaaaggggctgttgcccgggcgaagct

SEQ ID NO: 21571 - DNA, 121 bp, Artificial Sequence
  Synthesized
  misc_feature (61): n=a or g
caatacacactaccaaatcttggaaggcaagcatgtacgacagtaatgaggcaccttgaantgtgacaagtgcaagctgtgaatttctacatctatgtagagcacgactgaaatccagtga

SEQ ID NO: 21572 - DNA, 121 bp, Artificial Sequence
  Synthesized
  misc_feature (61): n=t or c
accaaaggaaacaaatcgatatggacaagttaaatggtgtacttgcagaaaatgagttttnctgtcaggattcttagatttaaccataagtttagtcttgatgtgatctctttcactagtc

SEQ ID NO: 21573 - DNA, 121 bp, Artificial Sequence
  Synthesized
  misc_feature (61): n=a or g
cccatcgtgaatctggaaagctttgttcccttctgaaggtttgagccttcagacatccatncccctccacgagtttaactggcatccattctcctatacctgatgttctaaccaaagcttg

SEQ ID NO: 21574 - DNA, 121 bp, Artificial Sequence
  Synthesized
  misc_feature (61): n=a or t
caactctttcagactccatcatagggcatgaagggttagagatgaagacggatttgactgngtgtgaagtgttttagactttgcagttgccatagctgctaattggcaggccaccatgctt

SEQ ID NO: 21575 - DNA, 121 bp, Artificial Sequence
  Synthesized
  misc_feature (61): n=t or c
agggttgaacagggagtgtacattagtaactgcttaaatcctccaaatacctataatatcnaagcaaggattagaaaactggttctacgtgcccagtaccctcaccaactgttccaacctc

SEQ ID NO: 21576 - DNA, 121 bp, Artificial Sequence
  Synthesized
  misc_feature (61): n=t or c
gtaatgaaatcgcttcctctcatttaaaacatcatttggtactcctgtgtaaccaagggcngggtctccccatgccagctgaaagcagcacgtggaaacccagcccaaggcagatggctcc

SEQ ID NO: 21577 - DNA, 121 bp, Artificial Sequence
  Synthesized
  misc_feature (61): n=t or c
cccaattaacctttcataattaatatttctgctgtgttgcttaatttgcacttcttatgcnggcttcttacatcttctccttttcatccttttgaaaacacacaggtagaaattgtcagta

SEQ ID NO: 21578 - DNA, 121 bp, Artificial Sequence
  Synthesized
  misc_feature (61): n=t or c
gtagaaggtgatggttctccagggactgctgcgtctttatctccacatatctgaagagaanccaactctgccttcttcacattcacctcttcttttgtttctcctttgtcctcatcttcat

SEQ ID NO: 21579 - DNA, 121 bp, Artificial Sequence
  Synthesized
  misc_feature (61): n=t or c
gacaagagttcgccatcattctgcttctaggatcactggctgaatctgctaacttagttgntgtttaacgtttaaaaagaggtgtgcaactgttatgttcatggttcaattattcaggttt

SEQ ID NO: 21580 - DNA, 121 bp, Artificial Sequence
  Synthesized
  misc_feature (61): n=a or g
cgcctgcagcaacttctgaattccttcttcgtgtgcaaatggaagttgtctcttccacttnataaagcctttaaaattgggaaaatgaatcattaagttccaggtattactcacgaggcaa

SEQ ID NO: 21581 - DNA, 121 bp, Artificial Sequence
  Synthesized
  misc_feature (61): n=t or c
gaatcatcagcagtcaactcacacagacaaattacagcttgattctttgctccctctatantcctccatgactactatctacttgatgcacaacacaccatatgtggtcatctgttcatga

SEQ ID NO: 21582 - DNA, 121 bp, Artificial Sequence
  Synthesized
  misc_feature (61): n=t or c
ggtagcccataaagatgggtgtcttcaggaacgggtaccccacaagcatgtgatcataganctatactggagatcatgggatggtgagagacaggtagccccattgcgtgtgtggccacgg

SEQ ID NO: 21583 - DNA, 121 bp, Artificial Sequence
  Synthesized
  misc_feature (61): n=t or c
acactaatgctcttgtcttgataaagggaatccaaactcatcttgaaggcacatgaacatntggtactagcaacatgaaatgcacgaaaaagttgtttcagatatacacctccagattcaa

SEQ ID NO: 21584 - DNA, 121 bp, Artificial Sequence
  Synthesized
  misc_feature (61): n=t or g
gagtctcggtgcagatgacctaagagaaagtttcaggagataatcccccatgtaaactgtnagcctggtgttcatcagctgtgaagacacagtattcctgcctgtcatatcactgaagaca

SEQ ID NO: 21585 - DNA, 121 bp, Artificial Sequence
  Synthesized
  misc_feature (61): n=a or g
tgctagcatttgggggagaagttgctaaatgcataggaaagcatgacttttgcccccttcnatgagcctgcaagtgcccattttccctctcctttctcccctgtcccatctggtgcagcag

SEQ ID NO: 21586 - DNA, 121 bp, Artificial Sequence
  Synthesized
  misc_feature (61): n=c or g
agcaaaatgaatgcagctgttacgctgctacattcagctggaaatctgacaagcagcaggntttatggatgagcctaatgcatcccaggctttctgaggtgcaaagggaagggtgacagat

SEQ ID NO: 21587 - DNA, 121 bp, Artificial Sequence
  Synthesized
  misc_feature (61): n=a or c
agatgtgaagaaggagcttggtttcttggtgtagactgtgacttgaattacaatcctatgnagatcagggagacaatgaaatatatcttcagcttttgttctgaatcagtaagtgggagtt

SEQ ID NO: 21588 - DNA, 121 bp, Artificial Sequence
  Synthesized
  misc_feature (61): n=t or c
gaggtttcgatttcatggatttgtaacccaaattaaatagagctatgaggaaagagtaatnctgaaaatattgtccatctgatattttatcttatggcaagacaagccagcaaaatcacta

SEQ ID NO: 21589 - DNA, 121 bp, Artificial Sequence
  Synthesized
  misc_feature (61): n=a or c
gtttagggaagaagagctcattgagactatgtgtttgggtgagggtcagcagctacctcgngacctctgttcaacgggggtaaaccagcaccgtgccccaggaagtccccattcaaggtgg

SEQ ID NO: 21590 - DNA, 121 bp, Artificial Sequence
  Synthesized
  misc_feature (61): n=a or t
atgtccagtagaagtgatcccaagtttacttagagaacaggcactctctgactaattgacnacagtgtaatgttggaagtataattcactgtcactaacttgttttccattctgttttgag

SEQ ID NO: 21591 - DNA, 121 bp, Artificial Sequence
  Synthesized
  misc_feature (61): n=t or c
tgtggcaatacgagcacggtccattttgaagtctaatcctcatgtttaggttgaaaagaantcagcagctctgcagcgtgtgaaggaaagggagaacacttacaaaggcattgggagggtg

SEQ ID NO: 21592 - DNA, 121 bp, Artificial Sequence
  Synthesized
  misc_feature (61): n=t or c
tgatttttcatttctgtaattactgtactcagccttgtgatttggtaaaggtaagtagaangtgctgtgcaatgcaaatgaaaatttttgcgttatctgcacattctctagcttttacctc

SEQ ID NO: 21593 - DNA, 121 bp, Artificial Sequence
  Synthesized
  misc_feature (61): n=t or c
tacaacaacagaacaattgagtcactacagtcagcaataccactttagctactacttaaancttcaagtaaactttgctgttaagcacaggggttgtaccttagtggtgagggtcttcact

SEQ ID NO: 21594 - DNA, 121 bp, Artificial Sequence
  Synthesized
  misc_feature (61): n=t or c
cccaccccatacatccttgtgtcccccctgtgtgtctgtctgtcccactcactgcatcctngtgtcccccggtgtgtctttgtgtcccctggtgcatccacctgtctcatccgcccctctt

SEQ ID NO: 21595 - DNA, 121 bp, Artificial Sequence
  Synthesized
  misc_feature (61): n=t or g
ggagatttcctctccatggggtttcctccccccagtgatgctgtgacctcaggatctttgngagcctcccaaagcagaggtcggctccccctcactgttagctcagcatcgtgaaccttct

SEQ ID NO: 21596 - DNA, 121 bp, Artificial Sequence
  Synthesized
  misc_feature (61): n=a or g
acacaagcccacatcccaatggcagctcattttccaaagcaaccgtgtgctgtctgtagantgtaagagctgcgcagtggtgcgtccacagggatgctgcctaatgcttgcacccaggtca

SEQ ID NO: 21597 - DNA, 121 bp, Artificial Sequence
  Synthesized
  misc_feature (61): n=t or c
ttgaactccagcagctttctgcagatcacaggagacctccagaacatcactggagaggcantggacttgccaagaacttggagaggattcagacggctgtatttgtggaaggctttactgt

SEQ ID NO: 21598 - DNA, 121 bp, Artificial Sequence
  Synthesized
  misc_feature (61): n=a or c
atctatcctccaaggtgctatgattaaaaaaaccaagtgttcttccatgcaaaagtgcttnaattctagctaactgcagctagtggtaatagctcttgcctgcacgcttaagaacttgagc

SEQ ID NO: 21599 - DNA, 121 bp, Artificial Sequence
  Synthesized
  misc_feature (61): n=a or g
gtcactcccgcatgagtgcgttggtgcaattttcaagttgcacttacagctcttgctgccntgcagagggacgctcgtggtgtctgtttggctgttcctcgtgcacttctagttacagtca

SEQ ID NO: 21600 - DNA, 121 bp, Artificial Sequence
  Synthesized
  misc_feature (61): n=t or c
atatctagcctaatatatgtgctattgtgggtggctgtgagagtatctgaaatacatctgnactttgtttcttcactgtcaaaatcagatttagttaatagtatgaacagttgataggcta

SEQ ID NO: 21601 - DNA, 121 bp, Artificial Sequence
  Synthesized
  misc_feature (61): n=a or g
ttttttctcctgaagccaaaacttagcatcgtaccacacactatggagaaacatgtcccanctgaaaccaggatgaagatccactactacatggctcaggtattttgtgaagaatcacagg

SEQ ID NO: 21602 - DNA, 121 bp, Artificial Sequence
  Synthesized
  misc_feature (61): n=c or g
aaattcagacatccatctcttacttgctgactttgattggatctttttcctgaaatttgancaaaatcacatatctatctagataatcctcatctcatagcagttgttttgtctctttctt

SEQ ID NO: 21603 - DNA, 121 bp, Artificial Sequence
  Synthesized
  misc_feature (61): n=t or g
cagtcaatgaaattaatctttgtgatggtaacaaagcaccatacaaatctaaatttcaccnggtgcaggacaatttcactgtagcctatatagccacctgaataaaagagttaagatttat

SEQ ID NO: 21604 - DNA, 121 bp, Artificial Sequence
  Synthesized
  misc_feature (61): n=c or g
aaagactgatagacacattgcaactcagctggaaagtggctgcagaacttctatctagctntaagtttgcctggtaatttatggggctgtgaaccacatcttactggtgttattattgctg

SEQ ID NO: 21605 - DNA, 121 bp, Artificial Sequence
  Synthesized
  misc_feature (61): n=a or g
taattccaccgggtgcttaagcagccaagcagtcctgacagagctcaagcacttcaagccnctgcagcacaacctttaccatcgtgctcctcagctcttcaaaacccataacagaaagcaa

SEQ ID NO: 21606 - DNA, 121 bp, Artificial Sequence
  Synthesized
  misc_feature (61): n=a or g
caatgtgcttagtggctagtctgcgtggaatgtcagcatattttaacaggaaaccttcttngaaactatatcgctagctctagatccttttcttccctccccccccaagaaaaaaaacacc

SEQ ID NO: 21607 - DNA, 121 bp, Artificial Sequence
  Synthesized
  misc_feature (61): n=t or c
gaccaatcaccactatgcccattaaactatgcctgagtgctacatctccacgtataaattntgtgtctcacttctcagtggagaggtgattgatgcagttaatgaagacagcagagcccat

SEQ ID NO: 21608 - DNA, 121 bp, Artificial Sequence
  Synthesized
  misc_feature (61): n=a or g
tttccacctttttattttgctgaaaataatttagctatctgaaagtggctgcaactgagtnaagtcacaaggaattggcatttacttctgtgttcctgttgaaaatacttaagcctatttt

SEQ ID NO: 21609 - DNA, 121 bp, Artificial Sequence
  Synthesized
  misc_feature (61): n=t or c
gcccaaatttctctaaaaataaataacacgaaaggaacgcaagtcgtctcactagcagtgnttttgacaggtatcttgagaatattaatttttccactttttttccataaaaatacaagca

SEQ ID NO: 21610 - DNA, 121 bp, Artificial Sequence
  Synthesized
  misc_feature (61): n=t or c
ggaatacatatgtcatgaaatcacttaatttaatttcaaaatcatacaggacttctattanttttcacattctgctactattttgataccaaaacactaagcagcattggcacctgagact

SEQ ID NO: 21611 - DNA, 121 bp, Artificial Sequence
  Synthesized
  misc_feature (61): n=a or g
ttctggtgtgcaccagaaaagcaagttttcatatggcactgcctgcaatttatttgcagtngaagttctgatgctggagcccaagtagaacaacctctgagcatggtctgacacccacata

SEQ ID NO: 21612 - DNA, 121 bp, Artificial Sequence
  Synthesized
  misc_feature (61): n=a or c
gaggcatgaggaagagaaggtgaatagaaaatggtaaattttattcagaatggtaaattcnttgaacagttttgctcaggactttatactaccatgcactgtcagaaggcacgattaatta

SEQ ID NO: 21613 - DNA, 121 bp, Artificial Sequence
  Synthesized
  misc_feature (61): n=a or g
gaaatccacccctccccaatggcacaaaaagatggaagagggtcacagcaacaaatgcctnccatcccataattatttgtcctccagaacttgatagatgggtgggatgtggagatagaac

SEQ ID NO: 21614 - DNA, 121 bp, Artificial Sequence
  Synthesized
  misc_feature (61): n=a or g
ggtgtttgctaacaagccatttccatccacaggttattgcaagtgggtaaaagggtcaacngggactgtaggaattctggctgtgggtcaagctgacacactgcttattggtacacttctg

SEQ ID NO: 21615 - DNA, 121 bp, Artificial Sequence
  Synthesized
  misc_feature (61): n=a or c
attacttctctacctctgaatcactctttcctgttgaagatgacatgaaagaaaaacactnagcttttgcataaagaagatacgtgaggtatcacagtgagcatgcagtaaaagaaagtca

SEQ ID NO: 21616 - DNA, 121 bp, Artificial Sequence
  Synthesized
  misc_feature (61): n=a or g
caggctagcagaatgttgcaatggcttggagccaaacagcagcacccactgccactgaacnaggtgcatattgacagtgtcaaggtcacatgcttccactgtgggatgccatttcacagaa

SEQ ID NO: 21617 - DNA, 121 bp, Artificial Sequence
  Synthesized
  misc_feature (61): n=a or g
ctcttctgactgtcatttttcttgcctgcttgccatccctgtcctgcactcacccatagcngtgctctgaggcatgtaaattatttcacaagtttcctgtcataccaaaggcactgcaggt

SEQ ID NO: 21618 - DNA, 121 bp, Artificial Sequence
  Synthesized
  misc_feature (61): n=t or c
tccgccaccaactcctacttccagcctcacaaagcaaaaacatcttggtaagtttctacangattttatttctaaaacttgctgaaacatcctggccttagcacacatgtgacgtgtgtga

SEQ ID NO: 21619 - DNA, 121 bp, Artificial Sequence
  Synthesized
  misc_feature (61): n=t or g
caagtcctgtgcttggatctaattcctgcagcctgtgcgcagagcggtgccctgctgcgtnctgtggctgagtaagatgtgaggtgtgtgtggaaccaaagaaagttagagagcagcttaa

SEQ ID NO: 21620 - DNA, 121 bp, Artificial Sequence
  Synthesized
  misc_feature (61): n=t or g
tttcaaggtaatatccatagagtatctcaattttagtttttgggtgaaagcggcagcttcntttctactctcatatatcttcctgctttaataacaaactttggtttgttttatgctgact

SEQ ID NO: 21621 - DNA, 121 bp, Artificial Sequence
  Synthesized
  misc_feature (61): n=c or g
gactgtctgccacatggattaaaaaaaataataatgagcaaacactcgtaaaatgctgctnaagccaatggaagtccttccatgcatgcgggcactgagagcagcagcaaagccccggccc

SEQ ID NO: 21622 - DNA, 121 bp, Artificial Sequence
  Synthesized
  misc_feature (61): n=c or g
ttatagatcattccttttaattgatttactacaccattttggtagggttattttgttgttnttgttggttggttgcttttattttatgttttgttttgtcttctttgtttgttttaaatga

SEQ ID NO: 21623 - DNA, 121 bp, Artificial Sequence
  Synthesized
  misc_feature (61): n=t or c
gatatgttttcctattggagaagtcagacccaatggcaattgggagcaatctctttgctangtgccatatttatgcaatatgtactgcagagtctgtacaagtgaggtgtaatatttatac

SEQ ID NO: 21624 - DNA, 121 bp, Artificial Sequence
  Synthesized
  misc_feature (61): n=t or g
gagtaacagcctgttgctgagcagctctgaggatgtgagaggaaacctcagaccttacagntttctgctgcagatgctgccctcacttgtgctgctcacacacacacatctgggcacacac

SEQ ID NO: 21625 - DNA, 121 bp, Artificial Sequence
  Synthesized
  misc_feature (61): n=a or g
cacaatttatccttatttctgggtaacgaaatagattgtggtgtttactctctcacctgtntgtgtgttctgcacgtgaccatacagtgtacataacaaggagtcagacctgaagtctatt

SEQ ID NO: 21626 - DNA, 121 bp, Artificial Sequence
  Synthesized
  misc_feature (61): n=t or c
agtaccgttgttgtcctgcttctcctttcctcaaacaacacacctcactggttcaaaatantggggagagttctacaaaagcttttgtgatgtcttcactcaaaaaaccaacccattaaag

SEQ ID NO: 21627 - DNA, 121 bp, Artificial Sequence
  Synthesized
  misc_feature (61): n=a or g
tacatcttacatctccaatacacagcacggaacttccatgctgaaataactgtgtttaggnaacacagaagcattctatttaatggagcgatttattcttgcacaacttggcagttctgct

SEQ ID NO: 21628 - DNA, 121 bp, Artificial Sequence
  Synthesized
  misc_feature (61): n=t or c
gtgtagtaaagcacactcttcacagatctgcagctgccaaagaataaagttccaaacaaangggaactgcagtcctatgcatcattgaaaaagcttctacaaagtctgaacagctgttcaa

SEQ ID NO: 21629 - DNA, 121 bp, Artificial Sequence
  Synthesized
  misc_feature (61): n=t or c
gtaaatagtaacagcaggtataagttcaacaggctgtcctctctgatgccaggataatgtncaattaccatgtaagctgtgtagtagcaaggtaaaacttcagatttttttttttttgcca

SEQ ID NO: 21630 - DNA, 121 bp, Artificial Sequence
  Synthesized
  misc_feature (61): n=a or g
ggactcacctgtcacctcatcactgtagaccgcctgcatcatcagctgggggttttggacncagtcgatgatgcccagcagtgtgcgtgtcaggcgcagcagctcactgaagctgtagaag

SEQ ID NO: 21631 - DNA, 121 bp, Artificial Sequence
  Synthesized
  misc_feature (61): n=t or c
tataagattaacatttccaaacaacaccattaatgttgtgtctccattgaactccaagtgntgaacacttatggttatgaagttgtgaatatatagctttccttgaacttaaaatagggag

SEQ ID NO: 21632 - DNA, 121 bp, Artificial Sequence
  Synthesized
  misc_feature (61): n=a or g
ggttcaaagagttcatggcaggctctgtcttttgcttgctgaaacagtgcagcctgtaatnctgaatacatttcagttagactgcttccttctgtaggagctgagcagcttttcaacgtca

SEQ ID NO: 21633 - DNA, 121 bp, Artificial Sequence
  Synthesized
  misc_feature (61): n=t or g
tggttgcagtgtgcaactgtttgtgtatttctggtactctattataatgcaataacttcanaaattatcccaaattcaatctacaaaatcatgagatttcctattaaattgtgagtgaata

SEQ ID NO: 21634 - DNA, 121 bp, Artificial Sequence
  Synthesized
  misc_feature (61): n=a or g
agcctgcttcttctgcagagtgccagacatgctgtgcactgaatggagtctcacttgctgngttactaggacttgaatttgggattctagtaagggcatgatttaaggctttgttgcagtt

SEQ ID NO: 21635 - DNA, 121 bp, Artificial Sequence
  Synthesized
  misc_feature (61): n=t or c
ggcaaacattgacagtcttgattaaatcattcatcaggatatttaattgtgtacagatggnacaaaggatttccatgcttacaaacattgctttagatttctgttgtccttaggcttttac

SEQ ID NO: 21636 - DNA, 121 bp, Artificial Sequence
  Synthesized
  misc_feature (61): n=a or g
ggatgtatgtgcccccctgctttttgcgtgctgggaaatggagcaagagagattcatccancacaactgagagatgcctgagcagcagctcttgtgagaacagcgtgcagtcttgttgaag

SEQ ID NO: 21637 - DNA, 121 bp, Artificial Sequence
  Synthesized
  misc_feature (61): n=a or g
ggggtaacacagcacggcgtagcataatggttcattagacaggcttatcacttctttctcnggaggaattccagatgaaaagtaatcatctctgtttcatgatttggtgtgaaaaattcca

SEQ ID NO: 21638 - DNA, 121 bp, Artificial Sequence
  Synthesized
  misc_feature (61): n=t or c
gcctctttttctcaaatagatttaaacaagtcttttggtatggacttctcaggtgttttcngaaccagtatacaatgttttgcttgttagctgctactcaggaaaacagggaaattcattc

SEQ ID NO: 21639 - DNA, 121 bp, Artificial Sequence
  Synthesized
  misc_feature (61): n=t or g
ttctaagtagatcccaggaggaatgattttgttggaggatctgttccactcttacaaggcnttactgggaataataatctgtgtgttctgttctaccctgaccagcatgacgccagagtat

SEQ ID NO: 21640 - DNA, 121 bp, Artificial Sequence
  Synthesized
  misc_feature (61): n=t or c
aataaaacagctcccagcgtgccggcggcaataaaaagtgaagaagccagcaattggcatngccctcatggcataactcatgctccctattatttacaggggctctaaaattcaaaaaaaa

SEQ ID NO: 21641 - DNA, 121 bp, Artificial Sequence
  Synthesized
  misc_feature (61): n=t or g
tagctcacaaagttaaaagagactcccgtaactgactggggaccagcaatgaatggagccncatggcttacagtgaggtttgaatcctcagtgctctgtgtgtggcagaggacctcccaag

SEQ ID NO: 21642 - DNA, 121 bp, Artificial Sequence
  Synthesized
  misc_feature (61): n=a or t
gctcagggtctacagaaatgagatattgtcacttatgctctatgaatatgccttcttgtgnatcagtttagtgtgtcttagaaatctgtagctctcatatatcatgaagaatcatttctgt

SEQ ID NO: 21643 - DNA, 121 bp, Artificial Sequence
  Synthesized
  misc_feature (61): n=a or g
gcagaaagataactagccatagacttgtgtgacttgactggtctaaggatacaagcaaggnagctcacaaggaataccttctataagaccagcagatgctggctgagaaggggagaacaag

SEQ ID NO: 21644 - DNA, 121 bp, Artificial Sequence
  Synthesized
  misc_feature (61): n=a or c
ctagcagagatggaactgtgtacttaaaaatcactatatttttcccagctgtgctggtgtntctaagtaaaaataaagactttatcctagtttcttccatcatggctgcagtagctgcctt

SEQ ID NO: 21645 - DNA, 121 bp, Artificial Sequence
  Synthesized
  misc_feature (61): n=a or g
tgaagagtcattggagagcatttatctccaactgatcagtgcattagtatttgacttcctntatctttatagttttggaaatggtcgttatccatgcaaatgttcagtcctttttccaatc

SEQ ID NO: 21646 - DNA, 121 bp, Artificial Sequence
  Synthesized
  misc_feature (61): n=a or g
tcacaacttggccatagtgaagcagttatttaaaatggacacgtaacgcagagggagctcngggcaacgcgctgttgtgttgcggcgttgtaaaactcatttccattcagttgatcgtagc

SEQ ID NO: 21647 - DNA, 121 bp, Artificial Sequence
  Synthesized
  misc_feature (61): n=a or g
ggtaaaagccaccaccatatcattaagtacaaaatgaggcttgggatcctcagacaaatgnacttcttgtggtcttcctgatgtctcgattctgagtgcccctgtgagacaccaccttccc

SEQ ID NO: 21648 - DNA, 121 bp, Artificial Sequence
  Synthesized
  misc_feature (61): n=t or c
agtgctctgggttgacattaaccccatgttgtgctgctgcagtggtgatgttcatggcagngttctgctctcttgacatctgttgctcttcagaatgagaatacttctattttctcttcag

SEQ ID NO: 21649 - DNA, 121 bp, Artificial Sequence
  Synthesized
  misc_feature (61): n=t or c
attatagatatgaataaaagaagcggttctttgctatgtttaccatcactaatttggaatnagttttcaactgacttgggaatcttgttatgagtgaggcagtcttcctcagctaatgtca

SEQ ID NO: 21650 - DNA, 121 bp, Artificial Sequence
  Synthesized
  misc_feature (61): n=a or g
aaactagaggcaatccctatgcatttcaaaggatacagcatttacagtgacaagggactcngggacaccatttcaaaaggatatatgtccgtatcacagggactatacgtgaaaaatcaag

SEQ ID NO: 21651 - DNA, 121 bp, Artificial Sequence
  Synthesized
  misc_feature (61): n=t or c
gttgaaaaaagctgatgctcctttccctcctcgctccagtgtgcatgcagccatctacacnacagcccaaagcagcctccaaaaggagcctctcacttggcagccctagcaaaaatgcctg

SEQ ID NO: 21652 - DNA, 121 bp, Artificial Sequence
  Synthesized
  misc_feature (61): n=a or g
accctatctttctccaccacaatgctttatggctctgtcctcctgtggaggcatctgcatnagaagtggagcacagtgcagtcatccaagccagcaaaacctaagcaaagtttgaatcaga

SEQ ID NO: 21653 - DNA, 121 bp, Artificial Sequence
  Synthesized
  misc_feature (61): n=t or c
ttataggaaaagctgtagaattagtcagtgatggttactggaatgcttgttacatgtttangtgtaaatactgtactatcattcacttttttgctctatgacattccagctcagctaaata

SEQ ID NO: 21654 - DNA, 121 bp, Artificial Sequence
  Synthesized
  misc_feature (61): n=a or g
cgtgcaagctgcagcaccttcccttgctgttttccctccaaaagtccctgcctgttttccngtttacatatgtataccttgcaaaagcagcagctctcccttgcctgtgtcacagacctct

SEQ ID NO: 21655 - DNA, 121 bp, Artificial Sequence
  Synthesized
  misc_feature (61): n=a or g
ctgatgttacaacagttactgctctatttttaattagttcatccgcaataccttaatatcngttagttttgagttacttacatacatagggaagatcatagggaaacatttaagcattagt

SEQ ID NO: 21656 - DNA, 121 bp, Artificial Sequence
  Synthesized
  misc_feature (61): n=a or g
tcgatcgcttatcaggaggattagcccaccgtaactcacttccctgcagtattttgaaccnaggtacatttgagcaccttattctaggcaaacctctcccgaaagatgaggagacagacag

SEQ ID NO: 21657 - DNA, 121 bp, Artificial Sequence
  Synthesized
  misc_feature (61): n=t or c
tccaggtgacacagctgcaacccaagagctctgcatcagcagtacccatgggcagggctcncaaatttcagagataactgcacccattaggagatctcctcctgaaatggtttaggggaga

SEQ ID NO: 21658 - DNA, 121 bp, Artificial Sequence
  Synthesized
  misc_feature (61): n=t or c
tagagcattaatctgtctgtgtgttttgggaattcagacacagtagcattcaacttcatanggcaacaaaatggtgtggtcaagggaagatgcaggcagaagacacactgcaagtgtcata

SEQ ID NO: 21659 - DNA, 121 bp, Artificial Sequence
  Synthesized
  misc_feature (61): n=t or g
taacctgcagtacgtttagaaaataaagagctggatcagggtgggtgtgcgtgttcacacntttattgaagcattcagtagctagcccatatggaaataacagaacaaaaatagaagaaac

SEQ ID NO: 21660 - DNA, 121 bp, Artificial Sequence
  Synthesized
  misc_feature (61): n=t or c
ataaaccttgcatatgcaaactagccttacctcatcgtgtggatcttttcaaagaaagtcntcctatgtttgccaccaaaacaatatcacagactttattttcgctatttctctcagttca

SEQ ID NO: 21661 - DNA, 121 bp, Artificial Sequence
  Synthesized
  misc_feature (61): n=a or g
gtaaaccacaaaacaggggttctgttacatgatacatgtactaggataaccagaggttccnttttgtaatgagatataatggcctatatgagtttgattatttctttttgttttgtttccc

SEQ ID NO: 21662 - DNA, 121 bp, Artificial Sequence
  Synthesized
  misc_feature (61): n=a or g
ggaagaaaacttggcatactgtactatgccagtttctgaatctttacatcttgtgtatcancttatctttattaccttatatgtagtaaacatctaataatgtgattttgaatctctgcaa

SEQ ID NO: 21663 - DNA, 121 bp, Artificial Sequence
  Synthesized
  misc_feature (61): n=t or c
tctagaggagcacttctgcagtcctcagcagcacccccctctctgaccatagcaatgtaancagggctatcacatccctccaacatcctttgaggtacgcagtgacagcgatacaagcaat

SEQ ID NO: 21664 - DNA, 121 bp, Artificial Sequence
  Synthesized
  misc_feature (61): n=a or g
agatattactaagtacttgaaaatatatgcatatactgttctattgctgaaaggtgaaggntccactcttgtcttggaaatcaaactaaggtctgaccagtcttcctcatgaaagtctgct

SEQ ID NO: 21665 - DNA, 121 bp, Artificial Sequence
  Synthesized
  misc_feature (61): n=t or c
acggggcaaactgggacctgaggctgctagaatatccaccgtgttgaattcctgccatagncttgtctcagcttctggtgatttcaggatttattccaggctactttgtaattgaactgag

SEQ ID NO: 21666 - DNA, 121 bp, Artificial Sequence
  Synthesized
  misc_feature (61): n=a or g
ccatttcccttggcacaacatggcaggagcagtcccatgtgaggtactgaccttttcaccntgcaattccctgtttacctactttaactacagcatctcgtcttggtctttatctgatgag

SEQ ID NO: 21667 - DNA, 121 bp, Artificial Sequence
  Synthesized
  misc_feature (61): n=a or g
aattaagaaatctgttgcctaaaaataataaactaagttcttccctttgttagatgtaatntttgtgtcctctgttgcctcccaaaaatgcagatttgcatatgtattgtgcagcaaaact

SEQ ID NO: 21668 - DNA, 121 bp, Artificial Sequence
  Synthesized
  misc_feature (61): n=t or c
ccaccatgctcaggtaccttctgtcccccggcatgcaaatgcaaggaagcctgtagcatgnatgtgcagagaacagaattggagcccaccacccgagctggtgcagatgcagaaaatgctc

SEQ ID NO: 21669 - DNA, 121 bp, Artificial Sequence
  Synthesized
  misc_feature (61): n=a or g
agaatccacatctgaaaaggagctggttttgatattccaggctgagagtatgaatgccagnagtacatttaccttctgccaaatcttacaggtgcccttgcaaaaactgagctggtcaaaa

SEQ ID NO: 21670 - DNA, 121 bp, Artificial Sequence
  Synthesized
  misc_feature (61): n=t or g
atattgccagtaattgatgctctacaggtggatggaaggaggcaatctaaatgaagaaatntatacttcctttgtggtcagaagtgtgttggcataggtattactacataggaagctactt

SEQ ID NO: 21671 - DNA, 121 bp, Artificial Sequence
  Synthesized
  misc_feature (61): n=t or c
taaagttttttaagtgatattttgtgattgcattgaatggttatttagaaatttgataaanactggattacactgttggtggtaatccagaaatactctacttaaaacaccctgctggttg

SEQ ID NO: 21672 - DNA, 121 bp, Artificial Sequence
  Synthesized
  misc_feature (61): n=a or g
tcagtcatagcacatggcccgtggtgttttgagagtttcggtgcttgaggtatgtgaaganaaggagtaagaaattgttttatctgtgttttatgccactgtgtcttttgtgagttgagtg

SEQ ID NO: 21673 - DNA, 121 bp, Artificial Sequence
  Synthesized
  misc_feature (61): n=a or g
agagatatttaaaagccagtaatgaccagaagtaatcactaacacatgcatgaagaataangaaagagaatgatttcctcccatgcttacttgctacttgcccccactaattattcaacat

SEQ ID NO: 21674 - DNA, 121 bp, Artificial Sequence
  Synthesized
  misc_feature (61): n=a or g
ttcaaaaccatatgtgatgatttttaggtttttctctctgaggttaaaagagacctgcttngaagccatctgggaagatgcagcagctcaatggctgtattctagcatagaatacagctct

SEQ ID NO: 21675 - DNA, 121 bp, Artificial Sequence
  Synthesized
  misc_feature (61): n=a or g
ctgctactttctgattttgaacgtgctaaattacctcagccacaggtaccttatacacctncaggctgacgggatgaatatacttgaggacattcctccagagaggtgatactttcaggct

SEQ ID NO: 21676 - DNA, 121 bp, Artificial Sequence
  Synthesized
  misc_feature (61): n=t or c
tcaggatggaccctgtattgtaacattaatattacaaggaaggcagaaagtaaaatggtgntcatggaacaaagtggagtttacaatcagttagaaacgtagattcaatctgtgatattat

SEQ ID NO: 21677 - DNA, 121 bp, Artificial Sequence
  Synthesized
  misc_feature (61): n=a or c
gactcgttttggagctgatgtaaatgaaactctgccatttggaataaagcacaatcagtcnagaatactatcatataaatcttgcttttctcaggattcaaggacaacatttaatcagtaa

SEQ ID NO: 21678 - DNA, 121 bp, Artificial Sequence
  Synthesized
  misc_feature (61): n=a or g
actttatcacgaggcatatatccatgggtgaccagctttcactgatcctgctgcttaggcnaggtatttcttttttatgcctcttcagtacatgctctgaagaggttgtactgaaatttgc

SEQ ID NO: 21679 - DNA, 121 bp, Artificial Sequence
  Synthesized
  misc_feature (61): n=a or g
gctttagcacaggatttagaagtgggaagggatgtaaacatatctcagctgggctgtccantgaattatttttagttgcagcttttcaaaagaacccagtcctttaaaaaaaaaattcaag

SEQ ID NO: 21680 - DNA, 121 bp, Artificial Sequence
  Synthesized
  misc_feature (61): n=a or g
ccacccctggggtatctccacgctctggaaatctgtgcttgcagggtgagcaagagctggngcaaatctggagcatgcatgtgagtggagcagggcagaggtttgcacactgcaagcagca

SEQ ID NO: 21681 - DNA, 121 bp, Artificial Sequence
  Synthesized
  misc_feature (61): n=a or g
catgttgctgcattgttgaagtgcgggctctggagccaagctgcaactgtgctttgtatgnatgaagtatcaaaccagctcaggctgaaaactttacctaaaaggtggctagctggtgcta

SEQ ID NO: 21682 - DNA, 121 bp, Artificial Sequence
  Synthesized
  misc_feature (61): n=a or g
cttagaaggcatgtatattgtggaagtgtattatgctctgggaggttctatcactgcactntttctgtcaggcctgcaaaatactggatctgtgggcagatttccttgagtctcatgagcg

SEQ ID NO: 21683 - DNA, 121 bp, Artificial Sequence
  Synthesized
  misc_feature (61): n=a or g
aacgtgatctactgagttcagtaaaaacaaccaacactctacagtcactttctttgcaccnttgcagccttgaaagaaacagctacagtgctgccttcttccacactttgcctggtgtcat

SEQ ID NO: 21684 - DNA, 121 bp, Artificial Sequence
  Synthesized
  misc_feature (61): n=t or g
actaatttcatttcttaaatctaaagctacggtcaatgtgtgtgctctgcagcagcaattnccactctcctacttaaagaagagcatcaggaagtaggcagaagtctcagaatttaacatt

SEQ ID NO: 21685 - DNA, 121 bp, Artificial Sequence
  Synthesized
  misc_feature (61): n=a or g
ttctgcacagagatttttgaaccccttttttagccagggaatgctcgtggtgaggttgtcntcatttcatgaagctgaatgttggatgatccatcagccttcacaagaccagctttgagta

SEQ ID NO: 21686 - DNA, 121 bp, Artificial Sequence
  Synthesized
  misc_feature (61): n=t or c
cgagctctaggccaactgcagccaaccaggcaagagcatcgccaaagcaaaagttcctagngtacaaaactagactaaaagataaaactcaaagtacttctgtatacaaagagcaaggaat

SEQ ID NO: 21687 - DNA, 121 bp, Artificial Sequence
  Synthesized
  misc_feature (61): n=t or g
aaccacatcatgaggcttctgcttagtgataggagactttgggagatgctgatcagacttncatttcttcctacccaagagaattcattttctgagtcatttgcatttatctgagctttaa

SEQ ID NO: 21688 - DNA, 121 bp, Artificial Sequence
  Synthesized
  misc_feature (61): n=a or g
tttgatgtggatctgcatcagtttaggaagagctgctgtagcaaagtaattgcaaacaganaatctttgcagtcctgtgctgccagcgaggctgaccatcacccaacgccaagcagcagca

SEQ ID NO: 21689 - DNA, 121 bp, Artificial Sequence
  Synthesized
  misc_feature (61): n=a or g
ctccttcagcacttggagctgttcctgatggtctcccactcccagcctcaatggggacctntccttctactgccaagcaacctctgtgtccacaactaagttttcctgtaacattaatggg

SEQ ID NO: 21690 - DNA, 121 bp, Artificial Sequence
  Synthesized
  misc_feature (61): n=t or g
ctcaataatgttatgctaactatatgcttgtctttttaatattttgaatcaatctcacttngaactttgatgtagttgtagtatgccaagcttagaagtgataatgttcattccaagctat

SEQ ID NO: 21691 - DNA, 121 bp, Artificial Sequence
  Synthesized
  misc_feature (61): n=a or g
ggctactgcttgttttcccattgaaatccctttttgtagaaacaagtaaagtaaatgtacngtaggcctctggagaaaacaaggtttgtgtagctacagagcctgcttgaaatatcattgg

SEQ ID NO: 21692 - DNA, 121 bp, Artificial Sequence
  Synthesized
  misc_feature (61): n=c or g
agcgcttcaaaatataaagcaagggtgaatatacaagcttcagactttctattttcaggtncattagcatctgctgtacagacactaaaagttgtaaaggttagacaaacagctatatgct

SEQ ID NO: 21693 - DNA, 121 bp, Artificial Sequence
  Synthesized
  misc_feature (61): n=c or g
tgaaaattcctgctttactaattagtgagattttcaaagttgcctattccacatgacctcnagtgagtctgtaaatctgctggagagcttccatggtttccaaagtgaaccgaagcactgt

SEQ ID NO: 21694 - DNA, 121 bp, Artificial Sequence
  Synthesized
  misc_feature (61): n=a or g
gtacacaggcattgagtgcaaataagtgaggaggtgctgtcagttgcattgaggttagagnggctctgaagaaagaacttgataggttggagcactgggcacgctgaagttgtaagaaatg

SEQ ID NO: 21695 - DNA, 121 bp, Artificial Sequence
  Synthesized
  misc_feature (61): n=a or g
gagctccactgacaccccaggaaatttacctgatacataggccacttagagacacttaagntgcaggtgaatttcattcctattctctggttcattagatctaaccacataatgaaattct

SEQ ID NO: 21696 - DNA, 121 bp, Artificial Sequence
  Synthesized
  misc_feature (61): n=t or c
tatagccccagacatatttcaaccctgctggcagtctgcacacgtgttaacaggttccttncccttcccagagcaccgatggtcaggtttcctgcgcacacagttactacaaagaccgctg

SEQ ID NO: 21697 - DNA, 121 bp, Artificial Sequence
  Synthesized
  misc_feature (61): n=t or c
ttggttttcctctttattttcttactttgttacgtaccagataattactggtcaggtgatntcttatgttgctttctggttgagtatctggggatgaaagaaggtcaatctgtgtatatgt

SEQ ID NO: 21698 - DNA, 121 bp, Artificial Sequence
  Synthesized
  misc_feature (61): n=t or c
acccaaggaagacactcttacctgcattagcatgtaatagatcccagccacaccgtgggcngctccaacatactgcttcctgtgccactgatacaacagaggacaacgctcggttttacgt

SEQ ID NO: 21699 - DNA, 121 bp, Artificial Sequence
  Synthesized
  misc_feature (61): n=a or g
ctgtctctggagtacatgaaggttgaagacaaaaatgagtggaaatatacgcactatttanctatcagacatctgagtctaattctgatttactgaatgatgtaattgacgacttgctgaa

SEQ ID NO: 21700 - DNA, 121 bp, Artificial Sequence
  Synthesized
  misc_feature (61): n=a or g
catacctccactgcaagtaatctcattttaatcaggcaatcgctcagtattttaagttgtnatcacagtgagcttcaaggaccctcacacctttcctatacaataacacaccaaccagttc

SEQ ID NO: 21701 - DNA, 121 bp, Artificial Sequence
  Synthesized
  misc_feature (61): n=t or c
ctggttgcaaggggacacagcctgtgtcatggagcctaccacactgaaaggaactgtcctngctgtggccagtatagtttcgtggacacccatggctattgggctgctattacccattgtt

SEQ ID NO: 21702 - DNA, 121 bp, Artificial Sequence
  Synthesized
  misc_feature (61): n=a or g
caagctcctcctgtggcagtgggctccctgccctgcatgaaggagggctgcagcagcaggncatgcagaggtgagcactgcaggagctctggcccgttaacccaatttgcacactgaagtt

SEQ ID NO: 21703 - DNA, 121 bp, Artificial Sequence
  Synthesized
  misc_feature (61): n=c or g
ctaattccccctgagtttgcaatagaatgcagcatggacatggccaaatgcctcctggganacagccagcaaggagtgttcagccgacctcaggcactgctcacctgctgtctacacactg

SEQ ID NO: 21704 - DNA, 121 bp, Artificial Sequence
  Synthesized
  misc_feature (61): n=a or g
gcccacttcagatatcagtacttgttgagagggtaagatacatatccctcttcataaagancatgtaaagcatactgttctgattgacaaaggaaacagatactaccacccctgcaacctg

SEQ ID NO: 21705 - DNA, 121 bp, Artificial Sequence
  Synthesized
  misc_feature (61): n=a or g
ccctcactttgtacattcacctgggaaatgggtgactcagttgggtgatggctccgcatcncacttgtgctttttatgtgtttgtccattccaccactcccttgacggctgagtttctatg

SEQ ID NO: 21706 - DNA, 121 bp, Artificial Sequence
  Synthesized
  misc_feature (61): n=a or c
ctcagagtaagctcctcagataaagtaaagactagaaattactaatcaattccaagatatngtttctgaagtacaaagatgactgcagtgtcaaacacaaataccagataaggtctcttcc

SEQ ID NO: 21707 - DNA, 121 bp, Artificial Sequence
  Synthesized
  misc_feature (61): n=a or g
ttcccaaatgcaggcagcagtcacgggttggatatttgaactccactgaaaatggttcttnggcactcaggaaaggggctatctaatgaagagaggaaatgtcctccccattgcagtgaaa

SEQ ID NO: 21708 - DNA, 121 bp, Artificial Sequence
  Synthesized
  misc_feature (61): n=a or g
tctggaagtggttctctgcattccacaggtgccccagtgggaggatttgtcccttttcaangagctgtgattttcccattgggtcgccgtggccgtgcccagcgcacagtggggccaacgg

SEQ ID NO: 21709 - DNA, 121 bp, Artificial Sequence
  Synthesized
  misc_feature (61): n=a or g
aagatcccaactacatcaagctgtgcaatatgtgtgtgtcgccttggctccttctaaaggnctatatgtaccaagccattacataagcagaaaagctcctgagcaaactaagtattatcag

SEQ ID NO: 21710 - DNA, 121 bp, Artificial Sequence
  Synthesized
  misc_feature (61): n=a or c
tttgtatctttgtttggcattgttattgtactgcaaagtatctaggcagttgcttgtgccncttgaaaaggtgatgcatctggtttgtatttaaataaatatggtggggacatcatatatg

SEQ ID NO: 21711 - DNA, 121 bp, Artificial Sequence
  Synthesized
  misc_feature (61): n=t or c
ctcttgacaaaactgagaatcagagaggaatgggtattattttcccgtgtgttttattctngtgctgtctctgctactctgcatcactttctttctgtcatctttctctgattttccagtg

SEQ ID NO: 21712 - DNA, 121 bp, Artificial Sequence
  Synthesized
  misc_feature (61): n=t or g
gcaagtttttgactgcgtgtcagagaaagctgcagtacctgtaaaacatctaagctatgtnatctgaggttttactgctcccattgaatacgatgacattttatttatctccaaaagacaa

SEQ ID NO: 21713 - DNA, 121 bp, Artificial Sequence
  Synthesized
  misc_feature (61): n=t or c
ctcttgtaagctgaggtgggtctgcagcatgcctgagctcctgcccaacgaagacactggnagagctgagttgtatccaacccaacgcaggagctacctgggatggctatatcagacaccc

SEQ ID NO: 21714 - DNA, 121 bp, Artificial Sequence
  Synthesized
  misc_feature (61): n=t or g
aataatagcattgtgtactgaggacattgaattgcagaaacagagaggtgtgggaaagagnagtttagtgtagctactgctctgcgagagggtgaagcacttaatgctgtctgccctgtgt

SEQ ID NO: 21715 - DNA, 121 bp, Artificial Sequence
  Synthesized
  misc_feature (61): n=t or c
tctacttgtacccaatgagaaacctgtgtgagcagggaaaggcgtctaggctgcagcacangctgctgtaatcaaaaaggtgaaaagaaaaggctgtagaagaaagcatgtaattggagat

SEQ ID NO: 21716 - DNA, 121 bp, Artificial Sequence
  Synthesized
  misc_feature (61): n=a or g
attcccagctccctcagaggctgaaatgaaaggtgtccttgggaaaaaataattcttcacnaacgctattgactgctttataaacagaaagccttgcttgtgctgtgacgtgtgtcactgt

SEQ ID NO: 21717 - DNA, 121 bp, Artificial Sequence
  Synthesized
  misc_feature (61): n=a or g
ctcctcattttctcaaatttcttcaattgctgcaactctgatttcctcagtgctggatccntccagccctcctgtatgcggaaagttattctgagagagaggaatgggcaaactcaggctt

SEQ ID NO: 21718 - DNA, 121 bp, Artificial Sequence
  Synthesized
  misc_feature (61): n=a or g
tcgtataaaatgggaagcagcaaatactccggaaaagcagctatctatactccaccagtgntaataactgcggtgactgtgcaaatctcattggaaggtcagggtatcaaagcagatggaa

SEQ ID NO: 21719 - DNA, 121 bp, Artificial Sequence
  Synthesized
  misc_feature (61): n=a or c
cttactgactgtctcccagcaggtgtaggagttctggtaccttctaaacaggtcagtgcanttggtagaaccagaaagcacctgagtcagtgtgtgctcaggggaatgggggctgtttttc

SEQ ID NO: 21720 - DNA, 121 bp, Artificial Sequence
  Synthesized
  misc_feature (61): n=t or c
agaacaactttggaaaaacaagtctcggtattcagaagtacctgcggcagcgtttaactgngtgtgggtgttaatttgcttcataatgcaacgtgggaaatcataaactcattcacagatc

SEQ ID NO: 21721 - DNA, 121 bp, Artificial Sequence
  Synthesized
  misc_feature (61): n=t or c
attttgttacagctctttgtttgtttgtttccagattaggttatattcttttctaaagacnattttggcaggtgcctaggtgacagttttggatataatttccagtttctaaggcgctaaa

SEQ ID NO: 21722 - DNA, 121 bp, Artificial Sequence
  Synthesized
  misc_feature (61): n=t or c
cattctctgcggggctgccctaagtggtttaagcatagcaaggtctgcctgaagcatcagngtagtctttctggccttccattcgcattttgagatctgttttcagcttaccaggactatc

SEQ ID NO: 21723 - DNA, 121 bp, Artificial Sequence
  Synthesized
  misc_feature (61): n=a or g
tgttctgtcagctgcagggaaaccacctaaactttaagccagtgtatataatttaataagngttttggaatccctcgtcaacatggtttacaaatgcagccttctcagcagtctattgcta

SEQ ID NO: 21724 - DNA, 121 bp, Artificial Sequence
  Synthesized
  misc_feature (61): n=c or g
attgtgtaactaagcattgttttctcgtggtggttgtatgctgctagaaaagaagaaatgnacatcccattactgagtgtgtacctgggcatttcaaaatctgttttgcaatgtaccttgt

SEQ ID NO: 21725 - DNA, 121 bp, Artificial Sequence
  Synthesized
  misc_feature (61): n=t or c
agccctatgataaatcagtgtgaggtgatctttcctcattttgttgcttctacttcatgtnatactgccttctggaagtgactgtcctaaatcttgaagcccaaggtcttcgtattgtgtt

SEQ ID NO: 21726 - DNA, 121 bp, Artificial Sequence
  Synthesized
  misc_feature (61): n=t or c
tttgtctctgttgaacttcatatttccgtcagcacatttcctcagcttatccatgtgccantgtattggagccctgctctccagcaagataagtcttttacatctgttggacagcaagccc

SEQ ID NO: 21727 - DNA, 121 bp, Artificial Sequence
  Synthesized
  misc_feature (61): n=a or g
ttctgaattcaagactttttaacatgctacataagtttacaaaggctgaattgcaccagcnttttaaagggaagtacagaaacggaagttgaagaagtctaactaacacccctctgtcttt

SEQ ID NO: 21728 - DNA, 121 bp, Artificial Sequence
  Synthesized
  misc_feature (61): n=t or g
tgtgcagcattgctggtgccgagcctgagtttatacagtcctttgtgcatttctaaccaantatatatgtaatggaagccagttctctttggaaagcaggaagtctttatgaagcggtaag

SEQ ID NO: 21729 - DNA, 121 bp, Artificial Sequence
  Synthesized
  misc_feature (61): n=t or c
cagaagtgcttctatgtaaaattctgcttcaggactagttattgctcaagtttgaataganagactcttcagcttcctttaactggattcagctcagggtgtgaagaaagtcccctcccag

SEQ ID NO: 21730 - DNA, 121 bp, Artificial Sequence
  Synthesized
  misc_feature (61): n=a or t
gatttgggcacagtatcctctgtaggctgaagaaatcaaacttctgtttgccatctcaggnatatttgcttaaccactgtattgttggctagtctggatcaggaactgtttgcctatcatt

SEQ ID NO: 21731 - DNA, 121 bp, Artificial Sequence
  Synthesized
  misc_feature (61): n=t or c
tagcattgctccagatcgccatctattttctgctcattcctgaagcaagtgggaacagtantttaaagccaaatgaaacaagctgtaatgcaaaagcaaaagatggctgcccattttaaaa

SEQ ID NO: 21732 - DNA, 121 bp, Artificial Sequence
  Synthesized
  misc_feature (61): n=a or g
tgcattaaggatgataccaatgtagtggtttctgttagtaggaaatatttctgagctccantcacacttagcagtcgggctggagtttgggaaagagaaagccttgagggacaaaaagcat

SEQ ID NO: 21733 - DNA, 121 bp, Artificial Sequence
  Synthesized
  misc_feature (61): n=t or c
aggttcatctgaaagtaacagcacatcaatactgtagtcatggtgttctgaagaacagcangtttgaaactggacatagccagctacttttatttcagcaatatttcttattttagaagaa

SEQ ID NO: 21734 - DNA, 121 bp, Artificial Sequence
  Synthesized
  misc_feature (61): n=a or g
tggttctgaaggaaaccctacagctcagcaagcttctggggaaaccaaggaagtataaacnctattaaatctgtctcaaccctagttcaagtcaagaggagggggagtggaaaaataagca

SEQ ID NO: 21735 - DNA, 121 bp, Artificial Sequence
  Synthesized
  misc_feature (61): n=t or c
tatttttagcaggccacaggggaatcctgttccccgtacatatctgcctatatgggtagcnaccttagttttgctccctgttcatattgacgtgcgttccccagtttctaggcagatctct

SEQ ID NO: 21736 - DNA, 121 bp, Artificial Sequence
  Synthesized
  misc_feature (61): n=a or g
cacttaaagagcagcgtcatctcttccccagagcacagcacacaagctcagaaaaccaccnagattttccccctcaaataaaaccccaagtgcagactgatgacaacagcttgcagtgcaa

SEQ ID NO: 21737 - DNA, 121 bp, Artificial Sequence
  Synthesized
  misc_feature (61): n=t or g
gcatgatagggttagttctctaaccctatgtgcattactaggatgcgtacaagatgtatanagatcaatatatatgatcgatcagtaagctcaagaggacaaaaccacagagataggacta

SEQ ID NO: 21738 - DNA, 121 bp, Artificial Sequence
  Synthesized
  misc_feature (61): n=a or g
tgacggttcagggcttaatccaatctttagtccttttattaataaaaacaaggataaggcngggatctcaattctatgacccagattgtcagtgaaagtagaatctcttcattctcagaaa

SEQ ID NO: 21739 - DNA, 121 bp, Artificial Sequence
  Synthesized
  misc_feature (61): n=t or c
tgtctgggcctctggacaagtaagtaatcatgagagagtatgaaaggcataatgttttctncccaacacataagcaattctaagctttcattctgttgttgttgcttttaataagttcaac

SEQ ID NO: 21740 - DNA, 121 bp, Artificial Sequence
  Synthesized
  misc_feature (61): n=a or g
ctgagatctatagcagaatttcatagcagatagcaattaatttactgactggagctgtacngatagtatttgtgtgaatccttcagcttaaggcaaatactttgaagctgactgtttcctg

SEQ ID NO: 21741 - DNA, 121 bp, Artificial Sequence
  Synthesized
  misc_feature (61): n=t or c
tacaggagtgccagtgtcctcttttggggtagatcagctgctgaagccccaggtctgtaanaacctcacactgaactgcctggaagcttctggaaacctgctctgtgatgggttactgaag

SEQ ID NO: 21742 - DNA, 121 bp, Artificial Sequence
  Synthesized
  misc_feature (61): n=t or c
ggaaggattcatccagaatagagtgagtccttgcacaccccaatgccagtgttaagtgganaaagtcgtgtccaggacattggttgtgatccagcagtgtatgggtgtatttgtgtggcac

SEQ ID NO: 21743 - DNA, 121 bp, Artificial Sequence
  Synthesized
  misc_feature (61): n=a or c
tttaaaggatgtcaggcaaaacatgattgtaggtctggttcttcaaacttacctaggtggnctccaccgtgtggtctggctggcccttttcagtggatcctctgaggttctgaatgctctg

SEQ ID NO: 21744 - DNA, 121 bp, Artificial Sequence
  Synthesized
  misc_feature (61): n=t or c
cgtccttgaagtcttcccttcaataaaacatgacatctccagcagatcaggggtcaggtgnctgagaagttcccactccaccttgcacagttacaagccaccaggccagtggccctgcaac

SEQ ID NO: 21745 - DNA, 121 bp, Artificial Sequence
  Synthesized
  misc_feature (61): n=t or c
gttttttattaactatattactagctaaacaacaacaacgctgcatacagccgatggcaangtggaccttctgtgtgtttcattaaaaatggtaacagttgataacagttcagtgagttac

SEQ ID NO: 21746 - DNA, 121 bp, Artificial Sequence
  Synthesized
  misc_feature (61): n=a or g
tttctgttagaagttacttaaacatcccaaatttgttcttcttacagcagttgttcagagnggctttcaggcaataggtgcctctgactttgcagtgcaaataaataaatactctgtttcc

SEQ ID NO: 21747 - DNA, 121 bp, Artificial Sequence
  Synthesized
  misc_feature (61): n=a or g
accatcatcttcttcctgttctgcaggatcagatttccctgcctggtaaaatctttgggtnctgactcaagctagtctgtgggcatcacatgcaggcagcagaggtaagtgagagtttggg

SEQ ID NO: 21748 - DNA, 121 bp, Artificial Sequence
  Synthesized
  misc_feature (61): n=t or c
tagcacagtgcagtgattttcagttgcacacagtacaggggagggagtgttctccaatgcngaatgagggattgtggatctgaaagcttctccatcttctccttacatcattgcaataaag

SEQ ID NO: 21749 - DNA, 121 bp, Artificial Sequence
  Synthesized
  misc_feature (61): n=a or g
gtgtgaatacaggtccctgcagtcctctgtgacaacaaatgcaggcttagggaaccagaangagggagtcaaggctgaaaacaagtgtcagagaaaagtaggcttagatttggtacatctc

SEQ ID NO: 21750 - DNA, 121 bp, Artificial Sequence
  Synthesized
  misc_feature (61): n=t or c
ggtattccctgttaatgagcaaaaatgcatgcgcttccaaagctcgcacatttctccttcncatagggaagcttctgaaaaactcttttccacacgctctagcagcagcttcataaaggaa

SEQ ID NO: 21751 - DNA, 121 bp, Artificial Sequence
  Synthesized
  misc_feature (61): n=t or c
tctatcttccagctttttatggtgactccttcctctgtaaagggctcagcagtttctgagnttgacaacatgaggaattccacactgactgtgcaaagactcttctctactaattttctga

SEQ ID NO: 21752 - DNA, 121 bp, Artificial Sequence
  Synthesized
  misc_feature (61): n=a or g
acagggagtttgtttgtaacttcaggtgtatatatgtacatgctccagcttgactgaggtnaggaacattccaccagtgtctgagatacagctctgccaggatactggttgcctatttatt

SEQ ID NO: 21753 - DNA, 121 bp, Artificial Sequence
  Synthesized
  misc_feature (61): n=t or c
acaactaatcatagtctgctacactgagatcttgatatggggcacagcagagcaaaaccanggcatttttctgacataaaagaaacgggtgttgggagagttttcctatctgctgctccca

SEQ ID NO: 21754 - DNA, 121 bp, Artificial Sequence
  Synthesized
  misc_feature (61): n=a or g
agctcaggactttcctaacctcactgctcggggagcacagcaagttcctaatgcaccagtngttcctggaccagcatttctcagtactactcagggcacaccatcactgagccccaaacac

SEQ ID NO: 21755 - DNA, 121 bp, Artificial Sequence
  Synthesized
  misc_feature (61): n=t or c
ccataatcatcagcttctgaaggagtgcaatttaggtagcaagttgatcacatttgtaacnttggtcagcccaactatggcatgcacaaacagatgggataaagattggttacacattcca

SEQ ID NO: 21756 - DNA, 121 bp, Artificial Sequence
  Synthesized
  misc_feature (61): n=a or g
aaataaatcccaaattgacgtcatttgtctgtgctatggaacactgtttatgttgaatcangtttactgttttgttagcatggaaagcaacctgaatggtccaggtgcagaagcctgaagc

SEQ ID NO: 21757 - DNA, 121 bp, Artificial Sequence
  Synthesized
  misc_feature (61): n=a or g
agagctctgcaatcacatgcagttccagcaatatctcactaaggacacaagcacaaggtanaagttatagctagaggctggcaaaacatctggaactgacttgtttataacttcattgaaa

SEQ ID NO: 21758 - DNA, 121 bp, Artificial Sequence
  Synthesized
  misc_feature (61): n=a or g
actctctgtataatgacgtgccctaggaatccctacaacagcatttttttcatgtttatcnaggtgagctccttccccatggctgtctctgttgcatttcagccaggagctaacatggcag

SEQ ID NO: 21759 - DNA, 121 bp, Artificial Sequence
  Synthesized
  misc_feature (61): n=a or g
aagaagaagagaaagctgttaattccattctgctcaggaacaactctatcagctggagcantgtgccatttgggtgtcatctttcagagttatgtagacaaatttaggaaacttataaagc

SEQ ID NO: 21760 - DNA, 121 bp, Artificial Sequence
  Synthesized
  misc_feature (61): n=a or g
gtatgcaatattaaattcttttagcatcaattagtttaataccaaacaatctgttcatccnctctcagctcccaccagtagagctaaagcattgcagacttccacatgatgctatcttcct

SEQ ID NO: 21761 - DNA, 121 bp, Artificial Sequence
  Synthesized
  misc_feature (61): n=a or g
gttttcccttttcaccttgagatagcaaacatttatttttaaggagttggtggaatttcantaatttccctatacgttaatcaattacttggttcatctgttactatctttgttgaaggtt

SEQ ID NO: 21762 - DNA, 121 bp, Artificial Sequence
  Synthesized
  misc_feature (61): n=t or g
ggacaagggctctcaaactgcagaagcgttagaaggatgtttgaaattgtaattctttcangcaattgtttagtgtggacatgaaacagtttttatgcgtttatcagtaattaggcactga

SEQ ID NO: 21763 - DNA, 121 bp, Artificial Sequence
  Synthesized
  misc_feature (61): n=t or c
tttatggtggggatttccaccttctataatgtaagaatcttgtagatggcgtttgatccanttcagttaatataaaatagaaacctcccggcaagagattcttttgatataagttgttgtg

SEQ ID NO: 21764 - DNA, 121 bp, Artificial Sequence
  Synthesized
  misc_feature (61): n=a or g
tgggtcttggtcatggagcttggccatgggtcttggtcatggtcttggccatggagcttgnctataggccttggctgtagcgttaggctgtgggtcttggccatggggctcagccgtggtg

SEQ ID NO: 21765 - DNA, 121 bp, Artificial Sequence
  Synthesized
  misc_feature (61): n=a or c
aggaaaaaaacttgagtctagttcagatcaaaaatagaacttgtttgcaacataggatgtnattacttactgaggcacctttattggggatattacaattgaggtctgtgaagtcagcttt

SEQ ID NO: 21766 - DNA, 121 bp, Artificial Sequence
  Synthesized
  misc_feature (61): n=t or c
gaaattatttttccaactgagaagtgtcttggcaacatattatgagcatgaacctagctangcactgagtacatctctaccttcagtactaatgaagtgctgttgtccatcttgatgttct

SEQ ID NO: 21767 - DNA, 121 bp, Artificial Sequence
  Synthesized
  misc_feature (61): n=a or c
cagttcatatgtaccaaagagtacattcttacaacacattcaagtccattcccgctcttancaaaagctacatctaagccagaaggtcttcactatgaacgaatcccaagtaaaacttttt

SEQ ID NO: 21768 - DNA, 121 bp, Artificial Sequence
  Synthesized
  misc_feature (61): n=a or g
ggtgatgagatggtccttgccattcttggcctccaaagtactgtgacaaataaaaaggtcnctgtgaggccttactgtctcttatgtgggacacctcaaactttgcaaacaggtgttgtgt

SEQ ID NO: 21769 - DNA, 121 bp, Artificial Sequence
  Synthesized
  misc_feature (61): n=t or c
aaccacagatgtgctcgagtgcagcaagatgagcaaacactacagattatgctgaagactnggtttaaactgaggcaaagattcaggcaaactagcaaaggtgaactcagaaaaaaacctc

SEQ ID NO: 21770 - DNA, 121 bp, Artificial Sequence
  Synthesized
  misc_feature (61): n=t or c
atccatcagggtggggtttctttccctttgctgacacataactcatccttaacctaatatnaccatggcacctaaactgtgcttctgagatctttttaacttaaaaagagacaaaagtagc

SEQ ID NO: 21771 - DNA, 121 bp, Artificial Sequence
  Synthesized
  misc_feature (61): n=a or g
gttgctgctggcctgaggcagttgcacagctgcttctctcattgggtcagtttaagatgangataaataataagataacccaagacatcctttttaaccaatggttgagttttggggggct

SEQ ID NO: 21772 - DNA, 121 bp, Artificial Sequence
  Synthesized
  misc_feature (61): n=a or t
ataatgtcaaaattgtagataacagaatgttatttgacttcacaccagaaacaaactacangaactagctgaatagaaaaatacatagatgctaaactgtttacaattgcctgactgatac

SEQ ID NO: 21773 - DNA, 121 bp, Artificial Sequence
  Synthesized
  misc_feature (61): n=t or c
cttcagaagattataagatcataagatgggctgagacctacatgcttctgccctcttgatntctctcatgagaaattagacttcagtttctggtgacaaagaaaaaattaaaggccaatct

SEQ ID NO: 21774 - DNA, 121 bp, Artificial Sequence
  Synthesized
  misc_feature (61): n=t or c
cagtgaaatttactgaataaaattactccttactcagaggggtggctctagcagtaacaanacataatcccttctcaataatactggatttttcccttccctttccctttctctatccctt

SEQ ID NO: 21775 - DNA, 121 bp, Artificial Sequence
  Synthesized
  misc_feature (61): n=a or g
gaagttgccttgcagtggagatgcctttttgctccgtgaaacatctccttgggtggactcnaactcaagtgagatcctccagcagcaccttttacctgctggtctatttgttcctgtgctg

SEQ ID NO: 21776 - DNA, 121 bp, Artificial Sequence
  Synthesized
  misc_feature (61): n=t or c
tcagctctctgtctcgcctgaccaagaccagttttgggtcctttgaggtgagagctttgtncctgtgggaccaggacatcccctttcattcactgccctccctcctgcccttctcgcagct

SEQ ID NO: 21777 - DNA, 121 bp, Artificial Sequence
  Synthesized
  misc_feature (61): n=t or c
tcttctaactccacatttccatcttctgctgcctcatcctcatcctgcttagcttcctcanttccttctacagcatctccttcaggattctcatctgcctcagagccatcaacatctttgc

SEQ ID NO: 21778 - DNA, 121 bp, Artificial Sequence
  Synthesized
  misc_feature (61): n=t or c
aaatttctcaggcttatcctgtggtctgaatttccttatatggaattcagatttccatatnctttggactctgaatcctttggagtttatttgaagctgacattcaaagccaaactgtggc

SEQ ID NO: 21779 - DNA, 121 bp, Artificial Sequence
  Synthesized
  misc_feature (61): n=a or c
aaacttgaaacagctttagaagaacagcttcaaacaggtcagtaaatgctgaactcatttnacttacatctgtctttcagtcttacgaaactaaccaatttctagctgactaaacccaaga

SEQ ID NO: 21780 - DNA, 121 bp, Artificial Sequence
  Synthesized
  misc_feature (61): n=a or c
aaaatgtagagaacaggtatttagagcagaatgaagagatctgagaaggaagatataagtnataaggaagtttgagttctgttgatggaaatctgagagaaaagccacaaaactttgtcaa

SEQ ID NO: 21781 - DNA, 121 bp, Artificial Sequence
  Synthesized
  misc_feature (61): n=t or g
tccataacagaggccacaataagtcagtgactagctgctctggcagctttgctgcccaacncacaaaatgagatttgttttgtgatttttgtgatcccagattcacctgaaaggccaaaca

SEQ ID NO: 21782 - DNA, 121 bp, Artificial Sequence
  Synthesized
  misc_feature (61): n=t or c
atgcaatacaaatgctcaaacaccagcagtaatgaagaggatgacctctgatcaactgctngctctgctcttgggatgctatataaattagttgccaatgacttgctaaagtcttactaag

SEQ ID NO: 21783 - DNA, 121 bp, Artificial Sequence
  Synthesized
  misc_feature (61): n=a or g
attaccaacaacagtggggattttccttcatccaggctcagaggtctgatcgttttctgcntaactgaataaaaatattatcctccccatgaaaatagccccacagtctcctgtatgaagc

SEQ ID NO: 21784 - DNA, 121 bp, Artificial Sequence
  Synthesized
  misc_feature (61): n=t or c
ccaaggtctggattgctcacattgttaaaaaggcagtttggcaccacagatcctgctagtngtgccagaaataactcatcacaaattacaactcatactggaagcaataccttaatatttt

SEQ ID NO: 21785 - DNA, 121 bp, Artificial Sequence
  Synthesized
  misc_feature (61): n=a or g
aaaattctgtttccagatgttcttcccactgtgctctgtgaaaagtgaaagatcctctgtntccttaaatgcaacactgccatgatcatcatgtgagctgctggaaaaaaaaaaaaaaaaa

SEQ ID NO: 21786 - DNA, 121 bp, Artificial Sequence
  Synthesized
  misc_feature (61): n=a or g
gcccacttttgctggagagatgctgaagcaatagatttagcaaggggaggaaacaaaacanaacaactacaaactgctcgtggccactgtgtcatcagtcccacgtcgcagaacccaggga

SEQ ID NO: 21787 - DNA, 121 bp, Artificial Sequence
  Synthesized
  misc_feature (61): n=a or g
caataaaatcagtgagaatggagagtatacaaacgtgtatagaactgaacctgtagaaccnaactttcaccttattattcttctccttagatagaagtcatgatttgtccaaggtcctggt

SEQ ID NO: 21788 - DNA, 121 bp, Artificial Sequence
  Synthesized
  misc_feature (61): n=a or t
aggaatggagctcacaagccaatcttcaagcacctgttctttataacgtgcatggagagantcagatgtccgagcatgagaaccatgcagaaatgtttaagccagctcaagctggagccga

SEQ ID NO: 21789 - DNA, 121 bp, Artificial Sequence
  Synthesized
  misc_feature (61): n=t or g
gctggagaagaatcccaggggttataggtacccaactctgaagcaacaaggttggcatacngcagataatatatgaaagcaaatttgactgagaagataggcttgatgaattgctgcaaga

SEQ ID NO: 21790 - DNA, 121 bp, Artificial Sequence
  Synthesized
  misc_feature (61): n=a or c
attcttttaagttacacagtacagcaatgtataaaagaaaacttttgttaccgtatactgnactacagttcccatttagcttcgagtttaccactagatgacactacttcccgcttactga

SEQ ID NO: 21791 - DNA, 121 bp, Artificial Sequence
  Synthesized
  misc_feature (61): n=a or t
tccagtgttcatttccacagcatcctcttaaaaggacagcttatcctttgctaactacacntaagagagctgctaacagctcgtatgattttttctaacgtatgttttaactaaatgccac

SEQ ID NO: 21792 - DNA, 121 bp, Artificial Sequence
  Synthesized
  misc_feature (61): n=t or c
gtccagaaggaggcagtgtcattgcatcttgagtgtagctgaaatccagcacaggctgagngtctggaagtcattctcccaactgcagttgtaggataaggtcttaatagcatccatcctg

SEQ ID NO: 21793 - DNA, 121 bp, Artificial Sequence
  Synthesized
  misc_feature (61): n=a or g
cagtgacattccttgaagcaatgcacccaagcgtgcagctgggtggagatggggagcaaanctcgccctatccatagccccaaaatgccactgtgtttcgcacccctgagtccaaagcact

SEQ ID NO: 21794 - DNA, 121 bp, Artificial Sequence
  Synthesized
  misc_feature (61): n=a or g
acaagcaaaaggaaaccaaccctccagcagggaaggacaagagcatgtacaattctccacncccctttcaagacggacaacacttaaaaccttaagcattcttcttcaaccaagtaaacca

SEQ ID NO: 21795 - DNA, 121 bp, Artificial Sequence
  Synthesized
  misc_feature (61): n=t or c
tgtaataagcaacaaaaaaatgaagcaaatacttaaatccaagaggaaaatctggttgtcngggaataaaggaaaaagtaacagtaaattcctttttcttaacttggaagtcaaaaatttt

SEQ ID NO: 21796 - DNA, 121 bp, Artificial Sequence
  Synthesized
  misc_feature (61): n=a or g
agatattatcacttcataatctcaagcattagtcaccctcagcaactatcataaaagacantgcactagtttcagtcttcttttacatcccagaacaaaaaatgggaaaataaaataaata

SEQ ID NO: 21797 - DNA, 121 bp, Artificial Sequence
  Synthesized
  misc_feature (61): n=t or c
agtagaatataagaaagaaaaagtgtttaatccacaaaatgatttcccatccaaattccanattttacgtatttttgtattttaaatgtatttcttcagctatttttcttattttaaaatg

SEQ ID NO: 21798 - DNA, 121 bp, Artificial Sequence
  Synthesized
  misc_feature (61): n=a or g
tattgtttctgcttttatggattcatcactcttttacaagccagtgcaatctatatccccntaagatcataaggcaaggatcaggaatcatccagaaaacctcctgcagaatattttctgt

SEQ ID NO: 21799 - DNA, 121 bp, Artificial Sequence
  Synthesized
  misc_feature (61): n=c or g
tgttttggttttaactcaagagagctgtccttacaagcttcctccttccctatcttggaantgaaaccaggattaagatatttctagcttcctgatttttattttttgtcttatatgtatg

SEQ ID NO: 21800 - DNA, 121 bp, Artificial Sequence
  Synthesized
  misc_feature (61): n=a or g
caggagattgctaggcatgacaaggaagtatatctattcctcaaggtaagcgtatgttcantaagtgaattacaagagatttatttttgtattatgtgtgacactacaattgggtgtgaga

SEQ ID NO: 21801 - DNA, 121 bp, Artificial Sequence
  Synthesized
  misc_feature (61): n=t or g
agctgggactggtgggaaactatcctctcaggtgtgtggctgagatttgcccctcatgctntttttactcatcacaactgtattttcatcaattgtttagcacacaaatttagagagaaga

SEQ ID NO: 21802 - DNA, 121 bp, Artificial Sequence
  Synthesized
  misc_feature (61): n=t or c
tacttccagcagctgtgcaagccctccagtgtacagtgaaagcaagtaaaggcaaacaaanattataaacacagtcttatgaataaacatgcctcagagaagtagagaaaagcttgaagct

SEQ ID NO: 21803 - DNA, 121 bp, Artificial Sequence
  Synthesized
  misc_feature (61): n=t or c
ttttaatcccaaatctttaattcagagacaagatataattagtcatgtacttgcacaaaantgaagaaaaggtagccaaagaacctcctatttaacctgactgggttacggttgatcataa

SEQ ID NO: 21804 - DNA, 121 bp, Artificial Sequence
  Synthesized
  misc_feature (61): n=a or c
gaactgacactgaacatcagtgactcagaacgggaaaatggtgcaattctctctaaaaagnaaaggcacggggagaaactgccagaactggagagtgaaagatctggattagtctagaaac

SEQ ID NO: 21805 - DNA, 121 bp, Artificial Sequence
  Synthesized
  misc_feature (61): n=a or g
aattgccttttttttttttttggttgagtagctgttttacaatgctgttctacaataagcngcagtttaatcactgatgaatgagcatcctagcattcatataattgtctttgattctatc

SEQ ID NO: 21806 - DNA, 121 bp, Artificial Sequence
  Synthesized
  misc_feature (61): n=a or g
ttgcattggtcttaatctttatttttttccttctgctgttgactaagccctaatctctcanagcttcttgctttgctcatttactagtttaagtattaatgagcgttgttttactgtcagt

SEQ ID NO: 21807 - DNA, 121 bp, Artificial Sequence
  Synthesized
  misc_feature (61): n=t or c
tgacatctgtagagatgctgaggacatcgctggcattggcatatggtgctgtgggcaggcnggggcttgcatctctgccttgctctgtctgcattgtgctctctgccttgtgcccagcatg

SEQ ID NO: 21808 - DNA, 121 bp, Artificial Sequence
  Synthesized
  misc_feature (61): n=c or g
aggaaatccagccttttccccccaagtctggcctctcattcaccgtctcctcccttcatcncacaggtgaaggccaatgactcggaccagggtgccaatgccgagatcgactactccttcc

SEQ ID NO: 21809 - DNA, 121 bp, Artificial Sequence
  Synthesized
  misc_feature (61): n=c or g
taatcattagtgtgaagatttacattactgcaggtaactgacagcctgcaaagcaaaattnatgtccttatctattcaaaatcacttctaatttttatgacacaaaatatacaatcattga

SEQ ID NO: 21810 - DNA, 121 bp, Artificial Sequence
  Synthesized
  misc_feature (61): n=a or g
tcaccctccaatctgcttcttgagcttggcacacaggaacagatcagtaaaaagaaagacntgacgtagtttgcgagccccctcaacgagctccaccatgaagctgtccttcaggagctgc

SEQ ID NO: 21811 - DNA, 121 bp, Artificial Sequence
  Synthesized
  misc_feature (61): n=t or c
ttttattaagaactccttagacaactacatgtaagcagagtacagactacatggtcattantgagacatataacctggagcacaagactggagggtcagtgctaataacacatgccaattt

SEQ ID NO: 21812 - DNA, 121 bp, Artificial Sequence
  Synthesized
  misc_feature (61): n=t or g
gatgggagtgctacaatccattgtgtttttgtttgtctattctgtgtccacgccagttttngggccatttatgtcactccataaatgttatgtaagacattatgacattattcattcattc

SEQ ID NO: 21813 - DNA, 121 bp, Artificial Sequence
  Synthesized
  misc_feature (61): n=a or g
tagtttaaatgaaaatgataaaggaaaggtgagttttgattcttcttgtaatgtcactggntaatactgtttgtcaagctcctgcattatcattctgtgctgaaacaacaaagcccatgga

SEQ ID NO: 21814 - DNA, 121 bp, Artificial Sequence
  Synthesized
  misc_feature (61): n=a or g
aagagggtcaggagctgacaggacatacgaagggccaggcacagggcgttacttacggtanagggatcatgatgaccacgtcgttcagttctaggctctcctcctgcaactcgtattcaat

SEQ ID NO: 21815 - DNA, 121 bp, Artificial Sequence
  Synthesized
  misc_feature (61): n=a or c
ggaaacaaaataaaaagaaacgtcccagatcggtgtattctccatctggtatgttcccagnttcctaaagagatataacacgatgtcaagaaaaaggatgctgtaattagcctggtgcgtg

SEQ ID NO: 21816 - DNA, 121 bp, Artificial Sequence
  Synthesized
  misc_feature (61): n=t or c
atctgtcaaggagctagctatcatcatacaacacagcttgtttcttttacctgacagcttntaccggacaaaatttttttttcagaaagaaattaagtcaaaaaggagccttcaaatacat

SEQ ID NO: 21817 - DNA, 121 bp, Artificial Sequence
  Synthesized
  misc_feature (61): n=a or g
aggaagagagaaggcacagaaaaaaatcaccagaaattcctccagaaaattgcttcttatnctgtcctctagattggcttaaccctgaagtgcaggttgacctgaattcagctatgagaaa

SEQ ID NO: 21818 - DNA, 121 bp, Artificial Sequence
  Synthesized
  misc_feature (61): n=a or g
ggcttttacagaagtatcctcttgggaactggccgccacagctgggctcagtagccttccnatacatttcgtgctgtgaattgcagcaatatctgagaatttgtgtcaggaactgcagagc

SEQ ID NO: 21819 - DNA, 121 bp, Artificial Sequence
  Synthesized
  misc_feature (61): n=a or c
cagttattctatagactaagcacagcctggttccccttctgactggtatctttagacttantactatgaaaaaatacttaagtagtcacaaaaactgagcagaaaacctactgatataatt

SEQ ID NO: 21820 - DNA, 121 bp, Artificial Sequence
  Synthesized
  misc_feature (61): n=t or g
tgctctctcaggaaaataattctctgcagaacacagtcatcaaaaattgtacctacatctncagttgagtaccagctccaatgtgttctgaagttcaacctaccttcgataatggaaactc

SEQ ID NO: 21821 - DNA, 121 bp, Artificial Sequence
  Synthesized
  misc_feature (61): n=t or g
gttccctatcttctgtggaaactcccttgttaaactttaagaaggtacagtgttgcatggnttcaaaattcagaatggatatgacaaactagttgagaaatagaagagcaaacttcaaata

SEQ ID NO: 21822 - DNA, 121 bp, Artificial Sequence
  Synthesized
  misc_feature (61): n=t or c
aggaagaagtactgtttcatactaaacattactccttcactttcttcagacagatggaatngaacccctgtgaaaatggctctataaaagcagaaaataaccagcaagagcaaacccttat

SEQ ID NO: 21823 - DNA, 121 bp, Artificial Sequence
  Synthesized
  misc_feature (61): n=t or c
tttgaaattcatactgactgctgtaagagctctaatgggagctgtgcacttttgaaaacangatcatttaatatggagaacttttgattgctgatctccataattcagtggtctacctatc

SEQ ID NO: 21824 - DNA, 121 bp, Artificial Sequence
  Synthesized
  misc_feature (61): n=a or g
tagaagctaatgaagcacatagctgtaagaaactgatgtctaaaaacaggtggtcaaaganggcagtgatccctgcaccccatgagtaagggaaggactgcagtatgattttaccattgag

SEQ ID NO: 21825 - DNA, 121 bp, Artificial Sequence
  Synthesized
  misc_feature (61): n=t or c
agagcatgatctgcagattttaattgctccttgccatctacagtctcctcttccatctatnatctactgtcatctacatattttcataccaaaatgaataaactttaattcgactggtaaa

SEQ ID NO: 21826 - DNA, 121 bp, Artificial Sequence
  Synthesized
  misc_feature (61): n=a or t
caaaacatggtgaacaacaagaggagggaagtgagaaagcaactaatgattccaaacatcnctgcagaagtctcctggaaagagagaatagttcaccacttactggttcaaatgtcaaata

SEQ ID NO: 21827 - DNA, 121 bp, Artificial Sequence
  Synthesized
  misc_feature (61): n=t or c
tatagagtttgaagaactgttattttctcagccaagaaagagagcaccatcattgctcttntcttcctattttggtatgttcttaggacaccggaaaggctaataagatattcggtgtcta

SEQ ID NO: 21828 - DNA, 121 bp, Artificial Sequence
  Synthesized
  misc_feature (61): n=a or g
aatacacagtatgtggaaaataataatgtgacagtaaattcaagctttttctttcttgatngagaatttaccatgtagatctcagaatctaatttccagattttttgcagttttaactatg

SEQ ID NO: 21829 - DNA, 121 bp, Artificial Sequence
  Synthesized
  misc_feature (61): n=a or c
agcctgaccaggatcaggtggaggatggttgaaaaggaagaagaacgaccagtaatagggntctatagcacctccgtccgtaaagagtatgaccaattttcagctctcagaagctaaagca

SEQ ID NO: 21830 - DNA, 121 bp, Artificial Sequence
  Synthesized
  misc_feature (61): n=t or g
acagcacagcaacttgccgtgacctgtagccaacaaaagagaatccaggcagcaatcattncagaacgcagagcaagagcacaacccggagccgaacacgcccggtatttttagagcttga

SEQ ID NO: 21831 - DNA, 121 bp, Artificial Sequence
  Synthesized
  misc_feature (61): n=a or g
ttggaatacagatatccggggatttctgatccagatatatgatttaatcaacacacacacncacaaattcaaacaggactcacctgatagcacaccctgacccagaaaatgattaattgct

SEQ ID NO: 21832 - DNA, 121 bp, Artificial Sequence
  Synthesized
  misc_feature (61): n=t or c
ggacccaataatccattgcctgcctctttgcatgatcatgtatagccatgtgagaaggtanataatattaccatggtataaagtcatttaatctctgatatgcatgtgtgacaaagattac

SEQ ID NO: 21833 - DNA, 121 bp, Artificial Sequence
  Synthesized
  misc_feature (61): n=a or g
ttgtttcatctgtttttaaaacaaatcttctgttcagtatgccccataggaatggataatnactctgacctattcaggaacactctggttgttaaagcgttgggaagttctaaactggcac

SEQ ID NO: 21834 - DNA, 121 bp, Artificial Sequence
  Synthesized
  misc_feature (61): n=t or c
tgcatttaaagttcactgtacactttcagtgttttattttagagttctattatattcaacnttcagaggtgatacattatcttcaaacacagaagtaaaagacaagtaatatctgcatgcc

SEQ ID NO: 21835 - DNA, 121 bp, Artificial Sequence
  Synthesized
  misc_feature (61): n=a or g
ttgttattttagttaaaaatatattcacctgacttggatgtctctatactatcatacactntaattcttcaaatcaggcccagagctttcttttaagatcatgtggactgtattaattata

SEQ ID NO: 21836 - DNA, 121 bp, Artificial Sequence
  Synthesized
  misc_feature (61): n=a or g
ctctgcatggagaaggactgcgtatagagagagtgtgcagagctcacaccaccttgcagcnctgccccacacctcatggagatgccagcaggagccccaggggcggtgatcccatcacacc

SEQ ID NO: 21837 - DNA, 121 bp, Artificial Sequence
  Synthesized
  misc_feature (61): n=a or g
ggcagagagcgtgcaaaactgctttatagtaactttagaactttaactcctgaacagaagnattattattgtttgtaaatcagtcatcaaaaatctgcattgtgttgttgatcatattgct

SEQ ID NO: 21838 - DNA, 121 bp, Artificial Sequence
  Synthesized
  misc_feature (61): n=t or c
taatgaatggattggaatccacaaaagaaaaaaagaaactatatcaaaaatgaagaattangtgcagaaaaaaaatcaagatgttaggaaaatagaaagaaattgctgtagggagggaatt

SEQ ID NO: 21839 - DNA, 121 bp, Artificial Sequence
  Synthesized
  misc_feature (61): n=a or c
gaaccacctcgccgaacgaaggatgattcaggattacaagccacgtctctgctggcatccntttgtgtttgtgaaccatgcaattgtttgtgctgccgcagggatttccacctgcagctga

SEQ ID NO: 21840 - DNA, 121 bp, Artificial Sequence
  Synthesized
  misc_feature (61): n=t or c
ggaggtcctactggaaccctgccttggatttggtaaaagtctgtcaaaacagagatgcagngcatttaacaaaacataaaagagtgtactatttaactgaatgaataattaagtggtggag

SEQ ID NO: 21841 - DNA, 121 bp, Artificial Sequence
  Synthesized
  misc_feature (61): n=a or t
acatccttggtgctatacagacaatcaggagcaaaacttcacctattcttccaaattttgncattctcaacaaagagaaaaaatggaaaagggctccacaactttttccatacacaaaaca

SEQ ID NO: 21842 - DNA, 121 bp, Artificial Sequence
  Synthesized
  misc_feature (61): n=t or g
cccatgcatctcccctgtgctaactgcatcttgcagagcagaagcatttaaaggagagganaaagacctacatagaactacaattcgaaagtcctcaaagcaaacagcctctcttctttcc

SEQ ID NO: 21843 - DNA, 121 bp, Artificial Sequence
  Synthesized
  misc_feature (61): n=t or c
agcaccaggcacatggatacaagaataagggctgatactccagatggcatccactaagaantgattgtctgatttactgtttttatttgtctagctttgcccaggtctatttttttctgat

SEQ ID NO: 21844 - DNA, 121 bp, Artificial Sequence
  Synthesized
  misc_feature (61): n=c or g
ctaaaaaccacaaaaagacaacattaatgggattctaacttacttgattttctgggacttnactgcaagaatagctcaaaaagctaaaagatgacctggtgtttgagagagataaagggac

SEQ ID NO: 21845 - DNA, 121 bp, Artificial Sequence
  Synthesized
  misc_feature (61): n=a or g
atatctgagagcacagcctagtgaagacatccaccagtctggccaaatgcaccatgccaanagtaaaattcccatcacgaaaagcaatcgaggcatagcctgttgccagtttccacaaaga

SEQ ID NO: 21846 - DNA, 121 bp, Artificial Sequence
  Synthesized
  misc_feature (61): n=a or c
gaactaacacaaagctgatgttttttcaagtaatgaaacatattcttagcatcaaacacanccttgtatgattgcagactcatacgtttagagatgaatcaaggtatgaaggttttctgtg

SEQ ID NO: 21847 - DNA, 121 bp, Artificial Sequence
  Synthesized
  misc_feature (61): n=a or g
ttaactcctctgctgctcatctttgctccttctccttggagctggagcagtgaaggacacntttgtttgcagtgcagctccccaagccctaaggtttttggggtggaggtggtcagacctg

SEQ ID NO: 21848 - DNA, 121 bp, Artificial Sequence
  Synthesized
  misc_feature (61): n=a or g
agcagtcaaaatattcaggtggtgaatgttattttttcactgatttgattgcagggaatcnatgaagaaacatgcagtgggtatctgtgatacgtaaggctgacaccaatatttttggtga

SEQ ID NO: 21849 - DNA, 121 bp, Artificial Sequence
  Synthesized
  misc_feature (61): n=t or c
ctctaaaggtctctcaaattccttctgatctcaagatgggcaattttggtaggtagtttangagctagctgtttgtgcattcgttttacacaagtttgttttataactttaatgggcatta

SEQ ID NO: 21850 - DNA, 121 bp, Artificial Sequence
  Synthesized
  misc_feature (61): n=t or c
cctctgcatccaaaaggcagaagatgaaaagcagaactggacagtcacagacaggaataangcctaagtctgtgcatcctttgtctcaccttgactaatgttctgtaaaagggcatgttat

SEQ ID NO: 21851 - DNA, 121 bp, Artificial Sequence
  Synthesized
  misc_feature (61): n=a or g
tgagaaagaaaagccagacctcgaagttctagaagccactgaagcttcgccacgagccctncaacagcaccccgtgcttgtccatctgcaggttgtaaatcagcagccctctcctccctaa

SEQ ID NO: 21852 - DNA, 121 bp, Artificial Sequence
  Synthesized
  misc_feature (61): n=t or c
gttttccagttttagtctgaattcaaacactgttggcagttccaagaactctgtgggtttnatgctctaggtcagtgggtggagaatactggaaaaggcacactccatcctgtcccctcgt

SEQ ID NO: 21853 - DNA, 121 bp, Artificial Sequence
  Synthesized
  misc_feature (61): n=c or g
ttccagtgtttttattaaacttttatagtcagcacacagcaaaattagaaggtatgtcaantgcggtttgagagcctcaaagaaaccaaaatgcttaaaaaacaaacagttaaacaaaagt

SEQ ID NO: 21854 - DNA, 121 bp, Artificial Sequence
  Synthesized
  misc_feature (61): n=a or g
cataatccaaatttttcatctcagtgtatgtgttctcatctgctaggagaacaaatacaangagagagaaataagtgaaggtgtgatgttattaaggtccagcatagttattttttgttgg

SEQ ID NO: 21855 - DNA, 121 bp, Artificial Sequence
  Synthesized
  misc_feature (61): n=t or c
tagatgaaggcatacagaccaagatatgacaggccaagaatctgtcttcttgtcttactcnatagataatggctaaccctgggatgtaaacattcattttctaaagaccttggggaaatga

SEQ ID NO: 21856 - DNA, 121 bp, Artificial Sequence
  Synthesized
  misc_feature (61): n=t or c
gcactgttacatttactcagttagttctacttgcataaactgatatttttagtacaggcanacatagatgaatcctttcagtgtctacctgtaacacaatccaaacagtagctggactttg

SEQ ID NO: 21857 - DNA, 121 bp, Artificial Sequence
  Synthesized
  misc_feature (61): n=a or g
cacagcataggctttgatttcaggcttatgctgatgtaatgaggatcaaagtactgcccanggtcttgagtaacgtacttgagcattatctgtgagttagagtagctcttacaattcctat

SEQ ID NO: 21858 - DNA, 121 bp, Artificial Sequence
  Synthesized
  misc_feature (61): n=a or g
tgctccttttatggagaggttcagtagagcccagcaactgagcccatggctctgcctcatngagggaacagcacaactgcgatgtgttgctgtagagatagattctaacgttgtcagcgtt

SEQ ID NO: 21859 - DNA, 121 bp, Artificial Sequence
  Synthesized
  misc_feature (61): n=t or c
ttcatctgctgagtaattgctgggaagctgtgctttttctttatatcaatcattgtataangaatgtacatgtgtatgaataagcatcttaatcagaaatcttgtgaggaattattctgtt

SEQ ID NO: 21860 - DNA, 121 bp, Artificial Sequence
  Synthesized
  misc_feature (61): n=t or c
gttcattagaatatccttctaacagcaaatagtaaaaatatgacaaaggcaaaaatatacncggcttgttttgtatctgtgccatatccatgaacaatcctacatgttcattgctgggttc

SEQ ID NO: 21861 - DNA, 121 bp, Artificial Sequence
  Synthesized
  misc_feature (61): n=a or g
gtgaacaaaggggtatatttgtctgaggagacaattctctattgcttgtacaaggtccttntggcttttggttcagatgagagtagaacacactacaaatcacattttactaactgaccag

SEQ ID NO: 21862 - DNA, 121 bp, Artificial Sequence
  Synthesized
  misc_feature (61): n=a or t
acagggcttcagcatcttcaccatctacaccaataggcctgtgaaaacctgcagctggagnctggtgttttccaggcagaaaggatactgcctttagcatttacctcttgacaagtgatga

SEQ ID NO: 21863 - DNA, 121 bp, Artificial Sequence
  Synthesized
  misc_feature (61): n=a or g
ctctttctgcagactcgtggcattactgcagattaaccggtgtgtacagaccatgcatggncttatttaatcatcccaggatcttgtacagttggggcattagctccaggaactcactcct

SEQ ID NO: 21864 - DNA, 121 bp, Artificial Sequence
  Synthesized
  misc_feature (61): n=t or c
caaaagaagcttcatacacagatatttccacaccccatgggagttcttagccttatagtanacctcccaggatggcttggccaacagaagaaagagaatctcaccctctaggcacagccct

SEQ ID NO: 21865 - DNA, 121 bp, Artificial Sequence
  Synthesized
  misc_feature (61): n=t or c
tctcaacctggacacaacgatcgccatcacacagaactttgccagctgtaccaacttcccngtggtgtggcacaagacagtgagagggagacccaaattgtcacggaagtggtacaggtga

SEQ ID NO: 21866 - DNA, 121 bp, Artificial Sequence
  Synthesized
  misc_feature (61): n=t or c
ctctttcctctttgagcatgcaaaagagatctttctaagagccttgatcctgtgctaaaantgacccatgtagacaggaatgaacagaggtgaggcagtctgttcagtcagtactcctaga

SEQ ID NO: 21867 - DNA, 121 bp, Artificial Sequence
  Synthesized
  misc_feature (61): n=a or g
gcatctcttggtctccacagaggttggctttccaagtttttgtcttcagctcttcccacangaagccaagagctccccctagccatccctcatcaccttccaggcactgctagcaagaagc

SEQ ID NO: 21868 - DNA, 121 bp, Artificial Sequence
  Synthesized
  misc_feature (61): n=a or g
atagattgcagccagccacaaagccattctgtccatgaaagtctgtctttccaatcctacnctgatctatatttttacaatagatacaattactttttcctctgtttcacttttcatttca

SEQ ID NO: 21869 - DNA, 121 bp, Artificial Sequence
  Synthesized
  misc_feature (61): n=t or g
ttaagtgttcacttcttttatgttttgacttctgattgcccagaacaaaatcccctattcnaaatttcagagctgcttaggtctcttaacttcaagagcaagatgaaagtgttttgtgcct

SEQ ID NO: 21870 - DNA, 121 bp, Artificial Sequence
  Synthesized
  misc_feature (61): n=a or g
gggtgatgtttccaagcgtgtgctgtgttttcttacaaatttctgattcagcatttccccnaatcataatatgaaactatatgtgatatcaggctaccacctctggaagtgtagaactatt

SEQ ID NO: 21871 - DNA, 121 bp, Artificial Sequence
  Synthesized
  misc_feature (61): n=t or c
aacataattgccagatttaaacctccctctgatcccatctcaacgccttgctttaaagtancatcacttcaataccagcttgggttgtatccccaaagcacaaagggtgaagagaaagaag

SEQ ID NO: 21872 - DNA, 121 bp, Artificial Sequence
  Synthesized
  misc_feature (61): n=a or t
gaagtcacagatgtcatctgaaactccttcagcaatctccatagcgcactgctgccatacnttgtatatttccttttcttgttgctgtttaattttctgaagttagtgactggacctcccc

SEQ ID NO: 21873 - DNA, 121 bp, Artificial Sequence
  Synthesized
  misc_feature (61): n=t or c
tgaatacaaatctacagatgtgtaggtcgatgacacttcaatgatctgcaattctttgatngtttctccaaaccaatggaaagctttgaacatgaaatcagaatcaatcctaacaaaattc

SEQ ID NO: 21874 - DNA, 121 bp, Artificial Sequence
  Synthesized
  misc_feature (61): n=a or g
atgccctggtcagcttttaaaatattttaaaccctataaacagacaaataattctaaatanctaagctagagccttatgaagtgctcaagaatgcatttatttcagggttcttgccagttt

SEQ ID NO: 21875 - DNA, 121 bp, Artificial Sequence
  Synthesized
  misc_feature (61): n=a or g
gggatgaactatttgggagatcaatgtcagtaaaagagaaattacacaagtgtagactttnctgccaaaagcaatggaaggtggggcaatcagaccctttacactgcttctgaatcagttt

SEQ ID NO: 21876 - DNA, 121 bp, Artificial Sequence
  Synthesized
  misc_feature (61): n=t or c
tatctccagtaacatgacattccaacctcttgctagtctcatgtttgaagaacttttaagngtccacactggttttgtttttgtgaggtgaaatttactttgcatgttcatctgacctgaa

SEQ ID NO: 21877 - DNA, 121 bp, Artificial Sequence
  Synthesized
  misc_feature (61): n=a or g
caaagtaattcactgtaagaaagcagctcattcttcacctttggcgagctgctttgcttcntgaccctttctcgtgaaaagcaatttttccccaaacgcacaggacagggagtacatctgc

SEQ ID NO: 21878 - DNA, 121 bp, Artificial Sequence
  Synthesized
  misc_feature (61): n=t or c
tttattctcccactcaacatcatcactgactgcagtttaaattttaccaccacagcctatngttagcttcttccatcttaaattttatttcctagtagtcagccatacacgtacacattac

SEQ ID NO: 21879 - DNA, 121 bp, Artificial Sequence
  Synthesized
  misc_feature (61): n=t or c
catgaagcaaaacacaaaaatagaaatattatgcacatagactacatttataaactgtgcnctactttgttgaccaatctgtctggatattctttctagaggatgtgttgtatttcaatag

SEQ ID NO: 21880 - DNA, 121 bp, Artificial Sequence
  Synthesized
  misc_feature (61): n=t or c
tcaatgaacattaaggattacagataagagcttataaatgtctacaataacttctaactangggcaggcttttgaaacaagtctgatgtgggagttctccacaactaacaagttgtgtggt

SEQ ID NO: 21881 - DNA, 121 bp, Artificial Sequence
  Synthesized
  misc_feature (61): n=t or c
caaattttagaagctactccaagcaagctaggaacttggcttagactctgcaacagccctntggaggaccctgtgtttctctaccagctgtatacagggcttaggcagcatgtatggctga

SEQ ID NO: 21882 - DNA, 121 bp, Artificial Sequence
  Synthesized
  misc_feature (61): n=a or g
tgcaaactggagtgcttaggatgtccttctggagttctgtagcctttcaactcagtcagcncagactggttaggattgcgtgacttttattttatattttttccgttggttaaaaatagag

SEQ ID NO: 21883 - DNA, 121 bp, Artificial Sequence
  Synthesized
  misc_feature (61): n=a or c
tcgaacctgcttactcaatttgtctgaggtttctgtgcgtgtgcggtgctttcatcacagnaggatcctgatgtgaggcaccatctgcaatggcctggagcaacacacggatcaccagcat

SEQ ID NO: 21884 - DNA, 121 bp, Artificial Sequence
  Synthesized
  misc_feature (61): n=a or t
caattaaacatcgctgatccttatcctgcccccttcagcttgattccttaagcagcactcncttgaatattacccagagctctccttcagcattgtagtatctataacaagtccctgcctg

SEQ ID NO: 21885 - DNA, 121 bp, Artificial Sequence
  Synthesized
  misc_feature (61): n=c or g
cctggcttccgaagcaaaatctgcctggccttgagatagacttggaggcatcacattgctntctctgctttcttcctgactgatgtaccttccccaccccaggctgtgcagcacagggtag

SEQ ID NO: 21886 - DNA, 121 bp, Artificial Sequence
  Synthesized
  misc_feature (61): n=c or g
gtgttccaggtaaaacacatgggcaaggtgagagctgtaatggctctgctgggatcgctcnttttccttatcagagacagtcagtaataaagacagtagctgttttgctactgaatgtcct

SEQ ID NO: 21887 - DNA, 121 bp, Artificial Sequence
  Synthesized
  misc_feature (61): n=a or c
ctgcacacaaagaggtcttatttcctaatctggcttgtggttctctcctgcagaaaaaaancagtatttactgtaatcacatcctagcactgagagtggatatctcttgttgttgctcctg

SEQ ID NO: 21888 - DNA, 121 bp, Artificial Sequence
  Synthesized
  misc_feature (61): n=c or g
tggccgcccacttgggataagacgaaagattgtgtgtaagaactccatttgttagccaagntgagcagtccctttgcacttcagcgtgccccaatgggcttggttctcccagcagcaaaga

SEQ ID NO: 21889 - DNA, 121 bp, Artificial Sequence
  Synthesized
  misc_feature (61): n=c or g
ttaattctataggttagggaatggataagaagcaggaacagaagttgctctgtatgttgtntggtgggaagtaagatcagacccaagtacattaatattgagctatttctctgttgctgtt

SEQ ID NO: 21890 - DNA, 121 bp, Artificial Sequence
  Synthesized
  misc_feature (61): n=a or t
aaagaaataaagaacatctgtgcttttaatacacaatagaatgattcaaacacgcatttgncgtctgttgaatgccaggttttcaactgttagttatttgctttaatggcacgatgaagtt

SEQ ID NO: 21891 - DNA, 121 bp, Artificial Sequence
  Synthesized
  misc_feature (61): n=t or c
ccacctgcttttcagaaaataaagaacattcatttgatcctttgtcctctaattcattcanttgctggcattaaacacaaacttagccctcctgtgacagaaagaagagtgtttccaaagc

SEQ ID NO: 21892 - DNA, 121 bp, Artificial Sequence
  Synthesized
  misc_feature (61): n=a or g
gcccaccgaggcaccagggctgacatcagcccctcagcaaagctgagtggggcacctgaancatccctgcctcaacatcccttgagtctttgcggagtggctgcagcagaaccctctctgt

SEQ ID NO: 21893 - DNA, 121 bp, Artificial Sequence
  Synthesized
  misc_feature (61): n=t or c
atattccaccagtgctttctttcacttcacatattacacagactcttgagctccctgaganagtcactaacctacctgggatgttaaactccaaagaggcctgagagagctactcaagagt

SEQ ID NO: 21894 - DNA, 121 bp, Artificial Sequence
  Synthesized
  misc_feature (61): n=a or t
aaatccagacaaatacacttgtgtaccaagtgtgcggtagttcgttgcctctgggatcacnatgtcaagttctttctttgccttttggcatgttcactaccagaggttttgaatacatgaa

SEQ ID NO: 21895 - DNA, 121 bp, Artificial Sequence
  Synthesized
  misc_feature (61): n=a or c
gaggctcccagtttttgtataacctacctttcaacactcctccatgttgttagaaaaggcntcccatatctcccctgcacaccacagcaccagtagcccatttcatttcccttttgagcaa

SEQ ID NO: 21896 - DNA, 121 bp, Artificial Sequence
  Synthesized
  misc_feature (61): n=a or g
cctcagcgtaggtttgtggtatgtctccacacccagaccacgtaatgagtttaggggtacngagatactatatttcaacagtttatctgagtgaggatttgaaacccatttggaaggtttt

SEQ ID NO: 21897 - DNA, 121 bp, Artificial Sequence
  Synthesized
  misc_feature (61): n=t or c
gatataaaggttcagttatctcacccatgtaaactgtgtgaattgtcctgcaacagcaacnaggaggtaatttaggtgccaaacgaaaaatggtaacttttgcaggagaaaactgttcacg

SEQ ID NO: 21898 - DNA, 121 bp, Artificial Sequence
  Synthesized
  misc_feature (61): n=a or g
aaagagttgttatgacagttctgtcctcatattacctaatgataagcataaagaacctctnttgctcagaatgtgttgtttacctgccttgtgtctgagttgtatatgacccaaaatggaa

SEQ ID NO: 21899 - DNA, 121 bp, Artificial Sequence
  Synthesized
  misc_feature (61): n=t or c
gagtcagcctaccctctagggctaccacttcccatccttcttcatcagctaacccaagggngggatgctacaaccaccagtgctgtaggtcaaaaatcccatttgacctgtttggatgatc

SEQ ID NO: 21900 - DNA, 121 bp, Artificial Sequence
  Synthesized
  misc_feature (61): n=a or g
tcgggactggcacttcatttttccctgcaaaggttgtgatatgttaagtgctaccagtttnccccatcacattggtgggtctcggctacaagaaacagcactaccttaggaagtccaggat

SEQ ID NO: 21901 - DNA, 121 bp, Artificial Sequence
  Synthesized
  misc_feature (61): n=a or g
tgataagacagaggagtcagggagcttggcaacggtggcacgagtaatctttaaaatttcntccatttaattcctcactgagaggactcttagtgagctgaggttgcagctaaaagtgata

SEQ ID NO: 21902 - DNA, 121 bp, Artificial Sequence
  Synthesized
  misc_feature (61): n=a or g
agctggcgaggaaggcagccaagtccgtgtgtgctgtcgctgcctttgtcccttcagcatncttgagccaagggctggcttctttcctccttcctttctttctttcttttcttttcctctc

SEQ ID NO: 21903 - DNA, 121 bp, Artificial Sequence
  Synthesized
  misc_feature (61): n=c or g
gcagttaaatacacactgaccccaattttgtgaccaaccagcaatgcataggatgccaaanaaagtagtttcaatctactcaacagattttcctccctgaataactgccattggcaaaggg

SEQ ID NO: 21904 - DNA, 121 bp, Artificial Sequence
  Synthesized
  misc_feature (61): n=a or c
aataaaagttaaaaacaaacaaaaaaatcagtcaggagtttcattttttaggcaagaaacnacctggtacataccacatctttgctcttgcaaagacagactagaaataagagttttctca

SEQ ID NO: 21905 - DNA, 121 bp, Artificial Sequence
  Synthesized
  misc_feature (61): n=a or g
tcgtggtaactgagaaggtgtaatgcagggccctctgagcacacgcatggcacccaaagcngtgggatcttttcagatggcgaagctcgctcctaaggaagcctgctctggggctggctgc

SEQ ID NO: 21906 - DNA, 121 bp, Artificial Sequence
  Synthesized
  misc_feature (61): n=t or g
acacaatgttatttgaaaatgcttttcatatttagcatttttattgtgcattaatctgctncttcttttctctggactggaattttattgtttcttttatttcctcttctcttttcttttt

SEQ ID NO: 21907 - DNA, 121 bp, Artificial Sequence
  Synthesized
  misc_feature (61): n=a or g
cagccaatcaagaccctcctcgtctgtagctggagcactgtgtctggttcagggccctctntggtgccaagtggacaaattgacagttagcattgggcaatattgataggactaaaggcag

SEQ ID NO: 21908 - DNA, 121 bp, Artificial Sequence
  Synthesized
  misc_feature (61): n=a or g
taatttaacagtttatcctgtctgtattctgccgcaaaggggaattataattttactctcnttgcttctatgcagaagtcagaaggtagaacttctgctgtgacctcctccccccagctgg

SEQ ID NO: 21909 - DNA, 121 bp, Artificial Sequence
  Synthesized
  misc_feature (61): n=a or t
cttgctgccacttcttcatggccagtccttctgggcctgccctgttctggcatgactcttncacaagaagagagactacaagtatttctgctgatgcattcaccaaaaaacttctggctcc

SEQ ID NO: 21910 - DNA, 121 bp, Artificial Sequence
  Synthesized
  misc_feature (61): n=c or g
acagcacacgtcttctctgccctgaatctgcccttggtctgctcagttaagttcatcaacnacagaagggtgtaacagcttacttaaaaatgcactactcggtgctacctgctccaagaag

SEQ ID NO: 21911 - DNA, 121 bp, Artificial Sequence
  Synthesized
  misc_feature (61): n=t or c
tgctctcactgtttccccttcggagttcatagccccaaagaaagccattagtaaacttgcncaaaaggagtgcgtttcccagatctgtatatgcagaggttgagaactttttttggtccaa

SEQ ID NO: 21912 - DNA, 121 bp, Artificial Sequence
  Synthesized
  misc_feature (61): n=t or c
ggcactctgaatttaccactgacactttactattccttctttaataagaagccttatatgnaagacagagaaagaacaggaggaggttggaaactgcaggtttgttaatttagtgactgct

SEQ ID NO: 21913 - DNA, 121 bp, Artificial Sequence
  Synthesized
  misc_feature (61): n=a or g
tacggatgtgtacaggtatgttctagtcagcacctgcaaacatcatcactgctgctgacanctgagccttggcagggatcaatctacaacccatgtggcttattttcttaccctaaatatt

SEQ ID NO: 21914 - DNA, 121 bp, Artificial Sequence
  Synthesized
  misc_feature (61): n=a or g
agacactgaactcagaagagctcaggtggatttgctgctggacatccactgtggcttcaanctcaaagaacatcacaggggcaggtggctctcgctgggcttttgcttcagtgttggagat

SEQ ID NO: 21915 - DNA, 121 bp, Artificial Sequence
  Synthesized
  misc_feature (61): n=a or c
tttctctctctctctctctctatttatttatttatttattaagagaacagtgttatcctanttgtttctgttcactggcccgtaaattctcaagtgaaattctttccttcctttggtgttt

SEQ ID NO: 21916 - DNA, 121 bp, Artificial Sequence
  Synthesized
  misc_feature (61): n=t or c
ggtatccttggtcttgtatatgaagcttgttctagacttacatgaggcagaagtcactgcngggtcaactggaatctgaagggcttcaggaaacagtgctgatccagtctgctttgcagac

SEQ ID NO: 21917 - DNA, 121 bp, Artificial Sequence
  Synthesized
  misc_feature (61): n=a or g
gggttggagctgggtcatctctgaggtcccttccaaaccaaccacactgtgaagcacccantgaccaatcttccaagaggccactgagcttccaacgggctagaggtctcctctccggact

SEQ ID NO: 21918 - DNA, 121 bp, Artificial Sequence
  Synthesized
  misc_feature (61): n=c or g
gcagagtatacaaaatcatgaaagactaaattatcttctagtctgaagttacgtttgtaantaatactagaatcttcatcaagtcttcagagtgatgaagtgtggtctttagtctcaaaaa

SEQ ID NO: 21919 - DNA, 121 bp, Artificial Sequence
  Synthesized
  misc_feature (61): n=a or t
aacaaaccatacctgcctggtcacaaaccctgacctcactaaaaataactgagcaaaatgntggagcttatccacaaaccatgctaccagaagagacgcattcctgtgcccacagcatcag

SEQ ID NO: 21920 - DNA, 121 bp, Artificial Sequence
  Synthesized
  misc_feature (61): n=t or c
aataaaaagcatgctactttacaattcacacatattaattttctaacttccaattacttantcaaagacggcttcttcctttattaccttgcaaagcctattttaaaaaaaaaatcaatta

SEQ ID NO: 21921 - DNA, 121 bp, Artificial Sequence
  Synthesized
  misc_feature (61): n=a or g
tgttttaagaaaacttccacagtcagcaattatttgaaagaaaacacgttatctaaacccnagtgagctgcctctgcctaaaacgcatgttccccatgctagtgaaaaacagataccatgc

SEQ ID NO: 21922 - DNA, 121 bp, Artificial Sequence
  Synthesized
  misc_feature (61): n=a or c
ctataattcactcataaatagatatttctgtgttttgtgagattctcaagaggaccactgncctcacataaccttccaccttgttaaaaaaaaaataattagttatatcctatgttactca

SEQ ID NO: 21923 - DNA, 121 bp, Artificial Sequence
  Synthesized
  misc_feature (61): n=a or g
gtttcttgtgtttatgtgtgctctgatctgaattaaactaatctattatgtctgctttgtnttcttagggatgcactatttttatgcggaacttgcaaaggcgggcacagttcactgatgt

SEQ ID NO: 21924 - DNA, 121 bp, Artificial Sequence
  Synthesized
  misc_feature (61): n=a or g
ctgtcaaaaattgactagctaaccattaactcagacagagtaacacagtctttgacctaangtaaagattctttaacaatgaaaaaagtcacagtgtagtgtatttggggcacgctgctta

SEQ ID NO: 21925 - DNA, 121 bp, Artificial Sequence
  Synthesized
  misc_feature (61): n=t or c
gtttgattaaagcataattagaaagaaatctcaactcaaagtgagtggctatagcaacagntggttgatttcaggctgaggagggataggttggagatgaggaaaaacttcttctccagaa

SEQ ID NO: 21926 - DNA, 121 bp, Artificial Sequence
  Synthesized
  misc_feature (61): n=t or c
agcctaaaaatacacctctgtctgcgtaaagctgcagaggacaaattgcttccttgtcgcngctcgcccaaggcaagaaatgctcaaagccaggtgcttgagaacatgggatctcaagtcc

SEQ ID NO: 21927 - DNA, 121 bp, Artificial Sequence
  Synthesized
  misc_feature (61): n=t or g
tcctctcagctcagccagaagacaagggatgcttttctcctgaagcagactgaagttcccncaaatttcaggtgactctcctggcctgcctccagagcccatccttgatgctctacaaagg

SEQ ID NO: 21928 - DNA, 121 bp, Artificial Sequence
  Synthesized
  misc_feature (61): n=a or g
cccattgagatctgtagacctaaaagaatccagctgaagaagcaaatcccatacaagttanacactggctgggagtttatttttaccacagtcatggtcttccaactcagggctcttgagt

SEQ ID NO: 21929 - DNA, 121 bp, Artificial Sequence
  Synthesized
  misc_feature (61): n=a or t
ctgtgactaaacacatctatttctacagcccgggagctgcaaatctacacataaggatggntttggggtgaacgctcagtgtttgtcacagcactgtagtgcagttttaaatggcttatta

SEQ ID NO: 21930 - DNA, 121 bp, Artificial Sequence
  Synthesized
  misc_feature (61): n=c or g
taacaaaaaactttaaactttagtattcaaggcaaacaagttctcagaatagatgtcttanctctttcatctacacagttgttgcaaaggtctgtggcagcaaattttggcacctggactt

SEQ ID NO: 21931 - DNA, 121 bp, Artificial Sequence
  Synthesized
  misc_feature (61): n=a or g
tttcactcaaattaagtacatttactggctaacgtacattcaccagtgtgtaaggctaacnctgtgatgatgtttaaattcataggcccgtgcttatagtattggtttgaggtatgaagac

SEQ ID NO: 21932 - DNA, 121 bp, Artificial Sequence
  Synthesized
  misc_feature (61): n=c or g
atgctgaattccaggagaagaaaaagagtacttccaagctaaggatccttgttcgtccctntgtacaaactactgacttgatttttgtctaaatgatacaggattaatgtcattatctggt

SEQ ID NO: 21933 - DNA, 121 bp, Artificial Sequence
  Synthesized
  misc_feature (61): n=t or c
aagaaacctttggggtgggggtatggggaggaattgtattccccagctctctcttaaagcncagcccagatatacctgcagacccctgcaatgagagtttgctgcaagaatcctgagctgg

SEQ ID NO: 21934 - DNA, 121 bp, Artificial Sequence
  Synthesized
  misc_feature (61): n=a or g
aacgtctttgtttttagttgagcttacataaaaaaaagcattctatatttaaaaaccttantaaatgatttctatattgacacttgctagcttgaatccaagtgtctttgcttggcacagt

SEQ ID NO: 21935 - DNA, 121 bp, Artificial Sequence
  Synthesized
  misc_feature (61): n=a or g
tttgagctgcccagaaaaaggaggacaaaaaaaagtcactaagagtaggctataatctgancagttactgttccatctaatagctgcctatgtgaggatgtttcaatgcaaacttccctca

SEQ ID NO: 21936 - DNA, 121 bp, Artificial Sequence
  Synthesized
  misc_feature (61): n=a or g
aatcctccccaaatgcacgaaggtgaggattatagttgctacataaaggaaatggacttcnggatgcaaatctgcactgggaaaagtcagtacaacagggtacataccataaatctgtttt

SEQ ID NO: 21937 - DNA, 121 bp, Artificial Sequence
  Synthesized
  misc_feature (61): n=t or c
gttacttttagacagctgctttaccagaattggaagaaacacttcagttcaatgaagaacnaccactgctcccaatttagctgactggtgctggtaccagagggctgctttgctaagtaca

SEQ ID NO: 21938 - DNA, 121 bp, Artificial Sequence
  Synthesized
  misc_feature (61): n=t or c
atctaacatgactagatagctcaagtctattcaaccaggctgggtaaatacatgggctggnttcctctgtcctgagacacaacctacacaggtgagggcattctggagttaattggaatta

SEQ ID NO: 21939 - DNA, 121 bp, Artificial Sequence
  Synthesized
  misc_feature (61): n=a or g
taaaagtactgcagtgtaatgctcttattttgttgttcactacagctctaaagaagcctgntttttagttcacactctttcttttatagtttgtactactttgtgtagtaccatttagtat

SEQ ID NO: 21940 - DNA, 121 bp, Artificial Sequence
  Synthesized
  misc_feature (61): n=a or g
tagtaaatgcctgccaggcagaggacctccatgagccagcaaggatgcagtatgaagcacnaggaaagttcctctctctattttgtctactgcccttgcagcaggtttgctctttaatcat

SEQ ID NO: 21941 - DNA, 121 bp, Artificial Sequence
  Synthesized
  misc_feature (61): n=a or g
tagtttcattagctttatttcatagcaagactccttagccttcactgaattctattccccnttttcttcgttttatctatgatttctattgaatacttactgaaattcaaagacagattgc

SEQ ID NO: 21942 - DNA, 121 bp, Artificial Sequence
  Synthesized
  misc_feature (61): n=t or g
gatttgctaaaacgcagttctcttaacgtccctttcttattcatgtttgtttatatgcccntaagataattttcccttttcttggtattgattttttcagtcttttcttttgagaaatagc

SEQ ID NO: 21943 - DNA, 121 bp, Artificial Sequence
  Synthesized
  misc_feature (61): n=a or g
catcagctcctgataacattcttcagttttcaaaacatataaaatgcttttgagtcttccntgtatatttaatgtacatgatatcctgctgcttactacctcagtagttttcaatactgtg

SEQ ID NO: 21944 - DNA, 121 bp, Artificial Sequence
  Synthesized
  misc_feature (61): n=a or g
atactattttaataattagcaaattaggtaattcggtaatcagttattctttgccctcccncatctttattttaattggaacaatccccaatataaccatttctattacttcattttatct

SEQ ID NO: 21945 - DNA, 121 bp, Artificial Sequence
  Synthesized
  misc_feature (61): n=a or g
ctctgtgtgagtaaaattgccttatgtgtagatgtcatgcatggtaattagggaggcttanaataaggtccaaagctaaaagtggaaatgtaaagtggaaatgacagtaagtgattcaaat

SEQ ID NO: 21946 - DNA, 121 bp, Artificial Sequence
  Synthesized
  misc_feature (61): n=a or c
ttgtgcctctacgtaaccaaatgaccctaagagtgtctccattaaacccctcgaagcaaanccatacatctccatgccatgaggcagaggtagtcaccacatgcgtagatgaaggcactta

SEQ ID NO: 21947 - DNA, 121 bp, Artificial Sequence
  Synthesized
  misc_feature (61): n=t or c
tcggtagagaggaaacttgaaagtaaggactggtacgatgccttttggtactggataaggncacttggatgctagaaaggcaggacagttccattactaccactgtttctaataaaactac

SEQ ID NO: 21948 - DNA, 121 bp, Artificial Sequence
  Synthesized
  misc_feature (61): n=t or c
tgattatcctgtaattggtatctctctggggtgctgcacttgttaaatccgtatatgtganggggctatctggttacactgaagagattacctgttgattgctgcttctgggacttagcaa

SEQ ID NO: 21949 - DNA, 121 bp, Artificial Sequence
  Synthesized
  misc_feature (61): n=a or g
tctataccatcattttaaaggttttcttgactcagaatatctcctcaaaccttgaaggggncttcgtgttctactttttctaactaccctcaacttttcttcattattagcccctgatgtc

SEQ ID NO: 21950 - DNA, 121 bp, Artificial Sequence
  Synthesized
  misc_feature (61): n=a or g
tcgcaaaattgaaactcctatcagtattgtagggtactgactgcaagacctctttccccangaggcctttatttctctcacataatcttagattggattccaattatccttctaaatcaat

SEQ ID NO: 21951 - DNA, 121 bp, Artificial Sequence
  Synthesized
  misc_feature (61): n=t or c
tggtttgagtccatacacaataatttatggcaactcagctgctgagtggtggtgtattaangcactcttaagtatcattgtacatgttgatgtactctcagggaatctcggtcaccagact

SEQ ID NO: 21952 - DNA, 121 bp, Artificial Sequence
  Synthesized
  misc_feature (61): n=a or g
attgtatccctgggcgtaaaagtctttcccaggcaatactgtgtgataaggatgagagaangcgcaagatgtacaaactttttagctacaatcttggtaatcttccttccttgcacatagg

SEQ ID NO: 21953 - DNA, 121 bp, Artificial Sequence
  Synthesized
  misc_feature (61): n=a or g
gttgtaggacatactgtacctcacacttgcgtacagtgcaagatgatacctgtctccctgntacacacatagactacaattttatttatgccaagtaagcaaatcaagaattcagagatga

SEQ ID NO: 21954 - DNA, 121 bp, Artificial Sequence
  Synthesized
  misc_feature (61): n=a or g
aaattataaagcaggattgacaggagaaagagaaaagggtaggtatagaagaaataaatgnacaaatgggagaaaaaagtccctaattagctaagaaatgaagtggctttataacagcttt

SEQ ID NO: 21955 - DNA, 121 bp, Artificial Sequence
  Synthesized
  misc_feature (61): n=t or g
gtgcaataacttatatcaactgagtagctaaggatagtatcaacctttatttatacaactnattatatttgcacttgttactgcataccaagttactcatcctcctcttggtgagaacgct

SEQ ID NO: 21956 - DNA, 121 bp, Artificial Sequence
  Synthesized
  misc_feature (61): n=a or g
cggcctggcagctggttttgctacgggcgtaaatagggagctgatacaacgtgaatcctgncacagtgtgcctcacgtggctgtgctggaggtgggggagtccgggcagggtctgcattga

SEQ ID NO: 21957 - DNA, 121 bp, Artificial Sequence
  Synthesized
  misc_feature (61): n=a or c
ctcaaactgttggctcttcattgacactgtgccctctgcagagccccttttcaatatttcngctgcatgaattctatatggctatctgaaagaggaaaaacacaaaccttcgatgcttcag

SEQ ID NO: 21958 - DNA, 121 bp, Artificial Sequence
  Synthesized
  misc_feature (61): n=a or g
ccctcccatcccttgctctcaccaccatgggcatgtctttggacgctactccaggaattcngggtctttctatattgcatctatagcctgttttaccgaacagccattggggctcagcagc

SEQ ID NO: 21959 - DNA, 121 bp, Artificial Sequence
  Synthesized
  misc_feature (61): n=t or g
aaatacttttccaccagtaaaagctttgccactgggtttcttccaaaccctcaccaaaccntaccacgagaacaacttcttacaaagcatctagccaacttcagttttaaaaggaaagcaa

SEQ ID NO: 21960 - DNA, 121 bp, Artificial Sequence
  Synthesized
  misc_feature (61): n=a or g
actttgtgaaagcaggcagaagataaagtctctgcctgaaagggctgggatgtgagaggangtgttataggagaaaaaccacaaagatgtgcgactctgcaaaaaagtcttgcttcttcca

SEQ ID NO: 21961 - DNA, 121 bp, Artificial Sequence
  Synthesized
  misc_feature (61): n=t or c
aatcctcccccgtgagctgaagaagagtttaaggtaacatctgctcagctttatattagcngtgttcatactgatggtcccttggttctcattgccaagcaagtaaggggaacgtctctgc

SEQ ID NO: 21962 - DNA, 121 bp, Artificial Sequence
  Synthesized
  misc_feature (61): n=t or g
ttggggaggagctgtcactttttatactgtatggaccatctatagcatgatgagtggtgtntccctgagattattaagcgttccatcagaaaaaaatgttattgtcaaccctgactgcctg

SEQ ID NO: 21963 - DNA, 121 bp, Artificial Sequence
  Synthesized
  misc_feature (61): n=a or g
gtgattgtaatcagtggaactgtgttgattgacataggcaatgaatctgggcaggactggngtggctgctgtgccttatcattgactctgaaaagcctctgtttctgaatgcctctgattt

SEQ ID NO: 21964 - DNA, 121 bp, Artificial Sequence
  Synthesized
  misc_feature (61): n=a or t
tacttgaaaaggacagaatcttgaattgtgcattcaaacaacttgggcataatcgcctctngtgaaatttaagacatttaaggcttaaaaagcttaaataagaaataatgtgaaatatcat

SEQ ID NO: 21965 - DNA, 121 bp, Artificial Sequence
  Synthesized
  misc_feature (61): n=a or c
actccatctgtaacaagtaaaagtagtagcattcctaatgaacattttcagtgcgtctcanaacaagatgcatatttaagcagcctctgacacaagaagcttgctatcagatgaacagagc

SEQ ID NO: 21966 - DNA, 121 bp, Artificial Sequence
  Synthesized
  misc_feature (61): n=a or g
ataaacttcagtaattttagaaggagcctttcccagctgccgttctctttatttacttatntcttctctgtgttgcatttggatctgctacagttttccagcaagacccagaggttgcaaa

SEQ ID NO: 21967 - DNA, 121 bp, Artificial Sequence
  Synthesized
  misc_feature (61): n=a or g
agtgcttttatctcagtctgactgtgctacagactatccaagtgccagaacatttataacnacagtaactgtgttttcatcagcttagctttttttcatttgtaagaggaaaagggtagat

SEQ ID NO: 21968 - DNA, 121 bp, Artificial Sequence
  Synthesized
  misc_feature (61): n=t or c
tagtgctcgtgttgagatgattataaatagagaaatatgagtctgatttttgtcaatgatngatcactagagcctcttaaagttgcagtcatacaggggacatgaaaagcaaagagaatat

SEQ ID NO: 21969 - DNA, 121 bp, Artificial Sequence
  Synthesized
  misc_feature (61): n=a or g
atggagggtggctggacaaccacatcacaccgttcactcggggaacaccttttgttacccngatctgaatggaacttcacagagaagggctgcatggaaagtagcctctctcctccaccaa

SEQ ID NO: 21970 - DNA, 121 bp, Artificial Sequence
  Synthesized
  misc_feature (61): n=t or c
ggagatggactggataagttcttgacatcccttgcagttctgttttctatatttctaaaanacgtaaaatggtactattgtgatttaattaactgtaaaggtggttgtaaggataagtata

SEQ ID NO: 21971 - DNA, 121 bp, Artificial Sequence
  Synthesized
  misc_feature (61): n=t or c
tattagtaaatatcaggcagagtgtaagtcatttgtcgtaaaggagcttgtaatttagganacctaaggaattccagagctttgcaaggtcgtgcatgaagtaacatgcaacttatgctgt

SEQ ID NO: 21972 - DNA, 121 bp, Artificial Sequence
  Synthesized
  misc_feature (61): n=a or g
ctgttggctcagaaaaaaaaaatgcagagaatttaatttttctgtcttcagggcaagccangacatttctagcagtaattacaccttctacaagccaataatttcattttcagttcaggtc

SEQ ID NO: 21973 - DNA, 121 bp, Artificial Sequence
  Synthesized
  misc_feature (61): n=a or g
gttgctgcaggccacgtcagttggcaaggaacagccacagccacctgtcccagttacactnatttaaacagccacaggaaaacaaaccactcaaacaacaacagaaatgagaacaaggcca

SEQ ID NO: 21974 - DNA, 121 bp, Artificial Sequence
  Synthesized
  misc_feature (61): n=a or g
gaaagtgtgacattttaagtagtgtaaaaaaaaaaaatcatatcaaaaaaatcagcttccncagtcagtttgtacatcaggaggatgtaagtgtggtgataaaatactgaatttaaaacac

SEQ ID NO: 21975 - DNA, 121 bp, Artificial Sequence
  Synthesized
  misc_feature (61): n=a or g
tcttattttgcatgtttgttactgtctaacagtatatttaatatgcaagtttctttatgcnatatacaagtccagtttgtctcctcctttgacttttagttgttgatctaagatgtacact

SEQ ID NO: 21976 - DNA, 121 bp, Artificial Sequence
  Synthesized
  misc_feature (61): n=t or c
ctctgaagatatggctttcactgaggaggcagcaaagacatagaaaataattcttgaaaanatttcttccttagagaaccctggaggatagtttgcattaaacaaaaatggaaagaattga

SEQ ID NO: 21977 - DNA, 121 bp, Artificial Sequence
  Synthesized
  misc_feature (61): n=a or g
gggaaggaagtaagcgcgttagggatgagcgtgtggagttcctcctggtctgtaattcatnggctggtcagattggcagttttagcatgactgtgctaagggttcagaaatcagtagcgac

SEQ ID NO: 21978 - DNA, 121 bp, Artificial Sequence
  Synthesized
  misc_feature (61): n=a or c
tgataatctcttccttttgtttctgcttatgtgacagtgatcagtcattatctgatttccnaaaagggacaaaggctgacccacagaaatactgaatttggtggtgtcggcctaccagtca

SEQ ID NO: 21979 - DNA, 121 bp, Artificial Sequence
  Synthesized
  misc_feature (61): n=a or g
ccagcactgcaaatgtgctttcaaagcattcctctgcaatggcagagtcttagacacagcnaatgataacccatcattcaaagacatcaacttcttaaatctgtttgcaaaacctcagtgg

SEQ ID NO: 21980 - DNA, 121 bp, Artificial Sequence
  Synthesized
  misc_feature (61): n=t or g
tgtgcccccagtcctaaaaccaccctcatggatcaccgtgaacccccctagaaatacgtgncagctccaggagggcagctcagccctacggctcagggtggggaaggcgcagccgctgggc

SEQ ID NO: 21981 - DNA, 121 bp, Artificial Sequence
  Synthesized
  misc_feature (61): n=a or g
cccctagcctacctgcagccagtctgttggtgaggtggttgtacctctgacctgtgtcaanctgccactggtgtattagctggattgcaagatgattgcaacatatggcttttggaaataa

SEQ ID NO: 21982 - DNA, 121 bp, Artificial Sequence
  Synthesized
  misc_feature (61): n=t or c
taggggaaatatatccccataaaagtccttattttatatacagtatatagtcatacagcgnatggagacttaatattaaaatatggacacttaaaaacatacaactttccatctccagagt

SEQ ID NO: 21983 - DNA, 121 bp, Artificial Sequence
  Synthesized
  misc_feature (61): n=a or g
agcagggatctggaggctgacagcattcaaacagctcttttctaaataggagggagagaantggctctggatttgaataggactttaaagcacactatgtgagcctgcgtaccatgccata

SEQ ID NO: 21984 - DNA, 121 bp, Artificial Sequence
  Synthesized
  misc_feature (61): n=a or g
tcaagacaggatgtcacagtccttgttcttggcctaatacatagttcaaaacacagctaanctaacaacattgaattgtagtggttaatagttcatactctaccagaagatggttaaaagc

SEQ ID NO: 21985 - DNA, 121 bp, Artificial Sequence
  Synthesized
  misc_feature (61): n=a or g
atgatttcaaaggttgccccgtctgtgcttttagctgtaagaataggaaggttagaattanatttcccatctaggaggacacatcctggtggctcttctttataaatacagacatataatt

SEQ ID NO: 21986 - DNA, 121 bp, Artificial Sequence
  Synthesized
  misc_feature (61): n=t or c
caggatggcatatttttcttggtcctgttcccacattagttgtttcccagaatattttgcnacaccgatgtcacgcttctgtctgcttggctcacatggtgcagagcagaggtatttatga

SEQ ID NO: 21987 - DNA, 121 bp, Artificial Sequence
  Synthesized
  misc_feature (61): n=t or c
atactcttctttgaatggtgtcagctgtgtatcagttgcagctcactttccttgggacttngccttcatgggttatcacgacttgacaaaggatggtgcatcagcagaacatgcttgtagt

SEQ ID NO: 21988 - DNA, 121 bp, Artificial Sequence
  Synthesized
  misc_feature (61): n=t or c
tgttgatgcatgttttgactctgctgcagaagtaattctgtcttctgtagttgaagtaatnacatttgtttctaaatagagaaaaagaaatggtaattgtcaaaaaaaaaaagatccaact

SEQ ID NO: 21989 - DNA, 121 bp, Artificial Sequence
  Synthesized
  misc_feature (61): n=a or g
tagctactttgaattgcttaattttgtgtatcatacacaaacaccagctcacagctccacnagactccctgcacattttgtactaattctgtttcagcccaggtctgtatggatttacagc

SEQ ID NO: 21990 - DNA, 121 bp, Artificial Sequence
  Synthesized
  misc_feature (61): n=a or g
gctcccccccaactcctcagaagttctggcaaacatcttattaatagccaatccatctagngggaaaacaagaagtaagctggcaagtctttgattgtagagttgttggtttttttaatac

SEQ ID NO: 21991 - DNA, 121 bp, Artificial Sequence
  Synthesized
  misc_feature (61): n=a or g
caatggttactacactgatacttctgtttacttttctcatttgagcattaatctagatganggaacaaacaatctaaatttcttttcttgaataccagtgctgtaagggttgcaagaggca

SEQ ID NO: 21992 - DNA, 121 bp, Artificial Sequence
  Synthesized
  misc_feature (61): n=c or g
atggagtacgaaaaagagcagtgagcgtttttttgggaagcatcagagctatgaaacaggncttaatgagagctgcatggagactacgaatgtggtatggaagggaagaagtctgaacagt

SEQ ID NO: 21993 - DNA, 121 bp, Artificial Sequence
  Synthesized
  misc_feature (61): n=t or g
tggatatactgggtttcccaatgattaatggggagattcatatggtgtttcgctgggctgngtctcttgctgcagacatggcacagccccaagagtgtccatagacctcctggcccaactt

SEQ ID NO: 21994 - DNA, 121 bp, Artificial Sequence
  Synthesized
  misc_feature (61): n=t or c
gattgaacaatacatctgttctctataatttcagggaattcaggactaaaaaatgtcacangaaagacatacatgaattccaaggacattgcttgtagaaattccatcaatgtaacttctg

SEQ ID NO: 21995 - DNA, 121 bp, Artificial Sequence
  Synthesized
  misc_feature (61): n=t or c
tggcatacaaaatgattaatatgaccttaaaaacaaattgcttgacctgtataatgatganacttcttctaaataatttcattaggatctttcttcactgatttgcagagcatggtggaga

SEQ ID NO: 21996 - DNA, 121 bp, Artificial Sequence
  Synthesized
  misc_feature (61): n=c or g
atcatttgagttttaatccccagactagattgatggctttcaattgcaaaacctggtaganatgctgatgatatatgtcatggctcacattaaatcaatgaggaataaggatatacaactg

SEQ ID NO: 21997 - DNA, 121 bp, Artificial Sequence
  Synthesized
  misc_feature (61): n=a or g
gacaaagctgtgtataaatggagtgagggctcctactcatcatcatggtgaggtttttttnttctaatattaaccatatcaattccactagtaatagagtaaaacctactgcctggaagag

SEQ ID NO: 21998 - DNA, 121 bp, Artificial Sequence
  Synthesized
  misc_feature (61): n=c or g
cacaggtttttaatgtttgtagcttttggtgagtatggagaaccaagcgtgtttaaagccntatgtgaataaacggggaggccctgtgatttaggaatcaaagcacagagctgccttctct

SEQ ID NO: 21999 - DNA, 121 bp, Artificial Sequence
  Synthesized
  misc_feature (61): n=t or c
tgctgctggacaatgtagtgctttcctaagtttccttgtatgcacattgcttccttaatgngttagatggaaaaagtctcaaatgttaactaagttagaggaaacaagagcatcacgaaag

SEQ ID NO: 22000 - DNA, 121 bp, Artificial Sequence
  Synthesized
  misc_feature (61): n=a or g
ctagagtgaattaaaatacatggactacataaaataaaaggagtgtctttcctgaattaanaatcctgttcctgaagatttcaaagtctccttcaactccagcctttttctctccattctt

SEQ ID NO: 22001 - DNA, 121 bp, Artificial Sequence
  Synthesized
  misc_feature (61): n=t or c
agttaatgcttattaaaatacctctccaagtttttgacctcccatgtacacaagtgttgcnctttgtatataaaatcaaaagacaattggtaaggattttcacaacacaactttcagatat

SEQ ID NO: 22002 - DNA, 121 bp, Artificial Sequence
  Synthesized
  misc_feature (61): n=t or g
tgtatgaaatatttgggacccctgttagtgctgagtggtttccatgcgctatacattttcnctatgtaacagagggaaaagaaatgcctgtattagtgatttacaatggctaagcagtcaa

SEQ ID NO: 22003 - DNA, 121 bp, Artificial Sequence
  Synthesized
  misc_feature (61): n=a or g
gaaaaggcagcactgacatgcagtactgtttggctgctgtgctagcgggtaatgcacaccntgctctaatgcatcttcaaatcattcattagttctagttgctgcaaaatgtctgttaaca

SEQ ID NO: 22004 - DNA, 121 bp, Artificial Sequence
  Synthesized
  misc_feature (61): n=a or g
gtaaatctcagaaagaagagatgtgttatttttattcctgtgttctgatgtatatgcttcnttataaaagtctctctacactggttacggtctagactcagactgtgaaagatacaataca

SEQ ID NO: 22005 - DNA, 121 bp, Artificial Sequence
  Synthesized
  misc_feature (61): n=a or c
acctctcctattcaggaaactcccttcaacgtgctttagcattttcccagacttgctttgntgcccatgggacccaccgggctctttccacacgtgctgagggcagtgatgtccttgcatg

SEQ ID NO: 22006 - DNA, 121 bp, Artificial Sequence
  Synthesized
  misc_feature (61): n=a or c
tatatcccagtcccagtacggttgtgtctggagtgcacagagtacttttgggctgtgctgngtgcaattaagtgacattactttattcccaaaggccagcccaagacctgtgctcttctca

SEQ ID NO: 22007 - DNA, 121 bp, Artificial Sequence
  Synthesized
  misc_feature (61): n=t or c
tcacagataaagcagtgggataaataaaattaccggcaaccagcctttcaaacagcttcanggtcatacacaagaaagcgagctctgtccctccactaggtgtgtgggaatttggtgcttg

SEQ ID NO: 22008 - DNA, 121 bp, Artificial Sequence
  Synthesized
  misc_feature (61): n=a or g
acccgtcaacctaaggaggaagacttggaggcacaaatacgtatagactcgaagccaactnattactgactttttaacatgtcttgatctgggattcttgattttatgttgtggaaacaca

SEQ ID NO: 22009 - DNA, 121 bp, Artificial Sequence
  Synthesized
  misc_feature (61): n=t or c
ggtaccttaaatctgcagttacataattttagttgggacatatagcattatagttccttgntatgataaatgttactgtctccgtatagaagaatcacgtctacctcaagccctgaattag

SEQ ID NO: 22010 - DNA, 121 bp, Artificial Sequence
  Synthesized
  misc_feature (61): n=t or c
ccatgagaaacaaattgtcctcaattccatcacttgatcccacacacagatgaggaacatngcatcctaggacacagcctggctcctggcactgtggtggctggttctgcctggtgcttgg

SEQ ID NO: 22011 - DNA, 121 bp, Artificial Sequence
  Synthesized
  misc_feature (61): n=a or g
tattgtcatgatttccttctgctgatcttcaaagttagcaagtcctgaccatgggtaacanctgagcgctgcttaggactgaaaccactccaccacacacgcaaagatgaccacaccaggg

SEQ ID NO: 22012 - DNA, 121 bp, Artificial Sequence
  Synthesized
  misc_feature (61): n=a or g
tacattttggtagagtttcaaaaatgtaactcacatctcaaccaagcgtagacaggtcatntcatactacttgtgtttgttttttaactgcaataggctgctctgcctattggtctagaaa

SEQ ID NO: 22013 - DNA, 121 bp, Artificial Sequence
  Synthesized
  misc_feature (61): n=t or g
aaaataacgatatcttatctcacgtatagtggtggtaatgttgttaaagccaagatatttngatgaatattagccaatttttctccccaggaaggtcgcaactagtatttgataaactgtt

SEQ ID NO: 22014 - DNA, 121 bp, Artificial Sequence
  Synthesized
  misc_feature (61): n=a or g
accgaagacttcactccattgcttactcagttaaatgacccttggagcaaaagtatatccntatgtttctcagttatgattgctaatgacatttagaaaagtatattatcactgtaatcat

SEQ ID NO: 22015 - DNA, 121 bp, Artificial Sequence
  Synthesized
  misc_feature (61): n=c or g
cagtaggaggcacttctgtgagaagaaaatgctatgagggggtctgtcttcaggaaagaanaagataatgtttgaaataaagataattttgtttcatagaagtttgcagcagctgatcagt

SEQ ID NO: 22016 - DNA, 121 bp, Artificial Sequence
  Synthesized
  misc_feature (61): n=t or c
cagacagaaagttaaagttattttactagactcaatgtccatatcatgggaaatttccaanattattccttattcataaagtgaccttcattaggtttaatattccagtcttcgggaatat

SEQ ID NO: 22017 - DNA, 121 bp, Artificial Sequence
  Synthesized
  misc_feature (61): n=t or c
accattttccttcaaaaagcactctgatttcccggtataatgtggagttgcaggtaatganggccagcgtacgtcccagttggagttttgtcaccagaggagtctgccaggccttcattaa

SEQ ID NO: 22018 - DNA, 121 bp, Artificial Sequence
  Synthesized
  misc_feature (61): n=a or g
ttactcatggcaacacacaataattatgccagtgaaagataggccaaaatttggccaggcntgttctaaagaactgtgtttgactcaaggtagtattctatgccagaatgttatgccatgg

SEQ ID NO: 22019 - DNA, 121 bp, Artificial Sequence
  Synthesized
  misc_feature (61): n=t or c
acaaaacctgcagcatttccctcaaccccttgctacaggacatttatatcatctgttttantatttcattacatctgtgacagtaaaactgtataaccaggaaaatgcagcagattctctg

SEQ ID NO: 22020 - DNA, 121 bp, Artificial Sequence
  Synthesized
  misc_feature (61): n=t or c
ttagcactaggggagacagtggtgtgtagaggcagaaaagactgggaaatatgattgtttnagtggctgtgttgggaaagctctaactattcgtgacactgaggcctctgctaaggctcct

SEQ ID NO: 22021 - DNA, 121 bp, Artificial Sequence
  Synthesized
  misc_feature (61): n=a or t
ggcacaaaactgagttcaaagttggtcgacataattctgaggttaggacttaacttctgantttagaatggtttgtggtgctgaagaacacttacacaggtaagaatttttgctgctattt

SEQ ID NO: 22022 - DNA, 121 bp, Artificial Sequence
  Synthesized
  misc_feature (61): n=t or c
gcagcacttcacctctgctctcagctcagggtcctccctcccaaaatgtgccaagaaaagncagagctttcagaaagaggatggtgaacccagtaggacagactgtgcttggctggctcct

SEQ ID NO: 22023 - DNA, 121 bp, Artificial Sequence
  Synthesized
  misc_feature (61): n=a or g
gctgagcagggaagttcaaagtgcacataacccagtaactcattctacctgacccttaagncagaatggcaggcatgcatccgagaacaaaggttgcagctccagctgagtggtctgcccc

SEQ ID NO: 22024 - DNA, 121 bp, Artificial Sequence
  Synthesized
  misc_feature (61): n=a or g
caagcagacagctggcccactattttattgccctatggaagcttctttgggactatcggtncctcacagaaaaccctacaaagatccccagctcatctctaagggtagcttagtctctctc

SEQ ID NO: 22025 - DNA, 121 bp, Artificial Sequence
  Synthesized
  misc_feature (61): n=c or g
agaatcctaattcttcagcttatctatgagaaagaaagttctctgatgacagtttaggaanaagagggaacaaggagatatcctcagggaggtgaagagcaactctcctagatgctggtaa

SEQ ID NO: 22026 - DNA, 121 bp, Artificial Sequence
  Synthesized
  misc_feature (61): n=a or g
atgacaggtagcagagtctaccttaaaatagtcatttaatcattccctcttaacagccagncattaggaagaaaatgaccaggtgtcctgcatagtgtttaacagtatcagtgtattaaca

SEQ ID NO: 22027 - DNA, 121 bp, Artificial Sequence
  Synthesized
  misc_feature (61): n=a or g
ctattgcattacactaggctgcacacacctcccaggtgtgaagcacactgacacttgcccngtaggttatacaaagcaattaagatgaaagtgaatgggcttctttcggtgcccttgctaa

SEQ ID NO: 22028 - DNA, 121 bp, Artificial Sequence
  Synthesized
  misc_feature (61): n=c or g
aatatctgcatggaacagggcaggaatgaaactttttacagctaattgattccaaactagntcaactgctatccacataaaactaataaaactgaagaccaaccaaatgtataatgatttt

SEQ ID NO: 22029 - DNA, 121 bp, Artificial Sequence
  Synthesized
  misc_feature (61): n=t or c
gatacttctttgctcaagccacgcttttctataggatggtagcatgtgaagcaagagtctnggatatctgtggtgtggctgtgcccctggatttctaatttcttgcatttgacaaaaaaaa

SEQ ID NO: 22030 - DNA, 121 bp, Artificial Sequence
  Synthesized
  misc_feature (61): n=t or g
atcatttgatttgtggttagggcacattgcttccatacccagcgcaatccagggcaacatncaggaactgccactggctgtgttgttaatctctgctggcaataggaaagcagcctcctca

SEQ ID NO: 22031 - DNA, 121 bp, Artificial Sequence
  Synthesized
  misc_feature (61): n=a or g
attcacagcctacaatgtggcctgtgggttggcatgagcattggcaagaggctgagggggngatacaggatttggctggtttggggatgaagacatcccagtggggtagctggcaggtgac

SEQ ID NO: 22032 - DNA, 121 bp, Artificial Sequence
  Synthesized
  misc_feature (61): n=t or c
tgtgtgatattaacatgaaatctttctgctttccgtacaaattcaactcttcaaggggaantgactttgaatgccccccttcctcaataggcatagggctgtacgagcccacgggcagcca

SEQ ID NO: 22033 - DNA, 121 bp, Artificial Sequence
  Synthesized
  misc_feature (61): n=a or g
gtagcacaatccgtggactggtgatgtgaattttccattgaataagaaggtcaagatgcanacttcagtgggtgaagtgacttgcactgtattttgggatgggaaaggactgatccttcta

SEQ ID NO: 22034 - DNA, 121 bp, Artificial Sequence
  Synthesized
  misc_feature (61): n=t or c
ctttgcagccattctgtgcatagccccatgcatggtgagtgtagaggccgccaggactctnctcacaactgcatggggaccgtccctgtatgagtgtgggtgcatccagtggccccgcagc

SEQ ID NO: 22035 - DNA, 121 bp, Artificial Sequence
  Synthesized
  misc_feature (61): n=c or g
gacagggggtataaaggagctactctggaaaagtctggagtaaagaatggcaggacataanaatcataggtttcattatagacatggacatacacttttattaaatatacttacaacacgg

SEQ ID NO: 22036 - DNA, 121 bp, Artificial Sequence
  Synthesized
  misc_feature (61): n=a or g
cacgccagatggaaataccccacagtgtacctgacggatggtgatatacactgcccagatncacataagttccgtttcactccaagctgattgaaacctagaaagtggcattagcacaggt

SEQ ID NO: 22037 - DNA, 121 bp, Artificial Sequence
  Synthesized
  misc_feature (61): n=t or c
gcaagaccacatggctctgtgattcctctgttgtgctggctgggtgtggggctgctttgcngacagggagcactccctgagcacagagcagccccacagccccacatccatcctcctctgc

SEQ ID NO: 22038 - DNA, 121 bp, Artificial Sequence
  Synthesized
  misc_feature (61): n=a or g
aatacacgaaaataaataattaaaacaaacagctacaaacccaaagtgccaaaaacacctnaataatggaggcctttcccactgcaacatgaaaaccacttcaggacaaactcaggaatat

SEQ ID NO: 22039 - DNA, 121 bp, Artificial Sequence
  Synthesized
  misc_feature (61): n=a or g
agcttgtcccagtgagctcccactgggtacagggccaccacagccagagcactctgtatcncctcactctgaacatactcaaggttttcagtgtgtgtttgaaaataatagatgggattgc

SEQ ID NO: 22040 - DNA, 121 bp, Artificial Sequence
  Synthesized
  misc_feature (61): n=a or g
tatatatgcatatttttatatatgtatatataaatactaaatactaagaaagtcccaagcnaggacatagagagaaagagagcagttatcagtatggcaagaaaacccatttgtcaggcaa

SEQ ID NO: 22041 - DNA, 121 bp, Artificial Sequence
  Synthesized
  misc_feature (61): n=t or c
tattcttagatgatttgatctaacctcctagaacagttacacactctttgatttttattantggattataaacttgtccacgttaccaagtttttcattcttacaggtatctatctgcaaa

SEQ ID NO: 22042 - DNA, 121 bp, Artificial Sequence
  Synthesized
  misc_feature (61): n=a or g
gcttcttatttgcttgggtttttagaatgaagccctaaggaactgacatcagttctactgnaaacagtgcaaaattgagcataaaaattaatcagggatggattagtccctaaatcagtaa

SEQ ID NO: 22043 - DNA, 121 bp, Artificial Sequence
  Synthesized
  misc_feature (61): n=a or t
tgacaacgtctgctcttttgtgggtatgctagaggccatatgtttctgtagcgttcatagntagcttctgtgtcatattaatagcacttggccacaattccagagtctaatggtgccactt

SEQ ID NO: 22044 - DNA, 121 bp, Artificial Sequence
  Synthesized
  misc_feature (61): n=a or g
tggcaacgcactgacaactgcagtccttgggcttttggatatactgggacagaagggtatntctccaagaaatgcatgatgaacagacacaacttagtgcctagagagggtttagatttgc

SEQ ID NO: 22045 - DNA, 121 bp, Artificial Sequence
  Synthesized
  misc_feature (61): n=c or g
gtcagtgtgttttagcaaaatctacatcagctaagcaatatagcaggcctcttcagctagnttgttttttaagggggcagactgaaagcaaaattggagaaggcaagcctgggaggcaaag

SEQ ID NO: 22046 - DNA, 121 bp, Artificial Sequence
  Synthesized
  misc_feature (61): n=a or g
agccataggcactgcctagtcctctgcagtgcaaacagtaccatcaaatggtgtcagaccngtagttttaagtgctccagctacaccacagccccaacttctacacatggcactaagctgc

SEQ ID NO: 22047 - DNA, 121 bp, Artificial Sequence
  Synthesized
  misc_feature (61): n=t or g
aaccattcactcccctgaaagaaaaccaccaaaaaatgtcttcctgtgcacagaagaaaanaacaattttaaattagaattttagagcattgccaaatgatcacatatctgtgtctaagat

SEQ ID NO: 22048 - DNA, 121 bp, Artificial Sequence
  Synthesized
  misc_feature (61): n=c or g
gttgaggagaggggagttttaaaaagatgccttcctcagctctatttctgcaagaaaagtnagtattaaactgaaatgctaagtctctgatgatgatatcaaggatgatatcacaaggaca

SEQ ID NO: 22049 - DNA, 121 bp, Artificial Sequence
  Synthesized
  misc_feature (61): n=a or t
gaaacaaaaacccaaccgtagcaggtaaaaaagcccaggaacttagagggaatgatctacnttaccatgtgtcttaaggttactctttatttgtacttttgtgcccaaaacaaaaaagact

SEQ ID NO: 22050 - DNA, 121 bp, Artificial Sequence
  Synthesized
  misc_feature (61): n=a or g
gtgcttctcaggacttactgctgctgccagttctgctgctgcctttctacagaagcttganaatgccactctggtggtccagaagtggtccaaacatgattgtcacagctgtatgagagct

SEQ ID NO: 22051 - DNA, 121 bp, Artificial Sequence
  Synthesized
  misc_feature (61): n=t or c
gatttaatgtttgtaatgctcaaattcatttatgttcatctcatgacaccatacctagcanttttttggttgaggagggacattctgtgtggattgtttagtcagtctctcccactgttac

SEQ ID NO: 22052 - DNA, 121 bp, Artificial Sequence
  Synthesized
  misc_feature (61): n=a or g
caacgggcggctcaggctggattttggctgcgtacttcttgcacagtgaatattaactacngagaaactcttggaataggtccgtgtcatttctttacatgtgttcctttcagtctggagc

SEQ ID NO: 22053 - DNA, 121 bp, Artificial Sequence
  Synthesized
  misc_feature (61): n=t or c
ggtttatcaggcccagagaaaggggcaatctcagcagggtttattttacacagcatcgccntcctctccctatcagacatctgcagagaacttgcatgccttttctctctcttatctgtac

SEQ ID NO: 22054 - DNA, 121 bp, Artificial Sequence
  Synthesized
  misc_feature (61): n=t or c
aattcagcctatttcccttccatctgcaaacacagtgtttggaacaacaggaacacagtcngtccatcaggaggcacacactgacagtgaattattaccccatccagtgtgggattgaggc

SEQ ID NO: 22055 - DNA, 121 bp, Artificial Sequence
  Synthesized
  misc_feature (61): n=a or g
agcaaatgaatatagtagttgaactgtgacctcattctaagtatcttttaccagctgcttnaggtggttgtttccaatttctgaaaaacacttttttttttttttttttttggtaaaagct

SEQ ID NO: 22056 - DNA, 121 bp, Artificial Sequence
  Synthesized
  misc_feature (61): n=a or g
ctgtgctgaactcgaagcagtggggttcgtgagtacctctatgcacagctccaagcccgcnccagtgtaactctgttgttacagagctctcagatgttgaggaccttagcttatggatcag

SEQ ID NO: 22057 - DNA, 121 bp, Artificial Sequence
  Synthesized
  misc_feature (61): n=t or c
cggtggtttcagagctcgtggatgtcagatataaaagtacttactttgaatatacagccanggagaaaaggtgattcatatctcgataatctattccaccaggaatcttactacccacatt

SEQ ID NO: 22058 - DNA, 121 bp, Artificial Sequence
  Synthesized
  misc_feature (61): n=t or c
agtcacttatctccttttctctcaatttaaccatcctttacactgatggaccaacattcanctacctcacaggagagctgtgaggacaaattctttggttttagggtctttcaagattctc

SEQ ID NO: 22059 - DNA, 121 bp, Artificial Sequence
  Synthesized
  misc_feature (61): n=t or c
ttttcatcatcatttgtagcaagattattcacaaaaacagcataagtgttcataaaaatantaagacagcttcaagaaagaaacactatgctccacttaatagacaattttgtcacaagta

SEQ ID NO: 22060 - DNA, 121 bp, Artificial Sequence
  Synthesized
  misc_feature (61): n=a or g
ttgtgatgagcatgtcgagcggcgactttgtgaagatgttcactggtgagtaacagttgcnttcggcagaacagaggcagctactggtggcaggaaacatcctgctgatggatgagcaaac

SEQ ID NO: 22061 - DNA, 121 bp, Artificial Sequence
  Synthesized
  misc_feature (61): n=t or c
tatattaatgagacacagctttttcatgaaatactgaaatatttccaacagagaaaaattnagttatatacttacggcatggggtgttttgtttgttcacaagttgtgggaatgcaaagat

SEQ ID NO: 22062 - DNA, 121 bp, Artificial Sequence
  Synthesized
  misc_feature (61): n=t or c
ctgccatcaagaaatctgtagaagctaaaagcccacattcttcaaacctttcactgcccancgcaacacgcagatgcttcacctccataccttgacttcatagccagtgaggaatttcatt

SEQ ID NO: 22063 - DNA, 121 bp, Artificial Sequence
  Synthesized
  misc_feature (61): n=t or c
ggtttctttatgtctttacactgagtagtgattctagcagggtcacggagaagggactagngagtggcttcctttgatggggacaagatagaaaaagtgctgtcagcatcctgtggagtga

SEQ ID NO: 22064 - DNA, 121 bp, Artificial Sequence
  Synthesized
  misc_feature (61): n=t or c
ctgaccagaggctgtcaggctggaaggtccagagctagaagctgtaatgtgaccttgccantgaacaaaatagtaccaaacagagaacaatcagaaggttcttgaagaattccaacagccg

SEQ ID NO: 22065 - DNA, 121 bp, Artificial Sequence
  Synthesized
  misc_feature (61): n=t or c
agtggaaaaccatgaaaatgcagcaagatttcaccatacgtgagaaactattaaagctttnagctactaaacctacagaaaaagaaaagcatgagaaggtctcattggctgtggtagagtt

SEQ ID NO: 22066 - DNA, 121 bp, Artificial Sequence
  Synthesized
  misc_feature (61): n=t or c
taatttccatgatgaacttgtatgttcctattcctacaacaagtctaatatatcttcagtntcataatttctcctctaaatgtgtttattaagtgaaaatggttttgaaattccactgttg

SEQ ID NO: 22067 - DNA, 121 bp, Artificial Sequence
  Synthesized
  misc_feature (61): n=a or g
agaaatctcccttggctgctctggctacttctctttatagatggctctaggcagtaggcancttaattgcacatcacttcctcagtattagacaccagagtaaccacgaggctaacactag

SEQ ID NO: 22068 - DNA, 121 bp, Artificial Sequence
  Synthesized
  misc_feature (61): n=t or c
gcgtcacagcatggtgccacctggtgccactcatgcgtgggagtggagaggggcttctggntctgcagtcacctagctggactgaccccgtattcctccccttttcctaggagaaccaggg

SEQ ID NO: 22069 - DNA, 121 bp, Artificial Sequence
  Synthesized
  misc_feature (61): n=a or g
aaacaccccgagaagtcattagatttgatcatgacaattgtgaataatcacctctgctgcncattgctatgatgcacagggccatcgtcagtcattcccaatgatctgccacaaactttct

SEQ ID NO: 22070 - DNA, 121 bp, Artificial Sequence
  Synthesized
  misc_feature (61): n=t or c
gccaccttccagacaccactggccgtatttttgacacatgtatcaataattaaggagaganaggactctcaaatacaaagcaaacccccagcctcaccctctaacaccaagcccttaagca

SEQ ID NO: 22071 - DNA, 121 bp, Artificial Sequence
  Synthesized
  misc_feature (61): n=t or c
ctctgtggactgcaaaaaaaatcacagaagaggtaaaggccattgtttggtcttcctttgnttgaatttttgctaggtcttgcaactctcacagtctttcaataaatcagagactacacat

SEQ ID NO: 22072 - DNA, 121 bp, Artificial Sequence
  Synthesized
  misc_feature (61): n=a or g
gggagttgtttatcaattaacacttgttacaaattattagtaattatatggactttgcgtntatacttcagccagtaaaacctgagccatactttcctacaacagaaattaattcagatgg

SEQ ID NO: 22073 - DNA, 121 bp, Artificial Sequence
  Synthesized
  misc_feature (61): n=a or g
actgaatatacaatgataaacccccttgtaaagaggatttggcctgacatcttgtccgagnttcagtctgtctcttcagcacaaacgatttgtgctgaacacaaggatcgaacctccaaac

SEQ ID NO: 22074 - DNA, 121 bp, Artificial Sequence
  Synthesized
  misc_feature (61): n=c or g
atgcattctactaaaaaacttatacacaactacaatttccattactgtgagtttccaaccngttccagttaactaggtttttggaacaagacagatctattgacctgctctggtttctggg

SEQ ID NO: 22075 - DNA, 121 bp, Artificial Sequence
  Synthesized
  misc_feature (61): n=a or g
gaacagcacagatgatgacaaaggatgcaatgctggtcaaaaaagcacctccatacatcantgttttctgtctggttggcattttggctggcagatttttcacaggttcagattttcttcc

SEQ ID NO: 22076 - DNA, 121 bp, Artificial Sequence
  Synthesized
  misc_feature (61): n=t or c
tatcactctttattcctgatagagctgtagttggacttaaaagatattttgtaatggctgntgagtcatttacatgaagtgctgcaaacaaattctagcatttatagtattgaagttatct

SEQ ID NO: 22077 - DNA, 121 bp, Artificial Sequence
  Synthesized
  misc_feature (61): n=t or c
aaaaatcttacatatgatctgcaggacgtcttgatgcacagtgatttaaagatgatgttangagctatatacttccatcaccattcatgtaaagaatggcacctatcacgaacgccagaga

SEQ ID NO: 22078 - DNA, 121 bp, Artificial Sequence
  Synthesized
  misc_feature (61): n=t or c
ttccatcacctttccaaggatggagttgaggctgactggcctgcagttgctcagatcctcngtcttgccctttttgacagaatcactttgctaagtctgcatcagtgactgatcccatgat

SEQ ID NO: 22079 - DNA, 121 bp, Artificial Sequence
  Synthesized
  misc_feature (61): n=a or g
gccagtaaatatttgacagtagttcaaatagaagtcttttcttatagtactgttgtagccntaggagcatgtgcaaatgcagtttcaggaaaaaaaaaatcctcaacctagttaaaataca

SEQ ID NO: 22080 - DNA, 121 bp, Artificial Sequence
  Synthesized
  misc_feature (61): n=t or c
gttcagttcctttaggtgtggtctgtaaagcagcactgaaactggggtgctgtgagaaacngtgatcactggacgattacacagatgtaaatatctgccagcattactcagtgacacgtgg

SEQ ID NO: 22081 - DNA, 121 bp, Artificial Sequence
  Synthesized
  misc_feature (61): n=a or g
gtaaatttttatcattttggtccccataactgtaaaagcaaagagccatcagtcgatagcnggatggccatcacgcacttgtcttcatcacctgtttgtggacatgctggcttgtaagcat

SEQ ID NO: 22082 - DNA, 121 bp, Artificial Sequence
  Synthesized
  misc_feature (61): n=a or g
ttttttctgttgttgttacctgaaatccatcaggacctcagctccctgttatacttttctnctccatcctgtgatgttaatacatacgcagggattcacttgcacttcaaaaggacatctt

SEQ ID NO: 22083 - DNA, 121 bp, Artificial Sequence
  Synthesized
  misc_feature (61): n=t or c
ggtcatgtcatcataagcatctgcttcccattcctggtaaagtgggtgaaggctcagactncaagtttggatctgtagcagagctcacacatcaaagaagctgaattttgttaactatatc

SEQ ID NO: 22084 - DNA, 121 bp, Artificial Sequence
  Synthesized
  misc_feature (61): n=t or c
tttggtcaatagtataggcttcagagaaagttccttgcagcaaaactgcaactcactgtantggaatttaattaataaatgtctcgttttctaaaccacatttgccaaagcattaccaacc

SEQ ID NO: 22085 - DNA, 121 bp, Artificial Sequence
  Synthesized
  misc_feature (61): n=a or c
tccaggctttgactaactcagtgcttctgccttggtccctgccagctgaatgaagggttangtgcttgcttggtctgtaagacgaaaaaatgggagaaaacactgtttcctgcttatgggc

SEQ ID NO: 22086 - DNA, 121 bp, Artificial Sequence
  Synthesized
  misc_feature (61): n=t or c
ttccagttattgtatttatatatttaagtgatcattactttagctccatcttctgtaattntcccctttttcatgttattaatgcccctaatcttgggatcaaaatgaccggctgtacaga

SEQ ID NO: 22087 - DNA, 121 bp, Artificial Sequence
  Synthesized
  misc_feature (61): n=a or g
ccagtaagatggatctcatttcatttcccaaatccctctggtctccagagttcattctttnctcttaacgtttcatgctatggcttattttagtctccttagtgaaaagtttaaaacattt

SEQ ID NO: 22088 - DNA, 121 bp, Artificial Sequence
  Synthesized
  misc_feature (61): n=a or g
acatcacagtttgtataaagcagaccttttcataaaacaaatagagtctagaagtagcccntggattttctgcatatgatgagcagtatttcactatttcctgacaaaaacccagtttcca

SEQ ID NO: 22089 - DNA, 121 bp, Artificial Sequence
  Synthesized
  misc_feature (61): n=a or g
gaagccagatgagcagagactgtcgtgtcctttaggactatgtaaacaaattcctgactcngaggttacaggctaagttcccaagagaagccacgggctatggaagaaacattaggtgcat

SEQ ID NO: 22090 - DNA, 121 bp, Artificial Sequence
  Synthesized
  misc_feature (61): n=t or g
aaaccttctctcattaccctttgctgatgagatgctactgccctgtggcccactgtacatncaaggatcagctcagagcagtgggtgctgcttgtgccttgtgaggaaagctgctggtagg

SEQ ID NO: 22091 - DNA, 121 bp, Artificial Sequence
  Synthesized
  misc_feature (61): n=t or c
tcacatcaggttcatctgaagcaccagggcatctctacagtaacctcagaaatttcaggtnaatgaattcatcctctgaaaataatacctaagatttccaagaagaatgtaacacgttgta

SEQ ID NO: 22092 - DNA, 121 bp, Artificial Sequence
  Synthesized
  misc_feature (61): n=a or g
caaactgggggaaagcctaagcagctcacccacggacagaggggaaacttgaatcaaagcngagaactgagagcagatttcctccatgagcagcagtggagaggtgccaggaggtttggct

SEQ ID NO: 22093 - DNA, 121 bp, Artificial Sequence
  Synthesized
  misc_feature (61): n=t or c
catggttgctactcaagccgaataaacaacctgcagcaagggaatctataatgatatacangctctcattactgcagaacatgcaggaagaatacctcacatcattccctgtgttttattt

SEQ ID NO: 22094 - DNA, 121 bp, Artificial Sequence
  Synthesized
  misc_feature (61): n=a or g
aaagttgagcaaggaaaaatatgaaatccacatcattcacagaatggtctcatttggactnctttggaaaaaatacagaagatattttgctgcatgcacaccatggatacaggaatgatac

SEQ ID NO: 22095 - DNA, 121 bp, Artificial Sequence
  Synthesized
  misc_feature (61): n=a or g
tgtgagcgctatcattccatcccagcaagggaaaaaccaaaggttaaggggaggttattcnagagaacagaagtgataaaaatcaaaagcatttcttctgctgactctgagccttcagaag

SEQ ID NO: 22096 - DNA, 121 bp, Artificial Sequence
  Synthesized
  misc_feature (61): n=t or c
gactctgcttggatggacactcttaacacctaaaagggcttcagcttgacagcaagaatanagctgctcaaaaataaatgattgttatagaccattagtgaaaataacctagttttatttt

SEQ ID NO: 22097 - DNA, 121 bp, Artificial Sequence
  Synthesized
  misc_feature (61): n=t or c
ataccccttctcaggaacacctcattttcttttgtatgtttaaccagctgccaagagcaangcttgtgcaaaaccctctcttttcctcctctgcaaactcaagcaatgctttctgaacacc

SEQ ID NO: 22098 - DNA, 121 bp, Artificial Sequence
  Synthesized
  misc_feature (61): n=t or c
ttgtaagtgatttagccactcccttttcagtattctttcacaagtggttagtgataatganaatgtggtcattttttattattactgtattttcaggtggaaagaaaggcaaagcaatcat

SEQ ID NO: 22099 - DNA, 121 bp, Artificial Sequence
  Synthesized
  misc_feature (61): n=a or t
gactctcattgtgacagcaatagtgctatgtttcgcaaaacctcattttatctttccagantcctccaaatctaagcaatgcttagttatgcatgagggaccagtgataccagattgacat

SEQ ID NO: 22100 - DNA, 121 bp, Artificial Sequence
  Synthesized
  misc_feature (61): n=a or g
tcctgccccacaggccgtgacactgggttctcccatgtttgggcacccaccagctatcatngcaggacaacaggtccttcacagctccttccacccagccgccacctccccgcagccacca

SEQ ID NO: 22101 - DNA, 121 bp, Artificial Sequence
  Synthesized
  misc_feature (61): n=t or c
agaccttggcataatttggtaagtctgattctggtaggtctgatggaatctattaccatgncagtgattacttataacttcttttgtctttaatgcagtctaatgagtctctacttagtga

SEQ ID NO: 22102 - DNA, 121 bp, Artificial Sequence
  Synthesized
  misc_feature (61): n=a or g
aaaactttctggaagcttaggaactgtgatagaagccaaatcacccttatcaacttggtcntctacaaagaactcttataggtatttgaagtttaatttcttcctggaaagataaaacccc

SEQ ID NO: 22103 - DNA, 121 bp, Artificial Sequence
  Synthesized
  misc_feature (61): n=t or c
gctttgctgtgactaatagcaaatgttgccactgagttgctctggtttctccatacgcttnggatgctttgttgacctcagtttgagcacttcattatagagatctgtctcgcctttacgt

SEQ ID NO: 22104 - DNA, 121 bp, Artificial Sequence
  Synthesized
  misc_feature (61): n=a or g
gggtgattttctggagaagtattgagtaaattcagggtcgtgggttaataaaaaatggtanaacttcttcctaacttgggaagcaagttggggctggagtatttcagatggagatgtgaca

SEQ ID NO: 22105 - DNA, 121 bp, Artificial Sequence
  Synthesized
  misc_feature (61): n=t or c
gggggccactggagatacagcccaacccctttgctctaaggtcagttagagcaggttgctnagaacattgcccagtccagttctgaatatctccagagattgagactcaaacagtctagga

SEQ ID NO: 22106 - DNA, 121 bp, Artificial Sequence
  Synthesized
  misc_feature (61): n=a or c
gaaacagcggcatgtctcagctcgctggcaataaaacctgcagttgattggctttgtcctnaccgcacagctacaaggaaagtgcaaccacagatttgatgagaagaaagaaggcaaacac

SEQ ID NO: 22107 - DNA, 121 bp, Artificial Sequence
  Synthesized
  misc_feature (61): n=a or t
gtagaatggggggagaagaggcagtgaactaggttagcgtggtcagccacaaacataccanggatttttatcgcatatattgtactgtcaagcatttaagacatgccttctctttctcttc

SEQ ID NO: 22108 - DNA, 121 bp, Artificial Sequence
  Synthesized
  misc_feature (61): n=a or g
caacaacaaaagaaacaattaagagcagtgtaagatccaagaaagttctgacagtctcacntatgatactctcctccagaactagaaccattactttctatggaagctgctgttaacagct

SEQ ID NO: 22109 - DNA, 121 bp, Artificial Sequence
  Synthesized
  misc_feature (61): n=t or c
gagaccataccaatgacatgtgccgtgagtttaatggcctaggggccagagtcctctgagntccttctctcatcaaccattagttacctgtccataagcctttctgtgtgctgctgttcca

SEQ ID NO: 22110 - DNA, 121 bp, Artificial Sequence
  Synthesized
  misc_feature (61): n=t or c
atttcctctgtggaagacaaattcacagcaagaattttggagagtttggtgttttctcctngtaaccactcttcaaagtcatgcaggagcttactgtggctgcttgccctttgcccatctg

SEQ ID NO: 22111 - DNA, 121 bp, Artificial Sequence
  Synthesized
  misc_feature (61): n=a or g
agattaaactggaatgcagttgtatttatgttctcagaaaacttggaaagttggctcagangtgataccactcatggtaatggattgcacagaaaattaatagggaagaactattgtttga

SEQ ID NO: 22112 - DNA, 121 bp, Artificial Sequence
  Synthesized
  misc_feature (61): n=a or g
gcgttagctcatgccagatgaatccaactgcctacagcagagctgtagcataaaacaggcnataacagcacagcatggaggatacctgaattccagaggcaaatcccttatgcggccccgc

SEQ ID NO: 22113 - DNA, 121 bp, Artificial Sequence
  Synthesized
  misc_feature (61): n=t or c
gggacagggggtgggggtgggggggcattcgtggaccccatgtgcaaaggcagctccttgngcccattggtagttgcttgtggcatgatgccagcgaggtttgctgtgccgcagcccagcc

SEQ ID NO: 22114 - DNA, 121 bp, Artificial Sequence
  Synthesized
  misc_feature (61): n=a or g
ttttatgacaggcaccaaaggctctgggagtcgggcacagccacgcgcaccctgcacaganaaacaatcccagtaaagagctttatagccactgaggaatgtggaacctccaccagcccgg

SEQ ID NO: 22115 - DNA, 121 bp, Artificial Sequence
  Synthesized
  misc_feature (61): n=a or g
ttttcaactgacaattacatgctcatatgactctcttcccgagtgtctgaaaagtcttcgnccctttacattttcccctgttggtttgaaggaaggtcttttgttcatgtcctattaatgt

SEQ ID NO: 22116 - DNA, 121 bp, Artificial Sequence
  Synthesized
  misc_feature (61): n=t or c
atttgccacccagattcctagatatttagtgagaacaaggatagaatattatggtgtatcnggtttttatatatgaaagatctttacagggacattacatgtcacatttcattgtttaaac

SEQ ID NO: 22117 - DNA, 121 bp, Artificial Sequence
  Synthesized
  misc_feature (61): n=a or g
tgccacagccagattttggattcccaggagatgaggggaggctgagctaaacctcactgtnttttaggacagataaaaggaccagcaaacaggcagaagcatcctcagcagaggggcacag

SEQ ID NO: 22118 - DNA, 121 bp, Artificial Sequence
  Synthesized
  misc_feature (61): n=a or c
actaagtacatggaattggccaacaaattcggctaaacagtctcagatgttggagtccttnttacagcgttcccagcatcaactgcctggaactgtttaataagatggaattgcagtttga

SEQ ID NO: 22119 - DNA, 121 bp, Artificial Sequence
  Synthesized
  misc_feature (61): n=a or g
acagttcacagttctgttcacagttttcctctgtattttattacttttctggactgtttcntcacagcacaaacgctgagtttatctctcatgtgagattatcttgttatagacaatctgg

SEQ ID NO: 22120 - DNA, 121 bp, Artificial Sequence
  Synthesized
  misc_feature (61): n=a or c
ctacatctgtatggccttgttggagggcatggaaacttaactgcatatttaaaacaaaacnaaaaaaatcaactattacccagttatattccttgaatcttttaagatgtttctttataaa

SEQ ID NO: 22121 - DNA, 121 bp, Artificial Sequence
  Synthesized
  misc_feature (61): n=a or g
acgtggaatattgatgggaaggagggaacaaaagaattgaagtgatatctgaaatagattnaaaccaaaaggacagagtgaggattggggcccgtgtgctgtgggctgatgaggtggcctt

SEQ ID NO: 22122 - DNA, 121 bp, Artificial Sequence
  Synthesized
  misc_feature (61): n=t or c
ccaagaagctgaggaatttgcatgtggttaactgcatgcaaacatcattcggagtgatacnatgaatttattataaaaggcaaagacatttcactttgtgcagctgaagtatgcatttgca

SEQ ID NO: 22123 - DNA, 121 bp, Artificial Sequence
  Synthesized
  misc_feature (61): n=t or g
gttttcataccatataggaaaataggaactaagtaactgattactatatatctccttcacngttccaacattgcatgtacatttattctggatggtttggttctattttcaagatgctccc

SEQ ID NO: 22124 - DNA, 121 bp, Artificial Sequence
  Synthesized
  misc_feature (61): n=t or c
tgcttttacaaaccatttagcctaccagaaagcgccatttaaactggggtttcactgctgnggtactgtgcacggctgcgctcggatgtgtgagctcttgctttaataaactgggggagct

SEQ ID NO: 22125 - DNA, 121 bp, Artificial Sequence
  Synthesized
  misc_feature (61): n=t or c
tagactcaagctatttactgctgatcttcaatttgttcttaataggtaagaattgcagtgnctttcctgttaagagctaccaatttcatagacatttaccataataaaacatttagattta

SEQ ID NO: 22126 - DNA, 121 bp, Artificial Sequence
  Synthesized
  misc_feature (61): n=a or g
catgaaaattaagaaagtgagaaagaaagatcactaatagatactgagtatgaggaaaaanaggcaggaacatccgtgtaaggaaagtagaaaaattaactggaaaaaaaatagaaggaga

SEQ ID NO: 22127 - DNA, 121 bp, Artificial Sequence
  Synthesized
  misc_feature (61): n=t or c
ataatcacatgctatgatatcactgtactcactttccctttttaacaaatattcagaaatngtacttttaacaaaacatactttgctacatatataataaatacacgatatatatatacaa

SEQ ID NO: 22128 - DNA, 121 bp, Artificial Sequence
  Synthesized
  misc_feature (61): n=a or g
ctaaaagcttctgatttcttctttttggaccagcaggctccagtatagcatttctctctcntaattgcctcaggccaatttcttctaaaagaattaaaaatgcaaatctaatatcataatt

SEQ ID NO: 22129 - DNA, 121 bp, Artificial Sequence
  Synthesized
  misc_feature (61): n=a or c
attgctttgccctggaaactgctcaaccaaaacgatctctggttctttctcagctcactgnaaccagatgtacttctcacacaagtacagagatggtaaaagattgtatatttttgatgat

SEQ ID NO: 22130 - DNA, 121 bp, Artificial Sequence
  Synthesized
  misc_feature (61): n=a or c
acaccagtttctgtacttgaaaagttctgcattatcatttcattgcttcggtccagaaagntgatatacacctatgtaagccagccctgtttgaacctcctactgttgtggaagacaagct

SEQ ID NO: 22131 - DNA, 121 bp, Artificial Sequence
  Synthesized
  misc_feature (61): n=t or c
tgctcgtccctttttttctagagaaaataatactaaaattgagtgactgttccagggaagnttcctcatcaagaggctgaagaatcaaactaccattatcttagtccatttagtctaccaa

SEQ ID NO: 22132 - DNA, 121 bp, Artificial Sequence
  Synthesized
  misc_feature (61): n=t or c
tgtagaggcatgtaatcacttgtgtggtttccataagtgtataccatcagtccttgataanagcatgaagagaccacgggcacttgcctttaaatgaaatttcctgcctttatcacttttc

SEQ ID NO: 22133 - DNA, 121 bp, Artificial Sequence
  Synthesized
  misc_feature (61): n=t or c
ttgcatagctgcacaaagtaacgtgccttaagtacatgaggataataaggtctcattatanatatgacacctcatacgaatggaggtggtggttcttccgctaacttcctattcctgtcat

SEQ ID NO: 22134 - DNA, 121 bp, Artificial Sequence
  Synthesized
  misc_feature (61): n=a or g
tatatttctaaacaaagtgtgtaaacaggcagttattaatgacaaacaggaatttccacantggatcaaagtcaaaggccttttagcttggtatttccccttcgctgatgaacatagcaag

SEQ ID NO: 22135 - DNA, 121 bp, Artificial Sequence
  Synthesized
  misc_feature (61): n=t or c
caaaatggagaatgctttaattctattctttttttggttttgtacagtagaaaaatctaanaaccactattgctgagaattccattaggtttggacagtttatatcaatgagaggaatttt

SEQ ID NO: 22136 - DNA, 121 bp, Artificial Sequence
  Synthesized
  misc_feature (61): n=t or c
atctgtactcatgacatatattggcacctggcaagaaatgataataacctacctgttaagngttgtcatcttctctctagctgcccggtcctatggtgtactgcatctgattcagagctga

SEQ ID NO: 22137 - DNA, 121 bp, Artificial Sequence
  Synthesized
  misc_feature (61): n=a or g
aagccttatctagtaaggtcacagatttataccattttctgtccacagaatgaattcaaangacacatacactataaccactgtaatttcaaataatagataaaaaagtactgtgatagca

SEQ ID NO: 22138 - DNA, 121 bp, Artificial Sequence
  Synthesized
  misc_feature (61): n=t or g
cagagttttaaaggcatctcgtaaatcatctacttcatacagtggctgcagaacaaaatanaagtgattggtcacttatcaagtaagcaggggcctataaagatggggaaggacaaaagaa

SEQ ID NO: 22139 - DNA, 121 bp, Artificial Sequence
  Synthesized
  misc_feature (61): n=t or g
gaagagcagattaaaatagattgggttgcagatgctggagtcacttttgttcacactccanctctttactaccactacttaagtaatgttcccctaccccattttgaccttctcttacagg

SEQ ID NO: 22140 - DNA, 121 bp, Artificial Sequence
  Synthesized
  misc_feature (61): n=t or c
tcaactgaactgctatctctccaacaaatccttgctcacgaacaatttgtaaaataacagnagtggaattcatttctcctataaaaaagggggggggggaggggggatgatgaatgtgatt

SEQ ID NO: 22141 - DNA, 121 bp, Artificial Sequence
  Synthesized
  misc_feature (61): n=t or c
ctgctttggtctcagcgtaatcaaaggtttctgaggcaatctgtcctgagttatttcctangacccctgaactacctcatggacagtggtgcttcaactccctctttaccatcttagaccc

SEQ ID NO: 22142 - DNA, 121 bp, Artificial Sequence
  Synthesized
  misc_feature (61): n=a or g
ggggtggaaataagattaaaaacaaacagaaaaagttctgagtagctttttgaatggagcngtaaaaacaagaaacccaattattctgaagatggattatgtgatagggatgcttagcagt

SEQ ID NO: 22143 - DNA, 121 bp, Artificial Sequence
  Synthesized
  misc_feature (61): n=t or c
cgcagcctcctgcaccctctcggtgttggtattagggccaatttgtgcagcagattagctngttgccgaggttggaaagattttcccatttttctgtgaaaacacattaattaataccact

SEQ ID NO: 22144 - DNA, 121 bp, Artificial Sequence
  Synthesized
  misc_feature (61): n=a or g
aaagttagccttgcccacataatgcgtgcataatagggatgtattaagcaaacagggctgnaggcactggtgatgaacagtcctgtaagtgtctgctacacctctgcaatgaaagtgggct

SEQ ID NO: 22145 - DNA, 121 bp, Artificial Sequence
  Synthesized
  misc_feature (61): n=t or c
cggaaatattttttgaccagagcaaatagaagtttgatcaaagtgcaggtaaaggtgttangcaggcattccccttaagcagtttgccagctatgtacagcagcccagcttgttcactgct

SEQ ID NO: 22146 - DNA, 121 bp, Artificial Sequence
  Synthesized
  misc_feature (61): n=a or g
cagaaattgtttaaagatccttcagtgaaaagttatattgatgttttcagaaacattatcnttttaaactgtctattggttttcatcttctcttagaaatgacatgaaccaaagaagtaag

SEQ ID NO: 22147 - DNA, 121 bp, Artificial Sequence
  Synthesized
  misc_feature (61): n=a or g
aaactaacagactgaaacaggatcaataaatatacacgtcaatagaatcatgccagttcanatgatgtgttctttacatagatgaatgcaaacgggcgaatggagcaaggggccatgtaaa

SEQ ID NO: 22148 - DNA, 121 bp, Artificial Sequence
  Synthesized
  misc_feature (61): n=a or g
gttcctgtgctggttgttggctttgttttttaaacttagctgtcttagtgcatgctagacngacctggaaaatacacattagctagagggctgaaaaaggcaagtgtctctctgggacacc

SEQ ID NO: 22149 - DNA, 121 bp, Artificial Sequence
  Synthesized
  misc_feature (61): n=t or c
ttctggacaagaatatcacgctgatgtctggaggggtgaggaggggatctggaattgcagngtaatccaaacagtgaaggaccaacagaggccagaggtgtgcaggggtaagcatcccctt

SEQ ID NO: 22150 - DNA, 121 bp, Artificial Sequence
  Synthesized
  misc_feature (61): n=t or g
gtctgggacatgttgacctgcttagtaaaaaatctttgaagaatctcttggtttttttttncctccagtgagcaacagactacacatcattctgtgaaacatggctgtcaaatacctttgt

SEQ ID NO: 22151 - DNA, 121 bp, Artificial Sequence
  Synthesized
  misc_feature (61): n=t or c
tcttgaactaattacttacactacgcgacgaggaataagaagtagcttattagccagttgngacctcttctgatttcggatgaataaaactgaatttcatctaagtttcttaacatgctat

SEQ ID NO: 22152 - DNA, 121 bp, Artificial Sequence
  Synthesized
  misc_feature (61): n=t or c
taaggttttcctatgagcttctacggttttctctgggagcatcacgaagagttaggcaacnccagattgaaagaccctggcctcaagggctgaagaatagagctacattgtaacatcctga

SEQ ID NO: 22153 - DNA, 121 bp, Artificial Sequence
  Synthesized
  misc_feature (61): n=c or g
gaggcacctacagatctctgcagccccttactggcagtttttctgtgcgttctataccagntcttggaggtgtttcttggtgatggacgagatgtgtgttgcatcagaggaaatcatcccc

SEQ ID NO: 22154 - DNA, 121 bp, Artificial Sequence
  Synthesized
  misc_feature (61): n=a or g
aattgggaattgagttattttgagcatatttatatctcaatttatattatttctgacttcnaattcccctagagattctgtggtccgtgcaggatgatttattcaggatttatttattcat

SEQ ID NO: 22155 - DNA, 121 bp, Artificial Sequence
  Synthesized
  misc_feature (61): n=a or g
gcatgactcagcagcgttttggagaagttgagtctatggggtcatgaggaaatcttcattntttgatgtgtcctgtgctgtctcatttgagacaaatgtgatgctcaatcttggtcatatg

SEQ ID NO: 22156 - DNA, 121 bp, Artificial Sequence
  Synthesized
  misc_feature (61): n=c or g
aataaaataaaataaaataaaaattggcatcttaattggcactaattggcggccccagaanagaggggttttgcatgcttgccttgattcagtttcccctgacacccactccatagaggcg

SEQ ID NO: 22157 - DNA, 121 bp, Artificial Sequence
  Synthesized
  misc_feature (61): n=t or c
tatttaatagcgtgattaatgcttttagcagtaacacagctgtagggttttgcaacacttncttacacaattgaattccagttaatggtccttctataacatctcctaaaaccaaaccaga

SEQ ID NO: 22158 - DNA, 121 bp, Artificial Sequence
  Synthesized
  misc_feature (61): n=t or c
gaagaccacctacaggaagcagagatacaggcattagagagaaaacgcagaggaaagtaanggttgctacttgaacttacatgccttaaaagcagttcattatgtttgaatttgaatggag

SEQ ID NO: 22159 - DNA, 121 bp, Artificial Sequence
  Synthesized
  misc_feature (61): n=t or c
ttagtttggtctgaaagaggacttcagaaacatttagtttggccggcaaactgaatgagcnttgtttaaataaccaaacaggtacagaaggctatttgatgtttgaaattgtcaataaatt

SEQ ID NO: 22160 - DNA, 121 bp, Artificial Sequence
  Synthesized
  misc_feature (61): n=c or g
tctgtttaagcctggattgcagaatggtttggttctggttaaggccttctggggagctcantgctctgacagtgcttttccatagctgaataattttctaccctcagtttgcaaacttaga

SEQ ID NO: 22161 - DNA, 121 bp, Artificial Sequence
  Synthesized
  misc_feature (61): n=t or c
atacggtagtccccttgcttggtatctcacagctcagcaggcttgttcctcctaaatgcanggagaaacctgcacatagtttgtatttgagaggaaaccatgaagcaaatggggaaaagat

SEQ ID NO: 22162 - DNA, 121 bp, Artificial Sequence
  Synthesized
  misc_feature (61): n=a or g
ttcttattttgttaaatgaataaattttgagagtaaccacaacttaaaatattaacttacnaggcttttcaaagtaattagaaattctgagctatgaaagacctcagaatatcatgtctag

SEQ ID NO: 22163 - DNA, 121 bp, Artificial Sequence
  Synthesized
  misc_feature (61): n=t or c
tctggacatgaggacacgtatgatttccactcgcacgctctgaatattggccctcttcctntggggccactactgccttttccataagagtgttctgcaaacagcgacatccttcagacct

SEQ ID NO: 22164 - DNA, 121 bp, Artificial Sequence
  Synthesized
  misc_feature (61): n=c or g
gattgtacaaaggcacacgttcctattgttcagcctgatagatagatgatattaataggtnaacttccattgggaaggaaggcttttatcaacagcaatagcaaatgttacgtccttctgt

SEQ ID NO: 22165 - DNA, 121 bp, Artificial Sequence
  Synthesized
  misc_feature (61): n=a or g
tgagagaactcattaagttcaaggatatcagaatgaccagagtcaactcttgcaacatttntaaatactcactaggtccatacagagtgtagtagttgcagtcactccaactagtatgtcc

SEQ ID NO: 22166 - DNA, 121 bp, Artificial Sequence
  Synthesized
  misc_feature (61): n=t or c
ttaaagtcacatccccttcttccaattggcatgaacacctctttatgggatgagtaataantgcaggcttcagaaagtcatcacagagtgctggctgttggccgcaggtcatccttcttcc

SEQ ID NO: 22167 - DNA, 121 bp, Artificial Sequence
  Synthesized
  misc_feature (61): n=a or t
gaaaacaatgacaaaggaagcagacatggaacacacagatgatgtgcactaatgtaacatnacatgaaagacatacagccctggcccatgcatgcagaaaacagagcaaagcagaacagtt

SEQ ID NO: 22168 - DNA, 121 bp, Artificial Sequence
  Synthesized
  misc_feature (61): n=a or g
aaaagcagtattcgagactataaccattatcacattcacttgaatttggtcttctggaacngattcttagtaacaaagccccaggaacagggataatacaataccggagcatggcatgaga

SEQ ID NO: 22169 - DNA, 121 bp, Artificial Sequence
  Synthesized
  misc_feature (61): n=a or g
atggatgatgttgcgcgccctcaggccctgtgcaagcaggaggagagtgaactgagacttntgccacaccaccgacttacgccacactgctgacttaaaccacaccaccatccctccctgc

SEQ ID NO: 22170 - DNA, 121 bp, Artificial Sequence
  Synthesized
  misc_feature (61): n=t or c
ccgctacatcttggaggaacagcggtagccttcctttacaaacatctggtctagctggtgnttaagattctacctttcatcctagtgacctcttcccttggagcaaatcctttttactctg

SEQ ID NO: 22171 - DNA, 121 bp, Artificial Sequence
  Synthesized
  misc_feature (61): n=a or g
tctagctcatgtctgacaagatggttggagcttgcagttgtcacagctcacatcaccacanaaagggaagtcctgtcccagcactgtgttacagctccacattactgaaacaaaaacagcc

SEQ ID NO: 22172 - DNA, 121 bp, Artificial Sequence
  Synthesized
  misc_feature (61): n=a or g
aaaaactcagcagttctggaggagaaagaacattgtaatgttttatgtattctggcaatantatcccataagtgattatttgaaagagctatttcataaaaagtattaaaaaaaaaaacac

SEQ ID NO: 22173 - DNA, 121 bp, Artificial Sequence
  Synthesized
  misc_feature (61): n=t or c
ctctggtagaacgtgacatctggaattgctggttcctactgagttgtttggcctttcaganttcctcagtatctcatgggataatgatgtcagaagtggaaacataattttgttctctaga

SEQ ID NO: 22174 - DNA, 121 bp, Artificial Sequence
  Synthesized
  misc_feature (61): n=a or c
tgcactattcttgccagctttccagccctagatgttggtgcagctggatggaccagctccntggatagagctgattgcagattaacctgtaccgtggcactaagatgactgtgagaggtgc

SEQ ID NO: 22175 - DNA, 121 bp, Artificial Sequence
  Synthesized
  misc_feature (61): n=t or c
aagcctacactgttattgttgcattgctacttttcctttgtggtcttttaggaataacttntgggtaatgccctttttcatgcattgcttcaacaattcatgtatgaaattcatttgctgg

SEQ ID NO: 22176 - DNA, 121 bp, Artificial Sequence
  Synthesized
  misc_feature (61): n=a or t
gttttgtaaggcaactatctgagagtaataccatcaaatcagaagtagtattttgaacaanagctactgattttctcatttctgattacataacagtaaaaagttaaaatctctacttatc

SEQ ID NO: 22177 - DNA, 121 bp, Artificial Sequence
  Synthesized
  misc_feature (61): n=t or c
ctttgaatatttctaaaatacctctctgctatacataaaaaagtgttttcaaatcacttangaagagctgatttgtttctccataaaaagtctacaggcatagcagagaactatgttaaaa

SEQ ID NO: 22178 - DNA, 121 bp, Artificial Sequence
  Synthesized
  misc_feature (61): n=c or g
ctaacctgcatttacaaaacagctttaaaatatcacagagaaaaactgtacacagaaacantggagcaggaggtgaagggaagaaagaaaaaaaaggtctccttttaaaatatcacttaaa

SEQ ID NO: 22179 - DNA, 121 bp, Artificial Sequence
  Synthesized
  misc_feature (61): n=t or c
actgaatcttagtgcttcttatcctctcccacgtgaggacaagcattttagtttaaaccangctaagtaatgcaataatggtttgtttggctctctgctgaaatggactagcagtgctcat

SEQ ID NO: 22180 - DNA, 121 bp, Artificial Sequence
  Synthesized
  misc_feature (61): n=a or c
accacagaggctaacgagctatattagcttcattaggacacagcctcctctattcaacccnatcttcaacaaatctctgtctgaaaactgcctcgaaataaatgtattttctaatgcaggt

SEQ ID NO: 22181 - DNA, 121 bp, Artificial Sequence
  Synthesized
  misc_feature (61): n=t or c
cagctatgaggcaactagagttaaaagcagaggagtgtaagaacaaaagaaatctacacanaaaaccaaagaaaacacaagttctgctaacccttttgaaaataccctaacactgctaagc

SEQ ID NO: 22182 - DNA, 121 bp, Artificial Sequence
  Synthesized
  misc_feature (61): n=t or c
gcacagacttgaatgttattcatcactgccttcctgttaccgtgctgttcatcacagtttnggcccaaaccaaacagcactgtaccaggcagtctatgctgactttggagttagcatgagg

SEQ ID NO: 22183 - DNA, 121 bp, Artificial Sequence
  Synthesized
  misc_feature (61): n=a or g
tttactgttctgttgaccaaagtataaataagttaaatgcaaatgaaggaaagaacagagnaaggatatttggacaagtaagagtctgcagagacctcctctgctagagaatgatggaact

SEQ ID NO: 22184 - DNA, 121 bp, Artificial Sequence
  Synthesized
  misc_feature (61): n=a or g
cttctgcaggggttgcttttaacttcctgaccctctctccttgttcggtttcttagctatnggggaacttgggactacatggtatgttggatgctgattttgcctgttactcatgacttga

SEQ ID NO: 22185 - DNA, 121 bp, Artificial Sequence
  Synthesized
  misc_feature (61): n=a or t
attgttagggatcaaaacacaaataattggtggaatctgtaaattataagagaaataaatnacacaggaaatggaaatgtagggaaagaagttggttaaggaatctcttctttaagaacat

SEQ ID NO: 22186 - DNA, 121 bp, Artificial Sequence
  Synthesized
  misc_feature (61): n=t or g
acatccttacttggcccctgccagcatttttaccctgaaatacatctattccttgatgacngtgagctttaatttctgtttgatcccattaaatgaccattttttcaaaaaaagcctctgc

SEQ ID NO: 22187 - DNA, 121 bp, Artificial Sequence
  Synthesized
  misc_feature (61): n=a or t
agcttgtgtgtgatcagcgtaaaccctttcctccactgtttggtcggaaaaagcgatattngaagttcgcgtcttccctaaaacccagaagtatggatgtggcgctcgaaaatttgccttt

SEQ ID NO: 22188 - DNA, 121 bp, Artificial Sequence
  Synthesized
  misc_feature (61): n=a or g
cacatgctatgcttgcaaagggacttcacactttgggttacaggccctcttcacatcaagnaatcatctcccagctgtcaggggcctgatagggtccaaccattcagcagcaccccaggaa

SEQ ID NO: 22189 - DNA, 121 bp, Artificial Sequence
  Synthesized
  misc_feature (61): n=a or g
gagttgtggctccatcaaaggtattgccaaacttttctcccagctctgaaacatgagagcngcagtttcttgtatccctcagctgtgcaagtgcatgtgtcctaggtctgcttgctcgtgt

SEQ ID NO: 22190 - DNA, 121 bp, Artificial Sequence
  Synthesized
  misc_feature (61): n=a or g
acacccatctcttcctatatttccattagcatttcactcaaagatctggcttcatgcacanaactggggagagcaggaccttacctaaaaaagaaatactcttgtttctttctcttgcttc

SEQ ID NO: 22191 - DNA, 121 bp, Artificial Sequence
  Synthesized
  misc_feature (61): n=a or g
ttatctaacaagcttcatatctcaggtattcaaccccacaaaacactgctagtgtagcctnttactgaaacaagcaccatatctgatccctgtgcaagcaacagaaagcttctcgctctgc

SEQ ID NO: 22192 - DNA, 121 bp, Artificial Sequence
  Synthesized
  misc_feature (61): n=a or c
agtcccatgttgcttcttgtgtttggttgcttctaggctacttaactgagacatgaggaanttctccaaaatcagccaaggaacagtgacagaccatgaaccatgattcccattgcttttt

SEQ ID NO: 22193 - DNA, 121 bp, Artificial Sequence
  Synthesized
  misc_feature (61): n=t or c
ctctctcagctgtagacagaggggagaggaacaacagtgatgattcggtctcctgagagcngtgcttgatgttgtgtaatgtctcgagccagaaagcagagtagccatctgtggagtgctc

SEQ ID NO: 22194 - DNA, 121 bp, Artificial Sequence
  Synthesized
  misc_feature (61): n=t or c
agtgattttagtcaacaatttgtggcattgtaggatggagctatagaaacccccagctggntgatctgctttccttccataaagcttctttttgtatcttatttactcttaatctgtgagc

SEQ ID NO: 22195 - DNA, 121 bp, Artificial Sequence
  Synthesized
  misc_feature (61): n=a or g
cggaatgtcttctcttcgtacccattcaacccttgccttgtctgctaggatcaccaagaangctttgaattactatgataaattgctaatctaattaacggcaattttttaatcagctgag

SEQ ID NO: 22196 - DNA, 121 bp, Artificial Sequence
  Synthesized
  misc_feature (61): n=a or t
cctgcggacaggcttttgtctcactgagagagaaagcactgagttaccaatgcttgcgttncgttcaccagtgcctgcgcttcaacccgacctaccgcctgatcggtgcggggcagccctg

SEQ ID NO: 22197 - DNA, 121 bp, Artificial Sequence
  Synthesized
  misc_feature (61): n=a or g
gtgactcagttcaactctgaagggattctgtccttccctgttatgagtgctggtaaccgantgtgaagctcagaaaggaaacaactccctttttcttaactgtttcagttgcatagcggcc

SEQ ID NO: 22198 - DNA, 121 bp, Artificial Sequence
  Synthesized
  misc_feature (61): n=t or c
agatatatctgaataaaataagcagtaggttaaactacttcaaaataaaacagttgctacnctattccagaaggctgctagatcacaatctgagatcaataggatttaaaccttgtttagg

SEQ ID NO: 22199 - DNA, 121 bp, Artificial Sequence
  Synthesized
  misc_feature (61): n=t or c
ccagggatcacacgtgagttgtgatacctttgcaatgtgggacaagaacagaatttctttngctctacagactgctagctcagaggcattcagtgctacagagcctaaataaggttgaaag

SEQ ID NO: 22200 - DNA, 121 bp, Artificial Sequence
  Synthesized
  misc_feature (61): n=t or c
ggaaaggaagaaaggctggtgcaaaaggccagactaacaaaaccttaagtgcagcagtaangaagaatccaaaattcagtttcacagcatcatcatggtttccagagcatcagtctgatgc

SEQ ID NO: 22201 - DNA, 121 bp, Artificial Sequence
  Synthesized
  misc_feature (61): n=t or c
gactgagctgctcctcaccgcaccacatgcagcactgccatgcgccagccgcaaaccgttngtagatctatcagcaaacgccttccagaacccgcatccagcaccgacacatatagatacg

SEQ ID NO: 22202 - DNA, 121 bp, Artificial Sequence
  Synthesized
  misc_feature (61): n=a or g
tctgctagtttctctgttagagaagcagcagggtgtacttggagttaaggcaatgacatcntgatcaagcactacatcacctggacctgccacgggggttttccctctgtcctagctattt

SEQ ID NO: 22203 - DNA, 121 bp, Artificial Sequence
  Synthesized
  misc_feature (61): n=a or g
ttcacagcacaattgtattccaataggttcaggcaatgaacctatcactctgcccactccnaatgtaattgatgggccaaacagttttctttgaaacttccttgcttcatacctcactagt

SEQ ID NO: 22204 - DNA, 121 bp, Artificial Sequence
  Synthesized
  misc_feature (61): n=a or g
gcttattttgttgtcttttgctatgcagacagtgagcagaggaggagcctggctctcaccntggcttagagataatacctcaggagcttcttgcttcctcaagcttacctcttccttcaga

SEQ ID NO: 22205 - DNA, 121 bp, Artificial Sequence
  Synthesized
  misc_feature (61): n=t or c
cagaggcagctgggactcgatctgggaatgtttctttatatcagaaggcttagaaaaggantggtgcaagagatagtactgggccagagtagacgttagctgactgctgttgcataagggc

SEQ ID NO: 22206 - DNA, 121 bp, Artificial Sequence
  Synthesized
  misc_feature (61): n=c or g
tccatgtcagacacaagcaccccaagcagaattactgcaataccatgaaaaccctcttccnaaagacatcagttgcacttccatatttccaggttgctttctctttttgccccaactcata

SEQ ID NO: 22207 - DNA, 121 bp, Artificial Sequence
  Synthesized
  misc_feature (61): n=t or c
tggagggcagcagggaaaggtggtggatatgaggattgccccaaagaccacaaaggatggnctgagcggggaacgcagcagtatgaacacagagcagcccccaggcacttactgctcctgc

SEQ ID NO: 22208 - DNA, 121 bp, Artificial Sequence
  Synthesized
  misc_feature (61): n=c or g
ctgtcaaaagctagagtgaatagcagctctgaggtaccactgattcctttgctaagacctntctatggtcttaatgacacacgaatatcgaagttagttcattatgacagaattcttggtg

SEQ ID NO: 22209 - DNA, 121 bp, Artificial Sequence
  Synthesized
  misc_feature (61): n=t or c
ctagaaggagtacgacagttttgagtattgttgcactatctgcatatatatttggctcagnaactgctagaaatgtcaggttgttgatgcacagcattaattggtaagtactggtgacaaa

SEQ ID NO: 22210 - DNA, 121 bp, Artificial Sequence
  Synthesized
  misc_feature (61): n=t or c
tcattgctgcataaattatacagcaatttaggtagcatatgccagctgatgaagtaataancagggtggcattacatcaacccctaaaaccagcttcacatcctttttattaaaaagaaaa

SEQ ID NO: 22211 - DNA, 121 bp, Artificial Sequence
  Synthesized
  misc_feature (61): n=t or c
gtggcagctcctcagacgagtgagttaccttactaagttaaaagccattgtcttgagctgntctgtagtgcccggagaggaaggtacgtcaggtgtgtatgcctgtattgagaggtgggtg

SEQ ID NO: 22212 - DNA, 121 bp, Artificial Sequence
  Synthesized
  misc_feature (61): n=a or g
tgtttaaccaagaaaaaaacaaaatatacagcaccttcatgtattaaatagtctatttccnttcctatgtcacctactgctcatcttcatttcagctttgctttttagtgaaacctttcaa

SEQ ID NO: 22213 - DNA, 121 bp, Artificial Sequence
  Synthesized
  misc_feature (61): n=t or c
catattgatgtgtttagagttgctgtttgtaacatcagttacaaaccagagtaacaaaganggtgaaatgataattcttatttgctagttgggtttctgcatctctcaccacaaacgtgaa

SEQ ID NO: 22214 - DNA, 121 bp, Artificial Sequence
  Synthesized
  misc_feature (61): n=t or c
agctagttaccaaataaagactaccttggaagaacaacgttctctgttttcattcctcacncaaaattttattagtaagcatggcatcacatggtacagaatatgcctttgggcagtttaa

SEQ ID NO: 22215 - DNA, 121 bp, Artificial Sequence
  Synthesized
  misc_feature (61): n=a or g
gtagtgggacaaacttgcttggcttagtcagatgagaaaaggcaagagctccttatctgcnagaacagttcatcaccaaagccaaaaccccacctaagaaatgccagggtataaaggtgct

SEQ ID NO: 22216 - DNA, 121 bp, Artificial Sequence
  Synthesized
  misc_feature (61): n=a or g
tgttatttggaatacaatttcaatactattccatcagataccttaacattcagttcctcanatcttcccacagtttctagtttctaagcagaactccagtcatattttatattcagaggaa

SEQ ID NO: 22217 - DNA, 121 bp, Artificial Sequence
  Synthesized
  misc_feature (61): n=t or c
ccacaagtctatgataaatacatgtatatccatagccacacagtattttgaagtattttcntcatggtttataaatgtctataagcactgtctaaagtctgaggacttcaagtgtttggtg

SEQ ID NO: 22218 - DNA, 121 bp, Artificial Sequence
  Synthesized
  misc_feature (61): n=t or c
ttgatttggggaagttaaatcaatgcgtgcacctagtacaatttacacacctgactaaaangctataagatatatgcttacaatcactaagtgttgctattattacatgaacattgctaaa

SEQ ID NO: 22219 - DNA, 121 bp, Artificial Sequence
  Synthesized
  misc_feature (61): n=a or g
tccattttcctttgctcctttcccttcttccctcctcacacacactaattgctgcagtccntacaaagggatattgcaagtgtgactctgtctggcttttggccacgctcagcctcaatcc

SEQ ID NO: 22220 - DNA, 121 bp, Artificial Sequence
  Synthesized
  misc_feature (61): n=t or c
aaggccattcaggaagacactcaagtgggatttgggaaccctcagaggtcaaggacatccnacatgcctactatcccaaaggtttgcatctcatttgtagcccagtaacaccaccttttgc

SEQ ID NO: 22221 - DNA, 121 bp, Artificial Sequence
  Synthesized
  misc_feature (61): n=t or g
caagtaagaaacttcttagagtagtctttcaggatctctccttttcccctatggcaatccntcctgggtctacataagggtcttgtgttactcatttcttttataacacatttcttctgga

SEQ ID NO: 22222 - DNA, 121 bp, Artificial Sequence
  Synthesized
  misc_feature (61): n=t or g
caaaacagtaatgaaattgttcatttgtttttcttaatttcagcactgtgttacttactcngctaacaaggcactgccttgaaacaatcagtaattaaacggctcctcttctttattttca

SEQ ID NO: 22223 - DNA, 121 bp, Artificial Sequence
  Synthesized
  misc_feature (61): n=t or c
agagattaaaaagagcacctttttgctagtccagttatttctgatcactcatatattgttnaacttaaataatggtgctctatcattctcatagctctgggctcctaatatactcatacat

SEQ ID NO: 22224 - DNA, 121 bp, Artificial Sequence
  Synthesized
  misc_feature (61): n=t or c
ggaacacttatttaatatgggcagcagaattactctatttcttctacagtagctacatccngagcctataccacaggatctcaatgaacatgataaaattcatccccattgacttcaacat

SEQ ID NO: 22225 - DNA, 121 bp, Artificial Sequence
  Synthesized
  misc_feature (61): n=a or c
aacctataaagaaaaataactttctttccaggcctaggagaatcatcagatctgtagttcncagcatcccagtactattgctgctatcctatacttgtgttccctgtatggttggtgtacc

SEQ ID NO: 22226 - DNA, 121 bp, Artificial Sequence
  Synthesized
  misc_feature (61): n=a or g
ccggttcatgaactccgtataaagggcccgctggatctttgacagacgtaccaaaatgacntgttcttccttagaggggagctgaaccttcagcacattgtgcccccgcctggggaggcaa

SEQ ID NO: 22227 - DNA, 121 bp, Artificial Sequence
  Synthesized
  misc_feature (61): n=a or g
tgattccctattactagttttctcaagaacttagagaacatatccatgtaaatgtattttnttatattgttcttaaaagaaggtttagatgtcaaaagactgggaaatgtcacgtaaccaa

SEQ ID NO: 22228 - DNA, 121 bp, Artificial Sequence
  Synthesized
  misc_feature (61): n=t or c
caaagtgggaaagcacctcagctctggtattacaagcctcctccagtgaaacaaaattttntccaaacacatctgacgataacctgcctcagaaatggtagagctctcgtgtttctgttgt

SEQ ID NO: 22229 - DNA, 121 bp, Artificial Sequence
  Synthesized
  misc_feature (61): n=t or g
agtctggcttgtgccaccttcacctgtgtcccacccatcagaaacccagcctgaacacacncacccaacctcaacaccacaaggaagtgtaagggctccacctccactgtgtcttcactcc

SEQ ID NO: 22230 - DNA, 121 bp, Artificial Sequence
  Synthesized
  misc_feature (61): n=t or g
tcagttctgtgtgtcaacatgcttgtattgcattgcggtggtgtttgcaataatcacagtntaaaagcgtatatttcagaggcgcttgatcacagttctaccatacctgcaaaatgtgcag

SEQ ID NO: 22231 - DNA, 121 bp, Artificial Sequence
  Synthesized
  misc_feature (61): n=t or c
agatgtggcactgagggatgtggtcagtgggcatggtgggttgggttgtgatcttagtggnctctaccaaatttaatgactctgtgctgccagtccttcttgccaaccacagaacagccaa

SEQ ID NO: 22232 - DNA, 121 bp, Artificial Sequence
  Synthesized
  misc_feature (61): n=a or g
gatgggttaaatcatgtgacaaaatttggaaattacactcatatatactaagaataaaacncttgtaaaagctgggaccttgccagttgctttgggaagaacagatgaagggaagggattt

SEQ ID NO: 22233 - DNA, 121 bp, Artificial Sequence
  Synthesized
  misc_feature (61): n=a or g
aagaattcaactgcccaaaggaacaaactggacaaacacaaccacaagaacccagtgctcntgggaagttctgatattccaagaacaccagtgtgactctcctcctccccaggtcctaggc

SEQ ID NO: 22234 - DNA, 121 bp, Artificial Sequence
  Synthesized
  misc_feature (61): n=a or c
tagctgtcagaacaacctatctacattgcaaggcttcagtttgccctgatctctgcaacantatagacctcactgtttggatttcatcactccaaaatgcacctgaaactgcatcagagct

SEQ ID NO: 22235 - DNA, 121 bp, Artificial Sequence
  Synthesized
  misc_feature (61): n=a or g
atagtagttgcagaagctactgagttggcaaagatgttgatacatcaagtgcatctctctntgcttgcataaggccttgggtaacaccatctccagtggctctctgtgctaatggcctcag

SEQ ID NO: 22236 - DNA, 121 bp, Artificial Sequence
  Synthesized
  misc_feature (61): n=a or g
caccagcctaccttttcaccttaggaaacctcctggttctcaggccctgccacctagaagntgcaacagtactgctttatggcaagtcctgaaccagcttaatttaagtgctgataagctt

SEQ ID NO: 22237 - DNA, 121 bp, Artificial Sequence
  Synthesized
  misc_feature (61): n=a or g
aacagtgaagagagttgaaccctcccctgttatcatgcagggtgactggggacctgaggantcatgagaggcactgtgttgctcacctagcagatctgtaaatgagcatatcccaaagcat

SEQ ID NO: 22238 - DNA, 121 bp, Artificial Sequence
  Synthesized
  misc_feature (61): n=t or c
tatgccctcaagaagaagctgggctgggagctttcacccctcttcacctttccctttcccncaggctccatctggccctgggacagattctcctgcccccatcctgctggcactcggccat

SEQ ID NO: 22239 - DNA, 121 bp, Artificial Sequence
  Synthesized
  misc_feature (61): n=a or g
caggttctcagtgctgtacagtgctgggatatctcaaaaactggtcaaaaaccaaaagganctgaggttgcccacctttctacaggaccaggccttgggtatgttactgttaaacactgaa

SEQ ID NO: 22240 - DNA, 121 bp, Artificial Sequence
  Synthesized
  misc_feature (61): n=c or g
ctggaataatgtggaattaaaaacacaggactgtaggtctctaccacttagtcttaaatantgattatgtcaggcaaacttcttaacagataacatggaagttaccaaatactttgttgaa

SEQ ID NO: 22241 - DNA, 121 bp, Artificial Sequence
  Synthesized
  misc_feature (61): n=a or g
tgcccttctgaaataagttttctttagtgtaccatgtagaaaaagataaaaaacttacaangataacaggtccagttcttataaatacttctgtggttagagttgaattccctgcacctaa

SEQ ID NO: 22242 - DNA, 121 bp, Artificial Sequence
  Synthesized
  misc_feature (61): n=a or g
tttgttatgggtacaaggccaaagaagcaaccttgccaccggattcaccgccattcaaacnttagtgcaaggaatgttacacagagggtacgatccagtgggataaaagaaggtcacgcag

SEQ ID NO: 22243 - DNA, 121 bp, Artificial Sequence
  Synthesized
  misc_feature (61): n=a or t
ttgctgctggtagtttttctggagaacagcagcagataagaaggctgtatactgcatgggncagtagtcctcatgcacctgagtgaatctgcatcctgcagttaacacaaaacggacagct

SEQ ID NO: 22244 - DNA, 121 bp, Artificial Sequence
  Synthesized
  misc_feature (61): n=a or g
ttcaaatccttcagcttctgtgagggacaattctaagtattataagaaacatgaagactgnagtgtaagaatggccatgtgatctacatagtctctctgactgccttttcttctggaaaaa

SEQ ID NO: 22245 - DNA, 121 bp, Artificial Sequence
  Synthesized
  misc_feature (61): n=a or c
tagcggctcacagaaggtactcatgaggggagaaatgatagacacatttcaaaaccgtgantgagagactcaataaaataagagacttttcagtgattgaactgtagttaattaaagagta

SEQ ID NO: 22246 - DNA, 121 bp, Artificial Sequence
  Synthesized
  misc_feature (61): n=a or t
acattttggcaagttttctcataggagatgtttcatatttagaactgttaactggatctangttttacatcaagtgagcatcctaaaaaggaaagcagctcattacagtttttgtttgtgt

SEQ ID NO: 22247 - DNA, 121 bp, Artificial Sequence
  Synthesized
  misc_feature (61): n=a or g
aatagagcaaaaaagctacagttgattgaacagaactgagtgtgaatctggagatgctgtnagttttctcccattcgtttctttatagactggatggattgatacctcagataccaagagc

SEQ ID NO: 22248 - DNA, 121 bp, Artificial Sequence
  Synthesized
  misc_feature (61): n=t or c
aagcatcagttatgcattagattggaaataaaaaggtgctcttaaatattcattctcaaanggttggagggtaccagctcccaggctgccttcacaactaaaaggacagtaataaggaaaa

SEQ ID NO: 22249 - DNA, 121 bp, Artificial Sequence
  Synthesized
  misc_feature (61): n=t or c
acccagagttggaaaggaccctcaaagatgattgaatccaatttataactgaacatatagngctggcaaactcatgttatgtctaataacagccaaaggattgttctgtgtgaaggcttga

SEQ ID NO: 22250 - DNA, 121 bp, Artificial Sequence
  Synthesized
  misc_feature (61): n=a or g
aagactacagaattcttaattaaaggaaactagcccaacatcaggctatgccctaaatatnaagccagaaccatcagaattggtattcattccatggtgaagagcattttatagtccttgt

SEQ ID NO: 22251 - DNA, 121 bp, Artificial Sequence
  Synthesized
  misc_feature (61): n=t or c
acttggtcagggaacacctccccatgcagcagagatttccagaaagggctggtttattcanagacatagcagtgtggtgcaggacactttgagacggctgaaccctgcagcatcagggaca

SEQ ID NO: 22252 - DNA, 121 bp, Artificial Sequence
  Synthesized
  misc_feature (61): n=t or c
taagaactacagagtgctttaaataccatggaggagaatgtgattgctattagcttgatgngaagaaagaggtctgatcagagaaacatctccctccttttttgactgagacccgctttaa

SEQ ID NO: 22253 - DNA, 121 bp, Artificial Sequence
  Synthesized
  misc_feature (61): n=a or c
ggggatgccagcagctggtgctccacatagacacccacatcactgtgtggatgaaaccacnctctagtcctcttctcatctggactaggccagctggcttcctccatcccactcatcatga

SEQ ID NO: 22254 - DNA, 121 bp, Artificial Sequence
  Synthesized
  misc_feature (61): n=a or g
caataatggatacttgcttctgtttaattttaataatcttttggaacaaccagatttaatntctggaataaactgctttgcaaattaatcaagtgcacgataaagccttttaaagtacacg

SEQ ID NO: 22255 - DNA, 121 bp, Artificial Sequence
  Synthesized
  misc_feature (61): n=a or g
agtgagttaatgcatttgaccatcagaaagaaatcagctgatagtaatcactgaatatagnctttcttcttctaggaattatgttatttctggcattaatggtaactcttttttgtttttg

SEQ ID NO: 22256 - DNA, 121 bp, Artificial Sequence
  Synthesized
  misc_feature (61): n=t or c
cagcagcattatcaaacaagatcttgcatgaccgcaaggtttccattttgtagcatactgncatactagagagctacaaagcaacaggtgctcaccctcagatgacaaaccccaccttcac

SEQ ID NO: 22257 - DNA, 121 bp, Artificial Sequence
  Synthesized
  misc_feature (61): n=t or c
cactattcagtaataaggacacacagtgatctttcacatgcaggtaatagggtatgacatnaaccaccaaaattcccttgttaataaagctttttaaacctaacagatatttcattgttca

SEQ ID NO: 22258 - DNA, 121 bp, Artificial Sequence
  Synthesized
  misc_feature (61): n=a or g
gatagatagatggatagagggacaggcatgaggtttgatttacggttccagaagggtaggnttagcagcagacttgagagcagaacataaaccaacaccaactaaccttcatctaaaataa

SEQ ID NO: 22259 - DNA, 121 bp, Artificial Sequence
  Synthesized
  misc_feature (61): n=t or g
gacattgtctcgaggcaacttgcaatattttctactccgtccttcctccgagcattttgtnttgttaaggctccctcagaaagcacgtaaagctctgctgctcttcggagggatgggagga

SEQ ID NO: 22260 - DNA, 121 bp, Artificial Sequence
  Synthesized
  misc_feature (61): n=t or c
agattgcactaaatatcactaaggatttcctgaagtgtaagctttcttatgacaaacacangagaacagaaaaaagctacttgtaaatattttccttcaaaaacatggtgatagagactgt

SEQ ID NO: 22261 - DNA, 121 bp, Artificial Sequence
  Synthesized
  misc_feature (61): n=t or c
attattaagacatgatgccttgaatgagcagcacggtagtctccagcaggtgctctcttcnttcttcttaggagtaaaggtcttcaaacaattcaatgtcttgcaaatttctctcttcctt

SEQ ID NO: 22262 - DNA, 121 bp, Artificial Sequence
  Synthesized
  misc_feature (61): n=t or c
atgtgtgttaaggaaatatgtattagcatgagatttctcaatgttttaaaagtattatctnattgaaagtgtacagaaataatcaaacatgaagggagggaaaaaacatctaagtaacagc

SEQ ID NO: 22263 - DNA, 121 bp, Artificial Sequence
  Synthesized
  misc_feature (61): n=t or c
caaggctggctactctaaaatgagtatgcttataatttcagaaagtaagctgttcgtatcngtgcagtcaatttgtttatacgtagtctgaagtccctagactaaggttctgataacaatt

SEQ ID NO: 22264 - DNA, 121 bp, Artificial Sequence
  Synthesized
  misc_feature (61): n=a or g
gggaagttggatctttcaggagccagtgcctctcacagctgttgcagttcaagtctttcanggtgtttctgtaatctgctttgcactgttttttggtcccagtgacaaagttgcagattct

SEQ ID NO: 22265 - DNA, 121 bp, Artificial Sequence
  Synthesized
  misc_feature (61): n=a or g
tttctttcaccacctagttctcgtccaccatggtctgtgttttctggctgtcattttccantctgagagcttccttctgaaaaccctcagcctgtccatggccaactgctggggaacagcc

SEQ ID NO: 22266 - DNA, 121 bp, Artificial Sequence
  Synthesized
  misc_feature (61): n=a or g
ccggggagggacattttgctgcccgatattgcgttaatgaatccagccctttgtttggccnggggctgcgtgctgacaaatgtgctgtttcctgagagcctgagaacatctttgtgctgtg

SEQ ID NO: 22267 - DNA, 121 bp, Artificial Sequence
  Synthesized
  misc_feature (61): n=a or g
acgttcctatccttaaagacatatagttttagttctgtgacctttatcatagaaacattgnagagtaaatctcattcaaagcatttaaatgagatcaaacataagctgcagagtagataga

SEQ ID NO: 22268 - DNA, 121 bp, Artificial Sequence
  Synthesized
  misc_feature (61): n=c or g
tcttctgttcatcagacacttttccttctgtattgaaagtgaaatctctttgcttagtctngtggagagctgtgatatttctgttatctgtttgaaagtgtatgttcatagaatcagaaaa

SEQ ID NO: 22269 - DNA, 121 bp, Artificial Sequence
  Synthesized
  misc_feature (61): n=t or g
accgtgggaaaaggaatttaataacagcaaggacaggtagcttttaagcactccactctangaccccacacctaagtagaagcaaaacttcacaaccagaaaaccactcccagcagcacat

SEQ ID NO: 22270 - DNA, 121 bp, Artificial Sequence
  Synthesized
  misc_feature (61): n=a or c
tatttaaaaacctcagagctcttgctttgaaataaagaagtcttagtacgatgtagaagtnagagactgcagtttttatgtggaagaatggagcatgagtttgaccaaagcaaactggaaa

SEQ ID NO: 22271 - DNA, 121 bp, Artificial Sequence
  Synthesized
  misc_feature (61): n=t or c
agagtcatacttacttgtaatgtataaacttaatgcaagatgacagtcctttcccttctgngctatattacagttttgatgaaatagtcatcaaaacatcatcatttagagctatattatt

SEQ ID NO: 22272 - DNA, 121 bp, Artificial Sequence
  Synthesized
  misc_feature (61): n=t or c
gggtctgcactctgcaggttcctgacatcaagcacaccaagcttcaaaggtgctgatttantcttaacggtgcagtcgtaccccaggttactgatatggctccgaagttcctcaggctgaa

SEQ ID NO: 22273 - DNA, 121 bp, Artificial Sequence
  Synthesized
  misc_feature (61): n=t or c
tgcaaggtatccccattgctttgcaccaagcatgtgcctcagtgcaccctgagaggagcangctgctctgcactaggtcttctgttgttttttttttaatcagcatagttatttactaccc

SEQ ID NO: 22274 - DNA, 121 bp, Artificial Sequence
  Synthesized
  misc_feature (61): n=c or g
tcttaaaaacagaatatttttttcctgatcaaactaagtattgggctgcataaagtacttngttcaagtgctgtcatctctgatagcttcatgatttttttggcatcaaatgctaagtctt

SEQ ID NO: 22275 - DNA, 121 bp, Artificial Sequence
  Synthesized
  misc_feature (61): n=t or c
atgtggtgatcctggggccctgagatgcttgtgagccaccagagttgcagacatattcctnaggacagccctttctgactggggtgtcacatgaaggacaacagtcctgtaaagaacatgt

SEQ ID NO: 22276 - DNA, 121 bp, Artificial Sequence
  Synthesized
  misc_feature (61): n=t or c
ttccagatgcctgagaaccagacagtagatttgttatcctgtgggcttgtggtgggctctngacatccttgggcttctggcatttacctcctctatctggtatgtctgaaataacacccag

SEQ ID NO: 22277 - DNA, 121 bp, Artificial Sequence
  Synthesized
  misc_feature (61): n=t or g
attttaaagggacttgggcttgatttctctgattaaattttggcttcattactgtactggntttgcctgggatggagttaattataataacctgtgtagtgctatgcttaggatctgtgac

SEQ ID NO: 22278 - DNA, 121 bp, Artificial Sequence
  Synthesized
  misc_feature (61): n=a or g
aaaataagagctcttgctgccatgagagacaataattagggctacctgggtcttgagtacnatcattttctttggtttatatagttacagcactccctgctttgttgccaacgtgccctca

SEQ ID NO: 22279 - DNA, 121 bp, Artificial Sequence
  Synthesized
  misc_feature (61): n=c or g
cgggacagtatggaaagcagcaaatactggagggctctttctggctctgccactgacttangaccagcaggaaaattcagggccctgtgatcctgagtgttaaacttgaggtgccttaatg

SEQ ID NO: 22280 - DNA, 121 bp, Artificial Sequence
  Synthesized
  misc_feature (61): n=t or g
ctgtaaccctgcaaaatcatgttctgatacaatttatcttccatgtgttctttttcttgancttattcttctagtcaagtatatggaagctcagccattgggttcagaagtcacttgatgc

SEQ ID NO: 22281 - DNA, 121 bp, Artificial Sequence
  Synthesized
  misc_feature (61): n=t or c
gaaatattcttttttttttaatatgaagcttgaccaaatttaggtactttagtacctgagntgtgaagtgtagagaagtattatgggactttctaattcatagctaaaagcagatgtcatt

SEQ ID NO: 22282 - DNA, 121 bp, Artificial Sequence
  Synthesized
  misc_feature (61): n=a or g
cgtagggtgtagatgacctgggggagagtgcatacaggagtaaaacgctcagagtaggggnaaaaattgcagacaatggcactggggtagatctgtgaatggaagggtctgtcaaaggagg

SEQ ID NO: 22283 - DNA, 121 bp, Artificial Sequence
  Synthesized
  misc_feature (61): n=t or g
cagttcaagcaaggtatatttgaactggtgaataaactggctgagaccatttatagtctantgtccaaaaattaaagtgcatgattttgttcatcagagaggtcacttgggttcacagtac

SEQ ID NO: 22284 - DNA, 121 bp, Artificial Sequence
  Synthesized
  misc_feature (61): n=t or c
tagaacctgatgatccttgtgataccttccaacccaagacattcttcaattttactgtagnactgatcacaggaaagagaccaccatgaatctgtcaatctgaaccagagatggcagacct

SEQ ID NO: 22285 - DNA, 121 bp, Artificial Sequence
  Synthesized
  misc_feature (61): n=a or c
gcagataagtgtgtttatcatgggtaattgatgattaagaggggaaacctggctgtcttgntgtaatttgaagggtgtgaacttcaggaagagagctgctcggaagggtagcgggaggtgt

SEQ ID NO: 22286 - DNA, 121 bp, Artificial Sequence
  Synthesized
  misc_feature (61): n=a or g
agatctaatctgcatggacctcagtaacatatttgatacggtgcctcctgggaaattactntttaagctggaaaagatggggattagtgaaagaattgtgaggagctaaagacttagctaa

SEQ ID NO: 22287 - DNA, 121 bp, Artificial Sequence
  Synthesized
  misc_feature (61): n=t or c
ccctgtgccccccagagaccatcaggaaggtgaaagcaatctgctggcgacgccacatcanacactgtggagggaaggaggacctgaacccctgacccggctgtgccaaaaggtgagggca

SEQ ID NO: 22288 - DNA, 121 bp, Artificial Sequence
  Synthesized
  misc_feature (61): n=a or c
attaagcctgggtacagtagtcatgtcctctagcagtagacagacacgtggaaatactgcncctgtaacatcattggatcaaaatactttgctgccattgtctgttatcttacgctgtttc

SEQ ID NO: 22289 - DNA, 121 bp, Artificial Sequence
  Synthesized
  misc_feature (61): n=t or c
ggatgaaaaccaagctggtggatcagggtcattctgattgaattagtgagctttcatgganttaaggtggccagcatggagtgagcttcagccagtcagtgtcttagttaatccagaatct

SEQ ID NO: 22290 - DNA, 121 bp, Artificial Sequence
  Synthesized
  misc_feature (61): n=t or c
gagaaaaataacttagctcttatttaatgtgatcttgtttatctcagggaagttgcatcanccaaacagagcttcatgccgacacagttattctacttatgttatgacaatggcacatggt

SEQ ID NO: 22291 - DNA, 121 bp, Artificial Sequence
  Synthesized
  misc_feature (61): n=t or c
taatcttgtagaaaatactacctttttggtagtgggcatatttatcttgggatacactggnaagctataattctaaaattaccaaccttgggggaggctctccaatgctactaaacaaaag

SEQ ID NO: 22292 - DNA, 121 bp, Artificial Sequence
  Synthesized
  misc_feature (61): n=t or c
ggtttggctcttccatggcagaacttgatgctgctcagggtttcatagattttatcaattntgtggatcggctgatgtgatttcttgtgtttgtgaccactcataggaagtgtttgacttt

SEQ ID NO: 22293 - DNA, 121 bp, Artificial Sequence
  Synthesized
  misc_feature (61): n=t or c
tatgatctcttccctcttcaatcttttcttgctttaaactctacctcccaggctagctgcngtaatctagcagtcactgtggagtaggtgggagttgcaattgctgcaagaaacagtgtac

SEQ ID NO: 22294 - DNA, 121 bp, Artificial Sequence
  Synthesized
  misc_feature (61): n=a or g
agaggcttcttgccttacgcagagcaattgttgaactgtactcttttgttgcaatggtatnactgtatttgtagataaagctgtaggagtcagaggtgagcacacagcgagttggagtatg

SEQ ID NO: 22295 - DNA, 121 bp, Artificial Sequence
  Synthesized
  misc_feature (61): n=t or c
gtagatcgctggcctgttcagcttcccttatcaatcatgatacagttgaactccaggcttnccatcgctggtgtcagccctcagaccgtgagaagccaatctgatgatgaatgattttctg

SEQ ID NO: 22296 - DNA, 121 bp, Artificial Sequence
  Synthesized
  misc_feature (61): n=t or c
aatttctaatgtgtcattaaactggagttaagcaacgtagacttcttggacttttgttttnagtcatcatccataagtattcagttcataatgaaacattattttcctataacttcaaaaa

SEQ ID NO: 22297 - DNA, 121 bp, Artificial Sequence
  Synthesized
  misc_feature (61): n=t or c
gatgtttactcattttactgaggcaccagaaataataagtttcagaaaagagtcatttcanagaatctttcattcttactaccattttcttaacactttgataagaatcaggctactcagc

SEQ ID NO: 22298 - DNA, 121 bp, Artificial Sequence
  Synthesized
  misc_feature (61): n=t or c
aagtgaaaataaaggatacatctgattctttatcaattacatagccaagattccccaaccngaaatcacttattctctcgacagtgtttacttatcaattttaatggttttaatgggattc

SEQ ID NO: 22299 - DNA, 121 bp, Artificial Sequence
  Synthesized
  misc_feature (61): n=t or c
tatgacttcagtgcaatgcagtgattttaaagcatcgttgcttgtaatgtccctgctcctnttctcagaggatgctgctgtttttccttgcttgtgggagagattatagatagaactttaa

SEQ ID NO: 22300 - DNA, 121 bp, Artificial Sequence
  Synthesized
  misc_feature (61): n=t or c
gttttcgaaaagctgaactcatccaacgtggtgtgaaccagtggaatcccacttgtgattnagcttcactgaacagtaggtgcagcttcttaacagggcagtaagtcctcatagttcaaat

SEQ ID NO: 22301 - DNA, 121 bp, Artificial Sequence
  Synthesized
  misc_feature (61): n=a or g
cattttgtaacagagctaatgctttattggaaaagtatatcagtacaaaaaaggtgtgtangcaggtaacctaaaaatggagcaaggctttcatgcatagttattgtccatgtcatgtaaa

SEQ ID NO: 22302 - DNA, 121 bp, Artificial Sequence
  Synthesized
  misc_feature (61): n=t or c
caaagtactcctgaagttttgaaaggcatatatctgcagtttttgcagccttctctgtagncataaggtataattcttcacctgtatacttttcagacagtccagggatctggaattttgt

SEQ ID NO: 22303 - DNA, 121 bp, Artificial Sequence
  Synthesized
  misc_feature (61): n=a or c
ttttttttctttagccaagacatagcactgactttcttcactgtcactttggcttgtgttntttatcctctgacacatgggctgttgcagccagggactagctgctgcaaccatataggta

SEQ ID NO: 22304 - DNA, 121 bp, Artificial Sequence
  Synthesized
  misc_feature (61): n=t or c
catcccttcagcatgagcatcagaaagaccgatctcagcacaagttatgataactgaaganaatctcacaagtgcctctaaatggtttaagcagatcccactcttaacttggaaaaagaga

SEQ ID NO: 22305 - DNA, 121 bp, Artificial Sequence
  Synthesized
  misc_feature (61): n=t or c
gtgggctgaaaggaagtgtgaggtctgcaagccttacacccaaagagagctgagtccatcnctttcagattagtagcaaaaacaaaaatccaacatttaagggctgtcaagaatcgttttt

SEQ ID NO: 22306 - DNA, 121 bp, Artificial Sequence
  Synthesized
  misc_feature (61): n=a or g
gctctaagctgatcctgtgctgaacaatatttctgaaggtactgctatttttcgtttagtntttgtagcttgtgttgagttacaggccatgaaattatttttataatcgagcctggtttgc

SEQ ID NO: 22307 - DNA, 121 bp, Artificial Sequence
  Synthesized
  misc_feature (61): n=a or g
ctaaaacttgtgattctaggccaaggaggagaggcagccaggtgctagctctttcccaagngtagggcagaccatgactctactaaaggataccaagagatttcagtccctgtgcattttt

SEQ ID NO: 22308 - DNA, 121 bp, Artificial Sequence
  Synthesized
  misc_feature (61): n=a or g
gcagctccagctcggatctgtcggcactgtgaaagaaggagcagggagaggtgacacagcncagcacagcagcgaggatagggctcagcgtgggggaaccatggcgtcctagggaagggtt

SEQ ID NO: 22309 - DNA, 121 bp, Artificial Sequence
  Synthesized
  misc_feature (61): n=t or c
tcagtagcactatgggcagctaggtttataacttttatctgtccacttcaaatatattggngattcaagatttgagaggtcacaattactgcttaagagttctagtttttaggtacaagaa

SEQ ID NO: 22310 - DNA, 121 bp, Artificial Sequence
  Synthesized
  misc_feature (61): n=a or g
aatcacttccttcaactctcaacctttctttctgtgttctgcctaattacatctgagatangtagatactcctgggctgtcctagaacaccgaccttttctcaagatctcccttgaggtat

SEQ ID NO: 22311 - DNA, 121 bp, Artificial Sequence
  Synthesized
  misc_feature (61): n=a or t
gtggattatgttttaagtttgtttttttttctgtcctaatttgtttgggggaagtgccaantttttccatagttaggtagataactagaaataggaggaaagtgaaactttaaaagcagaa

SEQ ID NO: 22312 - DNA, 121 bp, Artificial Sequence
  Synthesized
  misc_feature (61): n=t or c
tacaaaactggaattacagaagcatagcgctgcttaacttgtgcctggtcagtagttaacngttatgcttaggtcttatcaaaaacttccagtaggaggaataaagacatctggatttttc

SEQ ID NO: 22313 - DNA, 121 bp, Artificial Sequence
  Synthesized
  misc_feature (61): n=t or c
attgctttgtaagtcttggctcattttatgtccgtgcttctataaactccacagtggaganaaaataaccactgaggatgacttagactcagggcatcaagtcagattattgctgaagcat

SEQ ID NO: 22314 - DNA, 121 bp, Artificial Sequence
  Synthesized
  misc_feature (61): n=c or g
ttccttctctaatccagctgaaggaccccgaacactgaattcttgttgattaataaacacnagattgttttcaaaggacgttctccttcactgtaaagcatctgctggctatgcaactctc

SEQ ID NO: 22315 - DNA, 121 bp, Artificial Sequence
  Synthesized
  misc_feature (61): n=t or c
atgtaatttgaggtttaattggctgagagctattaaaaacctcttcaacccactgtaaaanatttctgggtgaccatcaaatagtaacaagtaagaagacaacaaaacatgcctgtgctga

SEQ ID NO: 22316 - DNA, 121 bp, Artificial Sequence
  Synthesized
  misc_feature (61): n=t or g
ttgcttgtgcctgtgcttgtacagaattgcatggaacctggaagtgtactttttctcaggntcagcactgtgattttatagctgtgactctgagtcactgggaggggcagtagggatctgt

SEQ ID NO: 22317 - DNA, 121 bp, Artificial Sequence
  Synthesized
  misc_feature (61): n=t or c
cgttgccctgtttttctatttccatgggtagccaaatatgaaataaagaacaaagtcctgncctccttgctgacaattcaccctatttcctaaagagttttgtttgaaatctctgcgtgtc

SEQ ID NO: 22318 - DNA, 121 bp, Artificial Sequence
  Synthesized
  misc_feature (61): n=a or g
tcctaatctgtgacgcagagagtcttgaaatttctgttttagggtaataggctggtctgcnaagaaggatttattttttagcagtctgagagttgacaaaaccatgcacataacccaccag

SEQ ID NO: 22319 - DNA, 121 bp, Artificial Sequence
  Synthesized
  misc_feature (61): n=c or g
catcgcagtttggtaatgcaaagcactacaatggagctgtctttgcacagaagttaatttnagtctttcttcccatgaagtgggattgctatctggaatttggaaagcaggcatgttttag

SEQ ID NO: 22320 - DNA, 121 bp, Artificial Sequence
  Synthesized
  misc_feature (61): n=a or c
acctggtaaaaagcactgacttcaagcagaagacgggcaggcatcaccacactctcagtantcaatccagtactgagaatgagggaggatttagtttcacatcagtagatttctggcatag

SEQ ID NO: 22321 - DNA, 121 bp, Artificial Sequence
  Synthesized
  misc_feature (61): n=t or c
aggtagggggcagctggaataacaagttattactctccttttttacagtatttctagattnatttctgcttgggcaaatgaacaactctagtctggctaataagtgcttttggttgatcat

SEQ ID NO: 22322 - DNA, 121 bp, Artificial Sequence
  Synthesized
  misc_feature (61): n=t or c
accatttcaaaatgatctcaaacagcagtgtgacagtcctcctcttgaatcttcttaaacncttttctctgagatatcctggaaggtctgtcatcttgctttcagccccagtggcatgatt

SEQ ID NO: 22323 - DNA, 121 bp, Artificial Sequence
  Synthesized
  misc_feature (61): n=t or c
ctagctcccaacgacctctgtgctgcatcctgaccagactaaccagactcaacccaaacangaaagatcgctgcctactggagataggactggatgaaactccaagcagaaagtatgtgat

SEQ ID NO: 22324 - DNA, 121 bp, Artificial Sequence
  Synthesized
  misc_feature (61): n=a or g
actctttcctttttttgttctttcagatattcagaaaggtatcagcatagttacaggcgcntctagcccacagcccttttcctctataatgttctcttttctttttcaggtctgtgttgtt

SEQ ID NO: 22325 - DNA, 121 bp, Artificial Sequence
  Synthesized
  misc_feature (61): n=a or g
gacccaatactggtcctcagtgtgatactacggtgtagtgatactacggtgtgatactacngtgtccacatcaggtcttgtctgcttaccagctgtgtgggtaaaacttcacgtcagtgac

SEQ ID NO: 22326 - DNA, 121 bp, Artificial Sequence
  Synthesized
  misc_feature (61): n=t or g
aactcattccctacgtgcccattactcggtctagttgggaagggctgtgctttaataaacngagattaaagagatttctaaccaaccccgtttacacgcattataaatgatcacagcgctc

SEQ ID NO: 22327 - DNA, 121 bp, Artificial Sequence
  Synthesized
  misc_feature (61): n=t or c
acaatcattttcctcagctgtctaactgtgcttttacttaggcagttagcatagatactgnaagggctcgctgccaattctggtcctgctcatcttgaagcaggatgtatcctgcagagct

SEQ ID NO: 22328 - DNA, 121 bp, Artificial Sequence
  Synthesized
  misc_feature (61): n=a or g
atgttatgtcagaataaataggctctattgtcctcattctgcccaaaactgcaccaggagnactttagcagatcagcaagagaagtgtgccctcgtggcttaccagagctgctgcaggaat

SEQ ID NO: 22329 - DNA, 121 bp, Artificial Sequence
  Synthesized
  misc_feature (61): n=t or c
atatctccctgatctaagatggtcgaagtcagaagaaatatgttattttctgtcatatcanatgtaataggacctgcccacatttttttcaggactttctgaaagctgttttaagctttct

SEQ ID NO: 22330 - DNA, 121 bp, Artificial Sequence
  Synthesized
  misc_feature (61): n=a or g
gttcctaaactaaaccttatttatctgtccacacacatctcaacctacaaacaaacagagnacctgcatttcacaccattttctattctatcttcagtatttcatggttatattatgtatg

SEQ ID NO: 22331 - DNA, 121 bp, Artificial Sequence
  Synthesized
  misc_feature (61): n=a or g
cacatcacactacatcacaagaatctctgacaacatgaacaacccaggagaaaaaaacagntccatctcaaaaagctaaatgttctatttttcactcttttttagtaaatcccagtttgga

SEQ ID NO: 22332 - DNA, 121 bp, Artificial Sequence
  Synthesized
  misc_feature (61): n=t or c
tttttgttactataagctcagccttacgtcctggcactcatctgctcttctgccaattcanatcaagttaatgtgcgttgctgagagacaaatgtatctgtagtgcagttgcacaacttat

SEQ ID NO: 22333 - DNA, 121 bp, Artificial Sequence
  Synthesized
  misc_feature (61): n=a or c
atttgtccttcattcagttaatcatggtgcagaaacaatacgttgattgataaatttgacncaataagtagaaaacaatttaactacaatttagagaaaatgtttgaaaaaacagtttttt

SEQ ID NO: 22334 - DNA, 121 bp, Artificial Sequence
  Synthesized
  misc_feature (61): n=t or c
ggtctacgaagaaaataccacaaggagaatgctcttggaaagctgtgctctacacccgctngtagtgctaacacatggcacttcctgattaagctcattttgctttcctcagctactttcc

SEQ ID NO: 22335 - DNA, 121 bp, Artificial Sequence
  Synthesized
  misc_feature (61): n=a or t
tgatccctagtagaccacatgacattcaggacagtgtcttgggtttaactatacatcttcncttgatagactcaaaacacacgtttgtgttacacagggcttgctccttgctcattccatg

SEQ ID NO: 22336 - DNA, 121 bp, Artificial Sequence
  Synthesized
  misc_feature (61): n=t or g
tgagatgcgcccatgactgtatgagaaacagttgagagtgaattctgtggctgttacttgnaaatgtgaaatgtggctctggtcacatattttgaagaatctataacagttaaacagaagg

SEQ ID NO: 22337 - DNA, 121 bp, Artificial Sequence
  Synthesized
  misc_feature (61): n=t or c
ttggcaagcgatgttctcatcatggggaaattagtctaacgtgtgagattctcgcagtagnaatgcttgcctgattcataggaggatctcgtgggaaagatgtgagatttgtgtcaaaaaa

SEQ ID NO: 22338 - DNA, 121 bp, Artificial Sequence
  Synthesized
  misc_feature (61): n=t or g
gctggagtgcttccctctctgaggacaggatcctgctcgctccggtctcgcatgcagcccntttgcttggcgaggatgttaatgagccctgcagtgagtgccccagctgatgtgcaggtag

SEQ ID NO: 22339 - DNA, 121 bp, Artificial Sequence
  Synthesized
  misc_feature (61): n=t or g
accttttaaataattatttaataggctaagaatggttagacaactgacaggaggctttccnaaaaaatccccagatggttggcatcatagggaattttcatttgttgatgtcaatctaata

SEQ ID NO: 22340 - DNA, 121 bp, Artificial Sequence
  Synthesized
  misc_feature (61): n=t or c
gatgtaaagctgcttgaacttttattatgcaagagaggcaagtctattatcggccagggcngggtagaaatcagctaggagagaaggcaggagtagagatggatctctctgcagaccattt

SEQ ID NO: 22341 - DNA, 121 bp, Artificial Sequence
  Synthesized
  misc_feature (61): n=t or c
ttttactttgtgtgctgaaaatgctatcttagtccaagaacaatttgtatgtgctgcattnagccaagttcagttaaaacaatggatttacacgttttgaagttcaaatgaacccactgga

SEQ ID NO: 22342 - DNA, 121 bp, Artificial Sequence
  Synthesized
  misc_feature (61): n=a or g
tcaacacaaccaagattactcatttgaagtaaatattattccagttttatgaagatatgtnataaaacccgaagccacaatgctataccagcagtttggtactacctaattagcatcttgc

SEQ ID NO: 22343 - DNA, 121 bp, Artificial Sequence
  Synthesized
  misc_feature (61): n=c or g
attacagtgtgtttggtcagaatttgtgactcaagacttgcagatgtgtatatcaggatgntgtttccaatgatgtctctccatggactgaattcctaacatcagtctctctcattgtaaa

SEQ ID NO: 22344 - DNA, 121 bp, Artificial Sequence
  Synthesized
  misc_feature (61): n=c or g
ttaaaatatttaacagaactaaaaataatgagctagtcttccacctccaaaagatcttaanagcttcttggcaaagccagttttccaaagttactcaaggaaatgatgttggacgactttc

SEQ ID NO: 22345 - DNA, 121 bp, Artificial Sequence
  Synthesized
  misc_feature (61): n=t or c
acgtgttcgttccttgtgggctgtgctgactaaagtgggtacgagggtggtcaaggttccngaggagtttggtgtgtagagattgctctgtaatttccttaagcagtgtaacggcatccta

SEQ ID NO: 22346 - DNA, 121 bp, Artificial Sequence
  Synthesized
  misc_feature (61): n=a or t
ctgcagtaatatctaactgcagtatctaccctgagcatgggtaggcatcgcagcacatttncgtagcagttcttccccaggtcttttaacataaacgtggcagagttccaggggaagctcg

SEQ ID NO: 22347 - DNA, 121 bp, Artificial Sequence
  Synthesized
  misc_feature (61): n=t or c
cccaataagccagtctggcagaaaagctacttgaagtacttgctatttacataactgaagnttctaggctgtgcaaatttagactgtatcaattcagctggggtttgggtggttcttcctg

SEQ ID NO: 22348 - DNA, 121 bp, Artificial Sequence
  Synthesized
  misc_feature (61): n=t or c
gctcttgttgttcctgatttgcaggtggtgacgttcatccactgccctctgtgctgggagnccctaggaagcttcaacagtgataaacttaggaatttttccattttcatcgataatttct

SEQ ID NO: 22349 - DNA, 121 bp, Artificial Sequence
  Synthesized
  misc_feature (61): n=a or g
agactctaattcctgatgattgcattatctttgcttaatgtatattcttctggcttgcacnagtgctaatagctaattcgttctgctgacacctatcaggaaaagaaagcattacaaagtc

SEQ ID NO: 22350 - DNA, 121 bp, Artificial Sequence
  Synthesized
  misc_feature (61): n=a or g
tacaatccaactccacagtacctcctcagcaagaactcttaattctgctccggtgagtgancatcgtcatcctcttataggaacagacagacatactgcattgggcagctgaataaagcca

SEQ ID NO: 22351 - DNA, 121 bp, Artificial Sequence
  Synthesized
  misc_feature (61): n=t or c
tggctcttgtcctatctgttggatgaaacactgaggaacaacaattgtgaagacataaaangtcaacagcccatctacctcatggaaaaaaatgaaacaacttgcaaaaaacccaaaatat

SEQ ID NO: 22352 - DNA, 121 bp, Artificial Sequence
  Synthesized
  misc_feature (61): n=t or c
acctttatttccgtcttctcttttttttcctctttgaccactgcagccattctcccagganattgcacccatgactacacctttcccctggccattaattcgggacctgcccaggtgggaa

SEQ ID NO: 22353 - DNA, 121 bp, Artificial Sequence
  Synthesized
  misc_feature (61): n=a or g
gcgtgaatatccctaccaacttcagtcagtgtattactgtacaaacaattaaacatgtgcntaaaggactatatttactgaaataggagatgttaccaagaaagataaattatctgacaag

SEQ ID NO: 22354 - DNA, 121 bp, Artificial Sequence
  Synthesized
  misc_feature (61): n=a or g
agaatattcttaatttttagaactgtttatggaggatattgaatgaaagaaggtgtatacntgtaaatcctaaagaattgttgtgctctttccaagggtattggttttaggtactaaaaaa

SEQ ID NO: 22355 - DNA, 121 bp, Artificial Sequence
  Synthesized
  misc_feature (61): n=t or g
gagttttagagagcatttgtacaaactggatcttgcctatgtcattaaagccataggaaanacctgactagaattaggagaacagaatttcccatttttttcccccatacatttattaaaa

SEQ ID NO: 22356 - DNA, 121 bp, Artificial Sequence
  Synthesized
  misc_feature (61): n=a or c
cctgttgactttacagggattattttaaggaacgatgttgtgaaaccactctcagcttccngtcccctggaaatcacagttcagatgtgcctgcagtcaagggagaaagttatggtatgac

SEQ ID NO: 22357 - DNA, 121 bp, Artificial Sequence
  Synthesized
  misc_feature (61): n=t or c
tcttctggatctcgtgggaaatcaatgttactggactatgaatgcaggtctttcagtgccnttaatttcacagaattgtagagtgactgaggttggcagggacctctgggtccgtctggtc

SEQ ID NO: 22358 - DNA, 121 bp, Artificial Sequence
  Synthesized
  misc_feature (61): n=t or c
gaacattaacagcagcccaaaaaacagcttcaacatactgtcacgtcttatatttttttanttataaaatactctgacttaatgcctcccattgaaaacctgtttatatctcattttcaat

SEQ ID NO: 22359 - DNA, 121 bp, Artificial Sequence
  Synthesized
  misc_feature (61): n=t or g
ggtgagcctcactaatgcaagctgctgcttgtgacaccacacaactgaaagcaacattgtncctgggttgcaaattagtgtgggtgaaactgagatgggacatgacacatttgcgccttgg

SEQ ID NO: 22360 - DNA, 121 bp, Artificial Sequence
  Synthesized
  misc_feature (61): n=t or c
ctgcctttcctttggcacatccccgggccaacatacatttttcctaatgccaatgaactangtcagaggaggtgctgcattttagattaaatgcacacttgagatccttcgtacaccaaag

SEQ ID NO: 22361 - DNA, 121 bp, Artificial Sequence
  Synthesized
  misc_feature (61): n=t or g
cttcactttcaatgctctttcacacctggtggttcctacagagctcttccgctgcttcctntgtggttcacaccttactacagatcaaaataaggaagtgggaatctgtcgctattaatat

SEQ ID NO: 22362 - DNA, 121 bp, Artificial Sequence
  Synthesized
  misc_feature (61): n=t or c
caacaaagtgacactaggaaaaaagcacagctgacatttctgtcaataactcttcttaganaagctttcgtgaaacagcatgtttatacttgggcagggggacatactaagagtagtagaa

SEQ ID NO: 22363 - DNA, 121 bp, Artificial Sequence
  Synthesized
  misc_feature (61): n=t or c
ttctctatttactgatgcataccttttaacttgcattcaacaccctccttagatgcttatntgggcatagatattatggaagtacctccatctcattacttatctggagtggtccacgtgc

SEQ ID NO: 22364 - DNA, 121 bp, Artificial Sequence
  Synthesized
  misc_feature (61): n=a or g
aagtagaggtgaaagacaccactagtccagtagaagctgaacctgaagttccaagaccaancagaaaggtagaggtggtcatccaggagagaagagatacaaagcctggtgtgccttatgt

SEQ ID NO: 22365 - DNA, 121 bp, Artificial Sequence
  Synthesized
  misc_feature (61): n=a or g
aataccatctccagctgctcatggtcaagactgagtgatgggaaacaaaccttctgaaagngatccactgtcagcagaaaagaattttcctctaaagtagatcagctttaggctctgattc

SEQ ID NO: 22366 - DNA, 121 bp, Artificial Sequence
  Synthesized
  misc_feature (61): n=t or c
gcttctttcattactactgacctctcagcactggtgggtgtccctggtgtgctaggaacancacttctgcacacgaggttctgattcccatctttcagccttttggcataaatttggggtg

SEQ ID NO: 22367 - DNA, 121 bp, Artificial Sequence
  Synthesized
  misc_feature (61): n=t or c
aactgaccattggtgactcagacattttgttttccatttttcctctaatcactgttactgnaagagagctcagtcatggcaattgtgtggagttataccaggtacagcagagacttcactg

SEQ ID NO: 22368 - DNA, 121 bp, Artificial Sequence
  Synthesized
  misc_feature (61): n=t or c
caggaaagttatttttcttaatgcgttagttatatttcagtaacattatgaagctcttttncattcacaaaactcccgagggaaggtatcttccttccagctcaatgttccactcatgagc

SEQ ID NO: 22369 - DNA, 121 bp, Artificial Sequence
  Synthesized
  misc_feature (61): n=a or g
ggggctggagaacccagccgcagtgtcagacctcagcccagtgaagagcaaaaaagccttnatcaggacaaatatcatcacagagttcccctggtagaagccagcgtgagtttatgggaca

SEQ ID NO: 22370 - DNA, 121 bp, Artificial Sequence
  Synthesized
  misc_feature (61): n=a or g
atagccacaacatacataaagtgaaggaaaacaccaaacaaataaggcaggaacagattcnaactgaatacattatcaaatgacccagaagaaaaactatgaaaaatcatatatgctttag

SEQ ID NO: 22371 - DNA, 121 bp, Artificial Sequence
  Synthesized
  misc_feature (61): n=t or c
tttcagtgtttgcatcccttttgcttttctgtgctagcgagtcatctgtcttccatttcangcaaggccttgggttgtcagaaacaaaaacccatgatggtggatactacctcatgtggag

SEQ ID NO: 22372 - DNA, 121 bp, Artificial Sequence
  Synthesized
  misc_feature (61): n=t or c
atgcagaaactcaacatttttgcatttgaattgtatgtatgcctcagctttctttcctccnccattttgttttgtacatcttcctgtgcctgtaaatgcccaggaaatgctgtagagtata

SEQ ID NO: 22373 - DNA, 121 bp, Artificial Sequence
  Synthesized
  misc_feature (61): n=t or c
acaagatagacaattcagaattgaaataagaaagtacatttctttgtgatccaaattcacnaaaactcacctaatttttcatgcagacattttggatgcttctcagttgtacgaggggtgc

SEQ ID NO: 22374 - DNA, 121 bp, Artificial Sequence
  Synthesized
  misc_feature (61): n=a or g
attttatgcatcacaaactgttaaaggatactggatcaactaggggcagaaaaaaagaatntacagaaaatttaatgtgtacaagctttctctggcaaaaaatcaaatgaacaaactgcac

SEQ ID NO: 22375 - DNA, 121 bp, Artificial Sequence
  Synthesized
  misc_feature (61): n=a or g
tattcaaggaaaaactgctaataaatgtaaatacagaattaaatttgtgcttgctagcacngcataataggggtcataagtcaggaactggggcttagtgacctttacatattttctgata

SEQ ID NO: 22376 - DNA, 121 bp, Artificial Sequence
  Synthesized
  misc_feature (61): n=a or g
ctgaagtgtaattccttgattattatacattaagtgctaaccagtaaaataatgcactagnacaagaactctagggtctaaggtgcaagaactaaactaaatgaaaataaataaaagtggt

SEQ ID NO: 22377 - DNA, 121 bp, Artificial Sequence
  Synthesized
  misc_feature (61): n=t or c
aatgacaagagtgcttcttcatatagaacatgggcccacatgatccaatggaaatgtccangcattgtgaagcacaaagttaatggataccaaactctggctgtttgagtgctcatgaact

SEQ ID NO: 22378 - DNA, 121 bp, Artificial Sequence
  Synthesized
  misc_feature (61): n=t or g
tgtttagcagctatataatatagacactattgctgttaccatggacagacagggtagaagntgcattttaacaagaatatttccaaaagagacagaaagtacataggtgttcaattgtttc

SEQ ID NO: 22379 - DNA, 121 bp, Artificial Sequence
  Synthesized
  misc_feature (61): n=t or c
aggaacagttacagtaactttcaactgatggcatccaaatttagaaatttgtttctgtganccatttggttttccttcctgcagatcataataatattatctaagaatttaggaaattaat

SEQ ID NO: 22380 - DNA, 121 bp, Artificial Sequence
  Synthesized
  misc_feature (61): n=c or g
tgtgttctgcattatgttccaggccattctggtactaagtcagatatgatttcaaattaanaaatttcaccccactgttagctgtaaagaagccctaggctttcaaaataccacaacgtgt

SEQ ID NO: 22381 - DNA, 121 bp, Artificial Sequence
  Synthesized
  misc_feature (61): n=a or g
actttttggcacgttccttacgagcaccggacaccgctggcactttggcagcagctttgancagctctgaacaatgaataactatcactgacaggctcagctgctctgctgttccaggaaa

SEQ ID NO: 22382 - DNA, 121 bp, Artificial Sequence
  Synthesized
  misc_feature (61): n=a or g
tatataaatacaaaatatgtttttatgaattgctcaaaagtaagtatttttaaatcttgcnttattttgcttgctttcctatgctagttattattcagaaaatgtgtctagcctttaggat

SEQ ID NO: 22383 - DNA, 121 bp, Artificial Sequence
  Synthesized
  misc_feature (61): n=t or c
tcagcaccggcgtgcaacgatgtgcaatgctgcaaagttggtgtgcgattgcatcagcacnggtgtgcaatgctcggtgcagctgtgcaatgctcagtgctgctgtgcaatgcgtggtgca

SEQ ID NO: 22384 - DNA, 121 bp, Artificial Sequence
  Synthesized
  misc_feature (61): n=a or g
aaagcttctacttttcacttgaaaaatgggctgctggtgtcagacttaaaagtagcagacntttgcgcttctctaatgcatattcaattcctctacgacaaagcaaaaatgattgctatta

SEQ ID NO: 22385 - DNA, 121 bp, Artificial Sequence
  Synthesized
  misc_feature (61): n=t or c
tggctgtgagttggctgttaagacaggatcagacagaccagcgtttgcccattcctggagngtcccctactcagctccactgggacatcccatggggacaatgcagccatgctgctccagc

SEQ ID NO: 22386 - DNA, 121 bp, Artificial Sequence
  Synthesized
  misc_feature (61): n=t or c
tttagcagcgtgtgaactgcgcacctcctttgtgtgtgctctgagataggagtcaccaggncacacagccctatgcagtctaaaaactgctttctgtatgttgtgagaaaggaaacctggc

SEQ ID NO: 22387 - DNA, 121 bp, Artificial Sequence
  Synthesized
  misc_feature (61): n=t or c
agatgagctaaatagttgtgaggttcctccttggaaccctctgaggtaaatgggaagatgnggcagaaacatagtatagaaacagaatcattaagattggaaaagacctccaaaatcaact

SEQ ID NO: 22388 - DNA, 121 bp, Artificial Sequence
  Synthesized
  misc_feature (61): n=a or c
agctaaatgtccagacaggttacaatgcagtgaagtcttcattctcttcacagggatgcanagggtctaagacctcattttggagacacagaaaaactgcatttcagatttctatataaac

SEQ ID NO: 22389 - DNA, 121 bp, Artificial Sequence
  Synthesized
  misc_feature (61): n=a or g
gccagctgtgttgcaagtgccattgctttgttaattctgggaccagtgcagatcttgcctnaatgaactgttctactttaaaactactaattgttcacagcattgaagcactactaaataa

SEQ ID NO: 22390 - DNA, 121 bp, Artificial Sequence
  Synthesized
  misc_feature (61): n=t or c
gcagtcactgttagctctgcatcctggttaatgctcagtcctgtgggcaagtgagctattntctgacaaaagcattgggccaaggttttctccagatgagaggaatttattaaagtgacaa

SEQ ID NO: 22391 - DNA, 121 bp, Artificial Sequence
  Synthesized
  misc_feature (61): n=t or c
ttactaaatacatcaacacaagtagttgtgttatgcttcataactgcttagggcagtgtcnttggcctgatctgttgcatagaaagttggactccaagagcccattttataccttgtcctt

SEQ ID NO: 22392 - DNA, 121 bp, Artificial Sequence
  Synthesized
  misc_feature (61): n=a or t
aggaaaagaaatacctggaggattcagaaatagtaacaaaattcagttttgtcaacagtgnactagtcatctgaatggagaaacaaagagcttgagaagagtatgaaatagaccttcttgc

SEQ ID NO: 22393 - DNA, 121 bp, Artificial Sequence
  Synthesized
  misc_feature (61): n=a or t
taaaaggcaaacacacagttagccaggcttaacctcttcaaaaactgttacacttcatgtncaaagagatctatgcttttatttgctatgatatttaaaggtttgtttaaacttctgcatg

SEQ ID NO: 22394 - DNA, 121 bp, Artificial Sequence
  Synthesized
  misc_feature (61): n=a or g
ttctaagcacgtactcctggtctgttcatgtgctggcatcttcagcccatcctttctctcncttcctcttgctcaaaaagcagaaaattaatacagtggtgggggaaaaaatggacttgag

SEQ ID NO: 22395 - DNA, 121 bp, Artificial Sequence
  Synthesized
  misc_feature (61): n=a or g
tacacagatttttggtgtgactatctgggtctcagagcctttttccagaggcgttgttccncctcttgctaaccttagatattcaactgcttagaacatttcacatctctctgagtcaacc

SEQ ID NO: 22396 - DNA, 121 bp, Artificial Sequence
  Synthesized
  misc_feature (61): n=a or g
aaagtttggaaggaaatcatttgcatgctggagaacaccacgtaagtgttaacttttaacntattttgtcctgctgtttttcaggtaaaggtgatgtgttcggtgatatcttctggaagga

SEQ ID NO: 22397 - DNA, 121 bp, Artificial Sequence
  Synthesized
  misc_feature (61): n=t or c
cctaacgttgctttgcaagtcgttcaccttctgaaatactttggaatacagatacatcaangtgtatttatgcagcatcagaacgaaagatgaagttgtgacattaccagcatcattaaaa

SEQ ID NO: 22398 - DNA, 121 bp, Artificial Sequence
  Synthesized
  misc_feature (61): n=a or g
attactgtttatatggtgatttactgaacttctatacaaacttcctggagtctgatctcanaaagaaagcatccaaatgacaagggaggggttggaatggcagcgctccagaagtattcag

SEQ ID NO: 22399 - DNA, 121 bp, Artificial Sequence
  Synthesized
  misc_feature (61): n=a or c
taaaacattcaccctatcctatgcaattgcatcctttctgtgaagcacgggcgtaagggcntagtgaccctcagagctatgccactgggaacttatccatcttagcaaatgatctctcatg

SEQ ID NO: 22400 - DNA, 121 bp, Artificial Sequence
  Synthesized
  misc_feature (61): n=a or g
cttcatttctcacttgtcccaccttccttgcaacacaatttctagttccttgcacaccccnccaccatgcaatgtcacaatgcaccttcactaagacctctaaaagaagtcttctgccaag

SEQ ID NO: 22401 - DNA, 121 bp, Artificial Sequence
  Synthesized
  misc_feature (61): n=t or c
cagttcactataatgaaatggaagaaggttcaaaggcttacttaaatgtcaaaagagagcnggaagagcagaacaagtaactcatctttttggttaaatcaaaacattaaagccattctga

SEQ ID NO: 22402 - DNA, 121 bp, Artificial Sequence
  Synthesized
  misc_feature (61): n=t or c
atgatgatttaaaacattccattcttaggaaataccaataattctttgattgttatacatntatgttctgtgatcatgaccgtgaatttcattcatgtttattcacagaaagagcctcaaa

SEQ ID NO: 22403 - DNA, 121 bp, Artificial Sequence
  Synthesized
  misc_feature (61): n=a or c
tagctcgagaagtaccattaaaagcagaaatccaaagaacagaatcaactccaatttcctncacaaagtaagggatttggatcaagacaaagtcatcagcatctgcccaggttccccaggt

SEQ ID NO: 22404 - DNA, 121 bp, Artificial Sequence
  Synthesized
  misc_feature (61): n=t or c
ctgtggggtgctggagctgggcatggggacgtcacagaggcagaggttggcctgaatttcncagctatgaatgcagcagaaatgcctccttccttggtaatgggagaggctgagtgcatgc

SEQ ID NO: 22405 - DNA, 121 bp, Artificial Sequence
  Synthesized
  misc_feature (61): n=a or g
gctttcctccaggagagcagagaatgggaacagcctggagctgacagagtgaaggatgatngcagaaggggtttttcttacagagggagactctggctgtctgggcaagcagtaagccatg

SEQ ID NO: 22406 - DNA, 121 bp, Artificial Sequence
  Synthesized
  misc_feature (61): n=a or g
gaattgcaattcagtaattgcaaaattgagtccactgaatgtgaattcagtctcattgatncaagttttataagtttgttatattctgtagctattctgtctggtgttattcaatgttgat

SEQ ID NO: 22407 - DNA, 121 bp, Artificial Sequence
  Synthesized
  misc_feature (61): n=a or g
gactgtcaggagcagcagggaaggcaaatgaacagcttggaaacagcagaaagaattaatntagcattgcaaatgaaatcacattgctcaggcttaattagcaccggatgcaggcggctgc

SEQ ID NO: 22408 - DNA, 121 bp, Artificial Sequence
  Synthesized
  misc_feature (61): n=a or g
atcaggatgctgggaaagcaatcaatggagacatcacctccagcactgccaatgctataanccagatgccacttggtgccgttctggtgactcacctgcagggttggtgctcttctggcac

SEQ ID NO: 22409 - DNA, 121 bp, Artificial Sequence
  Synthesized
  misc_feature (61): n=a or t
cagctttgcagtgacataatcattaatctcagcccacctctcacacctggtgagttattcngaaaaagaacacataggcattcactgtgcaggactaaaaattgtttactctgtaggaagc

SEQ ID NO: 22410 - DNA, 121 bp, Artificial Sequence
  Synthesized
  misc_feature (61): n=a or g
ggaggatggctgccaaagaacttgtggcgttcaccaatgtggccatttaattgaagtagcnctgaaaaggaagccggaaactcgagaaccacattttttatcacttggacttcggcagaca

SEQ ID NO: 22411 - DNA, 121 bp, Artificial Sequence
  Synthesized
  misc_feature (61): n=a or t
gcaacgcatcagtgataaggtcatgtgaatttggtctttttggtcccattgcccttacatnttttactctctgtcttcttaagcacattatctctgttcgtctcagcctcacaggggcttt

SEQ ID NO: 22412 - DNA, 121 bp, Artificial Sequence
  Synthesized
  misc_feature (61): n=a or c
actgttacaaaccacatattttagagggaagtggctggcagacccaggctgcttatggagnatgaaatagagccttcagaccacatggtcataggatagggctgggttcccccagtgggct

SEQ ID NO: 22413 - DNA, 121 bp, Artificial Sequence
  Synthesized
  misc_feature (61): n=t or g
gacgtggtgtccttagcccatgaattagatgtggtatctggacaaggactgagatgatctnagagagagatgatctgaaatgactgagagctgtacacacagtgtggaaaaaacaattaca

SEQ ID NO: 22414 - DNA, 121 bp, Artificial Sequence
  Synthesized
  misc_feature (61): n=t or c
gattttcagtggccttgctttaccagtgcatctcaaaacatccaaaataggatttttgtanaataaaacgggctttgcatattactctaagccttcctttcacttcctttagatattttct

SEQ ID NO: 22415 - DNA, 121 bp, Artificial Sequence
  Synthesized
  misc_feature (61): n=a or g
agtatttgagattcagaaagttttcaggaatgcacctaaaatatatgcaacctaaaatatnagcaaaccgttctttctttccaaaacaggctgacccaaagatgtgatatgacagtctaga

SEQ ID NO: 22416 - DNA, 121 bp, Artificial Sequence
  Synthesized
  misc_feature (61): n=a or c
agtcagcaaagcccatacgacacattgtccagcctcatcactaaaccacccttggtgtaanaagtttgccatatctgtgctcttggctcacaaggaattttacattacatttatcgtatta

SEQ ID NO: 22417 - DNA, 121 bp, Artificial Sequence
  Synthesized
  misc_feature (61): n=a or g
taaatatttaagaaactactatttaggtgttagcaatgcatcaagagaaagaggagaatangttggtgggaattgggtcagggatgatggcagtatttggaacaggtgtctatggagggac

SEQ ID NO: 22418 - DNA, 121 bp, Artificial Sequence
  Synthesized
  misc_feature (61): n=a or g
agcacgactgctctcagtatgcatcttccacccttgctgtccttttgctgggccatctgcnttcttggcaccacctttattgaatgtagctttttataaatcaatttcctcgtggcagaag

SEQ ID NO: 22419 - DNA, 121 bp, Artificial Sequence
  Synthesized
  misc_feature (61): n=a or g
cacattcccttgcagagctaccatctcttgctgttctctcacatttcccacccccaaacanagccctcctatgtaatttcttggcattttctatataatgtgtgctttttgggggggctcg

SEQ ID NO: 22420 - DNA, 121 bp, Artificial Sequence
  Synthesized
  misc_feature (61): n=a or g
ccgttgcacctgggagatgggaggctgagtgacgtttactccatcctgcattcttggctcncaggtttacagcactccatagctgtctgcaggccgtgatgggtttacataaaaacacttt

SEQ ID NO: 22421 - DNA, 121 bp, Artificial Sequence
  Synthesized
  misc_feature (61): n=a or g
gagtctcttttcttgggaaaagagagcatcagcctattctcccagagtatgaatttgtgantccactggattttcagtaggacagaatgacagaatgctttgaaggaacctaattaacaac

SEQ ID NO: 22422 - DNA, 121 bp, Artificial Sequence
  Synthesized
  misc_feature (61): n=a or g
gggtacaattccttggatgaagaagggaaggtaagaagcaagcctgaataccgcagtgagnatctccttcctcaggactgttttctttccatctgtatagtgctcagagtctttctcaaat

SEQ ID NO: 22423 - DNA, 121 bp, Artificial Sequence
  Synthesized
  misc_feature (61): n=t or c
agagccaggatgttgctttgtgagtatgatcattttttctttgctgtaactgggtctttcnttccatttatcagaaggggaacaacctgccttatcttgcttgcaaaatcctgctcacctg

SEQ ID NO: 22424 - DNA, 121 bp, Artificial Sequence
  Synthesized
  misc_feature (61): n=a or t
ttctgaaatcagagagagatacatcaggaactggaactaaactgtttcttgctcaagatanccacagaagttaccaaaacattcattaaggaattctccacagtacagttgtttaattgga

SEQ ID NO: 22425 - DNA, 121 bp, Artificial Sequence
  Synthesized
  misc_feature (61): n=t or g
agtgtttccattaggagaattttagtcttagaaataccttcattaaaactcatgactcagnatttttaccagtttcagatcttcagggatactgatccacataacccttgttaaatcagta

SEQ ID NO: 22426 - DNA, 121 bp, Artificial Sequence
  Synthesized
  misc_feature (61): n=a or c
tgaactcctgctccagaggtggtgagtcaacacttctctacacccttcatctaaatatatnatggagcaaaagagtcatgttagcatcaaggtctgtgctgctcttccagggctcatcctc

SEQ ID NO: 22427 - DNA, 121 bp, Artificial Sequence
  Synthesized
  misc_feature (61): n=a or g
aaccaaagtgaagtgatttgtttcaggttaagcaaaacatctcattcaaatcaaatgcacntttgctgatttttctttaaacgacatattaatttttacaggattttttttctcagtttca

SEQ ID NO: 22428 - DNA, 121 bp, Artificial Sequence
  Synthesized
  misc_feature (61): n=t or c
ggctaaacgtacactgggacacccaagtgggaagtaagtagcctttcctcttttatgtaangtttgaaagcattggagtgtttcaagttctgctgatcataccacaggaaatatctggtga

SEQ ID NO: 22429 - DNA, 121 bp, Artificial Sequence
  Synthesized
  misc_feature (61): n=a or g
cagcagaaaggtcatactatttgcatactagatgatcaaataagccattctgattgtgganatctattgcacctaagatgacagcaaagcattactgtttggccagtcagagatgtaggat

SEQ ID NO: 22430 - DNA, 121 bp, Artificial Sequence
  Synthesized
  misc_feature (61): n=t or c
aaacaaaaaaacttacaaattcaaatacatacttttctgagtgtaaattggttcttctgtnatagatcagttatgatacacaaataaacttctgcctgttcatacatgtgtcattcacttc

SEQ ID NO: 22431 - DNA, 121 bp, Artificial Sequence
  Synthesized
  misc_feature (61): n=a or g
tttatgtgttacaatgtatggtctcatttctaatgcagagaaaactacctgtaggaagagnaacactgagcagtatgttactccgctaagctgctcatttatatctttctatggaaagaat

SEQ ID NO: 22432 - DNA, 121 bp, Artificial Sequence
  Synthesized
  misc_feature (61): n=a or g
ccttctctttcactatttctgctgcttcccgagttgctgcttgttgtgctgggtgacagcnaagcagtgctgaggctgttggatgttatagggaagggctctgctcttcaaccatctgaca

SEQ ID NO: 22433 - DNA, 121 bp, Artificial Sequence
  Synthesized
  misc_feature (61): n=a or g
tttctgaagttgcagttaggtgagttgcttgtagtacagcataagcctgattaacaacccnaactgtgggctttcaggtctggaactgcatctgcacagggagaacaggacgagtcaattg

SEQ ID NO: 22434 - DNA, 121 bp, Artificial Sequence
  Synthesized
  misc_feature (61): n=a or t
gagtcccccaaattattcatggaatagtattcatatagtatgatactccttatgataggtncagaaatatacacagaaaacatctggccgctctttccatagacaccaatgcaataacaat

SEQ ID NO: 22435 - DNA, 121 bp, Artificial Sequence
  Synthesized
  misc_feature (61): n=a or g
actttccacccagcaatgcctggctttcaagtctggcaaacaaatccacctgaaaaagccntgcaacaaaagctacttgaagactggctttgctcacctcctcacccagactgggctgagc

SEQ ID NO: 22436 - DNA, 121 bp, Artificial Sequence
  Synthesized
  misc_feature (61): n=a or g
ggaagtgaataagacttctgaatcacctcaccagaatattaggagactgagtgaactcaantttgcaaagctctttgcagtccctggcttaccatgtgaagctggaatgccctacacgcgt

SEQ ID NO: 22437 - DNA, 121 bp, Artificial Sequence
  Synthesized
  misc_feature (61): n=t or c
cttctttatccttttttttttttttttcaatattgcaagcagaacaacattgaggtaattnctttttgtcatcattaagacattcaagttagataccaacggtttacattttttccttgtg

SEQ ID NO: 22438 - DNA, 121 bp, Artificial Sequence
  Synthesized
  misc_feature (61): n=a or g
acagccactgagttttctttctccaacaggaagaaatgcaaacgagtcagcccaaagtacnacacttcttatacaaaatagctttaagtactcaaagaatgttctgtagcttctaagaaac

SEQ ID NO: 22439 - DNA, 121 bp, Artificial Sequence
  Synthesized
  misc_feature (61): n=a or c
tgcagaaggcgttgcattgctgctctagaatcactcataatagatctgctagtgtgtgctngaacagcagttaggtgtagtggagaactctctagcagtatgttaatcagcaggctgatga

SEQ ID NO: 22440 - DNA, 121 bp, Artificial Sequence
  Synthesized
  misc_feature (61): n=a or t
tggatcttgccttttttggatctgctcagtgctggtctgactcatctcttaggtgtttctnctcacaggagatcagtgactttgctgctgctggattgactggcagagtaaggacagttac

SEQ ID NO: 22441 - DNA, 121 bp, Artificial Sequence
  Synthesized
  misc_feature (61): n=t or c
gtaggccttgccagagtgagcaattttctttctctgtcagttttctttcttcccttactgntctgcctgtttgcctctttttcttaagtccttaagacatgcttcctgtgtcacagggaac

SEQ ID NO: 22442 - DNA, 121 bp, Artificial Sequence
  Synthesized
  misc_feature (61): n=t or c
gagaattagccaagaaatccaagaagtacatacaccatctgagttcattattattgacgancacatcccaatgtggtctgaactacttaaggttaagtttggctcagtaccaaccaatggc

SEQ ID NO: 22443 - DNA, 121 bp, Artificial Sequence
  Synthesized
  misc_feature (61): n=a or t
aacttcagatttatacctctatggtttggtcttctaccactgaaatcaacaggagttttgntggacaaacattcttctttgatggaaagctgtcatacacacttctagtatcacgttatgt

SEQ ID NO: 22444 - DNA, 121 bp, Artificial Sequence
  Synthesized
  misc_feature (61): n=a or g
gtatgaaacacacacgtaagaataatgctcccagtctccatccatctgcagtcctcctgcnttagggctttgggttcttttcaatgtgacaaggagttccacagctcagatactctgggca

SEQ ID NO: 22445 - DNA, 121 bp, Artificial Sequence
  Synthesized
  misc_feature (61): n=t or c
agtcttgtcagtaaattcattctatacaaaatttgctgaaagcaaacatagaagaaattanatttcttctccaaccttgccaactcccactgaatggaattcaaaatggagcttgaaatca

SEQ ID NO: 22446 - DNA, 121 bp, Artificial Sequence
  Synthesized
  misc_feature (61): n=a or g
ttaactgatacatagatttgatttcagcacacagatattaatgatgagaatcttgtgctgnctgaagttgagcaagtttggtggcttgtcttaaaggcatgcccagtgggagatcacccta

SEQ ID NO: 22447 - DNA, 121 bp, Artificial Sequence
  Synthesized
  misc_feature (61): n=t or c
gtaccatgatggtgtggggccatgatggcagtccattttgggccacagaaaccactgtgantctcttttccccacttccagccaggtgggcagatggccgaaggctgtgtgaagctgtctg

SEQ ID NO: 22448 - DNA, 121 bp, Artificial Sequence
  Synthesized
  misc_feature (61): n=t or c
tcagagcactgggtggtatcaccatgtctgtttgcagccgcttgcacaacgtactggcttncctaatgtagggttaaatttatctgtacagttcatagttgaggggagagaagaatcttaa

SEQ ID NO: 22449 - DNA, 121 bp, Artificial Sequence
  Synthesized
  misc_feature (61): n=a or g
gttttgctgggttagagctgagctcgttgagctccagagctctgcacaacgaagacggagncaggagatccaggacagagtgaggacgagtacatcaccatctcgttttgacatctgtgag

SEQ ID NO: 22450 - DNA, 121 bp, Artificial Sequence
  Synthesized
  misc_feature (61): n=c or g
cactcacatgccctaacttatccttgcctacttacatgggagctgagattgtctttccttntgcatttctacaggaccctgcatgatgatggcccaatcctgaccagaattctacagcatt

SEQ ID NO: 22451 - DNA, 121 bp, Artificial Sequence
  Synthesized
  misc_feature (61): n=t or g
acatactgcaaaccactttgttgcacttagcagtcactgcaggcaacagcacagcatgcantcaggtacagcaattctgtcttgggaaagccaagagctacagggggtgtctgatgggaga

SEQ ID NO: 22452 - DNA, 121 bp, Artificial Sequence
  Synthesized
  misc_feature (61): n=t or c
tttttcaagccacttacctgcagttacagcacaccacatggctagttttcaggtgcaatgnttgcatttagcacaacacaaaagcacttttaaaatcctaacaagattcactgtgagacac

SEQ ID NO: 22453 - DNA, 121 bp, Artificial Sequence
  Synthesized
  misc_feature (61): n=a or t
agttttaagccaaatgagttgaaagaccaagatcctctttcaggaaagcaattttagcacntcataaacacccagctaaactgagctattgctgaagcagtcttccaggaaaggtcacccc

SEQ ID NO: 22454 - DNA, 121 bp, Artificial Sequence
  Synthesized
  misc_feature (61): n=t or c
gtcacagaaatgcagcctgacatataaagatgaggcagctctgatttcgtctatccttaangtatcaggatatatggtatatctttttcaatgcttgtgagctggaccactgaactatcat

SEQ ID NO: 22455 - DNA, 121 bp, Artificial Sequence
  Synthesized
  misc_feature (61): n=t or c
aatatgaacctgctcctgcaacaaaagtttgctttgcgttttcccttttcttgaactctangtgcagcctcgttccctaagcaccaccgcctacatgttcactggtacactgtcccacagg

SEQ ID NO: 22456 - DNA, 121 bp, Artificial Sequence
  Synthesized
  misc_feature (61): n=a or g
ttgattacagaggagagatatgagagatttactgcaggaagttttatgtgccctaaacagngggcagcctaccaattgtggtgttctctggctgtatcctcctcctctgttgccatgatac

SEQ ID NO: 22457 - DNA, 121 bp, Artificial Sequence
  Synthesized
  misc_feature (61): n=a or g
gcaaaaccatgacaaaacgcataaggctttcatagatctgttcccttctccagctggcttnctgtgctccgctttgaagtctgtaaggaagcaaatgttttaaagtttgtaagtgcaaagc

SEQ ID NO: 22458 - DNA, 121 bp, Artificial Sequence
  Synthesized
  misc_feature (61): n=t or c
caggtcacgtcctgggtggtgctgcaggtctcagatggacgtcatgagtcattttttcgcngtcttccctttactacttctctattttttttccaaaagacattgggtgtttttttttctg

SEQ ID NO: 22459 - DNA, 121 bp, Artificial Sequence
  Synthesized
  misc_feature (61): n=t or c
atcaaatacatcaaatttttgcatgtctccataaaacactatattgtttcattttaagatnggcatctagacatgaaattgtccaacaaacactgaactgaaacaggaatttaacagttag

SEQ ID NO: 22460 - DNA, 121 bp, Artificial Sequence
  Synthesized
  misc_feature (61): n=t or g
taaaaaaaaaaaacaataacattagttttaaccaactcagagcagtcaacgttccactttnacgtacagaaacaactaagaaatactcaagagttcagaaagagtgaataaatttaaaaat

SEQ ID NO: 22461 - DNA, 121 bp, Artificial Sequence
  Synthesized
  misc_feature (61): n=t or c
ttagaaagagggaaggaagagtcatcttgaaacagactgagttacacttgagatttacccnacacaagcatgtgccaacatactgccaacagcaggttgctgcactgaatgtctgagtaac

SEQ ID NO: 22462 - DNA, 121 bp, Artificial Sequence
  Synthesized
  misc_feature (61): n=t or c
aatcacagactccagtgactgtttgtttggggctgcatgaatttgtttagatctgtgcatnccacactgtctgagacttgattcactagtgctatctagtggctagtactgaaaatgatta

SEQ ID NO: 22463 - DNA, 121 bp, Artificial Sequence
  Synthesized
  misc_feature (61): n=a or g
taagcatctatctcagaatgtgtgtaactgtgaataaggaatggaaattcccttgctccangtgctttttggacacaagaggatttgactgctactactgaaaaccacagagcaatggatg

SEQ ID NO: 22464 - DNA, 121 bp, Artificial Sequence
  Synthesized
  misc_feature (61): n=a or t
tttacgcagtttctactgcagtatttatttcagactgcctctgtacatgattttctgaagngactaccaatggcatattgcagaaataccgaggttaaaaaaagaaacactcattgcatca

SEQ ID NO: 22465 - DNA, 121 bp, Artificial Sequence
  Synthesized
  misc_feature (61): n=t or c
ctgggccagggagtgcagcacagctgacccctggctgaccacgctcaaagttcagcttttnagcagagcacagaagtgctggatgggagacaaaaccccgcgcacctttatccgcagcgct

SEQ ID NO: 22466 - DNA, 121 bp, Artificial Sequence
  Synthesized
  misc_feature (61): n=t or c
tctttaaatgttactgaaggcaatttttgttttcatttttggcttaacgtacaactgaaantcagtgatgctcagccaaaacccacaagtcttgcccgattttgaatcaaaattctacaaa

SEQ ID NO: 22467 - DNA, 121 bp, Artificial Sequence
  Synthesized
  misc_feature (61): n=t or g
catccacccacctgcccagagaaagatacacacacacagagaaaaactggctgttactggngtttccagtaaattatggagagttgtttaatttctttgtctgaacagacccagccacagt

SEQ ID NO: 22468 - DNA, 121 bp, Artificial Sequence
  Synthesized
  misc_feature (61): n=t or c
agcagcatctatagtctgaaggcattttgttctcttatttgacgagaggtgtttttcagantgtgcttttaatgtaaccaacctgacagacaaactgaataaatggcagtagcacaatctt

SEQ ID NO: 22469 - DNA, 121 bp, Artificial Sequence
  Synthesized
  misc_feature (61): n=a or g
gactgaatgaccatacaaccatacatgcagaaccaaaaaatgtggcacattattgcatgtngtacactattgcatgtggatttcagtatttcttagagttgcgtgggctggcaggacgctg

SEQ ID NO: 22470 - DNA, 121 bp, Artificial Sequence
  Synthesized
  misc_feature (61): n=a or g
tttaccattcagtgccttagcttcactttcatattatattttccattgccctctgttccantttgatagttcttgtcagtgaatagcacttctagaaaacaattatattccagctgtttct

SEQ ID NO: 22471 - DNA, 121 bp, Artificial Sequence
  Synthesized
  misc_feature (61): n=a or g
atgaacaacattgtaagaatataaagacggaccataagcagaagttaaatggcttagaganctaccacatttgcattttgagtctacagtggactgccaaatctctctgcttattcttcct

SEQ ID NO: 22472 - DNA, 121 bp, Artificial Sequence
  Synthesized
  misc_feature (61): n=t or c
agaggcctttcagcaagcaaaagtagctgttaaataggcccaggtgctgcatatatttaancctaccctctcagccaaactagacgcccatgtaaatcaggatgggttcagctggggcctg

SEQ ID NO: 22473 - DNA, 121 bp, Artificial Sequence
  Synthesized
  misc_feature (61): n=t or c
aagcaagtcactcactggtgcctcctctctcttagctctcaagcagccatctctgtgatgnaacacctttctctcgcatccatagctgcacaggtttgggaagcagggtgagaaaggaaca

SEQ ID NO: 22474 - DNA, 121 bp, Artificial Sequence
  Synthesized
  misc_feature (61): n=a or t
aaattgatgtcatccttaacaatgtttcatcttattttgggcacatcagcattagaagagntgtaaattggaagcatctttgatacgaagagagaatgagtagacttggtaggcaggattg

SEQ ID NO: 22475 - DNA, 121 bp, Artificial Sequence
  Synthesized
  misc_feature (61): n=a or c
gtttcttaataaataaagcttctggtccagacagtgcagtatgctttctccattaatcacnatgtgaatatgaaaaccaaaccatataacatacataagtactaactagaatatattttct

SEQ ID NO: 22476 - DNA, 121 bp, Artificial Sequence
  Synthesized
  misc_feature (61): n=t or c
tgcacataattaattactgcatttaatttctgttctccctccagtctgcagcgagcaaacngacgcttaatggtgtcaaagctcatgtcaatataagatggaaaagtatatgggctctcgt

SEQ ID NO: 22477 - DNA, 121 bp, Artificial Sequence
  Synthesized
  misc_feature (61): n=t or c
gcaaaacaaatagataagggaagtgcagcagcactgttgtgttcagattttctttagtgcngtttgctaagcattattccaagttgctttaatatcctaagcagatacacttctaccatga

SEQ ID NO: 22478 - DNA, 121 bp, Artificial Sequence
  Synthesized
  misc_feature (61): n=a or g
tgcatctggtttatcagatgtgactgcaactcatgccttcaaagatcatctgtcctgtgcnatttccagctttgtctgacaaaggagcttaggcaaacataggaacactacaggtttgtca

SEQ ID NO: 22479 - DNA, 121 bp, Artificial Sequence
  Synthesized
  misc_feature (61): n=t or g
actgcagtaatacttgatcttttaggcctgttacatcttctcacatctaaacagcttgccntggttgaaggtaagaaaacagtgtgagaatgcaaacactgtgggcctgtgaaaaaaagta

SEQ ID NO: 22480 - DNA, 121 bp, Artificial Sequence
  Synthesized
  misc_feature (61): n=a or c
gtgagatgcagcgtgtgatccactccacacatggaggagagttttccaaccagcagaattntaaagacactgttttgtctaataagaagttaaaggaagctaaaatatgatttcccagtgc

SEQ ID NO: 22481 - DNA, 121 bp, Artificial Sequence
  Synthesized
  misc_feature (61): n=a or c
ccacataagcgatcagagtataaggagacaaaaaattcatatttaagaacaccgacattangtctctaaaatacaagctacacaagaagcttaaaacagaagtaacagtagaccctcctgt

SEQ ID NO: 22482 - DNA, 121 bp, Artificial Sequence
  Synthesized
  misc_feature (61): n=a or g
cttaacagcgaatcaaaaggaatccaaagtgagcaactatggaaaaacctacaagtgagcntctcagctgtcctaccaggctggtgatgtgtgatttcagggagcacggggtgttttgtgg

SEQ ID NO: 22483 - DNA, 121 bp, Artificial Sequence
  Synthesized
  misc_feature (61): n=a or g
catatagttaataagtaagcttgacagctaagaggggacaaaaccacccactctgtttaanacacacctaacaggattatcttctatatgctacctgcaggccaagactgacaatagactg

SEQ ID NO: 22484 - DNA, 121 bp, Artificial Sequence
  Synthesized
  misc_feature (61): n=t or g
tgccaattgggaccatggaaccatggatgtgctctgaccttctcctaaccttagccctgtnttctatacctttctccactacgtccccatagcatttggctaatgtcaggtgctttcactt

SEQ ID NO: 22485 - DNA, 121 bp, Artificial Sequence
  Synthesized
  misc_feature (61): n=t or c
acttgcaatggaagtagcatttgaaactatattcctcttgcctttctacccacatctacangtgctcgacagagaattgtgcttaaaatattatcggggaaaaaaaaaaaagagttatttt

SEQ ID NO: 22486 - DNA, 121 bp, Artificial Sequence
  Synthesized
  misc_feature (61): n=t or c
tacagtcaaaacattttgtcagtctacattgtctagtcatagtggcaaagtgtaaagggcngtgttggcaacagagctcttcagtacacttctttaatacactgcatttcaaatatggcta

SEQ ID NO: 22487 - DNA, 121 bp, Artificial Sequence
  Synthesized
  misc_feature (61): n=a or g
aatgaccaataaggagcttatttgcctgcttgatggtagatcagttaataacaattgatcnatgtgacaattgaagttaccgatttatgtgcatctgatgaaatctaggagcactaatctg

SEQ ID NO: 22488 - DNA, 121 bp, Artificial Sequence
  Synthesized
  misc_feature (61): n=a or c
caatttatacacaaaggaacaggagctcagagcagcacaaacgctgatgttatcctacctncagattatattttaagctataatcaccacacatctgcccatgtaacagtaaaactgggtc

SEQ ID NO: 22489 - DNA, 121 bp, Artificial Sequence
  Synthesized
  misc_feature (61): n=a or g
attttgtttttagcgactttctatttaaaaattataacaatggaaaactgatgaattaacntgttctcagtaaacaattacatgtcaacagctgcatgcctgtcaagagacttgacagggc

SEQ ID NO: 22490 - DNA, 121 bp, Artificial Sequence
  Synthesized
  misc_feature (61): n=a or g
gagctatgcttgcttggaaaaatggggcttaggtccttctgtcatgggtctggggacctanagtaacctggaaagaggatattacaaaatcaggattctctgtgttttctcatgtaagaca

SEQ ID NO: 22491 - DNA, 121 bp, Artificial Sequence
  Synthesized
  misc_feature (61): n=t or c
gcagggaagaggtgcagtagacccccatagcagcactctccacaaaaaatgaaagagcagnaggatgcttccattggtgctggcttccacagtagctgagcagataggcagtgtcagtccc

SEQ ID NO: 22492 - DNA, 121 bp, Artificial Sequence
  Synthesized
  misc_feature (61): n=t or c
aagagatttagtgttctccattctgtcagacactggaagtttgtgtgacccacaccaggcnctccaaggcccctctgaccaggaagatatgtgtccagagtagcagctttagttcatctgc

SEQ ID NO: 22493 - DNA, 121 bp, Artificial Sequence
  Synthesized
  misc_feature (61): n=a or g
ccttgtaagtttacctttgttaatgaaggcaaccaagccagagaaaagcaatgttctagtnactggagggtaaatggcaacccaaaggaatgtgaagatctgaactgaagcctaacagata

SEQ ID NO: 22494 - DNA, 121 bp, Artificial Sequence
  Synthesized
  misc_feature (61): n=a or g
ttaaggggcagtaactgtggtgagggagaacattggaatgctaagtgtcgattagggcttncaggggaaaaggggtagtcttgtgaaaaccagtatttgtaaagagacagtggtaataaag

SEQ ID NO: 22495 - DNA, 121 bp, Artificial Sequence
  Synthesized
  misc_feature (61): n=t or c
ctgtcttttcccaaaacaattgtaactgcaaagaaagagagtatttaacaattctgaaaanggcaggcatttagaagagtagcagacctggtgtctttaaaccagtattaccaactttcca

SEQ ID NO: 22496 - DNA, 121 bp, Artificial Sequence
  Synthesized
  misc_feature (61): n=a or g
cttcagtattgcttttgcttactttcagttgaaatgcctttgcagtagcttttagataacncccaactaacatagatagtacatttctaaatgctggtagcagtagtaaggtagtaggtat

SEQ ID NO: 22497 - DNA, 121 bp, Artificial Sequence
  Synthesized
  misc_feature (61): n=t or c
ttgataggattgggtaaaaattcagcctaactttaagaaagagcactgtaaaaacaagatngcagtcattttttattcatcaagttatgaatatatttcattactggttcttaaacaagcg

SEQ ID NO: 22498 - DNA, 121 bp, Artificial Sequence
  Synthesized
  misc_feature (61): n=c or g
gactgaatgatcttagaggtctttttcaaccttaatgagtctatgtttctaagcaggttgngatgcaggcatgaaacatggcatggagctaagaccaatgcgccagttctgatggaaccac

SEQ ID NO: 22499 - DNA, 121 bp, Artificial Sequence
  Synthesized
  misc_feature (61): n=t or g
tggtacccaatctaaataaatgtttgaatgctcttttacaattatagcctgctgaattttnatgtacaaaacttttccatataaaggaaggtgctgtgtgcaaacatattccagttgactg

SEQ ID NO: 22500 - DNA, 121 bp, Artificial Sequence
  Synthesized
  misc_feature (61): n=t or g
caaggatggccaagattgatgacaagacaacaagaaaaattcctatcacaacattcaatanatgaagagagagattactcttttgacacattgttccttactgaagcttttgtcttgcctt

SEQ ID NO: 22501 - DNA, 121 bp, Artificial Sequence
  Synthesized
  misc_feature (61): n=t or g
atatctgcaattaagaaagaaccagcaaattttcacaacttcagttacaaaaaccacaaanaataacaaaatccttcagcagcccaggattagtaaaccataccaccactgtgttatgcaa

SEQ ID NO: 22502 - DNA, 121 bp, Artificial Sequence
  Synthesized
  misc_feature (61): n=t or c
tgctccatttctgtggactgccaattttctgagtactagattctcacatgagaagaactangtgccctagaagactttttgtttccattttccattctgaatgaacgatataactgcttgc

SEQ ID NO: 22503 - DNA, 121 bp, Artificial Sequence
  Synthesized
  misc_feature (61): n=t or g
ggctgactctatactttcttagaatagatggattattctggagcaacaaactcagaagttncatattctaaagttttcagagaactgaaacaaaatttgggtgatgaaaagctaacgtact

SEQ ID NO: 22504 - DNA, 121 bp, Artificial Sequence
  Synthesized
  misc_feature (61): n=a or g
ctcagtggatctgcttctcagggagctctgctgcagacatgcggggtcacaccatctcctnggctctactggagcttctgtgtcaatagtggccaaactgtaccaaactgcctccttgttt

SEQ ID NO: 22505 - DNA, 121 bp, Artificial Sequence
  Synthesized
  misc_feature (61): n=a or c
ttatctcttttttttcctctaacattatccctttgctactattttatatgaaaataacatntacccagttttgcaaagcaagctttctggggcagagattgctgcttcctgtgctcttatc

SEQ ID NO: 22506 - DNA, 121 bp, Artificial Sequence
  Synthesized
  misc_feature (61): n=a or g
gtttaagagactactaacaaataaacagtatttttcagagtgacctattttctgtggaggnaacaaccaaagaccaaaagatcaattcaagatggagggagcagaaaagggctcccagaga

SEQ ID NO: 22507 - DNA, 121 bp, Artificial Sequence
  Synthesized
  misc_feature (61): n=t or c
ctgggagagcacgggctagcaggtgaaagcacagctctgggacgtgtggtgactgatttcnggggacctccactcccactctgtcttgggctgtaacaaacactgccctagggtagcgatg

SEQ ID NO: 22508 - DNA, 121 bp, Artificial Sequence
  Synthesized
  misc_feature (61): n=a or g
agaagggatgtaaaaaggttttactgctatcggttaaaaattacatctaattttgtagagntctccagagtttgtcactcatcctagaagactgaataggaagaatagacattgttggaga

SEQ ID NO: 22509 - DNA, 121 bp, Artificial Sequence
  Synthesized
  misc_feature (61): n=t or c
ataaacattttcttaccatatttcatcactcctttttatggtcagcagcacaaaaccctcnaggttacagaattactagatgtctctgctatttaacaatgcaatccaacgaccgtgagca

SEQ ID NO: 22510 - DNA, 121 bp, Artificial Sequence
  Synthesized
  misc_feature (61): n=t or c
aatacatattccaaaatagcttagaaaataaagtacaattgatactgttattagaatctancctcacataactgcagagataacagattttaagtagcttacatcaacaatttttgaaact

SEQ ID NO: 22511 - DNA, 121 bp, Artificial Sequence
  Synthesized
  misc_feature (61): n=a or c
actctcagaagcagaaccaggtataattgcgtattgcttctggtctaagttctgccacagngaaaaatctcaatatgcaaatacattcatatttgagaaggctgggaaagacccataagta

SEQ ID NO: 22512 - DNA, 121 bp, Artificial Sequence
  Synthesized
  misc_feature (61): n=a or g
attccatggcaaaaccaaagtctcgaatgtctgacatcttgaacatgtgacagttgctganaaaaggcactgaccactgtctttcagattaaatatgaaaaatggtgcaatagcaaaaatt

SEQ ID NO: 22513 - DNA, 121 bp, Artificial Sequence
  Synthesized
  misc_feature (61): n=a or c
ctgtttttgttacaatttggaaataaaaataaaaattgcattcagttacaatgaaggagcngtgaaaatctcagcagcagttgattgtctttgcagcacttctctaaatgactccattact

SEQ ID NO: 22514 - DNA, 121 bp, Artificial Sequence
  Synthesized
  misc_feature (61): n=c or g
cctggacagaaagtgtgatagagccagagaaggtgagtgaggttgtacagtctattaaacnttcatactcaaagttatggggttgcaaagcttgcagcctaacaggctgtcatatctaatc

SEQ ID NO: 22515 - DNA, 121 bp, Artificial Sequence
  Synthesized
  misc_feature (61): n=a or g
taagggaaaggcagtgttcacaaacgtgtcacggcaaacccagaagtaagcaacagatgancaggttaagctgaagggtctttttttccttaatgctttcctttctctccctttttgctgc

SEQ ID NO: 22516 - DNA, 121 bp, Artificial Sequence
  Synthesized
  misc_feature (61): n=a or c
actgtcaggggccagtttctccctcaggtcagatagtctgtgaaccaagcataactccagngctacctgtgttctggctttgctatccatgacagtgtgaagtcccatgataggtagaggt

SEQ ID NO: 22517 - DNA, 121 bp, Artificial Sequence
  Synthesized
  misc_feature (61): n=a or g
tccacgtcagtcccgtggaccctgtgcttgtagtctcatcactgtgtagcaaaagcaacanaatatgcagttctcaagaagtcataacttttttctcattgatagttacagaattattaaa

SEQ ID NO: 22518 - DNA, 121 bp, Artificial Sequence
  Synthesized
  misc_feature (61): n=a or g
agctgttcctagcagctaaaactatgcatctcgattctaagcttaacttgacttgatatcntttcctgatagattaaagatgtgctattcagcatcgtatcaattcctagggatggtgatc

SEQ ID NO: 22519 - DNA, 121 bp, Artificial Sequence
  Synthesized
  misc_feature (61): n=a or g
tcaagcataggcatcaatgaacaaacaaaaaactgagcatgagccacattctgcaaatagnctgatgagaaatgtttctaaacaaactcatgatagtgactaattagaagaagttaacgag

SEQ ID NO: 22520 - DNA, 121 bp, Artificial Sequence
  Synthesized
  misc_feature (61): n=t or c
agcaggagccacagcccttgcagagagacgagacgtccccaaagctatcctgcctaagtgncatcggggtattttggcttgctttgaatttctgagctcactcctgcaatgctgattttaa

SEQ ID NO: 22521 - DNA, 121 bp, Artificial Sequence
  Synthesized
  misc_feature (61): n=t or c
cttcgaaatcagataattatttctccctgctcttaaatatttccttagcaagccctcctcngtcctcagcttatctctgtggcattgctgtttcagtccttacgttccttcccagataagg

SEQ ID NO: 22522 - DNA, 121 bp, Artificial Sequence
  Synthesized
  misc_feature (61): n=t or c
cttaaaatattttacattagctcttcctccatccatgtggatgagtgggaattgcttcacnatttctgtagactaaagcatctggtttctgttcagaatattcattgatttataatggata

SEQ ID NO: 22523 - DNA, 121 bp, Artificial Sequence
  Synthesized
  misc_feature (61): n=a or c
tgctatgtttcttctgatacaggccagccagaaccacaaaaagcattcataatgcatctgnattgatgcaactgatgttcttgatacctacacaatgaaggcttggctgcagaagatcttc

SEQ ID NO: 22524 - DNA, 121 bp, Artificial Sequence
  Synthesized
  misc_feature (61): n=t or c
tagctaagataaaaatctaaattctggggtttaaaagcagtgctaacacagctaagtatcnatggcctcgatcaacacaatctccaggcagtttctcaccactgcctcaacaaactgatta

SEQ ID NO: 22525 - DNA, 121 bp, Artificial Sequence
  Synthesized
  misc_feature (61): n=a or g
ggtcgaaccaattgtattccatatacttgtaatagcaatatatgcccttggactgattctnaatctactgaagctattgcctctgcattgacttctgctggctttctgtctagtttctgca

SEQ ID NO: 22526 - DNA, 121 bp, Artificial Sequence
  Synthesized
  misc_feature (61): n=a or g
gcaggggatgctcagcttgggcaggtgctgcaggggctcatttctctttctggatggggtncagccacctcgctgcttgacttctctgcaccctgcctggctccctcctgtccccagagtc

SEQ ID NO: 22527 - DNA, 121 bp, Artificial Sequence
  Synthesized
  misc_feature (61): n=a or g
cagggaggagcaccgccggcatgggcttttttgaccatataaggccaagttcttctctccntagccaatccaggaggaaggcaaacacctgaaccgtgcccagtttgccaaggcccaccct

SEQ ID NO: 22528 - DNA, 121 bp, Artificial Sequence
  Synthesized
  misc_feature (61): n=a or g
ataccttatttgtgaccacctgtgctggtgcagtaaagcaggctttcagactgctgatggngctttgtttttattcatgattgcagctgcagtgtcttcactgcactcatggtggaactgt

SEQ ID NO: 22529 - DNA, 121 bp, Artificial Sequence
  Synthesized
  misc_feature (61): n=t or c
gtttcctttgtcatgaaatgagaaacatgctgttctcaacattcaggtacatcacaaaatnaagcattctattaatgatctcttactttaaagtattggaaatcttacttccaagtacatg

SEQ ID NO: 22530 - DNA, 121 bp, Artificial Sequence
  Synthesized
  misc_feature (61): n=t or c
gttatttagggtctataagacataaacaactgtccagactcatgtggcatagatgtgggtntctagctgtggtgatgctgaacacatccaagaaaggattctgacaataagcaacgtcatt

SEQ ID NO: 22531 - DNA, 121 bp, Artificial Sequence
  Synthesized
  misc_feature (61): n=a or g
gtgtaaactgttttgggaacgaggggagtgtactttgcagtttgttttgggtttgcatcanctccaaaaacattccagataatttttttttctgaaaatatagcttaactgttgagaggga

SEQ ID NO: 22532 - DNA, 121 bp, Artificial Sequence
  Synthesized
  misc_feature (61): n=t or c
ttgctcatcacttaaaaataatttcagatatgattcactcaatatttgttttcccttgtcntttaacagagaccctgggagtcgttcaagctgcttcaccttttaagttaatattttcttt

SEQ ID NO: 22533 - DNA, 121 bp, Artificial Sequence
  Synthesized
  misc_feature (61): n=a or t
gtatgtctggtctcttttcactataaccaacagaagcaccatacaaaagtcttacaatggntgtcttaatctctctgtgtgcttttagagcattattttgaattccatcatgcaggctttt

SEQ ID NO: 22534 - DNA, 121 bp, Artificial Sequence
  Synthesized
  misc_feature (61): n=t or c
aaagaccactgaatgcatcttcaccttttgcatctgctgaggtgaagtcacagcccacagnaaaggctgtaacctggctctgatgggtcctaacaaagatgggaccactgctgcttatgga

SEQ ID NO: 22535 - DNA, 121 bp, Artificial Sequence
  Synthesized
  misc_feature (61): n=a or g
cccacgtggaggtattgctgaagcagaagaaggacaggaagcgggagctgaaggctctgcnggaacaggacaagaacctgtgtgacatcctctgcgtgtccaacttcagcatcgatgacag

SEQ ID NO: 22536 - DNA, 121 bp, Artificial Sequence
  Synthesized
  misc_feature (61): n=a or g
ttaaaaataattttaacttgatgtctcagtttttgaatatgagaaaattgtagttacagantgatgcaggtctttggagatcattctttctagctccctgatcaaaacagagccaacttgg

SEQ ID NO: 22537 - DNA, 121 bp, Artificial Sequence
  Synthesized
  misc_feature (61): n=t or c
gtagcatgggccacagcatttcatccagctaattttgcagcaagcctaaagcttgtctgtnccaaagtcaggtagatttaatctgaagatttgaggtgatgaagaattaaatgtaacattt

SEQ ID NO: 22538 - DNA, 121 bp, Artificial Sequence
  Synthesized
  misc_feature (61): n=a or g
aacagatctgaaataaatacagatacagatataaacaaatccaacgtacacactgccaagntgcccatttaacaatgtgtttttgttagggttatgtgtaagtgacctaaatatgtgctga

SEQ ID NO: 22539 - DNA, 121 bp, Artificial Sequence
  Synthesized
  misc_feature (61): n=t or c
tggctctccctgaagggaacagaccttagctctggatccaagagtaacagatgtcatcagngtgagtcataacagccacaaagtttgtcacgaagaatcacaatgctgacctagaagtgtt

SEQ ID NO: 22540 - DNA, 121 bp, Artificial Sequence
  Synthesized
  misc_feature (61): n=t or g
gttaaagacaaacagcacaaggacacctcatattcttatggaatgcattataattaataanctagaatccgtgagttgtgaaaagactcaatcatgtaaaaacattgttagtcaaatgaaa

SEQ ID NO: 22541 - DNA, 121 bp, Artificial Sequence
  Synthesized
  misc_feature (61): n=a or g
catatttttatacagcaaactgaagctgcttcttaagaggagactatgacctctcttgagntgtttgctgaggctgggcagaaatgaagcagcatttgagttctgaaggatgtacccattg

SEQ ID NO: 22542 - DNA, 121 bp, Artificial Sequence
  Synthesized
  misc_feature (61): n=c or g
tggtttggacttggaaatgatcctaaccaacaagtcagcatcaggtggagaagtgcagaanaaggcatgcctcatgcccagcttacacccagaactgctgggctgctccttcagcctcccc

SEQ ID NO: 22543 - DNA, 121 bp, Artificial Sequence
  Synthesized
  misc_feature (61): n=a or t
aattccacaacaaatgctggaatattctgtacaagacagcagtgtatgcatgtacaggttnaattccagttcttccttaactagttaatacaaatcataatcataaacaggaaagttatga

SEQ ID NO: 22544 - DNA, 121 bp, Artificial Sequence
  Synthesized
  misc_feature (61): n=a or g
tcttgtattttactcttggagggttaaaagcagacagcactcagctagaactaaaaggtgntgcaattaaaattcacaaagttattgatcttagccctgctccagtgggccctccttcagc

SEQ ID NO: 22545 - DNA, 121 bp, Artificial Sequence
  Synthesized
  misc_feature (61): n=a or c
gtgacgaaaacccatgagggcctccctcaggagcaaagtgcaatgctcagttttccgttanacttacagcacatcacctctagaacaaaactctccatgtagaagaaagttcagcatgacc

SEQ ID NO: 22546 - DNA, 121 bp, Artificial Sequence
  Synthesized
  misc_feature (61): n=a or g
agatgccactgaatgctttcaaaacaaaatagcagtaaaaatgttaaaatcaaaacggacntttaccaagtaagccagctattctcaagaatgttgttagtgtgtttggctgtcacagctt

SEQ ID NO: 22547 - DNA, 121 bp, Artificial Sequence
  Synthesized
  misc_feature (61): n=t or c
ctgtcccgtcacgtggcactggatctgtgctgcaggctcctgctgtaggcgcgggctgccngctgccacagctccggctgttctgcagttctgcacatcagttccagtgtgactcttggtc

SEQ ID NO: 22548 - DNA, 121 bp, Artificial Sequence
  Synthesized
  misc_feature (61): n=a or t
cccatgaatcctttagtacacaactgtgaaaataatgaaacgtattcatagcagggaagtnttttctttgctgtatgtaactatcctcaagtcacacaggatttgtattgaagtgtgttct

SEQ ID NO: 22549 - DNA, 121 bp, Artificial Sequence
  Synthesized
  misc_feature (61): n=t or c
cctttcatgtgagatttaaatgtaaggtgctgcatatggtccctcagtgctttctcataangatctcgtacattaaaatacctttctctcctattacaactgaaaatttcagtatgcaatg

SEQ ID NO: 22550 - DNA, 121 bp, Artificial Sequence
  Synthesized
  misc_feature (61): n=a or c
aaggaaaatgtcaattcctcttaagagactgccaggggaattgagatgacaagctgtggcntagtaatctacaatctcactaatactttgtttgctggagatgcgattagaattcaaaatt

SEQ ID NO: 22551 - DNA, 121 bp, Artificial Sequence
  Synthesized
  misc_feature (61): n=a or g
aggctgggatctacatcagtattttcagagatttgggctcactgggcctttaaacaaatanatgagataggaatcagtggttcagatctcccagtgcccattttcaagtcaacttaaaatc

SEQ ID NO: 22552 - DNA, 121 bp, Artificial Sequence
  Synthesized
  misc_feature (61): n=t or g
ctgtggctgtgtgagtgatgcagtgcctccatgcaattaacttaatgtgttcagagaaccnccagaactcctcgcttggaaatgttcccaagggagatgggatttttttaatctctttaaa

SEQ ID NO: 22553 - DNA, 121 bp, Artificial Sequence
  Synthesized
  misc_feature (61): n=t or c
taatttcacgagaacactgcactcctgcaccaactgtaaaacagaaaaaataatgttgaantacttagctataggacaagagatcagatacttactaagcttgattcatgtgcataattcc

SEQ ID NO: 22554 - DNA, 121 bp, Artificial Sequence
  Synthesized
  misc_feature (61): n=t or c
gagctggtagaaagaaagcagtttgtctcagggcacgcagtaaaagctgttccaacactgnggtctgacacactgcatctgtatttcccctatttgccaacttccttccagctgaaggggg

SEQ ID NO: 22555 - DNA, 121 bp, Artificial Sequence
  Synthesized
  misc_feature (61): n=t or g
actcagattcctgcttccacgttctatccagcgataggttaactctgtatgtgtgtaaatntttgtaggcatttattagaccagcaggagctaatgggtccttgttgcttgttattttgag

SEQ ID NO: 22556 - DNA, 121 bp, Artificial Sequence
  Synthesized
  misc_feature (61): n=a or g
aaagcatctctaatcctataatccccatcctcattgcttaaaactgaagcgtatcttcccnaggggctctatcagccagctagtcagggctacctgcttccccttccaacctggagggctc

SEQ ID NO: 22557 - DNA, 121 bp, Artificial Sequence
  Synthesized
  misc_feature (61): n=t or c
atgtaaatagctccgaatctgtgatctgaaatttctataggaggtcactcagtaaagctanggttcaaggtctccttgcaggatgcaagagggaaggagcagacatttctcattcctgcaa

SEQ ID NO: 22558 - DNA, 121 bp, Artificial Sequence
  Synthesized
  misc_feature (61): n=t or c
tgtaattattaactctgactgtgtgggcattttatctgaagccactcagcattgaggtggngcaggctgtgataagagcgcggctttcaccttttgtgtgtaatgaaccctaatgcaaata

SEQ ID NO: 22559 - DNA, 121 bp, Artificial Sequence
  Synthesized
  misc_feature (61): n=a or g
ggagcatcctaccttgtcagctcctgtttcactgtgtctgatgtgaggtatggcctgctcnctgcctggccaaactgactgcccatttgttcacttttcatatgttgaatttattgaaagg

SEQ ID NO: 22560 - DNA, 121 bp, Artificial Sequence
  Synthesized
  misc_feature (61): n=t or c
catttctgctgtggtcatgttactcttttcccagtagtatcgcttggcagaagtttattantggacttggtaatcagttgtgttagagcatgtctgtaatatgcttgtcctattccttcag

SEQ ID NO: 22561 - DNA, 121 bp, Artificial Sequence
  Synthesized
  misc_feature (61): n=a or g
cttcctgctccatcaagaacccttttggtggaagaagttgaggggttgtttcactggtcanaaggtcatctacaatctgcaatagctcagaagaaatgttgttctgcaacagaaaggaagg

SEQ ID NO: 22562 - DNA, 121 bp, Artificial Sequence
  Synthesized
  misc_feature (61): n=a or g
atgaggctgctgctcttcatctttaggaagcactggcagaaagatcctggtacagaaacanccaaacagcaccctggagacacagccatgctacttctgcattgtgatgtgtatttgttta

SEQ ID NO: 22563 - DNA, 121 bp, Artificial Sequence
  Synthesized
  misc_feature (61): n=t or c
tcagttattaacaaccatcagtatgttatttcaccttcttgatagcacattccaaagtccntccacaaggcaaaaattaagacacctttctttttttcattacagactgaagtcaaaacaa

SEQ ID NO: 22564 - DNA, 121 bp, Artificial Sequence
  Synthesized
  misc_feature (61): n=t or g
ttgtcataacaatgccatacaatgctacaggcaagaggaacagtggctggaaagctaactngaggaatagtgccaggggttactgatctgaactgaaataggttgctcagaaaggttgtgg

SEQ ID NO: 22565 - DNA, 121 bp, Artificial Sequence
  Synthesized
  misc_feature (61): n=t or c
aaatctgttagatttagatcagacaatcccattgagaagatgcaaaataaagttcaaatangatatgtgaaaactgctgcaggttttaatcattctgaccttccacagattattttatcaa

SEQ ID NO: 22566 - DNA, 121 bp, Artificial Sequence
  Synthesized
  misc_feature (61): n=t or c
aaaaatctggggatttctctcaccttctgagactcattatgtttctttatgctcttagtgngtcaaaagagatcttggttagctgtctaagcaagttctgacaaagagcaccaacaagacg

SEQ ID NO: 22567 - DNA, 121 bp, Artificial Sequence
  Synthesized
  misc_feature (61): n=t or g
acaacaggatggcgtgttgtactttccctatctctgagtcaggaggcacaagcagttattnctatcgctgcccttcttgcaccacccagaggcactatgctgggtgcaaacccagtgtgct

SEQ ID NO: 22568 - DNA, 121 bp, Artificial Sequence
  Synthesized
  misc_feature (61): n=t or g
tgtgcaatactttttcccaatgcattactcagtatgagtatatcctctcgaggactgtccngttgtgtgactgttgccaccccttggcagagagcaggaggttctaaaatgagatctgttg

SEQ ID NO: 22569 - DNA, 121 bp, Artificial Sequence
  Synthesized
  misc_feature (61): n=a or c
ggaaagaaagatgagctgattggtgaaaaccaagaatggctccaccaaaggcaagttgtgnctaacaaactcagtggccttttatcacagagttacagcatcagtagataaaggaagagca

SEQ ID NO: 22570 - DNA, 121 bp, Artificial Sequence
  Synthesized
  misc_feature (61): n=t or c
agaagcttaaatatctggaaggtctttaaagaattgagctttcaaaacaccacagaaactnaattttctttattccttttggcaaattgaatcagaactgttaagtgagtctccctaactc

SEQ ID NO: 22571 - DNA, 121 bp, Artificial Sequence
  Synthesized
  misc_feature (61): n=t or c
ggagagatgaattacttctgatttatccatcacagagctgggtgtctcacccactctctcnttctggacttgctatataggaaagaaacaggcatctccatccagctcttagacacctcca

SEQ ID NO: 22572 - DNA, 121 bp, Artificial Sequence
  Synthesized
  misc_feature (61): n=a or g
taatattatgaaggcacatacagtattactattgctgtctaattaactttgagataatggnaagtctgctaaaaatgtcttatttcaatgtcacaggtattttcctattcagagtgtactg

SEQ ID NO: 22573 - DNA, 121 bp, Artificial Sequence
  Synthesized
  misc_feature (61): n=a or g
agcagccatggcctgcacaccccaagggctacgcggaggccctcagcatatcacctcctcntgctgctgcgacatttagagccccaggaggaagcttaattattttttctcctcaagcacc

SEQ ID NO: 22574 - DNA, 121 bp, Artificial Sequence
  Synthesized
  misc_feature (61): n=t or c
ggccttgggaatctcaggttgaacagccagaaattagctgtgcaatccaagagtgaggaangtggatctagtcccctgtccaccatcacagaggaattctacctaatgcttcaccgggctc

SEQ ID NO: 22575 - DNA, 121 bp, Artificial Sequence
  Synthesized
  misc_feature (61): n=a or g
gtatgttaagaaaatgaagtaacaggagcaaaccctgctgaagaggtggctctgctagacnagagttagctacaagtagctgaagcacactgttgtgctgaggaggcagaggagtattgac

SEQ ID NO: 22576 - DNA, 121 bp, Artificial Sequence
  Synthesized
  misc_feature (61): n=t or c
ttggagaaggaaatcagttcagagccagggactgtgcaaaacaactgcagcacatggggcngcttctgcttgggactcttcgctgtgaagctctgtgggattaagccgtgatgtctcctcc

SEQ ID NO: 22577 - DNA, 121 bp, Artificial Sequence
  Synthesized
  misc_feature (61): n=t or c
acaggcaccataaaactctgcctgttgtctcagcattccaaagaactctgcagatgcagtngttatctatacagagaaccctacagcattcttcctgtctcagatactcagtgcaaaggcc

SEQ ID NO: 22578 - DNA, 121 bp, Artificial Sequence
  Synthesized
  misc_feature (61): n=a or g
cttactttaaggtactttgtgggatatcagcaacctacacacaatagccctctttccagantgaattctccatcttcagtggaaggcagaaaatataaaattaaacttctgaaaaacacct

SEQ ID NO: 22579 - DNA, 121 bp, Artificial Sequence
  Synthesized
  misc_feature (61): n=a or g
tatttatgtttatacatttgcattggtagaatatgtgttttcctcattatctgaggtaggntctcacagggattcgaattgtcatgagtaaactggtatgtatttctgaataggttttatt

SEQ ID NO: 22580 - DNA, 121 bp, Artificial Sequence
  Synthesized
  misc_feature (61): n=a or g
gtgacataagggatctgttccattcctggcaatgttgttcctggtgcatctcagatgatgngagctaagacattttacaaagcttatgagggtttttcaagggagcaggcaacagatggga

SEQ ID NO: 22581 - DNA, 121 bp, Artificial Sequence
  Synthesized
  misc_feature (61): n=t or c
tctccagacctgtcatggtcctgtctcctgctattcctgaactggactccctgcaagcacnctagacctggcccctgatccttcctcccagaggactgccagacttgctgctgacactctg

SEQ ID NO: 22582 - DNA, 121 bp, Artificial Sequence
  Synthesized
  misc_feature (61): n=t or c
tgtccagcagcaagcagataaggcgtggctgggcatgtggtccttcacagtttaggaaganccacacaaaaccgccacaggaacagcctgcacaccttgaaatgtgctgattttgggaagg

SEQ ID NO: 22583 - DNA, 121 bp, Artificial Sequence
  Synthesized
  misc_feature (61): n=a or g
aaggcatgagaagaactgcagcaccgatatgattacagattatggatttcagtccagtggngcactgattactgaggcgagactgccttcagtttggtaacttcctataacagtattttgg

SEQ ID NO: 22584 - DNA, 121 bp, Artificial Sequence
  Synthesized
  misc_feature (61): n=a or g
gcttccagaactgtacaaacagaaggtctgtttctccttcaactatttctgaagagtttcntgaaggtgaggcaaactccctgattgcaagagtttatgcaacctgtagaaggcactgttc

SEQ ID NO: 22585 - DNA, 121 bp, Artificial Sequence
  Synthesized
  misc_feature (61): n=a or g
ccttcgccaggccactcagcaggcatatctcctcctcctttcaagacccagcagatggctntgtacgtgctaaacatggaggtaagaagaggcagcctgaatagacatcttgtgtcagtaa

SEQ ID NO: 22586 - DNA, 121 bp, Artificial Sequence
  Synthesized
  misc_feature (61): n=a or t
cagtttgtgcaggtattcatgaaaaagcaatacagagcaaaaccatgactaatcctctacngtattattttcacccagtgtgaatgtgctttgtatttccatgttagcaatattttagcaa

SEQ ID NO: 22587 - DNA, 121 bp, Artificial Sequence
  Synthesized
  misc_feature (61): n=a or g
gatcctctggaggggcaggagggagctggaaggcacttccaagctgtgagcaatgagctcngctttactgctggttcacacgggctgtgcagaggtttccagctgttgggtgccctctgca

SEQ ID NO: 22588 - DNA, 121 bp, Artificial Sequence
  Synthesized
  misc_feature (61): n=a or g
cccattcccacaacgtgggccgtgtggcactctttgcgtaccctatgcactggtgtgaaantcctcagatggactcctcactggaaaacccccagggccatggaaccagtgttttagatgt

SEQ ID NO: 22589 - DNA, 121 bp, Artificial Sequence
  Synthesized
  misc_feature (61): n=t or c
gtccatgcacggcagccagaatttggccttgcagcagccccttagggttcagggttcacangcttatgcatgagtgtaactctgcatacgtgggtgaggccaagcacgtgtttactgcctt

SEQ ID NO: 22590 - DNA, 121 bp, Artificial Sequence
  Synthesized
  misc_feature (61): n=a or g
aggaaaaatgagcagcagccctggggatggctcatcaaggagagcaggcctctctccttancacatcttataggaatgcttcttcccccatgctttgcagcaagcccacatactcagcagc

SEQ ID NO: 22591 - DNA, 121 bp, Artificial Sequence
  Synthesized
  misc_feature (61): n=a or g
ctcagctagagaaatggattgggttacatatttggatgagtactttccattcacaagatancattcttctcccctaaataagacagaatatttaacagactgacatggctgttttggaact

SEQ ID NO: 22592 - DNA, 121 bp, Artificial Sequence
  Synthesized
  misc_feature (61): n=a or t
gatgctaaggttgcaacaaggaaaattgcacaaaaggctctcccagcaaggttctacttgnaaaatgctaaacatcagttgttcacttaaatgagtggaaattgtggtttctgtggaaaaa

SEQ ID NO: 22593 - DNA, 121 bp, Artificial Sequence
  Synthesized
  misc_feature (61): n=t or g
ttgtatttctccaaagaagccatttaaattagtgttttctaaatcagaggagctgatattngttgttgctgtgatatgtgcagcttaggatcaccatctgtactcttttgctacctcacat

SEQ ID NO: 22594 - DNA, 121 bp, Artificial Sequence
  Synthesized
  misc_feature (61): n=t or c
tgaaaagtttacataatgacaatttccactggcacatgctcatcatgaatgaatttgctcngtgacatatttaattctcaggaatttcagagttccagatggctgcgtttactcagtgtca

SEQ ID NO: 22595 - DNA, 121 bp, Artificial Sequence
  Synthesized
  misc_feature (61): n=a or t
gccattctacgattctgtgattctctaatcagggctagctttctagtacaggtagaatgantgatcataactcttctagtcctcattgtctgattaagatgaaaaggactttgtattcttt

SEQ ID NO: 22596 - DNA, 121 bp, Artificial Sequence
  Synthesized
  misc_feature (61): n=c or g
ttaagggtcccttccaactcaaatttgtctgcgattctgtgatccctatagtgctggtagnagtggaacgcaagaaaatcagaggtatggatagaagctgaccacagtaacagatggctct

SEQ ID NO: 22597 - DNA, 121 bp, Artificial Sequence
  Synthesized
  misc_feature (61): n=a or t
tagactgcagctgtatgttcagatgggtcctgcacagtgtaggcagcaccctcagcccgantcgcaggacttggctcaccctccttgaacaaataacactcttaacactgaaactgttggt

SEQ ID NO: 22598 - DNA, 121 bp, Artificial Sequence
  Synthesized
  misc_feature (61): n=t or g
gaggatgtagcactcaattatggtgtgggatgcacaagacctcctgggagcattgggttgnggtttttccccagcaggaggctcagaagcagaatgggaccccagtgaattgttggggttt

SEQ ID NO: 22599 - DNA, 121 bp, Artificial Sequence
  Synthesized
  misc_feature (61): n=t or c
gggcagttgcaaacaagcccatgcttgttctgtagttctccaagatgaaagaatgagagcnagctctggtccaaaatccagagtcatgactgtaatgcacaaaagcaagctaataactcag

SEQ ID NO: 22600 - DNA, 121 bp, Artificial Sequence
  Synthesized
  misc_feature (61): n=a or g
aacttgataaactctgtcatcgaaccacattctgaattgcctcgccctcttctcccttacntgtatgatgtctggggacagtaggagcaccatcttcacccaactgaaaagaacatgttta

SEQ ID NO: 22601 - DNA, 121 bp, Artificial Sequence
  Synthesized
  misc_feature (61): n=t or c
caggttctgcgcacacatacaggttcagcaggcatttcattacagaaatacctgtttctgngagatatttgtcagctacacatcatatacactggcaggcagtgatacttattccagctgg

SEQ ID NO: 22602 - DNA, 121 bp, Artificial Sequence
  Synthesized
  misc_feature (61): n=a or g
tttggggaggggtgggggggagaaaaagcaaaacttctccatctgattgccactaataacngaaacagcactggaaatatgcaaagcaagcagaaatctggctaagcagaagttttccacg

SEQ ID NO: 22603 - DNA, 121 bp, Artificial Sequence
  Synthesized
  misc_feature (61): n=a or g
tatgtgcttttatcatttagttttctattgttggtgccaaatcctgaaaaattggtccccntagtgtgctgcaaccattaaatactggtctgttgcagaatatcatttgaacgtattaaaa

SEQ ID NO: 22604 - DNA, 121 bp, Artificial Sequence
  Synthesized
  misc_feature (61): n=a or c
acccatttgactacactctcccatgcatggtctgttactgcttggggtggccagctaacanaactcttctgcaaacctttgtgagtcctgtcaacactgcatctcatctggtttaatgtaa

SEQ ID NO: 22605 - DNA, 121 bp, Artificial Sequence
  Synthesized
  misc_feature (61): n=t or c
aagtattgccctctctggggaaactgtaggccttcctgaatggatcgcccttggaacatgnacaaaaaaggtagccctagacaggtagtagcacttaaacatattatttcactagcttttg

SEQ ID NO: 22606 - DNA, 121 bp, Artificial Sequence
  Synthesized
  misc_feature (61): n=t or c
ctttgttagcaagatgaagcccctcaagtcactccaaaacaattgtttcagcattatctangtagaaaatttgttaggtgtaggaagggtcaggaaggatgatcaggctgtgttacgtcaa

SEQ ID NO: 22607 - DNA, 121 bp, Artificial Sequence
  Synthesized
  misc_feature (61): n=a or g
ttacatgtagtcagggtttcagtaattactatgtgtaagtggcttcactttttaaaattangatacaaatcggaagaacctagggttcttctcaaaagtatttttctgtattggtcaggaa

SEQ ID NO: 22608 - DNA, 121 bp, Artificial Sequence
  Synthesized
  misc_feature (61): n=a or g
acaaacactactgatggcaatgccatgccacagcacacggatgtttggagtgacagctctnattccacaaccaatttccccccggatgttttgtgtgctgccatctcactgttgctatttt

SEQ ID NO: 22609 - DNA, 121 bp, Artificial Sequence
  Synthesized
  misc_feature (61): n=t or c
tcagccatttatcttctaaggcaaaatactttgttttacacagttctatgaaaagctgtcngtcagctccagtttgttaataaaagaaaaaaaaaaagaaagaaaagaagagcaatttgcc

SEQ ID NO: 22610 - DNA, 121 bp, Artificial Sequence
  Synthesized
  misc_feature (61): n=t or c
tgaaaatctcctgtggtagacctaggtaaaaatcccattagtgtttggaaagaatatctgncccttaaatgtgttttcattttgtttaacaaatataatcctcctgcactgttttgttgta

SEQ ID NO: 22611 - DNA, 121 bp, Artificial Sequence
  Synthesized
  misc_feature (61): n=t or c
agttcataattctgtaaattgtggttttgctttgagtggaggaagttttgttagagatctngttgtatgagggtatgtcctacttgcattttggaaacagaactgaaaatcatttgcattt

SEQ ID NO: 22612 - DNA, 121 bp, Artificial Sequence
  Synthesized
  misc_feature (61): n=a or g
agagaaaggctctgagggaaacatcaaggtctctcatttgccacgaagggcgtttgctatnggaatacagagctgcctcctgctgacagctctccacggcctgattctggcagggctcggg

SEQ ID NO: 22613 - DNA, 121 bp, Artificial Sequence
  Synthesized
  misc_feature (61): n=a or t
ttctagtcgaattatataaggtggctgaacagtcaagccaatctttcacatatgaaaggcnttgtgaaaaatgacgttagctgagatttaaaatggatgatgagaatatgggaagacagtt

SEQ ID NO: 22614 - DNA, 121 bp, Artificial Sequence
  Synthesized
  misc_feature (61): n=t or c
gatgatccttatgtgccccttccaactcaggatattctatggttgtacgatctacatgctnttgctgtaccagtcttccctgtgcttacttaatctaattatgactggacatttgatggct

SEQ ID NO: 22615 - DNA, 121 bp, Artificial Sequence
  Synthesized
  misc_feature (61): n=t or c
ttacttcttttctgctcccttttcacgccatcattacatttgacctatttctgggcttttnagcagtttcctttctgagtctcccaaatccctgtttttttcttgccaaaaagattaacaa

SEQ ID NO: 22616 - DNA, 121 bp, Artificial Sequence
  Synthesized
  misc_feature (61): n=a or g
accactgagctttggagatcattgtgcatagctggggatggggtttcacccctctgataanagtcattgcagactgtttccacttcttcacgtgcattactgttgctgtacctatgaacaa

SEQ ID NO: 22617 - DNA, 121 bp, Artificial Sequence
  Synthesized
  misc_feature (61): n=a or g
taagcagatgtggcttcaaccactgtttgaatttgtgtctcactttcagaggtcaagaatntttcaaaacagttttgacatagactcctctctggttttttctcgtggttacctttcaaaa

SEQ ID NO: 22618 - DNA, 121 bp, Artificial Sequence
  Synthesized
  misc_feature (61): n=a or g
ccaatgccatggtcaccctttctggttccatgcagatagccaccaagtggcaaagcacacnctcccttatcctgcttatctgtgcaaagcagcacaaagccatatgtaagctttcactgcc

SEQ ID NO: 22619 - DNA, 121 bp, Artificial Sequence
  Synthesized
  misc_feature (61): n=a or g
ttccccggctgttcctgaaaagctaattcagcccaaggggttcatgctgtgtgaaactccntgctctctaaatagagcatgcctcatgaagacgaaactgatatgggtgaacagaaggaac

SEQ ID NO: 22620 - DNA, 121 bp, Artificial Sequence
  Synthesized
  misc_feature (61): n=t or c
tctgaaaacagaatctatttccctgctgctctccaagcatgtgtcggacaatccaccatgngaatagcagaacagatcccctcattgctgtgattgaggtttacatgcaagtctgtatctc

SEQ ID NO: 22621 - DNA, 121 bp, Artificial Sequence
  Synthesized
  misc_feature (61): n=c or g
ggtccttgggggatttagcaatactcagcaggaaggaaatcttcagtccttcctcccttgnctgcagaaaaaggcttctgggatgtggtttatggaatcactcattggtgttctgtgctgc

SEQ ID NO: 22622 - DNA, 121 bp, Artificial Sequence
  Synthesized
  misc_feature (61): n=a or c
aagccttcttaacttagcatgtgagatgccatgctgctctcttttacctcaagtctgtctntagagtaatgttagaaatgtatagtcatgactgtacactctatattgattgtatacagtc

SEQ ID NO: 22623 - DNA, 121 bp, Artificial Sequence
  Synthesized
  misc_feature (61): n=t or c
aaagtgcaagtcctgattggctgtgtttatctgctctctccagagttaaggacttgttgcnttcccccactttttgttcagcccttgtgaacctcctatcttcttgtaagtcccattctca

SEQ ID NO: 22624 - DNA, 121 bp, Artificial Sequence
  Synthesized
  misc_feature (61): n=t or c
ttagttttctgcttcagaggtcaacacacaaaacaacagcagcattcaggactgaggttangtttctcccacacacagagtaggagatgagagctggacagaaatcaacaaggaggagcag

SEQ ID NO: 22625 - DNA, 121 bp, Artificial Sequence
  Synthesized
  misc_feature (61): n=t or c
tgccagagctgcgttatttcactcaagatgttatcttgatcgcatgcaaccattaaagctnctttagtgcttctcaagtggaaaacgttgagcttggcattgttgccgaattatgatctgc

SEQ ID NO: 22626 - DNA, 121 bp, Artificial Sequence
  Synthesized
  misc_feature (61): n=a or g
catttgaaatcgcactggcactctgctcttttgggctcttatttggaactagtgggtttcngcaaatgctgaagattatgtgttccccaactaaaaattacactgtgctgttgcactgtaa

SEQ ID NO: 22627 - DNA, 121 bp, Artificial Sequence
  Synthesized
  misc_feature (61): n=a or g
agcagtgaataggactgtgaatgcagtttacttgtctagtaatgcatcttgtagttcacgnctgcaggatgatactctttagtcaccaccacgggtaaatgtgaatgtatgcgtattcagt

SEQ ID NO: 22628 - DNA, 121 bp, Artificial Sequence
  Synthesized
  misc_feature (61): n=a or g
gagagttttttattgtaagttttcgtgggaggtatatcactttctagcttgtattttcacntttttatggatttttttcagttctctctgattggtttttactgtttcattctgccatatc

SEQ ID NO: 22629 - DNA, 121 bp, Artificial Sequence
  Synthesized
  misc_feature (61): n=a or g
aggacttattgccccagcacaactcttaatccaaagggatccctcaagtctagttagagcnttaccaaaataattgcttcaatgataattggatgacgtccaggttataaacactcaggtt

SEQ ID NO: 22630 - DNA, 121 bp, Artificial Sequence
  Synthesized
  misc_feature (61): n=a or g
gttctaataaatgcccccaaaacttggagttcaatgaaaaaaaccccacattcaagctctnttccacaggatgttatcaatatttaaccttcagcagaatttaataaaatgcaaacaaaga

SEQ ID NO: 22631 - DNA, 121 bp, Artificial Sequence
  Synthesized
  misc_feature (61): n=a or g
taattatgactgttgcagcttttaccctgttctgtcatcagtcagagggcaggaccctgcnggggactgcctgttctatcagaatagcacagttaatagtatctggttcaatactgagctg

SEQ ID NO: 22632 - DNA, 121 bp, Artificial Sequence
  Synthesized
  misc_feature (61): n=a or g
aacagggagcaatctttcctggcagaaattcccaacgcgagccgaacggctacaaaggtgngggtggaaccaaacgcagccctcgtgcagtcacgtgcagctccgatccgggccgtgcaga

SEQ ID NO: 22633 - DNA, 121 bp, Artificial Sequence
  Synthesized
  misc_feature (61): n=t or c
ctgtgcacaactcactgtgtaataagtacgtgcatctcaagtatgtctaatgatattgttnatttgggtttctcctaaacctcctggactaatctgtctctcatcctagaaggtaaagggt

SEQ ID NO: 22634 - DNA, 121 bp, Artificial Sequence
  Synthesized
  misc_feature (61): n=t or c
atatttccattgttaactggtgttggtaaaaacaggtaccacttttgctcaatatgatgtntttgtcaatggtgaaaacaaaatttgaattcatttatacccttcatctggttatcactat

SEQ ID NO: 22635 - DNA, 121 bp, Artificial Sequence
  Synthesized
  misc_feature (61): n=a or g
tggacaagcacctccagaagacatttttgtcttatccccaagactaggataaaaatcaacntgtctctggaatcgcctgtctctttctagtggttttatagagagcccagacatctctcac

SEQ ID NO: 22636 - DNA, 121 bp, Artificial Sequence
  Synthesized
  misc_feature (61): n=a or g
gaagacagagtatctctgcagccctgaagatggaatactctgttgtgcattcaaagtgaancagcaagcaaaaccaagagcagctttcatagagaaatttacttacctcatccattctggt

SEQ ID NO: 22637 - DNA, 121 bp, Artificial Sequence
  Synthesized
  misc_feature (61): n=t or c
atcacgtagtaagaaaaacaccggccctgagtgtgccattaggtttctctaatgagtaacngcatcttatctgcaacctgaagcaataatttatggacagttacaaaacagatgaaaggtc

SEQ ID NO: 22638 - DNA, 121 bp, Artificial Sequence
  Synthesized
  misc_feature (61): n=t or c
tgggctgttagaggaagctcaaatgaaatactgcctttgttttattcagcaagtggcaggnctgcagcagtgaaatgcttctgccctctataaacatcagtacagtgaatatttttcatag

SEQ ID NO: 22639 - DNA, 121 bp, Artificial Sequence
  Synthesized
  misc_feature (61): n=a or c
gcatattgcagaaaattcagtcaagggtcatcaagacttagctcagagttaacataaaacngaatcctggtgaatcacagctaacttgtggagctgtgctgggactgtcaaccagactcaa

SEQ ID NO: 22640 - DNA, 121 bp, Artificial Sequence
  Synthesized
  misc_feature (61): n=a or g
ggtacatctccagtttagaaaggaggagcagcagggtgggtcggtcgggtttctctaaccnaactctctgggtactcacagtctctgccctgccccaggctcccgcatgcttcccagggaa

SEQ ID NO: 22641 - DNA, 121 bp, Artificial Sequence
  Synthesized
  misc_feature (61): n=t or c
ttggaggtattaatcttaaagatcaggcaactaatgaaatctcttctgagcttgtttgagntttgtttttgtattatatcactgcattcttagcataacaacttgcaatctgagcagcgtc

SEQ ID NO: 22642 - DNA, 121 bp, Artificial Sequence
  Synthesized
  misc_feature (61): n=a or g
aaacgcttgcaccacctcccattgctttcccacttctccctctgcgccctataggaatacntgtctgagcccttcataagaactttagagattttggctgagatttttgtataccaaatca

SEQ ID NO: 22643 - DNA, 121 bp, Artificial Sequence
  Synthesized
  misc_feature (61): n=a or g
acatcttttctaataactgatagatttagaaatcaatttttcttgcatactttcctgcaantaaatccattggaccccaaagtaaagagaaaaagcaaaccaagaaatgaagcaacttgga

SEQ ID NO: 22644 - DNA, 121 bp, Artificial Sequence
  Synthesized
  misc_feature (61): n=a or g
aaggctgcacacactgctcctgagcaggtccagacctcaggggcttcgtgtgatggggacngggctcggcagacctccaggtattactgcagaacagcacaaggctgctgtccttactttt

SEQ ID NO: 22645 - DNA, 121 bp, Artificial Sequence
  Synthesized
  misc_feature (61): n=a or g
tcatgaaacttagcatgcttgagagaaggttggcatgcgcttctcccactgttaaaaactncagttagagctgacttttaaaattgatatctcttttttttttttcttggcatggtgaaga

SEQ ID NO: 22646 - DNA, 121 bp, Artificial Sequence
  Synthesized
  misc_feature (61): n=t or c
ctcactgcctacctgagacctttgggctgctgggaattgggaagctgtgctttcagtgacncagaaagccacagaaatcttgaaaacacaagaagcatcaattctcccttccacttttttg

SEQ ID NO: 22647 - DNA, 121 bp, Artificial Sequence
  Synthesized
  misc_feature (61): n=a or g
tcggctgcatgcattgggtacctattaggtacgtgctttgttaaataacaggcaggacccntgaggaagctttctgggcacagatttagctgatgtgatggtggaaggaaaggaagcagag

SEQ ID NO: 22648 - DNA, 121 bp, Artificial Sequence
  Synthesized
  misc_feature (61): n=a or g
cagaagcactattttaacattggttaaacaaactggcctgctgcagccagactggggctangcagaaaatgggcaggatgacgaggaaaacattgcagggcagagacgagaggaaggaaca

SEQ ID NO: 22649 - DNA, 121 bp, Artificial Sequence
  Synthesized
  misc_feature (61): n=a or g
gaaagagaaaggcatgttgtcttgaagagacatggctggacagcgttgagaattaaactcnaaatagtcttttggaagtagcctttctaatcaaatggtaatttggttccaaaatactagg

SEQ ID NO: 22650 - DNA, 121 bp, Artificial Sequence
  Synthesized
  misc_feature (61): n=a or t
tttggaagtccttatcccttcatacattctggtcctgaaaactggagttgttcattgggtngaagatttttatttgagaacaagcatacaccataattctaaatcagagcagatcaatcca

SEQ ID NO: 22651 - DNA, 121 bp, Artificial Sequence
  Synthesized
  misc_feature (61): n=a or g
ggaggcaagtaggttatgaggcaccacaagcacatccaagaggtagcaggggactatgaanaaaggcttgattacagactacgatttacaaagctttctatgtgatgtttggaaacctgtc

SEQ ID NO: 22652 - DNA, 121 bp, Artificial Sequence
  Synthesized
  misc_feature (61): n=a or t
atgtgagtcagtacagcattgtgtgagtgtaagagttacgctcagtggtctttgtcattangtgcaaggatttgtggtagcttcattcctcaatagaaagttctctttatcaccaagtctg

SEQ ID NO: 22653 - DNA, 121 bp, Artificial Sequence
  Synthesized
  misc_feature (61): n=a or g
gtgctgggccccactgtggtgggaggagtccggcatccaaggtctggcccggaggtgtggngtcagcatgggaagccatcttgacaacctcctccatcacacctgaggagacctggggagg

SEQ ID NO: 22654 - DNA, 121 bp, Artificial Sequence
  Synthesized
  misc_feature (61): n=t or c
aatgtcttctctaataatccagagaaacttctcataaactcccccttagtgggagagagangagattacttgggcagattaaccaggcacatcttcactgtctgtattttatagaatatgt

SEQ ID NO: 22655 - DNA, 121 bp, Artificial Sequence
  Synthesized
  misc_feature (61): n=t or c
ttcttttagtttgctttgtagatgaggtgattctgacttcaagtcacgttttattacaagngtagaatttgtttaatatgaaaacctaattttcaggaaaagagagcagtgatctgcttaa

SEQ ID NO: 22656 - DNA, 121 bp, Artificial Sequence
  Synthesized
  misc_feature (61): n=a or c
ctgcatctgaaagaatactctaaagtgaattacagccctttaaagccttctagcctacagnatattcagcaaaattgtgttaaaagctacaagctaaattctttaacatcactgctaacat

SEQ ID NO: 22657 - DNA, 121 bp, Artificial Sequence
  Synthesized
  misc_feature (61): n=a or c
tgtgcagctacgtctcctgataggctttgaacagtcaaagtttttacggtaattggtgtcnttggctgtgtgcacaaaggcccaatactttggctcatgctctacttttatgatcttggca

SEQ ID NO: 22658 - DNA, 121 bp, Artificial Sequence
  Synthesized
  misc_feature (61): n=t or c
cacgcatggctgcacatactgagcacgcaccaccttgccatttgcaaaggactgcaaacanctgctcccctgacatttcagcagagaaacacctacagcacacagacctaggtacgatgct

SEQ ID NO: 22659 - DNA, 121 bp, Artificial Sequence
  Synthesized
  misc_feature (61): n=a or g
ttcagtgtacgttgcacacctggtttaactcccctctgctcttccatcttaatacaagatngctggtatgatttgctttgactgtaaaatctaacctgtccttagttgccattatgcttcc

SEQ ID NO: 22660 - DNA, 121 bp, Artificial Sequence
  Synthesized
  misc_feature (61): n=a or g
tgacttgtgtgcccttcctgcccagcagtgcttaccatgtggcacgcttaccctgacagtnagagcatgactgcaggtctgtgaccctcgagaaaatctttgtataggttacttagatatt

SEQ ID NO: 22661 - DNA, 121 bp, Artificial Sequence
  Synthesized
  misc_feature (61): n=a or c
tttttttttctggatgattgattatcatatgctttaagtgaaagattctttcaatctcatntttttcctggtccaaagtaaggccaacatttgaaagaaatggaaatgtgtagtgttgatg

SEQ ID NO: 22662 - DNA, 121 bp, Artificial Sequence
  Synthesized
  misc_feature (61): n=t or c
ctaaagcagattacagaaggccagtataacctctttgctctctaacttcttgcagattccnctctaatcactggaatcaccagtcatatcaactgatatcataacagaggatggtggcaca

SEQ ID NO: 22663 - DNA, 121 bp, Artificial Sequence
  Synthesized
  misc_feature (61): n=t or c
ggcatttgctgcatggtttcccatgattttaaggaatccccactgttaaggtggcttcttncagttttaccttcctgttagtattaccactgtatagtccatagacaaagctcctactcta

SEQ ID NO: 22664 - DNA, 121 bp, Artificial Sequence
  Synthesized
  misc_feature (61): n=a or c
ctgtcctggaactccaatgaaaatgtagttattctccgctgctctggttttgtgcaagtanggatctgggtccaatcatcttaaagtttcacgagtgaagttactgtttatgtcccatgac

SEQ ID NO: 22665 - DNA, 121 bp, Artificial Sequence
  Synthesized
  misc_feature (61): n=t or c
gaaacgttcattttcctgctacaatcaatgtggataaataggaatttgatttctcatgctngtttttcatgtcagtctaccacaaaaggatttcatagagcagatattttcaagccaacgc

SEQ ID NO: 22666 - DNA, 121 bp, Artificial Sequence
  Synthesized
  misc_feature (61): n=t or g
tatttatctgtttattttggaaagttgctggggagattgtaggaggggattggatgctgtntgcaagaaatagataggatacttggaaaaatcagtcacagactgataattattctaactt

SEQ ID NO: 22667 - DNA, 121 bp, Artificial Sequence
  Synthesized
  misc_feature (61): n=a or g
cattgccatggagtttcttctaaattaactctgggtcctggtggcccttgggcaggatttncagatgtggtttccaagctggctgcattttaagaacctcaaatgaggtttcctggtgctt

SEQ ID NO: 22668 - DNA, 121 bp, Artificial Sequence
  Synthesized
  misc_feature (61): n=a or g
actgtcaaaaaataatcctgcatggcccttccacctagaattttagatatcaaaatagacntgtattaacttcaaacttgctttaaaatctttaacatgatgcaagacataagtttttgac

SEQ ID NO: 22669 - DNA, 121 bp, Artificial Sequence
  Synthesized
  misc_feature (61): n=a or g
taacagtatatatatattttcctttctaaactttaccccagatgattaatttcctcaaacntagtttatgttgataattccataccatcccccagattaagcttagagttaactttactga

SEQ ID NO: 22670 - DNA, 121 bp, Artificial Sequence
  Synthesized
  misc_feature (61): n=a or g
tgcaggacattgggaaaatccctcatcttcatactgggtacagcctgcatttctgccatcnttcagcagcatggccagtattgagtagtccagaatatgacctcatcagaaattatgagtg

SEQ ID NO: 22671 - DNA, 121 bp, Artificial Sequence
  Synthesized
  misc_feature (61): n=t or c
ttacgaagcttattggtcatgaccttgctacctggggaaaagaacttcaaactgttgcctnctttacatagtcattgcagggtgcaggatagatcgtgtccttttgcagtctcctgagatg

SEQ ID NO: 22672 - DNA, 121 bp, Artificial Sequence
  Synthesized
  misc_feature (61): n=a or g
gctgaaaggcagaggtatctgacttttattgagcgcagttcttacagagaagactgaaggntcgcctttaggactgcacagagcggcaggaattacagaccaggagagcataagaggtcag

SEQ ID NO: 22673 - DNA, 121 bp, Artificial Sequence
  Synthesized
  misc_feature (61): n=a or t
agggggagcctcagtagtgctttatgcatggggtattgtgggggtcacatggagacatacngggggtagaggaagtttggaagactaaagaacagctcctggcagtgctttcttgctttgt

SEQ ID NO: 22674 - DNA, 121 bp, Artificial Sequence
  Synthesized
  misc_feature (61): n=a or g
tagtcaactgcagacatactcccccaggactttgaaagtatgccttatgagactgttaccntgagtaagtaactttctgggccatttatgaaggtagatacaaccatagtaaatctctgat

SEQ ID NO: 22675 - DNA, 121 bp, Artificial Sequence
  Synthesized
  misc_feature (61): n=c or g
gaaagtcattattttataacagccaatctactattataaaaaaaatcattctgtcttgatncaactgtcagatggctgtcaacacctccctcaaaatacctctataactgaatccagatga

SEQ ID NO: 22676 - DNA, 121 bp, Artificial Sequence
  Synthesized
  misc_feature (61): n=a or g
atatattccagctgccctcagttacatcagtgccaactctgacaaaatgattgcagggatngagaatgagagctatgtacttcctgactgggctggaatgcaactgagaaacaacactgct

SEQ ID NO: 22677 - DNA, 121 bp, Artificial Sequence
  Synthesized
  misc_feature (61): n=t or c
ctgcaaacgcccctccagagcctgagtctgccacctctaaaattcagcaaacatctccaangccctctgtagctgttgctcacaccatccagcccctcttagcaggaagcttctaatctga

SEQ ID NO: 22678 - DNA, 121 bp, Artificial Sequence
  Synthesized
  misc_feature (61): n=t or c
ctatctgaagactgaattttggctaaatggttttaccagcaggaatggttattctgtcttngagttactcatatttttaaatttagttctgaccacagacaaagctggaaaaataaaattt

SEQ ID NO: 22679 - DNA, 121 bp, Artificial Sequence
  Synthesized
  misc_feature (61): n=a or g
tgcaatacaagaaaacaaaaaaggacttatgaatatgaaatgggaataaatgagaaaaagnagtcttttgtccttaaaagctgtacttgagctaaggctgataccactggtattaatggtt

SEQ ID NO: 22680 - DNA, 121 bp, Artificial Sequence
  Synthesized
  misc_feature (61): n=a or g
ctacacagcaggaacttaaataatagtcagctgtgaaacatgaaaggcagaatcagcccanctcagtgatataattactacactccacttgtagcaatacattatcccagattagtacaag

SEQ ID NO: 22681 - DNA, 121 bp, Artificial Sequence
  Synthesized
  misc_feature (61): n=t or c
accaattgaagatgattgtgtgagaaacatctctgggaagtagcccttaattagctccctntttctcaacggcaaaatatagctaatgattttttttttcctagctagaagaaacaggtct

SEQ ID NO: 22682 - DNA, 121 bp, Artificial Sequence
  Synthesized
  misc_feature (61): n=t or c
ttctgctctgacagttgcacccaagcattctcaggctctgcagctcaagccattgtaaccntcttgatctcagaagggtatttggtgaaggctgaatgcagttactctatggctattatgc

SEQ ID NO: 22683 - DNA, 121 bp, Artificial Sequence
  Synthesized
  misc_feature (61): n=a or c
ttttttgaacagttacgtattcatacaaactgcgtatagacttaaagtgactgtgattacncatgtaaaatggtgtgtttagaagtcaagcatgacattgcataaatgcccattttgtagt

SEQ ID NO: 22684 - DNA, 121 bp, Artificial Sequence
  Synthesized
  misc_feature (61): n=t or c
tctgccagcaggctacgcttcctcccagaagttaactcctgtaaattactgcaaaacatgnacttccaagattgaggagaataagtaagccatgttaatggaatagcctttggactttttg

SEQ ID NO: 22685 - DNA, 121 bp, Artificial Sequence
  Synthesized
  misc_feature (61): n=a or g
cttatacttgactaaaccaacactgtgaaaccaagcctctttatactcaatgagatcttcncgactgattgcaaaaggttaaagatttgacctgtaacgtggatgccttcatctcagccgt

SEQ ID NO: 22686 - DNA, 121 bp, Artificial Sequence
  Synthesized
  misc_feature (61): n=t or c
ataaatctgtcatgccaaggaaagacaagtaacagacttcactgtaacaaaaatgcatcantgagctgactgaaatgctctgtttaagcattttaaactgcttgtaattaatgatttctat

SEQ ID NO: 22687 - DNA, 121 bp, Artificial Sequence
  Synthesized
  misc_feature (61): n=a or g
cagtagataacaggtttttaaagtgttattcgttgtagagattaaagctgtttaggtgacntggtgttcttagtacaattaaacccttttggttttgaggaatacatttatatgagcaata

SEQ ID NO: 22688 - DNA, 121 bp, Artificial Sequence
  Synthesized
  misc_feature (61): n=t or c
caattaaaagacttgctgtaactaaatagaatagaatagagttagatttataacagaacancaccagaagtgagcaaacaatttgagaagaagatagtttctcctttcaccttgatctcca

SEQ ID NO: 22689 - DNA, 121 bp, Artificial Sequence
  Synthesized
  misc_feature (61): n=t or c
gtggtttgtttctattgtcacctgtggctgggcaaaacaggagctggaaacgaagcaaggngctcaaaagtatactgtgttctgcctggttaaacacatggtgcttctctggttgtagctg

SEQ ID NO: 22690 - DNA, 121 bp, Artificial Sequence
  Synthesized
  misc_feature (61): n=a or g
ggcatggcagaggtcatgggaagagtcagtatttagtcagcactgaaagtgaaggtggctnctttcaattctgcgcttctatagtgtaactggaaacctactccttccccataactgcaat

SEQ ID NO: 22691 - DNA, 121 bp, Artificial Sequence
  Synthesized
  misc_feature (61): n=t or c
tcaaaatgtttctctatattatatgctatgctacacactacctcattgtgctttctttttnaattataataaaaagtccttcatagtttaacatttattcttgattaaagagacatattga

SEQ ID NO: 22692 - DNA, 121 bp, Artificial Sequence
  Synthesized
  misc_feature (61): n=a or g
agcaattctctgctcaaatccaagcctgcaaaatatgtcctgttttcagaacgattttaanggctgaaacacatgttatgtaacaacacaaagcatcacttcacagctgctgatgaattta

SEQ ID NO: 22693 - DNA, 121 bp, Artificial Sequence
  Synthesized
  misc_feature (61): n=a or c
gggggatttttaagtttagcaaattcactaatatctatgttttacaaatggctggggaaantgtgctgtagaatgcttggaacttctttaaacagtgtgaagaaacgcagagtttttcctt

SEQ ID NO: 22694 - DNA, 121 bp, Artificial Sequence
  Synthesized
  misc_feature (61): n=a or g
aatcaaaatttgttaggtttacaggaatgataactggtatgaggttctagtctattctgcngagtaaattggagtagcaatacatacaatttcttctggatgaataaaaagtgtctctatt

SEQ ID NO: 22695 - DNA, 121 bp, Artificial Sequence
  Synthesized
  misc_feature (61): n=a or g
ctctgttctgggttttactccttgaaataaccaagaagttctttcttaaaaaggaatcctncagtgtgatatcatggttaaaaacatcaaggtgtacaaacttagtcatgaaattgctgtg

SEQ ID NO: 22696 - DNA, 121 bp, Artificial Sequence
  Synthesized
  misc_feature (61): n=a or g
tgagagacagtatgggaatatagaattaaaaggtctaggtttccacatggattacttctgngtatcattgcatgatacaacaaatatttttattttctttgaaatagtagaaaaaggttga

SEQ ID NO: 22697 - DNA, 121 bp, Artificial Sequence
  Synthesized
  misc_feature (61): n=t or c
agctcaagtattttcttgacttctgtaaagctttccaactggaagacagggctactgctgnactcccaaataaccagtgaaataatcctcagccttcccctgttttctgcctggatataca

SEQ ID NO: 22698 - DNA, 121 bp, Artificial Sequence
  Synthesized
  misc_feature (61): n=t or c
catggagggaattggcaggcttggttggcactggggccatcatgtccttataaagtcttangtttcagcatcccagtgagcttatttttcatgggaaactgtgttttaacctatttcctgg

SEQ ID NO: 22699 - DNA, 121 bp, Artificial Sequence
  Synthesized
  misc_feature (61): n=t or c
atttctgactgtggcttggctgtatctgggattcacagcatgggactgcattcccctacantgttagtatatgatctacatttctctggttgaattgtatgtgcggtgtctacaccatgtg

SEQ ID NO: 22700 - DNA, 121 bp, Artificial Sequence
  Synthesized
  misc_feature (61): n=a or g
ggtgcaatccagttgaggagcattcaatgacatttgtgtgtaggactcttttgtcacctanaggatgcacccagttatgttagcagagaccaaacatgagcagcaggagaagggctgagca

SEQ ID NO: 22701 - DNA, 121 bp, Artificial Sequence
  Synthesized
  misc_feature (61): n=a or c
ctcagtggtgctgtgtggtcttttaaggttatacccatgagagtgctgcaggagtgacatnattttgacaagctgtataatcacaaaagctgcagaagtataattgaatttgcttttattg

SEQ ID NO: 22702 - DNA, 121 bp, Artificial Sequence
  Synthesized
  misc_feature (61): n=c or g
caggtcatactctcctaagtcatttctgaaacagatacatagggctccgagcttcctaganccacatttctaaagtagttgggctacctaaggctcagattggtgccttgagagattcttg

SEQ ID NO: 22703 - DNA, 121 bp, Artificial Sequence
  Synthesized
  misc_feature (61): n=a or g
actcaagcaaacaaaatgatagaaactgcaacacagtaaaggattacctgaaactgagctncatacgctgtgcctcctacaaaagatttaccaagttggctattaattccaagaaattgca

SEQ ID NO: 22704 - DNA, 121 bp, Artificial Sequence
  Synthesized
  misc_feature (61): n=a or g
tgagaattgggcgacggttcatccctcctacacagctgctgttacacatgaagttgtacangactgttgtgaactcggtaccaacctggatgagatggagaggatgagcagaagagatggt

SEQ ID NO: 22705 - DNA, 121 bp, Artificial Sequence
  Synthesized
  misc_feature (61): n=a or g
ttccccctccacaccagccgttcactgtaggtagcaacaccctacctgtttcttagctctntgactgccccaaccgtaacaacctggtgaaccatgtcaggtagcagtgacaacatttgct

SEQ ID NO: 22706 - DNA, 121 bp, Artificial Sequence
  Synthesized
  misc_feature (61): n=a or g
agagccatggattctccctctgctggcacaaccaggtgatcatgtcaccatagccactggnagaaccacttcagataacgtgacagcctcaggaaggccctccccaccccttccctcaaca

SEQ ID NO: 22707 - DNA, 121 bp, Artificial Sequence
  Synthesized
  misc_feature (61): n=a or g
aaacacatgtctataaccaaactcaaatgattaaaagatctcaattttttcacttcagagnaaaggagaaacaagtggtatttaaatcttagaaaagtaatacctgtggtctcacccttta

SEQ ID NO: 22708 - DNA, 121 bp, Artificial Sequence
  Synthesized
  misc_feature (61): n=a or g
agcatttgtcctaattctgaagttattttcaagtattatgtattgaatatatcttttgacngacatcgctcaaatgctaaacttttctaacttcgatttgttttattgtaggatgtcgaat

SEQ ID NO: 22709 - DNA, 121 bp, Artificial Sequence
  Synthesized
  misc_feature (61): n=a or t
atgctggggatggaagaaatgcagggaaggattcccctacgttacaaaattctctgtaacntttctggtcgctctcatgttgcacagaacccagcagtcctcccagcaacagcgctgtgct

SEQ ID NO: 22710 - DNA, 121 bp, Artificial Sequence
  Synthesized
  misc_feature (61): n=t or c
aaagagtaattggaaaaaaaagaggggcagtgcagatctaatatgtaaacactgaacttangatcaacagtttcttcactgaacaacaaacctgtattttgcttttcaagcagggaaagaa

SEQ ID NO: 22711 - DNA, 121 bp, Artificial Sequence
  Synthesized
  misc_feature (61): n=t or g
atgaactgtgataatgcgtcaagaaaaaaacctaccaaaaaagtctttctccctatacctnctagcagcccacgcgttctgacattctgacaaaactctgggatcaaaagcacctatccag

SEQ ID NO: 22712 - DNA, 121 bp, Artificial Sequence
  Synthesized
  misc_feature (61): n=a or g
tacaatttctgcctgtcacattagtttccatcactgaaaggtgatattaactactgtaacnttaaatcaagggaacagaaagctatggaaaaccttaagtacaaggcataggaggtgtaca

SEQ ID NO: 22713 - DNA, 121 bp, Artificial Sequence
  Synthesized
  misc_feature (61): n=t or c
gcccaggtatttccactaacaaagctgcatttgtagttggcttcagttcacgttttccacngttccactgattaaagaaagccaagagcaatctggtagcactgggtacagcagccctgcc

SEQ ID NO: 22714 - DNA, 121 bp, Artificial Sequence
  Synthesized
  misc_feature (61): n=a or g
gcctgggctgagctgatgtttctatgatgtttctggtacgctccattgacaagatctcacnctcagcgtctccaatagcatcaatgctgggttccttcagcacaacaggtgggctgttatt

SEQ ID NO: 22715 - DNA, 121 bp, Artificial Sequence
  Synthesized
  misc_feature (61): n=t or c
gagaagacagtattacagcattttgaaatgtttggattgaatggtaggttatacacgttcntaacagatgttattcttaacaatccagtattggaaaatgtagaaacagtaaatacaaagt

SEQ ID NO: 22716 - DNA, 121 bp, Artificial Sequence
  Synthesized
  misc_feature (61): n=t or c
ataaagagtaatccgaagcccacaagaagactaaggaaaggctatattacattgataattnatacagtagaagctctatagtgccagattgagaccattttatttttaactttttaaataa

SEQ ID NO: 22717 - DNA, 121 bp, Artificial Sequence
  Synthesized
  misc_feature (61): n=a or g
tgtaattagtccagcagaattaggatggtatgtggcagaccaaaatggtgccacatacgtncagcaagagataagccccatcagaacacccctacaggctttaaatagccctgaaaataat

SEQ ID NO: 22718 - DNA, 121 bp, Artificial Sequence
  Synthesized
  misc_feature (61): n=a or g
aatttatcactcacagtgcaaaaaggagttttggaacccagtgggcccaccattcaaaaantctaaaggaatttaaaagctctattatttccaattaatccacaccaactataacacaata

SEQ ID NO: 22719 - DNA, 121 bp, Artificial Sequence
  Synthesized
  misc_feature (61): n=t or c
aatcagatacacaaagaaaaaaaatgatgcatgaggaaaagtcttcagaggcttacaaacncagataatctactggcaacgtaactgaatttggattaagagacataacacagagcctatc

SEQ ID NO: 22720 - DNA, 121 bp, Artificial Sequence
  Synthesized
  misc_feature (61): n=t or c
ttgtgccatttcagagctcctctcaccgtattgtgagctttgtttcttttctattcgctcncggtgtgaaccattcccctcctcaccagactcactgctgtgggtacagccacagcagcac

SEQ ID NO: 22721 - DNA, 121 bp, Artificial Sequence
  Synthesized
  misc_feature (61): n=a or g
agaacagacatcaaatgatacctgagctagcacaaagttagtgctgcattgacagacaacnttgtacagggtataaaatctaaccttacaaagttgatccatcatagtctttcagcaaatt

SEQ ID NO: 22722 - DNA, 121 bp, Artificial Sequence
  Synthesized
  misc_feature (61): n=t or c
gatcactaaaattcatttagcaagagaatttgtaaatcacgttgccaactgtgcttaaaancttttaaggaataatgtgtcttgctttcattttggattgcatcaacacaagtagaataga

SEQ ID NO: 22723 - DNA, 121 bp, Artificial Sequence
  Synthesized
  misc_feature (61): n=a or g
tcagagggatggctgctgccaaccagtactgttggtgtgggaatgagccacttatcttatncagtcacgtcgtgttttcccgatggattagcatgaggtgttcaggcagagaaagagaggg

SEQ ID NO: 22724 - DNA, 121 bp, Artificial Sequence
  Synthesized
  misc_feature (61): n=t or c
tgtggttattatagctctccattaaataaacataaacaattacacacattgagttagagcntgagttgtagttacagcaaaggcagatttatatgacatttcttttccaattcatttgaac

SEQ ID NO: 22725 - DNA, 121 bp, Artificial Sequence
  Synthesized
  misc_feature (61): n=a or g
aatctttcttttatctcatggatggtcttcagaagttgtgtgtttctcactgatcccttantgtatatagctattttcttcttcaaagtcacttaaatttatttgttctggaaagaagaaa

SEQ ID NO: 22726 - DNA, 121 bp, Artificial Sequence
  Synthesized
  misc_feature (61): n=a or c
ggagctcagggatgaaactgctgaattactaattctgatacacagtatattaaaagcaacntcaggcctgaagtcatgcactttggaaatatgatacctaattttaatattttgaggggag

SEQ ID NO: 22727 - DNA, 121 bp, Artificial Sequence
  Synthesized
  misc_feature (61): n=c or g
cagacacggcaggaaggtgatgcttttggctctggtagttgcatgcactgaattggacatntaatgcctctgtgtttgggttctgacacacaaaatggaaatagtcaggagtgaggtctgt

SEQ ID NO: 22728 - DNA, 121 bp, Artificial Sequence
  Synthesized
  misc_feature (61): n=t or c
gtgctacatttagcatagcccttcatgacgttatgtgtatgtaccacactctatccagtangtctctgttgcccaattaaatatctattctcgtctgcttctttctttaactggaagagtc

SEQ ID NO: 22729 - DNA, 121 bp, Artificial Sequence
  Synthesized
  misc_feature (61): n=t or c
cgggttttaaacactgcagtcagcagagcaaaacaaacccttctgacctagcaggaaacangcttttcagctaatcatttattgtgaatgtatttcgggtacttccattaatatgcaactg

SEQ ID NO: 22730 - DNA, 121 bp, Artificial Sequence
  Synthesized
  misc_feature (61): n=t or c
cagaaaggtaacttttggagcatttccttattattttgttctagtaccacattatgtcaangataccttttgaagtcaagatcctgtctttgagcaagaatcggttcttattgtttccttc

SEQ ID NO: 22731 - DNA, 121 bp, Artificial Sequence
  Synthesized
  misc_feature (61): n=t or c
atttccaaaatggaggtattccaagctataaccccctcaggagtgctgaaatgttcaacancagccctgtctctctccagaaaagctgtaagcacatacagctccctgctgctgacacatg

SEQ ID NO: 22732 - DNA, 121 bp, Artificial Sequence
  Synthesized
  misc_feature (61): n=t or c
cactgagaaaaaatcagctacttttacctcccttttcctaatcttctccctatttcctctncctcagtccctccaagtccgtggttcggtcagcctccatcctcctctcacctgatctttc

SEQ ID NO: 22733 - DNA, 121 bp, Artificial Sequence
  Synthesized
  misc_feature (61): n=t or c
gataacaaactcagagcttactctattcaactgtctcacaactggaaaacaggcaacagcnagatctgactgctcacaaagcaatgtaagaagttggcatttagtctatctgcctgctaca

SEQ ID NO: 22734 - DNA, 121 bp, Artificial Sequence
  Synthesized
  misc_feature (61): n=a or g
atggttgtaccagttaaactaagaataacacagtttgagcataaaacaaaacggattagcntacatttgccatcagcatagttagtctggaaagtagagaaaagctagcaaaaaatggaga

SEQ ID NO: 22735 - DNA, 121 bp, Artificial Sequence
  Synthesized
  misc_feature (61): n=a or g
ccgtataacattgtccaaacatcagacagtacagctccctcgtgagggacaggaggaccanggtctgaccaaggactatggaaactctcctttacaccgtttcaagaaaccgggctccaaa

SEQ ID NO: 22736 - DNA, 121 bp, Artificial Sequence
  Synthesized
  misc_feature (61): n=t or c
tccttctcaggaagaaactgctcagttaacataattcaaacacagtcaagatttaagcagnttatttatgtattagtgacaagtaattaactagccatcagtgaactatatctttttctgc

SEQ ID NO: 22737 - DNA, 121 bp, Artificial Sequence
  Synthesized
  misc_feature (61): n=a or g
gctctcctgccatttacttggtcagggttttgtgcttgaggttacagaggtacttcatccnctttcatgtatatttagtatgttgaccacagaattgactcaaactccatttttgttttct

SEQ ID NO: 22738 - DNA, 121 bp, Artificial Sequence
  Synthesized
  misc_feature (61): n=t or g
aggttttaggtcagttcctctcaagaatggttacagtgaagacatagagctagcctcactnctgattcactgtgaaatgcagcaagttctggtgagagcctcttgtttattttgtgcacta

SEQ ID NO: 22739 - DNA, 121 bp, Artificial Sequence
  Synthesized
  misc_feature (61): n=a or g
acactgaagaatgagcaggtccatgctcccaatcagattgtgcaaaaacagaaagagtctncaagaatgctgaacagactacatgctgattttgtctcttacatgttccccgtcaccatgg

SEQ ID NO: 22740 - DNA, 121 bp, Artificial Sequence
  Synthesized
  misc_feature (61): n=t or c
aatactgttattgctcttccatagtaacttttaacaaagttgatttcatccctctcgcagngtgccctgccaagaaatggacttgaataaagggccctcattagcaacaaaagcttggagg

SEQ ID NO: 22741 - DNA, 121 bp, Artificial Sequence
  Synthesized
  misc_feature (61): n=t or c
tatcccagctccatacacatgttcaagatactttagggcacttaaaatggcctgagcaacnggtgcatgaatttgaacccttagcaacagattagaattaatgtcacctaaaacaagtgag

SEQ ID NO: 22742 - DNA, 121 bp, Artificial Sequence
  Synthesized
  misc_feature (61): n=t or c
gtccgtcacccggtgatgtcatagcctgttgctcggggacatcgccatgggctgtccaccnccacagcacccatccctgaattttaagtttatattcacagtttcaataactactgaagtt

SEQ ID NO: 22743 - DNA, 121 bp, Artificial Sequence
  Synthesized
  misc_feature (61): n=a or g
ttaccccaggagcagtcccaatgggaagacttctgaaggaagagaagcagagtggtagagnaatgttatctggctgaattggccacttctctcccataagtatcatgaaggaccaatgaaa

SEQ ID NO: 22744 - DNA, 121 bp, Artificial Sequence
  Synthesized
  misc_feature (61): n=t or c
ttcccatcccaaccatctcacggtctacaccaggattaaacaaacaacagcaaatgtaaantaaaaatgtcttttacctttcttgaaagctaggcctgtctctttgacaccattcacatac

SEQ ID NO: 22745 - DNA, 121 bp, Artificial Sequence
  Synthesized
  misc_feature (61): n=c or g
attacttcgttaaaaaattctacatgatttgaaacaaattattaattcttttatcagtcancttccccacctatacaagagagaattgagaggctcacagactgtgatgagattgtaccct

SEQ ID NO: 22746 - DNA, 121 bp, Artificial Sequence
  Synthesized
  misc_feature (61): n=t or c
tactcagaatttcatggattttcatgggatgggtcaatgggtcatttgaaactgctatcanttgttcatatgcaattctcataaacatcacatataagttgataatagaaagtttcagata

SEQ ID NO: 22747 - DNA, 121 bp, Artificial Sequence
  Synthesized
  misc_feature (61): n=t or c
acagctgtgtggaaaggagtttaaccgaatgcacaatttaatgggacatatgcacttacantcagacagtaagcccttcaagtgcctctactgtcccagcaaattcaccttgaaggggaac

SEQ ID NO: 22748 - DNA, 121 bp, Artificial Sequence
  Synthesized
  misc_feature (61): n=a or g
gatgtagaactagatggttggttttattctttgataaattaaggattaatcaaagtggaanaagtcacattgattttgggggcattcatttgctgacattttagctttgatagcaagataa

SEQ ID NO: 22749 - DNA, 121 bp, Artificial Sequence
  Synthesized
  misc_feature (61): n=t or c
ttttcttggggctgtgattgtctcttttgcagaaattgtttttacaagtgaagtgattttnctgagaagtttgttctgttgttctgcatttcagccccatctgcactcctttgcagcactg

SEQ ID NO: 22750 - DNA, 121 bp, Artificial Sequence
  Synthesized
  misc_feature (61): n=t or c
atctgcaacctcctataaattcatttagcaggcctaaatattaccaagcatttttgcatcnttttgactagtaaattgatgttttccagatggctgccgtcagatctattttgattgcctg

SEQ ID NO: 22751 - DNA, 121 bp, Artificial Sequence
  Synthesized
  misc_feature (61): n=a or g
atttaacccattgttgtattcagtggcagtagacagcagagaactcagggagcttcaaaanaaccataccatccaagctgcagccaaacgtagttcagaaaatgctgagcatcagacatga

SEQ ID NO: 22752 - DNA, 121 bp, Artificial Sequence
  Synthesized
  misc_feature (61): n=t or c
ctgaatcagatgtaatatctggaaaccaatttgtcctcctttaaccttcccatttgaaggnttgcacctgtttgaaattctgacatgccccaggcagtgcagctccagacatctgagaggt

SEQ ID NO: 22753 - DNA, 121 bp, Artificial Sequence
  Synthesized
  misc_feature (61): n=a or g
tcagagcagtgggagatctgcttcagatctgactctggatcaagcagggatgggatgtganctgcaacttccccctcatctggcagcccgatgaaccccatccttcacttcctcttcagtt

SEQ ID NO: 22754 - DNA, 121 bp, Artificial Sequence
  Synthesized
  misc_feature (61): n=a or c
gaattgatactcatttatttcagacctatccagttcagtatagacagaaagaatctcccangaggaagagagatgggatctggaataactgttaaccgaagggcagtgaggttgttaagat

SEQ ID NO: 22755 - DNA, 121 bp, Artificial Sequence
  Synthesized
  misc_feature (61): n=t or c
aactttgctaattgttgttcaattggtccactttagcatgttgcaagagtaattgatttcntgtaaaaccctaaaagcagccaccagcaggagaaatatttgcaaacattccattatatag

SEQ ID NO: 22756 - DNA, 121 bp, Artificial Sequence
  Synthesized
  misc_feature (61): n=t or c
acaagagatagattgtctgatatttctgttcgtgtgatcctcccttataaaacacgaagtngatcaaggcagatccttctgttcttcaaatacaatctgtggttttgctcttccgttgggg

SEQ ID NO: 22757 - DNA, 121 bp, Artificial Sequence
  Synthesized
  misc_feature (61): n=t or g
agttgcacctcttagctgaatcatttctcatttctacaaaatccaggacatgacaacaaancctgcagttatctcccacgtaaaccaatactgaagaagcaccgcatgccaaatgtttcat

SEQ ID NO: 22758 - DNA, 121 bp, Artificial Sequence
  Synthesized
  misc_feature (61): n=a or g
tccagagaaactgatgcacacccagactgaagactatactcaggttgttattaggagtgcntgttgccagctctatggcacgagtctgtgctcagatcttaccttgcaatgtgaagtatgt

SEQ ID NO: 22759 - DNA, 121 bp, Artificial Sequence
  Synthesized
  misc_feature (61): n=a or g
tcacatacagtactctgtatactttagttcatattactactaacattttccactctgagtnaataagaaaagctacttctattttttaaaattttcttcacattcttttttccataatcag

SEQ ID NO: 22760 - DNA, 121 bp, Artificial Sequence
  Synthesized
  misc_feature (61): n=t or c
aggccacaagtctgatttattagttctagtggcccaagattatcatctcctggccctttantcaaggaaatagtggtgggtggcagaaaacaatgttccttcttgcaaatcattcatcatc

SEQ ID NO: 22761 - DNA, 121 bp, Artificial Sequence
  Synthesized
  misc_feature (61): n=a or g
ggactgctagggcctctgaacaacagaggtggaaagcaagcatcagccagctcagacaccncagacagtcacagtgcatcttttagtgaaggaatccaaaccaatttaaaataataatgat

SEQ ID NO: 22762 - DNA, 121 bp, Artificial Sequence
  Synthesized
  misc_feature (61): n=a or c
tccagttcacaagcaaagacttttaactgatggagaagacccaactgaaggccttcatagntccacaaaagacagacatttctaacactacggtctcaactgttaaagcaagaccaaactc

SEQ ID NO: 22763 - DNA, 121 bp, Artificial Sequence
  Synthesized
  misc_feature (61): n=t or c
atattatcttttgttttaatatatcgaatttacagttttgaattgaaatacctttcccccnccgataagtataataattgctggagaaataaaatattggccaaagtgtttaaataaaata

SEQ ID NO: 22764 - DNA, 121 bp, Artificial Sequence
  Synthesized
  misc_feature (61): n=t or g
tgcacaccctcactgaaaaaaaaaaaaaaaaaaaagaggcaattaagtcaatagtgctctnatgttgaagcagtaatctccagtctcttataccaacttcaattgtccaacatttgatggg

SEQ ID NO: 22765 - DNA, 121 bp, Artificial Sequence
  Synthesized
  misc_feature (61): n=a or g
aatattgatcacaaaattgttgggacaaagcaacattttaataattaatgcctgtgtctcntttcctaatgatctccacatggaacttcacctaattctggctggtgaggagcatagtgca

SEQ ID NO: 22766 - DNA, 121 bp, Artificial Sequence
  Synthesized
  misc_feature (61): n=a or g
gttgtttgtagattattttctaattaagagtaaaattcctgggtaaaaaagtctagctccnaaagccataatatgtatagcttgtaaaactggagctgcagcatatagtgatagcatcaaa

SEQ ID NO: 22767 - DNA, 121 bp, Artificial Sequence
  Synthesized
  misc_feature (61): n=t or c
accaaactaggaagtaaagctttgttaaaaactctacaaaccaaattactcagcattcagncaacaccgctaacaaactcagttttccaggaattcaccatgccactgaaatttctctgaa

SEQ ID NO: 22768 - DNA, 121 bp, Artificial Sequence
  Synthesized
  misc_feature (61): n=a or g
ctttcctgaaggatcccaatactaacagaaaccagccaaatggagtagagtgtgatgccancttcctgctgaaaaatgcagagagggggcaaaccaatctgcttgaggaaaatgtagagtg

SEQ ID NO: 22769 - DNA, 121 bp, Artificial Sequence
  Synthesized
  misc_feature (61): n=a or g
cgaactgcgggcctcacctccggagtctgtctgcaggcatcggaaatcggcctcatcttcntttaggagatcatcaaataaggcttccacgacgcacgctgtctgttcctcaaacgtcctc

SEQ ID NO: 22770 - DNA, 121 bp, Artificial Sequence
  Synthesized
  misc_feature (61): n=t or c
gcagatagatgtccaagtgcaccagccaacacagagagaaaggcagccacgttaacactancagctgtcacagatggaaactactctcataaaagaaaagcagcaatatatttactgatag

SEQ ID NO: 22771 - DNA, 121 bp, Artificial Sequence
  Synthesized
  misc_feature (61): n=a or g
gacctcctgctgtgttatcctcctgccctcatatttcaggacagctatgttgtcatagacnatacttatacaggcatgtgtgtaccagtaatggccagtttcacttctcataagataaata

SEQ ID NO: 22772 - DNA, 121 bp, Artificial Sequence
  Synthesized
  misc_feature (61): n=t or c
aatagatttggaagagagagggaaaatattgttgtggaatagacaggtctcatgaaatttntcattagctgaaaacagagggaatttgtgaagctgtgaggcatagaaattacctcagtac

SEQ ID NO: 22773 - DNA, 121 bp, Artificial Sequence
  Synthesized
  misc_feature (61): n=t or c
agtcgtctcaaattacagaagatggagggctcaccttcctctacatctgtgtagttaaatntgtagactgtaaatattctctcaggttgctaagtgagtttattttgcaccgttcctggca

SEQ ID NO: 22774 - DNA, 121 bp, Artificial Sequence
  Synthesized
  misc_feature (61): n=t or c
gcaaacagaacacagccttccccaaggtatttgtctgagcagcatcacttactctgggganataaagcaacagtgggtatctggtgaatgcaattcagcagtcccagaattttgttcccac

SEQ ID NO: 22775 - DNA, 121 bp, Artificial Sequence
  Synthesized
  misc_feature (61): n=a or g
cagttgtcagtaataccagtaagacctctcattaaattgctgcttcaatgaatgtttgggntgttctacacagggaatattcatagctacagaccaccttcagtctttctagtatggactt

SEQ ID NO: 22776 - DNA, 121 bp, Artificial Sequence
  Synthesized
  misc_feature (61): n=t or c
aattattattcctaaattatttacaaatttctaaattgtttaggaatgactgaaggacccngaggctcctgctggccccattgctgagcactcccatgggagcctctctgctccccgcaca

SEQ ID NO: 22777 - DNA, 121 bp, Artificial Sequence
  Synthesized
  misc_feature (61): n=a or g
gaacatcaagataacagttcagcagtgtgcaaaggcaactgaccatatgggagtccttganagtaggagatacaagttatggatttcactattgctttctttaaacatccttcaacatttc

SEQ ID NO: 22778 - DNA, 121 bp, Artificial Sequence
  Synthesized
  misc_feature (61): n=t or c
gtatgaagtctatggaaaagctgcacagctctggtttggtttatatggtttctcacatgcngggtttcattggacaacatgcacttggcaacttgtgactgctttgcaccgtgaggttttg

SEQ ID NO: 22779 - DNA, 121 bp, Artificial Sequence
  Synthesized
  misc_feature (61): n=a or t
gctctttttagttttaattgccatgcaatttcattcagggaaatacttgtatgtattatangtgagtgataagtgggaaaccaaggtaacatgataggtaaaatttggttagcagctaaaa

SEQ ID NO: 22780 - DNA, 121 bp, Artificial Sequence
  Synthesized
  misc_feature (61): n=t or c
aatttgaccacttcagactccaaatcaattcaggaaaataaagaatgtatgaagaaggagnatgaagctgagcacgtaaggcaaaatagacagtgattattgatgagaacttgttttatgt

SEQ ID NO: 22781 - DNA, 121 bp, Artificial Sequence
  Synthesized
  misc_feature (61): n=a or t
ttaccaacttactgctagttgcacattacaccattttaacaaggaaaagcagaataagaangcaattcttagatacatacctgtaaaacaagttcataggatgaaactaacatgccttcta

SEQ ID NO: 22782 - DNA, 121 bp, Artificial Sequence
  Synthesized
  misc_feature (61): n=t or c
aggatatttcagctacaatatgtaaactctgtctaatgcattaacttgaactgcatttcanaaaggatttccagaaatgagactgaggtcaaaacttttgtctactaaggaaattagaagg

SEQ ID NO: 22783 - DNA, 121 bp, Artificial Sequence
  Synthesized
  misc_feature (61): n=a or g
cacttacaggggcagctccagattccttaacatctagagaggtttttcccataggataacncaagcagcaagagaataactattgaaacccagaaagcagcagaggagatgaatgctgctg

SEQ ID NO: 22784 - DNA, 121 bp, Artificial Sequence
  Synthesized
  misc_feature (61): n=t or c
ttctgatttgcgcaatcaaagttcttgttagcctttatagcttggagtaatatattgcacngaattgcaagttaggctaggcatcacgttataggaaattaatatcttcagtggtactgat

SEQ ID NO: 22785 - DNA, 121 bp, Artificial Sequence
  Synthesized
  misc_feature (61): n=a or c
acacacacaaggctgtgctctcccagctttctccccactggacatgcaattagcatccttnaaacctagcacatttaaaatcccatcagcactgcctgaattctttagtagcagcctacgt

SEQ ID NO: 22786 - DNA, 121 bp, Artificial Sequence
  Synthesized
  misc_feature (61): n=t or c
ggggcatcagcatggcactgtcctgcccgcatgcccgctgactcattggcatgtcccagtncttctgcatctcagcttcccctctttaaccaaacgtgtctattgccagagcctctgacaa

SEQ ID NO: 22787 - DNA, 121 bp, Artificial Sequence
  Synthesized
  misc_feature (61): n=t or g
tctgtaagtcttaagaatatcaacataagtatcccctagggaggagaatgtctgcagtggntgcatgaagtactaattcaaaaactaggagcaatcaatacataaaaatatcaaatcctat

SEQ ID NO: 22788 - DNA, 121 bp, Artificial Sequence
  Synthesized
  misc_feature (61): n=a or g
cagaagcaggaacactagctcagaaggtccagattcccagaatttattattttgcatgtgntttcatacgtgattgtttagaaggggaaagtctggagtgttacatatttagaaacaatca

SEQ ID NO: 22789 - DNA, 121 bp, Artificial Sequence
  Synthesized
  misc_feature (61): n=t or c
ataactgttctcagactacttagtagctgatgcacttcttttaaggtcaatcattgtgcanaggggatactttttgttgtattctaggctttctgttgatctcagaagagtgaagagacac

SEQ ID NO: 22790 - DNA, 121 bp, Artificial Sequence
  Synthesized
  misc_feature (61): n=t or c
aagctgaagttgttaaagaacaggttcagtctccaaagttatcaaatacaacctcagacanccctacctcacaagtgttttcttcaggacttgaaaatcctttattttagtggcatctcac

SEQ ID NO: 22791 - DNA, 121 bp, Artificial Sequence
  Synthesized
  misc_feature (61): n=t or g
aatccagctgcagcaactttatcaatgaaaagcatattgtcatttcctccaagccatttanatagagatattctgcctgctggcattgcccagtttcatcaagaagcctacatgtcttttc

SEQ ID NO: 22792 - DNA, 121 bp, Artificial Sequence
  Synthesized
  misc_feature (61): n=a or g
tgtgacacagcagagaaatctgtgtgttttctaagagcagttaaaacagagcattactggnctgtgtggcacttttggggatggatatttgcccatggagaacactaccctgctcagtaca

SEQ ID NO: 22793 - DNA, 121 bp, Artificial Sequence
  Synthesized
  misc_feature (61): n=a or g
tattatttgcattgaatgtattaaaatattttaaacactctttttaaagagattgtccacncttgaaatcccattcagtcatgtgataatgccagtagagggagacagagtaaagtatgcc

SEQ ID NO: 22794 - DNA, 121 bp, Artificial Sequence
  Synthesized
  misc_feature (61): n=t or c
gtaaataaataaaacgaatgaacaaccgaacaaatataaaacaaatgtacaaaagttcagnctctaagaagaaattattagtactactattgcaaggataacaaatacccatcttatgttt

SEQ ID NO: 22795 - DNA, 121 bp, Artificial Sequence
  Synthesized
  misc_feature (61): n=t or c
gtttcccagagaagacaatattaaaaaaaatataatgtataatgctggtgaattatggaantgtggactagaactttactgagcaaagagctttatgaagaggaccaaaacatcttcaagc

SEQ ID NO: 22796 - DNA, 121 bp, Artificial Sequence
  Synthesized
  misc_feature (61): n=a or t
cgtgtattttgcatggaggaaatgccaaggtgtgaaacagggatggtgtttactaatacanctccaagaagtcttgagtgtgtgtttcctcttaggttatgaaaaacactgggttttgaac

SEQ ID NO: 22797 - DNA, 121 bp, Artificial Sequence
  Synthesized
  misc_feature (61): n=a or c
ttaatgagaaaaaagtggtttttctgagcttcaattatttttttgcttccttctgatgacntcaattcttcacattcctcctttcctgtttcataccgttatcacctctctattttatgtt

SEQ ID NO: 22798 - DNA, 121 bp, Artificial Sequence
  Synthesized
  misc_feature (61): n=t or c
gcaaaaacaggttgaaaaaaagcttctgaggaaaaagcctatagccttatatgcctctctnaagtatcttctttagcaatcttggatttggtttcagtgtaacatgaatagacctatctac

SEQ ID NO: 22799 - DNA, 121 bp, Artificial Sequence
  Synthesized
  misc_feature (61): n=a or g
aaaatcttgttgacatattttagtttatttctacgcctccctctgccacaaagacaaaacngaaaactaactctggttcttctaagtatcacagttatttgagagatactaaaacatatgt

SEQ ID NO: 22800 - DNA, 121 bp, Artificial Sequence
  Synthesized
  misc_feature (61): n=c or g
gcacataaggtttggtactctccctcctcagcagcgtctgtgttggctgtgttaggaacanagacagagtgatctctatctgcagttaccctggatatctactcctgactcctgcctcaca

SEQ ID NO: 22801 - DNA, 121 bp, Artificial Sequence
  Synthesized
  misc_feature (61): n=t or c
cccaaaaatggtttagttctgtcagtggtttggggcactgaaattccctgaggttaacagngagtccctcccctttgcttatccatgtttgcaatgaagtgctgctcaaagcccagagctg

SEQ ID NO: 22802 - DNA, 121 bp, Artificial Sequence
  Synthesized
  misc_feature (61): n=a or t
gaaattctccagtggagaatggcagggtctgctgtcctcatccacatgaaaccatcagtgnttcccttagaggtaccgaagtcccccaggtggaaagcaaacccctcactcagctgcatgc

SEQ ID NO: 22803 - DNA, 121 bp, Artificial Sequence
  Synthesized
  misc_feature (61): n=a or g
gtctcactctttgtcccctccgcagagctggatttagagcacgcagatgtgactgtgggcnaagctaaacagcagttgcattctggagcacatccagtccttcaaaccagacttgggatgg

SEQ ID NO: 22804 - DNA, 121 bp, Artificial Sequence
  Synthesized
  misc_feature (61): n=a or c
gtttggatgtccatgtgtgcaagcccgtgttaaacagttcataagcagcacaagaatctgntgctgctgaacatgtgtgtccatgaggccgactgtattaagatgtcaaacacaggggaag

SEQ ID NO: 22805 - DNA, 121 bp, Artificial Sequence
  Synthesized
  misc_feature (61): n=t or c
ttttctcacctctccaccttcagtcttgacagtgaccttccctccttctttactttggatngtccctttcacaaaggattctttggggtgcaccacaaagaccgatgacttggcatcaaaa

SEQ ID NO: 22806 - DNA, 121 bp, Artificial Sequence
  Synthesized
  misc_feature (61): n=t or c
cttcttttgccttggcacttacagatgtgctggctgctaaaacttgtgcaactttcagtcnttggagtgtgaggcttgtttaaaacgtctacttgacagtttcaggtgtttttagttatct

SEQ ID NO: 22807 - DNA, 121 bp, Artificial Sequence
  Synthesized
  misc_feature (61): n=c or g
aaaaaaacgcagatgaaaatttagaagaactacctggaacctgacactgtaggttcaaaanctggaacctgatctctgaagatatgtatttcttcagttaattaatatccaccgtcatcca

SEQ ID NO: 22808 - DNA, 121 bp, Artificial Sequence
  Synthesized
  misc_feature (61): n=a or g
gctctaaaacactgaagagcatactgagggaagagtcccagtggtctcagtgggtaagtcncactccatctctactagctactcttaatggaggttgaaatagggaaaaaaattggcaaaa

SEQ ID NO: 22809 - DNA, 121 bp, Artificial Sequence
  Synthesized
  misc_feature (61): n=t or g
tggatttctcttggtgaatttgtggttactgggattgtccaaggaaacccaaatccttcanttcagaaaacaaggtagcttgatcccattttaaaggctttagaaagtaaatacttccatt

SEQ ID NO: 22810 - DNA, 121 bp, Artificial Sequence
  Synthesized
  misc_feature (61): n=a or g
gctcttacaatattactgcatccacattaggatgttagagtatggatggccaaaagacaangtggattaaaaaactttggtcaaggtcagcaggttgtggttaatgggtctcccctgtctg

SEQ ID NO: 22811 - DNA, 121 bp, Artificial Sequence
  Synthesized
  misc_feature (61): n=t or c
tctcacgtgagaaagaggagcaaaagcgtcgtaacaaacgttctcacagccgggctgctcngtgttgcagacaaacttgctttgctcatcgtaataaatggattcgcctcccacagcagtc

SEQ ID NO: 22812 - DNA, 121 bp, Artificial Sequence
  Synthesized
  misc_feature (61): n=c or g
gtaaagcaatgaggcggtaatcttccgggatgggtgagtcagctgtgagctgagctctggngcttttgcagtgtgaaacagtttctcggtgtcgaattaatgaggtttcagctcttccaga

SEQ ID NO: 22813 - DNA, 121 bp, Artificial Sequence
  Synthesized
  misc_feature (61): n=a or c
ggtgacagcatgggcgcgagtagaggatatgtgggataggagctatgattgaatacagagnacagtattgggatggaaaaatccaagagggacatttaagcacgggggctgaatgcttcag

SEQ ID NO: 22814 - DNA, 121 bp, Artificial Sequence
  Synthesized
  misc_feature (61): n=t or c
gcggtggccataggaaacatcacccagaccttcctgctgcactcactcgggtgcagtgtgnttaaccgcttctgtctgctaaactctacatcagctcacaaaaagaacgtgctttggaatg

SEQ ID NO: 22815 - DNA, 121 bp, Artificial Sequence
  Synthesized
  misc_feature (61): n=t or c
ctgaatttcatatccagtggggttacactggaaatagacttgttcaaactcgagacaaccnttctactctgttctatctgtggagactgtatccactctttgggaatgtttatcctaagtc

SEQ ID NO: 22816 - DNA, 121 bp, Artificial Sequence
  Synthesized
  misc_feature (61): n=t or c
gtagtgaaatcagttcccaccccccaaagcataatgtcattcccacagaacttatccacangtttccactggctctgctggagtaagaaacaggtttttggaaagtgtatgcacttgctga

SEQ ID NO: 22817 - DNA, 121 bp, Artificial Sequence
  Synthesized
  misc_feature (61): n=a or c
tactgttttgacatatcattctttcataacagcttttttgttctgtcatgtgtactctcanttggactccttgcatatattcactgtacacataaattataggttttattacctctatgca

SEQ ID NO: 22818 - DNA, 121 bp, Artificial Sequence
  Synthesized
  misc_feature (61): n=a or g
ttctctcgcatactggagaagtgcagacatatctctgtggatcagtggaggacaatgcagngatttccaagctgttttggcaccgagctggttattttacctagtcctatctggatgaatc

SEQ ID NO: 22819 - DNA, 121 bp, Artificial Sequence
  Synthesized
  misc_feature (61): n=t or c
atgtgaatggataatttaaaccctacaggtgatggaatacccccctgtaccatggatgacntcagcattcgtgccgtgagtcagcatccacctgctgaggccgagcagatgcgggcacgag

SEQ ID NO: 22820 - DNA, 121 bp, Artificial Sequence
  Synthesized
  misc_feature (61): n=t or c
aaagcttgcagtatctgcattttggaggaagctgcaatcttgagcctaagcagaaagcttntcagtagtcattcggttgtataaaagctggcacagactctttagatagtagaaatcaagt

SEQ ID NO: 22821 - DNA, 121 bp, Artificial Sequence
  Synthesized
  misc_feature (61): n=a or g
atctgtaacattccgaatctgtaatagtatttactgctgcctacatgaaatctcaggtatntaacacccaaagagaagtccagaactacacatttactttttctgtggtgaacatacctac

SEQ ID NO: 22822 - DNA, 121 bp, Artificial Sequence
  Synthesized
  misc_feature (61): n=t or c
tagtatagcagtacttaacatcctaaaggatatgaaaccagattcacttggcacattttgntacatttgtgtcacctgagtgtccagttagtatagcatttctctagcttgattttcagaa

SEQ ID NO: 22823 - DNA, 121 bp, Artificial Sequence
  Synthesized
  misc_feature (61): n=a or g
aaagacagcagaacgctgtaaaattaacttcttgtggactaatgcttccccagtgatgccntgtttgtttattttctgttgagttggtaatactgtagcatcctcaacatgtatttagtag

SEQ ID NO: 22824 - DNA, 121 bp, Artificial Sequence
  Synthesized
  misc_feature (61): n=a or g
gagccacagtacaactatggtgacagtttcagatgactgtcactgtggaaacctgacttcncctgtatgaatgtttcagctaagaatattcagtcttcctcctcccactaccacatactgc

SEQ ID NO: 22825 - DNA, 121 bp, Artificial Sequence
  Synthesized
  misc_feature (61): n=a or t
tttccattatcattttgttcaaaagtatattttgaaagcctcctcaaatgccatgtaagcnctttaccaaataagacaatctaaatcctgtcttcatgggatagaaagcactttcttcttc

SEQ ID NO: 22826 - DNA, 121 bp, Artificial Sequence
  Synthesized
  misc_feature (61): n=a or g
tttagtgattatattttcctgtgctcatacactagaaaggatagaatgcatacctcaaacnaactgccaaagattgattctggctttctgatgcaaagttaacactattctgaacataaag

SEQ ID NO: 22827 - DNA, 121 bp, Artificial Sequence
  Synthesized
  misc_feature (61): n=t or c
atctgcatggcagtgcccctctgtcctcttcggtctctctttgacgaaagccacagtgcangaagggaggtgttctcctatgagggatggttgaacttctcagcactgagccggtgggttc

SEQ ID NO: 22828 - DNA, 121 bp, Artificial Sequence
  Synthesized
  misc_feature (61): n=t or c
aatattattgattttattttcatagaaggtgcatttccaaacctgagtttctgttgctatncaacacacggtaaaagttcaagatacagtataagaccttttatgacacattcatcagcta

SEQ ID NO: 22829 - DNA, 121 bp, Artificial Sequence
  Synthesized
  misc_feature (61): n=a or g
tttaatcacttcagtatggctgttacactcacataaaattctattatttacttactaacanatgtgttccacttgtctgacaaacctcctctgacaaagcactgccacagcagatcagtca

SEQ ID NO: 22830 - DNA, 121 bp, Artificial Sequence
  Synthesized
  misc_feature (61): n=a or g
aattataccagccagacaacctgacaatggaatctagatgaaactgttacaatggcttccnagaaatttcctggcatggttcaaaatgctgaatatgtccaataaattatttacatgtttt

SEQ ID NO: 22831 - DNA, 121 bp, Artificial Sequence
  Synthesized
  misc_feature (61): n=a or g
tttagaataacaacagaggtgaaaattcctagtttgaggacaaactgtctgtgaccaagcnctcccagaaattatcctttgggagacccacagagctgcagctttacttctggtcatgtct

SEQ ID NO: 22832 - DNA, 121 bp, Artificial Sequence
  Synthesized
  misc_feature (61): n=a or t
aggatcaacaagcttctcagaagggaagtcagtctattaaagcattttggtgcttgttttnaccacttcacttaataacactcaaatagaagcaccactcctttcaacttgaaattcctca

SEQ ID NO: 22833 - DNA, 121 bp, Artificial Sequence
  Synthesized
  misc_feature (61): n=a or g
tttgttatgaaacttcctaaatctctaacataggaggatgatatgaagggctgatgtccanaatcaccaaacagccttcagacattctctacaaaactttaaaaatcattttcttatcata

SEQ ID NO: 22834 - DNA, 121 bp, Artificial Sequence
  Synthesized
  misc_feature (61): n=a or g
attacacagaattaaactggctaatctacaagataaagagcaatacttttacagcacatanaagatgttatgttccatcaagacatattttaatctcttgccgaaacaggtcagccattgg

SEQ ID NO: 22835 - DNA, 121 bp, Artificial Sequence
  Synthesized
  misc_feature (61): n=t or c
ctcccacaggagagcagtttaccttttttcccagtgatcatgattaatgttttctgactgngatcttagcaggaaactcattctaacagttactgtggcacagtgtaaaacaatattacag

SEQ ID NO: 22836 - DNA, 121 bp, Artificial Sequence
  Synthesized
  misc_feature (61): n=a or g
aaaacagctttttcattcattcttgcttatgcagagatactcctcaagtccaccaaaagcntaggtagctaaagttagtggctttttctgatggggaacagaaatatcccctcagggagaa

SEQ ID NO: 22837 - DNA, 121 bp, Artificial Sequence
  Synthesized
  misc_feature (61): n=t or c
ttgtgttgttatttttttgttttactttgggcatgtgttaggctatagcgtgcactgttangtagcatttttaggttgtattgttttaagtgttttttgcctccttgagaaagttgactga

SEQ ID NO: 22838 - DNA, 121 bp, Artificial Sequence
  Synthesized
  misc_feature (61): n=a or g
gcagaaaaacaacccagaaaattggatcatatcctgctgggcgaacgattcgcatagttcnttgtaggatttgttgagctataggaattgtctcaagggaaaagagaggcccacagggctg

SEQ ID NO: 22839 - DNA, 121 bp, Artificial Sequence
  Synthesized
  misc_feature (61): n=t or c
tcccttccttcctcacattcaaatcttttctcatgctcatgctagccattatcatcttgtntcataagagttcggcatactgtgctacagttacattctgtacatcttccagtacattctc

SEQ ID NO: 22840 - DNA, 121 bp, Artificial Sequence
  Synthesized
  misc_feature (61): n=a or c
aattaacaccatcccagcaaaaatcaagacttgagtatacaaggaaaaaagcataactganagaactgatgtgaagactatttcctaactcctctagttttgctatatcacattaggtcac

SEQ ID NO: 22841 - DNA, 121 bp, Artificial Sequence
  Synthesized
  misc_feature (61): n=a or g
ggttttgctgggatcaggtgggtcctgccaaggtgccccaatgcttcggagtgctcacacngtacaggggtgttagctatggccacagtagcaaacaagttggggatgatttagctggttt

SEQ ID NO: 22842 - DNA, 121 bp, Artificial Sequence
  Synthesized
  misc_feature (61): n=t or c
gcaggagaggtaccagtgcatgacaaggtggtgagggttccaagtggtgctttcttcttcnttaaccagagaaaagtcaggatgaatcataactgatctgaatgggcctccccatcccttt

SEQ ID NO: 22843 - DNA, 121 bp, Artificial Sequence
  Synthesized
  misc_feature (61): n=a or g
gtgagaacagatcagttcacacttcagcacacgacagctgaaacctctttatcaaccacangctcaccttctcactcttctctcaggagtgctagaccctgttacttttcataatgaaaaa

SEQ ID NO: 22844 - DNA, 121 bp, Artificial Sequence
  Synthesized
  misc_feature (61): n=t or c
atgctaatcatgagcttctcctcgaattggaaagtaaagcaaagcctgtgtccttgctctntgagttgcattttcactaagcactgctgcagcctagtttcagtggtcaggtgcagctgac

SEQ ID NO: 22845 - DNA, 121 bp, Artificial Sequence
  Synthesized
  misc_feature (61): n=t or g
actagaattggtcagctctgtttcattgcactttcaccaggaagcaagtcagaaaacatgntttgtggcttcttctcttggaattccctaatatcgagcaatagcttttaagaaaaaaact

SEQ ID NO: 22846 - DNA, 121 bp, Artificial Sequence
  Synthesized
  misc_feature (61): n=t or c
ggcattgctagtttgggagcaagactgaattaatgctttagagtagcaatctgcgagttanaccagtctttgacactgtggttccctcaatcaatatgcaaggtaaacagtgtgtgataat

SEQ ID NO: 22847 - DNA, 121 bp, Artificial Sequence
  Synthesized
  misc_feature (61): n=c or g
aaaaattaacactgaacttaaacatgaatacacaaagaagctcaccagaaggacttcttancagagccagcagatttctgctcttctccttgatactatgaaagtctgatcttcctttaat

SEQ ID NO: 22848 - DNA, 121 bp, Artificial Sequence
  Synthesized
  misc_feature (61): n=t or c
gatgtttccttatttgacactgggtgcaccatgctgatttgccatagccttcctactgccnatgctctttttgccactggtaacgctgttcaggactgagcaagtaatgcaatggcactgc

SEQ ID NO: 22849 - DNA, 121 bp, Artificial Sequence
  Synthesized
  misc_feature (61): n=a or g
aaatgttcttctggatgggacgtaagatcaagattcttgcacatttaatcattattacagnttgtttaaggagggccgaagtccatccctattaattccttttccgcctctgatattcttc

SEQ ID NO: 22850 - DNA, 121 bp, Artificial Sequence
  Synthesized
  misc_feature (61): n=t or c
gcaaaaaggactgcacattcatcagcattatcctctttcagggagcatgtagaagaatttntgtaccttaggaacaatgttggtttagtaaagctagtttgaaattttatccttcagtacc

SEQ ID NO: 22851 - DNA, 121 bp, Artificial Sequence
  Synthesized
  misc_feature (61): n=t or c
gcacctaaatgtagacttgggtgcatgtctgtgccttacatccagctgatacatgttcttntaatgtatgttggattgctttacatgcttgacaggctgtgtttctttctgttggccgtct

SEQ ID NO: 22852 - DNA, 121 bp, Artificial Sequence
  Synthesized
  misc_feature (61): n=a or g
ctcaagaaactgattcctcctcgtcttccacctcctctccataatcttgaagacttagctntaattcagtttgcttgatagcagccttgttgtccctctgcccaagaatcaggattttgtc

SEQ ID NO: 22853 - DNA, 121 bp, Artificial Sequence
  Synthesized
  misc_feature (61): n=t or g
tccccactggtatgaggatgtggtgaatacttggatgtcgagagagaaagttagatcaagncaaagacccttgcgggctcaggagactagcagtgcaactgtgggactagcatagatgtca

SEQ ID NO: 22854 - DNA, 121 bp, Artificial Sequence
  Synthesized
  misc_feature (61): n=a or g
tacatatgccttctgtgtgttgtgatacttataaggatgcttttctacaactatgccagcngttattttttggcagttcagtattgtggtgataataaagaggtcggttaaatacttttct

SEQ ID NO: 22855 - DNA, 121 bp, Artificial Sequence
  Synthesized
  misc_feature (61): n=a or g
aaagctgtagtcatgaaaatctgcctcgtgtgctgctcccaaaaatcagtctttggcaccntgtaagcacagacacaaacaggacatggaatcctgttatatttgcagctgcttcctccct

SEQ ID NO: 22856 - DNA, 121 bp, Artificial Sequence
  Synthesized
  misc_feature (61): n=a or g
aatcaaaggacagcactgatttacaaaggaaatgaatcaccgctatatggtaaagagaccntgtagccagctgttgggattttccaggaggcattttgatttcctatcttgctgtgaatca

SEQ ID NO: 22857 - DNA, 121 bp, Artificial Sequence
  Synthesized
  misc_feature (61): n=t or c
cgttaggcagtagaagtggttctgagtcatgggttttgccagaactattagtaaaggatantcttcaaagacatttttaaggacagtagttaagactgtgttttattttttgaagtaaagt

SEQ ID NO: 22858 - DNA, 121 bp, Artificial Sequence
  Synthesized
  misc_feature (61): n=a or c
caaaatatatccaggcttcagtagtgaagaagccaggggaaattgatttttgcgtgcacantttctgccagcttctccatggtcattctttacagtgaagtaggaccaacaaagtcacaac

SEQ ID NO: 22859 - DNA, 121 bp, Artificial Sequence
  Synthesized
  misc_feature (61): n=t or c
ctctacagcctgtccaggttcctctggatggctgcatagtcccctggtgaatcagccactngccccccgtttcatgtcatctggggatttattgatagtgaactctatccatagtccagtg

SEQ ID NO: 22860 - DNA, 121 bp, Artificial Sequence
  Synthesized
  misc_feature (61): n=t or g
aattgtccttgaggtagcattaccagtacttgcaagacatccaaaagaaatgctaggatanacaccagtaccacagatagataaacctagtgcatgtatctaatctgacaaaggaatgtct

SEQ ID NO: 22861 - DNA, 121 bp, Artificial Sequence
  Synthesized
  misc_feature (61): n=a or g
agactacagctagatgtagtgtgctggtctaatggaaaatgaattacagactgacataggncatatgtgtatatatttcccctttttctcctaaaaaaaaaaaaaaaaaaaaaaaaaaaag

SEQ ID NO: 22862 - DNA, 121 bp, Artificial Sequence
  Synthesized
  misc_feature (61): n=t or c
aaaatcctcaatggttgcttcactgatctcttctttgcagtatgtttctcaagttgaggancctgaggtaaactaagaggcaacatgggagaatacttctctctcctttatagttatgtag

SEQ ID NO: 22863 - DNA, 121 bp, Artificial Sequence
  Synthesized
  misc_feature (61): n=a or g
aagaggtagtctctgtgccaaataacatattaaggaaagagatgcgcagcagagcagtacntctggcaggaaaagcaagaacagtggtctggatagaagtctacttaaataatgacatttg

SEQ ID NO: 22864 - DNA, 121 bp, Artificial Sequence
  Synthesized
  misc_feature (61): n=a or g
gtcacttgtctaggtctcaagagcccagtccttatcacaacagggaaagctgtccccctcnaagcaggacaatacctgcaaacacttggcctgcaggaggaagagcactggatatttcaga

SEQ ID NO: 22865 - DNA, 121 bp, Artificial Sequence
  Synthesized
  misc_feature (61): n=a or t
gtatgaccaatgttatgcaagcctggcgttaacccaagtggaccaacacaaactgggagangaaatccttgaaagtagccctgtagagaaggccttggggtcctggttcatgaaaagctta

SEQ ID NO: 22866 - DNA, 121 bp, Artificial Sequence
  Synthesized
  misc_feature (61): n=t or c
ctcatttagaagatgaaattgaaaactaaatgtattactatcagttgttcctgtcaagcangcaattctctcaaagaaattaactattttcagttccgcagagatgttacaatatagaatt

SEQ ID NO: 22867 - DNA, 121 bp, Artificial Sequence
  Synthesized
  misc_feature (61): n=t or c
ccctgtatcttgtgcatgctctggcgtgaatagatcttgagggtgttaaaagtcagcagantgtggccataagcattcatgaaaagccaaatgcttttgcttagtgccattgcagggctgt

SEQ ID NO: 22868 - DNA, 121 bp, Artificial Sequence
  Synthesized
  misc_feature (61): n=a or g
gagatgtctttgtggtattgacccatatgaatgaggctgtgatataggaagacgaagttanaggcattccaaatactgccagatattcatcttttagtttcttcttaccttcttttggttt

SEQ ID NO: 22869 - DNA, 121 bp, Artificial Sequence
  Synthesized
  misc_feature (61): n=t or g
taatgaaatacaaggctttatgtttaaagtaacttaacaaatgatagcacgcatgtaacanagattttcccagtttgccacaatgccacgtagatgaattgatagaagtatcaaagtctgt

SEQ ID NO: 22870 - DNA, 121 bp, Artificial Sequence
  Synthesized
  misc_feature (61): n=a or g
tgcagaacttgcttttctcttgccctcctcctttgcaacagtagacaatgttgctagtgcngaagatgataatattgacctatatgaagggattttatctacagtacttgaaaatcctctt

SEQ ID NO: 22871 - DNA, 121 bp, Artificial Sequence
  Synthesized
  misc_feature (61): n=t or c
tgccattctgcccaagatgaatttcatgctggaggtggattaccttcccaaacaccacgtngctgctttgttcattgccctcctgccccccagcttgctgtaaagccaagaatttcggcat

SEQ ID NO: 22872 - DNA, 121 bp, Artificial Sequence
  Synthesized
  misc_feature (61): n=t or c
tgaggtaatttcatgtgcagttttcctcctcctgttggctttcacattttaacaaaacttnaggtgttgttgctattaagtgccctgcacagacagagtaacttggttataactgtgtggt

SEQ ID NO: 22873 - DNA, 121 bp, Artificial Sequence
  Synthesized
  misc_feature (61): n=a or g
ccctacactgtaggatgctcaatcggagatcttggtgggacagatgcattttctgccttgngatgaaactgttggcagtttcccatagtatgaaaatagttgtggtaagagtgcaaagatt

SEQ ID NO: 22874 - DNA, 121 bp, Artificial Sequence
  Synthesized
  misc_feature (61): n=a or g
tttgttttaaagcactgtgtaagttgtacacattaacagtatttttgtatgtagtgagttngcaatctttctccatgtatttgattttgtatgtaagtcactttgtaagtgtgaaagcaaa

SEQ ID NO: 22875 - DNA, 121 bp, Artificial Sequence
  Synthesized
  misc_feature (61): n=t or c
ttttagatcaaaatctctgctttttacaatgttatatcagaaacaatgtacaacaaaaggnactccattagcacaaacttatgtagctgcatctcactgcaagtagattgcttttgggaag

SEQ ID NO: 22876 - DNA, 121 bp, Artificial Sequence
  Synthesized
  misc_feature (61): n=a or g
ttatgctgaacgtggctctccaagtgggaaatagtagccagtgttttataaagcgccatgnattatattcctaaaaagcctttgcagccttcagacaaagctcccactctgatctctatca

SEQ ID NO: 22877 - DNA, 121 bp, Artificial Sequence
  Synthesized
  misc_feature (61): n=t or c
ttgtcaattaaaatgttcgcttgctgccctggctgcagtgctgtggtatcaaagcagagangagttgggtacgttagcttgcctcgtgtcttttattggaggtaaggttcatgcattgacc

SEQ ID NO: 22878 - DNA, 121 bp, Artificial Sequence
  Synthesized
  misc_feature (61): n=c or g
agatagacatggtttgtatgaaaatgaaggactggaattttcagtgggacatatgcactcnattaatgagtgttaataagcaaggaagagtggaaatccagagatcaagaaaagttcaaag

SEQ ID NO: 22879 - DNA, 121 bp, Artificial Sequence
  Synthesized
  misc_feature (61): n=a or c
gcccctggtgcgagggctggtctcccctttctccccctagtacagaaacattgcacacatngtttgaacccaaaccttggcatttactatttgaatttgcagaacttttgattgaaattgt

SEQ ID NO: 22880 - DNA, 121 bp, Artificial Sequence
  Synthesized
  misc_feature (61): n=t or c
gaattaattccgtgctgaacccttgcctacacgttcaaacacacatgccatggatgagagnctgcaagccaacaaaaggcagcacccttgggcttacacagcccctcacactgctgggtcc

SEQ ID NO: 22881 - DNA, 121 bp, Artificial Sequence
  Synthesized
  misc_feature (61): n=a or g
aaaagcagcacaaatatttttcctttatacaaaagtataattacatagttagaataatcantgctgaaagacagttattccttcattttaatttcatggggtctacacagccgtataagga

SEQ ID NO: 22882 - DNA, 121 bp, Artificial Sequence
  Synthesized
  misc_feature (61): n=a or t
cttatcctcttttttttttttttttttttgctgacagttgcaggcttttttgtcagctacnaaggtgaaagaccttctgtaaatgacaagcaaagagaatggttgatacattgttggtgag

SEQ ID NO: 22883 - DNA, 121 bp, Artificial Sequence
  Synthesized
  misc_feature (61): n=a or g
cacggcgcttaggctgcgccttccttcactgtgaggcttgatgatgactcccactgacacngggcagctggtgactgtcatgagaaggaggaaaagaagctttttgcttgtggcacagtgg

SEQ ID NO: 22884 - DNA, 121 bp, Artificial Sequence
  Synthesized
  misc_feature (61): n=t or c
aatacaaatatcatttctgtctgggagatgataagaaatgcattgacttaggattgtcaanatgttttttgtgctcaaactgctgtatgcttcagtctgtggttttcacaggacacccatc

SEQ ID NO: 22885 - DNA, 121 bp, Artificial Sequence
  Synthesized
  misc_feature (61): n=a or g
tgattaagatttgaagcaaacacagatcctacttattacgtctaggagaagatcctatatnttccttttgtgaaggcttggcactggagtacagtggagagagcagcatgtatgttgtgga

SEQ ID NO: 22886 - DNA, 121 bp, Artificial Sequence
  Synthesized
  misc_feature (61): n=a or c
atgatttttttattttatttttttgaaattgctattcattgattgtctgtgtctccccacnctcccctttactttaaaaatgttgctcccttttcacagcatctcaagttgaggagccagc

SEQ ID NO: 22887 - DNA, 121 bp, Artificial Sequence
  Synthesized
  misc_feature (61): n=t or c
cagatattacacttcaagaaacattcttgaaagcaattttctcaactaaccagcagtacanacattcaacaccacccatataacaactcacactaatgaaacactgcaaagttaactctgc

SEQ ID NO: 22888 - DNA, 121 bp, Artificial Sequence
  Synthesized
  misc_feature (61): n=a or g
tctgagtcaaattctgtatttcatatctgcaacctttatacacataacttgaatattcagntgtcatggaaagaatactgaagtatttccctgttaattgtctttcttccctggggaaagt

SEQ ID NO: 22889 - DNA, 121 bp, Artificial Sequence
  Synthesized
  misc_feature (61): n=t or c
gctgcagagactgtatcagagcttcttgatgtctttatcggtgatttgagagagaacaaanggccagttaaatgccatgcaacaaagatttgttgatggtcaattatgatgtatccatcat

SEQ ID NO: 22890 - DNA, 121 bp, Artificial Sequence
  Synthesized
  misc_feature (61): n=t or c
tatcctgagccaacgcctggtgagtgcgaaatgctagcccggctttattgctctcgctatngtacgggtgactgctcggctttccacagccagggactggactttccagcggctctcacat

SEQ ID NO: 22891 - DNA, 121 bp, Artificial Sequence
  Synthesized
  misc_feature (61): n=a or g
cagggccaagcagcggttctgctcgggacacgtttcacagcgtgtgcagccttgcatgccnttcacctgagacactactctggccctttatcaacaccagccttttaaaaataaataatgc

SEQ ID NO: 22892 - DNA, 121 bp, Artificial Sequence
  Synthesized
  misc_feature (61): n=a or g
caggcacagaatatttaggtacctttgaaaaacatcagaacacgtcaaatttaacgaccantgtgtccaaatctacaagacaaacaagtagatgaaagaaatgaattgccatacttcccaa

SEQ ID NO: 22893 - DNA, 121 bp, Artificial Sequence
  Synthesized
  misc_feature (61): n=t or c
acttctactgataatcccccaacgaagttttcacattatctgatccaagctgcgccagccngtgtgatgtccagcactcagagctgcctggaagtgcactcactctgttgcagatggcaac

SEQ ID NO: 22894 - DNA, 121 bp, Artificial Sequence
  Synthesized
  misc_feature (61): n=a or g
cagaaagagagaacagtataactaatattacgaccctttagatggtgcgaatcctaagctntgcagcatttagtgctcctgggatccatgttcagcatgctgagcagaccctgtccgtagc

SEQ ID NO: 22895 - DNA, 121 bp, Artificial Sequence
  Synthesized
  misc_feature (61): n=t or c
atggacagatgtgaaaataaatgaatagctgctgaacatcttttattacaaaaccctttgntgactttcagaataagctgtgaaaagtttttaaaatgcccgtgtagattattgagccaaa

SEQ ID NO: 22896 - DNA, 121 bp, Artificial Sequence
  Synthesized
  misc_feature (61): n=t or c
agtactctcatggcagttcccattcactttccttctggcattcccaggtgctgcagccacntgcagagctcatgctccaaccagatttccaccagggagaggttttgtggtgttggttttg

SEQ ID NO: 22897 - DNA, 121 bp, Artificial Sequence
  Synthesized
  misc_feature (61): n=a or c
aaatttaaggcataatttgttttgtgcatctgtgttgaatcctcagttaagatagttttcnaaaaaatgattgcgtgggtagagcttcatgggagaacttgctggttgcttattatgttat

SEQ ID NO: 22898 - DNA, 121 bp, Artificial Sequence
  Synthesized
  misc_feature (61): n=t or g
gtctgagtaacaaaacaagggcagcaccatcaaactcacacgtatgcccgagataccatcnttgagcttgcccacagacatggtgtcttctaagactattttgcagcgactgcacacagtg

SEQ ID NO: 22899 - DNA, 121 bp, Artificial Sequence
  Synthesized
  misc_feature (61): n=a or g
cctctgaactgcaaagcaattgcacgtgtcaagttcccataacatgatggtgccagctgangcttatgttaaagcagtgcaataaaatgagatgtctgaagcttctgtcagaagaatgatg

SEQ ID NO: 22900 - DNA, 121 bp, Artificial Sequence
  Synthesized
  misc_feature (61): n=a or t
ttgtacaagattggaaacgttcaagtcatctttaagaccatcactcacaatcacctggttntcagcaacgttatccaagtgctgtgatgacgttagtgttaagaacggtttcctttttggc

SEQ ID NO: 22901 - DNA, 121 bp, Artificial Sequence
  Synthesized
  misc_feature (61): n=a or c
taacttgtaatctttttttttccattatgattttttttctcaaatgagaataactcacaanaacagcagcttaacatcactttcatctcattgctctggtttacacacagggctataaacc

SEQ ID NO: 22902 - DNA, 121 bp, Artificial Sequence
  Synthesized
  misc_feature (61): n=t or c
gctccacactttatgtaagccaattgactctgtgttctgtatcgttccttcaagaaactcnggtgtacctccatttcttcaagcacttctggttttgggaaggagaattttattttctccc

SEQ ID NO: 22903 - DNA, 121 bp, Artificial Sequence
  Synthesized
  misc_feature (61): n=a or g
tcctattgattgtttaacgacggccttgaaagcaggaacagagacaagatccttgctccanacagcagcatggtatggaaggttgtgaaaagtggcttctggagtttgtgggaataggcca

SEQ ID NO: 22904 - DNA, 121 bp, Artificial Sequence
  Synthesized
  misc_feature (61): n=a or g
tacccccccctccatgcctcaccctatcctattgtggcgacagccaagagcttcactgggntgagcaactctccccagcagtctgctctcggcaaggggagcattgggttcccgatggtgg

SEQ ID NO: 22905 - DNA, 121 bp, Artificial Sequence
  Synthesized
  misc_feature (61): n=a or g
gatagtgcagacctatgcactcagtaacactaaaggtgaaatattgataagaaatgagatncttacacataatttaaagctatttgaaactgctgaaagcagcatggttttgggaaataaa

SEQ ID NO: 22906 - DNA, 121 bp, Artificial Sequence
  Synthesized
  misc_feature (61): n=a or g
ctactaccaccatcactgccactactattgccactgccattactagtgtgtttataaaggnaagaggtaacattcaagatgtacattctgatggcatatccgtgttaatcaaagtaatatt

SEQ ID NO: 22907 - DNA, 121 bp, Artificial Sequence
  Synthesized
  misc_feature (61): n=a or g
attttctgtgtatttcaatgactgacatggacacaacagaggcgttgctatgaggggcctntaagaggccattggcattgcaagtgttgcaccaagtgctattaactctttcctcctgtta

SEQ ID NO: 22908 - DNA, 121 bp, Artificial Sequence
  Synthesized
  misc_feature (61): n=a or g
agcccagtcttggggtctgggggaggcacagcatggggtgtccactggcatagccttggangccaggatttgctcagagcgcaggttgtggagtaaaagggagcgtttaagggacccatcc

SEQ ID NO: 22909 - DNA, 121 bp, Artificial Sequence
  Synthesized
  misc_feature (61): n=t or c
cggctctgatgcgaagatgggactgctggtgttcatgcgcaacctgctgctcgccctctgnctgttcctggtgctgggctttctgtactactccgcctggaagctgcacctcctccgctgg

SEQ ID NO: 22910 - DNA, 121 bp, Artificial Sequence
  Synthesized
  misc_feature (61): n=a or g
aagtttgttaaaatcacatttttgctaacaaatgttaaaagatcctgcttggagaatctcnagacaggctattttgacatgagagaaatgtgatttgccattcctcccctccaacatcttt

SEQ ID NO: 22911 - DNA, 121 bp, Artificial Sequence
  Synthesized
  misc_feature (61): n=a or g
aggctggttagtagactcacatctaagaaacctccaggaaagaaaccatgagagaaccacnaatagttgatggaagccaaagaaatacaaaaacaagcatatagatgaaaataaatgtttg

SEQ ID NO: 22912 - DNA, 121 bp, Artificial Sequence
  Synthesized
  misc_feature (61): n=t or c
gtaaacacacaagcctagggttaagagtattctccaggcaacaggaaacatgaatttgaanccttagggtggagagtcaaatattttttacaagcacagtatttctttttgctgctgatga

SEQ ID NO: 22913 - DNA, 121 bp, Artificial Sequence
  Synthesized
  misc_feature (61): n=a or c
tggtcctaagtcatctccccaggtagaagtggtgattttctcatggagatattgattcttntgcatctagtactacctctagttacaaaacccattccaaatacctgccaaaacaatacaa

SEQ ID NO: 22914 - DNA, 121 bp, Artificial Sequence
  Synthesized
  misc_feature (61): n=a or g
gagcacagcatctgtgcagccagctagatgttcagcagcttaacgagggctcaggccctcntgtggattccaagtgtgtaacctcaggctgtgtgagtcctctagccattgcttctttggg

SEQ ID NO: 22915 - DNA, 121 bp, Artificial Sequence
  Synthesized
  misc_feature (61): n=a or t
aagagatgagacatttgtatggtgctgtcagctgaagggactgaccacaattttggagacntaccacatggtaagaaatttgttttggcaatgttttgggcaacttccgctcaccataaat

SEQ ID NO: 22916 - DNA, 121 bp, Artificial Sequence
  Synthesized
  misc_feature (61): n=t or c
tttacagaactgtgaaaggaaatgcttgaactgaaacaatgggttaaaagttagtcgatcngttgagaaatactgacatcaagaaagatttaaagatgacaaaaggagcattgtatcatat

SEQ ID NO: 22917 - DNA, 121 bp, Artificial Sequence
  Synthesized
  misc_feature (61): n=a or g
tctcccaatcggcattagctggagagaaaaactggtcatggagtttcccacagctgcaccnaagcaaaataagtcacacaaacacgtggaagtgttcagaactgtgggccttccatggcac

SEQ ID NO: 22918 - DNA, 121 bp, Artificial Sequence
  Synthesized
  misc_feature (61): n=t or c
agccaaggtcagcagtaagctggggaatgcctcttctccaggcacagaactggggcacagntggtttcgaaaggatcgttgacactgacagtgaaaagtaaaaccgtctctgaactcacaa

SEQ ID NO: 22919 - DNA, 121 bp, Artificial Sequence
  Synthesized
  misc_feature (61): n=a or c
catacaagccccaacatctttatgaaacttacctcattgtctcagacaccccacagtcctntatgcactttcacaaagaagatgagaacagatgaaagctaggaccttttaaatagttaaa

SEQ ID NO: 22920 - DNA, 121 bp, Artificial Sequence
  Synthesized
  misc_feature (61): n=a or g
agccttctgagaatgcacacttgaggttttaacactatttcatcagcttgaagtatttgcntgtttgatggttttagctttcagaatgctgatgaaccccgtgtgccttaaagacactgaa

SEQ ID NO: 22921 - DNA, 121 bp, Artificial Sequence
  Synthesized
  misc_feature (61): n=a or g
tgtttcatcaagccgtcttattcttggatgctccgattcaaaagtaatcattcatattttntaaatgtgacagatgtgtagcacttggtgtacttactgtaaaaatgagtcgaagtttgtt

SEQ ID NO: 22922 - DNA, 121 bp, Artificial Sequence
  Synthesized
  misc_feature (61): n=a or g
aatgagaaagaaaattaagataatgtgtgagtaccttttcagcacccttaatgtttaatcnttttatctcaagttaatctttcctaccaagacaaactccagtgaagcttacatgtctgcc

SEQ ID NO: 22923 - DNA, 121 bp, Artificial Sequence
  Synthesized
  misc_feature (61): n=a or g
tcagttctcatgtgtcgtgtgaacacagacctgtaaactggactctagttctaggaggatnaaccagagtcagttgtttataatgatataatattctgtcagtaatgttccttgctgctgc

SEQ ID NO: 22924 - DNA, 121 bp, Artificial Sequence
  Synthesized
  misc_feature (61): n=a or g
tgctgaactatttcctggttcagtgggagaagcacacgctgcaggataagtgaacagaagnccagagctggcaattattgaatatggagcaagcttttccactgcttcacccctgcaatct

SEQ ID NO: 22925 - DNA, 121 bp, Artificial Sequence
  Synthesized
  misc_feature (61): n=a or c
ttttatgggaatcctcacgtttccatggattgcattcaaactcaaggacttgtaaatagtnaacaacaaaaaatatagcgaacaatgacaaataaaaaaacacagtaaatagtgcttcaca

SEQ ID NO: 22926 - DNA, 121 bp, Artificial Sequence
  Synthesized
  misc_feature (61): n=a or g
agaaggcaaacagaaacccgggtattttctaacacctatggcggtagcctttttattgacnagaaagtaaagccaaggcctaccagagaaaggagcacgtttcagtcccttcccacatacc

SEQ ID NO: 22927 - DNA, 121 bp, Artificial Sequence
  Synthesized
  misc_feature (61): n=c or g
gcactcagaaggttcccaaaagtctgcaagacctgaaagtgcattaagataacatcagcantgtaaacccagaagaggaaggagtgtggcatttggggatgaagctcagattttaaaatgc

SEQ ID NO: 22928 - DNA, 121 bp, Artificial Sequence
  Synthesized
  misc_feature (61): n=t or c
taacaagcaacacttgccatgagtcatttctgacaggattcaggactgaatcaaggagccnggtgcagtaagccaaaatgcaatcaaaagggtggttagtctttgtgctcttggcaaatga

SEQ ID NO: 22929 - DNA, 121 bp, Artificial Sequence
  Synthesized
  misc_feature (61): n=a or g
gaacagtagaggttctacccccattttctttgaaggagaaaattcttcaagacctggtgcngttcctgccagagcagagtaaaatggaagatgtgctccaactgatgcaaattcaacaact

SEQ ID NO: 22930 - DNA, 121 bp, Artificial Sequence
  Synthesized
  misc_feature (61): n=t or c
aacccattcctattgtttctgcctcaaactttgtagcacagacacatccaacacgtatcanccctcttactcatcctttctctctccttcccactgccttgctatgtctgctatgggtcat

SEQ ID NO: 22931 - DNA, 121 bp, Artificial Sequence
  Synthesized
  misc_feature (61): n=t or g
gtcttcagtccctgtgtttgcaggagttaaaaagtaacagcgtgcagagagccaagttgtnagctctgcgatcgctaatgctctgagccaaaaccacggcgcaatggatgatactcgggtg

SEQ ID NO: 22932 - DNA, 121 bp, Artificial Sequence
  Synthesized
  misc_feature (61): n=t or c
agaaatttttaccttgaaaactaatgaatcaaataaactatttgtcaccaagtctctacanagatgtccaagaaattagataagttagggaaaagctggagataagaaattatagccatct

SEQ ID NO: 22933 - DNA, 121 bp, Artificial Sequence
  Synthesized
  misc_feature (61): n=a or c
tcagctcctcaccccaatgcattgctgcaagccaacgttagctgctgtgtcaccacgaagnagccagcccacactgaccagcatcaccacagatcactgttggtaacccaacagatttcct

SEQ ID NO: 22934 - DNA, 121 bp, Artificial Sequence
  Synthesized
  misc_feature (61): n=t or c
tcattcctccccattagaatactttatgccaaaatatgcattacaatatgcagggtgcttngggaatcacgtatgtaacacctattttcagaccttgattattatcttcattcttgtcttc

SEQ ID NO: 22935 - DNA, 121 bp, Artificial Sequence
  Synthesized
  misc_feature (61): n=a or g
agccaaatttatcctcagaagaataattctgaaatccttctctgtgcttagtttcaatacncttgaaccttttggtttcaactctgtccagagctgaaaagaattggaagttggtgtgtgt

SEQ ID NO: 22936 - DNA, 121 bp, Artificial Sequence
  Synthesized
  misc_feature (61): n=t or c
actgaaaatggagagagcctccaggataaagctgtgctcacaccaagtgtggcaaagcccncagctcctcctcctggtctgcacatccctgggtgctgggtagcaggttggggccgccagg

SEQ ID NO: 22937 - DNA, 121 bp, Artificial Sequence
  Synthesized
  misc_feature (61): n=a or c
gctaacaactcaaccctgagtgactgagtgagaggatgacagtaggagatgggtggatatntataatgacttgtttgaagcagacattagagtcagcctacagtacggtggttataatcaa

SEQ ID NO: 22938 - DNA, 121 bp, Artificial Sequence
  Synthesized
  misc_feature (61): n=t or c
agaggtgaaaaacaaattctgattccccagttaggcaaccgactctacgtgtgaacacagngtaaaagcagacagaataactgcactgagcagctgcattttgcattaacatttaggccac

SEQ ID NO: 22939 - DNA, 121 bp, Artificial Sequence
  Synthesized
  misc_feature (61): n=t or c
caaacaaagaatgggaaatattgtgggagtctgctacatacagtcacaagccacgccaaanaactcaactgccatcttgctattatttgctgaccacatcaggactacactgcacttagct

SEQ ID NO: 22940 - DNA, 121 bp, Artificial Sequence
  Synthesized
  misc_feature (61): n=a or t
aatcatggaatcatagaatatcctgagttggaagagacccataaggatctttgagtcccantcctaaaactgatttttattagctgttcagtgggccaacagcctagatacttataaaaca

SEQ ID NO: 22941 - DNA, 121 bp, Artificial Sequence
  Synthesized
  misc_feature (61): n=a or c
tattcacaatatacaataaacctgtttttttttccaaggaaaacaacgctcgagttctttnctccactaccttaagggtttgtatttgcaccttctgtgcttgtgttagtttgccatgtta

SEQ ID NO: 22942 - DNA, 121 bp, Artificial Sequence
  Synthesized
  misc_feature (61): n=t or c
gagtttctacaaaagttctctcacacagagccaaaacacagtagagaagcttactacagtntgtgggcaaagaaaaattaaactgaaacacactacttctaggtaagaaatcacttggatc

SEQ ID NO: 22943 - DNA, 121 bp, Artificial Sequence
  Synthesized
  misc_feature (61): n=a or c
tgctcacaaacctgccacaacaacttcctaaccaataatctcacacagcattaaccaaganattgcttaaaagcatcaatgcacacttagaatattaggatcatagaatctcaaaagttgg

SEQ ID NO: 22944 - DNA, 121 bp, Artificial Sequence
  Synthesized
  misc_feature (61): n=a or c
cacgtcaatgttttgagtcttaaaaaaaaatggcagagccaaatgggaagtgacagcacancagtacagcgtggaaggaaggaatatggaggaaggaatatggaggaagactgcttattgg

SEQ ID NO: 22945 - DNA, 121 bp, Artificial Sequence
  Synthesized
  misc_feature (61): n=t or c
ctcttggatgtttggtgcaggctgatcccccagccctctcctgcaccgatccaacatctcngccaaactctggtgacactgagcaatggaaaggagcttcactccctttgaaaaacagtgc

SEQ ID NO: 22946 - DNA, 121 bp, Artificial Sequence
  Synthesized
  misc_feature (61): n=t or c
gtaatgggcagtattcctgactgtaatggcagtatggttaacgcatacctacagaatgttngagtacatgctttacaatagctgaattccccaattttcttttgacctgggtgactaaaat

SEQ ID NO: 22947 - DNA, 121 bp, Artificial Sequence
  Synthesized
  misc_feature (61): n=a or g
atagtgttaaccgggaggctggcagatggcattctaaagatgacacaaaagtgttgtcttngacccagctctatgacccagtcttcaggcagtcaatgaaatccctaaagagctgttgcaa

SEQ ID NO: 22948 - DNA, 121 bp, Artificial Sequence
  Synthesized
  misc_feature (61): n=a or g
ctagcaacatcagatagccaaacacaagacaaaacttttaaaaaatatcacagtttgtcantatcactcctctactggggggactcaaaactggaagcagtattatatgtacgctgtaatc

SEQ ID NO: 22949 - DNA, 121 bp, Artificial Sequence
  Synthesized
  misc_feature (61): n=a or c
tagtcctactgacttctgaaggataacaaccaactttaaaaatcacatcagttggtcactnattaagcactatcgttctcatttcaaaccgtgttgtttcaaactaagaacgcaggatttc

SEQ ID NO: 22950 - DNA, 121 bp, Artificial Sequence
  Synthesized
  misc_feature (61): n=a or g
caagctcctgtggtgtttaattcatgtgaaacatcaccccttctttgtccggtgtacttcngaaagcttgaggggtagtgcttccatttcatctgtggcttcacctcatccatcagtttct

SEQ ID NO: 22951 - DNA, 121 bp, Artificial Sequence
  Synthesized
  misc_feature (61): n=a or g
tttgcattcaacataactgcagcacccccaaagtactggaaacctcaatactgagtgccantgcaatgctttgctcactgcttttaagtgaactggtctttgaaaagttttaggttttcta

SEQ ID NO: 22952 - DNA, 121 bp, Artificial Sequence
  Synthesized
  misc_feature (61): n=a or g
aaaaatctttggtgaaaataaaatcactccaagtcaaagaacataggagaaataatagttnttctaacatacaaattatacgatttgagtagtacagttgagacagctttataaaggcttt

SEQ ID NO: 22953 - DNA, 121 bp, Artificial Sequence
  Synthesized
  misc_feature (61): n=a or g
tctagcttgtctgggtttacagctgtttaaaacctccctgtctgagtcactctgcctcacntcacttctaaagaaattggttctgctgaaatgtagacttgcccttaaatgtatagctctg

SEQ ID NO: 22954 - DNA, 121 bp, Artificial Sequence
  Synthesized
  misc_feature (61): n=a or g
aacagaggtcatatctaaggctacccaactgctcagtgaaggcatgcatacaacatagcantatttcagttgtttttgcccaaaggggggaggagaaagaaaggttttgtggcttgtggga

SEQ ID NO: 22955 - DNA, 121 bp, Artificial Sequence
  Synthesized
  misc_feature (61): n=t or c
atagtgttcaccaactattttgggaacggctctgtgctcttaaccttatggacttaagaanaactaatgttcattttgtgcatacagaatttcttaatgcttcgcttttttttatatactt

SEQ ID NO: 22956 - DNA, 121 bp, Artificial Sequence
  Synthesized
  misc_feature (61): n=a or g
cagagaagtacaataattaatagaatatgaggatattccccaaagtgcatgagcagcattncaaagaggtatgaatgcctctccttttaaatttgtctgctacggcctcttgaactttgat

SEQ ID NO: 22957 - DNA, 121 bp, Artificial Sequence
  Synthesized
  misc_feature (61): n=t or c
tacacactgcatttccaggcactgaaatgcccctgggtgccacgcagccgtggatgtcagnatgctgtgcccacaaaacctcctgcgcctacagcacgacagcaccaaagcacagacctct

SEQ ID NO: 22958 - DNA, 121 bp, Artificial Sequence
  Synthesized
  misc_feature (61): n=a or g
tattgatggactttggcatttcacaaggccttacaccatgtgtcagatggcacgaaatacntatgtccatacactccttaacctcctattatgcagaggctgggtgttttctaacatagct

SEQ ID NO: 22959 - DNA, 121 bp, Artificial Sequence
  Synthesized
  misc_feature (61): n=t or c
ttgtttcaataacaaacagctgcttgattgtgtgcaaactgacctgtggacattcacactnacgtaagctgttccatatccacgagggtggatagtgataggacaagggggaatggtttta

SEQ ID NO: 22960 - DNA, 121 bp, Artificial Sequence
  Synthesized
  misc_feature (61): n=t or c
tcgtaaatgaaggaaaatgcctctgcccaaaatcttttattctgaaatttctgctgaattntagaaactagcaatacccatttcaataatattgctgcgcttatgatgcctattagatagg

SEQ ID NO: 22961 - DNA, 121 bp, Artificial Sequence
  Synthesized
  misc_feature (61): n=a or g
tgcttctcgtgggtgctgggctggggctttggatccctacagctttctggggctgcggtgngtgctgaagacgactctgaaccaagagacctccgtgttggcccctcttgtttctgcatga

SEQ ID NO: 22962 - DNA, 121 bp, Artificial Sequence
  Synthesized
  misc_feature (61): n=t or c
ttcccatttcaactgctttttcttctgcttcttttcctttcctccataggaatatgattgntgaccttctaacagaaggagaaggaaatactgttgatggggcagaagtagcgctgcaaga

SEQ ID NO: 22963 - DNA, 121 bp, Artificial Sequence
  Synthesized
  misc_feature (61): n=t or c
ttatggagattattagaagcaaaaaaattttgcttacctaacctagcttttaagcacatantgccctgaggaaatgggaacatttttaggattagttaatatcttacacatgctgaattta

SEQ ID NO: 22964 - DNA, 121 bp, Artificial Sequence
  Synthesized
  misc_feature (61): n=a or c
atttaatggtaccttaattatatcttttacgccattcctggtatccttagtgtagataaanagaaagtataatgaatactaaatttagatccagcaaacagctcattgctttaaacaagat

SEQ ID NO: 22965 - DNA, 121 bp, Artificial Sequence
  Synthesized
  misc_feature (61): n=a or g
atgtggaggacaacgtgaaagaaggtgatttaatacctctgtggggtttgtcttcaggccngggagagtacatgggatggacaattgtgtctgacagcagctctgagagtatcagggattt

SEQ ID NO: 22966 - DNA, 121 bp, Artificial Sequence
  Synthesized
  misc_feature (61): n=t or c
tgtgcacatctgaactgcagacagggaagtagtggggcaagcagcagattggttgtcaccngtttctcaagatgccagtggttatcaaagtagaccctctgagtttgctcataggaacaag

SEQ ID NO: 22967 - DNA, 121 bp, Artificial Sequence
  Synthesized
  misc_feature (61): n=t or c
aaaatgaaggctaaagctcagctcctaggtgcattagtgaaccgcagtacccagtctccanacatcccgagaatctggaagcagcagatttctcagactctccacaaaggagcagaatgtt

SEQ ID NO: 22968 - DNA, 121 bp, Artificial Sequence
  Synthesized
  misc_feature (61): n=t or c
tgtgcacactgagccagccccgaccccagagcagacgacgatgccagaaagcggtgacctngtagctgtcttgtttggggtccggttccaagacatctgttaatttaacgttggctgtgaa

SEQ ID NO: 22969 - DNA, 121 bp, Artificial Sequence
  Synthesized
  misc_feature (61): n=t or c
acccaaaaaaaaaaaatcctttaaacacaggataaagagaaccagtatgccaatggtacangagcaagcacattttaaagaatatggtaccaagcaaattatgctttcgtgttgccgtgct

SEQ ID NO: 22970 - DNA, 121 bp, Artificial Sequence
  Synthesized
  misc_feature (61): n=c or g
aatgttgagatgaaagcctttttccaaggctgtgaggacatgtgcctcctgttgcccccanaatttgtagcacagagaccagaaagcagcagcaccaccccatggagttgcccatgggatg

SEQ ID NO: 22971 - DNA, 121 bp, Artificial Sequence
  Synthesized
  misc_feature (61): n=t or c
tgaaggaaaacattttggattagatttttagaaattgaaaccatccttgacaatctccttntagggaacattacttactggtatactggtatatcatttccaggtctgaagtagagtatat

SEQ ID NO: 22972 - DNA, 121 bp, Artificial Sequence
  Synthesized
  misc_feature (61): n=a or g
gtgcaacagaccttgcagttggatggtacaagtgtgtaagaagggacctctttctcacccngatggtaagctccccagctgtagtactccaggtctaacaagtctgcaaggaataatacgc

SEQ ID NO: 22973 - DNA, 121 bp, Artificial Sequence
  Synthesized
  misc_feature (61): n=a or g
ctgtcaaatgtgtcttgtgtgaggccccagctgttaagtttgcccatgaaaggagaagatnggaaaagctgagctgcatttagatcacagcactatgattccttctaaagaactctaagtt

SEQ ID NO: 22974 - DNA, 121 bp, Artificial Sequence
  Synthesized
  misc_feature (61): n=t or c
agggacaacaaacttattttctctctttgtttaacattctttatcagttactgagacttangctcaacttactcgtgcacccaaggggtgaagactttcagcacaaatttttccttctcct

SEQ ID NO: 22975 - DNA, 121 bp, Artificial Sequence
  Synthesized
  misc_feature (61): n=t or c
tcacagtatcctgtgacagtgaatttagcagctgatatatcttccattttaaacctgccanttcatttggacgcctttttttaaaaatattttagattgtgtgaaatgataataaataatt

SEQ ID NO: 22976 - DNA, 121 bp, Artificial Sequence
  Synthesized
  misc_feature (61): n=a or c
gagaaataacgcgcagcttcacaatattactgtgatatcgacctagaaaacggtgaaaatntgaaggccggcggtgtactacattgccttctccacccccccgtttacagtaacagtgacc

SEQ ID NO: 22977 - DNA, 121 bp, Artificial Sequence
  Synthesized
  misc_feature (61): n=a or t
tttgtagcatatcatatgaatgtgatgggtgtaacaaaactgagagagatgtgagagaagngaagctgccttcgtcttagacgacttttgatgtgctgttaagcaaatcactgaagttttt

SEQ ID NO: 22978 - DNA, 121 bp, Artificial Sequence
  Synthesized
  misc_feature (61): n=t or c
caaatcattggatgcaccttgtacagacactgttcctaacagttatttctttattggattngattcgattcagatttagaccttctccaatatgaaatcctataaggttaccaagcatgga

SEQ ID NO: 22979 - DNA, 121 bp, Artificial Sequence
  Synthesized
  misc_feature (61): n=t or c
ctctaagaaggatgcaatttatttccaggaaagaatagtcactttgctttgcacataggtngaactgtgagtagggattcctttcccacacaagcaaaaaggctactaagaccccgtggtg

SEQ ID NO: 22980 - DNA, 121 bp, Artificial Sequence
  Synthesized
  misc_feature (61): n=a or t
ctcgtgctgcagtcattcatggtgtgccttgcaggtaaagcattgcttaaaaactttctantttaggatgtttgcaccaaagcaaaagttgctgcacattacattccaatgagaaaatggc

SEQ ID NO: 22981 - DNA, 121 bp, Artificial Sequence
  Synthesized
  misc_feature (61): n=c or g
ttagtagagtcaagaaaggactggtcagcagcagtttccaaggcggaaaataatggctcanaggagatgcaagttctgctgcttctctaccagtagcagttaggaagaagggcaggttgtt

SEQ ID NO: 22982 - DNA, 121 bp, Artificial Sequence
  Synthesized
  misc_feature (61): n=a or c
agttcctgctgagagctgcccctcttcccacagggagaaattttactcaaaggtaacaacnacagagtaaaaccaccggctaatgggctgagtcttggtggaagagctaagcaagcacctt

SEQ ID NO: 22983 - DNA, 121 bp, Artificial Sequence
  Synthesized
  misc_feature (61): n=a or g
aaacgtgacaagtcctcgtcagacactcacttgcatttttagggaggattaaaactacctnaacaaaaattcatcatttaaattcttttccaggagcctgaagatctaaatcaaaacatca

SEQ ID NO: 22984 - DNA, 121 bp, Artificial Sequence
  Synthesized
  misc_feature (61): n=a or g
tggttattccacataatacaaccccctagtagacagtaccatcagcaaggatattggcagntaacagacaggaggtcttcagctgagtatgttattatctatttttttattattatttcac

SEQ ID NO: 22985 - DNA, 121 bp, Artificial Sequence
  Synthesized
  misc_feature (61): n=t or c
atggaaataataggatgtttgtccctcctctgtgatccgggctgtgccttgaatgtatgtnacccagagggtgagctgtgtttaagtgctgcttcagagatgtaggggaacggaaaggaca

SEQ ID NO: 22986 - DNA, 121 bp, Artificial Sequence
  Synthesized
  misc_feature (61): n=c or g
gcgtggaatacagactccaaggtgaattctttggtaacaaaaagctcttttcagtgtcttntaagttaaaatgtatggttttgcagtatgaagtaaaggttcatatgacacaggcaaagaa

SEQ ID NO: 22987 - DNA, 121 bp, Artificial Sequence
  Synthesized
  misc_feature (61): n=a or g
gaagaacatgatattattaccaaagctagagaggaaacttgtctgctccactagaagaacntgcttagagatggctactatttacatgtatttaaataactaactagaactactgattttt

SEQ ID NO: 22988 - DNA, 121 bp, Artificial Sequence
  Synthesized
  misc_feature (61): n=a or t
tttcaggctgcacaaataaacttaagaggatgagtaaacttgctgcatagaatattttgtnatcttaaccattgttgcacactgaattaaatttggtcattctgctgaagctccaatttta

SEQ ID NO: 22989 - DNA, 121 bp, Artificial Sequence
  Synthesized
  misc_feature (61): n=a or g
ccacagaaggaatcctcctttgcagcaacaactaagacatttagcttctcacaggagcatnttctttacctgcttttccccactatttactttattgtgacagtggctatggagaagcaat

SEQ ID NO: 22990 - DNA, 121 bp, Artificial Sequence
  Synthesized
  misc_feature (61): n=c or g
gtttggggtatgagcaagcagtggaaaatccctgtgttccaacccgtgctcccttccttgntttggatttatccacaatctgctgaagtgggatcttgcattcctctaggtgggctttgga

SEQ ID NO: 22991 - DNA, 121 bp, Artificial Sequence
  Synthesized
  misc_feature (61): n=a or g
gtatagtttagaagaaacaatcaactttaagtgatctagattacacattcttgatgtttgncatgtacttttgtaatatggttaaaaagagtatgtattcagatcttctgtgttcattatg

SEQ ID NO: 22992 - DNA, 121 bp, Artificial Sequence
  Synthesized
  misc_feature (61): n=c or g
acagaggctctttcctccagtgcttttgctgagctcttcatcctaaaatacttattaactnagctcatagcccagacctatgtgtatcagatatgcacacagcagcaagtgcctctacagt

SEQ ID NO: 22993 - DNA, 121 bp, Artificial Sequence
  Synthesized
  misc_feature (61): n=t or c
cacctccagcatcaagttgtgcgtggcagcatttggtttcagattggcagttggcttcaanctggcaaaaccaagctctttattggtctcctgaacagctgtttgggtgtgaaggactttc

SEQ ID NO: 22994 - DNA, 121 bp, Artificial Sequence
  Synthesized
  misc_feature (61): n=a or g
cagacaacaaaaagtcacaaaagcaaccccaaactggcttttatcctgctccctctcctgngcagtgctaaggaaacctttgcagcagcactgggagtgaagcaaaatccaagcagtacag

SEQ ID NO: 22995 - DNA, 121 bp, Artificial Sequence
  Synthesized
  misc_feature (61): n=a or t
gttccaaaatctttcttagataattttgtagcattcattctattacaacaacagaaatacngcagcttttaacgttctagatacaacttttactcttaagaatatgttgtttacattacaa

SEQ ID NO: 22996 - DNA, 121 bp, Artificial Sequence
  Synthesized
  misc_feature (61): n=t or c
ggcccctgctgtgttcccacactgaggctcacaactttgagatgcaggagtaactccatanacaaaggagggccttccaaagaatttgtacttcactacatttgttcaacagaaggcagat

SEQ ID NO: 22997 - DNA, 121 bp, Artificial Sequence
  Synthesized
  misc_feature (61): n=a or g
ttaatcaggtcccattttccccgtaccaggtatcttcccattccatcctatagccctcacnctgtttctaaccacacagtttggtttgtatctttcactaagctgctgcaggccgacttgt

SEQ ID NO: 22998 - DNA, 121 bp, Artificial Sequence
  Synthesized
  misc_feature (61): n=t or c
caccaggtccaaccacccacccatccccaccgtgccagtgaggagctgcagcaccaccttngccttctctttgcaccactccttgatggagagtgcttttctctgcagcacttctgcaccc

SEQ ID NO: 22999 - DNA, 121 bp, Artificial Sequence
  Synthesized
  misc_feature (61): n=t or c
gaaagtatcagggctgcctttggaaatagaaaagaatattggctgagcatctgacaagcangcggcagctccttaaagctgttttgggtcattgttattaatctccaccaatcttcctggt

SEQ ID NO: 23000 - DNA, 121 bp, Artificial Sequence
  Synthesized
  misc_feature (61): n=t or c
aatacacccgaagtcacttcacatcccgtctgcactgatcgcacaatgctgagcacatttntgctccaagatctatgcagctgttctgctagttgactcctatacgccaaatacctgctgc

SEQ ID NO: 23001 - DNA, 121 bp, Artificial Sequence
  Synthesized
  misc_feature (61): n=c or g
gtcccacaggaaaatagttgacttgatgagaaatacaacttcgaatcaatgtattagtcancttttgctgaatgtggagaattgctctaagcaggaaatgctcactttgtaattcaaagtg

SEQ ID NO: 23002 - DNA, 121 bp, Artificial Sequence
  Synthesized
  misc_feature (61): n=a or g
ttcttgtgtgatgctggggaagtatactagggtggttctgaaaggcactaaggacaacaanaggcacgaatgagaccttgagatggattcctatccttgctgacatacacagggctctaca

SEQ ID NO: 23003 - DNA, 121 bp, Artificial Sequence
  Synthesized
  misc_feature (61): n=a or g
taagtagatcattaagatcccccccagaaaatgtaaaaaactttggtactatgacactaancaatctaagaccatggttaccaatttcatgtttaaatactgcaaaaatatctgaaagcat

SEQ ID NO: 23004 - DNA, 121 bp, Artificial Sequence
  Synthesized
  misc_feature (61): n=a or t
agtgacaattttttgtgtccaggtttcataaagagcatattttacgtatatattcacatcnacaggacactatttctagtagagcattgattttatttgcataatgcattttattgtagca

SEQ ID NO: 23005 - DNA, 121 bp, Artificial Sequence
  Synthesized
  misc_feature (61): n=a or g
atgaataatggagcagcaccatcattatggccacatgtggcattgtttactcatgacactntaaatgattaatgtggaaaagctgcatttgaacaagtgagattgatgagagctttacaac

SEQ ID NO: 23006 - DNA, 121 bp, Artificial Sequence
  Synthesized
  misc_feature (61): n=a or g
atatttagttatttgatgtatttcagtctagataatcagcaacaccagtaaaatgtaaagngtctgtaatgcaccttaaatcaaattctgttaagctccatatcttcttcagactgtttcg

SEQ ID NO: 23007 - DNA, 121 bp, Artificial Sequence
  Synthesized
  misc_feature (61): n=a or g
attggctgcctctcccaagtgatttatggttgagaagacattacaaggaatcaaaaataanagaacacaactgcttattcattatgaaaatgacatttattggcatactggaatctggaca

SEQ ID NO: 23008 - DNA, 121 bp, Artificial Sequence
  Synthesized
  misc_feature (61): n=a or g
tataattttatgaacctagttgtttcagatcttgaatcgtgggtgaagttaacgggagagnacagactctgagatgtttaatttggtagcaaatcatgttagtgtttttgtgtggacttat

SEQ ID NO: 23009 - DNA, 121 bp, Artificial Sequence
  Synthesized
  misc_feature (61): n=a or g
gacttttcccctaaaggcagtagacggtgcctggtgtgtgcctgtgcagaagccaggtacnaaagcaattcctgctctgtcaggcaggccatgactgctctccctgaaaagcacagattct

SEQ ID NO: 23010 - DNA, 121 bp, Artificial Sequence
  Synthesized
  misc_feature (61): n=a or g
attcagtcttatgccttcaagcagagagtctgaaaatcacttcctaaagtctgaattcctnctaaagttgaattgctctcttctgggatttgggctctaggaaattatttataactctatt

SEQ ID NO: 23011 - DNA, 121 bp, Artificial Sequence
  Synthesized
  misc_feature (61): n=a or g
gcagtacgggatatatagggggaggaccaaagaaaaagggagagatcaaagtggatcccanaggaatccttgcaactctgaggctatatcccagcggtgggatgagtcctgcagcccatca

SEQ ID NO: 23012 - DNA, 121 bp, Artificial Sequence
  Synthesized
  misc_feature (61): n=t or c
atgaaatctccagcaaatagacagtttgaggaatagcagttttttaagtatgagaattcanaggagcctgacaactatgggtatgatgattttcctccatttaagtaatttttattatttt

SEQ ID NO: 23013 - DNA, 121 bp, Artificial Sequence
  Synthesized
  misc_feature (61): n=t or c
aagtacggtaggtattttttttcttaatttgtctcatcaaaatgcagctgtaatcttttanaccagtttagacaatttaggagactgctcttttagcataatcatgctggttgcagtgcct

SEQ ID NO: 23014 - DNA, 121 bp, Artificial Sequence
  Synthesized
  misc_feature (61): n=a or c
ctttatataggtttcatctgtcagtttgtttgaaagtcaaatgcaaattgcctatgtttgnacttctggctatctgcttgcctaactctgagacaatgccccagaaaattaacaactattg

SEQ ID NO: 23015 - DNA, 121 bp, Artificial Sequence
  Synthesized
  misc_feature (61): n=t or g
agtgccagaatctactgacactcctcttggcatgtaactgaccatctaatttccaggcatnattttgtaaaatgcatgatggcaacttttagaacattagaacaggaataagcaaatagca

SEQ ID NO: 23016 - DNA, 121 bp, Artificial Sequence
  Synthesized
  misc_feature (61): n=a or g
tgttagcaagtagttatcagtatttacatgcaagtaatattggcagcacaaaccactagtntcatcataagaatggttcaagagaagtcaggagggaagtaagcatcacaagcgtcttaat

SEQ ID NO: 23017 - DNA, 121 bp, Artificial Sequence
  Synthesized
  misc_feature (61): n=t or c
cagaaaagattgggatggattcaatacaagacagataccaaatcagatactatcattcatnttgctgcatttactactgcttaaagctagcatttttgccatcttatgcttaacagttcat

SEQ ID NO: 23018 - DNA, 121 bp, Artificial Sequence
  Synthesized
  misc_feature (61): n=a or c
ccctcagaacatcgcaaagcgcagctctcaccatccctctagaaaacccttcattaagaanagataaagtcaatcacttacttgttctctcccgccgttctcatctattatacacacacac

SEQ ID NO: 23019 - DNA, 121 bp, Artificial Sequence
  Synthesized
  misc_feature (61): n=t or c
gaggatgagtgaggaagccttgtgtggcttgggacgaggcctgggtgtggccagcagaggntgacctgcctgcagctgtgattcatgatacaccaagaaatgccaagttctggtgcagaca

SEQ ID NO: 23020 - DNA, 121 bp, Artificial Sequence
  Synthesized
  misc_feature (61): n=c or g
cctgctcagttatattgctactgttaatcctgatcctcaggtactgtatacaaatgcttcnacttgatattcttttttcctccctatgtccagtagaagttatcctcctgtgttacagata

SEQ ID NO: 23021 - DNA, 121 bp, Artificial Sequence
  Synthesized
  misc_feature (61): n=t or c
aggatagtagtgatacctgcctatcactgcgtacgtcacaccgcatagaaacttctatcanctaaaaccggggggttgagtttttaacacggcttaaagccacacgttgagaaagaaattc

SEQ ID NO: 23022 - DNA, 121 bp, Artificial Sequence
  Synthesized
  misc_feature (61): n=a or g
agtaggtaccagcatggagctttagagaaagctgtaagcagaagagaacttgaaaagaaangtactttaattacgtgattgctggctttcatccagtcaagcatagttgctctctgaagct

SEQ ID NO: 23023 - DNA, 121 bp, Artificial Sequence
  Synthesized
  misc_feature (61): n=t or c
cacctccccgggcagctgtgccaatgcctcaccgctctttctgagaggagacttttcccantatccaacctgaatctggtggacagaagtgccacgtgcatctgtacagcagtgttgggac

SEQ ID NO: 23024 - DNA, 121 bp, Artificial Sequence
  Synthesized
  misc_feature (61): n=a or g
cttcctgtattgttctcaatctgcaccaagtatcatcctagcttggagaccatctctgtcncattaaaatacacagtgagacatttaccacttcttgaaaagaaaagaaaaacatctctat

SEQ ID NO: 23025 - DNA, 121 bp, Artificial Sequence
  Synthesized
  misc_feature (61): n=a or g
ccttgtttgggttccctgagggcttccccagttcttctgtggcccacccaattgtgcagtngtgtgacctggtcctcgtgctcctactgattccaggaacagattctttctcaatctcaga

SEQ ID NO: 23026 - DNA, 121 bp, Artificial Sequence
  Synthesized
  misc_feature (61): n=t or c
tgctgaaatatgagcgcttccataaatccagccccacgcaaagctgcacttttataacacngagaaggtttgcccatttttcctcccttctttgaaaagcaaagggcttcctgcaagaagc

SEQ ID NO: 23027 - DNA, 121 bp, Artificial Sequence
  Synthesized
  misc_feature (61): n=t or c
ctgggtggaataaaccacaaatcatcaggttggctgtgtatttgtgagctacttcatgtcnaaatccccatgcagacttgcctaatgtctgtctgaatttaagatctgggcctatagttaa

SEQ ID NO: 23028 - DNA, 121 bp, Artificial Sequence
  Synthesized
  misc_feature (61): n=a or g
tgttttaggctcagcaaaatgcagactaattgataaactccaggaaaagcaagtacaatgnatatactctgttcactttatagtatttcagaaacaagccaaggcagcagggatagaggtt

SEQ ID NO: 23029 - DNA, 121 bp, Artificial Sequence
  Synthesized
  misc_feature (61): n=t or c
ttgcagagaaccagaagttctccaagcacagcctcattaggcagccacagtgcagcctacngatggcaaagaggttgcaagcagctcatctccagagagaccaacggaataccccctgaaa

SEQ ID NO: 23030 - DNA, 121 bp, Artificial Sequence
  Synthesized
  misc_feature (61): n=a or g
taccaagtgtatttgccatgaactaaacctccaaaaaatcataaaaagccattggttctgntcaacagtccataaatgttatttactctatcttttaagtagtaatactgattgtataaag

SEQ ID NO: 23031 - DNA, 121 bp, Artificial Sequence
  Synthesized
  misc_feature (61): n=a or g
atgctgggagagagaggtcattattgcaaggagaccagagctgcttggatgtgagctttgngaaaagtgatgtaccccaaagatacctgcttaatgaatgaaaaaggtgccatgcttgtta

SEQ ID NO: 23032 - DNA, 121 bp, Artificial Sequence
  Synthesized
  misc_feature (61): n=a or g
aaatttgtatggactttaccgtttacgtgcacatttttatatcctatacacaaggcacagncattttaaagtatttcaataattagtaaaggaaaaaaacgttctttgacttatttattag

SEQ ID NO: 23033 - DNA, 121 bp, Artificial Sequence
  Synthesized
  misc_feature (61): n=t or c
caagtacctttccacagattagctaaatggacaatttaacttcagccattacaccttatanaggaaaaaaatctgctaggtgtattttagattgcattttaaaaatgactgatgcttttac

SEQ ID NO: 23034 - DNA, 121 bp, Artificial Sequence
  Synthesized
  misc_feature (61): n=t or c
cagctctgattctgtctcattgtcaacactattatcaacatcaacgtgtcatcttcaatcngtgggtcctactggtgacctgggcaagagtgtgggtgagcaggatatcacagatgccctg

SEQ ID NO: 23035 - DNA, 121 bp, Artificial Sequence
  Synthesized
  misc_feature (61): n=a or g
agaaattcagttactttggaaaacatattgatgcttgctcaaatacttcacttagttcatnctccacattaaagattatttttcaggataggattagaaagagttttaccaccgggacaca

SEQ ID NO: 23036 - DNA, 121 bp, Artificial Sequence
  Synthesized
  misc_feature (61): n=a or g
tatcaagccaagtaattaagactagtggttttgaacacagtaaacacaacctttgtttctncatttcttgttgtaacaccatctaaatgtgtacacaaacatacaaaatgcatttcagtga

SEQ ID NO: 23037 - DNA, 121 bp, Artificial Sequence
  Synthesized
  misc_feature (61): n=t or g
taaagctctaccaaccgtactttgatctcctgcacatgggaaaaccaactgcaacttgganggatcatctttttatagaaatagttacggccctcatcttacacctaattacacatcaaca

SEQ ID NO: 23038 - DNA, 121 bp, Artificial Sequence
  Synthesized
  misc_feature (61): n=a or g
tttgatgctacgaaggaggaaggtgttttaccttgtcaacaatttgcttgagagagcatcncatcacccctctgacacttttgttggttttggttgctgttgtttgtgtctccagtgtaaa

SEQ ID NO: 23039 - DNA, 121 bp, Artificial Sequence
  Synthesized
  misc_feature (61): n=a or g
gaacactgttccagtgagtctgcaccactgatcagtgcacagtgctcgtgagggcccatcnggagaggacagagcaggaaacatcacttctgacattgggaatactaaaagagggaggtaa

SEQ ID NO: 23040 - DNA, 121 bp, Artificial Sequence
  Synthesized
  misc_feature (61): n=t or c
atcggtatactatattgtatcacagtaaggtatggatggaagaccatttatgacatttttnctgcttcattatgattgcattaagatgccaagtaaattacagtgctaatgtgtagttatg

SEQ ID NO: 23041 - DNA, 121 bp, Artificial Sequence
  Synthesized
  misc_feature (61): n=t or g
ttctagtaaaaagtaaaagctctttaaagcttttgtttctgattgtactttatgacggcanttctgtatcagtgaacagagtgttcctttgcaatcagcgcagtgtcacaacgacctggca

SEQ ID NO: 23042 - DNA, 121 bp, Artificial Sequence
  Synthesized
  misc_feature (61): n=a or g
tctttgtgacattattcactctttatctctgggcagaaatgtaaggatgcagcttgccctngagacaccacgcaaaatgaagttgtgctgtaggaggtgcgctgtgtttggaataaaggca

SEQ ID NO: 23043 - DNA, 121 bp, Artificial Sequence
  Synthesized
  misc_feature (61): n=a or g
aaaaactaattaaaattgtcagttgataaagttaatgactgatagcatttcccatgtaacncttactataaaatatttagaaactcaaactagcagcacagatatattgagaatatccaca

SEQ ID NO: 23044 - DNA, 121 bp, Artificial Sequence
  Synthesized
  misc_feature (61): n=t or c
gtcatctagacataaacgctagtgctgttgtttcccagaataactttataaacaaagttgntttctcagagatttttaaatccttttcacattacaaatccttttcacattgcatcatgat

SEQ ID NO: 23045 - DNA, 121 bp, Artificial Sequence
  Synthesized
  misc_feature (61): n=t or c
tgacttacctatgctactatgatcacaaacctcttccctctgattaaataacatattcttntctatttgcatgactctgttacagagctcagcgtggttttgctgtgtattgactgcttct

SEQ ID NO: 23046 - DNA, 121 bp, Artificial Sequence
  Synthesized
  misc_feature (61): n=t or c
aaggatatctgtgggtctctgtgacagctttcttcatttgcaccagcgttcctgttcaccnctaaactggaggcaaaatgggtaacttggtcttccaagaacccgcactcaaattcagaca

SEQ ID NO: 23047 - DNA, 121 bp, Artificial Sequence
  Synthesized
  misc_feature (61): n=t or c
ggacccagaagcacggtaactgtgtctttgagagttcaccgagtttcctcaggcaacttanggaaaggctgcactgtatataatcctctgaattgtacatggatatatatcgtatttacat

SEQ ID NO: 23048 - DNA, 121 bp, Artificial Sequence
  Synthesized
  misc_feature (61): n=t or c
tctctgcgcatttcacagtattaatgggtagaagagcacatgacgcaccttctctctctgnttggtctcaatgatgccattccagaggggcagatctaatacctcttttcagaaacaagtt

SEQ ID NO: 23049 - DNA, 121 bp, Artificial Sequence
  Synthesized
  misc_feature (61): n=a or g
ggaggggggtgtgtggggtcctcctgaagtgacaaacctggtggtctttgtaatgggaacncctggactcgtgcagcctgctgtgggtgtgctgtgcctctgtggggtggctctgcaggcc

SEQ ID NO: 23050 - DNA, 121 bp, Artificial Sequence
  Synthesized
  misc_feature (61): n=a or g
acaggaagaaaaaaagtctgctgtctacttatggcacattttgttcactcaaaagtatgcnctcttgttaagagaatactcttcattgctcacagcagtaaaaacaacaacaaaaacaaag

SEQ ID NO: 23051 - DNA, 121 bp, Artificial Sequence
  Synthesized
  misc_feature (61): n=a or t
aggaaagatatcaaaagtttgcaaaaagaaatgtagctaacaaagatgcttgagaggtgtnttcttcagatacacacatggtgttcacttattaagaattgtaagaaaattatgatctaga

SEQ ID NO: 23052 - DNA, 121 bp, Artificial Sequence
  Synthesized
  misc_feature (61): n=t or c
ctcagaaccactgccattttcatcacagtgaagaattataccaccaaataaatgtatatantgtggtagctggaattctatgtgcagtgtgacctgtgagatatacagtcatttaggctca

SEQ ID NO: 23053 - DNA, 121 bp, Artificial Sequence
  Synthesized
  misc_feature (61): n=a or g
aaattagtgaataacattctccacgtgtccaaattatccagttatacctttctgcagaggnaatgacagtgctccattatttctctttgactcatatttggataggaacaattcagcatgg

SEQ ID NO: 23054 - DNA, 121 bp, Artificial Sequence
  Synthesized
  misc_feature (61): n=a or t
agctgacagaaataccaaagaagcatacaattaaattatgattcaacttaaaatcgaagtnattctgacatgaacaacttgccaaatcaaccaaccatttacagaatgccagaaactgagt

SEQ ID NO: 23055 - DNA, 121 bp, Artificial Sequence
  Synthesized
  misc_feature (61): n=t or c
gtttctttgcttttgtttgctcttgtctatcaccgtctttgcacttaactgttggttcttnggtatacttgactaatgagccatcaccatttccagggtgaaggaaatctctgttaactag

SEQ ID NO: 23056 - DNA, 121 bp, Artificial Sequence
  Synthesized
  misc_feature (61): n=a or c
aaagaaaactttggtgggtggtatctataccttctaataggatggagtattgaaaacatcngcatttggtatgtggctcctaaggctcacatctctataaactaaggcctacataagtttg

SEQ ID NO: 23057 - DNA, 121 bp, Artificial Sequence
  Synthesized
  misc_feature (61): n=c or g
cccttagcagagtgtgaggaaacggttcctcagccctcgtgttgctgctgcctcagaagtngaatgggaaaccaaccctcagactcacttccatacaccctgcaggcggtcagcactgctg

SEQ ID NO: 23058 - DNA, 121 bp, Artificial Sequence
  Synthesized
  misc_feature (61): n=a or g
tgtttatagggggagatttttgtatagtggtagatggaaacaaaatggagatctagtaggngctgttcctggttttgggcaagaacttcacacctgctattcttcctcgtatgttccaaat

SEQ ID NO: 23059 - DNA, 121 bp, Artificial Sequence
  Synthesized
  misc_feature (61): n=a or g
tgatccaattccctaatctgcttttcccccgaagtttagaagccctacagactttctacgnaacattttaatatttgtgcctttacatgagggtctaaaaaaattgagttaatgtctaaat

SEQ ID NO: 23060 - DNA, 121 bp, Artificial Sequence
  Synthesized
  misc_feature (61): n=c or g
aaaatggaaggttgcactctgaaagatgtctatgtgcgcccttcccaagcactcagagganaaagcacagcccatcaaggctcaagaacttcagccttcctgggtccagagatcaactggg

SEQ ID NO: 23061 - DNA, 121 bp, Artificial Sequence
  Synthesized
  misc_feature (61): n=a or c
atggtcctacgataagggccatggttcattgtgtcagctctgaccattcagaactgctgangtccccaggagatgtttgtttttaaaatccatggctgaaggaaggggtttggatacattg

SEQ ID NO: 23062 - DNA, 121 bp, Artificial Sequence
  Synthesized
  misc_feature (61): n=a or g
taaacaagtgattcactcatctaacacttgggcatgacttaagaatgacacttcaaaccgntctgttgaaagacccttggaaaaagaaaatcaccattcatctttgcacttctcttgattg

SEQ ID NO: 23063 - DNA, 121 bp, Artificial Sequence
  Synthesized
  misc_feature (61): n=t or c
tatgtatcttcattcagtcatgcaaggtttcttctaaaattggagtttcagcagcaaacantgaaacaatttctttgatgtgtactggatctagctatgatacagtcaacatttcccttat

SEQ ID NO: 23064 - DNA, 121 bp, Artificial Sequence
  Synthesized
  misc_feature (61): n=a or g
gtggattagcaaaatgtagttcccaaaactcacacaaacccaccaaagcagagaattcagnccatatttgcagctgtatgaaaaagatacattgtcatcaagtggttcattccacctatct

SEQ ID NO: 23065 - DNA, 121 bp, Artificial Sequence
  Synthesized
  misc_feature (61): n=t or c
gtgaacattgggccgccctcccttgggcaatggttgctcacccaatactgagaattacacngagcaccctgaagggcaatgcccaatgtggaaaaactgagtatctcccaattgggttctc

SEQ ID NO: 23066 - DNA, 121 bp, Artificial Sequence
  Synthesized
  misc_feature (61): n=t or c
tgctttgatcacctgctgttttttcttgcaaatcctgctttatcactgcatgggcatattntctcactgtctctcacatggatacatatacaaaagttatagccttttaagtcagatggat

SEQ ID NO: 23067 - DNA, 121 bp, Artificial Sequence
  Synthesized
  misc_feature (61): n=a or c
tgttctctccaggttctgcaaggattttttttaccccttacacgttgcatccacatggccnatgcataatacagatcccaagtggaacatatgtttgcagaacaagttcttgcaaaatcag

SEQ ID NO: 23068 - DNA, 121 bp, Artificial Sequence
  Synthesized
  misc_feature (61): n=c or g
catgctggtatcttcattcatcagtccagttaagaatcattttaaaatcctccacaaagantgaactacatcttcatacacacattttctgacatgtatttctgatcttgtgaatgtgcaa

SEQ ID NO: 23069 - DNA, 121 bp, Artificial Sequence
  Synthesized
  misc_feature (61): n=t or c
acctttcccaaagacccaatggcatcgtccctctgggagactgactagagtcacatgagcngcaccgagggcaggtaacccaggagaggcgaagggggtgggtgggagagaagctcaggct

SEQ ID NO: 23070 - DNA, 121 bp, Artificial Sequence
  Synthesized
  misc_feature (61): n=c or g
aggataaataaacctgtagctctatactgactgcaccaaactgtcattcttctctattagnagctatggaatggagttacgccttcatggagaagtaaaatgagcatttagacttggattt

SEQ ID NO: 23071 - DNA, 121 bp, Artificial Sequence
  Synthesized
  misc_feature (61): n=a or t
tgcgttaacactggttgacaggtgggaaccaggcagagagtgtgttgggtcacaagaaggngggctgggagtacattctggtggactggtcagggcagacagtgttgtgaaaccatctctt

SEQ ID NO: 23072 - DNA, 121 bp, Artificial Sequence
  Synthesized
  misc_feature (61): n=a or g
ctgggtgctcaatgcctgcaggagccatctggaggtgggaagccctgagtgaagtgagacncaccgtgtttgtccctgggctcagtgccacaatgacacatatccctatgacattaccagc

SEQ ID NO: 23073 - DNA, 121 bp, Artificial Sequence
  Synthesized
  misc_feature (61): n=a or g
gatccaaaaagggataaataaaagaacaaccaagtagacgaagctgtgatttgtctacctngaagacgcatatttgaattgatttctccttgtaaagcattgcaccactacgttcagggaa

SEQ ID NO: 23074 - DNA, 121 bp, Artificial Sequence
  Synthesized
  misc_feature (61): n=a or g
cctaattttgcatcaagtgaaagcatcagtgaagacaggaatgagcgtgcatgcagaatcnctgtgcaaatgccaccctaaagctcttgctgccaaacccaagattcataagcaaggaagg

SEQ ID NO: 23075 - DNA, 121 bp, Artificial Sequence
  Synthesized
  misc_feature (61): n=a or g
atgcccacactactctcctaaacacaagcaggttttaggccctaagaatttctgagcatanacataactcgttacttcagaaggaaagaaaataaatgaaaaagctcacgaaacttcaggg

SEQ ID NO: 23076 - DNA, 121 bp, Artificial Sequence
  Synthesized
  misc_feature (61): n=t or c
ccaccatgggaagtcaattatctccatagcaaccaaaacaaatggtgaatattgccttagnagctgcaaagaataagaggtgcatctaaaattaatttatgtcttgggatcagacacttga

SEQ ID NO: 23077 - DNA, 121 bp, Artificial Sequence
  Synthesized
  misc_feature (61): n=t or c
tctcaacatttgcattaaatatactgtttctggcacttgagcccacaacagagctagtggntgcaacaacttgacagtctttttgtcatctggagaatgatggaaaccagaagaaagaaca

SEQ ID NO: 23078 - DNA, 121 bp, Artificial Sequence
  Synthesized
  misc_feature (61): n=t or c
gaaaagactgctgttaagccttgggtggaacacatattatagattactaataaaaaggtangtgtataggttcagtgaatgcccttgtattttaaagaacagtggtttggtataacaaata

SEQ ID NO: 23079 - DNA, 121 bp, Artificial Sequence
  Synthesized
  misc_feature (61): n=t or c
aagaggtcatcctacctgcaagctttcacagagaaccagccaatcccttcatccttgtgtnagacatcagacaagtcatgtggaagagaccagccttggaagttaagcttggtttgctcag

SEQ ID NO: 23080 - DNA, 121 bp, Artificial Sequence
  Synthesized
  misc_feature (61): n=c or g
tcaatgcacagtattaccttcattaaacacagaaagcagttgcatatgatattactgaganctgcctggttgttattgcacggatgacagtgccagtggttccagactggctgcctttgca

SEQ ID NO: 23081 - DNA, 121 bp, Artificial Sequence
  Synthesized
  misc_feature (61): n=a or g
cgaggcggtggcaggagcaggcgggtgctttcccatcccgctggagttttaatccaaaacngggccagaagagtaaacaaccaggttttttagaaaagaataactttgtgcattgtatgtc

SEQ ID NO: 23082 - DNA, 121 bp, Artificial Sequence
  Synthesized
  misc_feature (61): n=a or c
ctcctgttacatcatctgcagactatctcaggccttccaatgctcttggctatggagagcntctctcatgtccatgttgtccaagaaaaacaaatgtactgctgcgtgataagtgacagct

SEQ ID NO: 23083 - DNA, 121 bp, Artificial Sequence
  Synthesized
  misc_feature (61): n=a or t
tgggacagtagctaaaaaaggaatgaacacacagagggtaagtaacctcaaggcaggaaanaacaagattcagaaggaacggattgttagtaaaggtaagaggacaaaagatagggagtaa

SEQ ID NO: 23084 - DNA, 121 bp, Artificial Sequence
  Synthesized
  misc_feature (61): n=t or c
tgttagactgaagtttagaaaaacgtttccagctcctattaactgtcctcctttgattgtncattaacaataaggacaagaaaaagcacttacaaatgccctctcaaatcacaatttaaat

SEQ ID NO: 23085 - DNA, 121 bp, Artificial Sequence
  Synthesized
  misc_feature (61): n=a or t
cacatacatacatgacaagagcttgttaagtagaacttggaactaaaggtacaggtcaggngcccagatatgggacagtgccctcattaaaggaacttttatcactacagacaaaaaaagg

SEQ ID NO: 23086 - DNA, 121 bp, Artificial Sequence
  Synthesized
  misc_feature (61): n=t or c
aataataaaatgtcacaaaaccccagaagttatctgcttctttcctgcagctgccagatgngctcagtgctgcagtcttctttacttttcatctgccttttactatcctaatgctgttact

SEQ ID NO: 23087 - DNA, 121 bp, Artificial Sequence
  Synthesized
  misc_feature (61): n=t or c
agagaatatttgtgcaagaaaacattttccagatgccatatcaaataacttagtatgatgnttctaatcctttagtataaaaataggtcactgtatgggggaaaaaggaccttattacctc

SEQ ID NO: 23088 - DNA, 121 bp, Artificial Sequence
  Synthesized
  misc_feature (61): n=t or c
aaggagttggaaacctcattatgttgccctggtaatgttgtctgcattgtttgctgcatgngtagccattggcaatgccgtttggtctgtgtgtgctccgtctgaggagcagaacccggaa

SEQ ID NO: 23089 - DNA, 121 bp, Artificial Sequence
  Synthesized
  misc_feature (61): n=t or c
agcagagaagtgcccagtgctgctggttggaaagaggatggtggatgaaaaaaggcagaangccacagtgctgcagagatattgcaacactgagtgctgccagaaagtcagagcaacacag

SEQ ID NO: 23090 - DNA, 121 bp, Artificial Sequence
  Synthesized
  misc_feature (61): n=a or c
aaataatgttatgctaagggcttttatcagttgatgtcaggatgattattttttcatatcnaagctgtgatagtgttagggacccctgtgtgaatcatattcaattgtgttcagggcaagt

SEQ ID NO: 23091 - DNA, 121 bp, Artificial Sequence
  Synthesized
  misc_feature (61): n=t or g
ccaggctgttgcaaaacaccatgtgcagactccccaaaatgagtcatgtctgcaggcatgnatgtctgcatagtggcacagagctgtgcagagagcatggcagcccaccaccagtaccatg

SEQ ID NO: 23092 - DNA, 121 bp, Artificial Sequence
  Synthesized
  misc_feature (61): n=t or g
taacagaggaatgcactcctgtgtgctccgaaagaaagttggccacacacctgagtccggnttgtcagatgaagcaagtattaggtgcgagaatctgttgttcagtaatcgtcttggcatt

SEQ ID NO: 23093 - DNA, 121 bp, Artificial Sequence
  Synthesized
  misc_feature (61): n=a or t
cagaaatttgcaactccaacacagagatttcagaatttgtgactgcagatgctgaggtacncaaccatcttgcaaatatccttgagaagaagaatgtaagtgttgtgaagaccacaagatg

SEQ ID NO: 23094 - DNA, 121 bp, Artificial Sequence
  Synthesized
  misc_feature (61): n=a or g
acacctgtgtggacattctgagacttttcatccaggctgggaaagcagatctggagagacnaggtgagctgactctgacactgccacatcagctcccaacgtgggggctgagcagtgctgc

SEQ ID NO: 23095 - DNA, 121 bp, Artificial Sequence
  Synthesized
  misc_feature (61): n=t or c
aaaagaatgtattagaaaaccaaagtgatgaaaatgaggtattgttgggatctttgaagcngtgtcctgtgggctttgtggagtgcagagacagagggagtgcatagttgtgagaaatggg

SEQ ID NO: 23096 - DNA, 121 bp, Artificial Sequence
  Synthesized
  misc_feature (61): n=t or c
aggtaaaaatagagaaggtgtaaccggttcagaatgaaagtaatcatatgattgttgctgngtgccaaaaaaatctgatctatatataacaaatcagccttcaggtaatctccaaaacttg

SEQ ID NO: 23097 - DNA, 121 bp, Artificial Sequence
  Synthesized
  misc_feature (61): n=t or c
aatgcatatgccaaaacacattaagtccacaattctgcatgacacccttccgccacaatgngtttgtaaactgtttccagattacaaacagagctgcttaatggtgttcattaattgttta

SEQ ID NO: 23098 - DNA, 121 bp, Artificial Sequence
  Synthesized
  misc_feature (61): n=t or c
tattatgcctgatgtagtacagcatcatgttggtgtgcgaatatacactccaaacaagagnggttccaagaaatgtttggaaaacagagcacttcctcctcttcatgtactttctcttgta

SEQ ID NO: 23099 - DNA, 121 bp, Artificial Sequence
  Synthesized
  misc_feature (61): n=c or g
atgtgcttacacgacctcgtcacagattttctgtaagttccagtgactttgtttttgttcnttttgctttgtgtggaaagtgtatctgcatatttattccccaaatattaccttattttaa

SEQ ID NO: 23100 - DNA, 121 bp, Artificial Sequence
  Synthesized
  misc_feature (61): n=t or c
gtgaggcagcagatgaatctgccagctgggggcagaatttttctggggaaatcttgcatcngtgccgaggactggccattactgtgggatgtgacagagatgtgggagataccttcttaat

SEQ ID NO: 23101 - DNA, 121 bp, Artificial Sequence
  Synthesized
  misc_feature (61): n=a or g
cacgttccccatctctctggaggactctgaatccctaccaatgaacttctccccattccanaggtgaccaccatccctcttttgcaccccaaccactcctcacaccctatttcttcctcac

SEQ ID NO: 23102 - DNA, 121 bp, Artificial Sequence
  Synthesized
  misc_feature (61): n=t or c
aaaggaaatgatttccttactgaaagaaatcacttcaaagagctcagaccagaccctgctncagctcaggtttcccctctgtgcagcagcttggacaacagctctcacggagagccgggct

SEQ ID NO: 23103 - DNA, 121 bp, Artificial Sequence
  Synthesized
  misc_feature (61): n=a or c
aacagacccaaatgcgtggcaggtagaagttcttaggaagtttgtggtcacctactttagnaggatcaatggaaaggaagtgctgttcttgatctcccctgggagaaggggtgcccaggaa

SEQ ID NO: 23104 - DNA, 121 bp, Artificial Sequence
  Synthesized
  misc_feature (61): n=a or c
accatcaaaataaagcttaaaaggggcttgaaaggtacatcagtcttgtggtgcttctgtnaaagaactagtggaatttcaactttttttcataatcacataagattcaacgatatagctt

SEQ ID NO: 23105 - DNA, 121 bp, Artificial Sequence
  Synthesized
  misc_feature (61): n=t or c
ctgttaacaacaaatagcacggctggataggataactaggaggagaaggaactaaaagctntttacatgtcagcccccaagatttacctgcagggaaacattcacacactcagctcctgcg

SEQ ID NO: 23106 - DNA, 121 bp, Artificial Sequence
  Synthesized
  misc_feature (61): n=a or g
gtccagcacagtcttagggttgtggtattttgaggactgataggaaaaattactgtagccnaaatatcctgtctgcaaagcattgatcattttagtgaagattcagtctatgaaaagctct

SEQ ID NO: 23107 - DNA, 121 bp, Artificial Sequence
  Synthesized
  misc_feature (61): n=t or c
tgttttgtttgttgtcagtatttagaataataagtttaaataaagatatctagtaaaagcnactatgaagtgcttgaaaggaaaagtagaagcactactgtgttccaatgagcctgccaca

SEQ ID NO: 23108 - DNA, 121 bp, Artificial Sequence
  Synthesized
  misc_feature (61): n=t or g
gacagatgaaaaatgtgccatgtcactcactgaatcccaacagaaatctcacctaagtgtnttaaaagcacatgaaactcgtgtcattgaagtaaaatttaaaaatcgtcagtcttctaga

SEQ ID NO: 23109 - DNA, 121 bp, Artificial Sequence
  Synthesized
  misc_feature (61): n=a or g
tgcttagggcatcgcacaagagtcaccctacagggagtacaacacatgggacaccctacantggcactctatgtgggacgaagcacatggggcatcttgtgtaggacatcttgcatagaac

SEQ ID NO: 23110 - DNA, 121 bp, Artificial Sequence
  Synthesized
  misc_feature (61): n=t or c
ttgacagtacagactgatacttcggtgtgtgcagtatgtagcagctactacaacttctgcntctgcctgaaatgccagaatattaggtgaatttatactgtacctttctgttcagcacttt

SEQ ID NO: 23111 - DNA, 121 bp, Artificial Sequence
  Synthesized
  misc_feature (61): n=t or c
agcagccaggggcctggcataggattacttcccaagtacttaccaaggttcttacatttantgtgatccccatttattaagttatctcatatatgttcccactaaatatgcttaaaaaaaa

SEQ ID NO: 23112 - DNA, 121 bp, Artificial Sequence
  Synthesized
  misc_feature (61): n=c or g
ttgatgagatttttaccactggaggggatccattagaacagtagaagaatctgcaagactntatactctgtaggcaaattactgtcacagttccatttaataaaaatacagtggttttggg

SEQ ID NO: 23113 - DNA, 121 bp, Artificial Sequence
  Synthesized
  misc_feature (61): n=t or c
attaatcctttcaagggcttttccccactggagagaaccaggctaccgatttctagttttnccaaaccttccaagttctcagaatgagcacattagagaagggaaatcctcatacagctgc

SEQ ID NO: 23114 - DNA, 121 bp, Artificial Sequence
  Synthesized
  misc_feature (61): n=a or c
cagccatagagcagatggcataagaattggaatggtacaagatttgtgttgctcattcacntgccaagatttgtatttgaggaaatgaatctgaaaaggaatccagatttcactagcatca

SEQ ID NO: 23115 - DNA, 121 bp, Artificial Sequence
  Synthesized
  misc_feature (61): n=a or t
aaatattttacacatttcaagtatttcgtccttagagcaagatttatctcttcacttttanctgcatctgattattgaaatgaaggattcgatgttatggtcaaagaggctattgaaatta

SEQ ID NO: 23116 - DNA, 121 bp, Artificial Sequence
  Synthesized
  misc_feature (61): n=a or g
cagtggctgataaaaggaaagttctttctgttaaaagaagcaagagtaatagtacaaatcncagaagaaaacagtagcaatgatattcaaacacactaaaagaaaaaacagctttctcttt

SEQ ID NO: 23117 - DNA, 121 bp, Artificial Sequence
  Synthesized
  misc_feature (61): n=t or c
gataatttggattgtaattgttaaatcccattacaacacagttcagattggtggtgtgctntttgtgctgatgtctgtgtccctgggtctgtgcaggggggtcagtgttgttagtgggggt

SEQ ID NO: 23118 - DNA, 121 bp, Artificial Sequence
  Synthesized
  misc_feature (61): n=a or g
catgttgtcatgctgtgcaaaatcatcacacaagttctttcctctagtttggaaaaaaacntactgctgaattacacattatttgagtaaaggggttcatctgcttccaggagaatccacc

SEQ ID NO: 23119 - DNA, 121 bp, Artificial Sequence
  Synthesized
  misc_feature (61): n=t or c
cgcaaccggcatgtgtaattagtttcaattatgacaactttggtttattagttacatattngctatttgacatgaaatgacggccgcaattgggggaaaaaaaaatcgggacgcatctccc

SEQ ID NO: 23120 - DNA, 121 bp, Artificial Sequence
  Synthesized
  misc_feature (61): n=a or g
aagggaggagaggacctcagaggagggtttgcaccttcagagcaacggcgcaagcactggnaactccctggttttaacagcagaaaacccaagtgaggattaaatgtggattatgctgcag

SEQ ID NO: 23121 - DNA, 121 bp, Artificial Sequence
  Synthesized
  misc_feature (61): n=t or g
aaacctctgtgggagtcctatcagcacaaggagtgttgaaagtgaaaaggcaaaagccttnacaaagtcccgtgaacagaaagaggagaggatatagaaaataagacatgtttttagatat

SEQ ID NO: 23122 - DNA, 121 bp, Artificial Sequence
  Synthesized
  misc_feature (61): n=t or c
tggaaaaatcctgtatcagacctataaatgaagttttatctgctttgttatggttttatanctattcctctagttttatgaatctatacagaggcttgggtagatcacagaatcacagaat

SEQ ID NO: 23123 - DNA, 121 bp, Artificial Sequence
  Synthesized
  misc_feature (61): n=t or g
ctgaggatgatctctttgagtgtatttagcagtgttctagtagttaacaaaacttcccatnatgaggtttgaaggtgatctgaactttcatgatatgtgatttgttattcatattggccca

SEQ ID NO: 23124 - DNA, 121 bp, Artificial Sequence
  Synthesized
  misc_feature (61): n=t or c
tatctcacaggaccttattcaaatccctgcgtatgtggctttgatagtaatactctttaanctaaagtctttctgtacaaccatgaaatacgtgataggacccaaggtttgaaagcaagca

SEQ ID NO: 23125 - DNA, 121 bp, Artificial Sequence
  Synthesized
  misc_feature (61): n=t or c
actgggacatggaagacgatgttttgtaaccagctctgtcactgaccagaagaatgactantttctgagtaaggttcggtttcccatcactgtaaattggcagagctttgtacgggtgccc

SEQ ID NO: 23126 - DNA, 121 bp, Artificial Sequence
  Synthesized
  misc_feature (61): n=a or g
aagacagaagtctggtgcgagattacagcgtgcttcctaacaagctgaaatttttggatgnaatcctgcaatcccaaaggttgcatttgtttttcacatggatgatttatgaccacaattt

SEQ ID NO: 23127 - DNA, 121 bp, Artificial Sequence
  Synthesized
  misc_feature (61): n=a or g
tgtactctcttgcgcagtgtttgcttaggtcaactagggaagtagcaagtacttcaaagtnctttaatatacatgagatggctcctcatgacccttcacttgccctttcagaggtcccaag

SEQ ID NO: 23128 - DNA, 121 bp, Artificial Sequence
  Synthesized
  misc_feature (61): n=t or c
gggatgcctctcaggggccagcatctcccctcaatgcaccccttacagtgaggaatacagnctttcccaccagcttgcaaaggtccttcccatgctttgaagggctggtgggtttttgtct

SEQ ID NO: 23129 - DNA, 121 bp, Artificial Sequence
  Synthesized
  misc_feature (61): n=t or g
gaagaacgttaagcaaagctatatctaaatcatttattgtaattcagtaaatcaaagcttnttttatcatctgctccatcacttgttcatgctgctgcattgaactggtttgctggtttcc

SEQ ID NO: 23130 - DNA, 121 bp, Artificial Sequence
  Synthesized
  misc_feature (61): n=t or c
gtgaaagtaatcttacaggtgaaaggataaaagataaagcaattgtaatattgggaatgangcatttaagagccgttaagttggaggttcctaaaattcagtgttgtataaggtaaaatga

SEQ ID NO: 23131 - DNA, 121 bp, Artificial Sequence
  Synthesized
  misc_feature (61): n=t or c
ccctcaggtaatcgtgttcccttgtcaaaattggtacttacagacctcctcaggctgttantgagatagagtccctctatagaagctgatgactacccaaaggctgaatgccccataccag

SEQ ID NO: 23132 - DNA, 121 bp, Artificial Sequence
  Synthesized
  misc_feature (61): n=t or c
aaacctagcttaacactggtcagattcacagtacaagaagatttaaacaaaaacagttccnttctgtttcaactaaaactatgacaaagccagtttattgaatgcaacaaacccatttatc

SEQ ID NO: 23133 - DNA, 121 bp, Artificial Sequence
  Synthesized
  misc_feature (61): n=t or c
gtaagcacagaagaagtaaatacccaggcaaatatgtgttatttatcattcctttgtagtnaaacatgtcaaagtcttttgaatcttgtgctgaaatcaaccaatgcataaatgtcaggtt

SEQ ID NO: 23134 - DNA, 121 bp, Artificial Sequence
  Synthesized
  misc_feature (61): n=t or c
ttatgaaagagaagttttagagagagatctgaaacacagaactcccatcaggcgttgggtntgtgtgtgtgtgttggcatgatgattcatatgctttgtgtaagctgaagataacagaagt

SEQ ID NO: 23135 - DNA, 121 bp, Artificial Sequence
  Synthesized
  misc_feature (61): n=c or g
atggttttctaaaactccacatgtataattcaatacattatttttgcctaccctcactggnagaacaatttccagttggaggaaaaagtccaaattggagttttttctccatgaggtagct

SEQ ID NO: 23136 - DNA, 121 bp, Artificial Sequence
  Synthesized
  misc_feature (61): n=a or g
acagtaccaaaaatgcaaagaagaattgggcacctccagatctctgcaagacgttaagaanaaaatccagtagctcagaatgagaagttgaccatactcttctcccaggtaacagcaatag

SEQ ID NO: 23137 - DNA, 121 bp, Artificial Sequence
  Synthesized
  misc_feature (61): n=t or c
ccatcctctggattcacccaaattcgggaaagcattatcagtgggagcctcaagtagggantggagacaaagaaatgttgagatcaagattttctattacgtcctgactgcagcaagaggg

SEQ ID NO: 23138 - DNA, 121 bp, Artificial Sequence
  Synthesized
  misc_feature (61): n=a or g
cacactataccggatttcaaacctgcatattaattttataagaggaaaggacattgccttngacttttcacagtgttttatggtatttttgctagaatggtaatattaagttttttcccct

SEQ ID NO: 23139 - DNA, 121 bp, Artificial Sequence
  Synthesized
  misc_feature (61): n=a or c
tgaagcagctggcaatgctttagtgtttccagctcgttttcagcagcagttaccgcatacncccaaactggtgttaccgattgaaagaacaagattctatcaacaatttaaattgcatgcc

SEQ ID NO: 23140 - DNA, 121 bp, Artificial Sequence
  Synthesized
  misc_feature (61): n=a or g
aggtttttatcttccatggagctctcctaacagttgttctttcagccaagtgggccatgcngcaaaggctggaattgtccctttcctctcccttagctttccccaccatacaatcctgccc

SEQ ID NO: 23141 - DNA, 121 bp, Artificial Sequence
  Synthesized
  misc_feature (61): n=t or c
gcttttgcatgcttcaggacatcagacctgcttttgaactggactattttggctcccttantgagaactctggtggctctctcggctgtgcgacctcctagactccacattacatggaaaa

SEQ ID NO: 23142 - DNA, 121 bp, Artificial Sequence
  Synthesized
  misc_feature (61): n=a or g
tcccttcttttaaactatgttgagcatagatgcaccagttgctgatcctaaatgaaaagcngtgaatattaagcttttctcacttctcatgaagcaagcatcccgtgtctctgttccagtg

SEQ ID NO: 23143 - DNA, 121 bp, Artificial Sequence
  Synthesized
  misc_feature (61): n=t or g
ttacttttctccttttctctttcacaggcaaactagaactatttatccgcaattgtccttnaattagattcaccttggagggtgggaagcatggtgtgctggtgctgtgtgttggtgcctt

SEQ ID NO: 23144 - DNA, 121 bp, Artificial Sequence
  Synthesized
  misc_feature (61): n=c or g
ggaagcccagggccagtgaattgacagcttaaggccctggtccagcaagcagtttttctanactagaatctatctgtgaaaaactctgcatatatgaggtcaccaaggtttggctgcaagg

SEQ ID NO: 23145 - DNA, 121 bp, Artificial Sequence
  Synthesized
  misc_feature (61): n=a or g
cattcagcaaagctactgcagcaagcccaccttgaaaagaaggtgcccacagatgtccaangaaaaggtaagttacagaaaacactgtttaggataatttacttggtagttatctgtgttt

SEQ ID NO: 23146 - DNA, 121 bp, Artificial Sequence
  Synthesized
  misc_feature (61): n=t or c
tttttgtaggtcttgtgtttcagtcacccatcagttgaatgaaaactgtttctaaaaaganccttagccacaaccacagaactaaatgtggtactttccaagtcaacaacagaaattccag

SEQ ID NO: 23147 - DNA, 121 bp, Artificial Sequence
  Synthesized
  misc_feature (61): n=t or c
atagggtactggaagggttcttttgttcttccttttctaatgctttcatttgtatctccangttcagagatcaaaaagccaaaggagagggagagattatgaataattaataataattagc

SEQ ID NO: 23148 - DNA, 121 bp, Artificial Sequence
  Synthesized
  misc_feature (61): n=a or g
ttcattgctggtcccacaacaaagtcctcgttcagtgccattggggcttttaaagcgctcngggtctctgcattaggagtcctgcagttcaggaaacagcatgtgaattggtcagcttttt

SEQ ID NO: 23149 - DNA, 121 bp, Artificial Sequence
  Synthesized
  misc_feature (61): n=a or g
gtgatgcccttagggaatcactggaaaaccaagtgtcccaggtggaggtaatcttgacccnccaaaacagctcagctacagtgattgtctgtatgttgttttctgtggtatttggatttcc

SEQ ID NO: 23150 - DNA, 121 bp, Artificial Sequence
  Synthesized
  misc_feature (61): n=t or c
caacaaaatgtaacagaacgcaggtgggaagatgtttctacagatgagctgcagactattnactgttttctcattaagtatttgtggtctaaagaccccagttttggtggtttctgacatc

SEQ ID NO: 23151 - DNA, 121 bp, Artificial Sequence
  Synthesized
  misc_feature (61): n=a or g
ggagaggatggagcgacgatgccggggtgaatatgagcactccttcctgaatgagttccangaggtaagggatgccctggctttggaggtgtggagctgctcctgttcctgccactaagtt

SEQ ID NO: 23152 - DNA, 121 bp, Artificial Sequence
  Synthesized
  misc_feature (61): n=t or c
aatattaatgtaagatacaagttcaaattcttcaatttcatatttaaatggaaggatgagnttttgaatgccttcctttctagggtgcctgtttggcctctttaaagaactgggtattcaa

SEQ ID NO: 23153 - DNA, 121 bp, Artificial Sequence
  Synthesized
  misc_feature (61): n=t or c
cagctgaatgttataaacttgaagcctgcacgtgagatgcagaatgagttgcttagtttcnagctgatctcatctccctccttcatgtcctcaggaaactttcaaagactctagatttaca

SEQ ID NO: 23154 - DNA, 121 bp, Artificial Sequence
  Synthesized
  misc_feature (61): n=a or g
tactcatgtctgatgaattttttttccttataacaacttgccatgaagagaatatattctnccttgttacatctttgtttatgcactgttggagcttgttagggcaggaatttcattgatt

SEQ ID NO: 23155 - DNA, 121 bp, Artificial Sequence
  Synthesized
  misc_feature (61): n=t or c
gggatggtggagggagaaggatgagggcagctccggtgttgacaacatttggtctcttctnaggagacattaccaatgaactggtgaggcacttcctcatcgagaccagcccacggggtgt

SEQ ID NO: 23156 - DNA, 121 bp, Artificial Sequence
  Synthesized
  misc_feature (61): n=a or g
tggatagtgatgaggaactgtgcataacaaagctctgccaagtaaatccaatgaacattcntttgttccctttcctggtttccccaaaaacatctctgagagcgggtgggaaaagaagcct

SEQ ID NO: 23157 - DNA, 121 bp, Artificial Sequence
  Synthesized
  misc_feature (61): n=t or c
ctactgctgcttcaagaattcctttcattaaaagcattatttccgttaagactgtgttctnttaaagcatcaggatccatgcagaagcttctctgcaaagacatgctgcatgactccactg

SEQ ID NO: 23158 - DNA, 121 bp, Artificial Sequence
  Synthesized
  misc_feature (61): n=a or g
tgcacgaatacaaaggatgatatttccagtaaggaaaaaaggaacctcagaggcacagcgnggcttttatgggaatgttctctccaaggatcccagaagaactggcacggaaaccaaaggc

SEQ ID NO: 23159 - DNA, 121 bp, Artificial Sequence
  Synthesized
  misc_feature (61): n=a or g
catgaaacacacttgctgaagtaatcagaagccttttctgtcattcagcaaggtttaatangttctgggatcacatctactgctatgtctcagaaatggatgctctttccacttctctaag

SEQ ID NO: 23160 - DNA, 121 bp, Artificial Sequence
  Synthesized
  misc_feature (61): n=a or t
cggagaaaaaacatactgaaccctttacacttgctgctgttttttagcaaatcattcagtntttgagtaagaaacttaaagtgttgtagtgctactcactggacagtaatgattgagagac

SEQ ID NO: 23161 - DNA, 121 bp, Artificial Sequence
  Synthesized
  misc_feature (61): n=t or c
gtttgagatgggaattaaagaaatgtaggataaaaagttgcaatactctgtgggttattangaagatacctcctgaagcctaaggtctgcttttccatttaagtacaaagaagatggatcc

SEQ ID NO: 23162 - DNA, 121 bp, Artificial Sequence
  Synthesized
  misc_feature (61): n=t or c
tactgaattgtcgtaagaaaacttgtatgcttcatgacatgaaaggcacagaggataatanctgcatttttctccttgttttggacagaaaaaaaaaaaaaaaatcctaaaatcatgctct

SEQ ID NO: 23163 - DNA, 121 bp, Artificial Sequence
  Synthesized
  misc_feature (61): n=a or g
gaattgaattaaatttttataaatatcagattctatctgaaatacttctattgtgagtttngaaagctggtgaatactcagcactcatttgttgtcatctctctgaggatttgccttttgc

SEQ ID NO: 23164 - DNA, 121 bp, Artificial Sequence
  Synthesized
  misc_feature (61): n=t or c
tatgaaatagctggcctacaccacagcgagtcgttgctgtgatcataaagcgaagctgaangatggaaaagaaactgcaccaatattgcggtaaaagtttccttttttttatattgacaga

SEQ ID NO: 23165 - DNA, 121 bp, Artificial Sequence
  Synthesized
  misc_feature (61): n=a or g
gtgttgtagacaaaagcttcccatttgagctgatcatctgttgctctaaggggcaagtcangaggtattattaactgctcatcagatgctgaacctgctgataacccagagaggggtgagc

SEQ ID NO: 23166 - DNA, 121 bp, Artificial Sequence
  Synthesized
  misc_feature (61): n=t or g
gtttctgatgtctttttcatcaacattttcttggtttccttatccacagagactgaagctnttgtaggtgcaccacccacatcctctgcagcatcacaaataaaagcaatcctttgcatac

SEQ ID NO: 23167 - DNA, 121 bp, Artificial Sequence
  Synthesized
  misc_feature (61): n=a or g
tgcaccagacaaggggcagcaacaactgcaagtgatactctgaggcagcagaacctgcatncatttgataggcataaaccattatagacaaagcacacagtatgggttgactgctgccacc

SEQ ID NO: 23168 - DNA, 121 bp, Artificial Sequence
  Synthesized
  misc_feature (61): n=a or t
ggaagaaggatgtgcatggtttaggatagtaactattgaacccacagttatgtggctctanttgggttggtatcttgaaccgtgactctgcttgacctttggagcacaggtgccactgcaa

SEQ ID NO: 23169 - DNA, 121 bp, Artificial Sequence
  Synthesized
  misc_feature (61): n=t or c
aaactgcaaatacaattttttttatattagagcttaaacagattaatctatttctaatgtngtacactaacttggttctctcccacaacattactgtcattgtcataatactatttgattt

SEQ ID NO: 23170 - DNA, 121 bp, Artificial Sequence
  Synthesized
  misc_feature (61): n=t or c
tattttctaatggcaaaataaaattgtaattattcctcaacatctacttacaagtgacaangtaagaagtccaaataattctatctggcttagaggaagaaataacatacccaatagtgta

SEQ ID NO: 23171 - DNA, 121 bp, Artificial Sequence
  Synthesized
  misc_feature (61): n=a or c
atacctgcccccctgaacaaaagctgagaattctgttctgtgtgagatatgttcaagaccnctagggcatttctgagttccttcagcatcagttggtaaccaaaggattgttgtacacacc

SEQ ID NO: 23172 - DNA, 121 bp, Artificial Sequence
  Synthesized
  misc_feature (61): n=t or c
cataaacattagcttttaattaaagtgaacggaacgctccagaaaatgctctgtgctcatntaaatgccagtcatcattcatgggaaagggacttcaggaggggagttggagtgttttgta

SEQ ID NO: 23173 - DNA, 121 bp, Artificial Sequence
  Synthesized
  misc_feature (61): n=t or c
tgtaaatcagaagtaaggtgctgaattacttctgagtaaagggtgttcatgtcagtctcantactgacttacctttgcttatctctctgtatggtttgaaatctaataaagatgttgttca

SEQ ID NO: 23174 - DNA, 121 bp, Artificial Sequence
  Synthesized
  misc_feature (61): n=t or c
tcagaaagtctagaaaagtaattactgaaacctgctattatttctgcctgtgctttctgtnctgggagcacacagctgtgctgggacgttggagtggccaccatctgcttcaccttctgca

SEQ ID NO: 23175 - DNA, 121 bp, Artificial Sequence
  Synthesized
  misc_feature (61): n=t or c
gcttatcgagcacagcattttgtaattacacactaccgcactccatctggatgcgagcagngagacctgtttgcaggcactgactttgtttagtcaaatccagagaagcctgggaagagct

SEQ ID NO: 23176 - DNA, 121 bp, Artificial Sequence
  Synthesized
  misc_feature (61): n=a or g
gcagcctcccgggaaacgctgctctcctttgtgcacattcatgaactctcccgtgctcgcngggagagagttggctgaacgcacagccgagggatttagctggaaaacaaataaaataaag

SEQ ID NO: 23177 - DNA, 121 bp, Artificial Sequence
  Synthesized
  misc_feature (61): n=a or g
agaaactgaatagtttggcaagccctgaggacttcaaaagcccatacacttctaaataaantatttgttttatttttagctaggaccgggaagctttttgacatttctgttactcatttaa

SEQ ID NO: 23178 - DNA, 121 bp, Artificial Sequence
  Synthesized
  misc_feature (61): n=a or c
tagtggggagaagagatgctaaatgaaagaggcataattaatttggaggaaaacacaaacnaacaatcaaaaagaagtgtgacacctgcttaaagcaaacatgaagttagcccagcatttt

SEQ ID NO: 23179 - DNA, 121 bp, Artificial Sequence
  Synthesized
  misc_feature (61): n=a or g
gagcagcaatatttaaagcatagtctatagcagactcaataaaataacaactaagtatgcnactgactacagcaaaaccatgaaatcctaatgagatttctctctaacaaattaacccttg

SEQ ID NO: 23180 - DNA, 121 bp, Artificial Sequence
  Synthesized
  misc_feature (61): n=t or c
catcccaccttcacagattattctactactttcttcttacatttacatttcagactactantgctttccactaatatgctgtgtcacatcaaatcctcacagcagaatgtgggtgggggga

SEQ ID NO: 23181 - DNA, 121 bp, Artificial Sequence
  Synthesized
  misc_feature (61): n=t or c
gctgatggtgctgcagcacagccctgggatgcattgtgtgttatcaaacactcggaaatantacgctcatttttaaagctcctatttgctgcttcacccactcgaggggtcattgccaact

SEQ ID NO: 23182 - DNA, 121 bp, Artificial Sequence
  Synthesized
  misc_feature (61): n=t or c
gagatacaacttgctaagaatgaaacaaaaatctgagacagtcataatgatgaaggattgnataactacacgtgaacttttggaaataactggattaaagttcctagttaatgattattgc

SEQ ID NO: 23183 - DNA, 121 bp, Artificial Sequence
  Synthesized
  misc_feature (61): n=t or c
caattcaaagtgaaacatgctctctactgaattagatgtatgtggcaaagtgtatgaaganagacttcattttagattcagtagcactcaggcctagttttcacagagtgaactcctgctc

SEQ ID NO: 23184 - DNA, 121 bp, Artificial Sequence
  Synthesized
  misc_feature (61): n=a or c
aaatcctaacgtaaatatttaataggtaaaattaatttgatgtttgacttctgactcctantcacattccatttcattgtacatcaggatatcttcagaaaacctttcagaattaaaaaca

SEQ ID NO: 23185 - DNA, 121 bp, Artificial Sequence
  Synthesized
  misc_feature (61): n=a or g
agtgaattaatgtgttaagggatcagaacatcactgtctaatgggtattaatttgattttnagaaaatacctatatttgtgagctgctagttcttggacattaggaattttctggagccat

SEQ ID NO: 23186 - DNA, 121 bp, Artificial Sequence
  Synthesized
  misc_feature (61): n=a or g
cagagatccctgaaaccaaataacaccgtctccaaaaggtgcagacctctcacatcacacnacacttaagttcagtggaggacagcagagctcagcttatgaaaatggaagggtaggcagc

SEQ ID NO: 23187 - DNA, 121 bp, Artificial Sequence
  Synthesized
  misc_feature (61): n=a or g
atgcctatttatgaaatatttaagttttcatataaatgattatacaaaaccaaaccaaccncttctatgcatccatggaagtgtcgaagatcacacttatcaactcattacgttcaacatt

SEQ ID NO: 23188 - DNA, 121 bp, Artificial Sequence
  Synthesized
  misc_feature (61): n=t or c
ctcttcacaggcaacacagcacaagaagctgagaagtccgtgaacacttctcaccaacaantgaagtatcagtatgtaatcaacaccaatctcatcctagatccaaaacagagcgccttac

SEQ ID NO: 23189 - DNA, 121 bp, Artificial Sequence
  Synthesized
  misc_feature (61): n=t or c
ctgagcctcataattgcattattaaagcaaagctgttttaaatgctccatctcctctctcngaggctctcccgataaccccggagccacgcacagaaataacgctgaatggccctcatctc

SEQ ID NO: 23190 - DNA, 121 bp, Artificial Sequence
  Synthesized
  misc_feature (61): n=a or g
ggcagaaaatgctgaagatctacttacccaatcatactgaaaccttcagaattatttctgngctattttgaggtcagcattagcatcattttttcaagagttcagattccagtatatgtct

SEQ ID NO: 23191 - DNA, 121 bp, Artificial Sequence
  Synthesized
  misc_feature (61): n=a or c
aaactcatcttgtggaagaacttaattgctgttcaggataattacttgttttctgctatgntgtaatacataatgccctatctttgcagtaaaatagcttgtttcgtcttagaatgaaaac

SEQ ID NO: 23192 - DNA, 121 bp, Artificial Sequence
  Synthesized
  misc_feature (61): n=t or c
aaaattatccagatcagtgaagaaactgcaatgaaaattcaacttcagcattacagaagangtctgacatacaaatattaaacaaaaattcaagtttgtagacattctactttttctacat

SEQ ID NO: 23193 - DNA, 121 bp, Artificial Sequence
  Synthesized
  misc_feature (61): n=a or g
cccgctgccaacgacgtgggaatttacctggggaagaaaaacactgaactgatgacttacngcaagtgctgatctaacagaagcatcttccactcagattccaaactggaaagctaagaat

SEQ ID NO: 23194 - DNA, 121 bp, Artificial Sequence
  Synthesized
  misc_feature (61): n=a or g
tgttgtaagagcatcatctattcacctgtcgtgttaaggtcaggataacaaagtgtgcctnagtttctagaaatataactagcaatgaaggacaaaatgaaggaagaggaaatggagattg

SEQ ID NO: 23195 - DNA, 121 bp, Artificial Sequence
  Synthesized
  misc_feature (61): n=c or g
ggctttcaaaatctgctttgcattgctaatgcttggggctgtaggcaaagttgcattgganagacaaaggaagaagagatgcactacaaacctcttaagacataaaatgtcttgagggtgc

SEQ ID NO: 23196 - DNA, 121 bp, Artificial Sequence
  Synthesized
  misc_feature (61): n=a or g
cttgaggagctcaggccaaaggcagcatcgcacctacacctcaacctctacagccagcctntgacaccatggttctagaaataagaaagagaagaaggacaatgaggaggaggatatttga

SEQ ID NO: 23197 - DNA, 121 bp, Artificial Sequence
  Synthesized
  misc_feature (61): n=t or c
attcaagtgtagtatctgcctgtccttgtatcttcctggatagatgaggaagaaattcccngctgtttaaggacacaaaaaattaacaacctgctgttgattacatttgttaactctttcc

SEQ ID NO: 23198 - DNA, 121 bp, Artificial Sequence
  Synthesized
  misc_feature (61): n=a or g
gacagccgagggctccaagcatcttccaggcgtgctgcctgaccttgctcaatgcggtgcnacagaatctcagtcccatgtataaaacagtggcatgatttatcaaacctacttgtataaa

SEQ ID NO: 23199 - DNA, 121 bp, Artificial Sequence
  Synthesized
  misc_feature (61): n=t or c
aaattcttcaggcttcagtgtgtttacactagtaaaagaattcccattaactttaatggantttggatcctgcctttgcctattagttgctatatgatatctcaggagagattttgtgatg

SEQ ID NO: 23200 - DNA, 121 bp, Artificial Sequence
  Synthesized
  misc_feature (61): n=a or g
aaattcctgattagatattatgtactgatagttttctgaagattagtaattattcatactnctgaccacacatttcaattgttgaaaagtaatagaaacttgtaatctacaaagtcaaaca

SEQ ID NO: 23201 - DNA, 121 bp, Artificial Sequence
  Synthesized
  misc_feature (61): n=a or g
ttgcaaagcccgaggtgaggacaccgtgcaggagactgtcaagtctagaatttggactganacatttccaaaaaaagcaccacttgaagcaatgcaacaggatgcaataaatcagttggct

SEQ ID NO: 23202 - DNA, 121 bp, Artificial Sequence
  Synthesized
  misc_feature (61): n=t or c
cgtggggggatgctgcctaactttggggattgcatttcagccacctgacagaactgaacangtccatgggagacctcaacagcagccagaggactggaaagatccaccgtcccattcagga

SEQ ID NO: 23203 - DNA, 121 bp, Artificial Sequence
  Synthesized
  misc_feature (61): n=a or g
ttgtattccattaaatctatttttttttgtctggtgaaatccttaaaacaccaataaggcntggtagatgcatgagtaatgtcctctacctctctggtggacagacttagcttttatcatc

SEQ ID NO: 23204 - DNA, 121 bp, Artificial Sequence
  Synthesized
  misc_feature (61): n=a or g
aacagggtatgtcagacagatgacacaatcctcatcatgtagatgggagcaaggactgagnggtgtccttcatggcactacacgaggtcttatccctccaagctaaggcttcgggaactgt

SEQ ID NO: 23205 - DNA, 121 bp, Artificial Sequence
  Synthesized
  misc_feature (61): n=t or c
ctggcctggatggagggctgtgctgcccagctccatgctcatatcacaacactgacggcangcagagctccagcagtgcctcatctcctcatcaccaacgtggaagagacggagggccccc

SEQ ID NO: 23206 - DNA, 121 bp, Artificial Sequence
  Synthesized
  misc_feature (61): n=t or c
ctgcaggaagtactctatctagaaacaatgtaaggtctaaattacatcttggagctggaantttgtttttatagcacaacagaatccctatccatggacaaattgcattaacacttcaata

SEQ ID NO: 23207 - DNA, 121 bp, Artificial Sequence
  Synthesized
  misc_feature (61): n=t or g
catgccagctacactaccccttgatagctgtcatacatctattttcaactgcatatttagntgaattgtaaaaactacaaatacttacagatgtttgtcaaaaaactgcagtagtaaatta

SEQ ID NO: 23208 - DNA, 121 bp, Artificial Sequence
  Synthesized
  misc_feature (61): n=a or c
ttatactttgagaatgactactgaatatgcttgaacaaaatgtgttctatgcttatcggtntactttaccagccaatatttttaaccaagcaaaatgcatgactgcccagattcctgaaac

SEQ ID NO: 23209 - DNA, 121 bp, Artificial Sequence
  Synthesized
  misc_feature (61): n=a or c
ctctgctgtttgatgttttaagtgctgaactgaaccaaaatattatcttcgagaattaccntaagagtcatccctccgtgattttttctgttcctgcctctgggtccttagtgaattctgg

SEQ ID NO: 23210 - DNA, 121 bp, Artificial Sequence
  Synthesized
  misc_feature (61): n=t or c
ctgtcctagataaacctcaagggcgctttctttcgggctaagaggaaagagtaatatgtgngtgtctggatggccaggatcactggaagcatccgactgcccatcacaaccagaggaatcc

SEQ ID NO: 23211 - DNA, 121 bp, Artificial Sequence
  Synthesized
  misc_feature (61): n=a or t
ttaagtactgttgcattaaaagaaattcacatttgttttttatggtacatttcctcaaatnctttgaatcgactccacctacgagggacctccgatgtggctgaggcacagtctggccttg

SEQ ID NO: 23212 - DNA, 121 bp, Artificial Sequence
  Synthesized
  misc_feature (61): n=a or c
ggttgaaatatctttccaacatcatttgaatgaaatcagaaaatgtaaaattaaccttttnacactgcagtacaaatgtggatgtatcagaacctgtggtgtaaatactgaacttgtcttc

SEQ ID NO: 23213 - DNA, 121 bp, Artificial Sequence
  Synthesized
  misc_feature (61): n=a or g
aatggagagaagaggcttgggaagctttgttacagagcacatctgcgtgggctgagggccntgttcccctttctcttggtcactccttctgcagaagcaacagctgctggcatttggcata

SEQ ID NO: 23214 - DNA, 121 bp, Artificial Sequence
  Synthesized
  misc_feature (61): n=a or c
tcacacctgaattttcctaaaatagtttcccccttacctgcagcaacttacttttgcttcnttacctgtatttcaaaaatcattgctttcaaaagatttttttaagaccctagtgtactgt

SEQ ID NO: 23215 - DNA, 121 bp, Artificial Sequence
  Synthesized
  misc_feature (61): n=a or c
tctcaattgtatccaccagtgtaaaaggatagagggtgcttttcatttgtaaaatccatgnggagtcatcagtggagattatttaaaatcatttggggggggtttggttccctaaatatga

SEQ ID NO: 23216 - DNA, 121 bp, Artificial Sequence
  Synthesized
  misc_feature (61): n=a or g
caaatgagcttgcaaaacgagatggcagagtactcatgggagcctacttcactatgaagcngtgaaccagctcatattttttccaagcaattcagttcatgacaagagctttaaagaacct

SEQ ID NO: 23217 - DNA, 121 bp, Artificial Sequence
  Synthesized
  misc_feature (61): n=c or g
tttctgtcactgtcagcacataagccagaaagaatatcaaaaagagcagaagctggatcantggtttacctggaaaaccaaccaaaatgaatccagtcacataagtctggttatctgaagg

SEQ ID NO: 23218 - DNA, 121 bp, Artificial Sequence
  Synthesized
  misc_feature (61): n=a or g
aattcaagacattgactagaaaaccttactagatttctctttaaatgagactgtcaaacantgtcagagagtgcttctcccatatgtagctcagcctcaaacaagtggatgagatcttcat

SEQ ID NO: 23219 - DNA, 121 bp, Artificial Sequence
  Synthesized
  misc_feature (61): n=t or c
tttttttgtttgtttgttttttgctggaacatctgatgaatgcaacataggaaattcattnaccttctgagaagtcattggaattcaaaatatgtttagcaactctcttgctacctccagt

SEQ ID NO: 23220 - DNA, 121 bp, Artificial Sequence
  Synthesized
  misc_feature (61): n=t or c
agttatgtgggaacttcaccactagacgtacctatgcaatgtttaatttcagaagagcctngcaggtagacatttgcatgcattatcagaagagtgtttgctatactgcacttgaattgta

SEQ ID NO: 23221 - DNA, 121 bp, Artificial Sequence
  Synthesized
  misc_feature (61): n=a or g
gcaagatggattaagaactgattgaatggcaaatctcagaatattatgatcaacaacactnaatctgattggaggactctagctagtggtgtcacccaaggatctgtactgtggccggtct

SEQ ID NO: 23222 - DNA, 121 bp, Artificial Sequence
  Synthesized
  misc_feature (61): n=c or g
tcctgcactacagcagccaaaaattgctttttcattacatatttttaaatagccaagatancattgatactggtttggtggcagacttgaagataaagagttacgtgaactaagtgtataa

SEQ ID NO: 23223 - DNA, 121 bp, Artificial Sequence
  Synthesized
  misc_feature (61): n=a or g
tcatttgcatttggcaccaaagtacatagaacactcccagactgaacacagaagtaagacngtgtatctccagccttaaaactgagcagccaggtaattatttacagtcttatttagagga

SEQ ID NO: 23224 - DNA, 121 bp, Artificial Sequence
  Synthesized
  misc_feature (61): n=t or c
cagttacaagccctgatcactgagttgctaattaccctatggttcaccttttcttttagcngatccccatccaacctgggttacctttagagcagactgatatgtggtcatcattcaataa

SEQ ID NO: 23225 - DNA, 121 bp, Artificial Sequence
  Synthesized
  misc_feature (61): n=a or g
ttgtgaggtgcaatgagcacctgctttgtcccactggattgtgatgtggattaacggcccncagttctgaaaagctggagttccttgtattcccatgttaacattttagaatgtgtgggtt

SEQ ID NO: 23226 - DNA, 121 bp, Artificial Sequence
  Synthesized
  misc_feature (61): n=c or g
agaagtgatggcccagaacactggaatgctagaatcaggagtacagaaaaatgcagaattntgtgtaaattcaacgtcactgtgcactcaggtgtaatgagtactctcacctctgttgttt

SEQ ID NO: 23227 - DNA, 121 bp, Artificial Sequence
  Synthesized
  misc_feature (61): n=c or g
tgttttttaggacaataattttctcctggtcatagggatagtgttactgctagaagtgttnatagtgtaaagataacttgcaggctgctgggagcataattctttttcaaatgtgactcca

SEQ ID NO: 23228 - DNA, 121 bp, Artificial Sequence
  Synthesized
  misc_feature (61): n=a or t
attttgcagcaaagcatgactgccatgagaacataaaacaaatttttaaaagagaacaagncagctgattgtatccttgcctttgtaatgaatgcagtaggaatgaggctaagtagtatat

SEQ ID NO: 23229 - DNA, 121 bp, Artificial Sequence
  Synthesized
  misc_feature (61): n=a or g
attagggcagagtagagggggagattaacctctctccatctactggctattctatttttanttattaatgcaccccagggtaccattggtcttcttgaacactcttaagggcacacttctg

SEQ ID NO: 23230 - DNA, 121 bp, Artificial Sequence
  Synthesized
  misc_feature (61): n=a or g
acttgttcctccacatcctcgagaggcagcctgaccattgagctacggctgctctgagaangggctccctctctcctacaagatctgttttgtcctggttcagaatagggaaaacatcaaa

SEQ ID NO: 23231 - DNA, 121 bp, Artificial Sequence
  Synthesized
  misc_feature (61): n=a or g
ggagctgctattggaaagggccatgttaaaccctccgtttctggccgtctcacctgctctntcctggttctcagcagcttcccccaaggtacaggagaaggtcagggatcaggtccactcc

SEQ ID NO: 23232 - DNA, 121 bp, Artificial Sequence
  Synthesized
  misc_feature (61): n=c or g
caggcaggctatctgctcaggtatccctctctgaccctggtgcagagaagagagccactgnaagcacctgccatgggcacacctaacagctccagcactccccatcacccccacacaggcc

SEQ ID NO: 23233 - DNA, 121 bp, Artificial Sequence
  Synthesized
  misc_feature (61): n=a or g
ttaaacaaaaaatgtctgaaagatcaatcacacatagatatgatagtaacaggcagtgtanaaacactgcttatttctttttatcactgtatgaatttacttttatttcctctatctgtag

SEQ ID NO: 23234 - DNA, 121 bp, Artificial Sequence
  Synthesized
  misc_feature (61): n=c or g
tcaggcacattttgcatgcaatcctgtgagagtcttcagagggacaaggtgaggatatttnaagttttccttgatgtccgtggcattttgattgatgctgtgaatggtgatttcaatttat

SEQ ID NO: 23235 - DNA, 121 bp, Artificial Sequence
  Synthesized
  misc_feature (61): n=a or g
tgagcaagaccaaggtatcacttgaagtctgtcttagaagtgtggctgactgaggaacccncatatctgcagctcctccaaatgttgcttgcagggctctgggcttttacaggactagaac

SEQ ID NO: 23236 - DNA, 121 bp, Artificial Sequence
  Synthesized
  misc_feature (61): n=a or g
ttctatacatatatagaaacgggattttgctataaacagctcctaatgcaggtgaaaaccntgtattgattacttaaagaaagttaaaataaaagcaattttccccccatttccacacatt

SEQ ID NO: 23237 - DNA, 121 bp, Artificial Sequence
  Synthesized
  misc_feature (61): n=a or g
gaattgctgcagccaggatttgatcttgcatcagtctcaggaccacaaaggatctttaganctacagacagcttagagacgcttcccactctctgctgaagtttaaccaggcctcggtgag

SEQ ID NO: 23238 - DNA, 121 bp, Artificial Sequence
  Synthesized
  misc_feature (61): n=a or t
attagcccaacataccttctcgtgcctttggatctttgttgtcagactcacggagtatagngatggcagcaaatggccccataattaggccagacaaggtgggaaaggaagctggtgttaa

SEQ ID NO: 23239 - DNA, 121 bp, Artificial Sequence
  Synthesized
  misc_feature (61): n=a or g
tttgcaagttcatcgatccctttggcagataagcgtaggtagataataatagatggagatnttacatgcaaattctcatacctctgtcactgaagtcatccaccagcactatctctgctat

SEQ ID NO: 23240 - DNA, 121 bp, Artificial Sequence
  Synthesized
  misc_feature (61): n=a or g
aaattgctcagttagactcttctgcatcaaccatcagtatttcttccccagaactgcagtnacctgtctttagttctgtgcttcttccccacttccacgaagtcttgtatttcagtagcca

SEQ ID NO: 23241 - DNA, 121 bp, Artificial Sequence
  Synthesized
  misc_feature (61): n=a or g
tgcaagttacattatcaagttcaccggttctcatctattctaagcaagtaaatttacacangactttttatttacctacgagtatactttttttccagtatttattcagctatagtgtggt

SEQ ID NO: 23242 - DNA, 121 bp, Artificial Sequence
  Synthesized
  misc_feature (61): n=a or g
tcattctttgtttatttagttttacagttagtgatgtgtgaatatgttcaagatgtaggcncaatgtgttgaaaaggagtgtgcgaattggggagtacacactgggacatcacagcaaagc

SEQ ID NO: 23243 - DNA, 121 bp, Artificial Sequence
  Synthesized
  misc_feature (61): n=a or t
gtactagttcagtggaggatttacacacatcagctgtttatatcctcacattgtgtaagtntactaattaagataaaaagcaagatatgctatgattttgttaaaagtttgactctttttg

SEQ ID NO: 23244 - DNA, 121 bp, Artificial Sequence
  Synthesized
  misc_feature (61): n=t or c
atagtctgcttggactgaattcctcgcggtgcagcaaaacgggtccagcacttctttgctncccagtaaatattccttcacctctatttggtacaaaatgcaccactgcttctccttttca

SEQ ID NO: 23245 - DNA, 121 bp, Artificial Sequence
  Synthesized
  misc_feature (61): n=t or c
gagttttagcattttcaggatgaataatatacgtgtaagttatcctttcctctttccatcngtcatcctttctgcactaagttacgtgggtgtactaataaagcctttattagataaactg

SEQ ID NO: 23246 - DNA, 121 bp, Artificial Sequence
  Synthesized
  misc_feature (61): n=a or g
ctgtgcatttgctaagtgtgacttctgtatacgtttgtcagatttgtcattcacaatatgngatcatgtactctctcagattttaaagacggcatttaaaatataaaaagaaaaatatatg

SEQ ID NO: 23247 - DNA, 121 bp, Artificial Sequence
  Synthesized
  misc_feature (61): n=a or c
tgttttctaggtaagtacaacttggtaaattagtcatctaaaggagtctagatgacttagnccttgtgcaatgattaaaactgataaaagcaacaagattgcctgttaagccaaacagcaa

SEQ ID NO: 23248 - DNA, 121 bp, Artificial Sequence
  Synthesized
  misc_feature (61): n=a or g
agttctgactgcttcttactgagaaaaggatttgtttcaacaactttgaattaagactgtntcctatgtggagtaatgtatctactctgatccagatgtgaagtcctaaggagaaaaaata

SEQ ID NO: 23249 - DNA, 121 bp, Artificial Sequence
  Synthesized
  misc_feature (61): n=a or g
aaatgactatttatgatggtgaggaatgtagaccagtaaagaactgatttactacccactncaactttcaagatttcaaagacattcctgttccaccagaacctcaattactgggagactg

SEQ ID NO: 23250 - DNA, 121 bp, Artificial Sequence
  Synthesized
  misc_feature (61): n=a or g
acagcccagttctgaataaaaccttcacaaattttgcttgactcctgcaatccctatgggntacacctgctcccattgtactccaggtgaagtacatcaaaaacctctgtaaggacatcac

SEQ ID NO: 23251 - DNA, 121 bp, Artificial Sequence
  Synthesized
  misc_feature (61): n=a or g
aggcacagaggagcagcccatagggcacacagcccatgttctctgcattgcaatctcatcngacggcaagtacctggtacggtgactggatgctggtgctgtcccatggtgccacatgctg

SEQ ID NO: 23252 - DNA, 121 bp, Artificial Sequence
  Synthesized
  misc_feature (61): n=t or c
tatgttatgtatattgacaaagggtcaaaacactttcatctgttgaggattttgtctaaanttagactgattgataatactaaaaatcttatttaaatacagggaaaaaacagcttgaaag

SEQ ID NO: 23253 - DNA, 121 bp, Artificial Sequence
  Synthesized
  misc_feature (61): n=t or g
ggtctggatcactcaggatgtcccaagcactagatgagagaaagggcctagcgtctaggantcacttctaggagcttcagcgacacagtcagctatgcagcagctagggtagaatcaatct

SEQ ID NO: 23254 - DNA, 121 bp, Artificial Sequence
  Synthesized
  misc_feature (61): n=a or t
gcaagtctagaatcattaaggctggtaagtccgtcgagtccaaacaacaacccttgcctgngactgctctggactgtgtcactcagtataacatctacccttttgttgaacacctccagtc

SEQ ID NO: 23255 - DNA, 121 bp, Artificial Sequence
  Synthesized
  misc_feature (61): n=t or g
agttcactgatttggatgtatttaactcctgttcagtgcatgcctgaacctgaaccagccnaacagtgccctaaataggctactatgtaggtttgttctccaaatgcctcatgttgcagat

SEQ ID NO: 23256 - DNA, 121 bp, Artificial Sequence
  Synthesized
  misc_feature (61): n=c or g
aatgcattcttaattttatatcagcaaatgtcactgttgcttagctattgtttgtagaatntattgcattaaatggaagtatgtattttccatctttcataccttgatagtatgcacaaat

SEQ ID NO: 23257 - DNA, 121 bp, Artificial Sequence
  Synthesized
  misc_feature (61): n=a or g
tgaatgcccagggaagggcagcatgctacagatatcactcctggagctgtctggattcacnggctgcaagacaatgaggatccatggttgggtgctcaatggcctagaacatggcttcaaa

SEQ ID NO: 23258 - DNA, 121 bp, Artificial Sequence
  Synthesized
  misc_feature (61): n=a or g
atagaagtaataaagatgaattgttttgcgtgtaatttgacacagaaatgaaaagcaaccnctcctgctgactgtcagtatctcggtcccaacgctgctcgagaaaccagtgtcaggaaag

SEQ ID NO: 23259 - DNA, 121 bp, Artificial Sequence
  Synthesized
  misc_feature (61): n=a or c
tatactgtactttgggaagactagagagaagaaaaattttgattactctccaaagcactantgagcccttccttggcagtaacacatcccacttctgctgatgcgttaaaatggaacttga

SEQ ID NO: 23260 - DNA, 121 bp, Artificial Sequence
  Synthesized
  misc_feature (61): n=t or c
cagtttcagttctgccttctgctatatattcaatttatgctgatcacaaagctaacctgantttttcctcattttgtgaaagctctgtgtaacctacattccactaatatttagtactcca

SEQ ID NO: 23261 - DNA, 121 bp, Artificial Sequence
  Synthesized
  misc_feature (61): n=t or c
tgcctcctgatgcctatgcagaagcagatgaaatgagctggtaccatttgtctccaatcangttcaagcaaatcccacctttgaatcaaatgacctggagtcagggctggaaccccctggc

SEQ ID NO: 23262 - DNA, 121 bp, Artificial Sequence
  Synthesized
  misc_feature (61): n=a or g
ctatgtcatatataccatacatatagcattattcagaaatattggctttaaaagaaagacnactttagagattttcttctatcagggtagtggatgggatggttctacatgagcacttgtg

SEQ ID NO: 23263 - DNA, 121 bp, Artificial Sequence
  Synthesized
  misc_feature (61): n=t or g
agtatagatcattcagtcaatagctggaccttttttgtaagaggagggaatttattcaccntatctcataccctggaactgttcggttcaaccactgtgagtaaaatcctttctttagctt

SEQ ID NO: 23264 - DNA, 121 bp, Artificial Sequence
  Synthesized
  misc_feature (61): n=t or c
cattgtctaattagactcgattccactgtcaccaaggtttgtcgtctttggatatatatcntcacggttatcgtgttaaccaaattgtgtgcatttaagatactttacataggagataaat

SEQ ID NO: 23265 - DNA, 121 bp, Artificial Sequence
  Synthesized
  misc_feature (61): n=t or c
catctcgtggtggtgaagctatgttatttatgcttttcttgaatttttgagtctggaaatnattaaaaataaactgtagctgcagatagtcttgtcagtgcagtgcctttctacatctgtt

SEQ ID NO: 23266 - DNA, 121 bp, Artificial Sequence
  Synthesized
  misc_feature (61): n=a or g
aagagcttaatttagatggagcaaacaattctgtattttctttcctgtctcttcccaccancctaaacctcaatatttagcacgtgagaacacaaattttgtttgatgaaatcagctacaa

SEQ ID NO: 23267 - DNA, 121 bp, Artificial Sequence
  Synthesized
  misc_feature (61): n=a or g
gcaaattaaagactttctactgtaggattactgggtaacactgatgttcatacaaacacancaagggacaaattactcagataggtgcatatctaattattttcacttattcattcagcag

SEQ ID NO: 23268 - DNA, 121 bp, Artificial Sequence
  Synthesized
  misc_feature (61): n=a or g
gctatcacagcataactcagaaaatattaatgctaaatagtatttgacagagttttaatgntcagaggttattgtcacctgtgtatttgaaatggaagaagaaactgaaaagttgctaaac

SEQ ID NO: 23269 - DNA, 121 bp, Artificial Sequence
  Synthesized
  misc_feature (61): n=t or c
tttgttaaaaaggaagttggattaagcagttgataatgcagatcatgtattttaatttcantgagtctgattgttttccttatatctgttgatagaatcttctttccccgcagtggcgcat

SEQ ID NO: 23270 - DNA, 121 bp, Artificial Sequence
  Synthesized
  misc_feature (61): n=a or g
ctgagaaagaagagggagagagaaataagttatggaagctgctcttaactgttgatgcaangccagggaatggatcagtatggacagtgaatcgcttctctattctcttgaatctgtacat

SEQ ID NO: 23271 - DNA, 121 bp, Artificial Sequence
  Synthesized
  misc_feature (61): n=a or t
ctctaccttttttttttttggtactgaatattctttaataataagggaggtgagaatacanggagcccttccttctatttattgtctgtatttttgggtggggatgaagtgggattttctg

SEQ ID NO: 23272 - DNA, 121 bp, Artificial Sequence
  Synthesized
  misc_feature (61): n=t or c
tgaaaagaatactggcaatgctactgttatatgcagtttgtaggctctgatgctttcagangtatcaaggaagagcatttgcaggaaattggccttagtaacttgcctcccagctactcca

SEQ ID NO: 23273 - DNA, 121 bp, Artificial Sequence
  Synthesized
  misc_feature (61): n=a or g
tgtagtttgaaaatatacccctttgtggcagggcttaggtcattcattctataaagcagcncagtattggctaaatttttggagttatagtttaggagttgggttcttaaatgtaacaatc

SEQ ID NO: 23274 - DNA, 121 bp, Artificial Sequence
  Synthesized
  misc_feature (61): n=a or g
gttgcatgtaacgactacatgattaggtcctctgcatacacacatacacttacagcttatntcttgatgaaacacagcagtacctgtcagagccaatggccgttgtggctgtagccattta

SEQ ID NO: 23275 - DNA, 121 bp, Artificial Sequence
  Synthesized
  misc_feature (61): n=t or c
aaaaaaaaaagcatactataactgtaaaccataccaagtatctcatgcaccttctgattgnggagtaatagggacacagcttggtgcaacaagaatgagaaaatccacatgcattttattt

SEQ ID NO: 23276 - DNA, 121 bp, Artificial Sequence
  Synthesized
  misc_feature (61): n=c or g
acctttcaaatatgtttgataaggtctgcccagagcgtggatctgagcttgtggcagtgangtaggaaagggtgcttgcaaagatccaatgctttaaacaggaaggatgtactgaagctga

SEQ ID NO: 23277 - DNA, 121 bp, Artificial Sequence
  Synthesized
  misc_feature (61): n=t or c
agatcccatcacccatggcacagtgcaatcttcccctttgtgcatgagaatcactgagttncttgtgctcacgacctctctggtctgtctatacttacacctgcaaatacccttgagctgc

SEQ ID NO: 23278 - DNA, 121 bp, Artificial Sequence
  Synthesized
  misc_feature (61): n=a or g
gtgatgtaagtcctgcaatttcactgtctgcagaattcagattgacttttaactgaagccnctaaaaaggatgcactcttttacaggttctaagctgaatctcaattcattgtcagcgaaa

SEQ ID NO: 23279 - DNA, 121 bp, Artificial Sequence
  Synthesized
  misc_feature (61): n=t or g
tatgtgtttcttaggaacattttctggtggaggaaacaaaaatgagagagggggagagacngagagacttgatcttctactctttggtgtgctccatctacgctgtaaatggcattggtcc

SEQ ID NO: 23280 - DNA, 121 bp, Artificial Sequence
  Synthesized
  misc_feature (61): n=t or g
tgctgtcttgatatttacagtctggacaaggaagaataatagcttctgaagagctgtaaantataactaccctagcaggagctgctaggttcttgtgcgtgttcaaaagatgataaaaaaa

SEQ ID NO: 23281 - DNA, 121 bp, Artificial Sequence
  Synthesized
  misc_feature (61): n=a or g
aactgtacagcatcctctctgtaagtctgcaaataccctgtgtacaactcacaaagcctcntcactgcagattgtcaaggtcactacaatttaaagtgtcattttgcaaaacagagcttaa

SEQ ID NO: 23282 - DNA, 121 bp, Artificial Sequence
  Synthesized
  misc_feature (61): n=a or g
ggaaattatttgtagcttaatgtcagttagctcacaggactcttggactgactgcaaaccnctgcactggagttaatgcagaagtctctccagctgcaggtagaccacttgctgccttttt

SEQ ID NO: 23283 - DNA, 121 bp, Artificial Sequence
  Synthesized
  misc_feature (61): n=t or c
tctgttagtcattgtccatctcactgtttgagagtgggtgttaacaagatttctgtcaccnctacaggatatggtgtaaatgaaacaggccaaataactcttaaggcttcatgtggaggaa

SEQ ID NO: 23284 - DNA, 121 bp, Artificial Sequence
  Synthesized
  misc_feature (61): n=t or c
gcagggaatgggacttgtaatcgcccaggctttatcagagtacaacaggtaaaagataaangtctcttgttttcagatgcatgccaattgtgttccatttcaacatacttttttgagttaa

SEQ ID NO: 23285 - DNA, 121 bp, Artificial Sequence
  Synthesized
  misc_feature (61): n=a or g
agagaccttccttctatcagggcagaaagaagagcaggtgaccctggaaagcacgtgactntgacgaggagtttaatgtgccccagagcggtcggttccatagcaatgcctgctggggatg

SEQ ID NO: 23286 - DNA, 121 bp, Artificial Sequence
  Synthesized
  misc_feature (61): n=t or c
gattttatattgattaacaattatttttaacgtgtaaatgtgtattctttgtttttgctangtttcagtttggaatgtagcaggcaaagatagttaactatcatacagattacttaaaagt

SEQ ID NO: 23287 - DNA, 121 bp, Artificial Sequence
  Synthesized
  misc_feature (61): n=a or g
acttggcaagtattctatgcataatggaactgaaagagcataaacaatgcaaaatgatttnttaagggattaaaacaacctcaatttttgcaaggctcgctcccaaagtttctggcatcta

SEQ ID NO: 23288 - DNA, 121 bp, Artificial Sequence
  Synthesized
  misc_feature (61): n=t or c
ctatgtgctgcagggatggccatgaagacagcgtgaaacacacatgagagcagcggtcacnctgcttggacagagaggccggtggctttgtgggtttgtcttctttttttcatttctttgg

SEQ ID NO: 23289 - DNA, 121 bp, Artificial Sequence
  Synthesized
  misc_feature (61): n=t or c
ctcatttctaaaattgctgcatgtcccaccttggtgctggtgggagatctgaggcgttcgnacagtaattcctctgtaggctgagttgcagaaaggcaaggcagcatgaagaagacacgtc

SEQ ID NO: 23290 - DNA, 121 bp, Artificial Sequence
  Synthesized
  misc_feature (61): n=t or c
actgctgcaagtgatttcccttcatcccttcagaatgttaatgtcttgatactaatgatgnaactatatggccagagttgtctcagcccacctctggttgtctcccttggtttcctgctgc

SEQ ID NO: 23291 - DNA, 121 bp, Artificial Sequence
  Synthesized
  misc_feature (61): n=t or c
acttacgaaaaataaagtctgcagtatatattcaaagtacaggttcaaagctcacaacagnacacacaaattctagccatcctgaatatagataaaagcttgaaagacaagcaaatcttac

SEQ ID NO: 23292 - DNA, 121 bp, Artificial Sequence
  Synthesized
  misc_feature (61): n=a or g
tatatgtatatatattaaaataaaaagtagggaaaaagagcagcaaagaatgatcttgacnactcataaggccatgatattttgcagtcaatactgagtgtctatcaaacacatgttgatc

SEQ ID NO: 23293 - DNA, 121 bp, Artificial Sequence
  Synthesized
  misc_feature (61): n=a or g
gaggagaatttggaaactgatcttggacaattacttggtttatgagaactaagtcaggaangtataccagtgtaaattatacttcttaataactctacaaatgttattccagacaagcttt

SEQ ID NO: 23294 - DNA, 121 bp, Artificial Sequence
  Synthesized
  misc_feature (61): n=a or t
attctatctatttactgtgttctctgaagagtgatctatattgaatgcgtctgaaagctangagtgtgagggagagtgaagcccaatcagcatgtagtcatatatccatcaagtgcatgct

SEQ ID NO: 23295 - DNA, 121 bp, Artificial Sequence
  Synthesized
  misc_feature (61): n=c or g
atgataaaccagtcaggttcagaatccttactgaattaaaaaaacaaatctggcatccaanccactacatagtctgtagctattgtgcaaaactgaagtagcctttggtgatctaccaaaa

SEQ ID NO: 23296 - DNA, 121 bp, Artificial Sequence
  Synthesized
  misc_feature (61): n=t or c
gccacgcttaccaatataaagaaagcactatgctctaggacataaaacttctgtcatcacngagacctcactcactgggggctggttttattgttcccccaaatacctgttccactttttt

SEQ ID NO: 23297 - DNA, 121 bp, Artificial Sequence
  Synthesized
  misc_feature (61): n=a or t
cctgggtttggcttgagagaatgcacattaacagaaaaagacataataaaattttacatantctgattttggttgatcactttaacagctaagttagttgatgagtgtccctaggctccct

SEQ ID NO: 23298 - DNA, 121 bp, Artificial Sequence
  Synthesized
  misc_feature (61): n=a or t
gcaaatgtgtatcaggatgaaaatcagaaaatctaaacttagctgtcatcattaaagcaantattttgccgagactcatttggaagatgcaactgttaatgggagcgccacctgggtgcca

SEQ ID NO: 23299 - DNA, 121 bp, Artificial Sequence
  Synthesized
  misc_feature (61): n=t or c
gtgctgctattcctgtcctccttttcctttctgggagcagaaaaatctcacttcaaagccnggtggctcaaagggcccggctgtgccaggttggaaatgggttgagttatattgtctgggg

SEQ ID NO: 23300 - DNA, 121 bp, Artificial Sequence
  Synthesized
  misc_feature (61): n=t or c
gcaaatatataactacctacaaaaacaacaaagagaagagaagatgaaaggtgtatctaanaagaaagtgtaacttgcacaaatgtcatgccttcagcaaaaagtaatgcagaaaagtcat

SEQ ID NO: 23301 - DNA, 121 bp, Artificial Sequence
  Synthesized
  misc_feature (61): n=a or g
caacagtctaaaagtgtaacttttcctctagagaaatctgggaaagtagcagcaataggtngagatagttccctatggctgtcccttttcacagcttgttggcatttattcagcgccagcc

SEQ ID NO: 23302 - DNA, 121 bp, Artificial Sequence
  Synthesized
  misc_feature (61): n=c or g
ttctaagagtaagatgtaattcttattgcattctaagaataatttgcattttacataaaanacaaggcagtcattttaattctagcagacaaaccaatggtaattaaaagacaatgttcta

SEQ ID NO: 23303 - DNA, 121 bp, Artificial Sequence
  Synthesized
  misc_feature (61): n=t or c
tctgttgttctcctccactcttactgaaacactgaccctgactaacaacttgttatctgcngtgcatttcaggcagcactgcttcattcaggagctactgcatcttacacctgctgccaac

SEQ ID NO: 23304 - DNA, 121 bp, Artificial Sequence
  Synthesized
  misc_feature (61): n=t or c
aggtgtatcccagagaccttccaatcaaaattagaagatgtgtttttagaaagatgcgttntgagaggggagctttctgaatgcttgattgaaatcatctctgcatatctgtttcatcaaa

SEQ ID NO: 23305 - DNA, 121 bp, Artificial Sequence
  Synthesized
  misc_feature (61): n=a or g
gcaggctatgttacagtctattaaacgattcagtaatgaatctgaagccttgatttgcatnaggctacagacaacaattgttaaaactagcttctattaaggttaccaattgcctaaaagc

SEQ ID NO: 23306 - DNA, 121 bp, Artificial Sequence
  Synthesized
  misc_feature (61): n=t or c
ttctgctggttgtaacctttgaatggttacatagaaccactgctatgagctagtgcttcangttggttgtgttaatgagtggtatttatctcgtctgtagctgctcatcggaaaatatcag

SEQ ID NO: 23307 - DNA, 121 bp, Artificial Sequence
  Synthesized
  misc_feature (61): n=t or c
ctgtgctgggccgcatgcgacctacaggccatgggttggacataactgatttaagtcatgnaatggatgaaagactctgcagtcctgcattctgtttatcttctgcttatgacaatgtcta

SEQ ID NO: 23308 - DNA, 121 bp, Artificial Sequence
  Synthesized
  misc_feature (61): n=t or c
tggagtgtttacttttgttgtgtgttttgttttatttattaactagctaaatagaaggagngttccaccctgcagggtcgtctgtatattgcactataaaaagggctgtgataaaaaggtt

SEQ ID NO: 23309 - DNA, 121 bp, Artificial Sequence
  Synthesized
  misc_feature (61): n=t or c
atctatgtaatcagaatcttttttttatgaaattgcaaaacaaagggaagtcgctgaatangagaaacaattttagcaaatctttccctgttaattctctttcttctatgagagaaggctc

SEQ ID NO: 23310 - DNA, 121 bp, Artificial Sequence
  Synthesized
  misc_feature (61): n=a or g
cattatatttgtgttcaagactgagaacacagcaaatcacaaactgccactaagcaatcanaaaacaagcagtgtaatctgttacataatatatctctttagcttccctttacttatggaa

SEQ ID NO: 23311 - DNA, 121 bp, Artificial Sequence
  Synthesized
  misc_feature (61): n=a or g
aaagagaacagagaatcactaatttaaatccagatgcaacccctgcatctgactgctaagnactgcattcaatctgcatcagcagcaggtaacagcagcacagtgcatgctcacagagagc

SEQ ID NO: 23312 - DNA, 121 bp, Artificial Sequence
  Synthesized
  misc_feature (61): n=t or c
ggaatataactgagaagaactgacaaataggttaaataggtttttagtagtccaaacatgncagcattaaatattcagagtgagaagtgagctctcgggaacgcagatgactgtgtgtggc

SEQ ID NO: 23313 - DNA, 121 bp, Artificial Sequence
  Synthesized
  misc_feature (61): n=c or g
agaactgaatggaaaactgctgtatttgtgatatccaagaaatatcttgagaaattctcanaaaatttttttccagagctctttaaacttaatttgttgtgcatttgattcacttcagtac

SEQ ID NO: 23314 - DNA, 121 bp, Artificial Sequence
  Synthesized
  misc_feature (61): n=t or g
atagctcttctaggtttgcatgattcctggagcatctgtagctcaccaatagccctcccanagattctatagtttctggtattctgtaatctttccagcccacattctactgcagctcttt

SEQ ID NO: 23315 - DNA, 121 bp, Artificial Sequence
  Synthesized
  misc_feature (61): n=t or c
aaatgagaaaacacttgtgcttctctttttagaggctggcagctttgaaaaactagctttnttgtgaatatcagaaactttattgccttgccttgagtgacctcatttactagaatgaagt

SEQ ID NO: 23316 - DNA, 121 bp, Artificial Sequence
  Synthesized
  misc_feature (61): n=a or c
ccaatctgtagaaaacaaattccccagcagctcaggcagcattctgagttcactgaagaanaactaatctgagtttatctacaaaaaggacaaacaaaccagaataatatatctgtctcat

SEQ ID NO: 23317 - DNA, 121 bp, Artificial Sequence
  Synthesized
  misc_feature (61): n=t or c
tgggtacatacaactgaattactagcatttttttgtgctgccaatacctcttttttgaacngtgcatacatataaatggcctttgcaattcaagagattgatatttaggacttgtggtgtc

SEQ ID NO: 23318 - DNA, 121 bp, Artificial Sequence
  Synthesized
  misc_feature (61): n=a or g
tctggtaagaaactgaagcttaaggagcaaaagcaggaagaaaagctgtccaggtatgtgngccttggaattagcattgtgttcagagcctgggagctctcacactgcagctacagccctt

SEQ ID NO: 23319 - DNA, 121 bp, Artificial Sequence
  Synthesized
  misc_feature (61): n=t or g
agctcacttccaacacatggtttctaattcagcactatatagtcagtattcatgcactacntgataaagatctttagttaccataatttgacttatggccaacatgtgttagacagagagg

SEQ ID NO: 23320 - DNA, 121 bp, Artificial Sequence
  Synthesized
  misc_feature (61): n=a or g
cagatacagcggcacaccagtaatgtgcctagtctgatcactcacgtgctcatgatccacnacagtaagtgtggcaagaaacactcaataaggggtaataaaactgaaatttagtcccata

SEQ ID NO: 23321 - DNA, 121 bp, Artificial Sequence
  Synthesized
  misc_feature (61): n=t or c
tgacctgttagaggagatgagagaaagaactccgacattgtgcgatacgcagcacagtctngggggaaaacaagggcaaacctctcaaagcagctaagctggtcgtggtgtggtgcacaca

SEQ ID NO: 23322 - DNA, 121 bp, Artificial Sequence
  Synthesized
  misc_feature (61): n=a or g
tttgctacaggatggatttttagagtattttgttagtagccttcatttaatttggcataancttgaattactgaacttctgataaatgagctaaagacttggtatgttagtgcaggataat

SEQ ID NO: 23323 - DNA, 121 bp, Artificial Sequence
  Synthesized
  misc_feature (61): n=a or g
gtctttcactgtatagagctcccagattcccagggagagctgctgatatgtctgcccacanagctttcagatcaggaggaacaaaggatgaaccacatgtcagataaaacaccaggaaggg

SEQ ID NO: 23324 - DNA, 121 bp, Artificial Sequence
  Synthesized
  misc_feature (61): n=t or g
ttatacgtacaggtatgctctgatggaatgcacattttcatgtattattgctcagagaaanataaaagagatgctacaaatcattacatttgaaatgatgtgatgtatagtctcttataca

SEQ ID NO: 23325 - DNA, 121 bp, Artificial Sequence
  Synthesized
  misc_feature (61): n=t or c
ctcagcacatcctggtaaagtcaggctgagtgcacctgaatgcagcctgtctctgatcttngaacatggtagtactgaagccggttattactacctgcaaagccataaccactgcagttct

SEQ ID NO: 23326 - DNA, 121 bp, Artificial Sequence
  Synthesized
  misc_feature (61): n=a or g
atcaaaaccatgctcactgtatgctactttacatgtatagatttccctggataacagtctntttgactaaattttttggtataataacttgtcaagtgagtcttaaagttataaaggaaaa

SEQ ID NO: 23327 - DNA, 121 bp, Artificial Sequence
  Synthesized
  misc_feature (61): n=t or c
tctgtgtggaagggtccagacacccattattcttaaacttttccttcccttctgagcttcnttctagttacactgccaaccccatgggtcacacacagcagccatctaagcacagatctga

SEQ ID NO: 23328 - DNA, 121 bp, Artificial Sequence
  Synthesized
  misc_feature (61): n=t or c
gagatccctcaggtggcatttgctttatctcatgaactcagcttttcagatggtatgaaanggtgtcttttcgctcccgcatttgtttgcccagtgatgtcatccacattatcgcaaaggc

SEQ ID NO: 23329 - DNA, 121 bp, Artificial Sequence
  Synthesized
  misc_feature (61): n=t or c
gcctttgctcatctcaacagccatataaagtaatgcagcagcatgctgatcctctgtcagnactatcatgggtatcgtgacagagatgagaggaaggcaattactgtgttttaagaagcaa

SEQ ID NO: 23330 - DNA, 121 bp, Artificial Sequence
  Synthesized
  misc_feature (61): n=a or g
gttacaaatgtttttgcacagttttgtaataagaagaatgttctctaacaccccaagtagnaccaacaaaatgatgcacagcagtagtaatgccaaactgaggtgcctttctcctttctga

SEQ ID NO: 23331 - DNA, 121 bp, Artificial Sequence
  Synthesized
  misc_feature (61): n=a or g
aaaacaagtgttatgggtactaatgagaaacaactgctattctgcaaccacgagcactcgncacactggatcactgggacaaaaacagaagtctccactgaagaccatgacactgtagcaa

SEQ ID NO: 23332 - DNA, 121 bp, Artificial Sequence
  Synthesized
  misc_feature (61): n=a or g
ttttctcctcaacgttcctacagtcaatgtgtggtttgcttccatgatatcaaagaatganattttttagggtttgctcctaatccggcaaactttcccaacagtgaattccactaagctc

SEQ ID NO: 23333 - DNA, 121 bp, Artificial Sequence
  Synthesized
  misc_feature (61): n=a or g
gtgcattttccagagcgaagacaacaccctaaaaattgatgtcacacattacttcatccanctcactctgatcaaccagattggtccatgagaatgaaaagtctgagcaacatgctgcaga

SEQ ID NO: 23334 - DNA, 121 bp, Artificial Sequence
  Synthesized
  misc_feature (61): n=a or c
ccctgagaaaaaaggacaccactttctggttgttgccagttggttggaatgtctcctttgncagacagtaaatgactgcctctgaggtttgatatcaaaatagttattacatatatcaacc

SEQ ID NO: 23335 - DNA, 121 bp, Artificial Sequence
  Synthesized
  misc_feature (61): n=a or g
tggctgggtgccatgtttcaggggaggggtctggtgtgcattttgtgtctgggaggtaacngctgtcttaatgggctgagcaatttctgctggccttctacttgagatctgggctacgttc

SEQ ID NO: 23336 - DNA, 121 bp, Artificial Sequence
  Synthesized
  misc_feature (61): n=t or c
tcctcccacagagtttttcctttcacaacagctggagctgacctgggagaattctcattcncagcaagttggtctcatttcggtccagtggatgtggcagctcctgttgccctgtgccagg

SEQ ID NO: 23337 - DNA, 121 bp, Artificial Sequence
  Synthesized
  misc_feature (61): n=t or c
caaccaatgcaatggcccccaaaacacatgggaaaccaacagaaaatttacacaatacttngctcaaaatgggaaattttacttcctgatcctgcagattgtatctaacaatgcatatgaa

SEQ ID NO: 23338 - DNA, 121 bp, Artificial Sequence
  Synthesized
  misc_feature (61): n=a or g
aaaagcaaaattaaataaaaaatgttgatattttatacattacaatttctgtgcagtttgngtagactccttagcactgacaaatgctttggtgtttcaaaaaatataaacctgtttcaaa

SEQ ID NO: 23339 - DNA, 121 bp, Artificial Sequence
  Synthesized
  misc_feature (61): n=a or g
tgaaggcttgtgggcacacacacacacagtcaatttcttgagaattctttatcagattaangttcaaatcaaaagttactactaaacattttagtctaatggacaatacaacaaagaaatg

SEQ ID NO: 23340 - DNA, 121 bp, Artificial Sequence
  Synthesized
  misc_feature (61): n=t or c
gtgtatgtggttatctgaacattttgagaaattcaatactgcttttatatttaaactgacnctcagggttcaacaactaagcaaaaaatgcatgcgtttataaaagtattctgggacaaag

SEQ ID NO: 23341 - DNA, 121 bp, Artificial Sequence
  Synthesized
  misc_feature (61): n=a or c
caagacgcttactacaacaggcatgaaggacatcttatacaagcagcctgccaattgcttncaggaaatcaaacgtgagtattgtttcactgggtctctgagatagatgtcgttttctggt

SEQ ID NO: 23342 - DNA, 121 bp, Artificial Sequence
  Synthesized
  misc_feature (61): n=a or g
acttagaatatgtttaagggaaatgtcttaagtaacctaaaagtagctgagcagaaagagncctactggcaattacatgtcatcgataaataaagtaaaccccagatttctgtctcttaat

SEQ ID NO: 23343 - DNA, 121 bp, Artificial Sequence
  Synthesized
  misc_feature (61): n=a or t
gcaagaacatcaagttcagcatcaagggcacaagaacaatcatccagaggagctctctccngggagaaacactggtagtgagggacaaagttgcattgagcatccctgaaccagggattgc

SEQ ID NO: 23344 - DNA, 121 bp, Artificial Sequence
  Synthesized
  misc_feature (61): n=t or g
tctatttcctgttccttcttcctagctattcagagtgaatatgatttctttgttcccttanattagaatctctcatcatccaagacttctagcaagatgttttccctctttccccttcctc

SEQ ID NO: 23345 - DNA, 121 bp, Artificial Sequence
  Synthesized
  misc_feature (61): n=a or t
taggaaaagagctgattaagctaaagccagcactagcagaagtatagataagtacttttanattggagctggacttaggacacctcgaaacaagcagagcaaatgtgttctagaacattgt

SEQ ID NO: 23346 - DNA, 121 bp, Artificial Sequence
  Synthesized
  misc_feature (61): n=a or g
tcatacaagtgggaaaaaataatggattagatttcccagagattcaaagctgtcagctacnctgcccacagtgcccagtcacccttagagcttgatggtatgagagtgagggttttcaggg

SEQ ID NO: 23347 - DNA, 121 bp, Artificial Sequence
  Synthesized
  misc_feature (61): n=a or g
ggtagagtctagggtgaagtactataaaaccttgatctgaaggcacagctgttaatcttgnaaaaaatagccactttaattttatctgttattgcatggaatagaggttgctttatgttga

SEQ ID NO: 23348 - DNA, 121 bp, Artificial Sequence
  Synthesized
  misc_feature (61): n=a or g
ctcatttctggttcgatcagaagtaaatattgactcaggtgtaataattaactccgtgccncttaacataaccgcagatccacgtacaattaagtatatatgtgtatgtttttcaggttca

SEQ ID NO: 23349 - DNA, 121 bp, Artificial Sequence
  Synthesized
  misc_feature (61): n=t or c
tcattaaagctatactagaatagcaaagatacttatgtcaatttaataaggtagtagatanagatttctgtttccttgtttgaattctccctttttgatgctcttcgatatactatccttg

SEQ ID NO: 23350 - DNA, 121 bp, Artificial Sequence
  Synthesized
  misc_feature (61): n=t or c
tggtaagagaacatcttcagtaaatcttcttcttgtgaaccttacaaaaaaacatgcaagngttcagaccagcatgaggaagccatatacgaggacaaagggattgcacagatctcatcac

SEQ ID NO: 23351 - DNA, 121 bp, Artificial Sequence
  Synthesized
  misc_feature (61): n=a or g
aaaaaaactggcttctaaaaagccctctcatgagtcactaaaagagaacgatttactgaancaagagttctgaggactcctattatgataggtctgtgattcagtcacagaatcacagaat

SEQ ID NO: 23352 - DNA, 121 bp, Artificial Sequence
  Synthesized
  misc_feature (61): n=t or c
tggctcagttttgtggaggcgtaaagggttaattgtaaatttatcaccatctcacattctnaacacagtacatctttagctgttgaatctgatctacagggttgggaggccagtgagaaaa

SEQ ID NO: 23353 - DNA, 121 bp, Artificial Sequence
  Synthesized
  misc_feature (61): n=a or g
ttcagagtcactgaagtctgatcttgttctttcattgtttgcacagaaggagcaattaggnttagccagggccttagaagtcatgctctgacaagaattctcttgtagcccagatgtgctc

SEQ ID NO: 23354 - DNA, 121 bp, Artificial Sequence
  Synthesized
  misc_feature (61): n=t or c
gtttcttgtaacactcccataacctgtaaaacaatagggacaacagaaaacccaaaccagnaaccataaaatgcagaaaatcttataatgacataagctggcatcttataatgacgtagtt

SEQ ID NO: 23355 - DNA, 121 bp, Artificial Sequence
  Synthesized
  misc_feature (61): n=a or g
ctctagtactagttctagttcatacagtcccatgcttgcacttaggctggtgcttccattnttactttcactgttacaagaaaagtaattgtgatcaaaaccaaaattgtcttgcgctgac

SEQ ID NO: 23356 - DNA, 121 bp, Artificial Sequence
  Synthesized
  misc_feature (61): n=t or g
acctctgtgcccagctttgggacagtgagtgaagcctctttgcagaagaatggaggagcancccaggagctaccaggtccaggtgcaaggacagaacccaggcagatgccatgtgcatggc

SEQ ID NO: 23357 - DNA, 121 bp, Artificial Sequence
  Synthesized
  misc_feature (61): n=t or c
aaaaaaaaaaagcttagtactattctgaggctcactccacctcttctttacagtttttttntctcattaaattccattacctgaaaatgaaacagtattcttaaatttattgacttcagga

SEQ ID NO: 23358 - DNA, 121 bp, Artificial Sequence
  Synthesized
  misc_feature (61): n=t or c
gcgttcttaacaggattcaaggcagcttattttcattgcctacagagctgtcagggaacgngggcaggtaggaaatacttcagagaaccattagctaatgcttcttcagagcagcaaaggg

SEQ ID NO: 23359 - DNA, 121 bp, Artificial Sequence
  Synthesized
  misc_feature (61): n=t or c
aatgaatagctcaagtcaaatggtctctgtgacacagcacaatagcctattgtcttggctnccataaatcagcctctcacagcctgtgtttggagagccagatgttcattattaaacagtg

SEQ ID NO: 23360 - DNA, 121 bp, Artificial Sequence
  Synthesized
  misc_feature (61): n=a or t
gggctccgtgacatttctaggccagatctcctgcaatatacaagagttttattacatttangtttcgtatagattttctacatgctatcttctgggaagagggaatagaaaattagttcaa

SEQ ID NO: 23361 - DNA, 121 bp, Artificial Sequence
  Synthesized
  misc_feature (61): n=a or g
cttctgtgaatgctcagagaactgactgggatgtctctttacatagcatagcgtaattccntctaaagtttcattaggaaaaaaatacggaaacagtgagaaaaagaaatgaatcgatttt

SEQ ID NO: 23362 - DNA, 121 bp, Artificial Sequence
  Synthesized
  misc_feature (61): n=c or g
aggcaggaaaaaaaggatgaaaggaatggaaacaagcatttggaggtcacctctcgacctnaaagatgcacttcatagcagtgggacagattatctgaaaggtctgtttcacataaagtac

SEQ ID NO: 23363 - DNA, 121 bp, Artificial Sequence
  Synthesized
  misc_feature (61): n=a or g
agcataaagtgcagtaggcttaggtgagtgaaggcttagttcagctctgggtactgattgntaacagggtagctgcttgtgttccagtgagcttcgctgtgtacagtaagctatgcacctc

SEQ ID NO: 23364 - DNA, 121 bp, Artificial Sequence
  Synthesized
  misc_feature (61): n=a or g
ggtgtaattctgcatcacaattaaatgtcaaatattttaatacatgtataattgaagcagnaggaggaattagtgctttcggatgccattgggtttatgtctaacattttatttgaaacac

SEQ ID NO: 23365 - DNA, 121 bp, Artificial Sequence
  Synthesized
  misc_feature (61): n=a or g
ggatttttatttttgccaatacagataaatgtgttggcatatctattgctttcagcacacnctgtggctgagaggttggacagacgcattccagccagtgacgtgactaaactgcccaatg

SEQ ID NO: 23366 - DNA, 121 bp, Artificial Sequence
  Synthesized
  misc_feature (61): n=a or g
ctgtatgaaagaggaaacgttgacttaaagcaaacagacaaaccgttgtagccagagctcntcatcttatccgtgcactaaggagaaggaatgaggaagtttgatttgtgagcagggaaag

SEQ ID NO: 23367 - DNA, 121 bp, Artificial Sequence
  Synthesized
  misc_feature (61): n=t or c
ttatcactgccatgaagtcagtcacaaagcacacgtctgcatttacagaaacacaaactangggccacttataaactaagtagtagtctttactatggtcttgagaaaaatctttgctatg

SEQ ID NO: 23368 - DNA, 121 bp, Artificial Sequence
  Synthesized
  misc_feature (61): n=t or c
atgtatcagttcatcaaatgagaaaatacaacattaaagaggactgtctatgaccaagaanggcactcttgtctctataggaagaattatttgaaaaatatacacaatcagaatataaacc

SEQ ID NO: 23369 - DNA, 121 bp, Artificial Sequence
  Synthesized
  misc_feature (61): n=t or c
tgtctgtgaagtctgcagctcctgactggctctgcagagttgtgtttttgcaggttatggnctgggtgggatctccatctcagctcttcgtggagctaaagcgagccttccctgtgctcct

SEQ ID NO: 23370 - DNA, 121 bp, Artificial Sequence
  Synthesized
  misc_feature (61): n=t or c
ggaagtactcctgcaggcagctgccataggatcctctgcctttccaaagattcctgctgcncagagcagtgcatttggccactgaaagtcatactgtgcacctactgcaaatggaagcgca

SEQ ID NO: 23371 - DNA, 121 bp, Artificial Sequence
  Synthesized
  misc_feature (61): n=a or g
aatcaacaaaagtgcagggatttggtgtgtaaattcttcagatactaccagaagtctgggnaacaaagtatcacaacttatgtccttgattttctacaggaatgggtacatgtaacaaagc

SEQ ID NO: 23372 - DNA, 121 bp, Artificial Sequence
  Synthesized
  misc_feature (61): n=t or c
tttcatgttaattggtctaagaaccgggagatttcatgtgcttccttccatgagaaaaagnacatatgggggctttctttctgcacagcaaaatgtaacacccaaatgcactcggaagatt

SEQ ID NO: 23373 - DNA, 121 bp, Artificial Sequence
  Synthesized
  misc_feature (61): n=a or g
gtttgtgactgtgttgcttgtgcagtccctcatccctgtgggacagacctgttggtgtgcnggatgtgggtggttagagctgtacatctggcgtggtgcaggaggggattggctgcgtcac

SEQ ID NO: 23374 - DNA, 121 bp, Artificial Sequence
  Synthesized
  misc_feature (61): n=a or g
ctgagatgtgtagtattttaaatcagcgcaaattactttctagggtgaaagggctttccangggacttacctggttcactctctgtccaaaggttgaggaagtgtgagcatgagctctggc

SEQ ID NO: 23375 - DNA, 121 bp, Artificial Sequence
  Synthesized
  misc_feature (61): n=a or g
ggggccgtgctgtgcccattgcagccaggtgggatgtgctacgaccacgagttgtgtgctnggatggggcaaagcatacatgagcccctgcaagctgtgccgctcagcagctttgctgcat

SEQ ID NO: 23376 - DNA, 121 bp, Artificial Sequence
  Synthesized
  misc_feature (61): n=a or g
gaagacaacatatgcagaacagtcagtgcctttaaagtagtggtacaaagccttgcacaancacttcccagtggcagagaagacaagtttacttggttttactcccagacacttctgaaca

SEQ ID NO: 23377 - DNA, 121 bp, Artificial Sequence
  Synthesized
  misc_feature (61): n=a or g
tctgaacttattgaggcattcatgtttgttttcttaaatgcagggtagatcagcttgtttntcatataattgatttgacttctaagcaaggtgcagagctcaggtctggtccagcctagtt

SEQ ID NO: 23378 - DNA, 121 bp, Artificial Sequence
  Synthesized
  misc_feature (61): n=t or g
tacagtgctaatagaagcagatcaccaatctgatataccaaattccaatctgatctcccanatgcttaacattgtattgattagcctaagttggccaaggtagactgaatgttaaaagtaa

SEQ ID NO: 23379 - DNA, 121 bp, Artificial Sequence
  Synthesized
  misc_feature (61): n=a or g
agacagttgtgggtcaggcatgcaaaacagaccaggatgatgtcccaggagcagtcaaganggcagggcttattttaggtttaaacacaaaaggggaaaaaaataaattcacctcccacca

SEQ ID NO: 23380 - DNA, 121 bp, Artificial Sequence
  Synthesized
  misc_feature (61): n=t or c
gtgctacaaacccctgtgctactgctgtgcaaagtatatggcttaaggtgtgatctgtcanggccttaaccacggcaggccagaggcctttttttacagacctcatttacagaacataaag

SEQ ID NO: 23381 - DNA, 121 bp, Artificial Sequence
  Synthesized
  misc_feature (61): n=a or g
tgtggtctgacagactgctttcttctcctaagtgtattcttaatccagtctgtttatgggncttcgtgagtattgttgtacttatatggaagtcagagtctgaccacttttcatgtagtaa

SEQ ID NO: 23382 - DNA, 121 bp, Artificial Sequence
  Synthesized
  misc_feature (61): n=a or g
gtaaaataagaatgtcagcgattctattccttttaccaagcatatgatcaccctcactgcnatccgtgttccactgagatccagtttcatatttgctttgcttttgtgtcgctgctataag

SEQ ID NO: 23383 - DNA, 121 bp, Artificial Sequence
  Synthesized
  misc_feature (61): n=t or c
caactgctctactgagcacagccactcagctctctcctgcaagatggctgcggagtttgangcattcctgtccagtgaccagaggtgagttggggctgctgtgaaagtgaacttcttcttg

SEQ ID NO: 23384 - DNA, 121 bp, Artificial Sequence
  Synthesized
  misc_feature (61): n=t or c
gggctgtaattccaggcatggcactgcagccttgcctgtgaaggagagtacttcagatcanacatgcacaattctctacagttatatccataatgcagacatgctcttttgcttggcttac

SEQ ID NO: 23385 - DNA, 121 bp, Artificial Sequence
  Synthesized
  misc_feature (61): n=t or c
acataaaaactaaacttctctacaagtcctattgactcaggcacagatctaaatgattttntgtgtcaagaggaaaacaagtgggagaagcaaaggatgaattttacgagtaagataggca

SEQ ID NO: 23386 - DNA, 121 bp, Artificial Sequence
  Synthesized
  misc_feature (61): n=a or g
tgagatgaaaagccccctattggctgccaatatctgtgtattttttcatttggattatccntgcaggattcagaagacacagttggtccaggagaaatgtgtgcccagaaatacacatttg

SEQ ID NO: 23387 - DNA, 121 bp, Artificial Sequence
  Synthesized
  misc_feature (61): n=a or c
tcaggccccgttcttataacttacccagcgtattcccagtgagaacagatctcaccctttnactgttctactgtgctcacagttttcatgtgtttatcatgaagctaagcagaaacatgct

SEQ ID NO: 23388 - DNA, 121 bp, Artificial Sequence
  Synthesized
  misc_feature (61): n=t or g
ccttaaaacactgctatctcactcctttagaatgttacttagaggcaaatgctaataaatnagtttagtagagatgctttcaaacaaaatgcagggaaacttcactatttttcaaggaaaa

SEQ ID NO: 23389 - DNA, 121 bp, Artificial Sequence
  Synthesized
  misc_feature (61): n=a or g
tggacccgtctggctgagaggtaggaccctgggggtgagggctggatgtgagaccacagcnttacatacaagatgtcagagatgacctaatgctcattcaaaccctttgaaatgttttgaa

SEQ ID NO: 23390 - DNA, 121 bp, Artificial Sequence
  Synthesized
  misc_feature (61): n=t or c
ggacgctggtggaaactccccacctgcgaagtctaagcatgtcctcctgttttcctgggtntgtgctgctccttactctgttccagatctctctggcaagacactaccttcctgaaattgt

SEQ ID NO: 23391 - DNA, 121 bp, Artificial Sequence
  Synthesized
  misc_feature (61): n=a or g
gtgcaaatgggatatgacaagcgcatttaatggccttttattttccatcctaacgctgccntgtgtgcccaggtgtgttaatggtttatccggtaggcaactcgcatgcagtgagaattgg

SEQ ID NO: 23392 - DNA, 121 bp, Artificial Sequence
  Synthesized
  misc_feature (61): n=t or g
ccgttatggctgtgagtgtgttgaaaaaacaattattgtgtagttatgtatcagactgtcnaaagtatgactttctcagtgttcttgaaatttggacttctcaaatgactcaaaggatgga

SEQ ID NO: 23393 - DNA, 121 bp, Artificial Sequence
  Synthesized
  misc_feature (61): n=t or c
gagcttcttagaaggaaaagaaaatcgaacatacagcctgcactaatgcttcagggtaaanggatccaaaattatcttatttacaagctctttggctcagtgcttgcactgctcttggaaa

SEQ ID NO: 23394 - DNA, 121 bp, Artificial Sequence
  Synthesized
  misc_feature (61): n=t or c
tcctagcactttggaaagagcgtgatatttgagcttttcacctttagccaatttctagctngatagcacagagatatacctgcacttaattattatttgttcttccctatgctctactatg

SEQ ID NO: 23395 - DNA, 121 bp, Artificial Sequence
  Synthesized
  misc_feature (61): n=t or c
aataattctccccagttccaaattgttgtgaaatttcatttgcaccattacaatagattanttgtagaaaacagctacacagtgctttgcatacaactagattttatgctagtatgaatat

SEQ ID NO: 23396 - DNA, 121 bp, Artificial Sequence
  Synthesized
  misc_feature (61): n=a or g
aacacagcacagagatgagaatgggcacctgctgagcattgcagccccgagaattccagantgtgacccagaaaacacctctgatggttactgcttggctaagagatgcagagagaggccg

SEQ ID NO: 23397 - DNA, 121 bp, Artificial Sequence
  Synthesized
  misc_feature (61): n=a or g
tctcagacaaaaggcagaaatcagcagccagacaatggctcattaaatcatgcctcagtgnaaagttaaataaaggcaaatataatttgaaaaagtaattctaaaactgctttaatacatc

SEQ ID NO: 23398 - DNA, 121 bp, Artificial Sequence
  Synthesized
  misc_feature (61): n=a or g
gctgttaattttgacacaggtgaattattctggggccaacatttatggtaatctctcttgntgtcatctggaggccttcccactcaatatgtatgattgcttgctcaacatattctttcat

SEQ ID NO: 23399 - DNA, 121 bp, Artificial Sequence
  Synthesized
  misc_feature (61): n=a or g
tggctccattcacagctccttgtcattcaccctaactcagatcccaaggctgggagccaantggcacagaaaggttcaacgaatcgcagaacagcaccaggaaatgtcacgctcctggatg

SEQ ID NO: 23400 - DNA, 121 bp, Artificial Sequence
  Synthesized
  misc_feature (61): n=a or c
aagaaaaatgatacataccaaagaccaaaagaatgaaggaagactcactgcaaaagaactnatgtccccatcttacagttcatcaaacccattctaaaatggttcaaagtaagaaaaagtt

SEQ ID NO: 23401 - DNA, 121 bp, Artificial Sequence
  Synthesized
  misc_feature (61): n=t or c
caccgggttaatgcgtccatttccctctgtctgcaggagcggctgcaaggtgaagcagtangagacgccggcgctggtgctggatggctgtgctcaggtgggtgggagcaggcagggggtg

SEQ ID NO: 23402 - DNA, 121 bp, Artificial Sequence
  Synthesized
  misc_feature (61): n=a or g
tgtggcacagatcacatcactaaacagaacagtcttgataatactaacttctgctttattnttttagtgttcccgaggggttaggctttgtccttacagaagcatttaactttcagattca

SEQ ID NO: 23403 - DNA, 121 bp, Artificial Sequence
  Synthesized
  misc_feature (61): n=a or g
aggctggtgagaagtgatgctcttcactttatctataacaaagtggaatcgtgtactctcngcaagtttgcttgcagcaccaagctgagtggtgcaagtgatataattgaaagaagggatg

SEQ ID NO: 23404 - DNA, 121 bp, Artificial Sequence
  Synthesized
  misc_feature (61): n=a or g
aagacacatggaaaacacaacttgaagccccccacagctctccaggtaagagaaagaaatntatgaggtaagaaagaataaaacaaaaaacaacaaacagaaaaacacatagtggctcctg

SEQ ID NO: 23405 - DNA, 121 bp, Artificial Sequence
  Synthesized
  misc_feature (61): n=t or c
gattgttcctgcccattctattgttgcatagaatagtgctggatattggaactggagcacnggatttcaattaaaactgttaagtgacaaaccaataaaaattgcaagaaataattcacac

SEQ ID NO: 23406 - DNA, 121 bp, Artificial Sequence
  Synthesized
  misc_feature (61): n=a or g
aagcacggctgcatctcgcgaagcaaattcacaatgctgcacagtgcatctgctctacaangagccacatacaagcaaaggaacaaagccaaagcagtacaagtgagagaccagaagtaat

SEQ ID NO: 23407 - DNA, 121 bp, Artificial Sequence
  Synthesized
  misc_feature (61): n=t or c
cctgtttcatgtcactagcaaagatttttgctcactaaaaaataactgggaattcgctganacaggtaggcataagaaatatgaatcatatcttttcacagaaacagatatacagaatatg

SEQ ID NO: 23408 - DNA, 121 bp, Artificial Sequence
  Synthesized
  misc_feature (61): n=t or c
tggaggaaattctgttgtttaatgccaaatagaatagagcattcacatttgcaatcggccnagcataataatttctaatgcctgactccaaatagactgaagtataaagcctaacaaaagt

SEQ ID NO: 23409 - DNA, 121 bp, Artificial Sequence
  Synthesized
  misc_feature (61): n=t or g
cactctctcttgaattcaagcacatatgtatcctgagaaaaaactgctgatatgaaaatanaagtggaaagaaggaaaaaattacctatgaaaaaatgtagaagagtatcagaaaatactt

SEQ ID NO: 23410 - DNA, 121 bp, Artificial Sequence
  Synthesized
  misc_feature (61): n=a or g
accaaggccctatccacagccttgggcacctccaggcaatgcagcaaagcatccttgtatntgtttatagccacacagcatcccacagccctacagggttggatgtgcgtggttgctcatc

SEQ ID NO: 23411 - DNA, 121 bp, Artificial Sequence
  Synthesized
  misc_feature (61): n=a or g
tttgatctctgctgttgtttaagagagcaatatgaaactggtgcttccccagagaataatnaaaggattccattatattgtatcatttaccattttaaaagatcttgacaaattggagaaa

SEQ ID NO: 23412 - DNA, 121 bp, Artificial Sequence
  Synthesized
  misc_feature (61): n=a or g
tcctccattgtctccaccaagtgcttacacttttttcaagtgtgcaccgggacccagccancagaggggactgccagagagaaaacagtgattatcgttagccagattgcatttagtcttg

SEQ ID NO: 23413 - DNA, 121 bp, Artificial Sequence
  Synthesized
  misc_feature (61): n=c or g
aagaattccaggaatgactttttttccccctcttaaactagttgagacttcatctgttgtntcattggcttgcagtggagcattcaacttcatccaacaaaagcatagtgctgagatatca

SEQ ID NO: 23414 - DNA, 121 bp, Artificial Sequence
  Synthesized
  misc_feature (61): n=a or g
gaatttctcattccacatgaggaatcaagatttacttcaaggctgccaaatatgttacatnaagtctgggccactggattgtttgagatctttgccaagcttttcaatcaaggtttataca

SEQ ID NO: 23415 - DNA, 121 bp, Artificial Sequence
  Synthesized
  misc_feature (61): n=c or g
acagatagagaatacaggctctcccttgactagactaagtgccataatcagaagtcgtgtnctaacaaatatcaacctacatgtgagacatcaggcaaaactaatgagctgaggctaacaa

SEQ ID NO: 23416 - DNA, 121 bp, Artificial Sequence
  Synthesized
  misc_feature (61): n=t or c
tgtttccatacgttgtagcttttgctattggtaggctaaagactcctggtttaatgcatcngtacgtgctgtgttagacacagtcaacgtttttccaaaataaaggtgtttgtctttcact

SEQ ID NO: 23417 - DNA, 121 bp, Artificial Sequence
  Synthesized
  misc_feature (61): n=t or c
ggctgcaaacttcaaaacacattgtaccagctacaggagcccaatacacatccatgttgcntctagtagaacatacaagataagcaaaagacaccgtgagcagttttaggttcagacagga

SEQ ID NO: 23418 - DNA, 121 bp, Artificial Sequence
  Synthesized
  misc_feature (61): n=t or c
tcattttgaacagtgcatgatctttgactcttggcctcttggttagtcctgtgttataaanaagaaaatttcatgttgcagtgtattttggcatggttaatttgaaataccagaaattgga

SEQ ID NO: 23419 - DNA, 121 bp, Artificial Sequence
  Synthesized
  misc_feature (61): n=a or g
cagagggggaaaggagaagaagaaaatgcaagaagaagaaaaaatcttcactccattttangactgggaaaggcatttagtaataaagacatttctgtttagctaaaatgctctctttcgt

SEQ ID NO: 23420 - DNA, 121 bp, Artificial Sequence
  Synthesized
  misc_feature (61): n=a or g
aaaacaaaaaatctagctgccaagatatttttaggtgggataatactcctagtccagccancagttacagtccatgtcaaccttcctctgtttttaagataacaactgcatacccaaggga

SEQ ID NO: 23421 - DNA, 121 bp, Artificial Sequence
  Synthesized
  misc_feature (61): n=t or c
agtgaatgaaatgcactctcttcctgcttgatttaaaatgtcctcaatgatcctgcctgancacctgcatcacctcttcatacagactgtcagcttaaatgctttgaaggaaacactgaaa

SEQ ID NO: 23422 - DNA, 121 bp, Artificial Sequence
  Synthesized
  misc_feature (61): n=a or g
gaacactgtgactgatcctggggcagcacatctaatccgtgtcgcctgtgttaacttattncattgaatgtgagcatcttcctcccccagtgccttaaggagagcattcctagcttgcaga

SEQ ID NO: 23423 - DNA, 121 bp, Artificial Sequence
  Synthesized
  misc_feature (61): n=t or c
aaacccagaacccttcttacaaatgtgaaatatattgctctgctgtcaattgcatgtgctnttcttcagtgatctgtggaagatttagtggcaacccatcaccacagtacctgagaaggta

SEQ ID NO: 23424 - DNA, 121 bp, Artificial Sequence
  Synthesized
  misc_feature (61): n=t or c
gagctgcagggcaggctctttccatctgcagtggccaccacgaggtgctttgtattgccgnacataaggaaatacttctccctgtcccctccagcctagtctaggccaggcttaattctgg

SEQ ID NO: 23425 - DNA, 121 bp, Artificial Sequence
  Synthesized
  misc_feature (61): n=a or c
atgattctacatttcaaaccaaaacaccttccagtagcgcaggctgttgggtttatttttnggaacgtaatggaagagaatctacaagactcgaaatacaaatataccctaaaacttctca

SEQ ID NO: 23426 - DNA, 121 bp, Artificial Sequence
  Synthesized
  misc_feature (61): n=a or c
tcctgaacccctattcaaacaaaacaaaagagacgtgcaaaattttgtattcctaatattnatcatcctgtattgtcatctcaccttactcttatcccatcctgctcaaccatcctcaaga

SEQ ID NO: 23427 - DNA, 121 bp, Artificial Sequence
  Synthesized
  misc_feature (61): n=t or c
ggcttcttcacccttgcctcctgctcctggcaagcaagagttttgctggcaatgcagggangagcaccaaagccggctatggcccagcccaagccccaggcttagccccagcccagcctcc

SEQ ID NO: 23428 - DNA, 121 bp, Artificial Sequence
  Synthesized
  misc_feature (61): n=a or g
cacaaacatcatctagacccttgcagggacatttttctctggagcaatttgctcaaaaccnaatccaacccaactggacatttccaatgatggggcagccacaacttcaccgggcaacttg

SEQ ID NO: 23429 - DNA, 121 bp, Artificial Sequence
  Synthesized
  misc_feature (61): n=t or c
aaattctttttctagtgcctggtcatttaaaagcaggtgaagctcttgtttcaaaacaccngaggttgcagtgaccggagtctgtcattcggtgactaagtagaggcctgtattaaatggg

SEQ ID NO: 23430 - DNA, 121 bp, Artificial Sequence
  Synthesized
  misc_feature (61): n=a or t
ctttcctctactgcttggcttgtgcaagtctctcatttctctacctactttctgcctctcnttcccttaaagcgtgtcttttccaaaccgactgtgcacgtataggaaccgggccactatt

SEQ ID NO: 23431 - DNA, 121 bp, Artificial Sequence
  Synthesized
  misc_feature (61): n=a or g
agtgcaaagattcttcaactcagcagttcttgtttcctatttgcctcttacaaaggtgtgngtctcctacctgagtaaaaataactttcaaaattacttcttgaaagtgggtcaatgccac

SEQ ID NO: 23432 - DNA, 121 bp, Artificial Sequence
  Synthesized
  misc_feature (61): n=t or c
aatccctctacttcaattaaaatgagaacaataaacactgcaagagccagcagaagctttngtatgaatagggatttaggctttagcctgaaatgttgaagaaggtgttgattttcttcca

SEQ ID NO: 23433 - DNA, 121 bp, Artificial Sequence
  Synthesized
  misc_feature (61): n=a or g
cctgactcctgctccatggcagcaatgctttgcttgcaacgtcatttagcgaacagcaaantccaaacctgagcaaagccaccttccatgagcagcattaatcctttgtacctaacccaac

SEQ ID NO: 23434 - DNA, 121 bp, Artificial Sequence
  Synthesized
  misc_feature (61): n=t or c
ttgaacgctttggtgactactttgctgtaaaagcaataaactctcctcgctgctaattcanactgcgtggggtgtatacataatactgtaagagctgtgacatggcagcattttgcttcag

SEQ ID NO: 23435 - DNA, 121 bp, Artificial Sequence
  Synthesized
  misc_feature (61): n=a or g
gccctgtgaagctgtcagcgtgtcctgctgctgacatgtccctcctgtcacacgtgcagcntgatgctgaggtttgtgcgtgacttcctccttcatcacatgaataaataaacgttcccag

SEQ ID NO: 23436 - DNA, 121 bp, Artificial Sequence
  Synthesized
  misc_feature (61): n=a or g
agctttgggaagtgcttggccttgcagcaacctttcctatccaacctctgttcttcctgcntccctccccatctctgtgtgactttggcttcccacctgtctcagttgctcagtgtttata

SEQ ID NO: 23437 - DNA, 121 bp, Artificial Sequence
  Synthesized
  misc_feature (61): n=a or g
tagccactaacttacctggagataattgcaccagctgccaatctttgtaactcatattacnttccttgccattccaattgtatagctctggaaggctattttaatgccaaaatgctagtga

SEQ ID NO: 23438 - DNA, 121 bp, Artificial Sequence
  Synthesized
  misc_feature (61): n=a or g
gcagatgatgatgtactgccatcacgccatggctggtggtgccaagtcagtttaccaacanactggaatccctagatatctgaagtatattggttcctccaaaagtaatgcctcctattta

SEQ ID NO: 23439 - DNA, 121 bp, Artificial Sequence
  Synthesized
  misc_feature (61): n=a or g
tgtgagaatctcaaaagaaaggaagcaccttgaaacagacctgaatcaggtgttcttgagnaaagatttgctttgtccttctaatttcttttctgacttattttagccaggtacatgttaa

SEQ ID NO: 23440 - DNA, 121 bp, Artificial Sequence
  Synthesized
  misc_feature (61): n=t or c
ggtgtgggaaatgcattcattgtgacttgaggtggcctgagctcgctggcatctccgatcngttgcagacctcctgagctcagagaataaaaataaaataacaatgacaacaatccccgtg

SEQ ID NO: 23441 - DNA, 121 bp, Artificial Sequence
  Synthesized
  misc_feature (61): n=t or c
gaggcactgggctatggaacagtgtgaaccaaggcacacaaagctgggcctgtcccttccnctgctatcacttagttgccctaaaagctccatatacatatcatcctactacaacaaatat

SEQ ID NO: 23442 - DNA, 121 bp, Artificial Sequence
  Synthesized
  misc_feature (61): n=a or g
cagcaccggcacagtccattttagttaacaatcccatttcctcttcctgaatttctgttangagactggcacgtctccagctttctctctctatagtgcagcctacacatggaagtaaaaa

SEQ ID NO: 23443 - DNA, 121 bp, Artificial Sequence
  Synthesized
  misc_feature (61): n=a or g
agaagtgcagagatgatgccccgcagcatcatcatccagatctgcctcccgagtgcctttnctcagtgtggaacacccaactcttcatgtgaaagcaactgcttccaactgaaaagcactc

SEQ ID NO: 23444 - DNA, 121 bp, Artificial Sequence
  Synthesized
  misc_feature (61): n=t or c
atgagttcagccccctcatggtcccagacaagaactctagcagtaaaaggctccccaggancatcctaagactttgcacatcgctctgttgaggcatctactacctgtgttccctactgct

SEQ ID NO: 23445 - DNA, 121 bp, Artificial Sequence
  Synthesized
  misc_feature (61): n=t or c
gctaagctgttaggttgtaatgaatgatagattctttggtttcttcagccacctaaaattnacagcaagtaactggaagagattgctgcttactttgtgcccttgtttaatataacttatt

SEQ ID NO: 23446 - DNA, 121 bp, Artificial Sequence
  Synthesized
  misc_feature (61): n=a or g
ggctaccgtaccactaatatgcagctgcctctgaagttaaattcaacaacttttaatgatntgcagcagcttaaaacaagagctaaagatagagatgtccaattgaaatcacaagggagat

SEQ ID NO: 23447 - DNA, 121 bp, Artificial Sequence
  Synthesized
  misc_feature (61): n=a or g
actggacaatctatgtgaaaacattacttgattataaaactagctagacaactcacactancgccaagccagggtttctaaaattctgtgtgaatcagcactgggagctctgtcctttagt

SEQ ID NO: 23448 - DNA, 121 bp, Artificial Sequence
  Synthesized
  misc_feature (61): n=a or g
catatttagatacaaactgaaattctattcacccacagcaaaacactttcctttttcaaanatttgttttaagaagaccttcagtgtatctgctacgtaagaagagattatcaaattgaat

SEQ ID NO: 23449 - DNA, 121 bp, Artificial Sequence
  Synthesized
  misc_feature (61): n=t or c
tccataattcaagtctgaactgataggaacatgtctacgttaatactgtgagactcataangtacagtaaagcttatgataacatgatattatgtttttatactatcctcaaaagtgaaga

SEQ ID NO: 23450 - DNA, 121 bp, Artificial Sequence
  Synthesized
  misc_feature (61): n=a or g
tttagtgttttgtgacaacatttttctttgggtaacttcatggaattcactggttaggacnttaatcttggaacaaaactaaatatctctgcttgttacctaaataaagtagcaacaccag

SEQ ID NO: 23451 - DNA, 121 bp, Artificial Sequence
  Synthesized
  misc_feature (61): n=a or t
tactgaatctcatgaagataaaatcccagaagatcctgctgaaagaaagatgaggtatctngagtttgctttcatttaattttagcacttgtgtgtgaaaactggtcaaattcatgtgtca

SEQ ID NO: 23452 - DNA, 121 bp, Artificial Sequence
  Synthesized
  misc_feature (61): n=t or g
ctataatgctgtattgctacagagtccctgtgaagccaatagtcgtaccatagaatcatanactcacttagatgggaaaggaccataaagatcatctatctagttccaacccgttgccatg

SEQ ID NO: 23453 - DNA, 121 bp, Artificial Sequence
  Synthesized
  misc_feature (61): n=a or g
tcttgcaagtgtttatttgaatcattgtgacatgtgtcaaacgctggactctaaatgtgantgtttatcttagactagtttccccatatttcttagaacctgggctctttcattacccaag

SEQ ID NO: 23454 - DNA, 121 bp, Artificial Sequence
  Synthesized
  misc_feature (61): n=t or g
tgctctgtatagtaacaaagaaaggaaattatgcagggagagtgatttcacagcaacagangaaaatatttttgcttatctacctaatgattcattacaaagaataaggaaaaaaaaaaaa

SEQ ID NO: 23455 - DNA, 121 bp, Artificial Sequence
  Synthesized
  misc_feature (61): n=a or g
tccccactcctcctaaggttcattaggtaagtacattttacatattgtttgggaagacacnttgctttctattgattttgatgttgctgagctttgagtcaacagctagttctttatagac

SEQ ID NO: 23456 - DNA, 121 bp, Artificial Sequence
  Synthesized
  misc_feature (61): n=c or g
atttatgagtatactgtacttagaaaacaaagtccataaccaagaagacacgcctttaggnatacagggagctgatgttaataaagacaaataaaatcaagtggatctactccatgaagtt

SEQ ID NO: 23457 - DNA, 121 bp, Artificial Sequence
  Synthesized
  misc_feature (61): n=a or g
tttggtttgcacttctcatagagtaatcctagaataatacctggaagatgccttctaaacngctttagatataaggtactgtgacaaagcagagaccaacttaacaaacgttttgccaaag

SEQ ID NO: 23458 - DNA, 121 bp, Artificial Sequence
  Synthesized
  misc_feature (61): n=t or c
ataaaaacttctgcctctttgtttcatttatttcaaacccaacaaaaatgtcagctgcctncagaataaggaaacctaggagatttatcttggaagattgttcttctaaatgtgccttttt

SEQ ID NO: 23459 - DNA, 121 bp, Artificial Sequence
  Synthesized
  misc_feature (61): n=t or c
ttttttatgccctggaattaaataaatccactttggtcatccctcatcatgcagtagcatnctgaatgcatttaataagcttcccttttagcccttgattgaaagcagtgctttcttatgc

SEQ ID NO: 23460 - DNA, 121 bp, Artificial Sequence
  Synthesized
  misc_feature (61): n=a or g
ccatgttcatgcatcatgccatctgcaccatgaaacagaagtcattttgtctgcatagtancagacaaagtactgactactagcgttaaaaccaaggtgttccttgaagaaaaaaaaaaaa

SEQ ID NO: 23461 - DNA, 121 bp, Artificial Sequence
  Synthesized
  misc_feature (61): n=a or g
agaagcttgaccagcatatagctgtgcattcagacatatttccaattgcagttatttttcntcatttgaagttccagttgcatattctgaatgtaaggataggtttaaaaaataactaaaa

SEQ ID NO: 23462 - DNA, 121 bp, Artificial Sequence
  Synthesized
  misc_feature (61): n=t or g
aatgtgtaaagagttgcttggttaacaatgggcaatagaacaatatattgccaaataaatnttttcttagcttagccaaatctccaaatctataatgataactagtcctttttctggtggg

SEQ ID NO: 23463 - DNA, 121 bp, Artificial Sequence
  Synthesized
  misc_feature (61): n=t or g
ttttctgatcaatacagtagacagaaagatttcataaaaagtgagcagatctgagagtatnttttacagagatcatgtcaaattttagaaagacaatctgctgcctttgtgccttgtttcc

SEQ ID NO: 23464 - DNA, 121 bp, Artificial Sequence
  Synthesized
  misc_feature (61): n=t or c
gtgcttgcagtgcacatcttgctccccattgggatccctggtacaagatgctgttgggaancatttcgtacagaagaaagcagactcactaatctttcctgctctttttctgttaattata

SEQ ID NO: 23465 - DNA, 121 bp, Artificial Sequence
  Synthesized
  misc_feature (61): n=a or g
aaggctaataattctgatcgtatggtgaaattggctgctcctgatttctgagctctctggngctgtattttaatttgtacctttttggacttgctgcactgaatgacgctgaggtgtgtta

SEQ ID NO: 23466 - DNA, 121 bp, Artificial Sequence
  Synthesized
  misc_feature (61): n=a or g
gtcccaggctgtcacttctgctttgccatctctttctgtgggagagaaatctggttgtacncagcaaactatagttatcttttaattaaatgagctgctggtgagagaaagcaaaacgggt

SEQ ID NO: 23467 - DNA, 121 bp, Artificial Sequence
  Synthesized
  misc_feature (61): n=a or t
agctactcaacattgacaaggatgttcagaaaggctggaaaacatctgagttggcttcctnccatcgatcctacctgtagttctatgtatagattttaagtggactttctaagaatattca

SEQ ID NO: 23468 - DNA, 121 bp, Artificial Sequence
  Synthesized
  misc_feature (61): n=a or g
tcatagttccctgtagcatctcttctttgggctgcgcatgtgtaggttttcattgactgcngacacagcaactgatgatttctgactgcagaccaagctcagttttttttcttcatactgc

SEQ ID NO: 23469 - DNA, 121 bp, Artificial Sequence
  Synthesized
  misc_feature (61): n=a or c
ttaaaggctcacaaggatggcaaccttcggatctgccaagagtctgtgaaagaaaaaagcntgtggttacaaataaaaatcataataagaaatttcacttaatatggatgactcccagttc

SEQ ID NO: 23470 - DNA, 121 bp, Artificial Sequence
  Synthesized
  misc_feature (61): n=c or g
ttcactgatagagcgtttgttcagagaagcaatttattggcaacagtgcacaggttggagnttccagagataacagattttgaatggtcactgcctggatgttacaactttctctgttgca

SEQ ID NO: 23471 - DNA, 121 bp, Artificial Sequence
  Synthesized
  misc_feature (61): n=a or g
ctcttaaatctatgtgctttccttactgaagtactcaagatatggcctaatgctcagtgtnttttagtctaaaagctcaataccatttgatttggtatctgggtgagaagatcaggcctgc

SEQ ID NO: 23472 - DNA, 121 bp, Artificial Sequence
  Synthesized
  misc_feature (61): n=t or c
gaaatatagaatctacaggctctagtgctaagtcctgtatcaggtgggagcagtgcagctnataggagatgggatgaagcttttcctacttccactgcatagattctctttcctctgccat

SEQ ID NO: 23473 - DNA, 121 bp, Artificial Sequence
  Synthesized
  misc_feature (61): n=a or c
ctttcacattattcaaaaaacaagtgaaaaaaagagtaccaccgccttttggctccacatnaagaaataaagagctgtctaactattccttatacatcgcttagtaaagctacacaacttg

SEQ ID NO: 23474 - DNA, 121 bp, Artificial Sequence
  Synthesized
  misc_feature (61): n=t or c
tcctgattaccccaattttcttgtctctcttattggctgaggatggttttcctccaccgangcaggaaagcaaggtcaaaccagtcctacatctgagagtataaacgatgaagttcaaaga

SEQ ID NO: 23475 - DNA, 121 bp, Artificial Sequence
  Synthesized
  misc_feature (61): n=t or c
ctcagtgcacaccttctggtagtaactgcctctcattcttctgaggacaacttaacagacnctcaaaaacagtattgtggtttgagagattattgtattattattattattacagggattc

SEQ ID NO: 23476 - DNA, 121 bp, Artificial Sequence
  Synthesized
  misc_feature (61): n=t or c
attctcccctaaatttatctgaacctgaagactgccatcccattgcttacttagccctcgnggtctgatatctaacatcaaaatccactctgtggtttactgaatcagagcaccaaattac

SEQ ID NO: 23477 - DNA, 121 bp, Artificial Sequence
  Synthesized
  misc_feature (61): n=t or c
tgcctgaggactctgctgatacacagcctttatgatgctgaaggcttcctgcaagatagcngtgtttttaaatgctggctggaaagaatctgttcagcttgtctggctgggctgcgtcatg

SEQ ID NO: 23478 - DNA, 121 bp, Artificial Sequence
  Synthesized
  misc_feature (61): n=a or g
acttcagatttgttaagatcattttacactgtctctcatgctaccttgaacataattttcnactagacttgacttgttgcacaaagacttcccaggtagccttttcctcaggtagtacagt

SEQ ID NO: 23479 - DNA, 121 bp, Artificial Sequence
  Synthesized
  misc_feature (61): n=t or c
gtctccccatctcatgcttgcctgctcatattgctcatcaggtcttccatggagccacagngcaatagcacacatgggacaactcaaggactatcattgtaattaaaatccccatcagtgc

SEQ ID NO: 23480 - DNA, 121 bp, Artificial Sequence
  Synthesized
  misc_feature (61): n=c or g
acttttgtggccactgagcagcatgttgggctcaatgcacacaggatcacaagtagcatcntactggtcaactaccttccttcctggccagcatgtgcacacaacactgaacactgggatg

SEQ ID NO: 23481 - DNA, 121 bp, Artificial Sequence
  Synthesized
  misc_feature (61): n=a or g
ccatgtcagggctctcttacagtgtactgcatccaaatgctgagcctctctgcttcttttngagaacttttttttatggcgccagtggggctgctgtctataaaagacaactgattttcca

SEQ ID NO: 23482 - DNA, 121 bp, Artificial Sequence
  Synthesized
  misc_feature (61): n=t or c
caacagcttacaaattattattaaaatagaacagaaaaagacctgttggcctccacagcgnactcattgatatgctgtgggaaagcacaaacacagcgctgttgtggtgtctgtcctcact

SEQ ID NO: 23483 - DNA, 121 bp, Artificial Sequence
  Synthesized
  misc_feature (61): n=a or g
ggatgggaataaaaatttgctgggcaaagcacgatgaaggaacttttgtataagatctaancctgcatatatacatgtacacgtggactgacaattgtactgcaattccgtatttataaat

SEQ ID NO: 23484 - DNA, 121 bp, Artificial Sequence
  Synthesized
  misc_feature (61): n=a or g
gagggttcaggcgtagtgagaaggtggtttgtgagcaggagagtacaaataaggcctttgnggccaacattgtgttgctgctgtggtttgtttcagtgtttaatatttgtaaacaacaaaa

SEQ ID NO: 23485 - DNA, 121 bp, Artificial Sequence
  Synthesized
  misc_feature (61): n=t or c
ttgcaagtaactgaatgattacccagctaaggaacaactggtgtttaaagaactctacatnaaaattacaggtaagggataactaaggataactctgcattataattagaaatgcaatacc

SEQ ID NO: 23486 - DNA, 121 bp, Artificial Sequence
  Synthesized
  misc_feature (61): n=a or g
tttatttttataaagtagaagcgaactgctgtaccagatgtggtctatctcatcaaggtantactctccttgaattgaatattaacacagatgttaaaaagctactcacacagtggggagc

SEQ ID NO: 23487 - DNA, 121 bp, Artificial Sequence
  Synthesized
  misc_feature (61): n=t or c
gaaacaaaaagcatccgtagatttacaaataaagttaaagacctctaagaaaagtagccanatcatccgttttagagaactcctgccatccacatgaggtgtgatgcactgtttcactcct

SEQ ID NO: 23488 - DNA, 121 bp, Artificial Sequence
  Synthesized
  misc_feature (61): n=a or g
gaaaaggctgtacacccagaaggaaccaaacacacatttattctacccagacagaagcctngaatgagcgtatgtcaagccaacttaatgttttaaccatctaaccctcttgctgctccat

SEQ ID NO: 23489 - DNA, 121 bp, Artificial Sequence
  Synthesized
  misc_feature (61): n=t or c
catgaaagtggtacattgattaccatcatggaatttgttggcttccctaagtaacaatatnagctgtaagactctgctagtgaaagctgttggtactttaaggggagcagttttcatgtga

SEQ ID NO: 23490 - DNA, 121 bp, Artificial Sequence
  Synthesized
  misc_feature (61): n=a or g
cagtgcaaagaaaagaataagaggaatggatagtaatgtcatggcttgcaactaagtggtnctgcaacacctttgttcactttctgctaatggccttaattggttccttctgtaccaccag

SEQ ID NO: 23491 - DNA, 121 bp, Artificial Sequence
  Synthesized
  misc_feature (61): n=t or c
tttgttcttcctcttcgtctaattttcttgatgaacacaatgttatgtggtagaatatccngctattgcccagcatcctggcggcattcacgcccaaatttgaggaatttcagccacaaat

SEQ ID NO: 23492 - DNA, 121 bp, Artificial Sequence
  Synthesized
  misc_feature (61): n=t or c
agaacagtgagggaggataatgtgaaaacacataagtagatctggagggatgagcttgagnttggcacgaagctagaactagcaaagctgactggttcctgcagggccacttaattatctt

SEQ ID NO: 23493 - DNA, 121 bp, Artificial Sequence
  Synthesized
  misc_feature (61): n=a or g
gttgattatacatctagtaatacaagtcttttcagattacgacaccagatgggaaccctcncccttatggctttacaggctataacagcaaatttttctccttgcactcttgtgccatttc

SEQ ID NO: 23494 - DNA, 121 bp, Artificial Sequence
  Synthesized
  misc_feature (61): n=t or c
tgggtgtctgtaaagtgggttaatgcaagtaggatttcgtccagcaggtggcatgaaaaanccagtgtgtacctgtgtactctgtgtatccctttagtatggctgctgttaggtttataat

SEQ ID NO: 23495 - DNA, 121 bp, Artificial Sequence
  Synthesized
  misc_feature (61): n=t or c
tttcttctagagggaaagaggataactccatatgcaagaacattgctttattcaaattttngttacttgacaacgttaagtgtttgtaatttgactacaaaaaagtatagggtagtaagag

SEQ ID NO: 23496 - DNA, 121 bp, Artificial Sequence
  Synthesized
  misc_feature (61): n=a or g
tactgtttcttatgctatccaggctagtgggggaaagcactcatttgctgcataaaacaangcacaccttctccagcagatacaaagctgatgtgcatatactttccaaataaagatgggc

SEQ ID NO: 23497 - DNA, 121 bp, Artificial Sequence
  Synthesized
  misc_feature (61): n=t or c
tggtgtgcttactagggtgaggtgctttggattgtgctggttctggacatcccacatctgngaaggagagactgtcaggccttaggaatggtcttttcctaggcagcttctaccttgaatg

SEQ ID NO: 23498 - DNA, 121 bp, Artificial Sequence
  Synthesized
  misc_feature (61): n=c or g
aaagaatagaggaagcattgagagacagaacacaggtagagctttcgtcttgtacgactgntttgtcactacagcctgaaacatttcatgccaaggggggtttgtctgtgctccactgagc

SEQ ID NO: 23499 - DNA, 121 bp, Artificial Sequence
  Synthesized
  misc_feature (61): n=a or g
aaaaatctgtaacagaaacactgagaaaatgcccctcacaggctatgttgtcacacaggantgtataaagaaggctcaactactgccatttgattctagcgacaatcaggcttttattgct

SEQ ID NO: 23500 - DNA, 121 bp, Artificial Sequence
  Synthesized
  misc_feature (61): n=a or g
ggataacggcatggtcaagaagaaaggcctggcatgtcccacagaagcagtacttacccangtgaaataattcactttgactgaggcacgttttagtcacataaagaaagaggacaattac

SEQ ID NO: 23501 - DNA, 121 bp, Artificial Sequence
  Synthesized
  misc_feature (61): n=t or c
cctgatctcccatggagatagaagggactgcttaaagtttctctgaccttttaacctcttngtcttcaggatctagagatactggaggccttgaagtatgtgaattataagagttttcagt

SEQ ID NO: 23502 - DNA, 121 bp, Artificial Sequence
  Synthesized
  misc_feature (61): n=a or g
attagatgctgaagaaacaagtgaattcctttgctaccatgggcagtggcagtcagggcantagcttgctctgctctatctagctggagacaaacagttataagatctgaatacacctatc

SEQ ID NO: 23503 - DNA, 121 bp, Artificial Sequence
  Synthesized
  misc_feature (61): n=a or g
acttagtgcctgcaatctttataaacaaaatgttatagatgataaaaaagctgaatgaatnctagactgcaaaacacacaacatattataagtttaggtggcttatgacagctttaaaggt

SEQ ID NO: 23504 - DNA, 121 bp, Artificial Sequence
  Synthesized
  misc_feature (61): n=a or c
cggttcaataaaaagttacctgcccaaaaattgaagacccagcattagcatcatctaaccnagcaacacccataacagagctcagcctttgctttatgctgtcttctcttcatttctacaa

SEQ ID NO: 23505 - DNA, 121 bp, Artificial Sequence
  Synthesized
  misc_feature (61): n=a or c
attttccctctccctcctcccatcctatgtcataaaatcagagcctggaactcactaaacnaagtatcagtattatgaatttaataacgttcagaaagggactgtatgaatatgcataatt

SEQ ID NO: 23506 - DNA, 121 bp, Artificial Sequence
  Synthesized
  misc_feature (61): n=t or c
tactctggaattcatgaattcaaggattagaaccacaaagtcaatttccttatttttcttnctctgttttcccctggcagggcaatgtaaatgggacttcaccccatccccacctcctgac

SEQ ID NO: 23507 - DNA, 121 bp, Artificial Sequence
  Synthesized
  misc_feature (61): n=t or c
aaaatttcctgaattttgacttcttcagttttgcatttgaatttgtggatttttatgccangcgtgtctttggtgtctgttcgttcttttgaggaaaaggagagctacagcttaacttctt

SEQ ID NO: 23508 - DNA, 121 bp, Artificial Sequence
  Synthesized
  misc_feature (61): n=a or c
agtgggatgtggcacagtcaccagaaactctcaggctgtgggcagggggatcagaaacacntttctgcttgtgctgcctacaagaagagattttgccatggctcaaaccttgtgaggcacc

SEQ ID NO: 23509 - DNA, 121 bp, Artificial Sequence
  Synthesized
  misc_feature (61): n=a or t
aattcccatggagaagaataacatgtaagagcctcattagacgaacagttagaggtattangtcctagtgtttcctcaagcagggaaaaactaaacacactaactgacatatgtaaatgtt

SEQ ID NO: 23510 - DNA, 121 bp, Artificial Sequence
  Synthesized
  misc_feature (61): n=a or c
tgcttactttctttgaagtatttttatgaattttgttcaggctttgtgtgcttaaaatagnttaaactaacatgttggatgagagcaagtcaaaaatggctgcaagcttttaacagtagac

SEQ ID NO: 23511 - DNA, 121 bp, Artificial Sequence
  Synthesized
  misc_feature (61): n=a or g
gcttgccccctactgaagagtggctggaagcaacccacacttccacagcttctccagtggnaaaacagcagcagaatagcagcatcactgctctcactgcagagcgttgtgcctgtctatc

SEQ ID NO: 23512 - DNA, 121 bp, Artificial Sequence
  Synthesized
  misc_feature (61): n=a or g
ctcaatctcaatactttagatttttagacaacagcagagattacgggtataacataacttntcctaagtgcactgttagcaaccttccagaataaaagacgttcaaaatacaaatttccaa

SEQ ID NO: 23513 - DNA, 121 bp, Artificial Sequence
  Synthesized
  misc_feature (61): n=t or c
gaagtgtttgtctgaggggttaagtctcctgttatctgtggatagagattacccaaattanaccgaaaatcttcagttcagaagcttggttgattccaaacactgttttgcagctgttcag

SEQ ID NO: 23514 - DNA, 121 bp, Artificial Sequence
  Synthesized
  misc_feature (61): n=a or g
cttcaagtaactattctgaccaagataagtgtttaaaacttcaggaaattctattattganaaattgtcaatgctccagtcagggactattggccgtttatcttttaactactggtgtatt

SEQ ID NO: 23515 - DNA, 121 bp, Artificial Sequence
  Synthesized
  misc_feature (61): n=t or c
gtgtaacgcatttgactcgagaattactcaaaaagcatcatcccgtgtattttccattacncgatgcagttggaagttatgttgtagatgcttagcaagctgtaagggagctagttgttaa

SEQ ID NO: 23516 - DNA, 121 bp, Artificial Sequence
  Synthesized
  misc_feature (61): n=t or c
acaaaaaaacaaaacacacacacaaaacatcttttacaagcagaccattgactctcctgcnttgaattgtggaaacactaattactaccaaactgtccttttgcaaataagcctagttctg

SEQ ID NO: 23517 - DNA, 121 bp, Artificial Sequence
  Synthesized
  misc_feature (61): n=c or g
atccaattaccccaatctaggccatgcagaactatttggtctgaggtatgcatcagtccangaggagcacaataaactgaaaagaaggcagattggcatatttcttaatagcataacacaa

SEQ ID NO: 23518 - DNA, 121 bp, Artificial Sequence
  Synthesized
  misc_feature (61): n=t or c
aatggggacaaaggttttggaaaagttgaaactgttcatcttgacacttacagaattaaangccttgctctcccatggcagggctttcatctcaaagactgacatgatgcaatactgcagg

SEQ ID NO: 23519 - DNA, 121 bp, Artificial Sequence
  Synthesized
  misc_feature (61): n=t or c
acacataaagggatatattattgcttgccaatgcaagctttaagaatgataacgttattancaataactgtttgacatcaagataaacagcagcaaatatctgcaggtaaataggtgagca

SEQ ID NO: 23520 - DNA, 121 bp, Artificial Sequence
  Synthesized
  misc_feature (61): n=a or t
ttttaacccaaattgttctttcttgtcactgcagaacttacttgactgtaaaaggaagaangagaaaacagatttgcagctgtgcataagcactactcagacatggtaagagaagttccat

SEQ ID NO: 23521 - DNA, 121 bp, Artificial Sequence
  Synthesized
  misc_feature (61): n=t or c
tcatttaacacatctcagctgatcagcagaaacccatgcaaccaggaagacttggctgtgnctgcttggatttcagctctctacagttcagctaaacattacagagaacaaaccaaatgtg

SEQ ID NO: 23522 - DNA, 121 bp, Artificial Sequence
  Synthesized
  misc_feature (61): n=a or g
tgagtgccattcctagagctcctccccactgctttctgcccctgttctgtaccatagcacntaacccaacagcctccctcatgcaggaccctgccccagcccaggctcgtttcagcccacg

SEQ ID NO: 23523 - DNA, 121 bp, Artificial Sequence
  Synthesized
  misc_feature (61): n=t or c
gctgagtctgggtgcaagcagatacagccaccacccagtttctgcaatgcatggtaactcnggaagacagattgggagtgcaacccctccacatgggaggggggtctggacgtaggctatg

SEQ ID NO: 23524 - DNA, 121 bp, Artificial Sequence
  Synthesized
  misc_feature (61): n=a or c
agatcttgttctttgtgatctcatgcattccttctgagaaatacggtctaaagagctgctnccgtgcagctgttgtacagggaatttgggcagtcttctttctttctgcccttcttcttta

SEQ ID NO: 23525 - DNA, 121 bp, Artificial Sequence
  Synthesized
  misc_feature (61): n=a or g
gaagaaagcaaagcctgttcctcatgattggtcttctcaccagcttcactcaccaactcantgggtcgatgtgtcccaggtagggaaggaagtaaggaaccagctctgacatggcaaccat

SEQ ID NO: 23526 - DNA, 121 bp, Artificial Sequence
  Synthesized
  misc_feature (61): n=t or c
ccagatgtgcatggaaataaaaaaacagtctttttccccaccctaatactaggtgtcaaanaatgcagcatgccagcttaccacaggactatcctggttgtcattaagctctgagagtttg

SEQ ID NO: 23527 - DNA, 121 bp, Artificial Sequence
  Synthesized
  misc_feature (61): n=t or g
atgcactttgcaggaattccttctgagtttgctctaatctcaacactgagtgggttctccngaatgaatggcaaaaagaaagcaaaataagatattgtgtatctaccactgtaccacacag

SEQ ID NO: 23528 - DNA, 121 bp, Artificial Sequence
  Synthesized
  misc_feature (61): n=a or g
tgaggggctcacaagaagcatttggtggagtatccatttggctgcggtgctccagcctccnggagcaaatgtccttctgcaaagataggcgtccagttcagctccaaaccaaagtagggct

SEQ ID NO: 23529 - DNA, 121 bp, Artificial Sequence
  Synthesized
  misc_feature (61): n=t or c
cggtgattgggtatggctgggcatcccactgctattgaagccactgcctgctcaggatggnaagcatgtgggtactggtctgcctgtagggaacacaaatacaaacagttttacaatgaga

SEQ ID NO: 23530 - DNA, 121 bp, Artificial Sequence
  Synthesized
  misc_feature (61): n=t or c
ccctcctgctgctgttacatggtctgatccacatctacgcatttcccaaagacgtctctangtccaattcatgtcagagagaaaaccctcaaaatcgacccctgggctgagcatgcagctt

SEQ ID NO: 23531 - DNA, 121 bp, Artificial Sequence
  Synthesized
  misc_feature (61): n=t or c
ttaactttaagatataagcctattctttatttcctgttggttggattcttgaggactctgntaggagtttgagcttgtttggtgcattcatggatcagagcttccagctcagcttcctcaa

SEQ ID NO: 23532 - DNA, 121 bp, Artificial Sequence
  Synthesized
  misc_feature (61): n=c or g
tacagccactcagaactcgtctttcattggcagagctatgtaaagaagccttgatgtaaangcatcagagttccaaacacattaatgactaaagacacacctgtatgtaaggtcagctaca

SEQ ID NO: 23533 - DNA, 121 bp, Artificial Sequence
  Synthesized
  misc_feature (61): n=a or c
agatccactgcaaaatggagagctaaaatgagatccagcagtgctggcaatatcattttcntggtcatttttgatctattttaagtcttcatagaggttatgtttttctgtgctcttttgt

SEQ ID NO: 23534 - DNA, 121 bp, Artificial Sequence
  Synthesized
  misc_feature (61): n=a or g
taatgaatgtctacagtttccactgttaagattgaagaagaaattcttaaggccttcgctncccacagaatgtacagacattcctttttttggctctttttctcccgtgtttcccaaaatt

SEQ ID NO: 23535 - DNA, 121 bp, Artificial Sequence
  Synthesized
  misc_feature (61): n=t or c
acttgatgttattgagatgtaaatggtgtacagcaggctccaggacaacctgccaacaagncacaagaagttcccttttcattgaagcatagagtttctaaggttggaaaagaactctaag

SEQ ID NO: 23536 - DNA, 121 bp, Artificial Sequence
  Synthesized
  misc_feature (61): n=t or c
acactaagaaggaaagagcctttctgatgaaataaactcaaagctttactaacattggcangtataatagtttttcagtttaaacactggacagatttttatggtggtgtgtttgttgttg

SEQ ID NO: 23537 - DNA, 121 bp, Artificial Sequence
  Synthesized
  misc_feature (61): n=c or g
atgggtagatggtatgtagatattgtcaaattcgtgcatggccatcattcctgctttaatnccctacaactcaacacaccgatcctactcgcagcctggacacgttctgggctgctctgtt

SEQ ID NO: 23538 - DNA, 121 bp, Artificial Sequence
  Synthesized
  misc_feature (61): n=a or g
tactaacattacttttatttgttttatactcatgacagtgaattcagaggatgctcggtcnttagatctgggactacattctgaaaatgatgacagaggtttctatacagaaaactttcat

SEQ ID NO: 23539 - DNA, 121 bp, Artificial Sequence
  Synthesized
  misc_feature (61): n=a or g
ggtgggaaaaacatatgctatttctgtttatatattttacaacaaaactataatgaagaangagggaaggtgaaaataaagagaaaaggactgatgagagtctgtttgaaaacaatgcatt

SEQ ID NO: 23540 - DNA, 121 bp, Artificial Sequence
  Synthesized
  misc_feature (61): n=a or g
gtggaaagaaattatagaatgcccaacctctgatctaacagattgttttcaatatccatcnttgattatgtccttaagtggaagaaaaaaaaaaaaacaaaaaacaaaaaaacatagtcta

SEQ ID NO: 23541 - DNA, 121 bp, Artificial Sequence
  Synthesized
  misc_feature (61): n=a or g
cttcttttgtatgatctgaaggaaatgcaaattagataatctcttattcttcccctggcantggttcagaacatgtttctctctccagctttgaacagaatgagggaacatacaaagatct

SEQ ID NO: 23542 - DNA, 121 bp, Artificial Sequence
  Synthesized
  misc_feature (61): n=a or g
ttttctctaattctgttcttttcactttccacctctctttatccttccctctgtgatttgncaggtctaggatcttcgccgaaagagaagtatgcttctgtgaaaaattcgccggtttccc

SEQ ID NO: 23543 - DNA, 121 bp, Artificial Sequence
  Synthesized
  misc_feature (61): n=t or c
cagggccagattttggctctgatcactccttccctgacagaagatattggagatcagtccnccacatgtgaaactggcataacctggtcctgccccacgtgacactatatggatgtgatga

SEQ ID NO: 23544 - DNA, 121 bp, Artificial Sequence
  Synthesized
  misc_feature (61): n=a or g
gatatattttagttttctttctctgccactgctcttcatatcatcaaggtcagacttatcngttgtaatgatttctgcaaattatcttccttttaaactgtcaaaaatctaagggaatttc

SEQ ID NO: 23545 - DNA, 121 bp, Artificial Sequence
  Synthesized
  misc_feature (61): n=t or c
aaaacatcatggcctgagatgcacctcagagaagcaccttgtgtggaagctaatgatgcangctagcagaaccagcaggatggctgctttagctatcaacaaacagaaggtgtctaaggag

SEQ ID NO: 23546 - DNA, 121 bp, Artificial Sequence
  Synthesized
  misc_feature (61): n=t or c
ccttgtaatgtaatcagatggcagattgagatttttaaatgatcaagtgatgggctcttgnggtggaactgagtgcagtctgaatttggtaccttttttctacatagtgttacagaccagc

SEQ ID NO: 23547 - DNA, 121 bp, Artificial Sequence
  Synthesized
  misc_feature (61): n=a or g
tttccctgctagctggaattcatgctgatatgctgaagtagcactagtggttaaacacacngatgttgagatacaacatctcagaatgtgagctgcatttaagaggttggactgagctggc

SEQ ID NO: 23548 - DNA, 121 bp, Artificial Sequence
  Synthesized
  misc_feature (61): n=a or g
atacttgcatcccacgtaaggtgtgggcatggagactttatccttaattccctttcaggcngttcacttttttaaaccaacagcctgtaatgctgtcattttgccagagcctgtgcatata

SEQ ID NO: 23549 - DNA, 121 bp, Artificial Sequence
  Synthesized
  misc_feature (61): n=t or c
gcagaaaacactgaacagtttaaagtatgtaacttgtttgaaccagatattcatggcttanacacttttatttggatatctggataaaactcctgattttctccacacagcaagtctggtg

SEQ ID NO: 23550 - DNA, 121 bp, Artificial Sequence
  Synthesized
  misc_feature (61): n=a or g
agtgtgtggcaaaagacgcagtccgtggagccagacttcccttgtggcaaagcacctgagntttgtaagtgtgcccagagggaaaacaaaacaaaacaaaaacaaaacagaacaacacaac

SEQ ID NO: 23551 - DNA, 121 bp, Artificial Sequence
  Synthesized
  misc_feature (61): n=t or c
gaccctgcacctacaacaggagctgtctgcaagggctgattttgttatgccatgaagcatntgtgttcttactacgataagctgttgttctaccattaattgttttggtaggcttttttcc

SEQ ID NO: 23552 - DNA, 121 bp, Artificial Sequence
  Synthesized
  misc_feature (61): n=a or c
atcacacagacccacattaactcctcatgggagccatgagtacatgacagtgaggtcacanagaactgtattcatgattaagaaaaataaaattaattttacatgtcaggcatcttttttt

SEQ ID NO: 23553 - DNA, 121 bp, Artificial Sequence
  Synthesized
  misc_feature (61): n=a or g
gtctgtaacaaaggtatttaacatgaagaaaaagtagttatgatcttaagcctctctgacnaacagagctggaactgaaattcaaaacatatttgaaaggctcatgaagattgtaaagatt

SEQ ID NO: 23554 - DNA, 121 bp, Artificial Sequence
  Synthesized
  misc_feature (61): n=t or g
ttctaacaaaaatagatttttaaagatacctgaaagtttgcaactgaccagcaaaagttangaagcataagaaaaaagagctgcaactcagcttatgaaatacaggaatttccatgaaacc

SEQ ID NO: 23555 - DNA, 121 bp, Artificial Sequence
  Synthesized
  misc_feature (61): n=t or c
cccagaggagtagctgacactggacacctcatgaaatgaaatcaaacccccaccctgggtngagctgtaacaacagaaggagaacttactgccatacagattgtttgtttcctttaatgtt

SEQ ID NO: 23556 - DNA, 121 bp, Artificial Sequence
  Synthesized
  misc_feature (61): n=a or g
atcaaaacccaagcgatgtttggagctcaagctgaggtcacgcagagaagcttcagcagcnctggacttcatcctattaatgatgtgggatagggtgatttatctcatcaactaattcaaa

SEQ ID NO: 23557 - DNA, 121 bp, Artificial Sequence
  Synthesized
  misc_feature (61): n=a or t
gaatgagacttctgattgatgaaacttttccttctgtcttcttgaaggaactagcctgagncctttcagtttaaactaatagagcatctggttttcctatacgtaaaggtctgcataatta

SEQ ID NO: 23558 - DNA, 121 bp, Artificial Sequence
  Synthesized
  misc_feature (61): n=t or g
tgcctttggtttgctcacatggaggtggaacagattctccttcttccatctttccttgtanatctgtgatctggactctctccagttagtctacagccttctcgaagagcaatacccatct

SEQ ID NO: 23559 - DNA, 121 bp, Artificial Sequence
  Synthesized
  misc_feature (61): n=a or c
taaaaaaagtcaggagagaaataagaactgaataaaattctactataaggcaatcagagcngcgtaactattctcaaaaccaaactgtcttcaaatatttggcaacagctgaagcataatg

SEQ ID NO: 23560 - DNA, 121 bp, Artificial Sequence
  Synthesized
  misc_feature (61): n=t or c
ttaaaatagttatttttgctcagtggaaggaagtgaaataaatccaaaagcaaaagcctgncatacacttgagggaagagctgggtccttgccgcacctggctgaggctgttgtccatcag

SEQ ID NO: 23561 - DNA, 121 bp, Artificial Sequence
  Synthesized
  misc_feature (61): n=c or g
gcatttagcttttcctgtcaccagttaacagacttgcttgcttaatgttggaaattactanttactttgttgcatgaaacccttattttataaatgaaatatttttaaggctcttaagtct

SEQ ID NO: 23562 - DNA, 121 bp, Artificial Sequence
  Synthesized
  misc_feature (61): n=t or c
tgtgtttcttaaacattggaagttgtgcctgaggtagagcttggaatctcttttctgcttngtgttggagtatttctagagtaaacatcagggggtggtgtgaatgcttaggaaaccaggt

SEQ ID NO: 23563 - DNA, 121 bp, Artificial Sequence
  Synthesized
  misc_feature (61): n=t or c
aagcagaatttcatatactcctcttctaacttctggtttttcaatcaagtcatcactagtngtattacgtgcagaatctagtcccagggattggagatcacattagatcagggcatgttac

SEQ ID NO: 23564 - DNA, 121 bp, Artificial Sequence
  Synthesized
  misc_feature (61): n=a or t
aatgataatcttgactatatagagttcgctttcctatctgagctatccaatttagggcaanctcgtttgacttctgaataccctccactgacctgatcctgctaatgtatgttgtacgcaa

SEQ ID NO: 23565 - DNA, 121 bp, Artificial Sequence
  Synthesized
  misc_feature (61): n=t or g
tgtactctcatacatcccatagtaacaagtgtgggctcagtatgacaaagttatgttgtgntactcattactagtctcagattttgcctctgattttattctgcacaaggaacttggaggt

SEQ ID NO: 23566 - DNA, 121 bp, Artificial Sequence
  Synthesized
  misc_feature (61): n=t or c
atgaaggtctgtgaatgaatgagttggaattgtggcagagtggttactgttttagcactgngttttacttatgtcatttgtcaacaacccaaaagtaatgagcctcctgtgaggtgacaga

SEQ ID NO: 23567 - DNA, 121 bp, Artificial Sequence
  Synthesized
  misc_feature (61): n=t or g
ccagaagccagatctgaaataaaaactggaaattattttaagtaataggaatacctaactnttacagtcctactccaacatgaaaattactttgcagcagtagctctgctataagatcagt

SEQ ID NO: 23568 - DNA, 121 bp, Artificial Sequence
  Synthesized
  misc_feature (61): n=t or c
gcctgaatcctggtaaagccacagagaattaaggatctgaacaccactgaggacattagcntgtgcagggtgtaatgagaggtttcacacagacaacttcgtagtgggttttctgagaggg

SEQ ID NO: 23569 - DNA, 121 bp, Artificial Sequence
  Synthesized
  misc_feature (61): n=t or c
gctgtggcctcctgtgctgctggggagtcagggcttctgtggaaggttttccttgcagttnttctttctacctctgagcctcttcccatctcacacagtgtgatgggggtgattatggggc

SEQ ID NO: 23570 - DNA, 121 bp, Artificial Sequence
  Synthesized
  misc_feature (61): n=a or g
tatttgaaatgtttcctgaaaaacatttaaatgtaaagctgtaagggtctctctacctcanaagaaactttccttttaaatgctaaatttaaacaattttgttgctacctagcaaattttt

SEQ ID NO: 23571 - DNA, 121 bp, Artificial Sequence
  Synthesized
  misc_feature (61): n=c or g
aagccattgaagccatcctacatgtggaggatgagacatttaagaacacgttcagcaagangcaccttttgcatgtgcaattgagcactcagaaatcctggctttttattttagtgaagta

SEQ ID NO: 23572 - DNA, 121 bp, Artificial Sequence
  Synthesized
  misc_feature (61): n=a or t
aaatgtaaagaattaggcatgaaatactgagaactgtccattaacaaacttataacggtgnaatgctctgcagggattcaacagagttttttaacatattttgtatagacaatgtctaaat

SEQ ID NO: 23573 - DNA, 121 bp, Artificial Sequence
  Synthesized
  misc_feature (61): n=t or c
ggagaaggttaccaggagagggagagatgaaaggcagttccatcgagccaactgcagaacntcctgaggctctctgcagaaagtcatgcagcctgtgcttccaacgggggccatggaagag

SEQ ID NO: 23574 - DNA, 121 bp, Artificial Sequence
  Synthesized
  misc_feature (61): n=t or c
tcactgcagacattgcctacaaattgaaatacaaatatggtccctttcttaaatgcagtgntttgttaactgtgctactgtgtaacaacaagacagcaaatctcaggactcccagatctga

SEQ ID NO: 23575 - DNA, 121 bp, Artificial Sequence
  Synthesized
  misc_feature (61): n=a or g
cttgcaatgaataattcaacagaggcataaagttgacagtattattctatgattacttctntggtcattctgcttggccagttcgtaacagacaggtctgtttgtcttgttaagctgaacg

SEQ ID NO: 23576 - DNA, 121 bp, Artificial Sequence
  Synthesized
  misc_feature (61): n=a or g
ttttaaagcttgaagcttcaaaatgcttgggacttacatgtgtacatttataagcactacntctaaggaggacgtgcagaatgacaacaaattttgtgtatttactcattttgtgcatctc

SEQ ID NO: 23577 - DNA, 121 bp, Artificial Sequence
  Synthesized
  misc_feature (61): n=a or t
agagctcagctgttttggaggtgcaaatgaaaaactcttgtttttagttgtagagataacnataggtaataacattcacaaatgaacaatcaaatgtgagtgcagttgtgaaagtctggca

SEQ ID NO: 23578 - DNA, 121 bp, Artificial Sequence
  Synthesized
  misc_feature (61): n=a or g
aagcatttctgcttcagtcaataccactgagttacagagcaaaacagaaggcttcactgcngttgtttacatcagtgcaaatgaaggttgctattaatctgggtttttctcctccgctgtg

SEQ ID NO: 23579 - DNA, 121 bp, Artificial Sequence
  Synthesized
  misc_feature (61): n=t or c
tgagtagtttttcaaatgatgatattttccatgattaagtcttttgtttttaacgatgttntgaaacagataatacggaatagtatcagattatctgttccgtgacatttttgaacaatcc

SEQ ID NO: 23580 - DNA, 121 bp, Artificial Sequence
  Synthesized
  misc_feature (61): n=a or g
acaaggcaagagtgacctgctctgtctctctttgagtattctcttgtgtggacccagaatngtgcagaaaagcttatttcactgagttacctttcgcttggcctcacagcctgccagtttc

SEQ ID NO: 23581 - DNA, 121 bp, Artificial Sequence
  Synthesized
  misc_feature (61): n=a or g
tgtgcagggctgagcgcagaggggacaccaaagcacccatgcacttatgctttgccacatnggtttatgttggctgtgcaactgtgctgggctgcttcacgtgctcacagcctggaacaaa

SEQ ID NO: 23582 - DNA, 121 bp, Artificial Sequence
  Synthesized
  misc_feature (61): n=t or c
ggcaagagaggacactgtcaagggtgagggaggaaggaatgcagacaaagagggggagcanagtctgaacagcatgctccctcatctggtaggaaggcagtgcagtttaacatatcagaac

SEQ ID NO: 23583 - DNA, 121 bp, Artificial Sequence
  Synthesized
  misc_feature (61): n=t or g
tatttgcaatctgagctatcagttatgtgtattatgtaaaaatgctgtgtaaaatccacanttgctcaatatacgaataacaaaagaaagcgaaagcagaattgatatctaaaagaagtgc

SEQ ID NO: 23584 - DNA, 121 bp, Artificial Sequence
  Synthesized
  misc_feature (61): n=t or c
agaatgtgagtactttacagtactttaccttaaccatactaaccagccttagtttctaaantgggagaaataaattgttcctgaagtgctcataagagtccttttctggattgagaagtag

SEQ ID NO: 23585 - DNA, 121 bp, Artificial Sequence
  Synthesized
  misc_feature (61): n=t or c
cctggggggttggaaatagccttgatgagagtgcaggagcagggtgacacatatctgatgngtgtggatgcaggagctctaaggcagcccgcaaggagccaaaaggatcccagatccttct

SEQ ID NO: 23586 - DNA, 121 bp, Artificial Sequence
  Synthesized
  misc_feature (61): n=a or t
tctctggaactaagcaggaagtagcttggtcaaagtgtgcattgagttcagagtcatttgnctgctgtcatgtctgtgtctgtggaaaacaagtggtgattcaaggaatcacaaccagttt

SEQ ID NO: 23587 - DNA, 121 bp, Artificial Sequence
  Synthesized
  misc_feature (61): n=a or g
ccacgatggaacaaaccctctgttcccctgcaggaccgttcctatgctccagcatcacttnggagatcacagcagcggtcccaaacacccaggagggatggagggaagggggctgcaggtg

SEQ ID NO: 23588 - DNA, 121 bp, Artificial Sequence
  Synthesized
  misc_feature (61): n=a or g
tgtgactctgtatctgagaaagaaatggagaagtctccagtgggcagtcatggtttggctnctatgatattgaagagccacacattctcctacagcctctacaagtatgcatcatttaaaa

SEQ ID NO: 23589 - DNA, 121 bp, Artificial Sequence
  Synthesized
  misc_feature (61): n=t or g
ctgctcaagataggcaaccccattgcagtaatcgctgcctcaggcctgagtctccgcctgnttcctcaccatgttgtctccatgacctctgcagaagcagctattcctctcagggtggggg

SEQ ID NO: 23590 - DNA, 121 bp, Artificial Sequence
  Synthesized
  misc_feature (61): n=t or c
taatgtataatgtaatactcataattgcaaatgtaaccatttctggttggaaaaacaaacngtatgagtatattatccttcatatgttacttttaaatccttaataggattaaaaaatgat

SEQ ID NO: 23591 - DNA, 121 bp, Artificial Sequence
  Synthesized
  misc_feature (61): n=a or g
agttacctgagcacaagcttgtgatggccacaggaaatcaagggcatctctgtggagtcantattggggctgaccctgtttattatcttgattgatgatctagacatggggattgagtgta

SEQ ID NO: 23592 - DNA, 121 bp, Artificial Sequence
  Synthesized
  misc_feature (61): n=t or c
cctcaaaggcttacttatgtacattatgaacagattcaacagagcacattttcctattgantatccatgtaagcagttcgaaaaaaaatcagtaacgtaattgggaagaaagatagcagaa

SEQ ID NO: 23593 - DNA, 121 bp, Artificial Sequence
  Synthesized
  misc_feature (61): n=c or g
actgtcctggaaggtgaaatttttcctgtggcacagactcctttcttctgtattactgttnctgacttaaaattagaggaataacaagttcatttgatttttactgtaaaatgttatcttt

SEQ ID NO: 23594 - DNA, 121 bp, Artificial Sequence
  Synthesized
  misc_feature (61): n=t or c
atacacttcaaagcttatgctttgattaaacccaggtactagcagcatgtcagataagctnccaacattacaccacatcagtaagacatgacaactcagtgagaaaagcaacgtgtagaag

SEQ ID NO: 23595 - DNA, 121 bp, Artificial Sequence
  Synthesized
  misc_feature (61): n=a or g
cactttccaaacaagataatgtggtaaagctgcgagcaataccagggtatcccactcagcnccgtgctcccctggtctggttaaaactcacagctcaatccagcccttgtaaacctcacta

SEQ ID NO: 23596 - DNA, 121 bp, Artificial Sequence
  Synthesized
  misc_feature (61): n=t or c
gcaggtagtgtagcccagaaaccagcaagacattttgaacagtgcttagaagagctgtttngtttcccaaaggctgcaggcatattcctcatagagctgtctatctaaagcttacacatgg

SEQ ID NO: 23597 - DNA, 121 bp, Artificial Sequence
  Synthesized
  misc_feature (61): n=t or c
gcagtgtctggaagactgaggaagaaatgaatagtctaaaataggtgtttatcaggcagantataaatacatcgttctaacactttcatgtgtgaggcaaatctcagatttgccttccctt

SEQ ID NO: 23598 - DNA, 121 bp, Artificial Sequence
  Synthesized
  misc_feature (61): n=t or c
ccggattctcagtgatcctctcacccagtctatagaaaagctccagacatttgagctgatnctttacatgaagaaaaacctcttctcctcctccctgtgtgtctttgagaaccctgtatcc

SEQ ID NO: 23599 - DNA, 121 bp, Artificial Sequence
  Synthesized
  misc_feature (61): n=a or g
atctactctgtcagtttctgtgctctgctatttaagaaaacactaaatgaaatgggagctntgtgtttcttgagagagaaggaggaaggaactgagatggggatagctctccaactatcgc

SEQ ID NO: 23600 - DNA, 121 bp, Artificial Sequence
  Synthesized
  misc_feature (61): n=a or g
ctgacacagtgattcagatcagggaaccgatctggctgaaattgatgcttggaaggaaaantaagtaaataaaggtagcagacatcagttcaccagtctagtcctgcatccacacacatac

SEQ ID NO: 23601 - DNA, 121 bp, Artificial Sequence
  Synthesized
  misc_feature (61): n=t or c
agtgcgcggtgttccagacacaccgaaccccacgacatgaaaaggtgcatgcatttgtcanggagacttctggcaggaagaaagcacgagctgtagcccctgttagcgtttgagggtgaag

SEQ ID NO: 23602 - DNA, 121 bp, Artificial Sequence
  Synthesized
  misc_feature (61): n=a or g
tcagcatgctggcagttaatagtcacagagaggatcgtaaagatttaattaggactgcatncggaaacgtggaaaaacaactcagacttttaattactagacttctttagttaaaagtgat

SEQ ID NO: 23603 - DNA, 121 bp, Artificial Sequence
  Synthesized
  misc_feature (61): n=a or g
cgtaattgaaatcccttttgccttatatagttttgtccatcttcttgttctgtcccaagcngatgtgaggagcagcttgcagcagcctcggctgcaatcctgtgctaatgtgagccctgca

SEQ ID NO: 23604 - DNA, 121 bp, Artificial Sequence
  Synthesized
  misc_feature (61): n=a or g
ttctggccccatagtacatcacttagtgaagcggaaacagagtaatgatttaaaaactgtnaagacaaacggttttgtaaaaatatatgtataaataaccaccgttctattcggtgttgtg

SEQ ID NO: 23605 - DNA, 121 bp, Artificial Sequence
  Synthesized
  misc_feature (61): n=t or c
cggtgagtggaaaaggatacactcacagaaaagaaaaagtgaatattcttgcccttgatantgctaatgtgagttactgtactttgagtcactgctgtataatacaatagttcttttactc

SEQ ID NO: 23606 - DNA, 121 bp, Artificial Sequence
  Synthesized
  misc_feature (61): n=a or c
gaccttcagtgcatcccactctgccacctcccataggagagacttggaccccagaaaccangagcccaaggcagagatactcccagctgccttcaaaatctgcctctctgcaatgcaaaga

SEQ ID NO: 23607 - DNA, 121 bp, Artificial Sequence
  Synthesized
  misc_feature (61): n=t or c
cagtagacctgatcagatgttttctgctttattccatttgatttatgaaatgtgaacaagnactttagactacagaaaatacattgcatgataaatacatacaggcgaagataaaaagatt

SEQ ID NO: 23608 - DNA, 121 bp, Artificial Sequence
  Synthesized
  misc_feature (61): n=a or c
acagaagacagcagctctgataactgaaaaaaaaatagtaatgaatggagttaccagatanaaggaatcctgaaaacactttagcattgtgatgacatacagcataccgctgtaataagct

SEQ ID NO: 23609 - DNA, 121 bp, Artificial Sequence
  Synthesized
  misc_feature (61): n=a or g
aaaccacaggcaaatgttattcatagacacataacatagcattagatgaaaccacagaaancaaaatgcacctggaatgcagagaaaatacttactgatgtatgatttaactttatgggca

SEQ ID NO: 23610 - DNA, 121 bp, Artificial Sequence
  Synthesized
  misc_feature (61): n=t or c
agcgagaggagtccttatcaatcagcctttagtcaacagggaaggctgtgataagtagtangaggaaaatggtacatggggagaacgtggcttagttaggaagggtggagatacaaggaca

SEQ ID NO: 23611 - DNA, 121 bp, Artificial Sequence
  Synthesized
  misc_feature (61): n=a or c
accaattcttcacagcctttaaaatacacagagaagccacaaagaatgcacagttctagantaaagagcttaatgaggttgtttttacaaaacgtttgctaactcgtgatgcttaactcat

SEQ ID NO: 23612 - DNA, 121 bp, Artificial Sequence
  Synthesized
  misc_feature (61): n=a or t
gcggctcatcagcagcagggtgagggcagtcggttcttcgttggcaatggaatgaagcagngctgcggtgtttgtttctcctcttcccacctccctctgtgttctgaagcatttccaggct

SEQ ID NO: 23613 - DNA, 121 bp, Artificial Sequence
  Synthesized
  misc_feature (61): n=t or c
tacccgaaatagataactgatgtaaaagcttcagctcacgaaacacaaaagcccaagtcgnagggctggacacaaacatcaccaggtcttgcgtggcccagaatttcatattaaaaagcaa

SEQ ID NO: 23614 - DNA, 121 bp, Artificial Sequence
  Synthesized
  misc_feature (61): n=a or t
aaataaaaaaagaacattgatatatcacaagatagctaataaacacagcccaggcacacantcatgacatcagtgaatgagaacaagatgaagaaacacctatggcatattaaactgccaa

SEQ ID NO: 23615 - DNA, 121 bp, Artificial Sequence
  Synthesized
  misc_feature (61): n=a or g
tgccatttgttaacgtccagctgctttgttgtctcacatagtgcagaaagggtatgtgctnctttgatctttctgagatgtaaagtgtagcttggtagctttctaagttggtaacttagac

SEQ ID NO: 23616 - DNA, 121 bp, Artificial Sequence
  Synthesized
  misc_feature (61): n=t or c
aataccacatccacaccccaaaaagctgttactgcaccattaaaagcttcatctgcactcngcagaactgcctctgggcactgacatcacactcatgtcaccatgcagacatgactgtgac

SEQ ID NO: 23617 - DNA, 121 bp, Artificial Sequence
  Synthesized
  misc_feature (61): n=t or c
ttcctttagtttgaccatatatttctgctgctatgtagtgaaaaagctaaactgaattagncgatcttttggattagatagctgggttaaatggtattcagaagtgtattactgaagaccc

SEQ ID NO: 23618 - DNA, 121 bp, Artificial Sequence
  Synthesized
  misc_feature (61): n=a or g
aatgattatatgattctatgaacatataaaaatatgtaaaataaattgctagaacatgatnctatggtgttgtcttctggcacattattaacttatttccattcatattgttcttaagaat

SEQ ID NO: 23619 - DNA, 121 bp, Artificial Sequence
  Synthesized
  misc_feature (61): n=t or c
gtccaagaacaaaagcattctatttagctaacaacatcagtgaaactgccaggtaaatttntgaagcacattacctaaacgtggaggcagtgagagtacaaagaatactgttttattgatc

SEQ ID NO: 23620 - DNA, 121 bp, Artificial Sequence
  Synthesized
  misc_feature (61): n=c or g
gacatttcagcccctgggagacctgcagcttggaaatttaaagcaggtccctgggctctgnttaactaccagcttgcttgcaaggatatcttttaagaacgtacatctcttgcctcattca

SEQ ID NO: 23621 - DNA, 121 bp, Artificial Sequence
  Synthesized
  misc_feature (61): n=a or t
tggccttgtctcctcttgatcatggaagggagaagcgctggcaagagacaaaaaaagaatnacagtctgaccattactgctgttgagaatggatgctttcagagtagtgcttcagagaagc

SEQ ID NO: 23622 - DNA, 121 bp, Artificial Sequence
  Synthesized
  misc_feature (61): n=a or g
tctatgggatacattcctattatctgatgatgctacaagaagacaaccatgcccttgacanttcttacttgaatcttattagtcttgcacacctgcctaaggattggttatatttacttct

SEQ ID NO: 23623 - DNA, 121 bp, Artificial Sequence
  Synthesized
  misc_feature (61): n=a or g
caggaaataatttatttaggacccctccctcctgtggtagtgagggaatgggaagtatagntggagctcaaacttagtatataaaatgcctaacaggatctggtcctaggagctagtacaa

SEQ ID NO: 23624 - DNA, 121 bp, Artificial Sequence
  Synthesized
  misc_feature (61): n=a or g
gatctgctggtctacagctaagctgcaagctgttgtttgcatgggctctgcaggggcttgnctaaaactcctggagcattccacagtgctaagcatggggcagcctcagtgagcccaatgg

SEQ ID NO: 23625 - DNA, 121 bp, Artificial Sequence
  Synthesized
  misc_feature (61): n=a or c
gccagaggatctacctcttgcagaaaatcatcaggagaagtgtttgtgaaattgccattgncatttgttccggcaggactagtctaaacacttcctactaccaaaggaacttagaatcagc

SEQ ID NO: 23626 - DNA, 121 bp, Artificial Sequence
  Synthesized
  misc_feature (61): n=a or c
gggccagctgggtctgctccccaaagcagcagctgggtgatacttaaccatgctttacgtntctcgtttccacccagggtttagatgggctgcttaagccacgctgtcctctctgaccctt

SEQ ID NO: 23627 - DNA, 121 bp, Artificial Sequence
  Synthesized
  misc_feature (61): n=a or c
tcccatgccatgaggaaaaacgaacaccttctccctccactctgtcactctctctcatacnccatttccagctgtctcctaaaccagagggtgccacacttacagttgggctccagaagga

SEQ ID NO: 23628 - DNA, 121 bp, Artificial Sequence
  Synthesized
  misc_feature (61): n=a or g
cagagaccacagggggagaagaagctattttctccgtggaggcacttgtttaacatttctnttgtaagcttcggcttgcagctggttttaggcttcatgctttttctctcccatttcactc

SEQ ID NO: 23629 - DNA, 121 bp, Artificial Sequence
  Synthesized
  misc_feature (61): n=t or c
aaaaaatgtctgtactgaggcgttcctctgcctttgttgacagcatttcaacatattctcngtaacctgagtaatgaaaggaatggaacgtctttaggaaggcgattgaactgccttaact

SEQ ID NO: 23630 - DNA, 121 bp, Artificial Sequence
  Synthesized
  misc_feature (61): n=a or g
agaaatctgtagaattttgaatgtattcatgcttttaatttaattccctgaattccctgtnatttctgataatcagtgtagagtgtacttcatttactgtattgttcatgacatgcttggg

SEQ ID NO: 23631 - DNA, 121 bp, Artificial Sequence
  Synthesized
  misc_feature (61): n=a or g
gggtaagcttcctatagtactgtctcagaatgctggaggttaaaacttgcagtaaaacaanatttccagtttccctgtacctgaactcgcgtagttttcatgggtgactcgtgcatcacaa

SEQ ID NO: 23632 - DNA, 121 bp, Artificial Sequence
  Synthesized
  misc_feature (61): n=a or t
atcttccttacatgttcacatacacagcagatttgtatgtttgtcctttgtttgaagattnaagttttctaagcatgtgtgaagaggtttgtagaggtatcaacaggggacatcaagcaca

SEQ ID NO: 23633 - DNA, 121 bp, Artificial Sequence
  Synthesized
  misc_feature (61): n=a or g
tgacctgaccttgatttaccagattcctgaataccaaaaaaaaatcccctggggtaataanagaggtctagcatccttacctacacagatagaagaatatggtttcagaaccatgaaatca

SEQ ID NO: 23634 - DNA, 121 bp, Artificial Sequence
  Synthesized
  misc_feature (61): n=a or g
aactcaccctttatgacatcgacaaagttcagatgaagaattgttgctgaagaccctctcnccatcataacccatccccaaaccctggctgcactctcggcagacacacgcaggaagctat

SEQ ID NO: 23635 - DNA, 121 bp, Artificial Sequence
  Synthesized
  misc_feature (61): n=a or g
ggggcagcctgttgatatctaagcagaaactgagaaaatggaaccagactctggagatgcncgacaggaaggaatagtgtttgtaaattgaaatagggtaagtttgttttgcactggaatg

SEQ ID NO: 23636 - DNA, 121 bp, Artificial Sequence
  Synthesized
  misc_feature (61): n=t or c
caagacaggccttcccttctcaatcaaatagaccagtggtcattattgttatgtaattaantaaaatataaacatttaagtcaggagtgaatgagagactcagtaataaggtctttgatca

SEQ ID NO: 23637 - DNA, 121 bp, Artificial Sequence
  Synthesized
  misc_feature (61): n=t or g
agaataatttacagtcagccacaatgtatgggcactcagagcggttgtgtttgtcccatcncatcaaggttcgttgatcccttcagtgttcaaacacaaagatatgggccttcagctggac

SEQ ID NO: 23638 - DNA, 121 bp, Artificial Sequence
  Synthesized
  misc_feature (61): n=c or g
tagagcactgagactaaaataaccagaaatgccatattatttatgttttaggagctgacancagggatgtaactgaacggaatattcacaaaggcactccacttaccatgcgctgtgcaca

SEQ ID NO: 23639 - DNA, 121 bp, Artificial Sequence
  Synthesized
  misc_feature (61): n=a or t
tttatattgtattcctgatgaaaatagattgagtaggcactgctagttttaagagttaaanaactcaatagtcatagattgctatgtttccaaaagcctccactgaaatctgagagaacca

SEQ ID NO: 23640 - DNA, 121 bp, Artificial Sequence
  Synthesized
  misc_feature (61): n=t or c
gtggtgttgtatagaggcaaattcacagtgaagggcccagggagatgggaggcagtagaantaggacagctggcttcaaccagccacagaaatattccgtaccacatgacatcaaggggaa

SEQ ID NO: 23641 - DNA, 121 bp, Artificial Sequence
  Synthesized
  misc_feature (61): n=a or g
atcctcaattactgtaaagcaaattttgtccaacggggaaatagagaagtccaaatggcantgttacctcaggagaaaccgtttttggtgtgtgattatcaagaacacccctgttacgtga

SEQ ID NO: 23642 - DNA, 121 bp, Artificial Sequence
  Synthesized
  misc_feature (61): n=t or g
aagaacaggagatgtggaggaatgagggggagaggaaaaaagcacagccgagaagttcttnttttgaatttggcttcccttgttgaaggtttgaagccatgatagatgttttcaaggaagc

SEQ ID NO: 23643 - DNA, 121 bp, Artificial Sequence
  Synthesized
  misc_feature (61): n=c or g
ttccagccagacttgttggctttacttgcgcttctatgggaagtggtaggggtagaagttntggcttggttgcttctttggaattgtgatttgtaggtccttggcggtctctgtacgtgtg

SEQ ID NO: 23644 - DNA, 121 bp, Artificial Sequence
  Synthesized
  misc_feature (61): n=t or c
tcttcctgtacacctttgtaatgtcctcccaaaacaataacgagaaccccgttctgaatgntgcagtaacacagcacatagggaggtttgctaagtgagcagcctgtgttcccaaacatgg

SEQ ID NO: 23645 - DNA, 121 bp, Artificial Sequence
  Synthesized
  misc_feature (61): n=t or c
ttaaaatgtccatctccctatcttcaggaattgttcaaaacagtatttaataacactagcnattgatagagacagaaattctgagtctattttgttcagtaggttactagggcattcaaac

SEQ ID NO: 23646 - DNA, 121 bp, Artificial Sequence
  Synthesized
  misc_feature (61): n=a or g
catgcctctctgtttctatatttaaacgcatgtattctgaggggaggaagacttggcttcnggactcgtgcacaatcctcctgccccgcatggttttgctcttgtgctgacacacagtgac

SEQ ID NO: 23647 - DNA, 121 bp, Artificial Sequence
  Synthesized
  misc_feature (61): n=c or g
gatcacaagactttcacaactgatagtgcaaccatgagttctgtgcttgtacttaaaaggnctaaatctgatctgcatatattgtacctttatatcctcaggtcggtttgtctctgttcgt

SEQ ID NO: 23648 - DNA, 121 bp, Artificial Sequence
  Synthesized
  misc_feature (61): n=a or g
ttgtacagcctcatggaggagcaaatcaagagtgtgcgcatgtgcatctgtttgtatgcantatctcagaggatgcctgttcagaacagccaaatatatacctcagcattagtatatagca

SEQ ID NO: 23649 - DNA, 121 bp, Artificial Sequence
  Synthesized
  misc_feature (61): n=t or c
agctgctctctcctcaagcacgtacgtggacacacattcagagggcaaagccatttgtagngttaaaggctaaaggggtgctccaagaagccaaactcttgttttcattgggccctcagct

SEQ ID NO: 23650 - DNA, 121 bp, Artificial Sequence
  Synthesized
  misc_feature (61): n=a or g
taatactatttttatttatttgtctatctttagtaacacagaagattcttttgcttcaatngccatttcttttggagcactatattccttcctgcttttcacattgtactgcattgttctg

SEQ ID NO: 23651 - DNA, 121 bp, Artificial Sequence
  Synthesized
  misc_feature (61): n=t or c
ccgctgggaggagcccgtgtgccccctcctgcctccctgctccctttcagcatctccctanggagatttacctatttaggggtagaagaaggtggctaaggccatcctcggtcaagctaag

SEQ ID NO: 23652 - DNA, 121 bp, Artificial Sequence
  Synthesized
  misc_feature (61): n=t or c
tcccaggtgaaccatcgcatcactggttcggccactgcattcccatcctgcttcctctccncatgctgtggagccatcctcctgctcctctcactgctcagcctcacccagcagcccctcc

SEQ ID NO: 23653 - DNA, 121 bp, Artificial Sequence
  Synthesized
  misc_feature (61): n=a or g
tgaaaatgaagatgcccaagtctatgcccgtctttaaactctgaagaggaaccggcagacncatttcttccctttacatctgagctgcaaacatgctctggagaatcaacacaagtttgag

SEQ ID NO: 23654 - DNA, 121 bp, Artificial Sequence
  Synthesized
  misc_feature (61): n=a or g
catcagaggtgatgatcagagaggcattcctcaggtctgtgttaacctgcaggcagtgctncagaagtaagccatactgcacagtatagagggtcctgctccccagaaacaggcaagcaaa

SEQ ID NO: 23655 - DNA, 121 bp, Artificial Sequence
  Synthesized
  misc_feature (61): n=t or c
tggattgatccaacaggatccccaaagcttcctcaaggaatggtgtttgtgctgtgtgaanttgcctgacttgtgcttcacacttgtggctgccttaatgggtaaccatagcccatgagag

SEQ ID NO: 23656 - DNA, 121 bp, Artificial Sequence
  Synthesized
  misc_feature (61): n=a or g
gattttcttagagaacataacactgaaaaataaagaaaatagttggcaggatgacatgtcnttaaattccaaaaaaggtctaggaaataaggcctggtctttcctatagtaaacaatcatt

SEQ ID NO: 23657 - DNA, 121 bp, Artificial Sequence
  Synthesized
  misc_feature (61): n=a or g
tgagatggcagggtttggtcctgcagatttaagttgttaaagcaaagggactggatgggancctcgcaaggctcaagagtgctgaactcccacccttatcatggactcattaaagttggaa

SEQ ID NO: 23658 - DNA, 121 bp, Artificial Sequence
  Synthesized
  misc_feature (61): n=a or g
ttctcaggagacagatgtgaatagctcttgctgctgtgtaggattgctgctttactcatcncttgagccgtgtgggttatggctttgtttatgaataacaacaaagtggatgtacagagat

SEQ ID NO: 23659 - DNA, 121 bp, Artificial Sequence
  Synthesized
  misc_feature (61): n=t or c
cccacaaggcaccagggcagttccatttttgtgcgtaatctcatggtgtgtgtaacttgcngtgtgggaagtcttaccagcctccccccaatcgcaccaagcagctggtgctggtactggc

SEQ ID NO: 23660 - DNA, 121 bp, Artificial Sequence
  Synthesized
  misc_feature (61): n=t or c
cacttcactttgctaaatgcaccgtggaatgatgctgagagttggcattgtcatctggtgntgaacttggaaggtctgaaatcacagatttttgctctggtgggttgttatagccaatgat

SEQ ID NO: 23661 - DNA, 121 bp, Artificial Sequence
  Synthesized
  misc_feature (61): n=t or c
gcatggaattcttcattaaaaatgtcaatgctgtccatacaacaaatctgcaaatgttcantgtatgtgttgttgcttgtccttcccaaaacactgaggtgtgaatgccaaaacaggattt

SEQ ID NO: 23662 - DNA, 121 bp, Artificial Sequence
  Synthesized
  misc_feature (61): n=a or g
tggagcctggctgagccctgaaggaaggtgatcacactcctccacgttccttactgaaagngaactgctctgggcagcaccatcttataggctgccctcatcatgcattgcagctgcctcc

SEQ ID NO: 23663 - DNA, 121 bp, Artificial Sequence
  Synthesized
  misc_feature (61): n=a or g
tccttgggtaattccagaccccttctagaaaccagaaagttgccatagcaaagataaaaancctaagaaagggtaaaacctgaaaactccaggatgttccctggtaaccttaaagcaacca

SEQ ID NO: 23664 - DNA, 121 bp, Artificial Sequence
  Synthesized
  misc_feature (61): n=t or c
aacaaaagattctgagttcagatatgggtttgtggttagactgctagaactgcacattccnttcatcaggaaaaatgcaaagtgttgatctgagtaaacttactgtattagcattgttgat

SEQ ID NO: 23665 - DNA, 121 bp, Artificial Sequence
  Synthesized
  misc_feature (61): n=c or g
aactcatgataatctaatgaaaaataaccatatttcaaactactacagtaaatttgctcancttcttctctcccatccccccagatctcaattatggcagatgagaaaaatgccacaggtg

SEQ ID NO: 23666 - DNA, 121 bp, Artificial Sequence
  Synthesized
  misc_feature (61): n=a or c
ctcgtggaggagctatttcttggagacattcatactgatgctacccagaggaggtactacngaccctccagttaccagcctcctcttcaaaatgccaaggtatgtatgtgtatatggcatc

SEQ ID NO: 23667 - DNA, 121 bp, Artificial Sequence
  Synthesized
  misc_feature (61): n=t or c
atatcgtttgcccacactacctcttactctcactacatgtaattcaaaaaaacagctcctnttaacctcttgctaggcagcaaatgtccacacctcaggttatttgtgaacactcctcaaa

SEQ ID NO: 23668 - DNA, 121 bp, Artificial Sequence
  Synthesized
  misc_feature (61): n=a or g
attttcattgcttattattccattttcaaacagtctcccttgcactgaaaatatgttattnctacagaagaaaatctattgcctacaataaaataaaataattaaaaaaaaaaaaggaaaa

SEQ ID NO: 23669 - DNA, 121 bp, Artificial Sequence
  Synthesized
  misc_feature (61): n=c or g
ttgaagcattttcatcttttccaaagtatcacatgtactacctagatatatttgattacanttaatgtaaatacctacagtagtccctctctttcaaacactggagaaaaaaaaaagaaaa

SEQ ID NO: 23670 - DNA, 121 bp, Artificial Sequence
  Synthesized
  misc_feature (61): n=t or c
taatgtagagtgatgcatgctccagatacaacaaagctgcatttgactcttatgccttccntaaataaaaacataacactatgaggttattatacgtatgtccacaatgtaaaagttcaga

SEQ ID NO: 23671 - DNA, 121 bp, Artificial Sequence
  Synthesized
  misc_feature (61): n=t or c
gctaagaggaatttaatttctttcctacatgttagcaggacttgctcttgttgtagagcangctgtgagctgtgctgcccagaaatacttctcgatgctaggaaatacaggaggcaaacca

SEQ ID NO: 23672 - DNA, 121 bp, Artificial Sequence
  Synthesized
  misc_feature (61): n=a or t
tgcttgtgctttgactaataccagatatgaaaaaagaatgtaatttatactaccagcttgntagtttttggtgttttctgctttgcgttctgtaggaggtgcaggctgtaatctctgggat

SEQ ID NO: 23673 - DNA, 121 bp, Artificial Sequence
  Synthesized
  misc_feature (61): n=a or g
ataaaacaatttacaaggagccattgcctaaaatatctgccctagtagctctgcaagggtnctaaaaagataatgaatacccattttgttgacatgaaaaacagtcattctttacttgatt

SEQ ID NO: 23674 - DNA, 121 bp, Artificial Sequence
  Synthesized
  misc_feature (61): n=t or c
aaattaactgaaataaatacctcaacacgcaagatgtggttatgctgtggatctctgtatngatgggtgcagaaagtcagcataagttcaaaaaggaaatgtaactacacagaaatttttt

SEQ ID NO: 23675 - DNA, 121 bp, Artificial Sequence
  Synthesized
  misc_feature (61): n=a or g
tcatcccgtttcctacttctgatgtgattgtatcaatttcttaagcagtctttaaaactancacactgactaaaaactgatcgtttttcttttgaatacacttcatcttcagctatttctt

SEQ ID NO: 23676 - DNA, 121 bp, Artificial Sequence
  Synthesized
  misc_feature (61): n=t or c
tccagatctgttcacaccgcatgtccctcaacgcatcctttccctgccagctattacagcnctgcttgaaaagaaacatctccagttttggcagagagggtggggaagttagcttggttgc

SEQ ID NO: 23677 - DNA, 121 bp, Artificial Sequence
  Synthesized
  misc_feature (61): n=t or c
ctcccaggagatggaggctctggattttgcagagctttgagtggttttggagaggggtctnttactacagctctggagacataccctatcccttctctgccatagcttcttgtgcttcctt

SEQ ID NO: 23678 - DNA, 121 bp, Artificial Sequence
  Synthesized
  misc_feature (61): n=a or g
tttaacaggaaactctgtgtgtccttggttttctgtaagtacgcggggagcaacttggtcncttgtatatcaaagaattttatggtatctggagttaagtagctgtaatggctcatgagag

SEQ ID NO: 23679 - DNA, 121 bp, Artificial Sequence
  Synthesized
  misc_feature (61): n=a or g
tggcttacaggcaaagcgtgagcagttcgatgtgcaccctaccctggtcatgggatgagcnaattcatgcctggtttgtccagactgcaaaactgacctttgctactggaaacacctgctg

SEQ ID NO: 23680 - DNA, 121 bp, Artificial Sequence
  Synthesized
  misc_feature (61): n=a or g
gcattctatcacctaacaaatccaacaagctacttgctacatttatcaactgtgcatgttntttacagtgcacctccttaaaaccaagaaatacctcttcctataaaggttatctatttca

SEQ ID NO: 23681 - DNA, 121 bp, Artificial Sequence
  Synthesized
  misc_feature (61): n=t or c
tgagagattcctgagaccaaatcatccaaccactgtgtttgggattgcaaagaaggaaaantgaaaaacatgatgtgatggaagggtcctatagggcatcaaaacagtgatacaagaaaga

SEQ ID NO: 23682 - DNA, 121 bp, Artificial Sequence
  Synthesized
  misc_feature (61): n=a or g
agaaagacaaagtgaaaagttcttgcttcgctcctccaaacaggtacactgaaaattaatntattttgtgtacgagtgaaagggaaatgtggtgatgtgtcattcctactgctgagttgta

SEQ ID NO: 23683 - DNA, 121 bp, Artificial Sequence
  Synthesized
  misc_feature (61): n=t or c
aaccactgtgggtcacagaacttggctgtggatctccaccccgctctaccttctgtgcaanttagtggcatagaggctgcactctgctcttgtacacctgtgaacgacctgtgccttaatt

SEQ ID NO: 23684 - DNA, 121 bp, Artificial Sequence
  Synthesized
  misc_feature (61): n=a or g
acggcacgaaacctcaataaagttggtgggttttctttttccgtcgtgtaaaatacctacntataaatccgcacacagctacaaagtaatcggaggccgtcttgttttagtcgctgtgatc

SEQ ID NO: 23685 - DNA, 121 bp, Artificial Sequence
  Synthesized
  misc_feature (61): n=a or g
attacaacagggatgcattgttccaaacctcataaagcccttttgggtcgtagtccactcnatgtaacgatatgcacgttactgaaatacacgtgagaaaatgcaagaaaaagattaaagt

SEQ ID NO: 23686 - DNA, 121 bp, Artificial Sequence
  Synthesized
  misc_feature (61): n=t or c
tgaaaataccgctattacttgtgggtcattgacattgcaaggataacatttgagaaaacgngtgtagctgaaaccactctgagcatgtatattcctttcagagtttatattttcctgcttt

SEQ ID NO: 23687 - DNA, 121 bp, Artificial Sequence
  Synthesized
  misc_feature (61): n=a or g
taaatgtaaatacataaggacatcacggtcctactctgtgtaggactgtagtgctattacnccataaacacaaaatggacagtcatagggcacactccgatatctgctgatcttgtggatg

SEQ ID NO: 23688 - DNA, 121 bp, Artificial Sequence
  Synthesized
  misc_feature (61): n=a or g
tcatgagaagacttcaaagaactatatgtggtcacaaaaggaaatttgttctatgttcccntacagctgaagtttatatgacttttctgagcctgaaagcctgtaagagaagaaaaaaaga

SEQ ID NO: 23689 - DNA, 121 bp, Artificial Sequence
  Synthesized
  misc_feature (61): n=t or c
tcattttaaatgacctatagtccatactctttgagtatccttatgtcatgtgagtctaagntgaatatatacaacaaagtttataagtgtacttcaccagatgtctctaaaatcgtacagt

SEQ ID NO: 23690 - DNA, 121 bp, Artificial Sequence
  Synthesized
  misc_feature (61): n=a or g
ttttttcaccactcttgctacctttttatcatactcagaggaaaacttctctgtctttccnaaatgtgccacttcatatcctcactgccttttcagaaagaaagaaagaaaggaaaaaaaa

SEQ ID NO: 23691 - DNA, 121 bp, Artificial Sequence
  Synthesized
  misc_feature (61): n=a or g
acccagcaaagaaggtgctgttgctggaaagaaagcatcagtcaatccgaaactcacatcnagtaacttcttagtaggcgacacagctcagtttcagcattgcaaccagccagcactgatg

SEQ ID NO: 23692 - DNA, 121 bp, Artificial Sequence
  Synthesized
  misc_feature (61): n=a or g
gccactcatacttaatatgctgattttgcaagtgtgttactaaaatcaggtaaccatcatnggtaagtatatattagattaaatttgttctgttgcgaaaatttcatgatgtttactgtag

SEQ ID NO: 23693 - DNA, 121 bp, Artificial Sequence
  Synthesized
  misc_feature (61): n=a or c
actgcttccaaaaagcagcttactgcctggaccatgtgatatacatgcatatcagggaagntactccttattccagattagagcatgccaggctacagaaaatgtttaccttcacacagtg

SEQ ID NO: 23694 - DNA, 121 bp, Artificial Sequence
  Synthesized
  misc_feature (61): n=a or t
tacaaaaccaattaagagtgaaacacaaggaaaaattaaaaagtgaggaaatacagagtangtgcaaatcaggcagcagtctaatgtgaaatttactagagttgggttataaaatatacct

SEQ ID NO: 23695 - DNA, 121 bp, Artificial Sequence
  Synthesized
  misc_feature (61): n=a or g
gccgtgttttcacaccttcaaccgtatatctggttcattgcaggctgtgacgactgggacnctctgagccttcactgcaccatcaacgggaggaggatttggttcatccctaaagcttcaa

SEQ ID NO: 23696 - DNA, 121 bp, Artificial Sequence
  Synthesized
  misc_feature (61): n=t or g
tccactgggaattatcaaggatccggctccctttaagcagggatgacagagaacagctcantgttataatggcctttgcagccactgactggtttggtgttgcttacattcatgcactggg

SEQ ID NO: 23697 - DNA, 121 bp, Artificial Sequence
  Synthesized
  misc_feature (61): n=a or g
ggggctggtgtgttctgctgctctgggatgttgtactgatgaaagacaacaggatgaaacntcagcttttccactaaggccgcagtcaaatgtagttcttttgaaggcagatcttcggggc

SEQ ID NO: 23698 - DNA, 121 bp, Artificial Sequence
  Synthesized
  misc_feature (61): n=t or c
ctgttacagcaaagacaaggaaaattaacagtgtttgcatacagaccacagcaagtctaanagttggggaatttcacatgtttttggttctttttctgctttagagggggagcattttcat

SEQ ID NO: 23699 - DNA, 121 bp, Artificial Sequence
  Synthesized
  misc_feature (61): n=a or g
taatattctgctacagcatctgcctccttgttgaggcagaattcagcctggattgcagcgnaggaagtgttaaccaaacctgggggagaggactcagctctgtactgctcactgttcactc

SEQ ID NO: 23700 - DNA, 121 bp, Artificial Sequence
  Synthesized
  misc_feature (61): n=t or c
ttagataaagcacactattaatgctaagataagagactctctagacagataaatcccagtncttataaagatttgatagccctttgtgaagagatgcacaaactatttcagagaatatatc

SEQ ID NO: 23701 - DNA, 121 bp, Artificial Sequence
  Synthesized
  misc_feature (61): n=t or c
ctaccctttgtaaccctcctactgatgtttgctttgagtgaagggagcaggcatttttttncccctctcgtagtcattcgtgtattgctctcaacttgatgcaaattctgtgcaacgtggt

SEQ ID NO: 23702 - DNA, 121 bp, Artificial Sequence
  Synthesized
  misc_feature (61): n=a or g
tcaaggagtgtttgggtatgttcttagattttttttcttaaaaagcaaaatttgagtgtgnaaaagtgtgaaacaggactctttcctgcttgataagttgtgctttaaaacatggtttatt

SEQ ID NO: 23703 - DNA, 121 bp, Artificial Sequence
  Synthesized
  misc_feature (61): n=a or g
tttcttctggttaactttctagggacagctgcatcttgttgcttgtgccataggtctgttnctgtgaaaatgtgtccctttatattgttttgatttcttacccctcttgttggggggggga

SEQ ID NO: 23704 - DNA, 121 bp, Artificial Sequence
  Synthesized
  misc_feature (61): n=t or c
gccgtccccacgcagggggagccgcctccatcggctccataatcccaatcgtgatccgctngctgcatcacggcttcttattcattttggcaccgctggttttgccgttccggccgcctgc

SEQ ID NO: 23705 - DNA, 121 bp, Artificial Sequence
  Synthesized
  misc_feature (61): n=t or g
tggctttgatacacatgcaaactttagaagttatctgaaagttacctgccctctattctcngtgaacaaggctggaagtctggtgggatcaggattctcaaggggatttcttctgtttctg

SEQ ID NO: 23706 - DNA, 121 bp, Artificial Sequence
  Synthesized
  misc_feature (61): n=c or g
caaaatgcaatcagtccatgcattactggagacctcaccctcatgtaaactgaaatggagnagtgcgggtcctctcctcaaaccacctcttctgaactaaaatgttaatacagattcacta

SEQ ID NO: 23707 - DNA, 121 bp, Artificial Sequence
  Synthesized
  misc_feature (61): n=a or g
caaaaccatcagtgacctcaaggcaccaggctatgtatcctgaaaatgtgggtattctgcncatctagtgaggggttacagctgctctggagaggggctgagattgactgtggacaactga

SEQ ID NO: 23708 - DNA, 121 bp, Artificial Sequence
  Synthesized
  misc_feature (61): n=t or c
ttctgttaaaccagtagtgccacacagcagtaaatattgagaagaatacccattaagccantgaagcagacagaggtttaggaaaatagaaaagtcagtgcaatgtggttcaaaacataaa

SEQ ID NO: 23709 - DNA, 121 bp, Artificial Sequence
  Synthesized
  misc_feature (61): n=t or c
aatgaactggctgagatgaaagcaagattagtgtggggacaactttttactgaaacactanaattgtaagaagtagaggccagatatccatagctccttatgagggtgtgccacatatgtg

SEQ ID NO: 23710 - DNA, 121 bp, Artificial Sequence
  Synthesized
  misc_feature (61): n=t or c
ggaaatatttgttgcttatttcaaaggagacttgagactatatatgctaaatgggagatgnatagcagaccgtatacctgaacagcggggtccttgaagctgcaaagtctgagggagactt

SEQ ID NO: 23711 - DNA, 121 bp, Artificial Sequence
  Synthesized
  misc_feature (61): n=a or t
cggcagccccctctccccccggcttctctcctttccgaagtccttcccaactttacttccncgtgagcctccagagcaaaatagaatgagcagggaaacaaacccgacagaaaaaggcagc

SEQ ID NO: 23712 - DNA, 121 bp, Artificial Sequence
  Synthesized
  misc_feature (61): n=a or g
cacagggaggtcccaataccttctatggtgtttcctttataaatagttctccaagtgcccncacagcctatctgccccaggagaccccataatggggagcaggagaagctctcaagcccat

SEQ ID NO: 23713 - DNA, 121 bp, Artificial Sequence
  Synthesized
  misc_feature (61): n=a or c
ctccagggttcccggcctcttgcaggactgcagatctgcttcctttgcctgcccactgaanatgactcatctcttcttggacactggcccttgccattcattttctgatggtacaaaatat

SEQ ID NO: 23714 - DNA, 121 bp, Artificial Sequence
  Synthesized
  misc_feature (61): n=t or c
accctaactaacagcccctcactaaaccacgtccctgagcaatccactgagaatgaggtangtgccatttgtttcaagggaaagcagtgatctcttcacccatacatgcctttttgaatat

SEQ ID NO: 23715 - DNA, 121 bp, Artificial Sequence
  Synthesized
  misc_feature (61): n=t or c
aaatgcctgttacacaaatcaaagtctggtaatttactatccaggtgtctgatcttctaanagccaacacgctgagaaaacatttgagggtagtcagctcagtttatatatgtcccgtatt

SEQ ID NO: 23716 - DNA, 121 bp, Artificial Sequence
  Synthesized
  misc_feature (61): n=a or g
ggcagaagtaagagggcacttaagaacagagcagcagtctgatatatctgtagctgtaatngttttaattcaagtcatgcgagttgaagtggataataattctggagggaatgcacagtcc

SEQ ID NO: 23717 - DNA, 121 bp, Artificial Sequence
  Synthesized
  misc_feature (61): n=t or c
catggtcttaagcatatgatgttgaagacagcccttcctcatagattcttccatttcaganttgtgttaacaagttgttttatcctgctctgcataagacagagttgtgaaaaaggaaaga

SEQ ID NO: 23718 - DNA, 121 bp, Artificial Sequence
  Synthesized
  misc_feature (61): n=t or c
cattcatcactaattctcaatactgaaaaactgccaccatgaaactaatagcttcctcagngctgttttggtgacctcccagttccactgtcagcatcaccatgtcttacagttcacctgc

SEQ ID NO: 23719 - DNA, 121 bp, Artificial Sequence
  Synthesized
  misc_feature (61): n=t or c
tagaagtgaactgtatggttgatctgaatttacatgactttcccttgaacataattgcttncaatcttgaagtagttacatcaggagagtgcccagtttggcatagcataatggtgggtgt

SEQ ID NO: 23720 - DNA, 121 bp, Artificial Sequence
  Synthesized
  misc_feature (61): n=a or c
gctaatatcatgttgatttatggtctgtataaatggaaataaatggtattttctgttaccnagagaataatagatggcccaggaatgaacagaactctacattcacacaaaaggctctgct

SEQ ID NO: 23721 - DNA, 121 bp, Artificial Sequence
  Synthesized
  misc_feature (61): n=t or g
tggaactgccaaaaatgcaactaacatgaaataagtgttaaatgttggtcctagttttcantacactgacatatcccaactgagtcctagaagtcaagagacgtgagaagcagcccctccc

SEQ ID NO: 23722 - DNA, 121 bp, Artificial Sequence
  Synthesized
  misc_feature (61): n=a or g
cacgaaacaactgaatatccattttcttggcaaacaagccctgagtagaagaatacggaancttctggaaacatggaaaactgacaaggtacgcttgattcccaagctcaaaagtggtcaa

SEQ ID NO: 23723 - DNA, 121 bp, Artificial Sequence
  Synthesized
  misc_feature (61): n=a or g
agataatatcaaagcaatatatttaaaatggaagagcacaattattagagttcttttgtgngtgaatagatagaatacatctcgctaggtatgagtaagcaaaagagactggaaaatactg

SEQ ID NO: 23724 - DNA, 121 bp, Artificial Sequence
  Synthesized
  misc_feature (61): n=a or c
aaggcaccccagagctgtatggatctggagattggtcacagctggggcgacgtgggaaganttgactaaagcctcagacactgctgagaaatgccaacagcgggcagacacaacattggga

SEQ ID NO: 23725 - DNA, 121 bp, Artificial Sequence
  Synthesized
  misc_feature (61): n=t or g
gcactttgacacctctctctctctgtgagatgatttttgacctcttttccattcatacatngcttgtaaacaatattgtatttcaatatacttctactgtgtcagttttagggcagctgta

SEQ ID NO: 23726 - DNA, 121 bp, Artificial Sequence
  Synthesized
  misc_feature (61): n=a or t
gcagtgcacatccccacatgcttgaggatagtgcactaaaatcagtgtaaatgattacagngccttcagtggctctttgactgacatccataggttattgttcaataacaaaaaacacccc

SEQ ID NO: 23727 - DNA, 121 bp, Artificial Sequence
  Synthesized
  misc_feature (61): n=t or c
gcacattgactaatgggtgcagagcttattacgtggattcaaggcaaaatggttagtgcgnattaaagaaaggagtagaatagatttgttgatatgttataattaagaattgtatccatac

SEQ ID NO: 23728 - DNA, 121 bp, Artificial Sequence
  Synthesized
  misc_feature (61): n=a or g
agcaagagtgaacagccgtgctctgatgccacgacaggtttgtggtacagttgtatttgtncaagcgaggtgtgctgcagatacagctgtgtgctctgacagctcagcctgcagcgctgtg

SEQ ID NO: 23729 - DNA, 121 bp, Artificial Sequence
  Synthesized
  misc_feature (61): n=a or t
tttttgggctaggtactattcctatttatattttaattcttatccagctattaagatattntcgtcttatcatattatcagctaataaggagctatcgatacatttttgactgcagaaaaa

SEQ ID NO: 23730 - DNA, 121 bp, Artificial Sequence
  Synthesized
  misc_feature (61): n=a or g
tgaggtgtggatagaaaaagactgaggcaaacagtgcagcacatgcagatccaggtgatcnttctgtggcagccaaagagcaactcattgccttcagaaaggctatgcctgcagcagattt

SEQ ID NO: 23731 - DNA, 121 bp, Artificial Sequence
  Synthesized
  misc_feature (61): n=t or c
caccctgccacatccattccctggaactgggagctcttgcatcaactccctcggctaaagnagcagcaaccctactgcaaacacaacactgccggcagcagctcaaccaccatcagctttt

SEQ ID NO: 23732 - DNA, 121 bp, Artificial Sequence
  Synthesized
  misc_feature (61): n=a or g
ccttttaacacagagatctgtgttatttgtatagtatcaaaattgagttagtccactgcantgagatgaacagactgtaatgtaagactaatataaggacttaattcctttacaagttcta

SEQ ID NO: 23733 - DNA, 121 bp, Artificial Sequence
  Synthesized
  misc_feature (61): n=a or c
acccagctctgtggctgctgatggtctcgtcccatctccaggaagatgctggaaggcaagntcctgggttggcagaagagtcttaaatgccagaccagtcaaagcagaaagtcagcagcaa

SEQ ID NO: 23734 - DNA, 121 bp, Artificial Sequence
  Synthesized
  misc_feature (61): n=a or g
ctgttgtcggtaaaacatctgcagaagctgtaaaaaaagtcacattttacttctcttacantgaggaaatacagacttatcctaacaaacgccaccaatcctgtcaacttctgagagaaac

SEQ ID NO: 23735 - DNA, 121 bp, Artificial Sequence
  Synthesized
  misc_feature (61): n=a or g
caccacccaactttattcagtgaagtactcaaagcctgcagtctgaacgctactagggccnaaaaactcccataaattcttcctgcttctcatttctttcttagaattaatagtctcatca

SEQ ID NO: 23736 - DNA, 121 bp, Artificial Sequence
  Synthesized
  misc_feature (61): n=t or c
ctgcaaaattggtaccattttacagcctttaaaatgtcgatgctcctacacaaatgcatanacagaaccttcaaagagtagcaacaagtcaaactatccaatgacaactccacattctagc

SEQ ID NO: 23737 - DNA, 121 bp, Artificial Sequence
  Synthesized
  misc_feature (61): n=t or c
ctacaacatctgtgggaagctttacacgctccacgagagactcaacaatttaaaagggcantgctctttatccagatttatccctagcacaaggatacaaaattgcatattatgcccttca

SEQ ID NO: 23738 - DNA, 121 bp, Artificial Sequence
  Synthesized
  misc_feature (61): n=t or c
taagttcatactgataaagagagcatgatcctcttctcttactaccacatactgacacttncaatttatgtagcacatataggacagaactgcaccaggaatgttgcatttgtggtattac

SEQ ID NO: 23739 - DNA, 121 bp, Artificial Sequence
  Synthesized
  misc_feature (61): n=a or g
ctcccacagcttatgttaaatagggtctgagatacatggtttctgctggagacctgaaganatctttctcgaggtgcaggagcctcagcacctggataacttcccactgtacattcaccat

SEQ ID NO: 23740 - DNA, 121 bp, Artificial Sequence
  Synthesized
  misc_feature (61): n=a or g
cttgaaactgctgacctattcagtacaataccacaatagctgttgaaatgccgtggcaccncaggagctgaaggtggcaaacgtcacattcatttttaaaaagggctcttagaggtcatcc

SEQ ID NO: 23741 - DNA, 121 bp, Artificial Sequence
  Synthesized
  misc_feature (61): n=a or g
caccccatagtgctgcatggctcctccagccacagggatggatttaggacttcagcacagncctcagccaaggagcagatcatgagtaagcagaggaagcaacctgcttccagagatgcta

SEQ ID NO: 23742 - DNA, 121 bp, Artificial Sequence
  Synthesized
  misc_feature (61): n=t or c
aactacctgcactggaataacatgcgtttcgaacaaattggaagatcaaactttatacttngaagaaaaaactattacatgccagctaatgttaaagttttcttttaattaatggcaatgt

SEQ ID NO: 23743 - DNA, 121 bp, Artificial Sequence
  Synthesized
  misc_feature (61): n=t or c
ttttttaaactagggtttcctttatcagattttaacagatgtcttttcattcttcaccctnctctttcctcttccatcccctaatgttttctatggcagggaaattttgtgcaagttgtag

SEQ ID NO: 23744 - DNA, 121 bp, Artificial Sequence
  Synthesized
  misc_feature (61): n=a or g
tatcaggttgagattactgggtctgggaaattgactccatactttttccaacaacagatcnttgtaatttagtaattcatagggttgcaatatctgcttctcaacataccccacactgcta

SEQ ID NO: 23745 - DNA, 121 bp, Artificial Sequence
  Synthesized
  misc_feature (61): n=t or c
taacttgagatagacaacagacttgttcaatgcctcttataggtggccaggaactgaattnatccatggtctgtcctgatgaaagctggaaaagacactgggtaggtcactgccttatacc

SEQ ID NO: 23746 - DNA, 121 bp, Artificial Sequence
  Synthesized
  misc_feature (61): n=t or c
aagtttgtcctgagagggcccagagcagaagctctgcctgtccctttgggtctgtggctgntctgtaagactgtgctctggttcccatcctggggttcatctgggcagtagcctgaaggct

SEQ ID NO: 23747 - DNA, 121 bp, Artificial Sequence
  Synthesized
  misc_feature (61): n=c or g
ttaatgttatctttcattacactatttgaggcagaaaacatgaatttggaagatacaccantgggctggcagaatcaaatttttacactttttattttaatctgaaatttgataaacatta

SEQ ID NO: 23748 - DNA, 121 bp, Artificial Sequence
  Synthesized
  misc_feature (61): n=a or g
catgtgaaggccagctgtgcccatggggctggagtttggaggtggctcctttggaaggganggagaaaagatggaatacgactggtttttaacagcagactttgcattgcacttgaaaacg

SEQ ID NO: 23749 - DNA, 121 bp, Artificial Sequence
  Synthesized
  misc_feature (61): n=a or t
ggagaattaatctgtgatgggcttaagaaatgaaaccatcagtgatgacactgggattgcnctgactgagcatacctaatcgtttataccaggtctgttttaactgttcacacttaatcat

SEQ ID NO: 23750 - DNA, 121 bp, Artificial Sequence
  Synthesized
  misc_feature (61): n=a or g
ttcacaatagatacggtttaatactgaagtatattttattttgtaaggtagataatttacncacttcaattatctggcataccaatctaggaacttaaagtgtttgctatacattaagtaa

SEQ ID NO: 23751 - DNA, 121 bp, Artificial Sequence
  Synthesized
  misc_feature (61): n=a or g
ccaaaccctccatgatactgaaagggagaggggtgattttatgtcagtacctaacttggcnaggtcttataaatgggaagtgtcacgggaggataataaataaatgctgtcttttgaaatt

SEQ ID NO: 23752 - DNA, 121 bp, Artificial Sequence
  Synthesized
  misc_feature (61): n=t or c
ggaggaacgcttcccaaaagcccaaagaaacacctaaaaggaaaagctttaactgaaaatngtatcatgaaatgcattatcagtgtcattcattccaaccaatgccagttgtactgggcaa

SEQ ID NO: 23753 - DNA, 121 bp, Artificial Sequence
  Synthesized
  misc_feature (61): n=a or t
tgttgcttgatttttaattatcctcgtgaaatagctttatgtatcattacataaaactgcnactgataggagtgaccaaaggtacatatagatcctttgttttagaaagcattttgtagta

SEQ ID NO: 23754 - DNA, 121 bp, Artificial Sequence
  Synthesized
  misc_feature (61): n=a or g
gtggcagctgttcttccatgaggctgtttcgttcctcactccttagaaattctggagaatncagaaagttgtcaggtggaggagtaaccaggttagcagtgctggtgtctctcctgggagt

SEQ ID NO: 23755 - DNA, 121 bp, Artificial Sequence
  Synthesized
  misc_feature (61): n=a or g
tttatgtgatagccaaaacctaatttcatgatccctttttgcgtttgcctattacaaaatnttgtagaggtacagacctcagcagagtttggagcatttcctccagtttatagcaaaccaa

SEQ ID NO: 23756 - DNA, 121 bp, Artificial Sequence
  Synthesized
  misc_feature (61): n=a or t
ttagttctaaataatacagtgggcatcggtcattgactgatgatgaatgtcaatcagcagntgttgtggtaaaaggggaattttaagaaatatttcaacgagacaaaaaaatacacacttt

SEQ ID NO: 23757 - DNA, 121 bp, Artificial Sequence
  Synthesized
  misc_feature (61): n=a or g
catcagtgaattgcttcatctccagtgttcatttcccaaagtgggatgatacagtggcctncattcttttaagtgaggaaagttgtttgtttgtaggacgtggtaactgctgagctcgaaa

SEQ ID NO: 23758 - DNA, 121 bp, Artificial Sequence
  Synthesized
  misc_feature (61): n=t or c
agcaaaccctataagagcccctttgcactgagaagtgatctctttcaaagcagaaggagcngcttggtgcattctcaaccatcagtgcaaaagcccaacagccaacagttgcacagctgca

SEQ ID NO: 23759 - DNA, 121 bp, Artificial Sequence
  Synthesized
  misc_feature (61): n=a or g
tatttctgcttaattggatgtactcttaattatttgtactccagtagcaaagttgtaacanaggtggtgatagaaaagaaatattttgtagtttattcaaaagcttccttttttttttttt

SEQ ID NO: 23760 - DNA, 121 bp, Artificial Sequence
  Synthesized
  misc_feature (61): n=a or g
ggagaggaacatttaacttgaaatggggcaaacgagggcagtttgggtggttggggttccnggagaggcctggccagagctggaggttgcgaggtgctgccaggagcaggagggaccctgc

SEQ ID NO: 23761 - DNA, 121 bp, Artificial Sequence
  Synthesized
  misc_feature (61): n=t or c
ctaacgcttaccagatgtgacaggtagactggggaccagtactgcctgacacagtgtaaanctgtgtttcccactggagcagcgaaacaactaaatcagcatgcctgtggtgtcctccagc

SEQ ID NO: 23762 - DNA, 121 bp, Artificial Sequence
  Synthesized
  misc_feature (61): n=a or t
cattaagtttggtaccaaagtaaaaaaaaatctatagaaaacgaggtcaaaagttatttgnaatagagaaaagagcatcactggatgctgcacctaaagatggtgccagcagaggtaagag

SEQ ID NO: 23763 - DNA, 121 bp, Artificial Sequence
  Synthesized
  misc_feature (61): n=t or c
tcagtggagctgagttgctgtatccagttgggtccagtgcaggaaagaccaaaaacagctncttccatgcctaagtaaaacaaaccagacactgaaagcatcggtgctgcacaaagcattg

SEQ ID NO: 23764 - DNA, 121 bp, Artificial Sequence
  Synthesized
  misc_feature (61): n=t or c
ccttcttgatcaatgaatttacaaagctatattggctcttcatctgtcagaaattaatggngagtcttttgactttcaaaaagcaattaagcttagagtgaaccaggtttaaacatttatt

SEQ ID NO: 23765 - DNA, 121 bp, Artificial Sequence
  Synthesized
  misc_feature (61): n=t or c
ctgactgctgccaagcaaacggcgagaggaagctgtgattctcccttcaacccaaacaagncaatgttcaacctctcaaaggccacacaaaaattaagctgtcacctaaatatcctcagaa

SEQ ID NO: 23766 - DNA, 121 bp, Artificial Sequence
  Synthesized
  misc_feature (61): n=a or g
gaagcaaggaaatgcatttgctatttctccacctactgcatagattggagaggaatcaatntttctccttgcataactgttagcaaaatattatcacaactgagaggaaagaaagatggcc

SEQ ID NO: 23767 - DNA, 121 bp, Artificial Sequence
  Synthesized
  misc_feature (61): n=a or t
acaatctaaggagaagttaagtctctagggtgcaggaggccaaatgaactctgcagatatncagagagtaatgtaaattattgctacttaaaaataaataattaaaaccacacaaccgaat

SEQ ID NO: 23768 - DNA, 121 bp, Artificial Sequence
  Synthesized
  misc_feature (61): n=a or c
taaatgtaaaatagacaaaccttaagtccttgcacacattactcagtctcttcagacacanaataggatttctctgactttaaagtatttgaaaatttgtgtgctatcattacagatattc

SEQ ID NO: 23769 - DNA, 121 bp, Artificial Sequence
  Synthesized
  misc_feature (61): n=a or g
tacttgcacccacacttatagcttcaaattcttccaaataaggggctagattctgcttcanaatttttctcagagtcgttccagagtctggtgttaaatcataccctactatatttgacat

SEQ ID NO: 23770 - DNA, 121 bp, Artificial Sequence
  Synthesized
  misc_feature (61): n=t or c
taaggtagtgagtataactttcctggacctcaaaattgacattcaggatgttttatagttnaaggaaagaaaatcttgattgatgtcctgaggatatcaaggatttctgtcaccatcccat

SEQ ID NO: 23771 - DNA, 121 bp, Artificial Sequence
  Synthesized
  misc_feature (61): n=a or g
cacaagaggagctgggtgtgagcaagcatctaacctgaagattacgatttaaaagtcaacncttaatttatttactgatgatcatgtctgcaggaacacacagcctgattacattaaatac

SEQ ID NO: 23772 - DNA, 121 bp, Artificial Sequence
  Synthesized
  misc_feature (61): n=a or g
gccagcctgagctgctgcccacacaggagaaggtcagggacaccaccagctcaggaaatgnagtggttgaggagctcctggcgcttaggagaaaccctctgggccaatgtcaggacaagga

SEQ ID NO: 23773 - DNA, 121 bp, Artificial Sequence
  Synthesized
  misc_feature (61): n=t or c
ggagaagaagaattttgacttgaaaaacatagaactccttatttgagcatgtggtgcatcnataaagtctagctgcagtgaaggggcttgtgtttcatgggacagccactagacagtgata

SEQ ID NO: 23774 - DNA, 121 bp, Artificial Sequence
  Synthesized
  misc_feature (61): n=t or g
tcttctaccttagtactgttgatctgctgccgtacattttggcttgtatggtcaaggacantgctttctaaaatgctatttcctgggtcaacagaagtaaactcttcacttttcaagtctt

SEQ ID NO: 23775 - DNA, 121 bp, Artificial Sequence
  Synthesized
  misc_feature (61): n=t or g
aaggtgcccctgccctccaggcagcatcccagactcaataggttgggtgttattctggcanctaggctgcccacagccttcagctctactcctcagtatggcaagggtgagctctgcttgg

SEQ ID NO: 23776 - DNA, 121 bp, Artificial Sequence
  Synthesized
  misc_feature (61): n=t or c
ggtctggaaaatcagattaatagttaataagaactaatgtatttcatgctttcagtgctgntgtgacgacatacctccattaagactataagcttctgtagaaggaaaaaaagttggcctt

SEQ ID NO: 23777 - DNA, 121 bp, Artificial Sequence
  Synthesized
  misc_feature (61): n=t or c
ttcgcttgatattctttcaacacttgtctcaggactcttcacctcaagtgacgcttcaatngtcatcttagtatctgaggaaggaatatcatcagcagctgatttcagtgtcagctcatcc

SEQ ID NO: 23778 - DNA, 121 bp, Artificial Sequence
  Synthesized
  misc_feature (61): n=a or c
cacactaatgaaatggcaacagtagttttcagtcttgaatatgtcctcatatgccatagtnctttcggtaaatgtgttgtgaactaaactgaatccagtttggtacaattttatcatgttt

SEQ ID NO: 23779 - DNA, 121 bp, Artificial Sequence
  Synthesized
  misc_feature (61): n=c or g
gtgagaaatacacataaatactgcaccaactgggttttaccaaccagaattttacctcttnttgtcaatagatttatataatgagacaggagcctcaacacagcaaggggcacactggtaa

SEQ ID NO: 23780 - DNA, 121 bp, Artificial Sequence
  Synthesized
  misc_feature (61): n=t or c
tttagaagaggataggcagttaggagcctgtgtccaacaagccttcagctggaggtctganggacatgtggcagcaaactgcatctgttaaagtaaatctaatctagcaaatgtctgtact

SEQ ID NO: 23781 - DNA, 121 bp, Artificial Sequence
  Synthesized
  misc_feature (61): n=t or c
ggtgtgctaaagacagagtacaaaatttgcatcttctgaatgcaaaactaatttagccctnaaggccacatggcattccagattcttggcatgccacttgaaaagaaacgatttttattta

SEQ ID NO: 23782 - DNA, 121 bp, Artificial Sequence
  Synthesized
  misc_feature (61): n=t or c
cagcatttaattgttactctggtaccaggcataaagctatgactaatacaccatcctcctnctactgggatttttatggcttaaaatcaggtattaaaagattgaaatctaaaagaaattt

SEQ ID NO: 23783 - DNA, 121 bp, Artificial Sequence
  Synthesized
  misc_feature (61): n=t or c
ttgcactaattaaaggcatgttaaacatacctcctttcaagccccttacatttgtctggantgtgaagtcacaggatccgtttgtaagaattaggagaatatgtactgcccatgaagttag

SEQ ID NO: 23784 - DNA, 121 bp, Artificial Sequence
  Synthesized
  misc_feature (61): n=t or c
aaatcatagatgacatgaaatattccaccatgcaattatgcatgtcaacgttttactgtantttgagtaagatgttttactgctgacctcagaattgataacggaggtgtaacagtcagct

SEQ ID NO: 23785 - DNA, 121 bp, Artificial Sequence
  Synthesized
  misc_feature (61): n=a or g
ggatgttcatagcctctgaattttacactattaaatgctcaacataataattaggtttgcnttgcatgtggtgtgattataagaggccatcaaggaaaacatcagtacttacaggatgcaa

SEQ ID NO: 23786 - DNA, 121 bp, Artificial Sequence
  Synthesized
  misc_feature (61): n=t or c
gtggtggtggtgtttgtcttctttgcaaggacatcctgttgctatgttcatttttgtcttnagagacaaggatgctgctcttgaacatgtctgtcaagcttccttggccctgactcgtcag

SEQ ID NO: 23787 - DNA, 121 bp, Artificial Sequence
  Synthesized
  misc_feature (61): n=a or c
gcaccagatcagcctcacagccagcaccccacagccagaacactgaggttctcaattcccnatggtagccctcccctgagttggccaacccttccttatagaatcaccaatgttggaaaag

SEQ ID NO: 23788 - DNA, 121 bp, Artificial Sequence
  Synthesized
  misc_feature (61): n=a or g
cttctaagaaagactttaccttgctgaagccaaaaaagctgaaaaatccacatcagcagantgacacggtcaccagcacagaatgttttccagcatttgtctgtgctctggactttaacaa

SEQ ID NO: 23789 - DNA, 121 bp, Artificial Sequence
  Synthesized
  misc_feature (61): n=t or g
aaagtcaacaagtccttttgacgtgggtagcattcaataattgcatttgagaaaacagttnaaaaaaagtttagcatggattcatatgaattaagaagtacatccagttccttccacactt

SEQ ID NO: 23790 - DNA, 121 bp, Artificial Sequence
  Synthesized
  misc_feature (61): n=t or c
gagctgtcacgtctgctcttggtgatgtggcacacgctttgaaatgtagaaacactgatangccctggatgctttctgacttggacttggtggctaagagtgagggcagaggttggttttg

SEQ ID NO: 23791 - DNA, 121 bp, Artificial Sequence
  Synthesized
  misc_feature (61): n=t or c
atgcccaccagcccaggacccggctgccacttccaacacctccaggctccaggacgcagcnttgcagtaggaggcctggcagtctaatcctgggcctaagaaagactttataattaaacag

SEQ ID NO: 23792 - DNA, 121 bp, Artificial Sequence
  Synthesized
  misc_feature (61): n=a or g
ttagtggagaagaattctactgaggctgaaattgtggaaggatccaaataaaaaggatttnttattcatgtaaacaccctggtactagtatcaattaactgtcctaagagaaacttttctg

SEQ ID NO: 23793 - DNA, 121 bp, Artificial Sequence
  Synthesized
  misc_feature (61): n=t or c
ttcgagtttgatgaaatgaaaggcttttttgaatcacaaattaaattaaaggaagaaatcngaaggtactcttctggatacgagtttaactgatggctgccagtttttctgttcttcctta

SEQ ID NO: 23794 - DNA, 121 bp, Artificial Sequence
  Synthesized
  misc_feature (61): n=a or g
ttcagcatgtggttaaataagagatctccagaggttccttgtgtcctgcttagtcctacanttctgagacttcttggagacatagatgtcccctttcccccgtgtatttacttacacaata

SEQ ID NO: 23795 - DNA, 121 bp, Artificial Sequence
  Synthesized
  misc_feature (61): n=c or g
accagtgcaccctcctctcactccacacaaaagtacccgaactgacaacaataaccaccantctcatcggaagacaaaggcaaccctagaagaaaatcacgttatttgtttcttttctatt

SEQ ID NO: 23796 - DNA, 121 bp, Artificial Sequence
  Synthesized
  misc_feature (61): n=a or c
aggagctacaggaacgaaggagttgagaagcctttgcagttatgaagctgcagtcaccaangtccagaagtacacgcgttatttcatatatatatccaccctctctttcagtgtctaaggg

SEQ ID NO: 23797 - DNA, 121 bp, Artificial Sequence
  Synthesized
  misc_feature (61): n=a or g
gatggctgctccacggtgcagcaggtactggcagagctctgagtggctcatcttggcagcnaggatcaacggcgtgcagccattctgggcagagataaattgggtgaggttctggggatgg

SEQ ID NO: 23798 - DNA, 121 bp, Artificial Sequence
  Synthesized
  misc_feature (61): n=t or g
agctcaatagcattaaactcatctaacagcagatccctaaagcagggctgaccaccggccngcagcaccatcagcattccaaccaacagcagctctaaaagtcctgtcggtttacacgttg

SEQ ID NO: 23799 - DNA, 121 bp, Artificial Sequence
  Synthesized
  misc_feature (61): n=t or c
caaggcaaaaagaagctatatagtgattggctttttctggggagctggacataaacattgngtgctctgatgttgggaggcattgccccactggcttgtttctgactgtcaccaggtgcag

SEQ ID NO: 23800 - DNA, 121 bp, Artificial Sequence
  Synthesized
  misc_feature (61): n=a or g
ctaaggctcagcactggatgaactaacctgcacataaacccatacaattactaagaaaacntactacactaacactgcagttctgggatcatcaccatgttaccctggacaaaaagctcca

SEQ ID NO: 23801 - DNA, 121 bp, Artificial Sequence
  Synthesized
  misc_feature (61): n=a or g
ctatcttacatataatttatgcatctgctaaataaatgccaggttcagtcagaaggcctgngactacattagtgttgccatgactgcacagtcaaaaggaaactgatgtcaaggttctgaa

SEQ ID NO: 23802 - DNA, 121 bp, Artificial Sequence
  Synthesized
  misc_feature (61): n=c or g
tgccagatctcaccacatgcagcacagtgttttggtgttgggaaaggaatgattttggggnacttggtcagcacattgtctcccagtgagaggcaatgacaagcagaaacaaagtagaaac

SEQ ID NO: 23803 - DNA, 121 bp, Artificial Sequence
  Synthesized
  misc_feature (61): n=a or g
gcccgtgggcacttggctggtgagcgacaacatttctgacatgggcaacgtgaaagctgcngaggagactaaaatgctgaagtgctggtttaacagttaagaggctaaaaaattaagcagc

SEQ ID NO: 23804 - DNA, 121 bp, Artificial Sequence
  Synthesized
  misc_feature (61): n=t or g
cctaatgatccctattgattatttatttgcaacaaaaacagcagaatgttgttaccaagcngatggcaacatcagccagggagacaagaaaaaagcatatgaagaggcttttgctacctgt

SEQ ID NO: 23805 - DNA, 121 bp, Artificial Sequence
  Synthesized
  misc_feature (61): n=a or t
caaaggtagccctggaggcctgtatgtttagacacctatgggaggtgttgagtctttgagngacagaggccaagagaactagaggccatactattatctgtctctgtaaagtctaaggata

SEQ ID NO: 23806 - DNA, 121 bp, Artificial Sequence
  Synthesized
  misc_feature (61): n=a or g
tgtggccatggggcaaaggatcctctggatagctttgttttctatctgtattccaagatcntagagataaaaaggctccattgtgtcctgcctggaaaaaaggaaataaaacctgggatgg

SEQ ID NO: 23807 - DNA, 121 bp, Artificial Sequence
  Synthesized
  misc_feature (61): n=a or t
tttcttaatttgtctaattactaactgttcttgttgttcagagctactttgcataacgtantacacttgaaaattttgaatcttgatcattacaacccttgctgatttgattttttttatc

SEQ ID NO: 23808 - DNA, 121 bp, Artificial Sequence
  Synthesized
  misc_feature (61): n=c or g
ggctttcccaccagcagcacgctgtgacacacctcaccccggacgttctaacttggcaagnacagtgctgcacaaggaaggctcagctcacctgcactactgcgctcctatgtctgcacca

SEQ ID NO: 23809 - DNA, 121 bp, Artificial Sequence
  Synthesized
  misc_feature (61): n=a or c
ttgtctctggaactttctgaattcatctcttcagctttatgaatctgacctcagagggcangaagatgaaaccttgatgatctaagttaaccctttcgatattgcagctgctgctagaaag

SEQ ID NO: 23810 - DNA, 121 bp, Artificial Sequence
  Synthesized
  misc_feature (61): n=c or g
tgcagagcctggtcagcatccgctcagcttgtgctgtgctgggttggataccagtccgctnttcctgtgctccgttccctcttatctcagtctcaaagtccttaaaggaaagcacttggtt

SEQ ID NO: 23811 - DNA, 121 bp, Artificial Sequence
  Synthesized
  misc_feature (61): n=t or c
gtttctttagacaaaacattaatgataaatatctgtttcttcaatgtaagacaagattaancacaggtaaactattgagaagaaactatgctatagccatgtggagtctgtgatctgtttc

SEQ ID NO: 23812 - DNA, 121 bp, Artificial Sequence
  Synthesized
  misc_feature (61): n=t or c
agttgtttcaaaaaggtatttactgaacccacagcaaaactaaactagtgtcagttagttnaatctacctatgtgttttctgcaatggaacaataagagagaaatccactacaagagaggc

SEQ ID NO: 23813 - DNA, 121 bp, Artificial Sequence
  Synthesized
  misc_feature (61): n=a or g
cctttaagattgttaatactgtatcagtgcaagtgttcagataatgcatactccaaagacntttaatctaagcagcagctcataaggatgtgatttgctttagataatttctaaagtcagc

SEQ ID NO: 23814 - DNA, 121 bp, Artificial Sequence
  Synthesized
  misc_feature (61): n=a or g
gcacccaactttccttgggttgacgtcacagtaacaaaataccaagctcagtgtttctcanagagtctttatagcctgtgttaaaacttcattaagtttttgttttccccagagtgtccag

SEQ ID NO: 23815 - DNA, 121 bp, Artificial Sequence
  Synthesized
  misc_feature (61): n=t or c
gagacaaactgtgcatctctgtagtttcccagcatttctcaaactcattacgtttgtgtcnacagcatccagtttcaagcaccttttccttgctgggcaataggtagcttacatgcagttt

SEQ ID NO: 23816 - DNA, 121 bp, Artificial Sequence
  Synthesized
  misc_feature (61): n=c or g
aaactcattccagatttccccactggcaaggaagaaagcccatcaattagccagtgcagtngagctgtgcaaaaatatccttgtaagtataagctactgctaattacagaactgccttcag

SEQ ID NO: 23817 - DNA, 121 bp, Artificial Sequence
  Synthesized
  misc_feature (61): n=a or g
tttggcaggtatcttgaaataataaagaaatattttcagtcactgaatcaaactaaccatntaactttttaacttgcactgctgcttcatttgattaggttagaaaacaagtcatgatagt

SEQ ID NO: 23818 - DNA, 121 bp, Artificial Sequence
  Synthesized
  misc_feature (61): n=a or g
gaacatgtagtacagaagcaggttcagtgacagttttgaacattttctgccaacaggaggntattgactaggagctagacattaggatactggatactgaggtattatcctggtagtggga

SEQ ID NO: 23819 - DNA, 121 bp, Artificial Sequence
  Synthesized
  misc_feature (61): n=a or g
gacctgctcatctctgatgtttcttgatatattaccatatattgcatgtatagtgttttgntttcaattgtcttctgagtggaatttaggcaatgtcattatggcaaacatataaggaaag

SEQ ID NO: 23820 - DNA, 121 bp, Artificial Sequence
  Synthesized
  misc_feature (61): n=t or c
aaagacccaaagagcttttaaaaaagctaacccagccatcagaagaggttctgggcaaacnatgccatagagacaagtggcagagctacaaaccagcaggacttggaggcttccccaagca

SEQ ID NO: 23821 - DNA, 121 bp, Artificial Sequence
  Synthesized
  misc_feature (61): n=c or g
cctcaatcattgctcacaaaataagttatatcatgcaaagattaatgtgacaattaagttnttactgctcaaagaactgggacaacatttcctggcttactagtttggatagctgaataat

SEQ ID NO: 23822 - DNA, 121 bp, Artificial Sequence
  Synthesized
  misc_feature (61): n=c or g
agatatacaacttcttacttgtggaattctttatgtaaggccacctcatctatattttttntttttgtagaggattttgatatgctattaaggagagagtacttgtgtgaaaaaactgttg

SEQ ID NO: 23823 - DNA, 121 bp, Artificial Sequence
  Synthesized
  misc_feature (61): n=a or c
tatacatagaatactaagtcagacttgttatttgaagggagcagggtatactgagtgaaantgttttgtttcatgataaaaaagcagcttaggtccaccactttccccataccactgaaat

SEQ ID NO: 23824 - DNA, 121 bp, Artificial Sequence
  Synthesized
  misc_feature (61): n=a or g
catgtggacctttccccccaccccccctctatttatgcagccaactctcatcacactgttntattttttgttgaaattatttcatcaggaaatgatttcagtcaggagtgatttcatctgc

SEQ ID NO: 23825 - DNA, 121 bp, Artificial Sequence
  Synthesized
  misc_feature (61): n=t or c
ctgttaacacttggtagagcttgtctacaatgcttcttgctcaagggttcataatatatgngtgtgtgtaactctccaaggtagtgtaataccagcattgaagcacagaagtataaccttg

SEQ ID NO: 23826 - DNA, 121 bp, Artificial Sequence
  Synthesized
  misc_feature (61): n=t or c
cttttatttcctaatggacaaaaacacacgagcagtcagaagtaacttgcagatatatagntgatctgacaatttgtttaattaaggctttaaaaatttcaaatccttctgagaagttgaa

SEQ ID NO: 23827 - DNA, 121 bp, Artificial Sequence
  Synthesized
  misc_feature (61): n=t or g
ttgataacagtctgtttgattctgctgctcagtgggacacaaagcagatatcctccagggnggggactgcagcagcccttgctattgcagtgcagtcagggacacgggatttgtggggtga

SEQ ID NO: 23828 - DNA, 121 bp, Artificial Sequence
  Synthesized
  misc_feature (61): n=a or t
cagtttccacaagtctgcagtttcatctctttagagtattttctcatgtgcttccatcctntctctgagatttgcagtaaaattcacttggcctctgtaatctggcagggatgtttctgca

SEQ ID NO: 23829 - DNA, 121 bp, Artificial Sequence
  Synthesized
  misc_feature (61): n=t or c
tctcaggttttgtggtgacttttagctgcatgtgatggttgcagcggcagaggcttgcttngagggaaggagcaaactctttgtaccttctgctgggctgaacgctctgtagtccggtccc

SEQ ID NO: 23830 - DNA, 121 bp, Artificial Sequence
  Synthesized
  misc_feature (61): n=t or c
tctgatttgaggagtcatctttaatatcttgccagtgatcttcagaagcaggaatgcaccngtatcaaattagcaggcccctgaggttgggggagtgcagtcagcatgtttgaatacatgg

SEQ ID NO: 23831 - DNA, 121 bp, Artificial Sequence
  Synthesized
  misc_feature (61): n=a or g
aaaccttctgtttagagtttttaggagcaattagggcaagtaatggttgatttaacacatnggtaagaatttgtgttacagatattctcctgtgcccagtctgtagggtgaaagagaagta

SEQ ID NO: 23832 - DNA, 121 bp, Artificial Sequence
  Synthesized
  misc_feature (61): n=t or g
gactactccaggcataaagacattaaggtttggtttgtgctgcagtgcagagctcttggangtgtcagtactgtactgtgaacagacagcttgtatgacgtcctaaaggtatccacgcaga

SEQ ID NO: 23833 - DNA, 121 bp, Artificial Sequence
  Synthesized
  misc_feature (61): n=a or g
gacactgccttagtgtccgtatgcagtctaccagccttcctagctcttactgcattagaantggacaactgagtaaaacttcttgttagaaggctgtctgatggcaccaaaaatgaaagct

SEQ ID NO: 23834 - DNA, 121 bp, Artificial Sequence
  Synthesized
  misc_feature (61): n=t or c
ctggggcttcaataaaacaatcctgctgattgaaacatcacagtccttcctaagtatagantttctctgtcttgttcaagaccacttcagacctcttgctggttagaaaccacactcattc

SEQ ID NO: 23835 - DNA, 121 bp, Artificial Sequence
  Synthesized
  misc_feature (61): n=c or g
aaattatgcactcagcttgatgcctttatttaactcctctccataacctgcattttagtgntatagttattcagctacaagactgataggagcaaaaggcattagatttagctttaaacaa

SEQ ID NO: 23836 - DNA, 121 bp, Artificial Sequence
  Synthesized
  misc_feature (61): n=t or c
ttttcagaatgatgttttagaaacatctgttcgagttgttcacacctgagtttttgaaacngacggccattttctcctcgctgtgacttcagcttgatccatgatcactgtgtgctcatag

SEQ ID NO: 23837 - DNA, 121 bp, Artificial Sequence
  Synthesized
  misc_feature (61): n=t or c
gttgtaaaagaatatatttcagccccttatagaaaggataatacttttcgaattgtactgncaagcattcataacacctacaaaacaccttgcaaaaatagtaattgctattacactgcac

SEQ ID NO: 23838 - DNA, 121 bp, Artificial Sequence
  Synthesized
  misc_feature (61): n=a or g
ttccacacggactctctgcccataccccacagctctgctgcttaatggaataaaagtgccnttacacaacatgctcacagtcaacgaacaccagagctaggaaaggttagtttctaccaac

SEQ ID NO: 23839 - DNA, 121 bp, Artificial Sequence
  Synthesized
  misc_feature (61): n=t or c
accacaactgccaaaataacgaaatctgaaaaccttaacataacagctttctccctgtggnactttgaaaggttttccagcatttactagaaaatgaaaaatatgcaggagggaagtagtc

SEQ ID NO: 23840 - DNA, 121 bp, Artificial Sequence
  Synthesized
  misc_feature (61): n=c or g
ggaggaggaaggtggcagcagccttgtcatcatgatacaggttcaactgagaagaagaatnattactcctctcctttaggaggcacagacacatttctcttaccacaggctgagagccact

SEQ ID NO: 23841 - DNA, 121 bp, Artificial Sequence
  Synthesized
  misc_feature (61): n=a or g
cttaacactgatgttaagcaagctactggggacctccagcataagagtacattcagatatntaactctccaaaacaaaaatgtaattttaaatagctctcctcgtttgtaatcctgttggt

SEQ ID NO: 23842 - DNA, 121 bp, Artificial Sequence
  Synthesized
  misc_feature (61): n=a or t
tagtaagataaatctaatttttttgtttgtttcttttgtgaaagtgagtgcattcacactntgacaggttcaaacttccactgctgctgctgacagttagctctgatatatgcctaggcat

SEQ ID NO: 23843 - DNA, 121 bp, Artificial Sequence
  Synthesized
  misc_feature (61): n=c or g
agaagcggccgttgtgcacctccattcctctcctccttgtttggagaaaactacagagctntgaacaacgtgcgaccgttgcaatgcttcacattccagacaagtgacaggagcagctcag

SEQ ID NO: 23844 - DNA, 121 bp, Artificial Sequence
  Synthesized
  misc_feature (61): n=t or c
actggcattgctattattaaagcagtaaagagtcctaaggacaaaaatatactattacttncccctctacagatacctcctcctctaaaaagggtgttctcttaatacaagcttccagcaa

SEQ ID NO: 23845 - DNA, 121 bp, Artificial Sequence
  Synthesized
  misc_feature (61): n=t or c
aaagaaaaataaaaggaagggagggggactatttcaagtctccagaaactttgagtgaagnttcatggtattctgcttctgtagctcttaaatccagcaagcacctactcaaacctcatgc

SEQ ID NO: 23846 - DNA, 121 bp, Artificial Sequence
  Synthesized
  misc_feature (61): n=t or c
tttagagttttctacaacaatagcaaccataatttttatccggtaactgatacttctcatnagcatctgaccatcttgcggtagtattgaaacattttacactgctgaattttattttcag

SEQ ID NO: 23847 - DNA, 121 bp, Artificial Sequence
  Synthesized
  misc_feature (61): n=t or g
tgcggtcgagccaggttggaagttgtgaatgcagtttgatttgttgttaaatgaaaatttngttgtaagatgatgtatttaaaagcttctcttgatttctgcttcctcctctcttcttttc

SEQ ID NO: 23848 - DNA, 121 bp, Artificial Sequence
  Synthesized
  misc_feature (61): n=a or c
agatataaatatatttctggatctagaaacatgcgtcttaattgtcaagcacagacactgntgttgaaagaaatggatatacacatatacgtaataaaatatgcatctaggaaaacatcca

SEQ ID NO: 23849 - DNA, 121 bp, Artificial Sequence
  Synthesized
  misc_feature (61): n=a or t
tgtctgataaaacttcagtatttagacccattggagctatgtgaatttccaagacaagggnaaattaatactgttctgggcaaggtgtgtctgctctcctgccagtttacactgaatccct

SEQ ID NO: 23850 - DNA, 121 bp, Artificial Sequence
  Synthesized
  misc_feature (61): n=a or g
ctctcatcagggaatcatacatggatgggttctcttatgaaatctcttatgagatttcagntatgagctcttcctcattcctatgctgaaatgtaacacttttcagaccgatgttgcatat

SEQ ID NO: 23851 - DNA, 121 bp, Artificial Sequence
  Synthesized
  misc_feature (61): n=t or c
gtcctatgtatgtacatcttgagacagtttcaggcctcttcacccctttttcagttcatancctgctcccttaattatcctttgcagtgctgacacagagacaagcagagtttgctgtcca

SEQ ID NO: 23852 - DNA, 121 bp, Artificial Sequence
  Synthesized
  misc_feature (61): n=t or g
aataatctgtaagtgtgtgagaaagcttcagttctagagctaaaaccgtttggctcgttanggcagcctgccaccacaggacaaatggcattggagtaatatccttatgttaaaacagaat

SEQ ID NO: 23853 - DNA, 121 bp, Artificial Sequence
  Synthesized
  misc_feature (61): n=a or g
gaaacactggtcaacagtttgcactttccttcttcctctgcatggaaagaaaatagcacanaaaaggcctggcacaaattttatgttgattttttttgttattaagagaggaatcaccgcc

SEQ ID NO: 23854 - DNA, 121 bp, Artificial Sequence
  Synthesized
  misc_feature (61): n=a or t
ttagaagatcttaacgcttatattttccttttttgctttaaatgagtggggatctttgaancctgtgaatgtagatttttaaaggacaaaatggagaaaatataaattcctgattgtgaat

SEQ ID NO: 23855 - DNA, 121 bp, Artificial Sequence
  Synthesized
  misc_feature (61): n=a or g
tgaattccaggaacatatgggattattgagaaagaaaattgtgtgaacaagggcaattatngcagtaactaaccatggcatagactgcaccgagtcatccaagcataacatagatataatg

SEQ ID NO: 23856 - DNA, 121 bp, Artificial Sequence
  Synthesized
  misc_feature (61): n=c or g
catagttcataaatcagttgaatgcacacatccagcaaaaacaaagggagtatgtgagttnaactaactcaaatgtgagcagcagtgcctcagaagttgtggaaccacatgatcagaagaa

SEQ ID NO: 23857 - DNA, 121 bp, Artificial Sequence
  Synthesized
  misc_feature (61): n=a or g
tgggttttgtgctgtctggatatgatcgtggccaagttctctgtcagactactgagcaccnttttcctgctttgcacagtcagatcagctggggtcagcatctcaggaacttatcatctct

SEQ ID NO: 23858 - DNA, 121 bp, Artificial Sequence
  Synthesized
  misc_feature (61): n=t or c
cccattccagttaagatgcacataaacagcagaggtactgaagaaaaaatattagtatcanttttaagactgtctgtcagatcccttaaaaatcacatttttcattccttatagcttttca

SEQ ID NO: 23859 - DNA, 121 bp, Artificial Sequence
  Synthesized
  misc_feature (61): n=t or c
atggtgcccagaagtaaaacaggtccctacttgagtgggtgtggcagtgttgctgctctcnttgggcaggtagtagggaagggaagctgtgtgtgcattgagatgttctctaccttggacc

SEQ ID NO: 23860 - DNA, 121 bp, Artificial Sequence
  Synthesized
  misc_feature (61): n=t or c
gctcctttgtgaggctttctgctgtttcctaactgttgaaatgctgagagaatcttaattnatcataatgtcaatttaggagtagtttaagccaagtagcagctatttttacgtcagaaga

SEQ ID NO: 23861 - DNA, 121 bp, Artificial Sequence
  Synthesized
  misc_feature (61): n=t or c
ctttgtaccttgttgcgttggagaaaagctcttatccatgtacctggaaaggagcagacantctccttttccatgcccttacaaaaaccctaaaataataaaataataaaataataaatat

SEQ ID NO: 23862 - DNA, 121 bp, Artificial Sequence
  Synthesized
  misc_feature (61): n=t or c
tgagctcaggtagcagcccactcccagctgttcatcatttactggtcagtcagtaccaaanagaagcctccttatggaagctgaactcctatcctgtgcccagcactgaacttatctctgt

SEQ ID NO: 23863 - DNA, 121 bp, Artificial Sequence
  Synthesized
  misc_feature (61): n=a or g
atgtccttttattctggtcagctttccagccggtcttctccaagtctacatgactgcatgngattattatgacccaaatgcagcactcagcattgactgttgttgaatatcctgtgattgg

SEQ ID NO: 23864 - DNA, 121 bp, Artificial Sequence
  Synthesized
  misc_feature (61): n=t or c
tgatgttcaggattggagaccccatgagccaggcagatatggggcagctccagcatgattngttttggttctcctgtttggaagcctttgcactgcaatctactttatagatatgattttg

SEQ ID NO: 23865 - DNA, 121 bp, Artificial Sequence
  Synthesized
  misc_feature (61): n=a or g
aggcaggacgccgatcccctggtgggtcggtgtgaggctgcgggtgtttcctggcactgtntggatgtgcctttcggttttgaggctgcaaattcctgaatccccttagagaggggtgtgg

SEQ ID NO: 23866 - DNA, 121 bp, Artificial Sequence
  Synthesized
  misc_feature (61): n=t or c
tgcattctagctcttcagtaaggcttgtgtgtccgtaagaactggatttgatctctcttcnattccaagctgattcaagtgcatagtatggtttgctaaactacaaggcaggtggtttatt

SEQ ID NO: 23867 - DNA, 121 bp, Artificial Sequence
  Synthesized
  misc_feature (61): n=c or g
gccttctattatttttccttttttcatttcactagtgtacttcagatttgtttcatttaanatgaaaggttatgcttttcatatgctacatcgacatagccacaggccaaaataaatatga

SEQ ID NO: 23868 - DNA, 121 bp, Artificial Sequence
  Synthesized
  misc_feature (61): n=a or c
ccagctgcaaagccactgagcttctctgctgctacttttctcaacttatcccatctggcantgagtcacctcccagtagagcaggtagggtggtgactgtctgcttccctgggtgctcagg

SEQ ID NO: 23869 - DNA, 121 bp, Artificial Sequence
  Synthesized
  misc_feature (61): n=a or g
cactgacatcacaactgtacccaggagtaaggctctaattttgtggtctttgtgacagaancgcaagtgcctgcagtactttggtggcttctgctgctcttgctgctcatgtaataaagcc

SEQ ID NO: 23870 - DNA, 121 bp, Artificial Sequence
  Synthesized
  misc_feature (61): n=t or c
gagttcaagttgcagatcacacatatatatatatctgtcagtattcatgtgggattgcaangttatggagagaaagtgctttgtctcagcttacctaagtctagaaattaaatgtaggaaa

SEQ ID NO: 23871 - DNA, 121 bp, Artificial Sequence
  Synthesized
  misc_feature (61): n=c or g
catctgaataggaaagtgcctcggtaaagtgcgcaagaggaatattttggaagtggagganaagatgaattattagagccttggtgttcattacttctgtcttgtctatctgatataaagc

SEQ ID NO: 23872 - DNA, 121 bp, Artificial Sequence
  Synthesized
  misc_feature (61): n=a or g
ggcactgtgatgctcctattggcctctttgtggccagagattttttgccagctcatgggtntcagggctcaaagagagctgactttttccctaatgctttgtgtagctggcatgagcttag

SEQ ID NO: 23873 - DNA, 121 bp, Artificial Sequence
  Synthesized
  misc_feature (61): n=a or g
cagaggtttaaaacaattgggaatactcatcacctactgcctggaggtttgttggcaagcnacgcaaactctcttggtgtttttctctggcactcggggcctgcagtgcagggaggagctg

SEQ ID NO: 23874 - DNA, 121 bp, Artificial Sequence
  Synthesized
  misc_feature (61): n=a or t
ttcaccattttgtcactttgtcaatatttttcattcttaacctgagtaggaatttttaccncctctgcttcatttttgtaagggataatggtgtgaagaaccggtatgcataatgattgtc

SEQ ID NO: 23875 - DNA, 121 bp, Artificial Sequence
  Synthesized
  misc_feature (61): n=a or g
ctgatgctctgcagttgccatccaagcccacactgctggatctggtgcttcctggctgccncctgatcccacctggagagctctgtgatggggtggtgatgagatcctggtgttaagggca

SEQ ID NO: 23876 - DNA, 121 bp, Artificial Sequence
  Synthesized
  misc_feature (61): n=a or g
gatgtgtttgtaattgtaacacactgagctccccaaagcatgctgtgagctgcgacttgtngtaacaaatgacagaatccttaaatacagccaagctgtggtcagtgtttatttattttta

SEQ ID NO: 23877 - DNA, 121 bp, Artificial Sequence
  Synthesized
  misc_feature (61): n=t or c
ctgaagggttaagagctacccttggggtttgatgcggcatgcattccacctgctagaagcnagctgtaccttggtctggtgttccaagcagtgccatgagaagcatgcatgctttcccttt

SEQ ID NO: 23878 - DNA, 121 bp, Artificial Sequence
  Synthesized
  misc_feature (61): n=t or c
ttgccgtcatagtatattttggaagggaaagggtaggtaggaaaagtcccatctatgctcntgtattcagagcctgcgcagagttctctgaactctgttagatgaacagaaagagagagca

SEQ ID NO: 23879 - DNA, 121 bp, Artificial Sequence
  Synthesized
  misc_feature (61): n=a or c
aagatctgcacaatttctgaatttttagaaaatgtgtttcttaagaattgcaaatgagttntgaaggcaaatagcctctcattctacagcacttacagtaaggaaaaaatgcaggagacat

SEQ ID NO: 23880 - DNA, 121 bp, Artificial Sequence
  Synthesized
  misc_feature (61): n=a or g
agtgcattctcaagacagtgcttgtcctcattattctcaattacaagcagtgcattctganccgtccaatttgtatgctttgttttaaacctactgctggtcttttcaagtttgacagact

SEQ ID NO: 23881 - DNA, 121 bp, Artificial Sequence
  Synthesized
  misc_feature (61): n=t or c
ctgagatcttcatgtgacagtttctgctttgcaggataagtcatatatgatagacttccanttactgtatcctgcttgaagacttgacagagaggagtaaacataacaaagttttgtgttg

SEQ ID NO: 23882 - DNA, 121 bp, Artificial Sequence
  Synthesized
  misc_feature (61): n=t or c
acttttatataagttcttcatgggttttgagctagatgcagggatgaaatgagactagtgntctcagattagaatgagcttttaaatactctttgcaaattgtttttagaaacaacacagc

SEQ ID NO: 23883 - DNA, 121 bp, Artificial Sequence
  Synthesized
  misc_feature (61): n=t or c
attctgtcttcggcttttctacctcccttattacccctgcaataaaatccagagatgtcantgtgaagtctagagcaagggaaaaaaggagttggctgaattctatgtccaaaaatcagca

SEQ ID NO: 23884 - DNA, 121 bp, Artificial Sequence
  Synthesized
  misc_feature (61): n=t or c
gattttaccagtatctgtaatttagttttatgttcaaatctagagatctaaacacattatnatctattcagtcattagtatgaatgagtttcttgcaagctaagtaaaaacatgccccact

SEQ ID NO: 23885 - DNA, 121 bp, Artificial Sequence
  Synthesized
  misc_feature (61): n=a or g
gtcaagttgtatttgaatggaaattagaattcaattaaaagcagtatttgcaatttattcntgctaattatataaaatgaccacaagtttcctgacttcctaaacatattggaacaaaaaa

SEQ ID NO: 23886 - DNA, 121 bp, Artificial Sequence
  Synthesized
  misc_feature (61): n=t or c
cttgtctctcaattccttcaggctttcactttgcaggactcatttcctttcgctgcagagnacctatttgattgatagcagagagaactgatattgatacaaataatggcaccgcagtttc

SEQ ID NO: 23887 - DNA, 121 bp, Artificial Sequence
  Synthesized
  misc_feature (61): n=t or c
tttgtttttttgtttttttgttttttttgctcaggaatgatttcctgctattgatacaggngcctcgcctccctgctattaatttgctacagatgaagacccctctgtgatagcacagagc

SEQ ID NO: 23888 - DNA, 121 bp, Artificial Sequence
  Synthesized
  misc_feature (61): n=t or c
gaatttgaaagcatgattctgcagatttcccatcataagagactgtacagcaggcaagtangtggggggaaagaagatacaagctgaaagcagatgctctcagatgcaccaagagatggga

SEQ ID NO: 23889 - DNA, 121 bp, Artificial Sequence
  Synthesized
  misc_feature (61): n=a or c
ttcaccacttgttagcacgtgaatagctgtagttacttttaaggggtgtattttgcctgantgtaacttaccgtgagcagtgactagtttgacccttcagaaggacagcaaatggattcca

SEQ ID NO: 23890 - DNA, 121 bp, Artificial Sequence
  Synthesized
  misc_feature (61): n=a or c
tggtgctaactggtagaccagctcaaaaatgtcggtggtatcttcacagccttgcccatanatacaacagtctgcacctgcctgggcgggtaggattccctgccaaagaaacggccttaat

SEQ ID NO: 23891 - DNA, 121 bp, Artificial Sequence
  Synthesized
  misc_feature (61): n=a or c
gtttatcggacttgcatgaaaacaaaaggatcccgactcttgtctagagggagtgattccnatgcttggatgatgatggttccactatttcatatgaagttctctaaagtaattccattat

SEQ ID NO: 23892 - DNA, 121 bp, Artificial Sequence
  Synthesized
  misc_feature (61): n=a or g
gaatcttgggatgccaacagagaaagctttttctctgatgcaaagttgccacgtgcagccngggatttgggccacaagagcgctggaggtctgccaagggctgagcccactgcagggtcac

SEQ ID NO: 23893 - DNA, 121 bp, Artificial Sequence
  Synthesized
  misc_feature (61): n=t or c
aaagaaacaaacaaacaaaaaaagggaaaaggtcaaggaacacgtttgcaaccttgttcangttacctaagagctagtggcatatagcagacaatcttgtttcattttggctaccagccac

SEQ ID NO: 23894 - DNA, 121 bp, Artificial Sequence
  Synthesized
  misc_feature (61): n=t or g
tctgcagactcatctgtagagtttaaacatagatagatatgtagactcatttggatagatnagggaatttaagaacctaaatcccattgaacagaagtccttatgtaccctaaacagaaag

SEQ ID NO: 23895 - DNA, 121 bp, Artificial Sequence
  Synthesized
  misc_feature (61): n=a or g
aggttaggtgccaatgcctccatctcattgagaaaacagtaaattctttctagtggtgctntgctattaattcctgagtcataagatgctggtccttaaactcctggctgattcaagctta

SEQ ID NO: 23896 - DNA, 121 bp, Artificial Sequence
  Synthesized
  misc_feature (61): n=a or g
gcatcagattccttcaaaacaaacacattcaatgggcagggttatggtagagctgaagagnctgcctcccaggctcagtgcctgcaaggaaagcacttagtgatgaacctactaacatgaa

SEQ ID NO: 23897 - DNA, 121 bp, Artificial Sequence
  Synthesized
  misc_feature (61): n=c or g
tgctctgggaaggctgtggtgagagttaagatctggagcacctgatgtgtaaccataatancagagcagagaatagttctttgaagaataggtgtttggtcttttattacatctttcacca

SEQ ID NO: 23898 - DNA, 121 bp, Artificial Sequence
  Synthesized
  misc_feature (61): n=t or c
aaaaagtggttgctttttaatgtactgtatctgttgcacttaaatcatgcttcaaaatgtnatgatcatttatgtgctccatctttgtgtttttctttactctattcaaggaataagacag

SEQ ID NO: 23899 - DNA, 121 bp, Artificial Sequence
  Synthesized
  misc_feature (61): n=a or g
tgtgatggggggtggttccatctgacgtccagctgctccgtgccagctgtgcctttaagangaagagcgtcgaggcgttgggtttcgtgtcttttatttgtttgatatgaacttaatccat

SEQ ID NO: 23900 - DNA, 121 bp, Artificial Sequence
  Synthesized
  misc_feature (61): n=t or c
ccccctttgctgtttccttttgcctccagcattgcgttctgcactcatcctccacttccanccagacgtctcccgaaggccggtgcatttttcagcccaaatttggcactgacagaatata

SEQ ID NO: 23901 - DNA, 121 bp, Artificial Sequence
  Synthesized
  misc_feature (61): n=a or g
aaggacctggaacttcaacactatgaatgaaggttgggagaacacaagaaactgtcagatntgaaaatcctgtttgtatattctctctcttagattgctttttggcaacaggatactaggt

SEQ ID NO: 23902 - DNA, 121 bp, Artificial Sequence
  Synthesized
  misc_feature (61): n=a or g
aggcggacagatttacaatcaaattcttttgtttttctttcgtatttgtcctgtcttttgnattaggtaatggaaactcagttcttctgttgtgcaaattgttttgcatgaccaacaacta

SEQ ID NO: 23903 - DNA, 121 bp, Artificial Sequence
  Synthesized
  misc_feature (61): n=a or g
ggtttttttttaaacaatatcagcaaaatccctgcggttaccaattgcagtggaaaggacnagtccttttggagctttgttgcatgtgaggatcttctatctaggtgaaaggcaaaaggtg

SEQ ID NO: 23904 - DNA, 121 bp, Artificial Sequence
  Synthesized
  misc_feature (61): n=a or g
atgctgcaggcagggatataacaaggagctcaccttgggtatgtggcagggtgggtgctcnggctgctggctccatgggtggagacctgcagttctggggtaagctgtggccccactgtgc

SEQ ID NO: 23905 - DNA, 121 bp, Artificial Sequence
  Synthesized
  misc_feature (61): n=t or c
ttagtctgaagaatctggtgtccagacacacctgcaaagacaaacaactcctacgggactnggtgcatcaaatcttgaaggtcttgcatcagaactgctgttgtctcccagtgactcctgg

SEQ ID NO: 23906 - DNA, 121 bp, Artificial Sequence
  Synthesized
  misc_feature (61): n=a or g
acagcagaaagggcctctgggatgaaggcattgatttatccctacatgcacggagggtttnaacctgtggttgcaggctcttggggaaccatttcagacggtctatgggaggtgagcaggg

SEQ ID NO: 23907 - DNA, 121 bp, Artificial Sequence
  Synthesized
  misc_feature (61): n=t or c
tttttgttaaatataccttcctatatattacagtggttactccagattaatcactgggctnctgacaaagtctgttccctgggtgatacaagagtgctgctctcgtctgcttggtcaaacg

SEQ ID NO: 23908 - DNA, 121 bp, Artificial Sequence
  Synthesized
  misc_feature (61): n=a or c
aaagtctgtgcaagtaattcacctgtattgttgagatttttaggaagtgctaaagtgtggnaaaggttggcatgaatggattatagtgctgtcctaagttactgcagattttagtctagaa

SEQ ID NO: 23909 - DNA, 121 bp, Artificial Sequence
  Synthesized
  misc_feature (61): n=t or c
cttagaaaggcgaggcattttcagtaacctcagaaatcactcttgatttcttcctatgctntcttagctacttggagacatgaacataacctccaaagagaactggacaagcactactttg

SEQ ID NO: 23910 - DNA, 121 bp, Artificial Sequence
  Synthesized
  misc_feature (61): n=t or c
gtagaagaggtgcttcagccctttgactggccctcctccggacctcttccagtagcaatangtatttcttgtcaggggaccccaggcttcgatgtcatgctgcaggtgcactctcacaatt

SEQ ID NO: 23911 - DNA, 121 bp, Artificial Sequence
  Synthesized
  misc_feature (61): n=a or g
cacagcctgccttgcttgcagaggaagggcattgttttctgaagaaacaagcctccatccnaacaccacgtccatgtgctcctcacagagctcagctgcctgtggccttttagccttgctt

SEQ ID NO: 23912 - DNA, 121 bp, Artificial Sequence
  Synthesized
  misc_feature (61): n=a or g
aataaattctgtcagaatccactgagttgtttaaaatgactccaagttcggcagccagcanagttacagaaaccataaggctggctctgccactgaataagttcaaatatctaaggaaatg

SEQ ID NO: 23913 - DNA, 121 bp, Artificial Sequence
  Synthesized
  misc_feature (61): n=a or g
aaatggctctaaaccatccgagttaaatttgaaaggaaacggagttgcattttgccagttntaatgcagactctgatgtcattgtttgacagccttcccagtggcctgaagcatatattga

SEQ ID NO: 23914 - DNA, 121 bp, Artificial Sequence
  Synthesized
  misc_feature (61): n=a or g
gggctgcaaaaaggatgtggggcggtagattcagtgtaatcgaagtattgctttattgccntaattggtctccttgccaaagagacttgccttgctgaaaaactgctatgctaatggtgat

SEQ ID NO: 23915 - DNA, 121 bp, Artificial Sequence
  Synthesized
  misc_feature (61): n=a or g
gcagtttctcacagggagcagaaggggtagcactgaaatctgctcggtgatgtggactgtntgacagtgatgggacctgatggaacagcatagagttgtgtcagggaagggtcaggtgggg

SEQ ID NO: 23916 - DNA, 121 bp, Artificial Sequence
  Synthesized
  misc_feature (61): n=c or g
ctggtacaactgaggccaccatcttcccctgagcactgttctgaatgtgttctgatttganaattaaaacatgatagaaacgcagggtttgcctaatatggcgtgacattgaccacagtgt

SEQ ID NO: 23917 - DNA, 121 bp, Artificial Sequence
  Synthesized
  misc_feature (61): n=t or g
catgaagggaaatattacaccaactcactcaaatctcacactcccccatggaaaaaggaantcatgcaattagtaaaactggaagtatctgtgactgaaccgctttgatatccaaattcat

SEQ ID NO: 23918 - DNA, 121 bp, Artificial Sequence
  Synthesized
  misc_feature (61): n=t or c
gagaccttgacttcactgtcttcagatgcttccagccaagccagggacacttgatatgctntgggatgaatcctctatgtcttgatgttcagtggatgtggtgttaaatggatgatgtctt

SEQ ID NO: 23919 - DNA, 121 bp, Artificial Sequence
  Synthesized
  misc_feature (61): n=a or g
tactcagttaagctaaataggggctttggcccactaatgtggcagaaaggaagcagcactngaatattcctaagcataactttatggtgcacaaagcatggataaattttcaataggctta

SEQ ID NO: 23920 - DNA, 121 bp, Artificial Sequence
  Synthesized
  misc_feature (61): n=t or c
taatgtttcttctcaattagcactgtgaagacattcatttctaaatttttcctctaagtangttctccctctaaaagcacctaatttcctttttccatagcgttccagaaccaatacaaga

SEQ ID NO: 23921 - DNA, 121 bp, Artificial Sequence
  Synthesized
  misc_feature (61): n=t or c
tataatcagaaatatataaccagctcactcccatatgctgaaaattatgccaatctcttcnttctcccattcacagataatgccctgtgcattttcctagtccttagcagcaaattgtttc

SEQ ID NO: 23922 - DNA, 121 bp, Artificial Sequence
  Synthesized
  misc_feature (61): n=a or g
atttattgcaactctaactcatctcagctcccccataccagtggatgactacattcaattnacgccctctagaattagtgtgatttgtcatagtagagataagagtctagagattttgaca

SEQ ID NO: 23923 - DNA, 121 bp, Artificial Sequence
  Synthesized
  misc_feature (61): n=a or t
tgccatgtcaatatatttttagtcttctatacaaaaatgctttctaacagtaatgaaatgnagactatcaaacttcagattttgtataagcctgcttttctgttgcattcattcactattt

SEQ ID NO: 23924 - DNA, 121 bp, Artificial Sequence
  Synthesized
  misc_feature (61): n=t or c
caaatgtttctgtcgagtttggtacagacatcattgtacttcccaggtttaatacgaattngatgtccaagcacagcaatgaccttcctttgtatgagttggaccaacacattgcttcctc

SEQ ID NO: 23925 - DNA, 121 bp, Artificial Sequence
  Synthesized
  misc_feature (61): n=t or c
ctctccagcctgagaacaagtctcagagcaaaataatgctctcatatggatccagctttcntacagatgggtatggctctattcagagaaatgttgcaagtgtttagccgccagggccttc

SEQ ID NO: 23926 - DNA, 121 bp, Artificial Sequence
  Synthesized
  misc_feature (61): n=t or c
aatgttctcctccgtttatgaagagaagcttgctgctttctgtgactttctccattcactnttgcataagagggaaatcagaatgttttcttccttttctattcttctgctcacaagaagc

SEQ ID NO: 23927 - DNA, 121 bp, Artificial Sequence
  Synthesized
  misc_feature (61): n=t or g
tgaaatatttctgccatgaatgtgtagtgcaacagaacctcagtttagctgtctttaaacnaggactagctcaagttctcagggtagttttagactgacagcacagagctccatacaagct

SEQ ID NO: 23928 - DNA, 121 bp, Artificial Sequence
  Synthesized
  misc_feature (61): n=t or c
gttcagtttgcacacaaccagcagcacaaagcttccttggatgtttgttctaattatgctngaatcattaatcctcactacacagacgaaccccttcaattcagagcaaagggccacagcc

SEQ ID NO: 23929 - DNA, 121 bp, Artificial Sequence
  Synthesized
  misc_feature (61): n=t or c
gaacaaaagcggcctcatcaaacgactgagacagagctttggcattggctttcacaatctntgcatgtagagaacttaaatatgcttgagcatcaaacacgataaactgctgcaatgctgc

SEQ ID NO: 23930 - DNA, 121 bp, Artificial Sequence
  Synthesized
  misc_feature (61): n=t or c
agcagcacatggcatggccactgggaaaggtgggtaaggcacatcatcccaaacatcggancacatctagcagtgcacaaaaacaggtactctctttccaaatgggtgaatggatcacctt

SEQ ID NO: 23931 - DNA, 121 bp, Artificial Sequence
  Synthesized
  misc_feature (61): n=a or g
agcctatatcgctttctcatgttcccgaatgtctgcgacagtgatctgtcaaatcacaggngctggagttccttagcaaagtataaatagcacattgtcagtgagtagcaagcagtgcttc

SEQ ID NO: 23932 - DNA, 121 bp, Artificial Sequence
  Synthesized
  misc_feature (61): n=t or c
aagacgaaatagaatattgtaggcctcattgcctcacttctgaatgctattacaggaaaanagaaagatggaatgttttatcttcacctttaatgggccaaataatggtaggacacatgat

SEQ ID NO: 23933 - DNA, 121 bp, Artificial Sequence
  Synthesized
  misc_feature (61): n=t or c
catagcagtattctgtccttcctttaagggaagttacaaagttgtgcctcacataaaccanatgttaatagctaatccgatgatgttgccagtgatacacataatcttatgttcctgtgtg

SEQ ID NO: 23934 - DNA, 121 bp, Artificial Sequence
  Synthesized
  misc_feature (61): n=a or g
gacatgttttttcttcactcattttgtgttctatgattataaaaatccatttcagaatgtntgtgaacccagcagcactgagtttttttctcacagtgatgatatctccaggctggtagtc

SEQ ID NO: 23935 - DNA, 121 bp, Artificial Sequence
  Synthesized
  misc_feature (61): n=t or c
ttttttttactagcataattgtttttgtcatgatggtagcagtgctctgtgtgccagaaanatatcctcagagcagctgtgatggaaaacacagtagcaacttttgcaagtcgttattagt

SEQ ID NO: 23936 - DNA, 121 bp, Artificial Sequence
  Synthesized
  misc_feature (61): n=a or t
ttatcatgacacagggtgagaaacaggaacgctgcttcttggtataatgatagaagacaanataaagctgggtaacaaagatgcttggtaattgcataaagcaccagcttcccaccctagc

SEQ ID NO: 23937 - DNA, 121 bp, Artificial Sequence
  Synthesized
  misc_feature (61): n=t or c
agcagaagtttttactcaagtttttagtttactccaaaggagatagaagaatggaaggatntcaagagaattacatctcagataagccatgcttaaatattctgacagttggatagatagt

SEQ ID NO: 23938 - DNA, 121 bp, Artificial Sequence
  Synthesized
  misc_feature (61): n=a or g
ggaaaactgctagaggccttcagccactttgtgtggcggtagaaaagcaaacagtagtttntgatggagtagtccagcaaaaaatacctgttttctgtttggagaagcaattggataactt

SEQ ID NO: 23939 - DNA, 121 bp, Artificial Sequence
  Synthesized
  misc_feature (61): n=t or c
ttaattaagatagctgaatagccttgagaatgtagtagagacttcagccaccttgcagacnttcagaggcagtaccactgctgaaataatattgaaataaactttgtaccacttcaggttt

SEQ ID NO: 23940 - DNA, 121 bp, Artificial Sequence
  Synthesized
  misc_feature (61): n=t or c
gacattatggtctaatttggtgtccatggactaaaaagcatgttcacatgaccccagttangtatgcctattacattggcaggaacacgttacattttctggttcatgctcttcacagttt

SEQ ID NO: 23941 - DNA, 121 bp, Artificial Sequence
  Synthesized
  misc_feature (61): n=c or g
aatctgtaatcttgacaaaggcaaatgtctggaaagattaccttgaaagaaaaatatcctntgttaggctagttttaggaagtggataagatgggagaagattactgaggaatgttgtaga

SEQ ID NO: 23942 - DNA, 121 bp, Artificial Sequence
  Synthesized
  misc_feature (61): n=t or g
ccacaaaacaaagcataaaaacccaaaaaaccacacaatcctacaaaccaatgaagaaaancaggaaaaggcagttttcggggttccacgaaagtgcattacacgaaatagctcagaataa

SEQ ID NO: 23943 - DNA, 121 bp, Artificial Sequence
  Synthesized
  misc_feature (61): n=c or g
ttattcagagaggaaaacttccaagactcatacaacctcatacagaggtgtgaaagctctngaattcataaagcaaaatgagagcctgcagccttcagttttatcatcaaatagtaaatgc

SEQ ID NO: 23944 - DNA, 121 bp, Artificial Sequence
  Synthesized
  misc_feature (61): n=t or g
aggtcttattaaaaatagcttgtatcttgaaacaaactcagctgctctaagtgaaaagtancagccagcacacacagcaatcctctggctgtgactttattaaacaggaatatagctccag

SEQ ID NO: 23945 - DNA, 121 bp, Artificial Sequence
  Synthesized
  misc_feature (61): n=a or c
tgcacttatgattgttgtcgttggactgttttcctggtgagagttcttgtgaataaaagtnccctgaggacttgcatggatagctatttgctgctgagatctttcagttgtcttgaatagt

SEQ ID NO: 23946 - DNA, 121 bp, Artificial Sequence
  Synthesized
  misc_feature (61): n=t or c
acaagaaagcaaacaagcaaatcatttaaatgaattttcttactgtgatgcgtaatgatancatgataccttggtgtcacaccactgtttatcaacagatcttaaagcacacgatgacctc

SEQ ID NO: 23947 - DNA, 121 bp, Artificial Sequence
  Synthesized
  misc_feature (61): n=t or c
ccctctgtctgcccatcctatacctctccaatgcctcttacacggagagaaggcgttcaantgccatgctgagatgcacacctccatttttcctctccaaaatttatggcagtgcacacgg

SEQ ID NO: 23948 - DNA, 121 bp, Artificial Sequence
  Synthesized
  misc_feature (61): n=a or t
acagtgatgcaactgatgtatagtttcccagcattcgctagcacatcatacttggaagttngttcacacatttacaaatattcaaagacatagggatgcatacattctattagtaaaacag

SEQ ID NO: 23949 - DNA, 121 bp, Artificial Sequence
  Synthesized
  misc_feature (61): n=a or g
aacacttgttcacacttgtcctaagaaaaacaagtttgccagtattgctctggtcttctcncagagatacacttttagacattttttggcttgctgttcatcatatttaggtcatttgcag

SEQ ID NO: 23950 - DNA, 121 bp, Artificial Sequence
  Synthesized
  misc_feature (61): n=a or g
gtacctttgtatatgtacatttgtacatacagagctttgtacctctctctgcatgaacgtntgagccaagcaatccacatgtatttgcatctcattttcacagcacttctatgctgacaga

SEQ ID NO: 23951 - DNA, 121 bp, Artificial Sequence
  Synthesized
  misc_feature (61): n=a or c
cataaacatatgattccataaatgcattgtcaaacaaacagcaattagtgatcagagcacnctgtaaaatgtaatgaactgatctggaaacagacatgttctgagataatttccgataggt

SEQ ID NO: 23952 - DNA, 121 bp, Artificial Sequence
  Synthesized
  misc_feature (61): n=t or c
aagtaattgaagttttagatttgaaaacgaaatcacgtattattttctcctccaaagcagnctcatattgttcctccattaagaactgataagtttagcaaggctcaagcacacctgaagc

SEQ ID NO: 23953 - DNA, 121 bp, Artificial Sequence
  Synthesized
  misc_feature (61): n=a or g
attctaacatactagtaatgagttatttctatgagttttataatgcttctatagaggtttntatacatgcattagcagggaaacatcaagtattcagtgcattcatttttaaatgatttgt

SEQ ID NO: 23954 - DNA, 121 bp, Artificial Sequence
  Synthesized
  misc_feature (61): n=a or c
taggtcaggaacaattccagctttctcatgacttggcaaagttgttatgtagctacaagantgcattttttattccaaccacagtcaatgccttgaagctatatctagcttacagtgttgt

SEQ ID NO: 23955 - DNA, 121 bp, Artificial Sequence
  Synthesized
  misc_feature (61): n=t or g
tattaatccatcctatccaatccaatctagtaccaatcaaaatacttaaaagtagaacagnctcttcccagtatagcacacattgcagcctgagcaaattagcccttcctatggcactgta

SEQ ID NO: 23956 - DNA, 121 bp, Artificial Sequence
  Synthesized
  misc_feature (61): n=t or c
ttccctacagacacagctgtgcgaagcaaaagctttaagacaaagtaaacagatgccctgnatgtgaaaggagtgctgcccaaccacagctcagtcatctcaggcagacaagtagctgctg

SEQ ID NO: 23957 - DNA, 121 bp, Artificial Sequence
  Synthesized
  misc_feature (61): n=c or g
ctttttaatttactgcttaaaattgcatgttcatttctctacatcacaagaattgcccccnataagtggaaaaatagccatggatattcaagtttattatagatcatgtttatatatatgt

SEQ ID NO: 23958 - DNA, 121 bp, Artificial Sequence
  Synthesized
  misc_feature (61): n=a or g
gtggcatgtatttaggcacattgccaaaagcaaattctcatgagcactggagagcaatagngctaagtagtagtagtagttgattccctcatctattcagctttcaggccaagcccctctc

SEQ ID NO: 23959 - DNA, 121 bp, Artificial Sequence
  Synthesized
  misc_feature (61): n=t or c
gaacctcacgccaccttagataaaattattctctgtgaaagcaagccctcagatagcctgnaccctcagataacccagagaccgtacacaggaatctacaccacttttatcagctggattt

SEQ ID NO: 23960 - DNA, 121 bp, Artificial Sequence
  Synthesized
  misc_feature (61): n=t or c
catgtaagatgaagtatatcctctattattgaagtactcacaacttttattagagatgcangagactgtgttacacagaatgtattggtacacagcttacatctatatcagtgtagttcaa

SEQ ID NO: 23961 - DNA, 121 bp, Artificial Sequence
  Synthesized
  misc_feature (61): n=a or g
ggtagagcttggttctccctagaggtgaacaataggcaaatggtaataagctgcaacatgnaaaatctaataaatgaaatctatatatctatttatatctaataaatatatctatatgtca

SEQ ID NO: 23962 - DNA, 121 bp, Artificial Sequence
  Synthesized
  misc_feature (61): n=t or c
agcccttttttaattcttgctttttatttcattgatacactgaaaaaaaactaatgctcanagaagttgacactattccctaagagaactctttccagtatgcttgcttccttgtgtatgt

SEQ ID NO: 23963 - DNA, 121 bp, Artificial Sequence
  Synthesized
  misc_feature (61): n=t or c
ttaccattatttctacattcaaagacaagagtacaaaaacaggactgtaaaaaccaaacanggtaacaagtttttgctcagggttcctacctggttgagcaaactgttaaatatctcacat

SEQ ID NO: 23964 - DNA, 121 bp, Artificial Sequence
  Synthesized
  misc_feature (61): n=t or c
agtccagaattaaaggaatagagaatggagtactggggagaagttatagaaatgttcagcnctgttcttaagttcatgttgactttgtcaacacctctctttttttcatggcagttactag

SEQ ID NO: 23965 - DNA, 121 bp, Artificial Sequence
  Synthesized
  misc_feature (61): n=t or c
tttatttctgtcttatctgcagaagtaccctttgttctctcatgtggtaggagagaagganggggagcaggttttctgtgtgtatctctttgtgaaagaacagttcctgctccattggttc

SEQ ID NO: 23966 - DNA, 121 bp, Artificial Sequence
  Synthesized
  misc_feature (61): n=t or g
ttgagcagactgaaaccaaactccctcatacaaacacaaaagtgacttctgcaaagtgcantgggtatatatgtgctaccttgctcctcctgaagatgtgagacacacctgcctggggaat

SEQ ID NO: 23967 - DNA, 121 bp, Artificial Sequence
  Synthesized
  misc_feature (61): n=a or c
gttttaaattaattttgaagctttcatccaggaacatgtaatacattggtttaaaaataanttctggctcatttcaccactgcgcgtagaccagggtaaaatgttcctaagaacactggta

SEQ ID NO: 23968 - DNA, 121 bp, Artificial Sequence
  Synthesized
  misc_feature (61): n=t or c
ttccccagtgttttctaaccatcctaaatcaacaccctgtgacacagcgcggcgtgccaancttaaatctacagagaacagcccaaataatcactgcctttgggaagaggctcgctctgca

SEQ ID NO: 23969 - DNA, 121 bp, Artificial Sequence
  Synthesized
  misc_feature (61): n=a or g
agcaaacattgcaccctaattttcacctctgtttttaaaagcagaagacagatgcctttcntgtaagactgaagaaaatactaatgaagaaaccacaaagcttttttcccttcatttcctc

SEQ ID NO: 23970 - DNA, 121 bp, Artificial Sequence
  Synthesized
  misc_feature (61): n=t or c
caataggacaatcatccggaagcctgaaaagctaagaactttactgtatctaaggaagcanctatatcaaagcactagcaacattaaaaacaaacaaacaaaaaaacaaaaaggacagcat

SEQ ID NO: 23971 - DNA, 121 bp, Artificial Sequence
  Synthesized
  misc_feature (61): n=t or c
ggcccactgcttcagtggctctgatgggattgcctagtccctaaatgggataaactgctcntgataatggattttcatgccaaggtaagaaggaaggaactgcaggactactggttgttgt

SEQ ID NO: 23972 - DNA, 121 bp, Artificial Sequence
  Synthesized
  misc_feature (61): n=t or c
acatcatagtatttttcttaaggtttgatttggtttttggttttgatataagtaatggtcncaggttatctgggtggaaaatatgtagagggaaacatcagtagtaatacctttttgttta

SEQ ID NO: 23973 - DNA, 121 bp, Artificial Sequence
  Synthesized
  misc_feature (61): n=a or g
attagaggcgttttctggttcccgttccactccagctgcgttgctatccgaaactgttgcnttaagcagaaaccaccgtgtgcaattaatggcaagagtggaggtgaagatgcagagctga

SEQ ID NO: 23974 - DNA, 121 bp, Artificial Sequence
  Synthesized
  misc_feature (61): n=c or g
attgtcagtattttctcagtgttttctttcttcttgcgttcacgtggttgtgatatgctgnagtgtattggagtcaacctgagaactttcccccacagccacagcgtgtactgtgttgaga

SEQ ID NO: 23975 - DNA, 121 bp, Artificial Sequence
  Synthesized
  misc_feature (61): n=c or g
gcagggcagggtgacgtgacatgaggaatgggcacacagccatctgccctcgctgggctgnaggagggctctcgtatttaccccactctgtcaccatcatacctcgcacgctggtttgaag

SEQ ID NO: 23976 - DNA, 121 bp, Artificial Sequence
  Synthesized
  misc_feature (61): n=t or c
ttattgactggatatcatttgctcctggcaatttgttactgttaattttatctttttgtgncctccttacttctgcaaaggtagaaaacttcaacttgagatggaaaaaactgggagaaag

SEQ ID NO: 23977 - DNA, 121 bp, Artificial Sequence
  Synthesized
  misc_feature (61): n=t or c
atggatggagaatccaaactaacagaaaacttttccagacagggcagggaaagggtaaganaagcaaaatgcccagaaacctggaagatggtcttcagctgctactacatgaacaaatagg

SEQ ID NO: 23978 - DNA, 121 bp, Artificial Sequence
  Synthesized
  misc_feature (61): n=t or c
aacagttataggatttttatggagaaataatgttgtgtcagagcccagcctggctgggcantccctgtttgggcagcatggagcagtgagagtccatgtcaatactgtgctctgcttcgca

SEQ ID NO: 23979 - DNA, 121 bp, Artificial Sequence
  Synthesized
  misc_feature (61): n=t or c
aagccttaatccatcacgggaagctcttatctgcagatggaggcaagtaggctcaagctangcagcagataaggtgcatggtctgcttctgacaggttggaaacacgtgaggctgcttggc

SEQ ID NO: 23980 - DNA, 121 bp, Artificial Sequence
  Synthesized
  misc_feature (61): n=a or t
atattcttgtatccaagtcagaacattatactctggataggtgggttaaagaaaaaaaggncagaatagtagcactttcagagaggtggttcatggattgtactttacctggattgctgtg

SEQ ID NO: 23981 - DNA, 121 bp, Artificial Sequence
  Synthesized
  misc_feature (61): n=t or c
tgattgattttgaagaaattgatggtatgtggacatcagagccaccagagcaatgcaccanggtacgtttcctctctgccattcctaacaactctgtggatgcatttgtggtgtaggcaga

SEQ ID NO: 23982 - DNA, 121 bp, Artificial Sequence
  Synthesized
  misc_feature (61): n=t or c
taagcagccacgtatttatttcagtagtcttctagagccagaagaatttgaatgaatatgntaggttataattctttaaacagccctagactaatagcagtattgtcagctccaaccattt

SEQ ID NO: 23983 - DNA, 121 bp, Artificial Sequence
  Synthesized
  misc_feature (61): n=t or c
tttccaggcaaaactaaagggtcagtcacacaagcagtgtggttcttgatatggtctcctntgggagcagtggagaagcttgactgcgggcaatgtagtatttagtatccaaatctatctt

SEQ ID NO: 23984 - DNA, 121 bp, Artificial Sequence
  Synthesized
  misc_feature (61): n=a or g
ttggcttgtgtaagagctggaacagattttccaataggaatctgtttactctatcctgccnttaatttttagtaagtttagaagcacttagtagctttgagacatgaacaaatcttgtata

SEQ ID NO: 23985 - DNA, 121 bp, Artificial Sequence
  Synthesized
  misc_feature (61): n=t or c
atttgagagcagacactcttagctctggtggcaggtgcccggtaagagtctcattatgtcngataggtaactcacagagtagttcccagagctcttatcccctctggagtgacatgcagaa

SEQ ID NO: 23986 - DNA, 121 bp, Artificial Sequence
  Synthesized
  misc_feature (61): n=t or c
aacacagcacaagcgaaactaatatgctccagaggaaggccaaagaacttacttgttctanttcaaccacaattattggtggaacaacttctgtaatgagttgatttacaggttcaatgac

SEQ ID NO: 23987 - DNA, 121 bp, Artificial Sequence
  Synthesized
  misc_feature (61): n=a or g
gtaaggaaagaacagagtgtgtattgccagcagcagcaaaattcacatggggaatatcacngggaagctaaatgcttgtgcagtttactgctagaacaggaattcagtacaattatactct

SEQ ID NO: 23988 - DNA, 121 bp, Artificial Sequence
  Synthesized
  misc_feature (61): n=t or c
acggtggcattcagtgcccacatacatgatacatattagctctacgcggtgcgagcagctngacacgtgtaactttacatatgctacagcctatgtacacatcagcagcaactgaagcaca

SEQ ID NO: 23989 - DNA, 121 bp, Artificial Sequence
  Synthesized
  misc_feature (61): n=t or c
gctttcagcacagggatggatgtgttggtgtttctgcggggacttccagaatggctcaggnagccgcttccatgctgctgagaaaaggctttgaggggaatgaggaggcagcactttgctt

SEQ ID NO: 23990 - DNA, 121 bp, Artificial Sequence
  Synthesized
  misc_feature (61): n=a or g
tcaactattactggacttctcttcccggaatattttccatatcaccttcaattcatgtagntgttcagtacctacagtatccagatacctcttgggcctgtagccactgccaactcttttc

SEQ ID NO: 23991 - DNA, 121 bp, Artificial Sequence
  Synthesized
  misc_feature (61): n=a or t
ccatgtctctcctgtactggatgctacgcaccagttgggttctcatgagggtggactagangtggacaatcaccttccctgacttgctggttgcacttgatgtatctcaggttgtgtttgg

SEQ ID NO: 23992 - DNA, 121 bp, Artificial Sequence
  Synthesized
  misc_feature (61): n=a or g
cacatgctgatcaaaaagtgctggccgagcaatctgtaagagaaagcaagacaaaatgccnagaagcttctccttcaagaaaaatcagtagctgtcttttcttagctatgtttataacagg

SEQ ID NO: 23993 - DNA, 121 bp, Artificial Sequence
  Synthesized
  misc_feature (61): n=a or g
agtgcacctcttttcaagtaattagattcccagaagttaaccagagtaacacagcactcangatttcattcacttcttcccttggagactttttttccccttcagtaataaaagcaatgag

SEQ ID NO: 23994 - DNA, 121 bp, Artificial Sequence
  Synthesized
  misc_feature (61): n=a or g
gtatcagacatcgcttatgaatacaaaacaaaggcgactatgtggtatcacaatcagtccntgtctgtgtattagttcttagggtttggatgttccgacatcctggttggaagctgcaggt

SEQ ID NO: 23995 - DNA, 121 bp, Artificial Sequence
  Synthesized
  misc_feature (61): n=a or g
tatgggctagtgtgtgctggagcaatgtccctgtactagcacagcttagcgagcattttgnaacacagcccccagggctctggtttaggccccagtgggcaggcacacccctgtggggtac

SEQ ID NO: 23996 - DNA, 121 bp, Artificial Sequence
  Synthesized
  misc_feature (61): n=t or c
atgtgctcccctgcaaatggaggcataacttcaggccataacttcaactgtagggcctccnttctgccatgctagggctgggaagaagaaacacattctcagtgtggacagaaactgcccg

SEQ ID NO: 23997 - DNA, 121 bp, Artificial Sequence
  Synthesized
  misc_feature (61): n=a or t
aaaataatctctcttctgaacaaacaagctttacaggggacttattactcataatgaaagnatcatgaattgtctatctagtcttacagcaccatcacacgcgtttgtaatccagatagga

SEQ ID NO: 23998 - DNA, 121 bp, Artificial Sequence
  Synthesized
  misc_feature (61): n=a or t
agtgttaaagccttcaacctaaattcctagtaagggctcttgatttaggagtgagttaccntaataaatgtagctggagtggattagtgccaagcacaattcagaagatgaactacaaaat

SEQ ID NO: 23999 - DNA, 121 bp, Artificial Sequence
  Synthesized
  misc_feature (61): n=t or c
ttggcactgattgtgaacataatcactgtaagagtcacatacacagaaggctgttatatgnctgttcactcttgaacaattcaaactgcccaaagctttaaagcagtgcactatactacag

SEQ ID NO: 24000 - DNA, 121 bp, Artificial Sequence
  Synthesized
  misc_feature (61): n=a or g
gaagcctatttttacactatgcatgattttaagtttctgtttttcccaacagatcctaagnatttgagaagctctaagaattttttcctctcccagttcgagaggcagtttttcctctgaa

SEQ ID NO: 24001 - DNA, 121 bp, Artificial Sequence
  Synthesized
  misc_feature (61): n=c or g
tagattttacttctttgggacttcactctacagctgtaactatatagatcaacttggtttntttgtgttaatattactttgctgatactaggaacacatcacaggtatgactaccttaaga

SEQ ID NO: 24002 - DNA, 121 bp, Artificial Sequence
  Synthesized
  misc_feature (61): n=t or c
atacagagagctgcagatcaaattcaatcattcatcactggaaaagatgggctttgttggntttaagaataaaaaatcattcatcagtaaaggaaaagaaaaaaaaaattaaactttccag

SEQ ID NO: 24003 - DNA, 121 bp, Artificial Sequence
  Synthesized
  misc_feature (61): n=t or c
actgaagcacttgatgtgttctgtttatagaaaaagctacaattgagtttttccttggcgntgcttccctgcagagtttcttcagcttttgcataatgtgtgtgtgtgtatatgcacacat

SEQ ID NO: 24004 - DNA, 121 bp, Artificial Sequence
  Synthesized
  misc_feature (61): n=a or g
ggagaaggaatctttcagagtttcatgcataatggatcagtagcaagattagcatttcatnaaaaaatagaattataatgcaatttctgttttgtatgtccaattttggtagcacactgta

SEQ ID NO: 24005 - DNA, 121 bp, Artificial Sequence
  Synthesized
  misc_feature (61): n=t or c
ttgttcctgctatctgcctctctctcggggattttttgtttgctggtggaaggaaccagantaacagagctctgtgttgagcacagatgtgggacggcacccgccctgccatatccctgcc

SEQ ID NO: 24006 - DNA, 121 bp, Artificial Sequence
  Synthesized
  misc_feature (61): n=a or g
cttggaaactcttcaggcatagggattccccccaacgctttcagtggcctcttcctggccntattactctcacttaacttttggttcctactgtccactgctcccaaactgcagcttatgg

SEQ ID NO: 24007 - DNA, 121 bp, Artificial Sequence
  Synthesized
  misc_feature (61): n=t or c
tatgttaatactgatgaactttcctttgtgccttcatcctgtcatctctgttgcgtgctcnagttggagcacatctcagggtctctccagaataacagagaacaaccagacgctttttcag

SEQ ID NO: 24008 - DNA, 121 bp, Artificial Sequence
  Synthesized
  misc_feature (61): n=t or c
tgttgttttgatacagcaaacaatgtaatgatttttttaagtggctggctatcttagtcantgtcagatcatactattcagtagtttgagtaagaaaattattttatacatctttcctact

SEQ ID NO: 24009 - DNA, 121 bp, Artificial Sequence
  Synthesized
  misc_feature (61): n=a or g
tatacacacatacatgatgcaatcccactgtgctggaggaggaggcattcctgatgactantgagcacacattcagtgtgaacatgcagctgaaataaagacaagggaaatgggaaagccc

SEQ ID NO: 24010 - DNA, 121 bp, Artificial Sequence
  Synthesized
  misc_feature (61): n=a or g
atcacaagatgctgcagttcctactacatcattatttagatcacgatagtcaagtttactncagtggcaggctgcaagttcgctgcttggaagcaccccaatggaatgatgtcaaagccta

SEQ ID NO: 24011 - DNA, 121 bp, Artificial Sequence
  Synthesized
  misc_feature (61): n=a or g
ggggatgagaaataaggatcttgttctgtagtttttataaatctcaatttagactcttacngagaactaaaggggtgcctctctgatgcacttaacagccttgccacaaaactgtcactgt

SEQ ID NO: 24012 - DNA, 121 bp, Artificial Sequence
  Synthesized
  misc_feature (61): n=t or c
gtttgaaactgccagatcttaagctccgagtgtgaaaatccctctgttgcctctgcccagntgtggtgcctgcattttgttcatgtctgtcctcttctgacacccttatgcttaacaagag

SEQ ID NO: 24013 - DNA, 121 bp, Artificial Sequence
  Synthesized
  misc_feature (61): n=a or c
gtaactatcaaaaaggattagccagctcaggtagtacttgttgacagtgcatcaccccgtntcagcaatgaatgaggctctggtgagccaagttgtattgacatctagcctctatttatct

SEQ ID NO: 24014 - DNA, 121 bp, Artificial Sequence
  Synthesized
  misc_feature (61): n=t or c
ctacctattagtaagtctgaaacatacttgttttagaccttcaaatattttattgttttantgttcaagtttttgaagagcatagtttacttgtgcagaagtaatttcccagactacctaa

SEQ ID NO: 24015 - DNA, 121 bp, Artificial Sequence
  Synthesized
  misc_feature (61): n=a or c
cattacaaatgaacacacatgctttacactgaaaaatgggaggcactgttaataccagtantagacattagttctctgctttctatacaaatagattttcaaaccactgagctcaaatggt

SEQ ID NO: 24016 - DNA, 121 bp, Artificial Sequence
  Synthesized
  misc_feature (61): n=a or g
cacttaatttatcaacatggttctcatttcaagatagctgtaataactgtcacaatatatncagtatgatgcacattcatttcaaatctctctacaagtagtaattaacatacagatcaag

SEQ ID NO: 24017 - DNA, 121 bp, Artificial Sequence
  Synthesized
  misc_feature (61): n=a or g
tgctaatattcatgagaaagaaaaatgtgctgtgcagaagttgaggagcaaacgaaccacnttaagcaccagtgtgcaagctggccggccctctgtgtttctaaacacatttttccataca

SEQ ID NO: 24018 - DNA, 121 bp, Artificial Sequence
  Synthesized
  misc_feature (61): n=t or c
tgaagttcatatatgtcataaatacatgttttgattcagtttcttagtgtgttcttcctantagtgggtagatatagttttaaggggttttcaggtagaccattatctcaccctttgcctt

SEQ ID NO: 24019 - DNA, 121 bp, Artificial Sequence
  Synthesized
  misc_feature (61): n=a or t
ctaatgtatgtccagcggaaggatttcacaaattgcaaggagaaatgtactgattcaagancaaaactgcagaaggttcagctctgagaagtagaggctgtgcatcagcactgatgctctc

SEQ ID NO: 24020 - DNA, 121 bp, Artificial Sequence
  Synthesized
  misc_feature (61): n=t or c
caaaaagtatgttcatttttaaagagaatagtagatctcccatttcatatgtatgcgaagnactgtaaatcatttatgtcactcctcatacttttgccattctaattttatttcgttctga

SEQ ID NO: 24021 - DNA, 121 bp, Artificial Sequence
  Synthesized
  misc_feature (61): n=a or g
ctagataggtgactgaaagctatcttccctgctaacttgtattttggtttaaactggttgntcaggtctgtttagaccttaagttataaggacttacgctttgtaccgtggttcaggagtt

SEQ ID NO: 24022 - DNA, 121 bp, Artificial Sequence
  Synthesized
  misc_feature (61): n=a or g
agggacatgtgcttctgggagcatccgtctggctgttcaggagatgccagttatctgagantttcaaagtgatgtccttttgggtaaatccgtactcattattcctttaatattaatagaa

SEQ ID NO: 24023 - DNA, 121 bp, Artificial Sequence
  Synthesized
  misc_feature (61): n=a or g
agctagactctgcaaatctttcttatatagacaaataattttcttgctgagaccattactnaatgctatttggccagtgataaggtaatactgtttggtccgtcctgtggctgaagaatag

SEQ ID NO: 24024 - DNA, 121 bp, Artificial Sequence
  Synthesized
  misc_feature (61): n=a or c
atcatcagcagagtggtcagagtcatgaaagggttatgcctaagacatcctgactcgcctngtacatgctggcatcttcaaccaaaacctcttttcctgtgactgcctgagaaaataaaag

SEQ ID NO: 24025 - DNA, 121 bp, Artificial Sequence
  Synthesized
  misc_feature (61): n=t or c
acacgtttatcagaagctgtcatacacaccatataaacagagaggcactgtgcatacaaantatcaaaggctacacaaagatggctccagaaaatgttttcaaaattccttcctactctaa

SEQ ID NO: 24026 - DNA, 121 bp, Artificial Sequence
  Synthesized
  misc_feature (61): n=t or c
gtagtatcagctttccctgagatgactgctgatgagagtttcctttgggttggtgctgctngtggcctgacttctggaggaaagtgcttgtgcctgcctaatgcactgactgctggtttta

SEQ ID NO: 24027 - DNA, 121 bp, Artificial Sequence
  Synthesized
  misc_feature (61): n=t or c
gctggagaccattcttcctaagtgataggagaggtttcctgcacgggtagcattgttttcnggtcccttctttctcttggggaaatctggcagcttcatgcataaggggaatttcgtcccc

SEQ ID NO: 24028 - DNA, 121 bp, Artificial Sequence
  Synthesized
  misc_feature (61): n=a or g
tgtgtggtagattggcaaattgctgtctttccatttcagcatgaatagggggttaaactangggttaaagtaaggtgattctgggacagatttttcacttcctggtgaaattcatactttt

SEQ ID NO: 24029 - DNA, 121 bp, Artificial Sequence
  Synthesized
  misc_feature (61): n=a or g
taataatgataagttttcttctcgtgattgatttgcagaagcctcattctacatacatgcntgttgttacctagtgatacagcaaagtgtaagcagggaggacagcagatatcccctaata

SEQ ID NO: 24030 - DNA, 121 bp, Artificial Sequence
  Synthesized
  misc_feature (61): n=a or g
tggaaattctcagatgctaatatagcatggtcaaaatcatttgctacaggaacaagaaatntcgctgaaaagtatatgtgaagaaactgtattcaaactgttatgctttttctaatcctta

SEQ ID NO: 24031 - DNA, 121 bp, Artificial Sequence
  Synthesized
  misc_feature (61): n=a or g
attaggccactgtgtgtattcgaaaatggagtaggccaaacattatattttctcacctgcngggttgcctagtaacctgaattaaggattttcaccaagccttcaagacaaatagtagaac

SEQ ID NO: 24032 - DNA, 121 bp, Artificial Sequence
  Synthesized
  misc_feature (61): n=t or c
ctgctgtgcgactgctaaatgttgggaaataggatgccggtgcccaagactataggagatntgtttagagagttcccatagatgagtggtcttctcccagttggacacctctgggatatga

SEQ ID NO: 24033 - DNA, 121 bp, Artificial Sequence
  Synthesized
  misc_feature (61): n=a or t
ttctcagcctccgagaccatatggagctgagacatgattgcattatttctactgtactgcngcagaacggaacagaaagctgtaataaactactcgcagcgtgtcccttagcacagcgcac

SEQ ID NO: 24034 - DNA, 121 bp, Artificial Sequence
  Synthesized
  misc_feature (61): n=c or g
caccaagaagccaattatgtcaaaatgcattacaagtgtttacacttctgaaagcaaatgnaaaggtcaaatccaacaagttactcatcactgacagccctatttttcacagacacacagt

SEQ ID NO: 24035 - DNA, 121 bp, Artificial Sequence
  Synthesized
  misc_feature (61): n=a or t
tatttaaatgttgaaatgcattctaaatttataggatgaaactatcccatattctactaanaccaaagtgtctgcaaagcctcaactagatctcagaataaaacaattagtgcatgcagta

SEQ ID NO: 24036 - DNA, 121 bp, Artificial Sequence
  Synthesized
  misc_feature (61): n=a or t
ttctggacgtacggtatatatgagctgatttccttgaacgtacatacgttctaatttaganaacttcttagcaaaatttgcaggtattgtactaatgtttgtgaaggacagatcaatgact

SEQ ID NO: 24037 - DNA, 121 bp, Artificial Sequence
  Synthesized
  misc_feature (61): n=t or c
tctgtttccaggtgttcagtttccagattttttagcatgacaaaactacttactcttcttnctcagtgccataccttaaacatatccagacctgctgatctttgctgcttctggctcctct

SEQ ID NO: 24038 - DNA, 121 bp, Artificial Sequence
  Synthesized
  misc_feature (61): n=t or c
catgtggcactgcacttggacttctaccctgctaataagtcccacaggataagagccatcntttctgcatgaagcagtactgtgatccctacagaacacctttcaaagtctcagagaaaac

SEQ ID NO: 24039 - DNA, 121 bp, Artificial Sequence
  Synthesized
  misc_feature (61): n=a or g
atggagattaaaaggtacaaaccaaagaaagaggaacagcagtctggagagtgggctgtcngggagtcccaccaagcacagtgatacggagcagcagtattgaacttctagagacaaaatc

SEQ ID NO: 24040 - DNA, 121 bp, Artificial Sequence
  Synthesized
  misc_feature (61): n=a or g
gacacagggatgcaccaggaatggctctgggccaagcagcctggactgcaggttgtctctnccctcagatcaccctggacctggaggacagcagcatctcgacaaagggaaccaagagtgg

SEQ ID NO: 24041 - DNA, 121 bp, Artificial Sequence
  Synthesized
  misc_feature (61): n=t or c
tggacaaaaatgcagattaatcttagaagattcatttactgatgaaataccaactctactnagtgattttgctatttccttatctcaaatgccctttgagacagggaaaaaacagtattat

SEQ ID NO: 24042 - DNA, 121 bp, Artificial Sequence
  Synthesized
  misc_feature (61): n=t or c
catgctgtagatttccgaaaactataaataagcctcttgcaaaatcccagtgccttcattnctgtaagcacggcttctgaagctttgtgcatctcatgctcccatctatatatagatgaat

SEQ ID NO: 24043 - DNA, 121 bp, Artificial Sequence
  Synthesized
  misc_feature (61): n=t or c
cacacagggtggggactggcctccccaccagtaccatggtgggagatttggctctataaanggcacataactacaggcaaacctcagtgcccccaaatcccaaagggattagaagagatct

SEQ ID NO: 24044 - DNA, 121 bp, Artificial Sequence
  Synthesized
  misc_feature (61): n=a or g
cttcatgttgtatttgacttccactttgcattacaagctttgtaagttttacctcctttcnttgtcttttggcagtaacactggccagaggtctgtaatgcagtgagcatagatataagat

SEQ ID NO: 24045 - DNA, 121 bp, Artificial Sequence
  Synthesized
  misc_feature (61): n=a or t
cggtggcttgtctctatccattttgctgaagtctgaagaacatgaagggacttgaaaaaanatatatatttcttgtttgtgtacgaatgagccttactgtgtggccaccaaaccatactgt

SEQ ID NO: 24046 - DNA, 121 bp, Artificial Sequence
  Synthesized
  misc_feature (61): n=a or g
tccctcatttattttaactggaatgttgaatactggtgtgcgtaggacatgagcagcaccncgtgctgagctgcacagagaggcagggcagcaggtgcccctggaaaaagtgccttgctgt

SEQ ID NO: 24047 - DNA, 121 bp, Artificial Sequence
  Synthesized
  misc_feature (61): n=c or g
atttgcctcctttaaacagtttgtccattgagctcttcactttgcaagtgtcatacgacangcaacccaatgccctggcttcttacaaagtttaactgaattcctcctgaggtttatgatt

SEQ ID NO: 24048 - DNA, 121 bp, Artificial Sequence
  Synthesized
  misc_feature (61): n=t or c
catattgtttctcctctagtggcagattttgagagggctttgctaccaactcatgtctagntgggcttccagtctgcttcacgataaatcaaaaagctgctcatattgggagacttgaaaa

SEQ ID NO: 24049 - DNA, 121 bp, Artificial Sequence
  Synthesized
  misc_feature (61): n=a or g
tgagatctctccatggatgggtgtgcaggagctaagggaatccttacgggaaggagaacantagtacccccacatcccacagacacttaggttttaacttgcttgatttcagccctctggg

SEQ ID NO: 24050 - DNA, 121 bp, Artificial Sequence
  Synthesized
  misc_feature (61): n=t or c
cttcactccacaactccagggctgggaaatatcagaagtgatttctccagggacccattcnggagctcaaattagcgatgaaccataaactgaccaaacataggattttggactgaattta

SEQ ID NO: 24051 - DNA, 121 bp, Artificial Sequence
  Synthesized
  misc_feature (61): n=a or g
ctgacaagacaactgaattctccatggtcagagccttgagatttctcccagcaacctaacngaaggctacatcataactcttctgagcttttaccttatctttaaatgacattagcagaaa

SEQ ID NO: 24052 - DNA, 121 bp, Artificial Sequence
  Synthesized
  misc_feature (61): n=t or g
gcaataacagtagtaaggctgcacctctgtaaagcaggggtctgttttgtttaaagaactnctgctgcagaaagtgatgtttaagaagagcctggcttgacctacatgtccctgtggtgta

SEQ ID NO: 24053 - DNA, 121 bp, Artificial Sequence
  Synthesized
  misc_feature (61): n=c or g
tcagtcattccctcactacctgctattagagtcattttttttcctttaccaggttgcaagnaacagttagaaaagcttattagaaactaccaagaaaatcgtgtttacaatttttcaggtc

SEQ ID NO: 24054 - DNA, 121 bp, Artificial Sequence
  Synthesized
  misc_feature (61): n=a or g
actgcccactaaactggtcaccaactctccaacaccacacccatcgtgtctagcatttacnataccatccaccctgtattttcctttaaaatctgtagaggtagcttttccccaattactt

SEQ ID NO: 24055 - DNA, 121 bp, Artificial Sequence
  Synthesized
  misc_feature (61): n=t or c
ggcttgccaggcccacacaattaagcataagccagagttcaaatgtaatgacctttggcanagaaccttagtgatgggattgccctgacagtttctatatggcacatgcactgccaatctc

SEQ ID NO: 24056 - DNA, 121 bp, Artificial Sequence
  Synthesized
  misc_feature (61): n=t or g
gtgttgcatcccatcctccattagtggctggtcatccctctgggctctgttctagttcctnttagtctcatatccactaacttctggcattaccaaagattcatttacattgagggcttgg

SEQ ID NO: 24057 - DNA, 121 bp, Artificial Sequence
  Synthesized
  misc_feature (61): n=t or c
gctcagtggagctgacatccagaaactgtctccagaccttgatttaatttctgcttaaaanacctcttttattttcctggtgatacatttatgaaactgataataggtttacgaaaccatt

SEQ ID NO: 24058 - DNA, 121 bp, Artificial Sequence
  Synthesized
  misc_feature (61): n=a or g
caaaacaaaacaaagtcctcttttacatgggaaaattcaggtttcctcatctggctactanataagctttgccaactttgatgaattattttttgaaatgctgtttcaggtgaagagacat

SEQ ID NO: 24059 - DNA, 121 bp, Artificial Sequence
  Synthesized
  misc_feature (61): n=t or c
cttgaataaacgtcccaggccatttgtctttatgctattcatcattagctccttagcactngaaaccttccgttagcctgaggaactttctggaatgcagcaacctatcaacgtgaaagga

SEQ ID NO: 24060 - DNA, 121 bp, Artificial Sequence
  Synthesized
  misc_feature (61): n=t or c
tatttttaccattaatataaagcccaaatagcttctgccccagtagtcggctaggaacgtngaatgcttgttgctattgtacttaatgcagctgctgaacttgaaatggcccctacgccca

SEQ ID NO: 24061 - DNA, 121 bp, Artificial Sequence
  Synthesized
  misc_feature (61): n=t or c
tatgaatattttattattgaaatatatgcttttatccattccagagaaggaaacttacttnttctgttctgatttgctgaaagtagttgatgatgaagagatatctcaggttagctttacc

SEQ ID NO: 24062 - DNA, 121 bp, Artificial Sequence
  Synthesized
  misc_feature (61): n=a or g
agactcctcagaacagtgtgggtacagctggatttggtcttagtttcagacttggtcaacngtttatgtctaaagcataatgtgcacaatcaatctaagatgcaacttaccaaagtttcag

SEQ ID NO: 24063 - DNA, 121 bp, Artificial Sequence
  Synthesized
  misc_feature (61): n=c or g
gcatctgaaaaaccatcttaagcactacaaaaaagcggtgcatggctccagcagtgattanagtgagcaacataagctgcactgaatgttaaaataaaaccagcattcctaatattggcaa

SEQ ID NO: 24064 - DNA, 121 bp, Artificial Sequence
  Synthesized
  misc_feature (61): n=a or g
gggcctcctcccagcactgagcagtgctgcacataggctccttctgaaggatgtcagatcntctgtgagttattttatgtgggtgcggttcttgggcctgctaacagaaaatgtggtggtt

SEQ ID NO: 24065 - DNA, 121 bp, Artificial Sequence
  Synthesized
  misc_feature (61): n=t or c
tcatctttagaactgccaacatggagtggtctgtgtgcagtcagtagatggatttgtaccngtgcctgactagtggtttgagagaatttacactgaaagaggtgtcagaaaggaccaagct

SEQ ID NO: 24066 - DNA, 121 bp, Artificial Sequence
  Synthesized
  misc_feature (61): n=a or c
gatttttccttctttctccccatccatttatttcaaccaataagacgatccatcacggcgngctggaaccgacctacgatccggggatattcttagatactcagcatgtcaggaaacggct

SEQ ID NO: 24067 - DNA, 121 bp, Artificial Sequence
  Synthesized
  misc_feature (61): n=a or g
tgacaaactgaaaatactaccactttgaaatggcttttaaagacacaacaggaacaaactnttgcctactgggtaatggccatttgaaataaattaattttaacaatcacactccttaatc

SEQ ID NO: 24068 - DNA, 121 bp, Artificial Sequence
  Synthesized
  misc_feature (61): n=t or g
ttaaaaaaatctatttccactgtatctgttgcttgtgagttcgtattttcaatcaatattnaaaaagcaactgacaaacctttcatcatcatctgcgggagttgtgacaccaacattgcat

SEQ ID NO: 24069 - DNA, 121 bp, Artificial Sequence
  Synthesized
  misc_feature (61): n=t or c
ctaaacgaagtaagaatgagcaagtgctactaattatatttcaacacaaagcagtacccanttaagcacaagctaaaggccacaactccattgttaacaggggtgttctcacggaaaagct

SEQ ID NO: 24070 - DNA, 121 bp, Artificial Sequence
  Synthesized
  misc_feature (61): n=t or c
atggagtctggacaccgttgagtaccctcctgctaaaaacaggttcactccaataggtaanacaggaaagcactttcagatgggtcttgactatctccagggaaggagattccaccatttc

SEQ ID NO: 24071 - DNA, 121 bp, Artificial Sequence
  Synthesized
  misc_feature (61): n=t or c
cagaccctcaagtcaccagcctgaaagctttcaagagccagcatgagttttctcaagatantctcccaaggtataatcctacctcctctgccaaggtgttttcttagaagcagagaagaaa

SEQ ID NO: 24072 - DNA, 121 bp, Artificial Sequence
  Synthesized
  misc_feature (61): n=a or c
tcaactgctgtattttcataacatagaatactcatactcatagcatcgttatcttcagaancattaaaaatgcattctaggaaccttgtgagcgattcattaagcatctgcagtagtctca

SEQ ID NO: 24073 - DNA, 121 bp, Artificial Sequence
  Synthesized
  misc_feature (61): n=t or c
gagggaattgtacaagcgtgtctcacaaaggacataaaggtttccattcaatgttcccatnagttacaaaaaaattagtcttcagaaaactgagcttagctcatcagctgtcccacaccct

SEQ ID NO: 24074 - DNA, 121 bp, Artificial Sequence
  Synthesized
  misc_feature (61): n=t or c
ttagtggtatgtctgcaaatacaaaactctagattttgtgtgtctccaaaataaacttganttcagaatttccagttatttacttcagcagaagctggcatctaataatagatagcatatg

SEQ ID NO: 24075 - DNA, 121 bp, Artificial Sequence
  Synthesized
  misc_feature (61): n=t or c
tgaattcctggctcaccaaaaagaccagcgagtggtttgagtgctcttttggtcccatctnctgtttgcctgttacagccacatcatcatttgttttgctggcacagttctgcagtttctt

SEQ ID NO: 24076 - DNA, 121 bp, Artificial Sequence
  Synthesized
  misc_feature (61): n=t or c
actcttcaacttcaatagagaaaggcttaccaactgtgcaacaaacgcagcctgatggtancgggaccgataatcagacgtggtaggattgataggacgtggggcaatggtttcaaactaa

SEQ ID NO: 24077 - DNA, 121 bp, Artificial Sequence
  Synthesized
  misc_feature (61): n=t or g
acttaaagacaattcaaacttctcatgaacttgacagaaagatgaaaatgtttgaggtggnaaggatggaataggaagaatttgaccaagtgagaataggcagaaagggagagaaaatctg

SEQ ID NO: 24078 - DNA, 121 bp, Artificial Sequence
  Synthesized
  misc_feature (61): n=t or c
ctttggaagatactcattcatatcctaactgattttcaggctttacttgtcccttacgtcncctacagaagcacggtagatgtacaatgctgcaaaaagtaaaacaaaacaaaacaaaatg

SEQ ID NO: 24079 - DNA, 121 bp, Artificial Sequence
  Synthesized
  misc_feature (61): n=t or c
ttcagtttctacttgtactgtatttctggctgtgtcaagaagttccttactctattgacantgatgtcttgcctgaatgcttttggtgaggagcagtaatatttctgttacagtccatctg

SEQ ID NO: 24080 - DNA, 121 bp, Artificial Sequence
  Synthesized
  misc_feature (61): n=t or c
tactcagcacaccaggggaacaatatgttttgagcaactaaggctgtgagcaaaccttttncagtggtgcatagcaccacttgtgaaattgaaggctacaaaaagatttgcaatatttgaa

SEQ ID NO: 24081 - DNA, 121 bp, Artificial Sequence
  Synthesized
  misc_feature (61): n=t or g
gtgatattactcatcacaacgaacactgtgacaaagccacagggcacaaccggagtttgtncttggcagatttcagctctgggttctgtggtagggacggtccgccgatggtttcgtgtcc

SEQ ID NO: 24082 - DNA, 121 bp, Artificial Sequence
  Synthesized
  misc_feature (61): n=t or c
tttgagtttccatagagcaggatgttacttcttatttatatttaatagccttccccctccnatgaagggaggtcttgggactagcacattattctatagctcaggagggttggatttagtt

SEQ ID NO: 24083 - DNA, 121 bp, Artificial Sequence
  Synthesized
  misc_feature (61): n=a or g
gtaaagattacctacatttcaaagctggatatctctattacaggttgtacccatcacactncaatttatacacccaccagcgtcattggagcgaaggagctctcagactgcccaggacaga

SEQ ID NO: 24084 - DNA, 121 bp, Artificial Sequence
  Synthesized
  misc_feature (61): n=a or g
cctcttctctgcccataagaatctctcagcacagagcagcatgggtcaggctcggtcatcngccatcctggagatgagaactgcaggacaggaccctctctggcattcatacagagatctc

SEQ ID NO: 24085 - DNA, 121 bp, Artificial Sequence
  Synthesized
  misc_feature (61): n=a or g
aggctgttcttttgcaggtccggtggtttgttcttaaagcttgtatatagtggatataacnaggctgtaatgattttgaggtgatcacagcggtgagaattgccatgggtagatgaggtga

SEQ ID NO: 24086 - DNA, 121 bp, Artificial Sequence
  Synthesized
  misc_feature (61): n=a or g
agaggcccagggctgagcagagcaaactccacttttcccctagcactgcctgcatttggantacatttccactgcttttcctggttcccatttttgcttttgggaatgctcttctactctc

SEQ ID NO: 24087 - DNA, 121 bp, Artificial Sequence
  Synthesized
  misc_feature (61): n=a or g
ttcaagagttgcgagcgtaataacttcttaggggatcccaagctctcttctcctgtttgtngtttcttgatgatattaggttaatactttttttctttttatttttcctacccacactcct

SEQ ID NO: 24088 - DNA, 121 bp, Artificial Sequence
  Synthesized
  misc_feature (61): n=t or c
aaagtcaatgcttactgaaattagctttcaaaatgaagtggatcagaataacattcactanaagtatactgcaaatccgtttcccaaagataagatattgcatgctacagagagcctcata

SEQ ID NO: 24089 - DNA, 121 bp, Artificial Sequence
  Synthesized
  misc_feature (61): n=t or c
cacttggagctatgggagacattctcagtaatatagaatgagatatcaagtcatcagtganagaattttcagctgatgaagactggtagaagtataaacaactgcagtgtaattgtgatgt

SEQ ID NO: 24090 - DNA, 121 bp, Artificial Sequence
  Synthesized
  misc_feature (61): n=t or c
tttcctcccttgcaacagctgcaacatctgctttctgtatttgctcatgatgagctctaangcgtcctggtgctcctccagagagatccacagcgctacgggacacggatcgcagcgcggc

SEQ ID NO: 24091 - DNA, 121 bp, Artificial Sequence
  Synthesized
  misc_feature (61): n=t or g
acagttttcttcattcctatcctttcaaaacagcttacagaaccgacaggtagaaacattnaccacggctgaggtaacaactgagcactgcggctgcgtccaacggagagaacagcccgcg

SEQ ID NO: 24092 - DNA, 121 bp, Artificial Sequence
  Synthesized
  misc_feature (61): n=t or c
atgaggagaaagcaaagcagaataacaaaacaggcctgaagtagtcagctcattaataagntcagagatcccaactcaggcctggcgcagcacaaggagggttgcagcttgcaagtttctg

SEQ ID NO: 24093 - DNA, 121 bp, Artificial Sequence
  Synthesized
  misc_feature (61): n=a or g
gtggtgttgttaggctgatttctactctcatctatgcaggatcagcatggattcatccatnttgctaggaaataagtaatgcctttactgtgctatgtgttaactgtatataaacttccat

SEQ ID NO: 24094 - DNA, 121 bp, Artificial Sequence
  Synthesized
  misc_feature (61): n=a or g
ctgctacagaaaataatcaacttttccactgttctctttcttaagctattttccagaagcnttagacttctctaaagtttgatcctagagactttgctttcatttccagaaattccctgaa

SEQ ID NO: 24095 - DNA, 121 bp, Artificial Sequence
  Synthesized
  misc_feature (61): n=t or c
caagcatgcatggattactttttgagctgtatgtgcaattttctgcgttatataagcacanacaatgtagtctgctgttgatcttaaagagatattgtgagatagcgtctatgtgtgtcaa

SEQ ID NO: 24096 - DNA, 121 bp, Artificial Sequence
  Synthesized
  misc_feature (61): n=a or t
caagcacaggaaaagacgagccagccctccgaccacggggcagttgggcttgcagaaatanatcaacccggagcatttgagaacaaggaacggagtgcgagcaccgctctgccggcgtgca

SEQ ID NO: 24097 - DNA, 121 bp, Artificial Sequence
  Synthesized
  misc_feature (61): n=t or c
taatatagcagttttatggagccaaatttctacagcaagagtacagaacaatacatatttncccttcattaatttgattcattgtactgtttactcattgccaaaatatactataaaatgt

SEQ ID NO: 24098 - DNA, 121 bp, Artificial Sequence
  Synthesized
  misc_feature (61): n=a or g
taaactcatgcctcatttaatttaggcacgagttgtaccttcggaggagactgtaagcacnttatgattacatgtccaagaatcttgtaaatacaaggttttaccttttgggtttcagttc

SEQ ID NO: 24099 - DNA, 121 bp, Artificial Sequence
  Synthesized
  misc_feature (61): n=a or g
gcagcccaggccataaactgaaagaggccattaggaaaacgaggccatcattaaaagcggngctggtaaacatgtaaatgtgttcagtacgcagagcacatcactggaggtttcagtgcaa

SEQ ID NO: 24100 - DNA, 121 bp, Artificial Sequence
  Synthesized
  misc_feature (61): n=a or c
gatctttagattaaaaaacaatactaagttcatccggatccttcacatgtctactgctgtnataaacaaactgcccttccttctcccttcttcatcctaaatccagcctcaattagaatga

SEQ ID NO: 24101 - DNA, 121 bp, Artificial Sequence
  Synthesized
  misc_feature (61): n=a or g
gctccgtatcataaacacaccctgcaagcctgagctggtttggctgtacccagaatgatcnctgtctggtcactgtctctaatgaggtctcagtttggcttctgaagaaacctcaatatga

SEQ ID NO: 24102 - DNA, 121 bp, Artificial Sequence
  Synthesized
  misc_feature (61): n=t or c
cctgttccaatgctaaatttcagcaactcctctgctattgacttttatggcaggaaccaantgtcactatcatttcactgctcaggtaactctgttgataaaatatttaggagaatgaatt

SEQ ID NO: 24103 - DNA, 121 bp, Artificial Sequence
  Synthesized
  misc_feature (61): n=t or g
ttattgttgttacaggctttaaaaaaaaattagagcagaacccatgaagattactgtatanattgaatataagagtgaaatgtctagaaggaatactgcattttatttgtttagctctttc

SEQ ID NO: 24104 - DNA, 121 bp, Artificial Sequence
  Synthesized
  misc_feature (61): n=a or g
ggcttgaggtaaaataatgaatttagacagacgttctaatgtccagtaagcacaggcaganagtacctgacggccattttccattcacacactcacaatcacatacattgcatgtacaacc

SEQ ID NO: 24105 - DNA, 121 bp, Artificial Sequence
  Synthesized
  misc_feature (61): n=a or g
cagtagccgaactttgagtaactttgctctctggcacagatgtaagaattgatggactacntgaaggagtcaatgcaagagaaataggcacagtcaagaagcttaatgggaagggctacaa

SEQ ID NO: 24106 - DNA, 121 bp, Artificial Sequence
  Synthesized
  misc_feature (61): n=a or g
attccttcatgacagcatgttatggcatgtgcctgtgtcacagagatacaaaaagacaggncattcaccaggatgcacaatttcaggaaatatttcatgaaaatatgattgtccttcatag

SEQ ID NO: 24107 - DNA, 121 bp, Artificial Sequence
  Synthesized
  misc_feature (61): n=a or g
ggttatgatctgctgaccttggaattactcttgttcacaactaaagcagagctcttaaagnctgttgttacaagcaggcagccaaactgcttgagtttcctgtgtaatctatgacaatttt

SEQ ID NO: 24108 - DNA, 121 bp, Artificial Sequence
  Synthesized
  misc_feature (61): n=a or g
ctttttcttccctattctctttatgtcccaaactccctggcaccaaaacaccacatgagcnatgtctgagccattctggagccaaaagctcttcaactgtgttatttggtcctagatattg

SEQ ID NO: 24109 - DNA, 121 bp, Artificial Sequence
  Synthesized
  misc_feature (61): n=c or g
aaggcaactatagacaaaggcaagagcagacacagctttaagttagccaagaaacacaaangactcaatctagtaaataaccacagaactgcttacccctttctgaggaacagggcacaca

SEQ ID NO: 24110 - DNA, 121 bp, Artificial Sequence
  Synthesized
  misc_feature (61): n=a or g
gcgtcaagcaaaacatcaacagccaccactcctgatcaccagtttccagcctagattaagnacagagccagtaaggactcctgaattcagtctaagctgaattttacatccatggccatgt

SEQ ID NO: 24111 - DNA, 121 bp, Artificial Sequence
  Synthesized
  misc_feature (61): n=t or g
tatagaggtaaattcatttacacctcacaccagagttttctatgctgctttgctaatcaanatatttattttccttgatagcaataaaagaattctaaaaatggtgaagtaatcaaaggta

SEQ ID NO: 24112 - DNA, 121 bp, Artificial Sequence
  Synthesized
  misc_feature (61): n=a or c
aggttggggggagggctctgctcccccaggattgcagtgtgtgtgtcaaggtgtggccctngggcacactgttgtcttctgtccttggtcagacacagtgttcactctgcaaggtgtgaag

SEQ ID NO: 24113 - DNA, 121 bp, Artificial Sequence
  Synthesized
  misc_feature (61): n=t or c
ttctttcgatggtcagtgagatgaagagagagaactggaggaggtggggcggcagatgganggcgtgatgcagaagtttgcatccttaggaagccaggcttgcagcagtcagagctgaggt

SEQ ID NO: 24114 - DNA, 121 bp, Artificial Sequence
  Synthesized
  misc_feature (61): n=t or c
tattgtataagaaattttgcttctctaaattccagaaggttgggtttgggctttcactcantttggtaataacagtaagcaaatgagtactttctcacactaggttatatatcgcaggtac

SEQ ID NO: 24115 - DNA, 121 bp, Artificial Sequence
  Synthesized
  misc_feature (61): n=a or g
agaaggagttcaagtttcagaacaatgattggtggcgcagggtgacaggcagacgtgctgngtgttggtgtgcagctccctgcaaagagctccttgggtcatttctgtgcacctccctgta

SEQ ID NO: 24116 - DNA, 121 bp, Artificial Sequence
  Synthesized
  misc_feature (61): n=t or c
attctttcctttcaccacaaatctgtggtatgctcaggtgtagtaggcatcactgtgctancaacacatgcaagaggcaatgcagaatctctgctcctgcccaaagtgactgaggtatcca

SEQ ID NO: 24117 - DNA, 121 bp, Artificial Sequence
  Synthesized
  misc_feature (61): n=t or c
agtctgaggtacatcttcagaactggttacagggatacttagtgctactgcttatctcccngtggtaatcgtggaaatgagagattgtggtgaagtctttcacttctcatttctttttctt

SEQ ID NO: 24118 - DNA, 121 bp, Artificial Sequence
  Synthesized
  misc_feature (61): n=a or c
gctccttgtgaagccaggggccgtgctcaggagcaggggtgttcgctggaaatgcaggganaagaaagctgtgctggaagagcagttcaagtggatgcaatgtgtttgccccctgaacaga

SEQ ID NO: 24119 - DNA, 121 bp, Artificial Sequence
  Synthesized
  misc_feature (61): n=a or g
acaaaattgttgatttctgaaacttgttaaaagagcaaagtaagtacaaaggacaactgtnggttataagagaaatttgtcagtcctttgtaaagcacgtaaaaagctatgttgaaatgca

SEQ ID NO: 24120 - DNA, 121 bp, Artificial Sequence
  Synthesized
  misc_feature (61): n=a or g
ctcactgcagatagtaatttacagttttaattgctcattcttcaatttctggctctaaacntgttgctcaaacagaaagtaagaagtataatattgtatgtattcaggctaatactctcag

SEQ ID NO: 24121 - DNA, 121 bp, Artificial Sequence
  Synthesized
  misc_feature (61): n=a or g
ccacccagattttatctggagtttatcttgtaaacagctagatatgtggagagccaggganaaaactaatagtagaaatactactgctgcttactttccagccttctcttatttgtagtat

SEQ ID NO: 24122 - DNA, 121 bp, Artificial Sequence
  Synthesized
  misc_feature (61): n=t or c
gggtactatgcttctatgtgcccacctcgcagtgagtacaggcactgtagcctctacagangggttattgttttggatgctggaaaaatggaggaagacacaattattgaccatatctgct

SEQ ID NO: 24123 - DNA, 121 bp, Artificial Sequence
  Synthesized
  misc_feature (61): n=t or c
gcctggcagcctagaatggagagcctacccacttgctttacacatgcttatctgtttgaantgcctcatgtttctccaacagttggtgagagcccatagaaacaaggctggtcttttcctg

SEQ ID NO: 24124 - DNA, 121 bp, Artificial Sequence
  Synthesized
  misc_feature (61): n=t or c
tgccatcgctaataggttttgatgggagcactggggcaattagctaacatcctggaaagtngttatccttccctgagagtttgtccaggggtatcccttggaaatacttctctagcactga

SEQ ID NO: 24125 - DNA, 121 bp, Artificial Sequence
  Synthesized
  misc_feature (61): n=a or g
agccagcaatgggcccagattttgatcccaatgtacaggactccctgtcatactactgcancatggagatgctgtcacataacccacataacccactgaatacatgccacaagaaactgcc

SEQ ID NO: 24126 - DNA, 121 bp, Artificial Sequence
  Synthesized
  misc_feature (61): n=c or g
atgatttggactcatggcataagtcatcctcaactcactgtgtgacaaatacgaaatgganactgctaaactgagcaaagagttttcccaagacagtttttaacgccactgagacagactg

SEQ ID NO: 24127 - DNA, 121 bp, Artificial Sequence
  Synthesized
  misc_feature (61): n=a or g
cacagatacgcttattaggatggacagatctcaaggcttttgcctgagaaaatgttgggcntccaatcaggcctggtttgtatctgtgcttctgttccacatgtaattgtcctctgcaggc

SEQ ID NO: 24128 - DNA, 121 bp, Artificial Sequence
  Synthesized
  misc_feature (61): n=t or c
gccttcttcctcccccttgcagccattttcagaagtacatcaaacattcccactgcagctnctggctttgctgtccctgaggttgctactgctgtaaatgtacctcactgcaagatgacac

SEQ ID NO: 24129 - DNA, 121 bp, Artificial Sequence
  Synthesized
  misc_feature (61): n=a or g
tacattaccaggtttccactacatattccatcaaatacttcttaaatcagtaggagtaagnatctatacagagccagatacttacactccaactaatggcagagcatatgcctttggatca

SEQ ID NO: 24130 - DNA, 121 bp, Artificial Sequence
  Synthesized
  misc_feature (61): n=a or g
gcatcatttccccaccacaaatccttccagcctggcaaaaaatagccaaaccaacccaagnagcagccgttcttccattggtctcaggcactgagagaggggatctccgagcagcggggca

SEQ ID NO: 24131 - DNA, 121 bp, Artificial Sequence
  Synthesized
  misc_feature (61): n=a or g
tagtcatatttatttgagtaaaaattcccaccttctattaagtgtagtcaaacttgaatcnctccctatagataatccagttaaaagtttggaataaagaaatggatttccttttgaaata

SEQ ID NO: 24132 - DNA, 121 bp, Artificial Sequence
  Synthesized
  misc_feature (61): n=a or g
aacaggaattcgacttttcttctctattgtttggagagatttcagaatctgctcggaaganctgctcttaagtaatctttttggtagcaaagtttttgacctctgaaaacataggtagttt

SEQ ID NO: 24133 - DNA, 121 bp, Artificial Sequence
  Synthesized
  misc_feature (61): n=t or c
gtcctcttcaagttgttcgacttggttctagattatcatttagtgcatgtttcttatgttntactttgtggagtattggttgttttaaagtttaggttcatcctatattttaggtagaatt

SEQ ID NO: 24134 - DNA, 121 bp, Artificial Sequence
  Synthesized
  misc_feature (61): n=a or g
agtaagtagaaacctctcaaatgatggaaagatacaggaaagatattttagtaagacagangcttcagattggtctggggaagaaagaaagatgaagtcttccagaaaatgacatttcagc

SEQ ID NO: 24135 - DNA, 121 bp, Artificial Sequence
  Synthesized
  misc_feature (61): n=t or c
gctgtcaaaaaaatttttaatatatttatttgcaccattagacaagtctttaaacgcccanctaatgcccctgtagactaagaagtacaaaaaggctacttgagggtgactgaagatccac

SEQ ID NO: 24136 - DNA, 121 bp, Artificial Sequence
  Synthesized
  misc_feature (61): n=a or g
gcttgtgcctggcagttcagagcacagcatgtgcctgtctgtggctgacaatgtagacatnccctgaaaagccaggccatccttcaagatgcaactgaaatgggaggcagcagagaggcaa

SEQ ID NO: 24137 - DNA, 121 bp, Artificial Sequence
  Synthesized
  misc_feature (61): n=c or g
tgtaacattgagttaggcagtccagtatttctcagttgttgcaggggaaaggagacaatantgccattatgcatttattgcaagccaagagattttgccaatcctgtggctttgtatgaat

SEQ ID NO: 24138 - DNA, 121 bp, Artificial Sequence
  Synthesized
  misc_feature (61): n=t or g
aaaaaattgttttctggagatacatctgtgtttctgttaattctactgttgtaaaatcctnttagttcatgattcctgtattccgtagctggtccttgctacttctgactccgttcttgcc

SEQ ID NO: 24139 - DNA, 121 bp, Artificial Sequence
  Synthesized
  misc_feature (61): n=t or c
ctagccactaactcaagacaaaaacagactctcaaatgaacaccacactttcaaagagaanggtaaagaaaatatttagaattttgatacagaaaattattttgaatagctttcaaacagt

SEQ ID NO: 24140 - DNA, 121 bp, Artificial Sequence
  Synthesized
  misc_feature (61): n=a or c
cgtctgatgggttgttttcaaaaggaggatgaacatgaggtcagaggggatgcgactgtgntataaatatgtgtggagcttatagaatggctgcatcactcctggctctgtctgcctctga

SEQ ID NO: 24141 - DNA, 121 bp, Artificial Sequence
  Synthesized
  misc_feature (61): n=a or g
aaaattaatactcatggagaattgactgtggacatacagtttgttcagatgaaaagaacancattagaaactaacctcaaatgactgggagatgagaatttataatgaaacactgaagaat

SEQ ID NO: 24142 - DNA, 121 bp, Artificial Sequence
  Synthesized
  misc_feature (61): n=c or g
caccagccctccagggggaattccatacagatgatcattgcagagatatccagcttccatnagaataacatgctccaatcatcactgccaacatctgtactttaataaaacctagaattgt

SEQ ID NO: 24143 - DNA, 121 bp, Artificial Sequence
  Synthesized
  misc_feature (61): n=a or g
tttagatccagacactccatcttcctttaaactatttctcagtctattgtattctgaaatnggaaatcaaaacggatatactttctggagaaaagtccaagcagaaccagactggctgaca

SEQ ID NO: 24144 - DNA, 121 bp, Artificial Sequence
  Synthesized
  misc_feature (61): n=a or g
ccttgtatatagatggtgactatagaatcgctgctgtcagatgactgctctctatggaccnatgattgttccagcacggagcagtgtaaagtaagagctgagggaaagaatgtaaaggaat

SEQ ID NO: 24145 - DNA, 121 bp, Artificial Sequence
  Synthesized
  misc_feature (61): n=t or c
agaagaatctcatgttgtgctgcaaaagcatagggcctgccttttagtgacttgcttcttngcacctattttttgcatttgattccttctactttgaaaaataccagcagcaaaatacgcc

SEQ ID NO: 24146 - DNA, 121 bp, Artificial Sequence
  Synthesized
  misc_feature (61): n=t or c
aaattggcatttaattacgatattggaaacagttggataaattttgaacatttgtagatcntctaattgtacagttctctgatcaagttatgtggtcaataaatagcagaagatgtaagat

SEQ ID NO: 24147 - DNA, 121 bp, Artificial Sequence
  Synthesized
  misc_feature (61): n=t or g
tgctcacataagaggtgattttgctacagaattttcgcttagtgaggcacagatcataacnctgtgattccttacagtaatgagatgattgtgatgtttattcaatttcttagatgcaatt

SEQ ID NO: 24148 - DNA, 121 bp, Artificial Sequence
  Synthesized
  misc_feature (61): n=a or g
caattgttttggaacacagccaaatacagatctttttgatcactgtagagtagtaattcantacaacaggatctgatccaaataatttcggtggatttcaaatcttgccctaaaatagttt

SEQ ID NO: 24149 - DNA, 121 bp, Artificial Sequence
  Synthesized
  misc_feature (61): n=a or g
cccagcccattagagatgagagtgaatatcatgctttcagctgcctttccataaggccccntggtctcagcctcatgtttcagacttcccaatagatgtgccaattattgcagaagttcct

SEQ ID NO: 24150 - DNA, 121 bp, Artificial Sequence
  Synthesized
  misc_feature (61): n=a or g
ttacccaactaaggctagcataagcacatttaactacataaaacgatccatattttccacntatatataacgtgtgggttgtgtgaagtcgcacagaagggaatacttcttgctttatctc

SEQ ID NO: 24151 - DNA, 121 bp, Artificial Sequence
  Synthesized
  misc_feature (61): n=t or c
cacaaacagagaagaatggacacttatttctacacccttttttgtcccatgaacatagatnagtggcttcataaaaccataagggcaccaacgaagcatttttttcccgagtttttcagaa

SEQ ID NO: 24152 - DNA, 121 bp, Artificial Sequence
  Synthesized
  misc_feature (61): n=c or g
cagcaataggcaatggagtgagtgaaaaaggcttttgctcaacatcttattgcgaggaggnagggtcttgtccaaatgatcaggaatctaatgtggatttataacaattgacagccttgaa

SEQ ID NO: 24153 - DNA, 121 bp, Artificial Sequence
  Synthesized
  misc_feature (61): n=t or c
agactgtagcatggactccaaaaaggcacaaattcagcccaaaagaagacagtctttttcnctgagctgtttttctagcagagagataactgctttcctcatttcctagagccagtcatgc

SEQ ID NO: 24154 - DNA, 121 bp, Artificial Sequence
  Synthesized
  misc_feature (61): n=a or g
cgatttaactttcccaggtaagcctgtgcagactcacagcaaaggatttgcacacagttancaaagaggaacctcaggttggcactacgaggctcctttgaaagcccgtcctgctcccttt

SEQ ID NO: 24155 - DNA, 121 bp, Artificial Sequence
  Synthesized
  misc_feature (61): n=t or c
tggagaagatagataacatgcacgtaaagcagtcaaggccatgccattttctaacaaccangagtcccacttgatcaagagagaaaaatcactgacatacactcagcctctgtaagctaca

SEQ ID NO: 24156 - DNA, 121 bp, Artificial Sequence
  Synthesized
  misc_feature (61): n=t or c
aacacagacactggcataatgagctccaaaaacctgctttaagaattattgaaatggatangacgattagaagagtgacgactcagagctgattcggccctggaaagatcaaaatgcattc

SEQ ID NO: 24157 - DNA, 121 bp, Artificial Sequence
  Synthesized
  misc_feature (61): n=a or g
ctaacttaaagtcaatactgagtttacatgttagaaattgtgcagcttcagttacagcccnttcttggaattggcttttacattctgtatttctcatataaagttgggagcatctcagtgg

SEQ ID NO: 24158 - DNA, 121 bp, Artificial Sequence
  Synthesized
  misc_feature (61): n=a or g
agtgtccagtaaaacagcacccgaaaagtgctctgctcaagtgtggtatagggactgttcnagtactcctgagggcagttttaatcaggagctgaaaaaatacttgtgtgacaaattgaga

SEQ ID NO: 24159 - DNA, 121 bp, Artificial Sequence
  Synthesized
  misc_feature (61): n=t or c
cagagctcttccccagggagttgagtttctgagctgtaacatttgccccctctttcagacngaggctggggagagaatctttccctcccaccccttcccgtgccactgtggttttctggga

SEQ ID NO: 24160 - DNA, 121 bp, Artificial Sequence
  Synthesized
  misc_feature (61): n=a or g
gaatgatttttaaattactattgcatttatttcccatttcctcatctccagccgttgtcanaatttactaggcagctcatactgcacattctacttaacactgatagtccagcttttccta

SEQ ID NO: 24161 - DNA, 121 bp, Artificial Sequence
  Synthesized
  misc_feature (61): n=t or c
attcatgaaagcttccagctcttgcttaagccattgagaggaaagctgcatcccaaagcantccctgtgcctggttagtgcagaactcaggaggctgaggtgtcccattgctccatggttc

SEQ ID NO: 24162 - DNA, 121 bp, Artificial Sequence
  Synthesized
  misc_feature (61): n=a or g
attgtctattgttgtaagttaaagttccgccaaaaaaatcaattcggaagcaaagtgtccnttcacctgaatgggaatttaagtaaataaacctcacatacaggaaaacccgtaagtgctt

SEQ ID NO: 24163 - DNA, 121 bp, Artificial Sequence
  Synthesized
  misc_feature (61): n=t or c
atcatgttgcattaacatattcatgagattgtacatatgattaagatgctgtttatttacnggcatggcgacatgtacttttaaagagccactgagaggtccagtcccattttaactttta

SEQ ID NO: 24164 - DNA, 121 bp, Artificial Sequence
  Synthesized
  misc_feature (61): n=t or c
tttctccttctttttcgctcctgaggtgtttatccatgggtgtgcatcctttttgcttccntgggtcgtgctgagtgatgaggagcattgttaggcacgagcaaagctgaccgttgttgct

SEQ ID NO: 24165 - DNA, 121 bp, Artificial Sequence
  Synthesized
  misc_feature (61): n=t or c
aattgtgactgttcatataataatttactgttacacttctttggagacatagatctgaaanttttgcattgtaagagtgtgatacagcaacagctacttaaatggagtgagaagtatagca

SEQ ID NO: 24166 - DNA, 121 bp, Artificial Sequence
  Synthesized
  misc_feature (61): n=t or c
tccttacacgctgctgatttgccccgacccacagccattagaagcacagctacagagcaangcattcatgcaaataaaggacttaaattatcagaggtttgccagaaagagagtgaggaaa

SEQ ID NO: 24167 - DNA, 121 bp, Artificial Sequence
  Synthesized
  misc_feature (61): n=a or t
agatacagtaaacagatcactgtaagtctattctttccttaaatgctaaatgatataaatntgaaatgaaagaatgtacaaagtaatgcatcaagataaggagcaggcttaaaactctgca

SEQ ID NO: 24168 - DNA, 121 bp, Artificial Sequence
  Synthesized
  misc_feature (61): n=a or g
atgacttgaatgaaaagttaactacaagatgagttacaaacctcacctagatttttcattnttaatacaatcacacgctattggttagcaagcagtgtaatcatctactgaataatatgtg

SEQ ID NO: 24169 - DNA, 121 bp, Artificial Sequence
  Synthesized
  misc_feature (61): n=t or c
tcatgttctgaacatgcgtaacgaaggcccagatagcaggatctgggtgaggagtgttccncacagctccagagttactggccaagagggaggatgatgaaaagcagcttaagatttaacc

SEQ ID NO: 24170 - DNA, 121 bp, Artificial Sequence
  Synthesized
  misc_feature (61): n=a or t
accttattgacatctgagtgtcgtcattggtctccctgaatgaatctatggaagttaatanggctaattaatacttcttgtgcattatattttgactagcattgcagatttcttaacaagc

SEQ ID NO: 24171 - DNA, 121 bp, Artificial Sequence
  Synthesized
  misc_feature (61): n=t or g
tctgtggggtaggtgcaccactgagcaacccacagcatgaggcatctgctctatccatagngagaaaccagaaaaattagatggatcccaaatacaattgaccctaaaacctttacaacca

SEQ ID NO: 24172 - DNA, 121 bp, Artificial Sequence
  Synthesized
  misc_feature (61): n=a or g
tcagtcacaatagcattcttttcacctgggagggagctgccaccagcagaaggacctcaantgtaattgtgtgcactcaagcctagattgctgccatcctgaaatctaaatgtctattcca

SEQ ID NO: 24173 - DNA, 121 bp, Artificial Sequence
  Synthesized
  misc_feature (61): n=t or c
gctgcaccaaatgtataattaactgttctcgccgtgcttctctcccatcgctaggcttgcngtggggaagctgttaaagcagcaccccgagccgtcgcgcgctgttagcagataggatgcg

SEQ ID NO: 24174 - DNA, 121 bp, Artificial Sequence
  Synthesized
  misc_feature (61): n=t or g
gtttatatttgccatttatcagtcagcttcagagtggtgctttctgaaactgcaattctgngcttcacagtccactttcgctgagatggtctgtgctgtgtaaaattgctaattctgttgc

SEQ ID NO: 24175 - DNA, 121 bp, Artificial Sequence
  Synthesized
  misc_feature (61): n=t or c
acccttttccctcacccaagtccctgtagagcttgctgatgctcccaagaatgcagcttcntacacagatatggatggtgccatagcagtgttagaaaagccataaaggcatgtgggtttt

SEQ ID NO: 24176 - DNA, 121 bp, Artificial Sequence
  Synthesized
  misc_feature (61): n=c or g
accctgtggctgagcacggccagggtttggctgtgcttcccttgcccgcaaaacatttcantgggttgctgtgctaggaaagccctaagaatatactattgtttttcctccttcctctgtg

SEQ ID NO: 24177 - DNA, 121 bp, Artificial Sequence
  Synthesized
  misc_feature (61): n=a or c
tcctaacacaaagagaatacgaataatgtggttcatctgtgtttcctcctcacctaaacanatttttctctagagtaagtggaataaaaaagaaaagagtaaaagggaaatagataaataa

SEQ ID NO: 24178 - DNA, 121 bp, Artificial Sequence
  Synthesized
  misc_feature (61): n=a or g
agaagggaaagctacgaagggaccttactgctcccacagagcaccttgtggcagggtgctnacacagtcagactcatctcagaaaactatggtgacaggaaatgctatgacagatgccaac

SEQ ID NO: 24179 - DNA, 121 bp, Artificial Sequence
  Synthesized
  misc_feature (61): n=a or g
ggctgctccacgccttggtgttttatctgaaaaaatgattaattattctggctcaccttcntaaagcccagagccactgatggccagagcagagctttatcatgggcaaaaaataataata

SEQ ID NO: 24180 - DNA, 121 bp, Artificial Sequence
  Synthesized
  misc_feature (61): n=a or t
agcacatagaagtatatgttgcaagtaaattttaaaaaagcgtaatgatcagtaacaacangcagcattaataacacagcatagcattcccacagcattttctcccaatataatgaataat

SEQ ID NO: 24181 - DNA, 121 bp, Artificial Sequence
  Synthesized
  misc_feature (61): n=a or g
gccttgtgcttaataataataattaaagagggttttttctatagatcctattagcatcacnggagaaatctgagcaactagattaaagagagcaattaccaccacttcctgccacagaact

SEQ ID NO: 24182 - DNA, 121 bp, Artificial Sequence
  Synthesized
  misc_feature (61): n=c or g
cccatcaaagatgttgtatgggttcttaatgtagccgaaggggccgtaaacgaggactttnagcagcatctccagggcaaagaggctcgtgaagacgatgttgctgatctccaaggcgttg

SEQ ID NO: 24183 - DNA, 121 bp, Artificial Sequence
  Synthesized
  misc_feature (61): n=t or c
cctggtttcctcaggaaatgagatccatagagtagttccgagcctggcttggctgcttgcnctctatgtaacagcttcacaagtgtcactccggagtgacacagtggagggctctcatgtg

SEQ ID NO: 24184 - DNA, 121 bp, Artificial Sequence
  Synthesized
  misc_feature (61): n=a or t
gaaactgtctcaaaagcagtagtaagtatttttaggaggactacttctattattttgaccntaaatttaccttccatgataaccagatcctattgtcctaaacttcagaataatgtaatta

SEQ ID NO: 24185 - DNA, 121 bp, Artificial Sequence
  Synthesized
  misc_feature (61): n=a or g
tagcatttcctgagatgctatggaaccagcactggaaataactgtgagtgggtgttaagcngaagggagtacttggaatgctatttagacaggtccagggtgctcgagtattttccttaca

SEQ ID NO: 24186 - DNA, 121 bp, Artificial Sequence
  Synthesized
  misc_feature (61): n=a or g
tgttgcctcaaacagtttgtgtgttttgacagggaaaggttgctgttgatcactaatccanggagctgtatcaattgctcctgatccgtacagcaaatgtttaagccacataatggagtct

SEQ ID NO: 24187 - DNA, 121 bp, Artificial Sequence
  Synthesized
  misc_feature (61): n=a or g
tggtagcattggggtagcactgggatttttctctgtaagtgcaccacaggttgattgttcntgaacagattaaattttcatatgcattacatatttattacattcctaaaattattatcct

SEQ ID NO: 24188 - DNA, 121 bp, Artificial Sequence
  Synthesized
  misc_feature (61): n=t or g
cacgcagcatggtcctgaccacacgctgcgggtccaagcgcgtgatcttcaaaagggtctngatcatgatgtcccgaagcaacgcgttgctgtctgatgtgaggttgtcacagatgctctg

SEQ ID NO: 24189 - DNA, 121 bp, Artificial Sequence
  Synthesized
  misc_feature (61): n=c or g
tatctaaaaagaataggtctagtatatttctgtatacctactgtgtttctttgtccagatntgagatgaaaagctttgttatgtttcaaatagtactttgtgtccttctcaccttgctggt

SEQ ID NO: 24190 - DNA, 121 bp, Artificial Sequence
  Synthesized
  misc_feature (61): n=a or g
tttttaaactaaaaatatttctatagcagctgtaagacagtctaacccatcaatttcagcncttttcttttccccatacatttttccacaaacataatacaaactttacttcgtttgattc

SEQ ID NO: 24191 - DNA, 121 bp, Artificial Sequence
  Synthesized
  misc_feature (61): n=a or c
aacacttgcatatcaggaatgcttttatgcttactcaagcacaccgcaagccatctctcangctatgttgcagtaaaagcactaacttcataggatagaacaacagcatatgccagcactt

SEQ ID NO: 24192 - DNA, 121 bp, Artificial Sequence
  Synthesized
  misc_feature (61): n=t or c
gttgcatcccactataactgacagatcttgcctagtcatactgagccagtctgaaccacanggctgttatgtgctacagactgagtacaacacagaacacactgcgccaaggcaggcaata

SEQ ID NO: 24193 - DNA, 121 bp, Artificial Sequence
  Synthesized
  misc_feature (61): n=t or c
agctgtagaacaaatttcaatagcaccctaacagaaatccacacctaagccctaagaaaanccctaaccctgagtctacccctaatcttaacactaaatctaaccctaaaacaaaccttaa

SEQ ID NO: 24194 - DNA, 121 bp, Artificial Sequence
  Synthesized
  misc_feature (61): n=t or c
cacctggaatccagggggaaggacagtcaagctgctgttaagaggtgcaaaacatgctgtntgatgcacgcatgtgcatctgcacaagtgcatgcatgactgaggctctctttggagctgc

SEQ ID NO: 24195 - DNA, 121 bp, Artificial Sequence
  Synthesized
  misc_feature (61): n=c or g
tttctctgtatctctgtaatacagatctaattaaagaaactagtttttaggacgttttgtntagtaacttccatttccagacagaatgtgctgattctgggtatccattacatattgagaa

SEQ ID NO: 24196 - DNA, 121 bp, Artificial Sequence
  Synthesized
  misc_feature (61): n=t or c
cagtccagtgcctgatgtggaaagcagttcccatttgcttatggctttgttacttttcacntgccaaaatactgtaatgctggcttagcatttcttctgaaataactcatggttggaagtc

SEQ ID NO: 24197 - DNA, 121 bp, Artificial Sequence
  Synthesized
  misc_feature (61): n=a or g
cctctggaaaaaaaaacagtagttacaacttttttcatatgacaggtagacaaaaaagacncctgaccacaagtaaagtgagaaggtaaagcaagtagttacaagacggagacagtaaaaa

SEQ ID NO: 24198 - DNA, 121 bp, Artificial Sequence
  Synthesized
  misc_feature (61): n=t or c
agtccttgaaatccgagcctctgaggaggatgactcagctgaccaaaggtatgtgttgacnttaggagctggattgctctctgtgctccactgggctcaattaagttgcccacacatatat

SEQ ID NO: 24199 - DNA, 121 bp, Artificial Sequence
  Synthesized
  misc_feature (61): n=a or g
gtgtaagtctcaacagtactctgggaaccactcagatttggtttgttggaccagcatctcnggtaaaaaccctgatggaatgcctctagaactagactgcatcatttcttctctcttccct

SEQ ID NO: 24200 - DNA, 121 bp, Artificial Sequence
  Synthesized
  misc_feature (61): n=t or c
ggctttgtacagaactccccaaccagagcagctctcccttccttcctacacaggcaactgntcatgcaaacagctgctgcatttctgcagcaggagcagctgggtctgtgcacgtccctca

SEQ ID NO: 24201 - DNA, 121 bp, Artificial Sequence
  Synthesized
  misc_feature (61): n=t or c
tacaagtaattcacattacaggcccattatctggtccaggacatgatgaaaaaatacctgntgctgagtggatgatttgaagttctccttttttgggaaaataatgagttgaaagtatgat

SEQ ID NO: 24202 - DNA, 121 bp, Artificial Sequence
  Synthesized
  misc_feature (61): n=t or c
gccgtggagcaagggatgtgggtgagcaagtgctggtgcaggtggctccttgaagagctgnctgttcccaccactgcagaaggacgttgcagggcatcctccagccttgtggaaatttgct

SEQ ID NO: 24203 - DNA, 121 bp, Artificial Sequence
  Synthesized
  misc_feature (61): n=t or c
tgcctccgactcgctccttctcctctatatttgataatcaccccaaaactgacaccacaangcggtgcaaaatggctcagaaatggaaacaacccccaaccccggcccagctccacgctcc

SEQ ID NO: 24204 - DNA, 121 bp, Artificial Sequence
  Synthesized
  misc_feature (61): n=t or c
tatgaaaccttttggaactgttaatgtacagttgtggtgctgtcatgaagagcctctcccntcagctgtgcctgctttgagatacagtggtggcccttactgtgacttcatggtgtggtag

SEQ ID NO: 24205 - DNA, 121 bp, Artificial Sequence
  Synthesized
  misc_feature (61): n=a or g
cccactcaacagtttgaagagaatgcaagcaagacaaagtcccaacagtgaaaaagcaccnattcatcacctcacagcagactaatttaattacttcttgggtattttattgtagtcttag

SEQ ID NO: 24206 - DNA, 121 bp, Artificial Sequence
  Synthesized
  misc_feature (61): n=a or g
tcaatgcttctgggtactgcacactcaccagctgaggtcacaaagacatcttccccacagngcaagctgaagtcatggatgtgtacatatgcatctcattggattttcatgcattagtcca

SEQ ID NO: 24207 - DNA, 121 bp, Artificial Sequence
  Synthesized
  misc_feature (61): n=t or c
agagttttattactcattttttttttgttttgaggaaaaataccagctggtaataccacantgtttgtttgtttgcacagtaccttagagaagaccagacagcattccaaaaatttgttta

SEQ ID NO: 24208 - DNA, 121 bp, Artificial Sequence
  Synthesized
  misc_feature (61): n=a or g
ggtctttgtccagcaatgctgttggtctccacacagtccttcagctgtcggctaaagcccnggtttgtgctaggccgttttttattatgtctgccttctccagcgtgcgtttgtgatggag

SEQ ID NO: 24209 - DNA, 121 bp, Artificial Sequence
  Synthesized
  misc_feature (61): n=c or g
ttcaaagatgtttgtctacctaggaagtgtgatggaaaccactgggattttcagtagtttntctgtgcagattatgttcttggctcctacagcaaagagtaatgagttatgcagtaaaaac

SEQ ID NO: 24210 - DNA, 121 bp, Artificial Sequence
  Synthesized
  misc_feature (61): n=a or g
tagtgacagaagaagagaactgtacagtatgaggaaaaaaggttgatatttccctcttgtnttttattgactagtgaaactcaattagccagtgttaaagcccgttcagggttttcttttc

SEQ ID NO: 24211 - DNA, 121 bp, Artificial Sequence
  Synthesized
  misc_feature (61): n=t or c
tttcacagcggcagtgctggaaattgtgtgcttaagggagcctttcttcatttcacagtanttatcaaatgtgctggttgagaacttgctgttggacactggtcttggttctacttcaggg

SEQ ID NO: 24212 - DNA, 121 bp, Artificial Sequence
  Synthesized
  misc_feature (61): n=t or c
gtcgattgttaataataaatacattaattgatattgccccctagtaatgcatcatgagcantaacactgtgcactgttaagagaaaagttatttattgtttcaagtaatgctcttgaacca

SEQ ID NO: 24213 - DNA, 121 bp, Artificial Sequence
  Synthesized
  misc_feature (61): n=a or g
ccattctcctatgctgactccaaagcagaaaagaaaaagaatttctgacaacactgggtangagcaagcaagaacccaagctcataagtgctcagacactgcccaggcacagcctggctgc

SEQ ID NO: 24214 - DNA, 121 bp, Artificial Sequence
  Synthesized
  misc_feature (61): n=t or c
aacacatatacctaacaaaattaaacacataaaatcacactatcttgtcttcccttctganaaaccacattctttccacctgtactgatgatttatcatttttaaaacatacactttgaaa

SEQ ID NO: 24215 - DNA, 121 bp, Artificial Sequence
  Synthesized
  misc_feature (61): n=a or t
actgtctttaacccactttgcatttacatttacccatatttctgaatatgtgtttgggaangtttataaactgccatttttggattcgctgaaatgtgaaaaaaaaaggtaagttaaaaaa

SEQ ID NO: 24216 - DNA, 121 bp, Artificial Sequence
  Synthesized
  misc_feature (61): n=a or g
cacccggagtaaattcagggagggaaaaagcaagaacttttccctctgggaatattgcacngaggcataaatcagcataaacagaatatactcaaatgctcaaacacaactcagtccactg

SEQ ID NO: 24217 - DNA, 121 bp, Artificial Sequence
  Synthesized
  misc_feature (61): n=t or g
catctaagtcattaatgaaaatggtgaatagtactgctctagagacagaaccctgcagaantccctgtgaaacacccttagattttgacagggaaccactgattattactacctaatcatt

SEQ ID NO: 24218 - DNA, 121 bp, Artificial Sequence
  Synthesized
  misc_feature (61): n=a or g
accagtggctgaaggaagaccacagaaatcagcagcccaagggagcacggcatggagacantgacaaacgactgaaaagcccagcctacctgtgccaacacggccggccccacagcctgct

SEQ ID NO: 24219 - DNA, 121 bp, Artificial Sequence
  Synthesized
  misc_feature (61): n=t or g
tctgaagggaaaagcagcacgtctctagatttaactacatttaaatatccaaccactaaanactctcctatgatatactatcatttttttcagcgtgttaacaaggatacaaaattaaaag

SEQ ID NO: 24220 - DNA, 121 bp, Artificial Sequence
  Synthesized
  misc_feature (61): n=t or c
aataaatagctcgatggtcttgcagattgactcagtggtagtcctatatggataccaatangaacttataaactcaacacacctgcacgagagtgcatcagtgtcatcactgatatccaga

SEQ ID NO: 24221 - DNA, 121 bp, Artificial Sequence
  Synthesized
  misc_feature (61): n=a or g
ttcttctctagaggcagggcgcttcttttccattggacacagccaagattgggctttcctnctgtgttaggttctgccacatctctgggtgatccaaagagagaaattgcatgggctgagg

SEQ ID NO: 24222 - DNA, 121 bp, Artificial Sequence
  Synthesized
  misc_feature (61): n=a or g
gtcagatattagaatactgttttttagggtgtcttgtgttttttggaactaacatacgcantatagtaaattattttcactgtaaagtctttgacagtctccgagtaccaaatgcggcacc

SEQ ID NO: 24223 - DNA, 121 bp, Artificial Sequence
  Synthesized
  misc_feature (61): n=t or c
tctcaataaaatgctggggaactttcagtgctccatctaaccgaactaaagctaggcctgngtctaagataattggcagagactgggaacaacataactagcagctgggagaggactaaca

SEQ ID NO: 24224 - DNA, 121 bp, Artificial Sequence
  Synthesized
  misc_feature (61): n=a or t
agtccttcttatggcacgcaaacattattttcagcccagtccttttggaagccttttacangaggaatgactgctttccattttatcttccctaagttgaatccaaacagattgaacaaaa

SEQ ID NO: 24225 - DNA, 121 bp, Artificial Sequence
  Synthesized
  misc_feature (61): n=a or t
atcccatagagacataaaagccaatcagatacgttgtgtggagtatttctcccaatataangagcattccacactctctcctatttttcacaacagtagctgcctgcatgcagtcagaata

SEQ ID NO: 24226 - DNA, 121 bp, Artificial Sequence
  Synthesized
  misc_feature (61): n=t or g
cgaagcacagaaagatacattctcacctctacaaaaaacgagtagctacttgagactatgngtataacgcctaaaaggccactagaagtttgtatgttctctgcagtgtccaaattctgac

SEQ ID NO: 24227 - DNA, 121 bp, Artificial Sequence
  Synthesized
  misc_feature (61): n=a or g
gcagttacgctattgaatggcacctttagttgtcagcataggcagttgctgagagttttgngagtggtagtaatgagtgtgggagaatagagtgataggatgttcatttttacctgtggat

SEQ ID NO: 24228 - DNA, 121 bp, Artificial Sequence
  Synthesized
  misc_feature (61): n=t or c
acatgcacaactaactgctcttcagaagctttgttgtttttaatttcaacatagcacgtanttagaatgatcagggtcccctgacaagataattatggactgaaattaataaatatattaa

SEQ ID NO: 24229 - DNA, 121 bp, Artificial Sequence
  Synthesized
  misc_feature (61): n=t or c
agaagcaagcatgggagtctatttgcctcatcaactcttgctcattacctcttcccacccncccaccaagcagaacaacttcgcacactttccataccgtacacaattcaagactacagcc

SEQ ID NO: 24230 - DNA, 121 bp, Artificial Sequence
  Synthesized
  misc_feature (61): n=a or g
taaagatcctcatcagaatgcaatggttcctgctacagctttgaagcttttgaaccttacnggaagcttgaaagacaacgaaagattaattagggaaaaaataagaaatttcagtttagaa

SEQ ID NO: 24231 - DNA, 121 bp, Artificial Sequence
  Synthesized
  misc_feature (61): n=t or c
gtcaaaatacatttcaaatgtcgtgccccccagaaagtgcctttttatcctgtagcactcnttcctgtgttttaaaaactggggaggttcccttgcttggcacttctggagtgggagaagg

SEQ ID NO: 24232 - DNA, 121 bp, Artificial Sequence
  Synthesized
  misc_feature (61): n=a or g
tgggtcaccccacagcggtgctatggggctggagaggccggcagaggatggaggtgatccntggtgtcctctggatgtccccaagaatgtcacccgagtgatggggatggaggatgtcatg

SEQ ID NO: 24233 - DNA, 121 bp, Artificial Sequence
  Synthesized
  misc_feature (61): n=a or g
ctagttatatggtgatgtggtcctctttgttgtagctcttcctctactatgtgtttgcatntcctgatactagaactatcatttttttaaggtcctgcagaaatgtgtacgatatggatac

SEQ ID NO: 24234 - DNA, 121 bp, Artificial Sequence
  Synthesized
  misc_feature (61): n=c or g
ggaagttcttccaaagcattccaggtgtaggacctgtgaagtttgtggctttttaagttcnctgactgtgatgtctcacctcagcagatttgctgtgacacctattctatgcagagtaaac

SEQ ID NO: 24235 - DNA, 121 bp, Artificial Sequence
  Synthesized
  misc_feature (61): n=a or g
ctaagaataactctactaggtgagatttcttccatttattaagaaaagaaggtgagtgctnttcaaaattcttaccatggaaattgtttttatgttttcctctgtttctgttggtgcaagg

SEQ ID NO: 24236 - DNA, 121 bp, Artificial Sequence
  Synthesized
  misc_feature (61): n=a or g
ctgtcacaaactacagcaacagaaatgggatgaaacttcacattgtgaatcaaaagactcnaaactatttttgttatgaagactttcagctgacaaaaactgaggagaaggcagtctgata

SEQ ID NO: 24237 - DNA, 121 bp, Artificial Sequence
  Synthesized
  misc_feature (61): n=a or c
tgctctgttacccctattgagcagtatgaggtttagtgggcatgttcacaggcagtccctnatctgcagtgtatatctcatctttgtgtctgagttgcactcagacttcagatgttttcac

SEQ ID NO: 24238 - DNA, 121 bp, Artificial Sequence
  Synthesized
  misc_feature (61): n=t or c
ttaatatgtggagaaaatggaatgtaaactgcatattatggtcactgtgttatgccaactntccttaagtacctaagtatatggatcactcgggattactgctcctgagttgatattcagc

SEQ ID NO: 24239 - DNA, 121 bp, Artificial Sequence
  Synthesized
  misc_feature (61): n=t or c
cagtgttcttctaccaagtgataaaggtgagaatccattttctcttcatgtcctctctgcntaggaacactacttcatacctgtttgacacttcttcacatcagttctttcccccgcattt

SEQ ID NO: 24240 - DNA, 121 bp, Artificial Sequence
  Synthesized
  misc_feature (61): n=t or c
gagatgtaaatgatttgactgtctgaataccatatgggtatgattttcaaaggatatgttntaggaaaaatgccttcatttttcagtggcttgtcatatgaattgtcacatgaatcagaat

SEQ ID NO: 24241 - DNA, 121 bp, Artificial Sequence
  Synthesized
  misc_feature (61): n=t or g
ctctaaataacaggcaacactacaattactctgtggccaagaatttgtttacctcacttangttactgagaaggcatttttaatattttaatatttacgatttgtgtgtgtgtatgtgtgt

SEQ ID NO: 24242 - DNA, 121 bp, Artificial Sequence
  Synthesized
  misc_feature (61): n=t or c
ttagaaataaaataagtgatgtgaaccaaattggtacagagctgtctttacagcttgacancacaatgttcatgtcagcagcacagagacagctgacagaagtcaacaaacactggtgagc

SEQ ID NO: 24243 - DNA, 121 bp, Artificial Sequence
  Synthesized
  misc_feature (61): n=a or g
taaataaatgtctatgttgtgtgaaattcagtaggtagcacagctgtagctgatggttggngtggactgaaattagacctccttgggcatcttctcaccatcctcccccaggctgattaag

SEQ ID NO: 24244 - DNA, 121 bp, Artificial Sequence
  Synthesized
  misc_feature (61): n=t or c
aagcaaaagtgaaacacattaatgctgataaaatttctattaagatatcatggctaagttnatgctgctgtagacccactctacttaaaaattaagtagagagtcacctatcatgatattg

SEQ ID NO: 24245 - DNA, 121 bp, Artificial Sequence
  Synthesized
  misc_feature (61): n=c or g
gcattctcaccctaaagatcgcctgttcagtgtcctgaaaatcagttgctgattgtacaanctgcttgtatcttgtccagcttagtctgtgtaagccaaatttttccccttcagaaatata

SEQ ID NO: 24246 - DNA, 121 bp, Artificial Sequence
  Synthesized
  misc_feature (61): n=t or g
caaaatgtcagcaggattgccgttagatatgctgtccttggattacactggtttaggtctntgtttggccttgctgtgtactgagtggggaagctgaactggctgaattatttctttccca

SEQ ID NO: 24247 - DNA, 121 bp, Artificial Sequence
  Synthesized
  misc_feature (61): n=a or c
tacagagagaatacatagggtgccatatatcagcacacggcacaccagctaattcgacctnatttacatagcattaattgtccgtgagttcatttcaatttgggcccaaattttcattctt

SEQ ID NO: 24248 - DNA, 121 bp, Artificial Sequence
  Synthesized
  misc_feature (61): n=a or g
tcaggaggactggcaaaaccaaaaatggcacatgagcaaaactttggaacatgcatgagcntctgccttcaccctcagcagccacccaaaccctcacagggacagatggccagagctggaa

SEQ ID NO: 24249 - DNA, 121 bp, Artificial Sequence
  Synthesized
  misc_feature (61): n=a or t
cctcctgaagggtacagagaggaacaaaaaaatcagcgacagtgatttactgagtaaaaancacaactcagaatctgatcaaagaccaatcaaccccagctagaaaaggggaagtcacacc

SEQ ID NO: 24250 - DNA, 121 bp, Artificial Sequence
  Synthesized
  misc_feature (61): n=a or g
caactggtcagacacgcacatgctacagccagtgataaagaagctctgatcaaaattaacntttcagatatgggatgtaggatccaagggcatacctaaaggtaataataacaaatattct

SEQ ID NO: 24251 - DNA, 121 bp, Artificial Sequence
  Synthesized
  misc_feature (61): n=a or g
ggactacactgttttagagatcttaaatttagccagctcaacatttaaggggctaatgggnggtgcacatatttatttatagtcttagactatgctgctattcatagacacttaaaaagct

SEQ ID NO: 24252 - DNA, 121 bp, Artificial Sequence
  Synthesized
  misc_feature (61): n=a or g
tttgtaagtaggtcacagtacgtactacttgtatggagggaacagggacctttctgtcccnaaagcacactgtcagagattttcgtgtctgtggtggaaagtgaaagcattcaacttccaa

SEQ ID NO: 24253 - DNA, 121 bp, Artificial Sequence
  Synthesized
  misc_feature (61): n=t or c
tacccccttgatggagaatcacagccaaagtaatacagtcttagagaattatatgctgcangagtaagccgttcgtgttagattttcaggtgttccccttagactgaagagatgcactgaa

SEQ ID NO: 24254 - DNA, 121 bp, Artificial Sequence
  Synthesized
  misc_feature (61): n=a or g
tttactttgtgccactgcatctcgtccctctgtgctgactgagctgtgcagctgttacccngagccactgctcctaggctgggcctggagaatgggtgttaacaccacgatagcaggaatc

SEQ ID NO: 24255 - DNA, 121 bp, Artificial Sequence
  Synthesized
  misc_feature (61): n=t or c
acaatggtattggtggttcccaggagcaccctggagactctaatgtgcttttcctgccatngattttgccttcatgctctgctcctctgggcttgaggagatgcctagaggcctgggcagg

SEQ ID NO: 24256 - DNA, 121 bp, Artificial Sequence
  Synthesized
  misc_feature (61): n=t or c
agctctctgggtacttgaagagcagtgggccaacatgacatagcacagagcaaaacaacangcccagaagtcagcacagagagtgagacctgccttaaaacctatccataaggtaggaaac

SEQ ID NO: 24257 - DNA, 121 bp, Artificial Sequence
  Synthesized
  misc_feature (61): n=a or g
taggttatttcttcacttccctgcagaacttggggtgaagaggggctgatgccttagtctncatttatatgctgataaagtcagagcgaggtgcaactgcttcttctgcaaagcagtgttt

SEQ ID NO: 24258 - DNA, 121 bp, Artificial Sequence
  Synthesized
  misc_feature (61): n=t or c
cccattatggttggaatacaaatgcaagactgctgcagtacacatgcttgaagacctacanacaactgctgagaatggacatctaggacatggtggggcagaaatctaaaattttcacaag

SEQ ID NO: 24259 - DNA, 121 bp, Artificial Sequence
  Synthesized
  misc_feature (61): n=a or g
tctgaaaaaaaagccataggtactatttattgctcctggaacggcatgaagaatgatcaanattgccccctatgctctttctagacttggtctctgtagtttttctgtaaaggaaccatcg

SEQ ID NO: 24260 - DNA, 121 bp, Artificial Sequence
  Synthesized
  misc_feature (61): n=a or t
cttcatagacacctcatcgtttggcccagttctggaagaattatttatattgttttcttantttcaataagtgccagtaaaatgtcatttcaagttaggtgaaatgccttacatccagcat

SEQ ID NO: 24261 - DNA, 121 bp, Artificial Sequence
  Synthesized
  misc_feature (61): n=a or g
tctgaatctttttgccctgtagcaaggaaacgtggtggcagcacacaaagatgctggtcancctcttcagaaattttacgtacaagagctgaaagggctgtgttaagtatcgcttggtcct

SEQ ID NO: 24262 - DNA, 121 bp, Artificial Sequence
  Synthesized
  misc_feature (61): n=t or c
cacaatactcccagatcacatttgatttccaaccctgaaagcagtgttcacatttcttgangtgctacttattttcttgagatttttaagaatcagaacaccatacatttatccatcagaa

SEQ ID NO: 24263 - DNA, 121 bp, Artificial Sequence
  Synthesized
  misc_feature (61): n=t or c
attcaaggttatctttaatatgaacaagcagtggtaccaagaggctaaattgtttccctgnatttatgtaagaagcaaatctgagatggaatcagtggatgttgattttgagttcctagca

SEQ ID NO: 24264 - DNA, 121 bp, Artificial Sequence
  Synthesized
  misc_feature (61): n=t or c
ctggcaatcaaacacaggctggacttcctgcaggacttggaacaatacacaaagcagactncagacaggtaaggtagcacaagcagcaaaatgcagacaggcacaaatcactgttttgcct

SEQ ID NO: 24265 - DNA, 121 bp, Artificial Sequence
  Synthesized
  misc_feature (61): n=t or c
atggtacaaacactagcattggccatgggaaacaggagggatagcaacaggtttgtttgantgctcttttgtagaaagagcaccacatacttcctcttaatgaatgtgtcctgatgtgaca

SEQ ID NO: 24266 - DNA, 121 bp, Artificial Sequence
  Synthesized
  misc_feature (61): n=t or c
gacccatagagtgaatgatcatcagacatgacttacgcttcttattgacacatcattgctncgttagtatttgaagtcttgcttgcattaatatagacgaatgatacgaagaaacttgcaa

SEQ ID NO: 24267 - DNA, 121 bp, Artificial Sequence
  Synthesized
  misc_feature (61): n=a or g
ttttttttttttttttttttttttacttcagtggagtttttgagagtgatgtgattactgntctgagcccttaggacaaaatcaggacaaatcccgataccattgtaacagtggcaaaaca

SEQ ID NO: 24268 - DNA, 121 bp, Artificial Sequence
  Synthesized
  misc_feature (61): n=t or c
taatttttgttttattttgtgatgaagctacaagccttttttttgccatcccaatgcggtntggagttctctagggtgaccatggtgcaggctgtccatgtagcagtctgtctgggacgat

SEQ ID NO: 24269 - DNA, 121 bp, Artificial Sequence
  Synthesized
  misc_feature (61): n=t or c
ccactgacaatgactcacttggtcatctgtttggcagctccactacatttacctcacaagngccaacacggtttctgaagattctgctggtgacggtgccatgacaacaagtggttctcct

SEQ ID NO: 24270 - DNA, 121 bp, Artificial Sequence
  Synthesized
  misc_feature (61): n=a or c
tggacagtcaccattacccaacttctgacctaatgggcacagtaaataagtgaaaggctcntaaaatcagatttactgagcatccttccttttgctgtccattaactgaaactattcatta

SEQ ID NO: 24271 - DNA, 121 bp, Artificial Sequence
  Synthesized
  misc_feature (61): n=t or c
agtgtcttaagtgttgcaatgcctcatttttggatgcctggctcactggacagaatcatangtttggaattgcccttcctataaggatatttaggaacctcttaatgaggctggtggcagc

SEQ ID NO: 24272 - DNA, 121 bp, Artificial Sequence
  Synthesized
  misc_feature (61): n=a or c
ttactttttctgtttcccatcaattataaaatacttccaggatgcaggtttgtaaaatagngttatttattctgctgcgtgttttgtctcaaatgtggcaattggaggcagcacatgctaa

SEQ ID NO: 24273 - DNA, 121 bp, Artificial Sequence
  Synthesized
  misc_feature (61): n=t or c
tctaacttctaaagcttgagactgaagttctgaatggaactctagttctgttttctactgngctgtgtatcttgcatgtgaggagagaaatcgattggttttccttttttgtctttcagtc

SEQ ID NO: 24274 - DNA, 121 bp, Artificial Sequence
  Synthesized
  misc_feature (61): n=a or g
gctctgacaccccagagcatcttcagcaagagctgcagccacgagtcgctctggatctcanatggtcggtcagtaaccaagccgcgtcctgcaacccacctagagtcaaaccaacagtgcc

SEQ ID NO: 24275 - DNA, 121 bp, Artificial Sequence
  Synthesized
  misc_feature (61): n=t or c
atacgctacctcaaatggacaacacgtgctgtaatgttagagacatctctctgcagcccgnatgtaaaggctactgtaagtagaagattcttataatgaccttttttccccctttcctttt

SEQ ID NO: 24276 - DNA, 121 bp, Artificial Sequence
  Synthesized
  misc_feature (61): n=a or g
ccactgaaaacattagagaactaagataaaccagaaaatcagatgcaaatgtatgactctnagtggacaccagaataaatttgagtggttcctaactctgaaatagacccaattgcctttg

SEQ ID NO: 24277 - DNA, 121 bp, Artificial Sequence
  Synthesized
  misc_feature (61): n=a or g
actcaagaacagaagatgtgaagagatctgtacatttttccagtatgagtgcttttgtcantcttgcaagatatacttctagacaaaacttcacacaacctgaaccattaatcctctacat

SEQ ID NO: 24278 - DNA, 121 bp, Artificial Sequence
  Synthesized
  misc_feature (61): n=t or c
acaccatgcatgggtctgtgcactgtgcaagtcaattccagcaggaaatgggcactgaagnttcatttcagcagtatgcattacatccaggaggaaagctgctggctaaattaagaaaaaa

SEQ ID NO: 24279 - DNA, 121 bp, Artificial Sequence
  Synthesized
  misc_feature (61): n=a or c
tttctgtatgcctggtttttgcaagaagcccagtgctactgttctgcagcagtaaaacacnaaagttcagacaaaatattcttaaaaaaagaagttttccatcagtaagaaattgtgaaat

SEQ ID NO: 24280 - DNA, 121 bp, Artificial Sequence
  Synthesized
  misc_feature (61): n=t or g
actgaagctgtcagaatgcgctgccaacgctctctatttgtgctgaggaactgcccggctntaaggctccccagttgtgttgacatagcagatctgcatgtaaaaagcctgctttcatcaa

SEQ ID NO: 24281 - DNA, 121 bp, Artificial Sequence
  Synthesized
  misc_feature (61): n=c or g
acagcatttctatgcaaagcattgcagagatttctgcctgggttgcaaacacaaagcttanataaagatttttcttccagtttgttgtactgatttgcttgaatgaaaactatgagaaaca

SEQ ID NO: 24282 - DNA, 121 bp, Artificial Sequence
  Synthesized
  misc_feature (61): n=a or c
accacagggcccatatgatgccactgagtccatcaaggggacatctccagtgggagagggnacagggatgcatgggtcatctccaccccatttgggctggaagtgcctccatggcccagct

SEQ ID NO: 24283 - DNA, 121 bp, Artificial Sequence
  Synthesized
  misc_feature (61): n=t or c
caacaaatgctgtatttgtctctttcataaactcaaatagtaaagatcatttatctctctntctgctatgtgtttgatttgtttactcagtgtacctccaatagcaaaagtcaaaataaac

SEQ ID NO: 24284 - DNA, 121 bp, Artificial Sequence
  Synthesized
  misc_feature (61): n=t or c
aaaagttcaaaatgtcagtgctgctttctgttctaatttattagctaaggtagtatataanagtgattcagaaaaagtgttgtaaaaatagtttcatcagtaataggacagtaaaaaacag

SEQ ID NO: 24285 - DNA, 121 bp, Artificial Sequence
  Synthesized
  misc_feature (61): n=a or g
tgggcagaagactgttggggtgccccaggtgaggcctttctgcaggtgggttgtagtcagnagatgctctttgttgggcatcaaaatacaactactttgtttctgataactgttatactga

SEQ ID NO: 24286 - DNA, 121 bp, Artificial Sequence
  Synthesized
  misc_feature (61): n=t or c
gagaagcacaaaaacactgcaccaaacagagggggacatgggaattcacagcaaaactcanggagggatattgcagaaagggacagcgatgctatttcacagtccgtgtgctcagctcacc

SEQ ID NO: 24287 - DNA, 121 bp, Artificial Sequence
  Synthesized
  misc_feature (61): n=a or g
tgaagatgtggttcctatctgtgagctgcttttggctctctgcattaaaccaggaaatagngatgttacaatggctctaatttcatggggagagatcacaaagtttaccatttgggcaggg

SEQ ID NO: 24288 - DNA, 121 bp, Artificial Sequence
  Synthesized
  misc_feature (61): n=t or c
catgaaggtttatttcctgtctgccaggaatatgctcttcccattttttgtttatccctgngagtattgccaaacttactctacaatagcaaattatctcaatcagaattgtagactctca

SEQ ID NO: 24289 - DNA, 121 bp, Artificial Sequence
  Synthesized
  misc_feature (61): n=t or c
acaacagtaggtactttataacactttccaaatcttagctcagcttttacacagcatgttnctagtctgaagtattttttaatcctgtatctctattatttagatcatgtgtgttatgtct

SEQ ID NO: 24290 - DNA, 121 bp, Artificial Sequence
  Synthesized
  misc_feature (61): n=t or c
agcagggcagaggaatttggatgggaaagctgagtgctttaatgagtggtctctcactccngacttcactactgtggcacacagattctcgagggaaatcagggccctatttccctgaata

SEQ ID NO: 24291 - DNA, 121 bp, Artificial Sequence
  Synthesized
  misc_feature (61): n=t or g
ctgaggtcaggtgctgcctcctcagtctaacttgatttatagcagaacagatgagtgttgnaagtgttcaagctagcctgccacctcttcaaagagaagaaccctaagacagatgattgat

SEQ ID NO: 24292 - DNA, 121 bp, Artificial Sequence
  Synthesized
  misc_feature (61): n=a or t
ttcttatttctcctttcactttgtctgtatagttgattttgatagatagtgtgcattacanagaatctgattttaatgtgtttgttacataaggaattctgatatggaatttataataatt

SEQ ID NO: 24293 - DNA, 121 bp, Artificial Sequence
  Synthesized
  misc_feature (61): n=t or c
ggcaaataaaatacaacaacctgggatggccccaagctgtccagtccggatcagggtatgnccatattcaaaggaagcaggatttgacttcagcctacctttctatactggcgttaaatga

SEQ ID NO: 24294 - DNA, 121 bp, Artificial Sequence
  Synthesized
  misc_feature (61): n=a or g
taacctattagtttttgtgtatccattgaatatgttggctgagatagttagcacttcactntctgaggaatggaagtttctccattgttttgaagaagcagttcttaaaggcctaagccca

SEQ ID NO: 24295 - DNA, 121 bp, Artificial Sequence
  Synthesized
  misc_feature (61): n=t or c
aaagcaatataagaccattacgtcccactgatgtcaacggaaggaatatcaaaaacccttnagtcaaattgcacttgtcctcaggaaaatttcagctctggtttaccaacagggcgcaggc

SEQ ID NO: 24296 - DNA, 121 bp, Artificial Sequence
  Synthesized
  misc_feature (61): n=a or g
actcttctgaacaggaggtgcaaaaccccaaagattaaacatattccattatgggtaactnacgttcttccttaaacattgctgagaggaatggggaagatggagaggggggagagcaagt

SEQ ID NO: 24297 - DNA, 121 bp, Artificial Sequence
  Synthesized
  misc_feature (61): n=a or g
gaaaataagcaggtaataattccatgaaaaaaaaaaaccgaccgctgaacagaactggganatcaacctccagtatcattaaatggttttacttgcaggctctttggttctgcaataagaa

SEQ ID NO: 24298 - DNA, 121 bp, Artificial Sequence
  Synthesized
  misc_feature (61): n=t or c
gagagcatcgtccatttgtcttgttgcatcctcatcttgttgcgtcatccatttctcttgntgcactgtccatttgctcacgtgcactctgctcactttgtgcaggaattgagttcccact

SEQ ID NO: 24299 - DNA, 121 bp, Artificial Sequence
  Synthesized
  misc_feature (61): n=t or c
aggtttagtgctctttctgctcctatgacacaactgatatttgcctctcagcattttgtgnaacataaggaaaccacttttccaggaagcatgagaaacttcagaaagtgtagggctggct

SEQ ID NO: 24300 - DNA, 121 bp, Artificial Sequence
  Synthesized
  misc_feature (61): n=a or c
ctttctgcagtcaaataactgccacccccagttaggccacatggattcccctacagacctncaggagaatatcaaaagcgacagcatgttgctttctcctttcaagctaatagcaaaattc

SEQ ID NO: 24301 - DNA, 121 bp, Artificial Sequence
  Synthesized
  misc_feature (61): n=t or c
gaagcttccttctgagcttatcaggaagctatcagcttgccaggaaggtgtatgtagatanatacgtgtgcatgcgtgttggcatgtgctgcctcgttggctgagatcatgacaagaacaa

SEQ ID NO: 24302 - DNA, 121 bp, Artificial Sequence
  Synthesized
  misc_feature (61): n=t or c
tacaagcacaccttgctcagctctgcctgaccagcctggtgtcttgtagcctctttgagtncactgcagtctcctggccaagaagccaggtagctagtgaccttcctactacagtggctgc

SEQ ID NO: 24303 - DNA, 121 bp, Artificial Sequence
  Synthesized
  misc_feature (61): n=t or c
ttctccctgttcgataatgcaaacatcagtcacactgctttcagaggctctcacttttgtnacccccaacacacctccagctagaagaccacacactaatttctacctcaagggccagaac

SEQ ID NO: 24304 - DNA, 121 bp, Artificial Sequence
  Synthesized
  misc_feature (61): n=t or c
gatacaaagatttagaagacaacatatttattatatgatgtatacatttttgactgagagntgaaagttgtagggacactatttatggtgccattcttagagccaaaatcaaatagacggt

SEQ ID NO: 24305 - DNA, 121 bp, Artificial Sequence
  Synthesized
  misc_feature (61): n=a or c
ttgctgccacttcaaaaaggagatcctttgccattttccctcattctcctgaatatgcaanaaattacatgaacagatgtactaaactgatacagttactggtggcctgaccaggcagtct

SEQ ID NO: 24306 - DNA, 121 bp, Artificial Sequence
  Synthesized
  misc_feature (61): n=a or c
gcacagaaggggaacaatgtggctttttggtccatttgcattaccatctggtaaggaaganttatttcttacctacaaacttctccatttgttcaacttaataaaatgagatgttagaata

SEQ ID NO: 24307 - DNA, 121 bp, Artificial Sequence
  Synthesized
  misc_feature (61): n=a or t
accactgccccttctttttattccttctttcccaagaatccttcaaacctgacacctacancgcatagtattaccgaaatgtatacattacacagatggaagacaccttcacgacggtcat

SEQ ID NO: 24308 - DNA, 121 bp, Artificial Sequence
  Synthesized
  misc_feature (61): n=t or g
gtttacacatggaaagttaaatatttgtaaacttaagaaggctgtcattcaaaagagatgnctgatgttcaaggttaaaagttgcttgcaagtagaggccaaagctttcaatctatttcca

SEQ ID NO: 24309 - DNA, 121 bp, Artificial Sequence
  Synthesized
  misc_feature (61): n=a or g
gaactcaagagaggtgatgcaagggcaacagattccagcacagcgtgttttctgagtgtgncaggccatccatgaaagtaccaccattaaagtaaaacaaatggctagagctgtaccaaca

SEQ ID NO: 24310 - DNA, 121 bp, Artificial Sequence
  Synthesized
  misc_feature (61): n=c or g
tttgaaggctgaacagagcaaccagtgtgcttgccttaaagatcctcatgaataaagactnaaatgaggcttatgtccactggaggaggtaggacagttgaatcactcaaggtcaaaaaga

SEQ ID NO: 24311 - DNA, 121 bp, Artificial Sequence
  Synthesized
  misc_feature (61): n=t or c
agtaggataaagaaaatgaaagtttcagatgctgttaattcccttcctgtatactcttccntatgtaagtctgtagatacgaaaacagagtctgttaggagcatggtagaaaggaagtcct

SEQ ID NO: 24312 - DNA, 121 bp, Artificial Sequence
  Synthesized
  misc_feature (61): n=a or g
ctttgagctcggtggtgattcatgctcttgactttccctggagggctcctcctgtgctgtncagctctcagcagccgtctgctgtggggatgggagtgtgggcaggggggagcgggatgcg

SEQ ID NO: 24313 - DNA, 121 bp, Artificial Sequence
  Synthesized
  misc_feature (61): n=a or c
tagacgtgcagataagcgaatggatgagcccattggcactgaggtttgggagcagggctgngtgctgcggtgctccctgcctgcagggctgtgcagctccgggctgcgctccttcgctcca

SEQ ID NO: 24314 - DNA, 121 bp, Artificial Sequence
  Synthesized
  misc_feature (61): n=t or c
ataagaaaagacatttgccttccaggtacttaccaattccattagacatgatggatttctngtattatagagattcttagaagatgacaaatgctgatcgcctcctttctgtaatgtagca

SEQ ID NO: 24315 - DNA, 121 bp, Artificial Sequence
  Synthesized
  misc_feature (61): n=t or c
tactaattaaatgtataataacttactgctcagaactggcaagtgatgcactcagcaatangacactccttcacttctagaatactgccttggctcttaagctgtgtgatccctgttaaca

SEQ ID NO: 24316 - DNA, 121 bp, Artificial Sequence
  Synthesized
  misc_feature (61): n=a or c
cagtgacccatctgctcgtctatctgtgcacagaaatttaattttgtctccactggactcnattgatcaccacagtcctggctgatttcaacattgtgaagcctacggctgggtttgtgca

SEQ ID NO: 24317 - DNA, 121 bp, Artificial Sequence
  Synthesized
  misc_feature (61): n=c or g
gtgggctttatttcacagcgatcttctgcctgattattactgtttaatatcacggcagagncttctattgcatggcgccgtctccaggcaggtagatgagcccgtgtctgaagtagctctt

SEQ ID NO: 24318 - DNA, 121 bp, Artificial Sequence
  Synthesized
  misc_feature (61): n=t or c
gtctttgggtttgcagggggaatactgcttcgtctgaggcattctctcccttctccattcnctgcagatcagcaaccacacaggtgatgtcagctgttaacccagatcacaagtgagtggg

SEQ ID NO: 24319 - DNA, 121 bp, Artificial Sequence
  Synthesized
  misc_feature (61): n=t or c
ggtacctggaaaagagaaacaaaaacattttaatttccattacattacattgccattgttntatttcagaccttcagagggtactctttgtcaggctgtcatagatgctaaaatctcactg

SEQ ID NO: 24320 - DNA, 121 bp, Artificial Sequence
  Synthesized
  misc_feature (61): n=a or g
acaggcttttacaatctcctcctgcattacctggaaaaccttccacaggttttaccactgnaaggaattaagcccatcctccttccttaatcacccactggtactgcccgtctccctgtgt

SEQ ID NO: 24321 - DNA, 121 bp, Artificial Sequence
  Synthesized
  misc_feature (61): n=a or g
gagcccatcctgcctccccttctgaaagcctttgttctgtttttagccatcttgtgtaagnaatatatcctctggggctcttccttagagcacgtaatcacagtgcaatatgacaaactca

SEQ ID NO: 24322 - DNA, 121 bp, Artificial Sequence
  Synthesized
  misc_feature (61): n=a or g
ctgaagcaaatgtgcgtttattgcaacaacacaattaaaaaacaaaagactgtaaaccttngaaacagcagcagtcaaaatactcacacacaaacacttcctgcagaaccatagcttcatt

SEQ ID NO: 24323 - DNA, 121 bp, Artificial Sequence
  Synthesized
  misc_feature (61): n=a or g
acaaagagaaccaaccatggggaaagcaggaaacactgtcacagttgggaaggcgaagttnatacaaaggctgctgacgacagaaccatggatgggtgattcatcttctgtgctaatacct

SEQ ID NO: 24324 - DNA, 121 bp, Artificial Sequence
  Synthesized
  misc_feature (61): n=a or t
ccctgaggttaggagagctgcatctgccctgggggatggcaaaccctccctgaccctaaangtggagagtggatgtgcagtcccaactgcatctcctctgcctgaccccatccccttgcac

SEQ ID NO: 24325 - DNA, 121 bp, Artificial Sequence
  Synthesized
  misc_feature (61): n=t or c
ctctgttctccttggctttgtctgtattgttttctgtttgttttaagcagataattattantatatcagctctaaccagtaagttatagactgatcagtagcactctcagacaagtcagtt

SEQ ID NO: 24326 - DNA, 121 bp, Artificial Sequence
  Synthesized
  misc_feature (61): n=t or g
ttgtagaagccataggaaaccacagcctctggaggaaagctgtgcatcaccccttcaacanctagttgagaggaactgaattattgttctgactgtctcccacagaaaatcatactggcat

SEQ ID NO: 24327 - DNA, 121 bp, Artificial Sequence
  Synthesized
  misc_feature (61): n=t or g
ctgagcacttggtgtgaacattaaatcttcatcaaaggccacaactacaggtcatatttgnctgtcctacttgctaacatagacagggactaagcgtactactttgtttttagtagagctt

SEQ ID NO: 24328 - DNA, 121 bp, Artificial Sequence
  Synthesized
  misc_feature (61): n=a or g
caagtcatctgtatctttttgtaactgctaaatatatgattgccaggtgtagaatttgaancaaaaacaggtagaacaggacatctgatgctcacatctgttgtctttgctttccagaaca

SEQ ID NO: 24329 - DNA, 121 bp, Artificial Sequence
  Synthesized
  misc_feature (61): n=a or g
gctaagggaaaaatggatacatcaaggatgcagcaaggtaatgggctgattattgagtttnaagctgctgagaatgagtgtgtgggattttatgatggcatagccagcagtgagtcagaga

SEQ ID NO: 24330 - DNA, 121 bp, Artificial Sequence
  Synthesized
  misc_feature (61): n=a or g
cttggtccccccattaggacttgttgtaataccttcatggcatgtagtgctctttgtgtanctgtggctgaacaaggtctagtaagtacattttctgaaaccagaaaaaaaaacaggaagt

SEQ ID NO: 24331 - DNA, 121 bp, Artificial Sequence
  Synthesized
  misc_feature (61): n=t or c
gtgacaaaaggccgatggggaattgagtgtaaaatggtaactcagtgcaaggttacctgantggttctaacttacactgatgccacacgcatattgaagactccagggtgctttatgaagt

SEQ ID NO: 24332 - DNA, 121 bp, Artificial Sequence
  Synthesized
  misc_feature (61): n=a or t
tatgttaaattcatggaggataagcactttggtgcataggttgcaaggcaaacaatgcatngtgaagtagaatgactcaccctgagatccagaatcatgatgactgcctccataacactga

SEQ ID NO: 24333 - DNA, 121 bp, Artificial Sequence
  Synthesized
  misc_feature (61): n=t or g
attaataatagttggatataatagccatgatagtggacagaaaatctacattcttaccaanaaaaatatataaacatcgtgattagttgcaagcatatctttgatatgtctgcactgagtg

SEQ ID NO: 24334 - DNA, 121 bp, Artificial Sequence
  Synthesized
  misc_feature (61): n=a or g
gctcatgagtttccaaggccacgtgttgtgtttctgcaaagatacttcagctcaataccancagacacctcttagaacagccatggtggaaaccaatcccatagcagctacaggaggtgtt

SEQ ID NO: 24335 - DNA, 121 bp, Artificial Sequence
  Synthesized
  misc_feature (61): n=a or g
taatcaaacataattatgcttgcaagctgtgctacacatttgtcttttctgccataggttnttcagagacctatgggaggcaggtccacttttcacccagctttcgtgttttcaactccca

SEQ ID NO: 24336 - DNA, 121 bp, Artificial Sequence
  Synthesized
  misc_feature (61): n=a or g
gaaatcagtaacgataatgtccactgtagtgaagtaatcctgtaacaacagaacaataatnctgtaactgaaatcttgtacagatagttgtttttgatgataatttctgcattgacctaga

SEQ ID NO: 24337 - DNA, 121 bp, Artificial Sequence
  Synthesized
  misc_feature (61): n=a or g
tgtttaaaataggccagacaaatctggctttatggtctcactatggactgcaaattgagcncaggatgacaaggtgagaggcagatatctgtaatgtaagcttcaaaagttaaatgagatg

SEQ ID NO: 24338 - DNA, 121 bp, Artificial Sequence
  Synthesized
  misc_feature (61): n=a or g
atgacattttaatcactcagttttcctaatctcagaaaatgcttatttcttttcttctcgngaaattgttaagataatgatgctgcattttgatttgcgaatgtattcacttcacataatc

SEQ ID NO: 24339 - DNA, 121 bp, Artificial Sequence
  Synthesized
  misc_feature (61): n=a or g
cagtaacaatcactactgtctgtgcatctgtcacatcatcgcttctctgtattttaaagtncattggttgatgatgtaattccctggaatctgttgctgcaggtaaacacaaaataatgcg

SEQ ID NO: 24340 - DNA, 121 bp, Artificial Sequence
  Synthesized
  misc_feature (61): n=a or g
ctggcttcttgctgcagggggaactcctgtccagatggtcaaagcaaacagcgatggacangtcaccagcgacctctgggccttggattagcaaggatactaagcatccgttagtattgca

SEQ ID NO: 24341 - DNA, 121 bp, Artificial Sequence
  Synthesized
  misc_feature (61): n=c or g
gtacccctgccactacagtcctgtttccatgccctgttgagcagacggctgtggaacactncctaaggaaccgcctgcaatgtcaaaacacagcacatcctccatgttccctgatttcaat

SEQ ID NO: 24342 - DNA, 121 bp, Artificial Sequence
  Synthesized
  misc_feature (61): n=t or g
aacaggtagtggtggcaagttatggcagaccaaattttgtagctgtgttttgaactgcttnccagccttttgttttcttcagcctttccagctgagcccacaactgtggatactttgcaag

SEQ ID NO: 24343 - DNA, 121 bp, Artificial Sequence
  Synthesized
  misc_feature (61): n=a or g
taaacaatggctgtaaacagggacatctggctcccataaattaattggccatttacacagngagggctgtttgcatgtaaaagaaggctttcctgctaattctgtcataagattttgattc

SEQ ID NO: 24344 - DNA, 121 bp, Artificial Sequence
  Synthesized
  misc_feature (61): n=a or g
taaccaaacaggtgggaaattaacattggctatgtaccattcccaacaagtgatttgcatncccccatgaaatttgtatgtcattatgaaaagcagtgtatttgataaactagatgtatcg

SEQ ID NO: 24345 - DNA, 121 bp, Artificial Sequence
  Synthesized
  misc_feature (61): n=a or g
atgcatcagaaaggagtttcttattaaaattatgcttgcagaccagctgttaccttgttgnttggggtcttcattacaatgttacaaacccaagttgaagccctattttcaaaaaaatcgt

SEQ ID NO: 24346 - DNA, 121 bp, Artificial Sequence
  Synthesized
  misc_feature (61): n=a or c
agtagcaaatgataaagtgtctgatcacgacagcagcaaaatgattaattcgttagcctgncgggttttattttgattagagctgacagtattagatgggttatatcctgcatctttctgg

SEQ ID NO: 24347 - DNA, 121 bp, Artificial Sequence
  Synthesized
  misc_feature (61): n=t or c
gttgttattgtaccaaaactttgcaccattttcactcaccttgtggaaaatgatctgaganatttacccatacaagattggctgccaactcagagaccagagaaacctccttttttggtaa

SEQ ID NO: 24348 - DNA, 121 bp, Artificial Sequence
  Synthesized
  misc_feature (61): n=t or c
agaaaaacaaataaaactatccatcttcttaggaaaaaatctagatatcagacttagtcantgcatacacaagtctgtggctttttcagtttgttcggatgcattgttgctgttgttaagc

SEQ ID NO: 24349 - DNA, 121 bp, Artificial Sequence
  Synthesized
  misc_feature (61): n=t or g
ttgttgttcatagaaggactttgctttgttctttggattgggaatctagttccatcttccnatctacttgtttgaaataaattgagtcaattactacaagtcacagaaccgaaaaacacgc

SEQ ID NO: 24350 - DNA, 121 bp, Artificial Sequence
  Synthesized
  misc_feature (61): n=a or g
ccttaacttattagatttggaattttcttttagcaatccattagttcccttaaatgttaangaagtgtaattcaagagattcaatgagtatatgctaaaggagatttagtcacagaggaat

SEQ ID NO: 24351 - DNA, 121 bp, Artificial Sequence
  Synthesized
  misc_feature (61): n=t or c
gacacattctgaagctcttattctgcttactgaagatggaaaaatgagcagggcaaattantggcagacattaatttcagaataacctacttttgcctgtagaaatggttttacatgtgcg

SEQ ID NO: 24352 - DNA, 121 bp, Artificial Sequence
  Synthesized
  misc_feature (61): n=a or g
tcggggacacaacacgacgcttggtatgggattgtgggcagcaggactgagaatggacatnattatctgcagtacatgttggtaaatggaggttgctttagctcatgtctcatttctacat

SEQ ID NO: 24353 - DNA, 121 bp, Artificial Sequence
  Synthesized
  misc_feature (61): n=t or c
ccaaattgagtctaacataagcacatgaacagaccaatctaacacaagacattctttgatnattacatgagtaatgttatggagtgaataaaaactttgatgtttcaagcccgaagtatgt

SEQ ID NO: 24354 - DNA, 121 bp, Artificial Sequence
  Synthesized
  misc_feature (61): n=t or c
aggaacaaatcatataggagatttcctcatgtctttctcctgtgttctaattttagtagangctactacctgaaatggcggtactcatagaaataggtcctcacagaaattggtcttcagc

SEQ ID NO: 24355 - DNA, 121 bp, Artificial Sequence
  Synthesized
  misc_feature (61): n=a or g
ggtatttggaaatcagggcaccacatacaactgtgacaacctactatcagttcaacagccntgctgcagattagctgtgcttctggtcagaagggagacttctgaacatccccaggatagc

SEQ ID NO: 24356 - DNA, 121 bp, Artificial Sequence
  Synthesized
  misc_feature (61): n=t or c
aggagatacatgtaagatatgacttagttgggtcaagaatggactcttctgcctgtcacancagtctctgcttttgtaagttaacctctcttattgagtcacctttggcgtacccacttgt

SEQ ID NO: 24357 - DNA, 121 bp, Artificial Sequence
  Synthesized
  misc_feature (61): n=a or g
ctttatgtacatactgcttggcaaaattgggcagtaagcaacaatacagtgagtccctagntcttatgttgcagtgacctccatttgagtccagacaatgcaaaatacagtgtttcaatgt

SEQ ID NO: 24358 - DNA, 121 bp, Artificial Sequence
  Synthesized
  misc_feature (61): n=a or g
ctcattgcctgcctgcactccagggctgttttggaatacatggaaatgtgtctggtgtacnagagaaccttctgctgatggttgaagtgccatttcacgtgtccctggtggctgagtttaa

SEQ ID NO: 24359 - DNA, 121 bp, Artificial Sequence
  Synthesized
  misc_feature (61): n=a or t
atatatatagatgaataactagtcaaaaaatatgcacccaatgcaagttttctcaatttanttcctacagcattatttttaagctctgctttcttatgaaagtgagacttacacagaaaca

SEQ ID NO: 24360 - DNA, 121 bp, Artificial Sequence
  Synthesized
  misc_feature (61): n=a or c
tacactcttcagagagagcagtagcgatacaggcattaaggccccagtgctgcaacacagnattctgagatcttggctattatagctgctttatggttatggagtatcattaaacaattag

SEQ ID NO: 24361 - DNA, 121 bp, Artificial Sequence
  Synthesized
  misc_feature (61): n=a or g
ctcagttaccataatgctgagatgacgctgtatgggcaagtttgtcatctgtgcagtgtcntgcagtgcccacatgtatgatcatgtgcatgtactacagcttttgcaggacaagacttga

SEQ ID NO: 24362 - DNA, 121 bp, Artificial Sequence
  Synthesized
  misc_feature (61): n=t or c
actgtcgttctccagtcgttttcagtgcatggatgaatccatactcttaatttcaacttcncccaatggccacatgtctgccataacctgtgaacgcccaccttgcagtcacagtgtgcgg

SEQ ID NO: 24363 - DNA, 121 bp, Artificial Sequence
  Synthesized
  misc_feature (61): n=a or g
aaacttgaagtagattacatttcggacagcatcttagctctgaaggagggctatgcatgcntacataaccattgcttgtcctcctcataatttcacttggcttagtggaataaaataaggt

SEQ ID NO: 24364 - DNA, 121 bp, Artificial Sequence
  Synthesized
  misc_feature (61): n=a or g
tgccatgcgttccagacttttttcccatcatttttaatcattagttaccacagtaacagcnttcagtgcagtgacagcagtcttctgtgacagcatttcatctttctgttatattacatct

SEQ ID NO: 24365 - DNA, 121 bp, Artificial Sequence
  Synthesized
  misc_feature (61): n=t or c
agggacagtttctgaatcctcctgactgcaaatcttgcaggcacagtgttgatcctggtcntccctgtaggagcacggaccacaggcaccgctggaacacaagctttggtctgtgcagggg

SEQ ID NO: 24366 - DNA, 121 bp, Artificial Sequence
  Synthesized
  misc_feature (61): n=a or g
gtagcacaatcagaaggagcagaagggcctgcttaatctgctgtgacagaggcccacccancagggcttggcctcagctgggaacccagtgataaatgctcagccttcacactgcctgtcc

SEQ ID NO: 24367 - DNA, 121 bp, Artificial Sequence
  Synthesized
  misc_feature (61): n=t or c
aagttacttctttcctattgacttttccttggttgtagaactgcagctgtcctggatattnaaagctacataacaatgaagatcacattcgtgaggtaacatcacatcccaaacacttctt

SEQ ID NO: 24368 - DNA, 121 bp, Artificial Sequence
  Synthesized
  misc_feature (61): n=t or g
aggtgggaattgagtaattgtgagtttcttacctgagattttcagacttgtgtttaccctngagatgagacagcagtattttgtaatagactttttgcatattttatgattgcaatagcat

SEQ ID NO: 24369 - DNA, 121 bp, Artificial Sequence
  Synthesized
  misc_feature (61): n=t or c
caatttctcctaaacgagccaatgcattgccttttttctcaagggaatcaaggaaacatcngcataaaaagggagctgatatagatgttaacagaacattgctgttactgatacaagcctg

SEQ ID NO: 24370 - DNA, 121 bp, Artificial Sequence
  Synthesized
  misc_feature (61): n=t or c
aagactttctcatggtgggcactctcctgtggtgggctggataattttcctctgctcagtnccctattttttcaaaactacccaacagcgcagagtccactgcaaacactgaatttggctg

SEQ ID NO: 24371 - DNA, 121 bp, Artificial Sequence
  Synthesized
  misc_feature (61): n=t or c
tccaaaatgataaattttaacctttctgaagaaaggaatagcaagattggcaagaaacccngaaagcatgcagcaacagtgtttgctgcatcccaggccagacattattaaccacttactt

SEQ ID NO: 24372 - DNA, 121 bp, Artificial Sequence
  Synthesized
  misc_feature (61): n=a or g
tagatcaagtttgtttcaattctcattcaggtcttgggccttagccaggttctctatttcntgccagtctctcttttattcagtataaatttggatttcacaatacaaatttagccactgt

SEQ ID NO: 24373 - DNA, 121 bp, Artificial Sequence
  Synthesized
  misc_feature (61): n=a or g
gacaaactctcctttcatgccatgtggctcccatagtagttacagaaatatggaagtactntgatcttactgttctctttctcctacatctctgggagattactcctggtgctatgtgtat

SEQ ID NO: 24374 - DNA, 121 bp, Artificial Sequence
  Synthesized
  misc_feature (61): n=a or g
acaaatcaaacagtgtaacaaacattgttgatatacttaattatcttatgatagaatttcngattgcagctgaaataggacaccatcctttgtgccttagacaacgaaagttttttcaggt

SEQ ID NO: 24375 - DNA, 121 bp, Artificial Sequence
  Synthesized
  misc_feature (61): n=c or g
atataactaagcaaagtacaaaatgggatccttctttggcagtttgttttatatgtcactnaaacaaggtagttttgcctagcaccttgagcctcgcttcttgacttcagttctggttcac

SEQ ID NO: 24376 - DNA, 121 bp, Artificial Sequence
  Synthesized
  misc_feature (61): n=a or g
gccatggaaatatgctctataaagttgattaccgtgcttcgtcctactgaaatagcagtcnctggaaaactatagataaggctaaagcaatttatttgcgtttccaaaggagatgggcaca

SEQ ID NO: 24377 - DNA, 121 bp, Artificial Sequence
  Synthesized
  misc_feature (61): n=t or g
ttaactatcatgttgagtcttaaacacaaaatttacagcacaattaattctggtagtatgnaacttaagggatttgatgaagtgtaagtaagaaagattctataataagttgcaaacttca

SEQ ID NO: 24378 - DNA, 121 bp, Artificial Sequence
  Synthesized
  misc_feature (61): n=a or g
cttcttcctaacttacactcaagtggctctctcactgtgaagactccctttgcaatcattnatgtaattgcttctaagctcatgtcattttttcatcacctttttgaagtgtagacagcag

SEQ ID NO: 24379 - DNA, 121 bp, Artificial Sequence
  Synthesized
  misc_feature (61): n=a or g
tgggactgaataaaaacgatggatgaggtctctgtgaagttagagccagagagggctctcncagctcctctcaggccccctagcgatccatccaagtattccctttgtgtaacgggtgtga

SEQ ID NO: 24380 - DNA, 121 bp, Artificial Sequence
  Synthesized
  misc_feature (61): n=a or g
tttgaacaattctgatccaccagatgggaaaaagagaccttgtgttacttcacagcccacncagcccccttccttttcctcttggttctagtcagaaagcacataggaatataaactgcca

SEQ ID NO: 24381 - DNA, 121 bp, Artificial Sequence
  Synthesized
  misc_feature (61): n=a or g
ctggtggctggaagaggcgaacacaagggcttgattcactgagactgttctggttccagcnccacacgtccgtgttttgtcctcactagcaatggaatttgtgccagtttctggccacagg

SEQ ID NO: 24382 - DNA, 121 bp, Artificial Sequence
  Synthesized
  misc_feature (61): n=a or g
attctgttaccatttagtgtgttatatatagggaaagccaatatcctgtccagttctaatntgaatgagattttgagtcattttaataggcaaaaacaaacaaacaaacaaacaaaaaacc

SEQ ID NO: 24383 - DNA, 121 bp, Artificial Sequence
  Synthesized
  misc_feature (61): n=t or c
ccagaagccagcaggaagagcttggatattcctttgtaatttctccaagaaataatgccangtttcaagacaaaccctgttcctgtaataaagcttgaaaacttttgtgtttaggatctgg

SEQ ID NO: 24384 - DNA, 121 bp, Artificial Sequence
  Synthesized
  misc_feature (61): n=c or g
ccacttcacaacacaaagctctccagctgctcacagcaacaactctctacgcccctcttanacatacagagaccaaggatggaaggaaaaaaaaggaagctacaaagaaatagatggttgt

SEQ ID NO: 24385 - DNA, 121 bp, Artificial Sequence
  Synthesized
  misc_feature (61): n=a or g
ttagaacaaaagtttaagtaatccatgtaagtgttacataggcaacatcagtacaagtggnagaaagtctgaagaggtgtctcaagcattataacctacattctttctagtccttgtgctc

SEQ ID NO: 24386 - DNA, 121 bp, Artificial Sequence
  Synthesized
  misc_feature (61): n=t or c
tagttagatataacgtatattcaaaatttactcctctgtgccttttcagtaaggacaaacnccttttctgactagcctgaagtataagagaaatgcataatttccctggtcgtgagtatga

SEQ ID NO: 24387 - DNA, 121 bp, Artificial Sequence
  Synthesized
  misc_feature (61): n=a or g
aaaaggttgtctcaccttgcccctggggtccatccatcgttggactaggtacattgctctngcaaaagctaagggcttttcccagttttctacgagccccaggccatcatagcctcagtag

SEQ ID NO: 24388 - DNA, 121 bp, Artificial Sequence
  Synthesized
  misc_feature (61): n=t or c
agcactggctgcagtctgtgcaaacaaagtgaagccaaatgggcttctggtgttgaggccnttactgctcctgagacatcagagaacacagcctgcactcctttagcagtgttacagttac

SEQ ID NO: 24389 - DNA, 121 bp, Artificial Sequence
  Synthesized
  misc_feature (61): n=t or c
tgcatttcccagagcagaatctgtatcattctctgtgaaatttcatggatctccaacaacncagtatctgagttctcagtagttcatcaaatacgcacttaagcagcagagtcagagactg

SEQ ID NO: 24390 - DNA, 121 bp, Artificial Sequence
  Synthesized
  misc_feature (61): n=c or g
tgggttgaagatttgtattcatgcatctagaaaaaataagccaaaaagtgtttaaaagtgntggaattattcaccccttcacgcaaaggattaaaaaagaacatctaacagaaagagcttc

SEQ ID NO: 24391 - DNA, 121 bp, Artificial Sequence
  Synthesized
  misc_feature (61): n=a or g
tagtagtgcaagatgtgtcactgcctgtatgctgctgcccactccactgaagcgggatacncgcccaagtgaacctccattcataccaaatgcaattactgatggaaaagggtaactttat

SEQ ID NO: 24392 - DNA, 121 bp, Artificial Sequence
  Synthesized
  misc_feature (61): n=t or g
attccagtactggaatatttcatcattacacttgtcccaaatagagattgagacattttgnatctaatatgtaagtatgtatttagattatatataatacatacatgtgtgtatgtatttt

SEQ ID NO: 24393 - DNA, 121 bp, Artificial Sequence
  Synthesized
  misc_feature (61): n=a or g
gaagatgagactcactctcttaaaagcccaggaacttatcatggaaaattatgtaaaagcngaagatctgaatttccttgagtgtctcagctcttggcttttactgctcccagtctttggg

SEQ ID NO: 24394 - DNA, 121 bp, Artificial Sequence
  Synthesized
  misc_feature (61): n=a or g
tcctttctgaaggagagtaaattagcctacaagaagcttgtgctgttcagagtagagtgcntctggtatccaagctagttcatctaaaaataggtttggaaactcgctattctttgcaggc

SEQ ID NO: 24395 - DNA, 121 bp, Artificial Sequence
  Synthesized
  misc_feature (61): n=t or c
aggtcagactctcagccaagatccctataagatgagctgtggccattggaaatgctgtccngggccagaagcactcatctgctgtgtgctgggggtgccatgagacactcatacatgggag

SEQ ID NO: 24396 - DNA, 121 bp, Artificial Sequence
  Synthesized
  misc_feature (61): n=t or g
ggggccctgctggtgcgatgtatcgaaatacctttctctctccactcctttgtggagaganaataaagaaaaggacagctgcccctcagatttgacagggtctgagctgctgggtgccatt

SEQ ID NO: 24397 - DNA, 121 bp, Artificial Sequence
  Synthesized
  misc_feature (61): n=t or c
taattcctgaattttggttttcagtagggtattaacagaccttcaagataattctgcttcnctcagtagacagcacgcaaacttgatcattatgtgttcttaattttacccagatcttttt

SEQ ID NO: 24398 - DNA, 121 bp, Artificial Sequence
  Synthesized
  misc_feature (61): n=a or t
tcattacagactaagatgatgttcaggcttaaggagacaaacattgtaaatttcagactcncaccaactttgacgtgctgaggtttataacctctataacattaacttagtttttaaatgc

SEQ ID NO: 24399 - DNA, 121 bp, Artificial Sequence
  Synthesized
  misc_feature (61): n=a or g
catcctgcagctgctgagaaccggcccatttgtgttccattggtaagttactagttgttcnttgaacagtcaaaaacacgtttaggggaagatgagccagcacccgtttctaatatgtacg

SEQ ID NO: 24400 - DNA, 121 bp, Artificial Sequence
  Synthesized
  misc_feature (61): n=t or c
aagaaaaggtggtttctacagatgtatggcataggtttcagaagtgaagaactgttgtaantttacatcatttaggtacagagtcgtttattttggtaaaataacttcaaaatgatatttt

SEQ ID NO: 24401 - DNA, 121 bp, Artificial Sequence
  Synthesized
  misc_feature (61): n=a or c
ggtagacagataaaactgattaggtagacaaaattatcgctatgttacagaaatcaaaggnaggattcttccctaatataacacgcataccatatttaccacaaattctgtttgtatttct

SEQ ID NO: 24402 - DNA, 121 bp, Artificial Sequence
  Synthesized
  misc_feature (61): n=a or c
tagtgggaaatatggcagtcttctacattcttcttcattatcagcttcagttttacctggnctttgctgtgtagatgctttgccctgcaactcatctgggttggaaaatgtgaccataact

SEQ ID NO: 24403 - DNA, 121 bp, Artificial Sequence
  Synthesized
  misc_feature (61): n=a or g
ggctgggcaggacagcaaagcagcagataagggccagcccatcacctttatgtctgggaanctcttgctcaagtggtgcctggcaggaaaccaaggctgttggctaagagccctcccccct

SEQ ID NO: 24404 - DNA, 121 bp, Artificial Sequence
  Synthesized
  misc_feature (61): n=t or c
tcctgttgctccaatttctactcttgctggggctcgacagctggccatccaccttctttcnttgtctaatgggaaagcagctgtgggaagagcttgtcttgctctgcaggtgtgtgctcct

SEQ ID NO: 24405 - DNA, 121 bp, Artificial Sequence
  Synthesized
  misc_feature (61): n=t or c
atttatttgccacactaggagtggatctgctttccagtagaggttagaaataacggtgctnaaaccactgaagcgtcagcatcaacacttccagatctctgtgaaatgtctccacagacaa

SEQ ID NO: 24406 - DNA, 121 bp, Artificial Sequence
  Synthesized
  misc_feature (61): n=a or g
aggtcctgctgtgatcccagaagtcactttacaatatcagcagacatgactcccatcacangtgcagtggtccctactggagtgatggacacagtttgtatctcctcaagcagaccgaaga

SEQ ID NO: 24407 - DNA, 121 bp, Artificial Sequence
  Synthesized
  misc_feature (61): n=a or g
agcttccttgtccttttcctggtggggcaggtgtctagactcaatggactcagcccatacntgactcataaaactgcttactcctgactttcttccaaattactcttatttcagagtgaaa

SEQ ID NO: 24408 - DNA, 121 bp, Artificial Sequence
  Synthesized
  misc_feature (61): n=t or c
cccctttttttttctgtgtgtgagtagagaaatggtctcatagtgcacccctgttccaatncctgaagctttgagagagacctacaaagtttacagcaagacctgtgatgagaccaagaga

SEQ ID NO: 24409 - DNA, 121 bp, Artificial Sequence
  Synthesized
  misc_feature (61): n=t or c
gatagaacaggggaaaacggaaaatcagacagtgaagctgtaggtgttttctgcatattcncaagactgtgcattgtttgttctaggaagggaatgaaattatttctattaatcactagct

SEQ ID NO: 24410 - DNA, 121 bp, Artificial Sequence
  Synthesized
  misc_feature (61): n=t or c
agagcaggatgggtgcccagaaatcatccagccgcacgttccctggagcccacagcttagngagttctcctcccatttctcttttgcaagcaagcactcctattccatcagcccatcagaa

SEQ ID NO: 24411 - DNA, 121 bp, Artificial Sequence
  Synthesized
  misc_feature (61): n=a or g
agatcctttaacacttttatgatattatttctgtgaaccatagtcaggcctgagaccaagntgatgcttcaggtacatatgtaatgtcctttccacccacattcacatttgtgctgagtct

SEQ ID NO: 24412 - DNA, 121 bp, Artificial Sequence
  Synthesized
  misc_feature (61): n=c or g
aagtcccctgctgctcagagcaaggtgactccagcctttggaggtgtgctggtcacacacntctgtccccttaaatccatcctttttcactctgcccttttgctgggagtcttcagcatga

SEQ ID NO: 24413 - DNA, 121 bp, Artificial Sequence
  Synthesized
  misc_feature (61): n=a or g
cggttttcttaaatgtcagcattgattggttattgctcatagtttgacaacaaaaaacccnttgtggacagcattcatattgaaagactaaagctggaatgatgtctattcttatctttac

SEQ ID NO: 24414 - DNA, 121 bp, Artificial Sequence
  Synthesized
  misc_feature (61): n=t or c
aatgagtcccaaatctctatgtgtgaggtttatcatgctgctgcaaccccagggtagatantgctgcctctacagaacaaggcatatactctcctttgcctctcaagcagatttttctatg

SEQ ID NO: 24415 - DNA, 121 bp, Artificial Sequence
  Synthesized
  misc_feature (61): n=a or t
ggaaagataacatggagagctcttcctgtcctcacgggtacctgaacatggtcagtgttangtattttatcaaacagcaggaccatgaacactgagcatttgtaagtcttggtaaagaaat

SEQ ID NO: 24416 - DNA, 121 bp, Artificial Sequence
  Synthesized
  misc_feature (61): n=t or c
gttggaactctccccctacccctgtaaccctccaggtgatttcagagctaaaagctgctcngtggtgatgcacaaaatgtctgacaccgacgagaggtgctgggttgtgcaatggcgagca

SEQ ID NO: 24417 - DNA, 121 bp, Artificial Sequence
  Synthesized
  misc_feature (61): n=a or t
ctctgaatattttctctatcatattcacttaaatctcagtgtaagataagaattcattacncttgtgctgagtgtgtgaaaccaggagttgataatggtaactcaatgtttgtaaaataaa

SEQ ID NO: 24418 - DNA, 121 bp, Artificial Sequence
  Synthesized
  misc_feature (61): n=t or c
tatggcacaggttgcctagagagttagcggggtctcctctttagagattttcagaatctgnctggatatagtcctgcacaacctactgtgggttggaccagatgatctccaaaggtccctt

SEQ ID NO: 24419 - DNA, 121 bp, Artificial Sequence
  Synthesized
  misc_feature (61): n=t or c
aatctgtacatttttccacctgtggcatctctaagccctcaaagaagggagcacttggatngggggtattataaatattccactatgctctgcttctgcttctatcaatgagtgttgtatt

SEQ ID NO: 24420 - DNA, 121 bp, Artificial Sequence
  Synthesized
  misc_feature (61): n=t or c
gtgtgctgatgctgacatacctgtttgcatagcatggagcaaaccaggtgagacaaatgantgaatgcatacaccaaaacaagaggattaattgaaatctgcatgtgctccttcacccaac

SEQ ID NO: 24421 - DNA, 121 bp, Artificial Sequence
  Synthesized
  misc_feature (61): n=a or g
ttcaccacaccctactgatggccccacagctctgccactttctatgcaatttttttcagcnctattccccctccttgctgtacagaactctttaatgtaattattccttcattttgatttt

SEQ ID NO: 24422 - DNA, 121 bp, Artificial Sequence
  Synthesized
  misc_feature (61): n=a or g
gtccctgtctccaattaatccagtggctcagggaattaaagcactgtagctcaagggatgncctcagttaaaagatggagttcaatctcaaaattaagacagaattaaggtgtggaaaatg

SEQ ID NO: 24423 - DNA, 121 bp, Artificial Sequence
  Synthesized
  misc_feature (61): n=t or c
tttttgaaggcgatggcattgaaacgtatgcgggcgatgatggaacattttcggagttganggctctctgatggaggccggtagtaacattaggagtattggaatgctccaaacgtagaac

SEQ ID NO: 24424 - DNA, 121 bp, Artificial Sequence
  Synthesized
  misc_feature (61): n=c or g
ctctaaagaagcagcacattggcaaattttgtactgtttatcatatttaccacataaccancactttaacgtacaacagaatctcctcctcctcatgcaggtggggaagtactgaagtgac

SEQ ID NO: 24425 - DNA, 121 bp, Artificial Sequence
  Synthesized
  misc_feature (61): n=t or c
ctgactgctttactcctctccagtccctgacaaaaacgacgcaggtaactttgatcatgtngatgccagaggaatcctcctcctcaaagtcttgctgaagctggtggagttggaagctctg

SEQ ID NO: 24426 - DNA, 121 bp, Artificial Sequence
  Synthesized
  misc_feature (61): n=t or c
ttttaagtgcattcaaggactgaaaaccaactaaactacagaggagcattaaatcagtaantgagcagtgcagggtgtatcttaatgatgtgatcatcagaaagcagcaaaagtgaggctg

SEQ ID NO: 24427 - DNA, 121 bp, Artificial Sequence
  Synthesized
  misc_feature (61): n=a or c
atttcctatatactcccgtaactggataggaacctagcaggtataacttagcctcactgtnatattcagtgagtcttttggacagcaccatgtagaattccagactcccataacacaatat

SEQ ID NO: 24428 - DNA, 121 bp, Artificial Sequence
  Synthesized
  misc_feature (61): n=a or g
ttaatgatttctgctagaaatcagatgaaggaaaagacctcctgtgagaatcagaagatancatttcttcatctctaaccaaataaacacaaagatgtttattctctagtcctcatttcat

SEQ ID NO: 24429 - DNA, 121 bp, Artificial Sequence
  Synthesized
  misc_feature (61): n=a or g
acatcagtctctctctttgagcagggcacctttgtgaaagcatcttcacgtgccctgcaancacctccaatgtctgcagcacgtacagcttgcattctttcagtgcatgtcaaaaagcatc

SEQ ID NO: 24430 - DNA, 121 bp, Artificial Sequence
  Synthesized
  misc_feature (61): n=t or c
tctcagatcacacccctccaatatgcccttttatctcctgaaactgtcccaatttacatantaatttactacctatgcagcgtaccattccataagatgcactgagcgagacctcatccta

SEQ ID NO: 24431 - DNA, 121 bp, Artificial Sequence
  Synthesized
  misc_feature (61): n=a or g
ttttctttcttctgccaagggagctccatgcccagtaactaaccttacctgttcctggacntcatttgtaagcttttggcttcctctgcagagaatactaattctggatagcagcctccgg

SEQ ID NO: 24432 - DNA, 121 bp, Artificial Sequence
  Synthesized
  misc_feature (61): n=t or c
aagaggctgggttgctttctttgccttaattctgtatgaaagagtcctgtggttctagganaagaaagtctttgcattgccagagttaatgagaaccaagaggtttatctctgctgtggga

SEQ ID NO: 24433 - DNA, 121 bp, Artificial Sequence
  Synthesized
  misc_feature (61): n=a or c
gggggggcacagcagctaatcaacagctgtagcacacccatggccctagcttaaaataagnattttgttagctctgcagccacaatgagaagtaggacacaggactgccttcgcactgctg

SEQ ID NO: 24434 - DNA, 121 bp, Artificial Sequence
  Synthesized
  misc_feature (61): n=t or c
actgatgaagcttaggaagtcctgataatctgtagtcccaagcttgatgatttgctctctntctgctgtgtgagcaatggctggtttaggctgatacttctttttctccttgtaggttgtg

SEQ ID NO: 24435 - DNA, 121 bp, Artificial Sequence
  Synthesized
  misc_feature (61): n=a or g
gtatctttctgccttgggcaaaagcctcccaaacagttaacaaagaagcgtgctgagtaangagaatttagttcttttctataaaacttcttccaattaccaaaaggcagagagagctcct

SEQ ID NO: 24436 - DNA, 121 bp, Artificial Sequence
  Synthesized
  misc_feature (61): n=a or t
taaaacaacttgttgccaattcacatctggtctaccatctattaattcatttaattatttntcctttccagtacatttttcaccttcagtatcacaaacaaagcagaaaattctagcataa

SEQ ID NO: 24437 - DNA, 121 bp, Artificial Sequence
  Synthesized
  misc_feature (61): n=t or c
cgtgccctaaatatgaacataggggaagtgagacccagctgcttccaaaccctcgtgctcngcagcacgccgcatactgatgcacagtcatgctcaagcagcagctctccagctgcagaac

SEQ ID NO: 24438 - DNA, 121 bp, Artificial Sequence
  Synthesized
  misc_feature (61): n=a or g
ggggtcctgtttcttaatggactaatcctacagacactttctgtcaagattatttattttntcagcaaaacttagagctatgaatgagtcctattcacttctttagtagttctggtttgct

SEQ ID NO: 24439 - DNA, 121 bp, Artificial Sequence
  Synthesized
  misc_feature (61): n=t or c
tgatcaatgaaaaaaattgtgaactttaaacatactgacacaagcctataaatagaagttnctggtactgacttcaacggaagtctaagaattttccccaatatctttctctgttgttcac

SEQ ID NO: 24440 - DNA, 121 bp, Artificial Sequence
  Synthesized
  misc_feature (61): n=t or c
ggctgcagctcgtgtcctgctgcagggatgtgagtgccttacaggggcaagtcctctgggnaggacacaggatcaggattttaaagtccttgcaggacacagtgctgaaggggctgaaatg

SEQ ID NO: 24441 - DNA, 121 bp, Artificial Sequence
  Synthesized
  misc_feature (61): n=t or c
aatgaggagtttactgctctcacctggtgctcaacgtgtaccctgtcagtcggcgcttaangcggagcctttggaataaagttgttcaaagaagtcttctgttatcttttgtctttttttg

SEQ ID NO: 24442 - DNA, 121 bp, Artificial Sequence
  Synthesized
  misc_feature (61): n=a or c
gtaggtgttggccatgaggacatgaatgaggggagaatcgtgtttgccaaagtggtgaacnacagacaaaccagccatggggaagtacaggatgaggactgccaggatatgggaccagcag

SEQ ID NO: 24443 - DNA, 121 bp, Artificial Sequence
  Synthesized
  misc_feature (61): n=t or c
acttgtcattcagtctaatcatagagtagacataagtcttattacattgtctagtgttgtnaaccattttactcatgtgcctaatttcttttttcaagccacttttttccaagaataagtt

SEQ ID NO: 24444 - DNA, 121 bp, Artificial Sequence
  Synthesized
  misc_feature (61): n=t or c
tgagaccttttatttttgttttactatcaaatctgctgaaaatatggagcaaaagccacantcttgcaaacttcatgtcaattaatccatctgggaacattgtctttagtagatctggatt

SEQ ID NO: 24445 - DNA, 121 bp, Artificial Sequence
  Synthesized
  misc_feature (61): n=t or c
atatttaaacagaaaaagtttgaatattcctgccctctaggcaaatctccatgtctacaangataatgttttcatttgcctagattataaccatactataagcaacctcctactctatatt

SEQ ID NO: 24446 - DNA, 121 bp, Artificial Sequence
  Synthesized
  misc_feature (61): n=t or c
gatgtatgtgcctgtgcagaatggttaacagagctcaacttggggaacaactctgtttgcnagcctctgtatggctttttgcactcagtctcatgtttttattatttttttctcatgttat

SEQ ID NO: 24447 - DNA, 121 bp, Artificial Sequence
  Synthesized
  misc_feature (61): n=t or c
tttgaaatatccaatgttaattatttgagaaatatttaacacgaaaaacctctcttgcatnctcatcattattttatgacaaagcattatttcttggatgggattttgcatgcaaagaaag

SEQ ID NO: 24448 - DNA, 121 bp, Artificial Sequence
  Synthesized
  misc_feature (61): n=c or g
gctctcactgtatgaatgttactcagtacctaaaacatgatagtggggaaaaatgctaaanaagtttttctggaaagctactcaactttaagaaaatgcagtgttatccaaagttaatcca

SEQ ID NO: 24449 - DNA, 121 bp, Artificial Sequence
  Synthesized
  misc_feature (61): n=t or c
cttgggttgtagtagcatcttccagtagaactgagtatgttcattgtttctgcagaacatngtacacgagctaagaataaccaaccaggtgatatacttgaatccaccaattgaagagtgc

SEQ ID NO: 24450 - DNA, 121 bp, Artificial Sequence
  Synthesized
  misc_feature (61): n=t or g
tgctgaaattcctctgccagaccttgatgtgtggctcctgctcctctgatatttgaagccnataacgaggaaaagctgatctcctggtgttcaaaaatgcaatgtttgaacaaggcttgtt

SEQ ID NO: 24451 - DNA, 121 bp, Artificial Sequence
  Synthesized
  misc_feature (61): n=a or t
caaatccaacaagacaggcctcaacacttcatgtataggcatctagatgaactaaataacngacttcttaggcaggtttgcatccaaaggagcctgggacttaaagcactacatgctgctg

SEQ ID NO: 24452 - DNA, 121 bp, Artificial Sequence
  Synthesized
  misc_feature (61): n=t or c
gggcacggctcaggagttatagcacaaagtgatcttcaccacgagggcccgttgtaggagngcagttctgcctctgcccattgcagcagagagtatttgaggtgcaagcaatggccccgtg

SEQ ID NO: 24453 - DNA, 121 bp, Artificial Sequence
  Synthesized
  misc_feature (61): n=t or g
gagcttctcgtgcacagtgtgtcactgctgcagggaaagcactaccagacaagaagagttncaacctgatgaattcctaacccagcagtgtttctcccaaggcacgatttcacagcacagg

SEQ ID NO: 24454 - DNA, 121 bp, Artificial Sequence
  Synthesized
  misc_feature (61): n=t or c
cgggtgctaaaaagaaatgcagtcagagcaggttctaaatcagcttggagtaaaacagttntgcctatcaggaaattccttgggcacctcatgcaaggtgtgtatccatacacagtgccac

SEQ ID NO: 24455 - DNA, 121 bp, Artificial Sequence
  Synthesized
  misc_feature (61): n=a or g
aatgaaactgtcattttctaccccattcattcacaagattacagggtttgtgcaagactcngtcctgcttctcttggaactggtgacaacatatctagtaacctaacttagcacaggctct

SEQ ID NO: 24456 - DNA, 121 bp, Artificial Sequence
  Synthesized
  misc_feature (61): n=t or c
gtggttattagatgattccgtgatgtgctgacatctaaccatcctttgtaagccgttgagngtgcattgcagaccatacccttttactgtgacgttattttttaattcttctaatgaattg

SEQ ID NO: 24457 - DNA, 121 bp, Artificial Sequence
  Synthesized
  misc_feature (61): n=t or g
ggaattaatccttttgtaaaacctaatttacaggcaatgactgtttaatttgaggtgcctntattttgtcatgaattcaaaaatgaacaaacaaaccaaaaccacaaaaattatattatgc

SEQ ID NO: 24458 - DNA, 121 bp, Artificial Sequence
  Synthesized
  misc_feature (61): n=t or g
acatagctggactcattcataacatggttgctttgcttatcacacaagccgtgcttccagntaaactttctacttgcctgctcagtgcttttcaagccaccatctgcaaaacctcagcaaa

SEQ ID NO: 24459 - DNA, 121 bp, Artificial Sequence
  Synthesized
  misc_feature (61): n=a or g
aggatagctgtaacagagatgattattcagttatcaacatcaacagcaggacttgaaaaancacacactggtacctgaagaatagtgtcttactagtggctttcatgacctggcaggaaaa

SEQ ID NO: 24460 - DNA, 121 bp, Artificial Sequence
  Synthesized
  misc_feature (61): n=t or c
tccaataccagatctttatatcagactggaagagaagacagggcaggaagataagaaaagnagacaccctgctccagcgtaggtccatccaaaaccatctgtattccaaaaccatctgaga

SEQ ID NO: 24461 - DNA, 121 bp, Artificial Sequence
  Synthesized
  misc_feature (61): n=t or g
ttatatacttctatagcatgtaccctgcttgcaaatggctgggacaacaggagatccaggnaacaaatggaatatttacaacacttttttgagacctgatcttccacaataaaatctttga

SEQ ID NO: 24462 - DNA, 121 bp, Artificial Sequence
  Synthesized
  misc_feature (61): n=a or g
ccaattccacacaaaatggagataacttctgatcttggttgtgccgataaccaacaaagcnatttccaaagagaacagaaggcaggaagcttgctatgagaaacatgtagaatccacagat

SEQ ID NO: 24463 - DNA, 121 bp, Artificial Sequence
  Synthesized
  misc_feature (61): n=t or g
tttccaccacaagacgtagtagtttctgagcgctgttctcactcattttaacacaggtgangaaggagcctccaaacttctccaacagaactgttccgctttcattcagcacccggtgcct

SEQ ID NO: 24464 - DNA, 121 bp, Artificial Sequence
  Synthesized
  misc_feature (61): n=t or c
ctcttctttggggttcccatttcctatggggagaagaatgtgatgatgttgagcccggagngtatttccatctgatccgtaatgcgatttccagcctggtgatcctacgctcctgcctgaa

SEQ ID NO: 24465 - DNA, 121 bp, Artificial Sequence
  Synthesized
  misc_feature (61): n=a or g
gatgaacctctggatttgtttgcgaagggggcagtgagttttctgctactgcaatttctcngtgtgaggtcaagaatgaataaaatacctcatttggagggaagaaaatgctctaagtgat

SEQ ID NO: 24466 - DNA, 121 bp, Artificial Sequence
  Synthesized
  misc_feature (61): n=a or g
actggtctgtcacgctaataaaaatcacttttctctgtgcacttatctccctctcctccantacacagttatgtaactgctttccacttgagatttcttgccagatccattgcacaaaaac

SEQ ID NO: 24467 - DNA, 121 bp, Artificial Sequence
  Synthesized
  misc_feature (61): n=a or c
cacaaacctgaaggcaagtgactgcagagcaactgtatctcgtacaaagcagcacatcccnaaaacagccaaatttgcttcatgtgaactgggaatgtgcacagcactgacagcataatgc

SEQ ID NO: 24468 - DNA, 121 bp, Artificial Sequence
  Synthesized
  misc_feature (61): n=a or g
tttttgaaagccattcagggggaagacagcagtgaggtaatgtcactcatgaatcacttcnaagacaagcggatcatcaggttggaaagaaaaatatggcacatatgagaccattaaaaga

SEQ ID NO: 24469 - DNA, 121 bp, Artificial Sequence
  Synthesized
  misc_feature (61): n=a or t
agcacaacaccagtgacaagcatgaataggcatccctccacagggattaactgctgtgtanctcttaagattgagaataataatatttgatttacatctgaaggttctgtagaaccttttg

SEQ ID NO: 24470 - DNA, 121 bp, Artificial Sequence
  Synthesized
  misc_feature (61): n=a or g
atcttgattactcttgacatggtctactgttttatgctgctttaattactccctggccccntatccagctggagcaggaattcagagctcattcagtttatcatgcatgtaatgcaactta

SEQ ID NO: 24471 - DNA, 121 bp, Artificial Sequence
  Synthesized
  misc_feature (61): n=t or c
cccagcagaaaaattattctgtgtcccccttcttggaacccttcaggtgtatagaaagttnataacaggcagatgagctgtaatctgatttgtttcccaaaggccccaacacacttctctg

SEQ ID NO: 24472 - DNA, 121 bp, Artificial Sequence
  Synthesized
  misc_feature (61): n=a or g
ctgcttttgaattgttgctgcatcgctcgcagagataatactctgctgccctcctacttanagaactcaaatgctctttattgtgaattcaaaaactaattgaaatccagattccttaact

SEQ ID NO: 24473 - DNA, 121 bp, Artificial Sequence
  Synthesized
  misc_feature (61): n=c or g
ttgtcacagaagggaagtttgtggccttcacttctgggttctcagaggacatggagagaancaagggagcagcaggagaataacacagttcaactgttttctgcctgatgggcttgattca

SEQ ID NO: 24474 - DNA, 121 bp, Artificial Sequence
  Synthesized
  misc_feature (61): n=a or g
tagctgggcttgggttggatcaaggggatccaacagcagaggggatgcggccatagcagcnctcggggattttactgctgttggcatcaggaggggtttgcagcccttctgagaaatgagg

SEQ ID NO: 24475 - DNA, 121 bp, Artificial Sequence
  Synthesized
  misc_feature (61): n=t or c
cccagtatgccttcctgacttgaagtggagtcaaataattgttttctacactttcccaatntaaaacattaaggaatggtggcaagtagaagaggcctgccaagtaaatgctgagaatttc

SEQ ID NO: 24476 - DNA, 121 bp, Artificial Sequence
  Synthesized
  misc_feature (61): n=a or c
tctgcctgctgctgtcagcgtgcagggggagctttacgggcccctttgatgttgagcagcncagaactgtgcagactttcattaaagccctgccctgtgggccatgggattatgaatatta

SEQ ID NO: 24477 - DNA, 121 bp, Artificial Sequence
  Synthesized
  misc_feature (61): n=a or t
aaatatgcataaaaggtattttgatggggaatacataagtggtgttaaaatgtgagaaagnatgcttgctttaaagaaagactggccctttacttgagaaaacatactttatcattaagat

SEQ ID NO: 24478 - DNA, 121 bp, Artificial Sequence
  Synthesized
  misc_feature (61): n=a or g
cacagttgtgatgttccaaaaatcagtctgtgggactggtatcctaatacaggaaatacangtacaatatcaagactccacacgtttcattttcaaaagatgtttgcatttttccttcctg

SEQ ID NO: 24479 - DNA, 121 bp, Artificial Sequence
  Synthesized
  misc_feature (61): n=t or g
gtatgtttttccaaataacagtctgtattttcaaggtaactgagactaatttgccttgccnaagcaaagatgtgaaacctctgtaaacttttggcttacatttgcacaagggagacttgaa

SEQ ID NO: 24480 - DNA, 121 bp, Artificial Sequence
  Synthesized
  misc_feature (61): n=t or c
tttctgttaaggctcacaccccaaatcagagcttacagtggaagaggaggaattcttgtcnggtgcagcatatcggaaaaaggttccaactttgtctacagacactgggctgacttcttcc

SEQ ID NO: 24481 - DNA, 121 bp, Artificial Sequence
  Synthesized
  misc_feature (61): n=c or g
gtcactcctgtttagggagttttctacaatttcagagaggaaagtcctggactaaagcagnttttctggtataggttaaaatcattaaggttggagagaccacaaagatcatctagttcaa

SEQ ID NO: 24482 - DNA, 121 bp, Artificial Sequence
  Synthesized
  misc_feature (61): n=t or c
tcagtacattctgcaagaccttacataggcagttctatgttttgatctttatctaagagtngtgtagggtcagcgtacattagaagttttctatcttacattctccaaattttaggattgt

SEQ ID NO: 24483 - DNA, 121 bp, Artificial Sequence
  Synthesized
  misc_feature (61): n=a or t
tttcaaaatccattcttcaggtatcagatttggtgctctgagttcccaccttgtcactgcntagctgtgtgcttttgctctttgatttagcttctatccaggcccttggatagatagattc

SEQ ID NO: 24484 - DNA, 121 bp, Artificial Sequence
  Synthesized
  misc_feature (61): n=a or g
aaaaatattacgtagtgggagaatggattaaatttgtcagatgggccaaatataacagctncatcaatttagtgaggggcacttccttaaatagaacctttctaactgtgcactgtcttca

SEQ ID NO: 24485 - DNA, 121 bp, Artificial Sequence
  Synthesized
  misc_feature (61): n=a or t
agaggtcatattgacatcgtattatgcagggtggacttagtgtagacagtgattcttccanaaagcttttctttaccacaagccttcttttatcagcttaaagggatcatgctgtcagagc

SEQ ID NO: 24486 - DNA, 121 bp, Artificial Sequence
  Synthesized
  misc_feature (61): n=a or g
acttttagtaggcttaaagtctataagaaagtgaatgctataatcagttgatgactctcangttacagagaggctttgagctttgaagatacttggagagactgacatgaacaaaaagaat

SEQ ID NO: 24487 - DNA, 121 bp, Artificial Sequence
  Synthesized
  misc_feature (61): n=t or c
ttatatgtttcctttgattttattttaggttttgactgaaaaaaaatacatggggaagacntgtggaatgtgtggaaattatgatggctatgaactaaatgactttgtgagtgaaggtaag

SEQ ID NO: 24488 - DNA, 121 bp, Artificial Sequence
  Synthesized
  misc_feature (61): n=t or c
gttttgtccttccaaagaagccaacagagcatggctgaaatcagtgaccgtggacatggtngaggtaaatgacccatacaggatacacctcaggctttcccttcaagcctgctcccctgga

SEQ ID NO: 24489 - DNA, 121 bp, Artificial Sequence
  Synthesized
  misc_feature (61): n=t or c
aagtcggtttctaaactgaaaacgtagacactattgtattagggccttgtaggatgatttncattgtttgaacactgatacataggctattgttttggtttgtttttttttttttttttgc

SEQ ID NO: 24490 - DNA, 121 bp, Artificial Sequence
  Synthesized
  misc_feature (61): n=a or g
aaagagaagaaggtataaaatacctagtgttttcattaaacagccacaggatccccatccnggtgtgatttccagtatgggattgaggtgcacctccagctatcccactagtttctaccac

SEQ ID NO: 24491 - DNA, 121 bp, Artificial Sequence
  Synthesized
  misc_feature (61): n=t or c
ttaggtttccgcaacgtgcaccacatgtagccccagttacatcagccttgtaaaacagtantgaaagttttccagttcggacatagtgggctctattacctccccattaaaaaaacattcc

SEQ ID NO: 24492 - DNA, 121 bp, Artificial Sequence
  Synthesized
  misc_feature (61): n=t or g
cccacatttctgctgtaggaaatcacttcaggcttgcacaagacatttgctggcagaaganccagacctgtgaggcaagagctgcctcacacagtcctgaacagttagcattacagcagtc

SEQ ID NO: 24493 - DNA, 121 bp, Artificial Sequence
  Synthesized
  misc_feature (61): n=t or c
tttacaaattatatgtactgccaaaaagcaatggcatattaatgaggtgtgattgtgaagngacaagataattctcttgggtaaaatagtgcttacagaagtccaacagagagacgtgatc

SEQ ID NO: 24494 - DNA, 121 bp, Artificial Sequence
  Synthesized
  misc_feature (61): n=t or c
caacaacaaaaaaagccaaacagaaaacacagcagcatgcatgaaagcgtagtttgcctanaggtttgatttacagctattctggtctttcaaagaattgattatttacataatatcagtg

SEQ ID NO: 24495 - DNA, 121 bp, Artificial Sequence
  Synthesized
  misc_feature (61): n=a or c
acatatcatttatcagtatcttgattatcctgcattcataaggaatgtcaatcacaaaatngtagtctgtcatgctgtagttcaaaactctttccaacagacagtttcaaaccaactgctt

SEQ ID NO: 24496 - DNA, 121 bp, Artificial Sequence
  Synthesized
  misc_feature (61): n=t or c
aagaagcaggcgttagacataagcccaaagtatgctctgcacctgaagaggaccatgcagngctacatctgtgcactaaggccccatgtcaagcagcaaggcatggcatgggcacaagaag

SEQ ID NO: 24497 - DNA, 121 bp, Artificial Sequence
  Synthesized
  misc_feature (61): n=t or c
gcagacgtgggaatggcagcccctcagtggctgtgcccatggtgtcaatgctgtgtgtggnaaagcttaaaacgtatacggataagtcagcagagtcaaaaggttcccagtcacatctgtg

SEQ ID NO: 24498 - DNA, 121 bp, Artificial Sequence
  Synthesized
  misc_feature (61): n=a or g
ctgtagcagcccaagcatccactggaccacactgccccacgtttccttggcatgggttatngtgtcaaacaaaaagcaaacgcaagctctttgtgagctgttccacagatgccgttgacct

SEQ ID NO: 24499 - DNA, 121 bp, Artificial Sequence
  Synthesized
  misc_feature (61): n=t or c
gttctgtgtctgatgccagtgtaacagccacatcttccatgcctttacacagctcctaggngaaagaaccggaggtggctgatggacagagggatcctcacatccaccagctgtgccactg

SEQ ID NO: 24500 - DNA, 121 bp, Artificial Sequence
  Synthesized
  misc_feature (61): n=c or g
gctgtgtcctcttgcagacacactcactcctgtgtggagcagtgtgcatgcaggatagctncaaattgcttcagcgcagattttccaaagagatgacattcattatggctgagattgaggg

SEQ ID NO: 24501 - DNA, 121 bp, Artificial Sequence
  Synthesized
  misc_feature (61): n=a or g
ctgaaatggtaacggatggcagaacttacttagtagtcattagatttgacactgaaatggnaaatacaggcaccttgggtgtcacggcatcgtttcactgtgtgaggttagaatttgggta

SEQ ID NO: 24502 - DNA, 121 bp, Artificial Sequence
  Synthesized
  misc_feature (61): n=t or c
actcaggatttgacacgtaatactacgtggtgccttagtagtaatactaatataattacantgagttttagctgttgtggagagacatcacagtttcttaagctttatttttcaattaaat

SEQ ID NO: 24503 - DNA, 121 bp, Artificial Sequence
  Synthesized
  misc_feature (61): n=a or g
aaataaatacatcaatctcctccccccctttcttatttgttaccgccagagtgagagagcnagagagagcgagggaagcaggaataaggttcactttagagcccaaacttccagcggggaa

SEQ ID NO: 24504 - DNA, 121 bp, Artificial Sequence
  Synthesized
  misc_feature (61): n=a or g
agctcacgtgtaactctcattaatgctaatggcatttaatacatgctgcaataagaaaatnccctcatttattttgcactgaattgagtggtagcaaaagtgctgatctgacaacttttgt

SEQ ID NO: 24505 - DNA, 121 bp, Artificial Sequence
  Synthesized
  misc_feature (61): n=a or g
accattccattttagctgggtgtagcctgcactgccatttcttcaagtcaatcaccctccntgaagtgttttgattggagttacaggtgctgcaactttacaatattatctcagcacagta

SEQ ID NO: 24506 - DNA, 121 bp, Artificial Sequence
  Synthesized
  misc_feature (61): n=a or g
gatcagtggaactgagcaaagaagagatttttaaaaactgagcacagaattgaaaagtacnaggaaaaaattgtttgagttgaatggaaacaaatgagtagggagagcttgtcctcaaatg

SEQ ID NO: 24507 - DNA, 121 bp, Artificial Sequence
  Synthesized
  misc_feature (61): n=t or c
gggatgagttttgttttcacttttctgctggagtgtaaggtgcctaattgaattcttcttnccctaaatttactaggaagaccttggttaaccttggaatcagtgagagattgggccagaa

SEQ ID NO: 24508 - DNA, 121 bp, Artificial Sequence
  Synthesized
  misc_feature (61): n=c or g
cgccgacagctcggcgcgatcaccctccggacccaacagcgtcgcacggcccagccgcacncacacaatgtccggaggcactgctctccctgcggacgcaacttttcaacccacgacgctc

SEQ ID NO: 24509 - DNA, 121 bp, Artificial Sequence
  Synthesized
  misc_feature (61): n=a or g
tgaaactgatgacaactcaccaatggaaaatacatacatttcagaagagtaactaaacaantagatgagcaaaaaagaacattcagtaagtttcttgtttttctataccactcactacctt

SEQ ID NO: 24510 - DNA, 121 bp, Artificial Sequence
  Synthesized
  misc_feature (61): n=a or t
gtcttatgaataacacccaattattattgaattacaggtctactttccactatttaatacnaagatgcaaatctgttcctcattttttccactcttgcctaccgcatcttacatatggaga

SEQ ID NO: 24511 - DNA, 121 bp, Artificial Sequence
  Synthesized
  misc_feature (61): n=t or c
gtgtgcactccgcctcagcccccaggttggcataaattggcaaaaaggggttttcaggttngctaattagggttgaggagcttcaccatcacagcgctgatgctcagtttccaaaaggctc

SEQ ID NO: 24512 - DNA, 121 bp, Artificial Sequence
  Synthesized
  misc_feature (61): n=a or c
ttaggcagttattttaaatggtctgagagaactaagtgactggattgtatgcacactgtcncattatttagatgaatgcaattttaacttcttaagttatataaaaaactggactatatct

SEQ ID NO: 24513 - DNA, 121 bp, Artificial Sequence
  Synthesized
  misc_feature (61): n=t or c
ccttcaattgatggtacctggattactaatcattagtgatcccacctggaaatttctattnccctatgagacaacttatacaaaggtaggaattaagaaggaagaatagtgcagagggatc

SEQ ID NO: 24514 - DNA, 121 bp, Artificial Sequence
  Synthesized
  misc_feature (61): n=a or g
tgacaagaaatgttagtgtccaatctgaatagtactcagccatattctatgcttcttggtnttaaagggctaggaaataagcccataattaaagtttcagaaaggccattggctttcttat

SEQ ID NO: 24515 - DNA, 121 bp, Artificial Sequence
  Synthesized
  misc_feature (61): n=a or c
tgcaggttaaaaaaaaaacaaacaaacaagaaaaaacacagaatgaacaaaaaacaagccncatctcaggtgcttctttattacttctttttgttagttcagttgctgcacactgcactta

SEQ ID NO: 24516 - DNA, 121 bp, Artificial Sequence
  Synthesized
  misc_feature (61): n=t or c
gcctaaccagacattcaaattttggctgagatttcatgttcccctcaatatgtttcacacnaaaacagcccactttcaaaagcaacactggacagttgaaatccaggttttccagtggttg

SEQ ID NO: 24517 - DNA, 121 bp, Artificial Sequence
  Synthesized
  misc_feature (61): n=t or g
caatacttattaaggtaactggtcttcagtgaaaacatttggaaacaagctgatctaagcntgctcatgcccaaaggatgaagaaagaaactgcttttcaaattcaacctagcatccactg

SEQ ID NO: 24518 - DNA, 121 bp, Artificial Sequence
  Synthesized
  misc_feature (61): n=a or g
aatattactatgttaatggcaaaagacaaacttagtatccccactgttcttctctatcccntgctattatagttatatttgctctttccttagctttctcctatctatatgactgaggaaa

SEQ ID NO: 24519 - DNA, 121 bp, Artificial Sequence
  Synthesized
  misc_feature (61): n=t or c
gtgtaaagttatgagggaactgaagactaaggtcagggcatatctatctgatgaatgaaangtagcattcatagactgtaaaaggggaggtagatacaagaacatcagcaatattaacaat

SEQ ID NO: 24520 - DNA, 121 bp, Artificial Sequence
  Synthesized
  misc_feature (61): n=c or g
ccacaatatttctttgagaaaaagagaacagataacaatgtggggaagcagaagtcacaancaactgctacaagtcccagtgctgtgcagcatggaaaggagaaggaggtgcagggctgaa

SEQ ID NO: 24521 - DNA, 121 bp, Artificial Sequence
  Synthesized
  misc_feature (61): n=t or c
caataatgctgtgaccagtcatgttgtgtctcctttcactgtttttaatcccaatttcaanttatttctgcttattatctgtcactagagtgatgcttcaatggaagctgctgtacttagc

SEQ ID NO: 24522 - DNA, 121 bp, Artificial Sequence
  Synthesized
  misc_feature (61): n=t or c
aactctgggctctgataatgatatgtcaaggcatgcaagcttctgagcaacttccctttcnaatctgctttaaagatgtaaaaaaggtgaccaaaatgtggttttattgtctcatagaata

SEQ ID NO: 24523 - DNA, 121 bp, Artificial Sequence
  Synthesized
  misc_feature (61): n=a or t
cttttccaacatggttctctttcagttcactttaatctgtggacaatctatatgtaataanagaaattcccactgtgctcccagaggagagtatattagcttatactcatgccccatcctt

SEQ ID NO: 24524 - DNA, 121 bp, Artificial Sequence
  Synthesized
  misc_feature (61): n=t or c
tcatcaaaagcttccataggaagtgatataacatcctagtaggcttatagaattagtggcnatagaagtagtagtgactgtgtgaccaggtgggatgtgtggctgaaagatacggagggta

SEQ ID NO: 24525 - DNA, 121 bp, Artificial Sequence
  Synthesized
  misc_feature (61): n=t or c
aggtctttttgcatcctcatccattctgatttctgcatgcacgtctgctggtcccgtggcngtgtgtgtgatgcagtctcatctcagagccaacttctctccaatagcagctcctcccctc

SEQ ID NO: 24526 - DNA, 121 bp, Artificial Sequence
  Synthesized
  misc_feature (61): n=a or g
gagtttgacatgttgtgatccactacaactaaccagacttgggttctctcctgctgagatncgacatccatggcagcaccactgactgctggtttcaatctttttgatttgctggcttgta

SEQ ID NO: 24527 - DNA, 121 bp, Artificial Sequence
  Synthesized
  misc_feature (61): n=t or c
accctttatcatttcatcaaggcaagttactcctttttaagccaaaactgaaagctgaaangtacatatttcatctgtccatgtcagtttgtacttaaagccactaaccacaaagtaacaa

SEQ ID NO: 24528 - DNA, 121 bp, Artificial Sequence
  Synthesized
  misc_feature (61): n=a or t
cacatgtcatcaaacatcaagtgtacagatcctggcacaacgtcaaatcatgtgcacagancagcaataactgagtgctggtgcacggtcactgctatgggcttgaaggctcatctaggac

SEQ ID NO: 24529 - DNA, 121 bp, Artificial Sequence
  Synthesized
  misc_feature (61): n=t or c
tattttcagaaatcttatgggctttatgaaatttttctcctttggaatacctggtttttanaatatgtgccacaggctgttttctcctctggcaatgagatacattcaaaggggagggaag

SEQ ID NO: 24530 - DNA, 121 bp, Artificial Sequence
  Synthesized
  misc_feature (61): n=t or g
atgtgcctatcttcattttttacaaagtcccttcacaccctgacacaccttcagctcccanaaacaaaccgtgctcttctccttagaccctcattcccccacatcacagcaaaatcagtat

SEQ ID NO: 24531 - DNA, 121 bp, Artificial Sequence
  Synthesized
  misc_feature (61): n=a or g
agcaaccccagcaggttcagagcccagctgctggatggtacttctacctttacgtcttccnaccaaaaagcatatgggtaagggacaagttcatcccactgttagagaaggctgcagctgt

SEQ ID NO: 24532 - DNA, 121 bp, Artificial Sequence
  Synthesized
  misc_feature (61): n=t or c
aaggtcagaatatctgactttctcttccataaccatctgatgcgttcaggactaatgatangataactcagagatgcctttgagaggcatatgtaagattctcccagagcaatcacaggca

SEQ ID NO: 24533 - DNA, 121 bp, Artificial Sequence
  Synthesized
  misc_feature (61): n=t or c
aaatacagataaaaataaaagcttggaaagacgcttttactgagaaatcattacactacanaagatgatagatcccattattgcaagacctctctgaattgagtgaaatgaacatgtattt

SEQ ID NO: 24534 - DNA, 121 bp, Artificial Sequence
  Synthesized
  misc_feature (61): n=a or g
taaacagtacagtgatggcatgaagaaaatgctagctttataaggctaccaccagaagagnagaaaatgcgctcataaccatgcacaccgtacagagatctttttcaagcacaaataagac

SEQ ID NO: 24535 - DNA, 121 bp, Artificial Sequence
  Synthesized
  misc_feature (61): n=a or g
aacaatccaggttaatggtggcacagatcaaccacaactgtttcagcaagagatgcagttnggtgactggtatttctgcatattgctgacagcaagttaatttgatttaatgttagtcttg

SEQ ID NO: 24536 - DNA, 121 bp, Artificial Sequence
  Synthesized
  misc_feature (61): n=t or c
gccacagcgtctctctgctgtgacctattttatgctcgatgcaagggcaaaagtatgcagngtgtaacttcgccgggtctcttacgtcgagtcgttgcctgtcggtaggaaagcccctcgc

SEQ ID NO: 24537 - DNA, 121 bp, Artificial Sequence
  Synthesized
  misc_feature (61): n=a or g
tgtgctggagtgaggcaggagtaatgcccctgaagtcagccgatgaacggtaatgtaaaancagtatacgtccctcatgcgtctgtaaagtgacaattgctaccttccatctccacgtggg

SEQ ID NO: 24538 - DNA, 121 bp, Artificial Sequence
  Synthesized
  misc_feature (61): n=t or c
gtcaattgtacagacgctagaacttaaagtgcagaattgtaagacagataaagaagccagngtttccaatgataaattgtgagcttaaaacagaaggggaagggggtcttggaaacaccga

SEQ ID NO: 24539 - DNA, 121 bp, Artificial Sequence
  Synthesized
  misc_feature (61): n=a or g
tcatctatatctcacctgctccattaaaataaaacaccaacagaattatcttatacctacnatgggtttggaccggatgactaaaacaactgtcctgttcatttaaagaagagactgactg

SEQ ID NO: 24540 - DNA, 121 bp, Artificial Sequence
  Synthesized
  misc_feature (61): n=a or c
ttctgtgcaggaaggtttatacgggatccagaagcatgaggtgggcaagaatatgaaagcntggaaatagggtgacatgctggctgaaagcagtgaaagaacaggtttggcagagccggtt

SEQ ID NO: 24541 - DNA, 121 bp, Artificial Sequence
  Synthesized
  misc_feature (61): n=t or c
tgagaaggaaggggattgatcatcagactcaaagctcgtagcaatgggctataggacgaanatgcactattatgtgatatgcctcatcatttcagggggtgtgatggaatcacatatttgt

SEQ ID NO: 24542 - DNA, 121 bp, Artificial Sequence
  Synthesized
  misc_feature (61): n=c or g
ccccgagtcagacgagcagcctctgggaaagctaggacatacagaacaggtagttcaatcncaggttgatatttttactactgtgatatcattcctatattatataagtaaaatgtaaaat

SEQ ID NO: 24543 - DNA, 121 bp, Artificial Sequence
  Synthesized
  misc_feature (61): n=t or c
cccccacgccctccacaagtacataaatcctttggtggtctcaatattaccgtatgtggcngatgagtattatatattgtggtcagattcttcttgacaaaattcatttagatttaataag

SEQ ID NO: 24544 - DNA, 121 bp, Artificial Sequence
  Synthesized
  misc_feature (61): n=t or g
aagggctatgagctcttatccatcaggctgtaaaacgactcctaattcaaatgggagggangctgttccctcaaagagctgattacataacagataagtgctctgcagctctaaaatcttc

SEQ ID NO: 24545 - DNA, 121 bp, Artificial Sequence
  Synthesized
  misc_feature (61): n=t or c
aggcaaagccacctcagacagaagtcctcctttcagtgctctccactcagctcttgactcntgtatcaagttttcagatacctgctataccgtttgggcagaggaagagtgactcatgaat

SEQ ID NO: 24546 - DNA, 121 bp, Artificial Sequence
  Synthesized
  misc_feature (61): n=a or g
aatggagtccttatctgtctgcactgctaacgtgagtggaagctctgaagatgagcgcccncacagtattttattcaactgagatcagggaaaacatgacttcttctactaattgttggta

SEQ ID NO: 24547 - DNA, 121 bp, Artificial Sequence
  Synthesized
  misc_feature (61): n=a or c
tgaactgtctgctatggttctcaattcttctccaccctctctgcattacagctttgcatgnaatccagatgctgaactattatgggtgtttattcacatatcagtagaagagaaattgaat

SEQ ID NO: 24548 - DNA, 121 bp, Artificial Sequence
  Synthesized
  misc_feature (61): n=a or g
gaaaagaattaacttttccagggcattcccattcaggtgtaagtataaaagagatccggcnctcagtgccaagatatcttccaccacagttacaaagaaaccaggctcttaatgagcaccg

SEQ ID NO: 24549 - DNA, 121 bp, Artificial Sequence
  Synthesized
  misc_feature (61): n=a or g
tgtctagaagtaaactttcattgcagatcccttctgaaactgtcattcttggatcttgacngtagtaactacaataatttaagatgttaatgacatcaaccatcttatcaagtggttaaga

SEQ ID NO: 24550 - DNA, 121 bp, Artificial Sequence
  Synthesized
  misc_feature (61): n=t or g
aggctgtggaacagtctacttgcttttgacagaaatggtttgccagctggctgtgtgaaanggctcttaatatagctggagtctcattctaaaatgtgctacttcagccctgacgtgttgg

SEQ ID NO: 24551 - DNA, 121 bp, Artificial Sequence
  Synthesized
  misc_feature (61): n=a or g
ggcatcacagggaaaccagaaacaacctgaaatctatctgcataattactggcaaagcatnattaccggtaccaaagactggtcgttcctttgtcagtacttctgtcatctcatgaactgc

SEQ ID NO: 24552 - DNA, 121 bp, Artificial Sequence
  Synthesized
  misc_feature (61): n=t or c
atttagagatataacaaataattttatatataaatatacatatatgagatatagctgacanagagatgtcaatactcacgtatcctgtaagcactgtaaggctcaatatatcacatggcca

SEQ ID NO: 24553 - DNA, 121 bp, Artificial Sequence
  Synthesized
  misc_feature (61): n=a or g
ccagtgcttctggcattctggtgtatttttcctcactgttggtaaatgagtttaaaagtanaccccttccttcttgactcaggtcaaacatccaacgtgtttttaattgttgttttttaag

SEQ ID NO: 24554 - DNA, 121 bp, Artificial Sequence
  Synthesized
  misc_feature (61): n=a or g
gcatacgttataaattaaaggaagccatctactcagcaattttgtattgacataattcacnaaagggtgaaatgctagaggaccacttgcagcgatgtgccttgtcagagcagcaccgtca

SEQ ID NO: 24555 - DNA, 121 bp, Artificial Sequence
  Synthesized
  misc_feature (61): n=t or c
gcacaagaccttgtactgggatttgctgaacctcgtgaggtgcacctgggcccagttaacncacagttagtgattatttgccaagcattgatgggctcggtggacattcccttgccatctt

SEQ ID NO: 24556 - DNA, 121 bp, Artificial Sequence
  Synthesized
  misc_feature (61): n=a or c
aaagcagttgatgggtgtactgctgcacaagctgctggcaaaagtcaagtgaaacccttgnggagatgtaaagattaccctttgtatggaggattgatagtattgataccaaggatgggtg

SEQ ID NO: 24557 - DNA, 121 bp, Artificial Sequence
  Synthesized
  misc_feature (61): n=t or c
taagtacttaataagacacttacatggttcaaaaactgttggttgacttatcaagtgtctngctgcattgttaagttgtcattagcagtttcttgcactggctcaaatgtcctcttagttc

SEQ ID NO: 24558 - DNA, 121 bp, Artificial Sequence
  Synthesized
  misc_feature (61): n=a or g
tctttgttgtttcatatcatttcatatgtgcaagtagttactattcacaatactcatgtcngggagctgtgtaataccatgctgacgtgactgcttgaaaatccagtatccctatttgttc

SEQ ID NO: 24559 - DNA, 121 bp, Artificial Sequence
  Synthesized
  misc_feature (61): n=t or c
ttgatacagcaactgcctataaaaaaggacacccaacatgaaaagtgattctctttggaanggtatctgtaatttatgagaacgtttcataatcttgtaactaacaaagcagggaatacga

SEQ ID NO: 24560 - DNA, 121 bp, Artificial Sequence
  Synthesized
  misc_feature (61): n=a or t
tgctgcagtgagagtgttccaggacagaggaaggactgcattttaggccgtccacaatacnatcctcatcagcaaaaaatcacacgtacacatctgacactggatattcacttaatgacgg

SEQ ID NO: 24561 - DNA, 121 bp, Artificial Sequence
  Synthesized
  misc_feature (61): n=t or g
aacatctctcctgaattatttaaatgaaagagccaggcctcacatctggagttgctgtgtnggtatgtaggctgtggcctgctccccctggactcaagtgtgacaaggtttttaagggatt

SEQ ID NO: 24562 - DNA, 121 bp, Artificial Sequence
  Synthesized
  misc_feature (61): n=a or c
gtttttgtttcaggtgcctccacgtactgttttcagtaatagtgttattacatttaagttntttcctcatatttcatgaaaactaccagccaaaagatcaaaagctttcagtgcaaaacag

SEQ ID NO: 24563 - DNA, 121 bp, Artificial Sequence
  Synthesized
  misc_feature (61): n=a or t
tttaattgtatacgtgcaattacaaaatgaaatttagaagacttatgatcatcatgtgacntaaattctggcattgacttcaaaataggtactgggaagcaagaatctctttccaaacgag

SEQ ID NO: 24564 - DNA, 121 bp, Artificial Sequence
  Synthesized
  misc_feature (61): n=t or g
aggctgtgagccaagcctgccagtggctccccaacagaaatggagtgggaatgcgtgctcnatgccaccagaagtcaaactgaatgtcagtaatgacttcttctgtcctcagcatctatgg

SEQ ID NO: 24565 - DNA, 121 bp, Artificial Sequence
  Synthesized
  misc_feature (61): n=a or g
tttggcacaacctccaactgctttagtttagtgggaatttgcctggcgtgctctgttttgnggagctgtatccatgttatcaacatcttttttaccatccccagggtcttacatgcaggat

SEQ ID NO: 24566 - DNA, 121 bp, Artificial Sequence
  Synthesized
  misc_feature (61): n=t or c
aagaatatttttctggagaaatggtatctcagcttccaattcatgaactattggtgatatntggtagatcacattagcggcctttctgctatttgaagatttctgtattcattccttgcca

SEQ ID NO: 24567 - DNA, 121 bp, Artificial Sequence
  Synthesized
  misc_feature (61): n=a or g
tgttgaaattttacaaatagtgcttgtaaggatgccctcctgacttcaagctctatatacntaaagacattcatcctctaaatctgcacaagtgttacactttcagaaaatggttgttgta

SEQ ID NO: 24568 - DNA, 121 bp, Artificial Sequence
  Synthesized
  misc_feature (61): n=a or g
gaacatagagtatttaggaaaacgaggaacgaaactgacttgaaatgagggctgctaagcnttacaactgtagcagttagagtattctggaggatatcagagtaactagcattttgtccct

SEQ ID NO: 24569 - DNA, 121 bp, Artificial Sequence
  Synthesized
  misc_feature (61): n=a or g
tctgtggctaaaacaggctggtcccattcaggggctacggctctgttctgcatttgatttntgaggtgttcataaacaattttaatggaagaacttggtcatattcttctacctctcaact

SEQ ID NO: 24570 - DNA, 121 bp, Artificial Sequence
  Synthesized
  misc_feature (61): n=a or c
cgccagctatttcaagtgtcctctctcttccttcgcttattccaaacaaacaacattcctnaggatcaacaacataaaaattaaaaccaaaggagcaacattttctttcaccaatcccccc

SEQ ID NO: 24571 - DNA, 121 bp, Artificial Sequence
  Synthesized
  misc_feature (61): n=a or g
gctgtttatttcatgacttctaaaaactgtagtgagcctgtatgcttccttttctgcctcntcgagccacaagttatagcaacttggaaatgacatctgcacatacaaagggagggtattt

SEQ ID NO: 24572 - DNA, 121 bp, Artificial Sequence
  Synthesized
  misc_feature (61): n=a or t
gcacagcacaacatcatacagactgctaggaagaaaggtaaatccattccagctagaactngcacacatatttatcctatgctgatcacttttctaaataacttccataaaaccttttttc

SEQ ID NO: 24573 - DNA, 121 bp, Artificial Sequence
  Synthesized
  misc_feature (61): n=t or c
ctgcagcaccctgctcacacttccagctctccaacgtctctcccttttttcttctgggccntgtttaataaagtatgtatttgcagtgctgtcccgacccttttgtttccctcatttaagt

SEQ ID NO: 24574 - DNA, 121 bp, Artificial Sequence
  Synthesized
  misc_feature (61): n=a or g
attttgaacatttcttgtgctaagaaagctccccattattatttcttttctttactaaccnaaaagtttgtggactacaatgggggtaaatagagggagaaggaaaagaaggaattgtcat

SEQ ID NO: 24575 - DNA, 121 bp, Artificial Sequence
  Synthesized
  misc_feature (61): n=a or t
agaagacttctcttttgtcctccaaagacttccaagaggcaatttaatcttctgcattagnaagtagtgggacatctgttactttttggctagtatgtaaaatcagggcaggagaaagcaa

SEQ ID NO: 24576 - DNA, 121 bp, Artificial Sequence
  Synthesized
  misc_feature (61): n=t or c
gcttgcagaaatggtgccaaaccccttacaaccaaagcatgcttcttcacccatttcagcnatcatttctgttctgtttgtgccacttaagcagaaatattcaagtatggcactcgcttta

SEQ ID NO: 24577 - DNA, 121 bp, Artificial Sequence
  Synthesized
  misc_feature (61): n=c or g
aatcacaattctcagaagatgcaaataaagtaaaaaggagcttttgctgtggaaacatcgncatctcccgttagcacaacagcttgagcaagttgtgggagttccacaaaatgaacaggag

SEQ ID NO: 24578 - DNA, 121 bp, Artificial Sequence
  Synthesized
  misc_feature (61): n=a or g
tacctctggcattttgtactgaagttctaaatataaatgcagcctaggaggagtgtgtctntggaactgccctgaccgcttgctttcccaataaccgcacttcctaacgacgtgattttct

SEQ ID NO: 24579 - DNA, 121 bp, Artificial Sequence
  Synthesized
  misc_feature (61): n=a or g
agaacacaaaacaacaacaaaaaaagcatccacagatgaaccaaacagtaagtctgacctngacacaaaacagtcaggtgtagggctcaaggcctctgctggtaagaggtaaactagtaaa

SEQ ID NO: 24580 - DNA, 121 bp, Artificial Sequence
  Synthesized
  misc_feature (61): n=t or c
tagagaaatgccaaaatgtcaaatcccaatggaagccaacagctgtacagcaattaaacangaacactaatatcagagaacaacggaaaagctttggttggatgggaacgctgccagtcag

SEQ ID NO: 24581 - DNA, 121 bp, Artificial Sequence
  Synthesized
  misc_feature (61): n=c or g
tctccctagattttcttcctagtccttctgtgcttgatggagaactttgtgccagacctantcaaccctaataaacttctggaaatagtaattaaggattttgatggtggtgtggcagtgt

SEQ ID NO: 24582 - DNA, 121 bp, Artificial Sequence
  Synthesized
  misc_feature (61): n=t or c
gataagtgaacccctgtacagaaactgaaatgatttttatgctagttagacttatctgatnaccttaaaagacagtcagaatctacagaacgttaactgttttatatgattaaatcttata

SEQ ID NO: 24583 - DNA, 121 bp, Artificial Sequence
  Synthesized
  misc_feature (61): n=t or c
ttgcagggatctgctaaactgctcctctttgctgtgatacctgagaaagagctcacatgtngcaggaaccccatcctctcattcactgctggcacaagagggtagctcttaacctggtgct

SEQ ID NO: 24584 - DNA, 121 bp, Artificial Sequence
  Synthesized
  misc_feature (61): n=a or c
attctattatatgattctatgtatgcgaactaagagaagagctcactgacagctgccatgnagagaagtatttggaggttctggtggatgaaaaactgtacgtgagccagcagtgagacct

SEQ ID NO: 24585 - DNA, 121 bp, Artificial Sequence
  Synthesized
  misc_feature (61): n=a or c
aactgcctgacatgactacaaagattcttggtacgtgcttcctggaagagtgctctacagncatgatgagggctctaccccatgctccagtctcactctgcactcatttgagattctccaa

SEQ ID NO: 24586 - DNA, 121 bp, Artificial Sequence
  Synthesized
  misc_feature (61): n=a or g
atgaggtctgcatgtttatcccggggatgttcaaatgaggtctttttagttgaagcacaanaatgctgttcagaccttgtctgtattccagctttgacatagtcaaaatacttaagccagg

SEQ ID NO: 24587 - DNA, 121 bp, Artificial Sequence
  Synthesized
  misc_feature (61): n=t or c
gccactggctggacaaagtcccacgttctggttcattattacatccagccacaaggcagantggatccagttccaactgcctgaagcagttggttgtgttcagttctggggtcacaaatca

SEQ ID NO: 24588 - DNA, 121 bp, Artificial Sequence
  Synthesized
  misc_feature (61): n=t or g
cacgcaatcttttgttgaagttccatttatggaattctcatgccctactaacaaggagtanggaaatccaaacccctgctctgaatttttatgattgaattggtaatggtttatgtaatat

SEQ ID NO: 24589 - DNA, 121 bp, Artificial Sequence
  Synthesized
  misc_feature (61): n=a or g
cagcatacttaagtcagatgtctacattgcataattgttcagagaacttgtggtgtttcantgcataggttgtgctcacatagtggaataagtcactgacagaatgtaacagcgtttacat

SEQ ID NO: 24590 - DNA, 121 bp, Artificial Sequence
  Synthesized
  misc_feature (61): n=a or g
atatttttacttccctcaaaagcagtgctcatggtatctaatgtctgtatatcacttctgntgagaaattatggaaatactgctcaatgtactaattttctatggcttttttttctaatta

SEQ ID NO: 24591 - DNA, 121 bp, Artificial Sequence
  Synthesized
  misc_feature (61): n=a or g
gaatgccttacaggctttcctgtcagaaaaatactgctgtttatggcagtgcttcacaccngatccttgcttggagacacgaatctcattgcacccagcactgtgctacatcctaccagaa

SEQ ID NO: 24592 - DNA, 121 bp, Artificial Sequence
  Synthesized
  misc_feature (61): n=t or c
atgttgcaaatgcatttagaaacgggcaccactagaagctgtgcagcttgctgtgctattncatttggggaactcacaaatcctgagcctggccttcagtgcattccctgactgctcttag

SEQ ID NO: 24593 - DNA, 121 bp, Artificial Sequence
  Synthesized
  misc_feature (61): n=a or g
ggtatttcaggagaaaaaagaagtatgaaagtagggactctctaaggtatgtcaacagatngagtatagaactgcatatcccaggaaccaggaaactctgtggataccacatcagagccca

SEQ ID NO: 24594 - DNA, 121 bp, Artificial Sequence
  Synthesized
  misc_feature (61): n=a or g
ttcatccttttaaaatgtgtaatcagctctcagataatgaccatgaaaagcacaggttttntatcaaaaaacctttagtgaggttttgaacctgaataaaaattaaggatgtgcagttttc

SEQ ID NO: 24595 - DNA, 121 bp, Artificial Sequence
  Synthesized
  misc_feature (61): n=a or g
gaaattgatctaatttcttcctaatgttttcagagtgggatctggagcatacgaacaggtngtgataaaacgctaggctagaacgacttggccggaagaggaaggcacagaactctcgcag

SEQ ID NO: 24596 - DNA, 121 bp, Artificial Sequence
  Synthesized
  misc_feature (61): n=a or g
ctttgtaagtcgtctacacaaaaatctctcctgtcggaaggaatcattttccgaacgaganagctctgcgatcgatctcaccgccagcactccgcgccgcagcgacacggcgcgctcctac

SEQ ID NO: 24597 - DNA, 121 bp, Artificial Sequence
  Synthesized
  misc_feature (61): n=a or g
gtgaacagacagcaagcagactgtgacttgcttctaggcttttactgaccaaagtcttctntaatgcactaatcagcattacagaataaaagactattagcctgttgttacagcaagatca

SEQ ID NO: 24598 - DNA, 121 bp, Artificial Sequence
  Synthesized
  misc_feature (61): n=t or c
cactgcgactcacctgcaggtcagccccacgatgaacaccacgatggcaccgacatccaanttgttccagaagtccttgaaatacagggaagccatcttcagggctccgagcccatctgga

SEQ ID NO: 24599 - DNA, 121 bp, Artificial Sequence
  Synthesized
  misc_feature (61): n=t or c
ctgaaggcatatttacagagctgccagctttgggcgggtgctgttggctaaaagctccttncctcccctggatccaacccatttatctgcctggccaccccctcccacgcggggagcacgg

SEQ ID NO: 24600 - DNA, 121 bp, Artificial Sequence
  Synthesized
  misc_feature (61): n=a or g
tctgccgggtttttcaggagaaggacctggctgtggattttgctgaagagaatcaagaatnttgttggtgcttatgcaagaacatgaatttatttcccttcattcgaaactgacagtctta

SEQ ID NO: 24601 - DNA, 121 bp, Artificial Sequence
  Synthesized
  misc_feature (61): n=a or g
ccattcattacgtatctagtatctcagatattcagagggccatgtaagagaaaacaagagntatcctattccaatgggcttgcaagtccatcagaactaacacaggaactgagagccaact

SEQ ID NO: 24602 - DNA, 121 bp, Artificial Sequence
  Synthesized
  misc_feature (61): n=t or g
cctccagccccaacactcagcagtactaaatgttcagaaatgtgcacttacagagctaacntagggaagataactcaaacaaaacccccacgaccatggcaaatatttaaaaaaggaacaa

SEQ ID NO: 24603 - DNA, 121 bp, Artificial Sequence
  Synthesized
  misc_feature (61): n=t or c
gggcaccttccctctctgctgtttattgtatccttcccctcctcaggtattccagttctgngactgtcagtgccttttatggtgggaggaaaactcttgcgtgagaaccagagactgtaag

SEQ ID NO: 24604 - DNA, 121 bp, Artificial Sequence
  Synthesized
  misc_feature (61): n=a or g
gactgcccatttcttagcaaagttttcaaggagtgtgagcacagaatgaaaaggtgctccntgtcccacagagagagcacaggtttagaataagacaaggaagctactggtcagtggaagt

SEQ ID NO: 24605 - DNA, 121 bp, Artificial Sequence
  Synthesized
  misc_feature (61): n=a or t
gagaactgcaaatgtttcttcaaaataatgatggccgagggtctgctgcagtcatacgacngtgagctcagactttaagcaaaacaccaactgctgggagattagcagcggagtcacaaga

SEQ ID NO: 24606 - DNA, 121 bp, Artificial Sequence
  Synthesized
  misc_feature (61): n=t or c
ttcttcagcctttctgtagccatccaggaggactctgaactttcttctgtgcagatcagcnttaggggaagttcatcctccccagggccaaatgcctggaaccttgcttgtggggaggaag

SEQ ID NO: 24607 - DNA, 121 bp, Artificial Sequence
  Synthesized
  misc_feature (61): n=t or c
gacagaagccacgtggtcactttgctggtaagcaataactcaaaaagtaacctacacatcngtaagccacagaccgattgcctttgtctgaacagagctgacatgctttagagcagagcag

SEQ ID NO: 24608 - DNA, 121 bp, Artificial Sequence
  Synthesized
  misc_feature (61): n=c or g
aggtagcaacacagctatttgggaatagaactcatttcatgtttcaaggccaaaacatctncagttcacttgcaaatgattaaccagcagatcatgtcactgaatgcttacatagtgtaaa

SEQ ID NO: 24609 - DNA, 121 bp, Artificial Sequence
  Synthesized
  misc_feature (61): n=a or t
acagttccgcttccagcagctgctgaattttgtggctgacatttctgttcagagctgttgntttcctgcacgttttggaaggctgatctctttgtgagaagcctcattgcgctgcatgggc

SEQ ID NO: 24610 - DNA, 121 bp, Artificial Sequence
  Synthesized
  misc_feature (61): n=t or g
gtatcttggccccatactttcagaaatctgcttcttgcacccctgaatctatgtcagtagnggtgctgtgcctatgtggcacagctactttacgtgatttaagttgtaactaataggccat

SEQ ID NO: 24611 - DNA, 121 bp, Artificial Sequence
  Synthesized
  misc_feature (61): n=c or g
atttcagactctttttttttttttttttaatgaaactgccagtatcaaactggaattcatntggaaagagaaagtaaaggctaatcagactacagtgctagtatcccatcttacagccaaa

SEQ ID NO: 24612 - DNA, 121 bp, Artificial Sequence
  Synthesized
  misc_feature (61): n=t or c
gcttaattacactagaaagtaataaatcattttctatttgcaaacttctgtatctttgtantcaactcacatagagactttatagttttccctcaccgttctcatgaagagcaacaaaatg

SEQ ID NO: 24613 - DNA, 121 bp, Artificial Sequence
  Synthesized
  misc_feature (61): n=t or c
atttttaaaggaattacacaaaaattcagcatctccctgacttttatcccttggccagttntcaactgaattaaaacaccagcaatgaggcttcagaagtctagtggagggaaggtaaagc

SEQ ID NO: 24614 - DNA, 121 bp, Artificial Sequence
  Synthesized
  misc_feature (61): n=a or t
tatgtggcttaagatggcctgattagatgtgagaatattctacattgtagatgtaccctcngttgataatcatacacagtgaaactcatgtccttgaagctggacttcggaaacaagggga

SEQ ID NO: 24615 - DNA, 121 bp, Artificial Sequence
  Synthesized
  misc_feature (61): n=t or c
aagcctgctgtgtttccaggcataagaggaacagaaacagaagcaatactctaagtcattncactaatccagggcagctttatcttttccagaaggtatctgaaacaccatacgaacaccg

SEQ ID NO: 24616 - DNA, 121 bp, Artificial Sequence
  Synthesized
  misc_feature (61): n=t or c
aaggaatagaactgctgtttaattcagtagcacaggaacagctcatcttggcacaccttgnttgtgcctcgtgctcctgggtgacctgggtaacccaccaaggctgctgtctgcctcagcc

SEQ ID NO: 24617 - DNA, 121 bp, Artificial Sequence
  Synthesized
  misc_feature (61): n=a or g
acacactggcatgagaagagcctgcagagtgcagaaagatgggcttccactgcttggtagntgaacgatgcccctcagcgagggcattatccaaataatctgatatttgatggttctgtaa

SEQ ID NO: 24618 - DNA, 121 bp, Artificial Sequence
  Synthesized
  misc_feature (61): n=a or g
atgctacaggataaaataatctttatgagtaaagaacatgctggtgagcatgtaaatgccntgtctttgtgctccatgcttagggcacggctcactaagtcaatcaacctgccctccttcc

SEQ ID NO: 24619 - DNA, 121 bp, Artificial Sequence
  Synthesized
  misc_feature (61): n=t or g
agtacaactgtgaggctgtattgtcagtggaagttcctgcagagggtgagctcagacaacnttcagacaggacagtagtctgggagcagagtgtataaccacgcggctgacaaccaaacca

SEQ ID NO: 24620 - DNA, 121 bp, Artificial Sequence
  Synthesized
  misc_feature (61): n=t or c
tagttgatgtcagtggagctacttattacagactataaaaaatcacgactccaaccgaacntgcgtctctagagctaataactgtagtgtatcagtctagagacagttcatgatctaagat

SEQ ID NO: 24621 - DNA, 121 bp, Artificial Sequence
  Synthesized
  misc_feature (61): n=a or g
aagatttcaaataccgtaccatgacttttcctctgacctattgcattaaccctacctacantctggcaaaatttcctggaccatgcagatgcacatggatatcattcaagctgttatactc

SEQ ID NO: 24622 - DNA, 121 bp, Artificial Sequence
  Synthesized
  misc_feature (61): n=t or c
attggaggctgtaacagttttacctctcagacaacttccaacactgccaggctaccactgnggtagctgttatctgtatgattttgcctctttctttttcttcttccttttccctatcatt

SEQ ID NO: 24623 - DNA, 121 bp, Artificial Sequence
  Synthesized
  misc_feature (61): n=t or c
ccacaggctctgaccacgtgcttcagacacagcaattcttcagagcacagagagaaactcnggagtgtgacaagatcacaaagcagtactgagttggacagtcctctgcacagcacgggga

SEQ ID NO: 24624 - DNA, 121 bp, Artificial Sequence
  Synthesized
  misc_feature (61): n=a or g
gtgtgctctgctcgttccccaaacccgagttagttccggcagcttccagtgctcagcgtcnatcatcatgcagctgagctgctgtattccatgcggggaaagcttttttttttctttgctg

SEQ ID NO: 24625 - DNA, 121 bp, Artificial Sequence
  Synthesized
  misc_feature (61): n=a or g
gcagtgttgtctgatgattcaactgtaacacatacataattatgaagggttctcttaaggncttctaagcagcaaaatgctgatcaagacatctaaacccctttcttcattacattttaat

SEQ ID NO: 24626 - DNA, 121 bp, Artificial Sequence
  Synthesized
  misc_feature (61): n=c or g
ttgtgagaaaagaaagtgctccatctggctggctgaaagatttgaattgcttcttcaaagntcactttaatctttcctcacaaattaatttaattaaatctattattataaggttggtatt

SEQ ID NO: 24627 - DNA, 121 bp, Artificial Sequence
  Synthesized
  misc_feature (61): n=c or g
ctgtttctttttatggctgagctgatatatcagacctgggatatgagatatatgatatttncattacaaccataatgtctccttgggacctatatggtgtcactgtgtattaccagatttc

SEQ ID NO: 24628 - DNA, 121 bp, Artificial Sequence
  Synthesized
  misc_feature (61): n=t or c
tgtttgggtaacacagctcacagccccatgctgaaggtgacatctacaactgagtcacatncacatcttccagaaggcacagcttttttccagaacctgctgcatcacctccttcatacca

SEQ ID NO: 24629 - DNA, 121 bp, Artificial Sequence
  Synthesized
  misc_feature (61): n=a or t
tttacctttgtgtttctgatgcttcccagtcgggctcccagcagaacaaagtgtagctgangccatttatcccctcccctctgcttggacacagccgaggccttctcctgtccttacagga

SEQ ID NO: 24630 - DNA, 121 bp, Artificial Sequence
  Synthesized
  misc_feature (61): n=a or g
tgacagagcagtatgcttcttatatcttgtgttctgctccttcatgatctcttcccttganttctggttggtttgcatggaagacatgttctcttcacaccccatcctccacgtctacctg

SEQ ID NO: 24631 - DNA, 121 bp, Artificial Sequence
  Synthesized
  misc_feature (61): n=a or g
aatgtatctagaaaaggtaggtagtgaagatggaactccattgactaatttgaatctgctnatgaatcatacaggagtttaggaggaaaaaacatactcagcaatttttgagtgggactta

SEQ ID NO: 24632 - DNA, 121 bp, Artificial Sequence
  Synthesized
  misc_feature (61): n=a or g
ggaacaggaatggaacaccaaatcctgcttctttggttaaagagctattattcctagtccntacactgatatgacataactgtgtaagtactacagataactagtcaatctaccatactgt

SEQ ID NO: 24633 - DNA, 121 bp, Artificial Sequence
  Synthesized
  misc_feature (61): n=t or c
atcaacgccatttagtcttatttagacattcctttttttcctgactagtttctaaatacanatctcacgggagatttccaaaattcactttttcatcctgatttgtaacaaaaagagctga

SEQ ID NO: 24634 - DNA, 121 bp, Artificial Sequence
  Synthesized
  misc_feature (61): n=t or c
agctattatagatctgaaggaagcctgcagagcaaaaggaactgagaatatttgctaaccnattcattggctgttgctcactagtgttctcaaccaagaggcaatgacactctgctcgggt

SEQ ID NO: 24635 - DNA, 121 bp, Artificial Sequence
  Synthesized
  misc_feature (61): n=t or c
tagcaacgtgtgcagcgtccttccttattggttgtgttcttaaaatatgttggtaagaagnatatccagatttccatgtgttcttactgctgaggtatggaagcacttcaccctaagaatg

SEQ ID NO: 24636 - DNA, 121 bp, Artificial Sequence
  Synthesized
  misc_feature (61): n=a or g
tgctattttccaacctgccctgacatgctaaggccactgcgctgttgggtccttgccctgncttagaactcctttcctgctgctgtgtgtggggcgagaggtgggacagtgctttgtgctg

SEQ ID NO: 24637 - DNA, 121 bp, Artificial Sequence
  Synthesized
  misc_feature (61): n=t or g
gctcctaatttaaaatggagtaactctgtactttcccttagaatgtagcactttacacagnggcattctgctttcctgggtgaccaattttaaatgggctttagggagcaggacatgtttt

SEQ ID NO: 24638 - DNA, 121 bp, Artificial Sequence
  Synthesized
  misc_feature (61): n=a or g
gagggtagggaactcttcctggtacatggaatagttgttgcccatataacatgaccgtgtngcaaccgcgtaaagttcccctgtgaggaaaagtcccaggacgccttacgggggcacaggg

SEQ ID NO: 24639 - DNA, 121 bp, Artificial Sequence
  Synthesized
  misc_feature (61): n=a or g
caattcaaaatgagattttgagaacccactagcacatttgagaaagtaaagatttacaacntacttcagttctcaggtaatacaaccctcagtgttgcaggtaccaaaagagtattcattc

SEQ ID NO: 24640 - DNA, 121 bp, Artificial Sequence
  Synthesized
  misc_feature (61): n=a or g
tactttgatttctctgaaaagccatctccttttccagggcagttagtaagttcacatcacngaaagacttacagcatttgcaccacgggttaaaatacctttccaccaagaaagcactaac

SEQ ID NO: 24641 - DNA, 121 bp, Artificial Sequence
  Synthesized
  misc_feature (61): n=t or c
tgcagtcctcagcagctttttcaccactttgctgcactgctgtcccttctgctcatcccanacaggagttgcaggaagactctgtccataggaattttctcacagtgcctgagcagagctt

SEQ ID NO: 24642 - DNA, 121 bp, Artificial Sequence
  Synthesized
  misc_feature (61): n=a or g
aatttatcaataaatctgcttgcagctcctggtaacaacgcatactttgcctagcacaganctcggcctagcacgatagctacagagccctctctggccacaattcctggcaagcatctta

SEQ ID NO: 24643 - DNA, 121 bp, Artificial Sequence
  Synthesized
  misc_feature (61): n=c or g
taaaagaaactcatatcccacactgactttgagaaagcactttgacctatcaaggttttgnttccacttgcagacagtccaagtcgcccttggagaggtcttgcagttaatgcccaggagg

SEQ ID NO: 24644 - DNA, 121 bp, Artificial Sequence
  Synthesized
  misc_feature (61): n=a or g
tactgaaaatgatcagattttagcccagtgagcaatacagagaattaattgcaacaggtgntgtaagtgtactgggtgacgttcttgaaaaaagggaaaagcttttctacaggatttgtac

SEQ ID NO: 24645 - DNA, 121 bp, Artificial Sequence
  Synthesized
  misc_feature (61): n=t or c
aagtgttatgggatgcagtgtgttttaaatatctgtataacagcttgagtttgtacagccnacactcattagattgtgatcttttgaatgagaaagctttaaggaaagtgtatactgactt

SEQ ID NO: 24646 - DNA, 121 bp, Artificial Sequence
  Synthesized
  misc_feature (61): n=t or c
ccttgtaggagggcttttattctgcagccatcagtgattttgcagcaaccagagctcagcncttgtgtacttagaacatactgctgtgtacctccatatctctcattattaacagatacta

SEQ ID NO: 24647 - DNA, 121 bp, Artificial Sequence
  Synthesized
  misc_feature (61): n=t or c
aacagtggctgatgtgggcagcatgggaaggttaactggttagaggctggatcttaggcangctctttagacagctcacgttgtagcaggttttttagtcaagagcaaggcttccaggtta

SEQ ID NO: 24648 - DNA, 121 bp, Artificial Sequence
  Synthesized
  misc_feature (61): n=a or t
agagtgattctccaaaaaggaacacagcaagaaaatatttgagctaagcatggtatgcaancagtttctttttgaccccttttagacaatatccccattgaatccagtgagaagtagtact

SEQ ID NO: 24649 - DNA, 121 bp, Artificial Sequence
  Synthesized
  misc_feature (61): n=a or g
atctctaaccacagtctctttattgtgcagcatctgagatgagatattcttttctctctcnctatgagaaacccctttcatgagaagaagttcaaggatgatatctgactcatgtagacag

SEQ ID NO: 24650 - DNA, 121 bp, Artificial Sequence
  Synthesized
  misc_feature (61): n=a or g
gtacttgtacacctttgggctcttgagatacactgtcatcctgactgggctagtttctatntggtattcatcacagactgtcatgaaaattgaagcatgtattcgtgtaatttggagttac

SEQ ID NO: 24651 - DNA, 121 bp, Artificial Sequence
  Synthesized
  misc_feature (61): n=t or c
gggaattgaaagagaccttaggggctccatccagagtgacaccagtctatgaatgtctgantgataatgctggattagaacagctatgagcagatgggctgtgagctcttcttccattgca

SEQ ID NO: 24652 - DNA, 121 bp, Artificial Sequence
  Synthesized
  misc_feature (61): n=a or g
attggctttgaatcaaccaaaatagtacttttgtggcaaattttaaaatcacatagctctnttcaagacaagtcacttttcctgcttgtattatctttaacaccatgtccaaaaatttcac

SEQ ID NO: 24653 - DNA, 121 bp, Artificial Sequence
  Synthesized
  misc_feature (61): n=t or c
tacatgcctggagcatgccttaactggaccatgctgaccatgctatggactgcagtaccanacgacagaagggaccatcttggcagttctttgttgactcatcttcctccttagtttaaca

SEQ ID NO: 24654 - DNA, 121 bp, Artificial Sequence
  Synthesized
  misc_feature (61): n=a or g
ttgtttaatttgttttttaaatttgttttaaaaggactaaccagccgggaatgttcacaangaaagaatttgatcagttggcctcagcagtagacagcttcagtctcatgacatatgacta

SEQ ID NO: 24655 - DNA, 121 bp, Artificial Sequence
  Synthesized
  misc_feature (61): n=a or g
ccattcaacctgtggggattagacttgtacctccttgcaggagagtgtcagcagactgtancgtagctattcaggcagctaccttgaaaaagtaattttggattctggtcactttgctgtg

SEQ ID NO: 24656 - DNA, 121 bp, Artificial Sequence
  Synthesized
  misc_feature (61): n=a or t
tgcagtaccttgagaaattaccttggtgattgatcttcttttgtaaatctcccacctgtgntataagtgcaggagtgggttttgtatgccacttctttgtatcttctccatgctcacatag

SEQ ID NO: 24657 - DNA, 121 bp, Artificial Sequence
  Synthesized
  misc_feature (61): n=a or g
cttaaacagagaaaataactattgttgaaaagcagagaaaatctctttgagaaagatctgntgggataggggataaattaaacatatagaggaattgcgtcaaaattcaggaactttcttc

SEQ ID NO: 24658 - DNA, 121 bp, Artificial Sequence
  Synthesized
  misc_feature (61): n=a or g
gtcgaagcagagagcagcacgcggaccttgatatagtttaatggcaaatcacatttgtcanaagtgcagataagggagcctcactccaagcaattcctgtaacaaaaaatggagaaaaact

SEQ ID NO: 24659 - DNA, 121 bp, Artificial Sequence
  Synthesized
  misc_feature (61): n=t or c
gtactggttagcattgcccccaggcagcactgctctccctccaatgactaacagagatctnggaggaccatatgaaaaaagacacctaacttttagccagcagacagcaagcaagaggaat

SEQ ID NO: 24660 - DNA, 121 bp, Artificial Sequence
  Synthesized
  misc_feature (61): n=a or c
ttatcagtgctgttattatgagaaatctgattttgtctgctctgagcgtgacaggcttttnttatgtggcactccgagaaaagtgtcttctgagccacagcatcagtgcttgaagagtgac

SEQ ID NO: 24661 - DNA, 121 bp, Artificial Sequence
  Synthesized
  misc_feature (61): n=a or g
ggaggggtggaggaaaatgtgactgagaataacaaaattcagagcagatccttcatggtcngtatggacccacttccagttttggtcttcttttgagccctgaggttggagcagttgacct

SEQ ID NO: 24662 - DNA, 121 bp, Artificial Sequence
  Synthesized
  misc_feature (61): n=a or g
ttagctacatgtagatgtgttaattctatttcacatcttttaatcatctccagagaccctncaaaccacctgtggaactttcaattagcaaattacaatatccatagtgaaaggcctaaaa

SEQ ID NO: 24663 - DNA, 121 bp, Artificial Sequence
  Synthesized
  misc_feature (61): n=t or c
gggaatccagttgctatgcaattaacaacaaaaaaaaaggttaactgcctgatatttctgntcctgagacagcaggcttaaatcttgtgggagaacgcctatccctacgccctccttcccg

SEQ ID NO: 24664 - DNA, 121 bp, Artificial Sequence
  Synthesized
  misc_feature (61): n=a or g
ctattaaaaatatgccagagaaaaaatcattaaaagaaaaattacaatgatgaaaagaaantagaatttcttttgctgaaaacccatcctatttttgcaaagtattagatgactttaagta

SEQ ID NO: 24665 - DNA, 121 bp, Artificial Sequence
  Synthesized
  misc_feature (61): n=t or c
ctgagtgaccacctactctgtcactatgatcttgccataactttctcctgctttcagagcntgcaaaaacaggaagccaaacaactgtttgaccgtcatgaaggccagagacctgaaaaca

SEQ ID NO: 24666 - DNA, 121 bp, Artificial Sequence
  Synthesized
  misc_feature (61): n=a or g
gatacaggatgtcaccagtaccatccagctgggaaaagcaaagcagaagacctgggctggntgacccatgtttcttctttctcgacagcattttgttctgctcttgtgtaaatttgcttac

SEQ ID NO: 24667 - DNA, 121 bp, Artificial Sequence
  Synthesized
  misc_feature (61): n=c or g
gagacagctgtagaaagtgctatgttttagctagctgcaaatagaaaaacaaggacttcantctttagcagaagtatgctcatggctcttaggaactggtgaggtgtgtgagcgtgtccga

SEQ ID NO: 24668 - DNA, 121 bp, Artificial Sequence
  Synthesized
  misc_feature (61): n=a or g
ccaacactgaagtgctcgggatatcgcgtgccataggagtcagaacaccagccaagatttncctatagttcctccatttgcgcttgtttcaaactgctcccaggggaggtgcctcactgct

SEQ ID NO: 24669 - DNA, 121 bp, Artificial Sequence
  Synthesized
  misc_feature (61): n=t or g
tggagctcctttggacctggtgctctctggtgctgggggctgatacctactagaacaaaantggaatagaaggatgctgaaatacagtagaggaggagagagtgccttccgtagcactgta

SEQ ID NO: 24670 - DNA, 121 bp, Artificial Sequence
  Synthesized
  misc_feature (61): n=t or c
gctagaaagacaccgctgactccacaagtatcagtcagtagtttcttcccctctgccatgnttgaaagagagcaaagagataagatggaaaaggaaggtcctaaaaacaggagagtgctag

SEQ ID NO: 24671 - DNA, 121 bp, Artificial Sequence
  Synthesized
  misc_feature (61): n=a or g
gagttttcagattactgaagaataaatcaagaaaaatgactccctcaaggagtgccaaaantagggaaaggagaaattatttaactcttccttatacctggaatgggaatttgcacattgt

SEQ ID NO: 24672 - DNA, 121 bp, Artificial Sequence
  Synthesized
  misc_feature (61): n=t or c
tcctcttctgcagaggattaattaactcagctatgtgtaataatatccagtatggatacangaatgtagattgtgtgctagttttgaggctttttttagttaccaaaactagagatttgtc

SEQ ID NO: 24673 - DNA, 121 bp, Artificial Sequence
  Synthesized
  misc_feature (61): n=t or c
ctctaaagacttcatggaaggaagtagataaacaagggaaggattgtaaattctgtttcangcttagggaatgaaaggacagaggttaaatgcctgccccagtttgaaaagctggacatag

SEQ ID NO: 24674 - DNA, 121 bp, Artificial Sequence
  Synthesized
  misc_feature (61): n=t or c
tttgtgctggaagggacctttaacagtcttttgtctttacattcaggacaaggtgtcatangctattgagatagaaggaaaagaatacacaatccacctggaaaagaacaagtgagtgatg

SEQ ID NO: 24675 - DNA, 121 bp, Artificial Sequence
  Synthesized
  misc_feature (61): n=t or c
gtcctaaaatcttgtaggtgggagaggggaggagaggtggtgagtgttcacgttgctctcnataagcagggaaggaagaaaggactgttatttctggttttaaaaacatgattattattat

SEQ ID NO: 24676 - DNA, 121 bp, Artificial Sequence
  Synthesized
  misc_feature (61): n=a or t
cacccacaaatcatcccagctcagcccctgaacatgccaccatttaccgtcttagaagatntctgagcttagacatcttggcttctgtcactcagcattgtgttctgtgcaaagtatacag

SEQ ID NO: 24677 - DNA, 121 bp, Artificial Sequence
  Synthesized
  misc_feature (61): n=a or g
taatgacaggacccccacactactgctgcttatgtagcttactgtaagggaaaggaggggngccaggaagctgaaggctttcctttaaacctgttatgataactacgcagatttcatgatg

SEQ ID NO: 24678 - DNA, 121 bp, Artificial Sequence
  Synthesized
  misc_feature (61): n=a or g
aaggaaaacttttatccaggagagggcaaataatttgatcccaaaccaccaaattatctcncatggataaggcaggaatgcttcatgacacgcccagttatgtatatattaacttaaaggt

SEQ ID NO: 24679 - DNA, 121 bp, Artificial Sequence
  Synthesized
  misc_feature (61): n=c or g
agatcagttcaatctagcaggacatccaggcgaactcaagacaagcagatactttgctctncagtaagacaaaaagaacccaggcagttttcactaatgtggcttctgtgattgtaaaaat

SEQ ID NO: 24680 - DNA, 121 bp, Artificial Sequence
  Synthesized
  misc_feature (61): n=c or g
tcggtagtagaaataaattggtagatctttggactgaagttctgctacatgctctttaacnctcaaaatattttacagtgggatattagccttttcattcactaacttcatagaatcatag

SEQ ID NO: 24681 - DNA, 121 bp, Artificial Sequence
  Synthesized
  misc_feature (61): n=a or g
ttgcagatataaattttgctttacctagcaagtggtctttatcttaatccacatgttctcncacttctacctttccgattctctcctccatcacacttagggagactgaatgagcagctgt

SEQ ID NO: 24682 - DNA, 121 bp, Artificial Sequence
  Synthesized
  misc_feature (61): n=t or c
ccacaatcacaaggagccctcgagcaaagggcagcgagcagtgggttcctcggcctgcaangaggcaaaggctggagcagcacaagggaaaaaccttcagatgttccgatccggccgtgcg

SEQ ID NO: 24683 - DNA, 121 bp, Artificial Sequence
  Synthesized
  misc_feature (61): n=t or c
aacagactaaaacccaaaagccttcagccaagctctagtcagggacaaggataacccatgnctatcgtgtcacacgtggttagagtcctgacccgcacccagccactgttccacctgtggg

SEQ ID NO: 24684 - DNA, 121 bp, Artificial Sequence
  Synthesized
  misc_feature (61): n=a or g
cactggccaagcaaaatattgtttttaaaatgtaatttatgtttggcactgaacacatagngagaattcagagcaatttgcactacagaccagccagtaaccccatgcaaaaagcactttg

SEQ ID NO: 24685 - DNA, 121 bp, Artificial Sequence
  Synthesized
  misc_feature (61): n=c or g
actgggggaaaattgaggctgggtgtgttttggtgcgggttggcagttgatttaagcagtnagcagagatggtctgaagtggattccagcacaaagcagcagctcaggggttgtgtgccat

SEQ ID NO: 24686 - DNA, 121 bp, Artificial Sequence
  Synthesized
  misc_feature (61): n=a or g
tctcttccaatggtcatagtgattacagtcatgggtctaagctgcaggattaccctataanctccagtgttggtgcaatcagcagctaagctacaagcaacacagtacttatgctatggta

SEQ ID NO: 24687 - DNA, 121 bp, Artificial Sequence
  Synthesized
  misc_feature (61): n=t or g
cagcaacaaaaatgaaaccagtactctcatccaagtgctttaccagctttatgggaatatnttatggatgcttatctataggcctgaaggaaagttcccctccattctgcttgaaagtaac

SEQ ID NO: 24688 - DNA, 121 bp, Artificial Sequence
  Synthesized
  misc_feature (61): n=a or g
gtgcagcaaatgtgtcggtaactgcttggtcattgtgttcaggggaaggcctcacaggganggtcccttgggagatactgtatgccctctgttcccagcccggctcaccaaggcaggtgga

SEQ ID NO: 24689 - DNA, 121 bp, Artificial Sequence
  Synthesized
  misc_feature (61): n=a or g
caaacagtctgcttggaacagaaggtttgggcatgggggagagatttgttctttcccttgnaaggcagagaatggggtaattctgggaggcaggacacgctggaaaacgtaggatggtatt

SEQ ID NO: 24690 - DNA, 121 bp, Artificial Sequence
  Synthesized
  misc_feature (61): n=t or c
gttcaacactgatcgggtgctgtagaccctgtaactgcaaaaattagggttgcatgctgcngtgaaacatggcatggaaagggtgggtggtattcagaggctggtgggcagcatgctgtct

SEQ ID NO: 24691 - DNA, 121 bp, Artificial Sequence
  Synthesized
  misc_feature (61): n=a or g
aattgcacacaaaaaggactacagatgttagaacacgtatgcgaagacatatagcatcagntggataatgtggaccttaatgttgtaaaagagaagtaagcaggtcatttctacaatttct

SEQ ID NO: 24692 - DNA, 121 bp, Artificial Sequence
  Synthesized
  misc_feature (61): n=t or c
ggtagagccacagagcggccatgttcacagtactgctgagaactggaagcacctccatggnttgccctaccagaaaatacctaaagcggtaagtccctgaaaagatgagggcatgggcccg

SEQ ID NO: 24693 - DNA, 121 bp, Artificial Sequence
  Synthesized
  misc_feature (61): n=a or g
aaggaaggatctgccagccagccagatcactggggatcccatgctgctgttctatgaatgngatggatgcagatgctgagatactggcattaatgcaggaagctggagaagtccatctgga

SEQ ID NO: 24694 - DNA, 121 bp, Artificial Sequence
  Synthesized
  misc_feature (61): n=a or g
tcatataacaacgctggttataccttcctcaaactcttcacaagaaaatggtaactcctcnagttagctgacaatgatgaggatttcatgtatcattccatgcgtcacagaatgtcaggga

SEQ ID NO: 24695 - DNA, 121 bp, Artificial Sequence
  Synthesized
  misc_feature (61): n=t or c
atcatttcatttgagaactatttaggcataatcttgaaacacagtctacagttttaaatgngaaaagaaaagcttttagtcattttttccacttatgttgtttgcttatttcattattaca

SEQ ID NO: 24696 - DNA, 121 bp, Artificial Sequence
  Synthesized
  misc_feature (61): n=a or g
tgtgggagttcaattttacaacacaaagtccttacagtgttccttgggactacttagtgcncctcattatgttgctgttgtagcaatgctcagtacatatttataaaggtgtaataataca

SEQ ID NO: 24697 - DNA, 121 bp, Artificial Sequence
  Synthesized
  misc_feature (61): n=a or g
acacccagctttaggatttgcagaaatgtttatcaccgaggtattgtcataaaatctgccntaatggattgtcaacacgtattattttgaagtgcagtgtgtgttcaacagcacagaagtt

SEQ ID NO: 24698 - DNA, 121 bp, Artificial Sequence
  Synthesized
  misc_feature (61): n=a or t
ccctttacaagcactgtgaggatgtggctcatcaggtgacagcaattccatttttcttacnacctcacttccccattcactgcgggaaactacagagaccaaacctacgaccctttcctat

SEQ ID NO: 24699 - DNA, 121 bp, Artificial Sequence
  Synthesized
  misc_feature (61): n=t or c
ttgtcgactttcactaagaacttttcccacacagcaactaaaggagcaagtgaaatcacangaggcttaactcacctcaattttgtctgaagcagggtgctggttgagcacaagctggtca

SEQ ID NO: 24700 - DNA, 121 bp, Artificial Sequence
  Synthesized
  misc_feature (61): n=t or c
tcacttagaaacttaattataaaatgacgagaaaaaatgtttaatacagtcaactgtttantttttgaactgacaacattttactgtgtcacagggtcgtgatgaaaaatattttgtatgt

SEQ ID NO: 24701 - DNA, 121 bp, Artificial Sequence
  Synthesized
  misc_feature (61): n=c or g
ctatggataatctcttttatgaacttactgaatttcatcttcacttcttgcaccctcacanctcatcacagggtgtctgcttagggtttgagtgctttcacagtcagaagcttgtttctta

SEQ ID NO: 24702 - DNA, 121 bp, Artificial Sequence
  Synthesized
  misc_feature (61): n=t or c
tctcttccctggcacttatgtgagatctgttattagttttggttagtcacaggactggcanggtaccctatgacctctgtcttctatgtgttaaagggttcatcccatttagaggggggaa

SEQ ID NO: 24703 - DNA, 121 bp, Artificial Sequence
  Synthesized
  misc_feature (61): n=t or c
ggctaaagtcatttgcattgcaacactaaaagccagggaatttcagcttacaggaaatgantctggtaattctatttctcatgaacatacttacagctagccatcaggttttaatttgttt

SEQ ID NO: 24704 - DNA, 121 bp, Artificial Sequence
  Synthesized
  misc_feature (61): n=c or g
taaaactgctcgtagtagaagaaccacctttggatttaattcagtcacggaagtacaatgntctatggtataagcagagcagaatttcattgtactacagaggaaacaaacattcagctcc

SEQ ID NO: 24705 - DNA, 121 bp, Artificial Sequence
  Synthesized
  misc_feature (61): n=t or g
ccttttagttttctgagtgcatagagaatatatagcaaatactataaagttcctcatagtnattcttttttcttactctgtagctcctgctcagtatgagtgtgggaaggccaaggtcaga

SEQ ID NO: 24706 - DNA, 121 bp, Artificial Sequence
  Synthesized
  misc_feature (61): n=a or g
tacatctacacacaccaactaaaagcaaactgaaaacgcacctgctctttgctctttcacnctgatcctctgctctccttgctatggatccaggttagaagctccccatgctgccaggaca

SEQ ID NO: 24707 - DNA, 121 bp, Artificial Sequence
  Synthesized
  misc_feature (61): n=c or g
aagaagtattgaagaagtgtcaagctctccccaagccacacatacgagctcaagacagtgnatacaatattgggcatagacgctggcagtagttacaaagcccatctaacaaagatacctg

SEQ ID NO: 24708 - DNA, 121 bp, Artificial Sequence
  Synthesized
  misc_feature (61): n=a or g
cagcaggagaatgtttctggtactccacaggcagaaatattggttaacttttttttacttncacaaatgaaatgaaattgtcccttgtctgtcatcacggacaatgaataaaagagcaaag

SEQ ID NO: 24709 - DNA, 121 bp, Artificial Sequence
  Synthesized
  misc_feature (61): n=t or c
acgctgctttcccctcgggcgcggtgttaccatagcttagcatagctcagcgtccttcggngggtctttctctttggtagagggacaaccaaaaagcaagcgagcaaatcgttagatacgt

SEQ ID NO: 24710 - DNA, 121 bp, Artificial Sequence
  Synthesized
  misc_feature (61): n=a or c
gctgcagagtcccagcatggtgggtgctgtttgcatgctcccgtgctccatttggttcccntgcatccttcttgtccctgtttcaccagcagccaggactgagcatcacctgtgggctccg

SEQ ID NO: 24711 - DNA, 121 bp, Artificial Sequence
  Synthesized
  misc_feature (61): n=a or t
tggataagtttttgcaccattctcattgtcgtttgcagttgtaagaaaactcagaattacntatggagtggaacattttaagtcttatttcatgtaatctgttcagcatgaggtttacaag

SEQ ID NO: 24712 - DNA, 121 bp, Artificial Sequence
  Synthesized
  misc_feature (61): n=a or c
actctgaaatgttgaggttatattctagaaactaagctttagcttcatgataagatattanttctacagcgcatgcctttttcaaatgtgaaatcagcatgcaccagacaagcagctaaac

SEQ ID NO: 24713 - DNA, 121 bp, Artificial Sequence
  Synthesized
  misc_feature (61): n=c or g
tttccttgccttgcttcatcaagctgggacctgaaagtttagaagcccttaacagctatgntcctcagactggaaggtgagaagcagtctccacccagggacccagggtctccctgaggac

SEQ ID NO: 24714 - DNA, 121 bp, Artificial Sequence
  Synthesized
  misc_feature (61): n=t or c
agactagcagacagaaggatggatgcactttcagacaacctttctgcacctgctttagctnagtccttgctggagcatcactgacggaggaagcaaaggaggagctgaaacccaaaggcag

SEQ ID NO: 24715 - DNA, 121 bp, Artificial Sequence
  Synthesized
  misc_feature (61): n=a or g
aggacaccctccccgcttgcacagaggcccacttcccacgccgaggcacagacagcaaggngtggaagaggaattaccagtgccagagccacacagctgggctgatgctccagggatgaca

SEQ ID NO: 24716 - DNA, 121 bp, Artificial Sequence
  Synthesized
  misc_feature (61): n=a or g
agacagatcatctcctttaggaaagtcaggcggctgtgaaaccatcgtgacggtggagagngtgggaaaggtgatgctgagtccacactggctgctgtcatagaatcacagaacggctagg

SEQ ID NO: 24717 - DNA, 121 bp, Artificial Sequence
  Synthesized
  misc_feature (61): n=a or g
agcagggaagcatttactccttgggtagtggacttaaagcacagtcaacccatgttgtctngcaggaagtctgagaacaaccagcaaggtatcttttcatacactgcagaagggaatgggg

SEQ ID NO: 24718 - DNA, 121 bp, Artificial Sequence
  Synthesized
  misc_feature (61): n=t or c
tactagttcaagaagttcataattatcattgctgtttctagtgctttttttcaatgcctanatcttctactacctctcaaataccctgattaaaaatcatcctagttatcttcttctatac

SEQ ID NO: 24719 - DNA, 121 bp, Artificial Sequence
  Synthesized
  misc_feature (61): n=a or g
agatgttgataaaagctggaactgttgcaggattgtacttgggccaccatcactacaatancacaggggaatgaggtggggaatttatcatcatgtaagcaaatatgactgcttcatctca

SEQ ID NO: 24720 - DNA, 121 bp, Artificial Sequence
  Synthesized
  misc_feature (61): n=a or g
ccagcccagcaccatccgccagctgtaggaggtttaagacactgcctgcaacatccacacnggcactcaatgtcaccgcacaggctatgacaaaaccgaagctgctgttacaaacctccaa

SEQ ID NO: 24721 - DNA, 121 bp, Artificial Sequence
  Synthesized
  misc_feature (61): n=t or c
tttccttcagagtgcactagagcaaaatactggtcattccatttgtacacatatagtgacnatgtcaaagcaaccctcttcaaggcaaagcattattagcacaacctgtgatcttaccgtg

SEQ ID NO: 24722 - DNA, 121 bp, Artificial Sequence
  Synthesized
  misc_feature (61): n=t or g
tttgggttttttttgtgcttcttatactcagttagctcaatctgcactccaaaacagaccnttcaagtctttgctgttcctctgtctagttattatatttcacagcccttttgttctccta

SEQ ID NO: 24723 - DNA, 121 bp, Artificial Sequence
  Synthesized
  misc_feature (61): n=t or c
gaaaacgaaagagctacaaagtcttcttcctccagataagtctgtcccaggtttcacatanagtttccacctgaagaagcaggaagtctcacgctcagataaaaggaggaagcaaacgcaa

SEQ ID NO: 24724 - DNA, 121 bp, Artificial Sequence
  Synthesized
  misc_feature (61): n=a or g
agcagtagcagagtgggaaaatatgagagatggacaaggcagttttaatagtgagtagtancagcatcagatcacttatgatctttggtactttccacaagagttatcattatgtgtagtt

SEQ ID NO: 24725 - DNA, 121 bp, Artificial Sequence
  Synthesized
  misc_feature (61): n=t or c
tccagcttctgattccccattggaagttactgagttgacaggatcatcttcccaatatgcnaaggtgaaagtctctgttctgaatagctttgtaaggaagagataaagcaggggcactaga

SEQ ID NO: 24726 - DNA, 121 bp, Artificial Sequence
  Synthesized
  misc_feature (61): n=a or c
gtttggtattctatctttaagagcaagtcattaaaaagatgcttttcttaatttctccttnatttgcagatccttgatagcatgaacccattgcgcccctatgagcgcattgacactttga

SEQ ID NO: 24727 - DNA, 121 bp, Artificial Sequence
  Synthesized
  misc_feature (61): n=c or g
aaatactttgaagtagaagtgcagttgaaattggtatattcctgaggtgtttctaactaantgttaggtcagaaaatcccttctctgcatgaatgactctcacacccaatgagtttgaaag

SEQ ID NO: 24728 - DNA, 121 bp, Artificial Sequence
  Synthesized
  misc_feature (61): n=t or c
gtatgggagcagcttagtccaaagccctagacttctcaatgtgaatgggtcccagagctcncagaagcaattcagtgagctgagggtggcactgaactggtgctcagacatacactgctgg

SEQ ID NO: 24729 - DNA, 121 bp, Artificial Sequence
  Synthesized
  misc_feature (61): n=t or c
ctgggcagcaggagggggcgtggggcgagcaggggctgtgtgaggtcactggtaaggtccnctctccactctcccttccaggtttgaggagttcctccatcggaaatggtcttcagagaag

SEQ ID NO: 24730 - DNA, 121 bp, Artificial Sequence
  Synthesized
  misc_feature (61): n=t or g
ctctggcacgagaccaaagtgtattatgttaagtgtatgttatgtattataaaagctgctngctgaaaattaattgagtattcccgtgctagataatgtttctccattccccagagcccat

SEQ ID NO: 24731 - DNA, 121 bp, Artificial Sequence
  Synthesized
  misc_feature (61): n=t or g
ataaaatatcgtatctttccgaataaagtttggggagcaaaactgcctgtgcattctctgnactccttctggtctgttgcagtacacctgagcagtagctgcttgtctaatagtactttct

SEQ ID NO: 24732 - DNA, 121 bp, Artificial Sequence
  Synthesized
  misc_feature (61): n=t or g
gtttattaccatatgatgtatgtagcagctggcacaactgggccatgaatgcctgaccttnttgtatgtattgatttttgtatgatatacacatgttctacaacagagtgggggattgtgg

SEQ ID NO: 24733 - DNA, 121 bp, Artificial Sequence
  Synthesized
  misc_feature (61): n=a or g
aacataacggcaaaaaaaaaaaaaaaaaaaaaaaaaacgcacaaaaaagctcagtagaaancacacattttagactgtgaacctcaaaagcctgaaagctgaaaagttgaataagaagaac

SEQ ID NO: 24734 - DNA, 121 bp, Artificial Sequence
  Synthesized
  misc_feature (61): n=t or c
gacgccctatgggaacctggagctcagctccccgtcctcagcaccctttgagatgaacccnttgtggttcccagaatgccccttctctgagctgtggggagacacacgatgctgtttcaaa

SEQ ID NO: 24735 - DNA, 121 bp, Artificial Sequence
  Synthesized
  misc_feature (61): n=t or c
tttttgaattcaaagttagataggaagaaattaacacggagcaaagaaatcccccacattngcaatcagaaaatcaagtttgtaattgttattgtatgttttcactctcataagaaagagg

SEQ ID NO: 24736 - DNA, 121 bp, Artificial Sequence
  Synthesized
  misc_feature (61): n=t or c
ttaggttgtttgttctttgttcatgctcagctattcattgcacgtagtcctcaaagtcctngctcttgtgtccaagagctttttcacagtattatcatgctttatcctgaattagtgacat

SEQ ID NO: 24737 - DNA, 121 bp, Artificial Sequence
  Synthesized
  misc_feature (61): n=t or c
cacaaatttttgtgttattgtcactaggatgtaagaaattcatatgttgtttcctctctanccattctgccacaaataaaaagtttaagttaacctattctttccagaatctaggatctcc

SEQ ID NO: 24738 - DNA, 121 bp, Artificial Sequence
  Synthesized
  misc_feature (61): n=t or c
tcattaagctgtggaactttgaagctgacatcagaggccatgtttattgtaagagaaactntcatttaattaaaggcactttttaatattgttgtctatatattttaccctatatatattt

SEQ ID NO: 24739 - DNA, 121 bp, Artificial Sequence
  Synthesized
  misc_feature (61): n=a or g
agtcgcgtatcattgcttcctgcataactttaaagtttacactgagctgcacagcctcgcnttttacactgcagagtgggagaggttagatttcaactatttggatccatctcatttttca

SEQ ID NO: 24740 - DNA, 121 bp, Artificial Sequence
  Synthesized
  misc_feature (61): n=t or c
aaatccatggggaggacaggaggaagactttatctcaaacaggaatggtaacagcggctgngtatgaagattatacatgttcctagactctatcatcttttctctctctcttctttttttt

SEQ ID NO: 24741 - DNA, 121 bp, Artificial Sequence
  Synthesized
  misc_feature (61): n=a or g
gtgacccagggagaaaattcaagtcactaagtcaaaacacagtcatcatgcaaattcatcncagtgtgaagttccccttgtcattggtaagcaagctcaataacttatttaatgaactcag

SEQ ID NO: 24742 - DNA, 121 bp, Artificial Sequence
  Synthesized
  misc_feature (61): n=a or g
gcctggggaatgtgtctgttaatgctccattaatatttaaaaagccagtccagtccttggnttgtcagtgttctcttttcacatctgtttcctagcaagtaaaaccactctctaagcatgg

SEQ ID NO: 24743 - DNA, 121 bp, Artificial Sequence
  Synthesized
  misc_feature (61): n=t or c
catctgtgtcttttccaaacccatcttattatgtgatctgtccattgtgcaaagtcaacancaccccaaaaaatctcattgctaggcctatctattgcaaggacacaagatagggagtaca

SEQ ID NO: 24744 - DNA, 121 bp, Artificial Sequence
  Synthesized
  misc_feature (61): n=a or g
gtaaaggtcattgtaacactgaaaaaacagaatattccaatggtgcaaggtaccacttccncagtactgctataaattatgcttttctttttttttttctccagtaatcatagtatcatca

SEQ ID NO: 24745 - DNA, 121 bp, Artificial Sequence
  Synthesized
  misc_feature (61): n=t or c
ctcttcaggaacagaacaggtcacttccacaccagtactgcactgatgtgctggcgactanctgcaagctgtaccttcagtggcatggaaatgaaagttataccctaacctgcccacggca

SEQ ID NO: 24746 - DNA, 121 bp, Artificial Sequence
  Synthesized
  misc_feature (61): n=t or g
ttctacattttctgtgttcctataggacaaagttgagcactagaacaaagagagagaaatntcactgtcagagagtccagcaatggaaggttcatgcagagaaaatgcggcttatttacaa

SEQ ID NO: 24747 - DNA, 121 bp, Artificial Sequence
  Synthesized
  misc_feature (61): n=a or g
ccataagccaagagcagctattgcacagtgtgggttgggagaggtttgggaagcctctgantgcaaaattaagatctggtgagggaaacggagggtgtgagaagaggaaagcagggttagg

SEQ ID NO: 24748 - DNA, 121 bp, Artificial Sequence
  Synthesized
  misc_feature (61): n=a or g
ccatccctatctccgtttctgacataccaatgagaagacacacctcatactaaggcacacngagccacgagttcagaaagggtgtaagcacacagctgctcatgacgaaggtgctgcttgt

SEQ ID NO: 24749 - DNA, 121 bp, Artificial Sequence
  Synthesized
  misc_feature (61): n=a or g
tcagatccccccacggaggaggaagcagccatgtgatcgtgctgcaaatccttctaagacngatctgacacaaaatacctgtctgtaattcttcctcaaatgatattcccatgcaacagca

SEQ ID NO: 24750 - DNA, 121 bp, Artificial Sequence
  Synthesized
  misc_feature (61): n=a or g
tgtctccttattcaaactccttaaaggatcaatgcattcaaaatctgttctgaaagagacntgagctgcgcagttataatggtacattacagcagaaaatgccctcggagcgcaggcatga

SEQ ID NO: 24751 - DNA, 121 bp, Artificial Sequence
  Synthesized
  misc_feature (61): n=t or c
tccaatatagatgatggatttatcttcagccatattttttcttctacacaaaggatggctnggtttgcttttgcaatggaatacaaatactaatagcaccatctgctgtctgtataagtcc

SEQ ID NO: 24752 - DNA, 121 bp, Artificial Sequence
  Synthesized
  misc_feature (61): n=a or g
ttagaaataggtgatgacttttcagtacagtactccagttaacagaatgtaggctaaccanctgtaaaacagagtggtcggactgcacagatgcacaggaaaggcaagttatcattgaatc

SEQ ID NO: 24753 - DNA, 121 bp, Artificial Sequence
  Synthesized
  misc_feature (61): n=a or c
attgtgttattcatttttaatcaaacttgtgcatcgagcgcttccaatgtgaaggaacagncaatgctagcaatcattttacatggaattttactgctgtccccagggctcgtatgcatat

SEQ ID NO: 24754 - DNA, 121 bp, Artificial Sequence
  Synthesized
  misc_feature (61): n=a or g
gctctgaaatgaagtggcattgttagaaaggttggacagcagatttcagtgtctggggacntcagtctgttttttgagcagtgacattataaagtacttaggaaagagcagtgcaaggcaa

SEQ ID NO: 24755 - DNA, 121 bp, Artificial Sequence
  Synthesized
  misc_feature (61): n=a or g
gcaactgctgcggcaggaactgacagccagcagcctcagcctccatctctctcctcactcntcctgcatgttaaatggctgcttcaaacccaagagtagcactttacatattaaaaccaaa

SEQ ID NO: 24756 - DNA, 121 bp, Artificial Sequence
  Synthesized
  misc_feature (61): n=a or g
tggaaattaagatgttgtaacagtcatcttaagatgttataacagtcatctagcaaaaatncacatcagttgaaacagaaagtggcacaaaactctacgttttaaatcagtgaaagttgca

SEQ ID NO: 24757 - DNA, 121 bp, Artificial Sequence
  Synthesized
  misc_feature (61): n=a or g
cagaatgtcagccagagatagattcactatgaaatagttggtgactgttcgcatgtgatgnttcttccacactgcaatacaaactgaatttggaaagagaagttagtgagctggaaatgtc

SEQ ID NO: 24758 - DNA, 121 bp, Artificial Sequence
  Synthesized
  misc_feature (61): n=c or g
caaactttatgaaagcctgaagagttgttaaaattagagttaatgagagatagactaggtnatctgcattacattattttgaaaaatatgctattattttgaaaatatgttagcaattcag

SEQ ID NO: 24759 - DNA, 121 bp, Artificial Sequence
  Synthesized
  misc_feature (61): n=t or g
agagatatggggcccaaccacatcatgtaggttcagtttaatgctcctgccataagtgagnggaaaaatgaagccaaaacattcttccgcgcttgtctcggagctagatccttgttttatt

SEQ ID NO: 24760 - DNA, 121 bp, Artificial Sequence
  Synthesized
  misc_feature (61): n=a or g
aagtccaaatgtggtagtagagatatattcctctgctagtttgaattttctccacagtgtntgagatggaaaacaaatatcctgttcctgtgactaaagacaagaacttttcaaggacaga

SEQ ID NO: 24761 - DNA, 121 bp, Artificial Sequence
  Synthesized
  misc_feature (61): n=c or g
tcactcaaacgacgacaaataccaacagaaaatacattgtgctggaggtactcacaatctntctcttcaggcatccaatttagatgcctccgctgggaggtgagtgcctttggcatgactc

SEQ ID NO: 24762 - DNA, 121 bp, Artificial Sequence
  Synthesized
  misc_feature (61): n=a or g
taaatcagtattaaagcagaacacaatagcagaggatttttcagtttctcctgcttagtgnttataacacacgtgcttgacttctcagggaaagtagtctgttggaatggttttgttagtt

SEQ ID NO: 24763 - DNA, 121 bp, Artificial Sequence
  Synthesized
  misc_feature (61): n=a or g
agcttaaggcatttctccagtttcacagtattctcagattgttgttgagtaaaacttgacncatatgctgttaaaatgaatgtaaataagaaaatgatattactttttattacatgttatc

SEQ ID NO: 24764 - DNA, 121 bp, Artificial Sequence
  Synthesized
  misc_feature (61): n=t or c
gctagggttagataacttcaaccccaccccaaatgtgactcagagctaataattttcagangtggctaactgttgcctttcacagcagtgtctgaatgggttaaacataaaatttgagtga

SEQ ID NO: 24765 - DNA, 121 bp, Artificial Sequence
  Synthesized
  misc_feature (61): n=a or g
ctggtggggctgctgggaggattcagagccactgaaggtgtctcccactaggttgcctttnttttcagccagcatcaaggaacagcaaatatccttgtccagtggttatcagggctccagc

SEQ ID NO: 24766 - DNA, 121 bp, Artificial Sequence
  Synthesized
  misc_feature (61): n=t or c
ctgctttctctggagctcctgtaccttcacttcccaacgcagtcacccgtgacacctgtgngggacagcactatgctgattgctgtaggattggctttgctgagctggggcagcgcggagc

SEQ ID NO: 24767 - DNA, 121 bp, Artificial Sequence
  Synthesized
  misc_feature (61): n=c or g
cacctcaggagttcctttccaaaatccacacatgtgagtataaagccaaaggcacaactantgaaacatctttgaaataacttagccagtaagcagttttattttaaatgcaggctgaata

SEQ ID NO: 24768 - DNA, 121 bp, Artificial Sequence
  Synthesized
  misc_feature (61): n=a or c
taactatacactcgcttgctaaatatttagggaaggggaaacaaaaagcagataaatgccnatgaagttgctattttgccactaaacaactgcacaggaacttgcataaggccacagagag

SEQ ID NO: 24769 - DNA, 121 bp, Artificial Sequence
  Synthesized
  misc_feature (61): n=a or g
aatgtattatgttaagttctaagctattaacctcctctgaggtttcttctgtaaagagtcnagactgtgatttgaatatcttgaatgagtgaacttgtaccacatccataaagtcatgata

SEQ ID NO: 24770 - DNA, 121 bp, Artificial Sequence
  Synthesized
  misc_feature (61): n=t or c
gctctggtaaatctagtactttaatgtactacccctatctggttcagttttgctggtctanggcagctggattagggctagtacagaagttaatggaagaaaacagaatagttatttatcc

SEQ ID NO: 24771 - DNA, 121 bp, Artificial Sequence
  Synthesized
  misc_feature (61): n=a or t
aagattccgagataaggtaattgaaggtcattccttctcttactcctatctgaacctaggncaagggatgtttgattttcctgtaggcgttatttgtaagagtggtagctctctgttctgg

SEQ ID NO: 24772 - DNA, 121 bp, Artificial Sequence
  Synthesized
  misc_feature (61): n=t or c
ttctccccctcccctttctgtaatatctagatatggccaacagtatgcttttaattaaccngttatgatttcaatcacgttaacaataaattcttcacttgagtatatggttgcatttcct

SEQ ID NO: 24773 - DNA, 121 bp, Artificial Sequence
  Synthesized
  misc_feature (61): n=a or g
ggagctcccccgtggggcaggatgcactcccaccgctctttgctttgcacggagcacaccnagaggcgtcaacgctgtcccctacaccatgaacagcactctgcaaagacactgctggaga

SEQ ID NO: 24774 - DNA, 121 bp, Artificial Sequence
  Synthesized
  misc_feature (61): n=a or g
tcactgtttaataaaatagggaacagaagctttattatcaaagtgatcagctgtcaggtcnctgctacatgagcctcttcattgagctccaaaacaggcacttaagtcctgttgtttatat

SEQ ID NO: 24775 - DNA, 121 bp, Artificial Sequence
  Synthesized
  misc_feature (61): n=t or c
ccaggagttggagctttgtgaaatgagcactgtgtttggatggtcatgtttagcatctaangttggaccaatcaccacagatgtcctcattctcctttgctgtggaattaagctgtaagtt

SEQ ID NO: 24776 - DNA, 121 bp, Artificial Sequence
  Synthesized
  misc_feature (61): n=t or c
gcttttatactaatacgtataaatctcacttctgttgaactagagagatgacttctctacnttagagtagacttttcttatcatgctttaagctttcaaagctggcatgatgttgtgggtc

SEQ ID NO: 24777 - DNA, 121 bp, Artificial Sequence
  Synthesized
  misc_feature (61): n=a or g
aaaccacattctcctccaagcactgcagtccaccagcagagaagcaccacactgctttcanagctgattgctgccaaccagatggcagagactcagcgtcccctgcatctaccccatgggg

SEQ ID NO: 24778 - DNA, 121 bp, Artificial Sequence
  Synthesized
  misc_feature (61): n=a or g
tacatcaattgctctcatggtagtttactttatttttctctgaattggtcttttcagagtntaacagacaagtaatgactgccttctggcatatgcagctattacgagaggtgtttttatt

SEQ ID NO: 24779 - DNA, 121 bp, Artificial Sequence
  Synthesized
  misc_feature (61): n=c or g
tgtttccactagctgcagtaatgcaaactgatggcagaatattcattcctctcctgctcanagaaaagagctcaggcttcaggcaatgccacaacagagtcatgcaccacactgtccctca

SEQ ID NO: 24780 - DNA, 121 bp, Artificial Sequence
  Synthesized
  misc_feature (61): n=t or c
gtagaagacagttcagagaagcaaaatgtgctctaaaatggatacctttttccttcaacantgaactgtcgatgaatataataagttcataagatgaaaggcggctcacaaaaagttctga

SEQ ID NO: 24781 - DNA, 121 bp, Artificial Sequence
  Synthesized
  misc_feature (61): n=t or g
acattaagagttggcagcagctttccagtgtgcacagatagaactgatacagcggtcgtanttggacactggcagctcctatgacataactctgctgctccccaagaactgcttctctatg

SEQ ID NO: 24782 - DNA, 121 bp, Artificial Sequence
  Synthesized
  misc_feature (61): n=t or c
gcatcagtggtgcccatccaatggtggtcccccatatcatgttggtagcgctcatcacatnggtggtatccatcacatcagtggtaccaccacattggtggtccccatatcacactggtgg

SEQ ID NO: 24783 - DNA, 121 bp, Artificial Sequence
  Synthesized
  misc_feature (61): n=t or c
gcagttggaaggttgtgccctatggctttggaggcacaaaaagcatctctgtttgcccatntgtaaaagcaggagggacggcaccgctctgtgctggagacatctggatgtggcactgagg

SEQ ID NO: 24784 - DNA, 121 bp, Artificial Sequence
  Synthesized
  misc_feature (61): n=a or t
ttgcagctagctgccacagtgtgagatacgaaagagggtagtctgtactgtgtactaaatnatgcatagaaacatgttacagctgaaattcataactgagttactgtggcttgacaggtta

SEQ ID NO: 24785 - DNA, 121 bp, Artificial Sequence
  Synthesized
  misc_feature (61): n=a or g
tgactgtcagtgggagccagtgcagctgaagcagatgtttcatgttgataagcagagactnggaaagaaatttctacgccactttttctctgtaccacatttcctctaccatagctggcaa

SEQ ID NO: 24786 - DNA, 121 bp, Artificial Sequence
  Synthesized
  misc_feature (61): n=a or g
aataggctgatttatttcttcaaaaattttcttttacaaagattgagtagataataaaatnatgtgaaatggtcattgatttgactgaatttctgtgcttgaaaggaaaaaagcattgctg

SEQ ID NO: 24787 - DNA, 121 bp, Artificial Sequence
  Synthesized
  misc_feature (61): n=c or g
atgaacatctgtaagctgtgttaatagacctggtgtctctagtattgttctttgcttgcanttttcaagcctatgcaattatcctgtactttccatttggagagtctctgttacaaacttc

SEQ ID NO: 24788 - DNA, 121 bp, Artificial Sequence
  Synthesized
  misc_feature (61): n=t or c
tgaccttgcccagtccttgccgaggagggctgcacaaaggggctcttgggagctcagaganatcccattacacaggggcaaatgatcatatcctctgcccagtgctgctggggacagtgga

SEQ ID NO: 24789 - DNA, 121 bp, Artificial Sequence
  Synthesized
  misc_feature (61): n=t or c
cagaaagcattccgaagcctaactggcaaaacttatatcatgtaacagtatgcatcatcancttgcaccttgtaaatacagatgccacatctggtatatgtgattaagctagaaaagttag

SEQ ID NO: 24790 - DNA, 121 bp, Artificial Sequence
  Synthesized
  misc_feature (61): n=a or g
ttttattttcttgcaggttatacagagaatattttatacagtaaataggtcctggtctggnaaaatcacttgcaacgagctcaggaaaagcaattttttgcaggtatgtagtatcttttgc

SEQ ID NO: 24791 - DNA, 121 bp, Artificial Sequence
  Synthesized
  misc_feature (61): n=a or g
tccacacactcctttttgtatctgtgatgacataagtggatggagaggtaaagagcagganatttagttaacaggcactaatgataccgtaacaaataggatctgaagtgcccgtcactaa

SEQ ID NO: 24792 - DNA, 121 bp, Artificial Sequence
  Synthesized
  misc_feature (61): n=t or c
tccattctgtgtaggaagcatacacagatttctttcagagccattacagctcaaacattcnggctctgtatgtgaccttttccatccctgcactgtaatcaaaacctccttccataaagag

SEQ ID NO: 24793 - DNA, 121 bp, Artificial Sequence
  Synthesized
  misc_feature (61): n=c or g
ctgaatgtgacctttataaagcaacatgatcctaaaaggtctctaatacactctgaaatgnaagtcagattgtcaaagcatgctgtagaatttaactgtctaaatttaatttcatatttta

SEQ ID NO: 24794 - DNA, 121 bp, Artificial Sequence
  Synthesized
  misc_feature (61): n=t or c
tgctgattgcttctgcaactgtattcctggcccagatgtctctagatacttggctaacagnagtaggacacattgcactttctccaaaacacatttctccatttctcgcttaacaataact

SEQ ID NO: 24795 - DNA, 121 bp, Artificial Sequence
  Synthesized
  misc_feature (61): n=a or t
taaaagcagagtgaagaaatagtctcttctattctggtagcgtaccacaaaaccagatgtntgatgctggaacacgtagacaggcccagtgtgattgcaggagtggtttctatgctgttag

SEQ ID NO: 24796 - DNA, 121 bp, Artificial Sequence
  Synthesized
  misc_feature (61): n=a or c
cttacagcatattacttgtaataaagagccaatagtcatgcaagcagtctctccatctgtncaagtacatatataaatagctcccacattaacttagggaacttgtacagatgttaaggag

SEQ ID NO: 24797 - DNA, 121 bp, Artificial Sequence
  Synthesized
  misc_feature (61): n=c or g
attttacccacaggcaaatcataatgatagcccctctaattaaaccaagacttcattaaantgtttctcattatcatttgcaatattttatgataattatctgccttttatatagtgaatt

SEQ ID NO: 24798 - DNA, 121 bp, Artificial Sequence
  Synthesized
  misc_feature (61): n=a or g
agacaaccaaaataccttcaaaacaaagtctaaaggaacacgcgctagaaagcagaaaacnggctttgtgaaccacactcaaagcagcatgtgttgccaaagaaacctgctggagcattct

SEQ ID NO: 24799 - DNA, 121 bp, Artificial Sequence
  Synthesized
  misc_feature (61): n=a or g
ttctctcctctgctgtaaaacctgaagagtgttttaaaagtttgaaaactcaagtgttaantaacaccccatttaccattaaaaggatagattatgtggagaagttaatttagtacttaag

SEQ ID NO: 24800 - DNA, 121 bp, Artificial Sequence
  Synthesized
  misc_feature (61): n=t or c
cacaatataaactcttgattaacatacaacattgaagcagagatgaaaagcaaggttaaanagcacaagtactctggaatggtctccagaaaagctggaaaacaaaagggggaggaagggg

SEQ ID NO: 24801 - DNA, 121 bp, Artificial Sequence
  Synthesized
  misc_feature (61): n=t or c
atggtttcttttttttctatctcttaccgtgtcctttagaccttcaaatccctttatattnggaaagatagaaaactgtgcagaactacagaaaataaagagaatgtttagaatgctttgg

SEQ ID NO: 24802 - DNA, 121 bp, Artificial Sequence
  Synthesized
  misc_feature (61): n=t or c
tttatttaatacacacttagtaaattatgtggatgcttgatggctcaaaggaacttagtantgagaagtagccttctccattttgaaatagctcttcatttctttagagtagactctcact

SEQ ID NO: 24803 - DNA, 121 bp, Artificial Sequence
  Synthesized
  misc_feature (61): n=t or c
ttttttattacaaatttttattacaaactgttttactatttctacaaaggattgcttctantataaagtttagggcaattggataggtgctatctgagatagaaaaagcatgctatgccac

SEQ ID NO: 24804 - DNA, 121 bp, Artificial Sequence
  Synthesized
  misc_feature (61): n=a or g
aagctgtccagtaccccagccagaagatcccacagtggaaaagctgaggcgtacacccaanacttacactgcttttaagcttaaaaggatacttagaacatctctttccactggcaccttt

SEQ ID NO: 24805 - DNA, 121 bp, Artificial Sequence
  Synthesized
  misc_feature (61): n=a or g
gagagatttttccaagtctattagaaattggcttggcgtggttttccaccagttgtattancctcctgggtagtgttggaagcatcccaaaactcattgttttgagagatgtgaatactgg

SEQ ID NO: 24806 - DNA, 121 bp, Artificial Sequence
  Synthesized
  misc_feature (61): n=t or c
tggttgtttttgtgtcttctaataatgatataaacataggttcaaaacttttaacatctgntgaaatacaggcatagaaataaaatttatgtaaacctgtaacgctagatgctgcctgcaa

SEQ ID NO: 24807 - DNA, 121 bp, Artificial Sequence
  Synthesized
  misc_feature (61): n=t or c
cccttccaactcaaatgattctatgattctgtcctacgtcctggatatttctgaccaccancatcaggccacctctcagctagggctgtgtctgtgctgtgcattaaaaatgaactgtatt

SEQ ID NO: 24808 - DNA, 121 bp, Artificial Sequence
  Synthesized
  misc_feature (61): n=t or c
aaccccatgatgtcttaaagccctgtctattaaagaaggccatgtttatgtgagatagagntatgtgaaagaaccttgaaacaaatgtcactaccttccagtaagcaggccttaaatgacc

SEQ ID NO: 24809 - DNA, 121 bp, Artificial Sequence
  Synthesized
  misc_feature (61): n=c or g
aaccaaacaacaaatccattagactcttgcactctcttcattatgtctgtaccattggctnagagtttatgttgcaactaagaattcagctgagtcacagcaacatactgtggttaattca

SEQ ID NO: 24810 - DNA, 121 bp, Artificial Sequence
  Synthesized
  misc_feature (61): n=t or g
tttgatacactacacaactcttttgaacttctcctgttgcctcctctctgattgttggttntaaaggaaacccgagattccccctcatcattcagctgatttatcctagaggaacatcaag

SEQ ID NO: 24811 - DNA, 121 bp, Artificial Sequence
  Synthesized
  misc_feature (61): n=a or g
tttgtttttttaatgctcctcactttgcagcctctgagctgcagacccaaaatctacaccntttgcttcctttgcagcccagttcaaagtgacaatcttctgttctctccacttctttatt

SEQ ID NO: 24812 - DNA, 121 bp, Artificial Sequence
  Synthesized
  misc_feature (61): n=a or g
ggccaatgggcatgtgacctttccaaggtgagctttgtttaagcctgaagagaaggaaatntgcctctgcaaggcatttgtgacatctcatagctttaagcactgcatccattgtcctagt

SEQ ID NO: 24813 - DNA, 121 bp, Artificial Sequence
  Synthesized
  misc_feature (61): n=a or g
cctgtgggtatagtataaataaaaaagacagcagatggatatgttaaacaaaaagtgtgtntggaattgcagtgagacagctgtgctttccatctctaggaaaggatgctgtgctagcagc

SEQ ID NO: 24814 - DNA, 121 bp, Artificial Sequence
  Synthesized
  misc_feature (61): n=t or c
taaaaatctttttcgttcataacttaaaacttgatgaagcaattcatctctcttgttttcnttattttcagctcacacagtcacgatgttactcaagtctttgtatatttcaggtaatcag

SEQ ID NO: 24815 - DNA, 121 bp, Artificial Sequence
  Synthesized
  misc_feature (61): n=t or c
ttacctttgcacccctttccattctggattttagaggccagtgtaagtgcacaggagctgnacaggcagtcactaacaaagagccctgttagaggaacttgctgtttccaagtcgctcttt

SEQ ID NO: 24816 - DNA, 121 bp, Artificial Sequence
  Synthesized
  misc_feature (61): n=t or c
caccaattttgcggtggtgttgaaatacgctactgcatacagtgaaacaggaatcctgtanttcccttaaatttctaccaacacggaaataataacctctgattctggaatgaaagctgta

SEQ ID NO: 24817 - DNA, 121 bp, Artificial Sequence
  Synthesized
  misc_feature (61): n=a or g
acgccgagataaactgtacatatgaaaagttgagcggaaatgtttttcagtttgactgccnctgtttccaaagtccaaaaacatatatcagtttctcatatatggcaaacaggtatacagg

SEQ ID NO: 24818 - DNA, 121 bp, Artificial Sequence
  Synthesized
  misc_feature (61): n=a or t
tgctttcttaccatcggattcagcaagcacagtttttaacttagaagcttaatctcaaagntgaacacttcccacagtcccacagcactaactgggttaatattcagcttacaaaatgttc

SEQ ID NO: 24819 - DNA, 121 bp, Artificial Sequence
  Synthesized
  misc_feature (61): n=t or c
acacattatcacaaaaacttgcacaaattactcacaaaagagggagtctgagtataccagnatatggatgctatattgtttaggagcccaactgaagtagtgcttcaaattccaacagaag

SEQ ID NO: 24820 - DNA, 121 bp, Artificial Sequence
  Synthesized
  misc_feature (61): n=t or g
gctctcaaagattgaagtgttttaaagtatagggttaagtaaaaatgcctggaggacatcnatgagcttgggggcatcacatgaattgcatgggcagctctaagtgccaacatgtagccat

SEQ ID NO: 24821 - DNA, 121 bp, Artificial Sequence
  Synthesized
  misc_feature (61): n=t or g
agattttaagatgttgtaaatgggaagatctgaggtgctatttgcagagcaagactgatanaagcttggaaagcactattaaaagcagtgcagaaatattgatttatgctagctgataatg

SEQ ID NO: 24822 - DNA, 121 bp, Artificial Sequence
  Synthesized
  misc_feature (61): n=t or c
atctttacacacttccactgatggcctcttcctttgcagccatgtctgtagttgccttganagtgcaccatcccacctgctcagctcagaaccagattcttcccagcatgaacaattgtca

SEQ ID NO: 24823 - DNA, 121 bp, Artificial Sequence
  Synthesized
  misc_feature (61): n=a or g
gccatgctggccttccccaggttgccaggtcaccttattgttgacagttctatcagttctncagcaccactgccaacccatggctgtgaactggtgagcttggagacattttgctggttca

SEQ ID NO: 24824 - DNA, 121 bp, Artificial Sequence
  Synthesized
  misc_feature (61): n=c or g
ttattcaagaagctgtcgcagcaaaactcactgctccatcagcaccctgtgaaatcattcnagctactgattagcttatatctctgcagttgcaccagctgggccctcttctgtcttgtat

SEQ ID NO: 24825 - DNA, 121 bp, Artificial Sequence
  Synthesized
  misc_feature (61): n=t or c
tgcctgacccatcggtggatgagttttccatcggctttcttggaaatgggctgtgctcccngctgctgactaacactaattgtaactgctgacactgtaacacttcctgcaagctgtgatg

SEQ ID NO: 24826 - DNA, 121 bp, Artificial Sequence
  Synthesized
  misc_feature (61): n=a or g
tcccacacatactgaggtacctacaaatatctgtgtggcaagaagctttttagcctctggncagttggtgaaatagctacttgttgactgtggtttgaaaatactgctgtaaaatccagta

SEQ ID NO: 24827 - DNA, 121 bp, Artificial Sequence
  Synthesized
  misc_feature (61): n=a or c
atatgtcttgtttgcagtctttgatccagctttctgtcctcataatttttataatccaganaatttagactgagagtaggatttaaaaggtacagtatcaaattgtttgcaaaataattac

SEQ ID NO: 24828 - DNA, 121 bp, Artificial Sequence
  Synthesized
  misc_feature (61): n=t or c
cggattgtcaaaactgacgaaacctgggggtgagggacggggcgacacagggggacagttngtcaccattaatgccacaccaagcagcttgacttcaacagggtcacggcataacttcacc

SEQ ID NO: 24829 - DNA, 121 bp, Artificial Sequence
  Synthesized
  misc_feature (61): n=t or g
gttgttttccagaagctcaagcactgagtgtcatactctgtctagcttcaatcttagtccnggtgctttaactgatcaaattgttcaaataaagcaaaataccattcattgtgggtacaaa

SEQ ID NO: 24830 - DNA, 121 bp, Artificial Sequence
  Synthesized
  misc_feature (61): n=a or g
ctgttgtcttgcaaactttgtttctggtttgatgcccttcactgtatacgcagatgacctncttgagttttctacagtcctcttgagacctccaggcaatagaacatccaattcccccatg

SEQ ID NO: 24831 - DNA, 121 bp, Artificial Sequence
  Synthesized
  misc_feature (61): n=a or g
tctcatcttctgccttaatccatttaaaaaacaccattagaatttacacaaaggattcccnaattgatttcctttcatcctgcctcaaacacaaagcagaaggtcattgtgtgagggcctc

SEQ ID NO: 24832 - DNA, 121 bp, Artificial Sequence
  Synthesized
  misc_feature (61): n=a or g
attaatattcttaagacttctttcttaatcaacattagaaggattgcacagttcttaatcnctgaagtaaatgagaattttaaaattaacttgataaaccaaaggaaccaaaattgcacag

SEQ ID NO: 24833 - DNA, 121 bp, Artificial Sequence
  Synthesized
  misc_feature (61): n=t or c
accattttcttcttaaagagcagacaaatgcagcccaaagctgtctaggatagcagccacngcaggataacattttaaatccaatctgtctctgctgttcagccaccatttccaagtcagt

SEQ ID NO: 24834 - DNA, 121 bp, Artificial Sequence
  Synthesized
  misc_feature (61): n=a or g
ggcacatcttcacaattattctgaggtttccattgttgaggatttaactgctttttacacnagtcactttttaagaaagcattgctgctcaccaattaatgttttacagttgtcttgcagg

SEQ ID NO: 24835 - DNA, 121 bp, Artificial Sequence
  Synthesized
  misc_feature (61): n=a or g
gggacattggaagggaatgatgatcaaaattttattcaaggctgtaagtagaagtgaccanaagaacagttctctcttaaaatatcttttgcatttataaggaacaggcattgatagatgt

SEQ ID NO: 24836 - DNA, 121 bp, Artificial Sequence
  Synthesized
  misc_feature (61): n=t or c
tgtcttctgaataaatatttattttagtttatacttctttttaagcctttagtgtcattcnataggttttatatgatttctttcctcctcctagaggaatttacatcatccttgtaccctt

SEQ ID NO: 24837 - DNA, 121 bp, Artificial Sequence
  Synthesized
  misc_feature (61): n=a or g
tccacccgaagagttgaattgtttgataatctgcatcaaaacctcagccactaccgagggncatagtgccatgagccagtgaactatcaggctcctcctcagtaccctataattatccctg

SEQ ID NO: 24838 - DNA, 121 bp, Artificial Sequence
  Synthesized
  misc_feature (61): n=t or c
actgccccagttacagagcatccctacctgggagcagtgcacaaaacatgggatggaggcnggtcagggtggcagcgctggatccaagcagctcggtggcacgggctcgctctgccccagc

SEQ ID NO: 24839 - DNA, 121 bp, Artificial Sequence
  Synthesized
  misc_feature (61): n=a or g
taatcaagctcattactagattatgtgttataagatctgggtgcataagcccttagcacanaaaattctcttattttgctaactgcttaaacataaaactgcaacagaaagaaattgttcc

SEQ ID NO: 24840 - DNA, 121 bp, Artificial Sequence
  Synthesized
  misc_feature (61): n=a or g
accaatttagtgcaaaggaggaggggctcccaaggatggccgacgagaagtgctccgtacnctttggagaaaaggcatagatttaacctctgaatgagatcaggctgccagcttctatact

SEQ ID NO: 24841 - DNA, 121 bp, Artificial Sequence
  Synthesized
  misc_feature (61): n=t or c
atgaagtttaggttgttacttgtctttgtgtatgtgaggacacaaaaatgtcagtaacttngtttaagctttgttttgcaagggtaaaatacattactgatttagatactaaaaccgtgta

SEQ ID NO: 24842 - DNA, 121 bp, Artificial Sequence
  Synthesized
  misc_feature (61): n=t or c
ggtggcctggcgctcttgaatcaactcagagtcagtaaaaatcctctggttgttacagatnttgactccacagtcctagattgcagatagcaaaatatacgtagtgaaactaagagggctg

SEQ ID NO: 24843 - DNA, 121 bp, Artificial Sequence
  Synthesized
  misc_feature (61): n=t or g
gcctacaatgcttcacagggagccaaggcttcccagcattgggtatagggtaaactcacancgcttccctgctcttccaatagggaatagtatggagctctgaaccatcattttaaaaaga

SEQ ID NO: 24844 - DNA, 121 bp, Artificial Sequence
  Synthesized
  misc_feature (61): n=t or c
cacttcgaagacttctgttttaccagcccttgtagagctgtgagagcttacagctgctggnaggactattttcacccagcacagggcaacatgctcaaaaccacccaaccactccccccaa

SEQ ID NO: 24845 - DNA, 121 bp, Artificial Sequence
  Synthesized
  misc_feature (61): n=a or c
tgtccagatattatgctaacttacccaggaaagataatgtagagggatggatgaacacagnaatgcatccccttaacagtgcaatatttgccttccctcagtcgtctcccaaagacttgtg

SEQ ID NO: 24846 - DNA, 121 bp, Artificial Sequence
  Synthesized
  misc_feature (61): n=a or g
aatgaagctgaaatccacggatccaaaacataaaaagaaatggtaatgaaaagatatccangaagaaattatacagtcacacaactctttgtaaggaaagactctctgatgtagctcctta

SEQ ID NO: 24847 - DNA, 121 bp, Artificial Sequence
  Synthesized
  misc_feature (61): n=a or g
aaaaaagaaagaaagaaagatgtagaaatcaaatccactttctctatctaccttgcagtcngagtcatggtatgcttgaggtgaaaggcaaatcagtttctactgagcacattcatgcagg

SEQ ID NO: 24848 - DNA, 121 bp, Artificial Sequence
  Synthesized
  misc_feature (61): n=a or g
cttaacgtgggagctctcacccctgtgtgagtgacgcgccctggcagcagggtggacctcntgtgctggatatgaggtggtgtggactgatggagggagtgtgattttctctctgtctcca

SEQ ID NO: 24849 - DNA, 121 bp, Artificial Sequence
  Synthesized
  misc_feature (61): n=t or g
gaacagtaagttttctgaagagaagagtaagaaacacctcttatcttcatttccatcaatncagattagtattccatgttcactattgcttattctccctgacttcctgatatctgcagct

SEQ ID NO: 24850 - DNA, 121 bp, Artificial Sequence
  Synthesized
  misc_feature (61): n=t or c
tactatagtttctgccataaacatgctccacttgcaaattaaaagagcatttggctactcngcttgctcagctagagatttggtagcctggaaatcagattaccaggtagtttatttgttt

SEQ ID NO: 24851 - DNA, 121 bp, Artificial Sequence
  Synthesized
  misc_feature (61): n=a or g
attcaagaaacgttttctccttatgtctgaaatatctctccttattcagatctacgcttanaattgtctttaaagaagttggttcttgggttttctggtcactgccaagaaaccaaagatt

SEQ ID NO: 24852 - DNA, 121 bp, Artificial Sequence
  Synthesized
  misc_feature (61): n=a or c
atatgcacttgggaaaagattctcgtagcttcaggtgtgtgaaaataggagctggattatnttgggaatggcgagggacagttgtttggtggaaaagttgggtaagatggcagctggggag

SEQ ID NO: 24853 - DNA, 121 bp, Artificial Sequence
  Synthesized
  misc_feature (61): n=a or g
ttgcattctataacaaaatgtttcattctttaaaaaatcaagtgtgatagttacattcatntctgaacatagtcttctgatggagaaaagtacatactgatttctaagggctcctgctgat

SEQ ID NO: 24854 - DNA, 121 bp, Artificial Sequence
  Synthesized
  misc_feature (61): n=t or c
acaccaccataaaaagcaacaagattggtcaggcaggaccggtccttggtgaagccaagcncattatccaatatcacctacgttttttcatatgccttaccatagattccaggaggatttg

SEQ ID NO: 24855 - DNA, 121 bp, Artificial Sequence
  Synthesized
  misc_feature (61): n=a or g
aaggctaggaatgaatggtcttaacttttcatttgtggtcagttgacttcacaagttgtgntctgatcctctgcacagggacaaggtgcattcagtgtttgaatgcattgagtttcttcac

SEQ ID NO: 24856 - DNA, 121 bp, Artificial Sequence
  Synthesized
  misc_feature (61): n=a or g
tttcaggttagtatcagtagaagaactggactgcagtttcaatgagattgaaacattgccntcatctgttgggcaactatctaacataaggacatttgctgcagaccataacttcttaacg

SEQ ID NO: 24857 - DNA, 121 bp, Artificial Sequence
  Synthesized
  misc_feature (61): n=a or t
tgctctttgacagtagtttatctccagaagtccagttgaatttataacccagaatcttccnacttgagttacatcagtcactctgcttagatctcatagccataagaaggccacagacata

SEQ ID NO: 24858 - DNA, 121 bp, Artificial Sequence
  Synthesized
  misc_feature (61): n=a or g
tgactgaagcattctaagggtggttgggaatgttggttttcctaagctggcctgaagtctnggcagtgcaatgggtgagatacaaattcaggactcgggaagctaggcttcaggtctgtcc

SEQ ID NO: 24859 - DNA, 121 bp, Artificial Sequence
  Synthesized
  misc_feature (61): n=a or t
cccgtttacgaatgtgcctttcttcatcatttgaagtgaacggtaggtagatatgtgcatngaatgagagaggaatgtaaaggaggacacaaaattacagtcaaaatatggtgtgctaatg

SEQ ID NO: 24860 - DNA, 121 bp, Artificial Sequence
  Synthesized
  misc_feature (61): n=a or g
tgattgagatggtaaaactgagcaagaagtgctctaaattctgctttgtatttgcaggttngtgaaacgcctggagtttggaacaagaccttcaagtactccaggaccaatgagccatcct

SEQ ID NO: 24861 - DNA, 121 bp, Artificial Sequence
  Synthesized
  misc_feature (61): n=a or g
tgtgatggtaatgtgagattgtaagaagaggttttccctttttagtgcattaaaatgaagnacaccctctttgtaggtatctggtcctgatcctgcaaatgcagtcagaaataattctgta

SEQ ID NO: 24862 - DNA, 121 bp, Artificial Sequence
  Synthesized
  misc_feature (61): n=a or c
ataccaactggctttcaataccaaacacgcctttcatcacctcgttattccttgttaaatntgctctatcatgctcttatgaagatgctcacctgttttagtacttctgtagctccagctg

SEQ ID NO: 24863 - DNA, 121 bp, Artificial Sequence
  Synthesized
  misc_feature (61): n=a or c
aggaatcagtgaaagaggtaagcagctgaagaagagatgtgggagagcattcctttcccanacatgagctagcagccctggcacaactgcctgtcacaaagggcagcttccagcactaccc

SEQ ID NO: 24864 - DNA, 121 bp, Artificial Sequence
  Synthesized
  misc_feature (61): n=a or g
ctggaaacaaacgcctgaggtgaagcacagctcctccgtgtcacagcagagcacagcttcntagcatcagctgccaaacattttgctgcttcaacccacttctgatcagtgatgtgttcag

SEQ ID NO: 24865 - DNA, 121 bp, Artificial Sequence
  Synthesized
  misc_feature (61): n=a or g
agcagtgagtttttcctacctcttcagcaaaggattcccccaggttggctcaggtacatanaagaagagaaaaggtgcccatgaatcctggatgagtcaacctggatgagtaacggagcct

SEQ ID NO: 24866 - DNA, 121 bp, Artificial Sequence
  Synthesized
  misc_feature (61): n=a or g
cgagtggtaagatggacgttgccaaactagcccagtgcatggcagctggtagattttgganacctgcatcttctctcgaacagttgtgttatgtactcagtagtgaatacacatcgtcact

SEQ ID NO: 24867 - DNA, 121 bp, Artificial Sequence
  Synthesized
  misc_feature (61): n=a or g
ttggtgttagcaaccaaataaggatctaccaggcttaaggcaaggagtaagcagtactttntgcaacagaggagtgagagggtgaataggatcgtgtcttggatcttgttagtctgtaaaa

SEQ ID NO: 24868 - DNA, 121 bp, Artificial Sequence
  Synthesized
  misc_feature (61): n=t or c
gcctgtttttttggactgtcactgcttgtggtggtggctggcctaggaagatgtcatcccnatttccatctcctctcagtgtgtcctacatatgtgcacaaaccagcgacgtgatgatgaa

SEQ ID NO: 24869 - DNA, 121 bp, Artificial Sequence
  Synthesized
  misc_feature (61): n=t or c
gttcataattaagtagtttggccccaaacagaccctgttaagagatcaccctctgcaaatntaacaaaagacgaacccagaaaatgaacaaatctacaatctgagcttttgaaaagaaaac

SEQ ID NO: 24870 - DNA, 121 bp, Artificial Sequence
  Synthesized
  misc_feature (61): n=a or g
gagctgctgctgcactcggtcctcatggtcacctccatgcaataagctccctcattaaganttgtacctttgttttccccttcctcatcccactgtttatgagccctattaatctgcatga

SEQ ID NO: 24871 - DNA, 121 bp, Artificial Sequence
  Synthesized
  misc_feature (61): n=t or c
aatgatcctttttgttatgtaagatatgctttacaatatcactgcatagtgacaactcctngtcctcctgtcacatcctgtcccttagactatactgcagaaaagcaattttctgcctcaa

SEQ ID NO: 24872 - DNA, 121 bp, Artificial Sequence
  Synthesized
  misc_feature (61): n=t or c
agaaaactccaacagagaaataaaaatcctgcagttcaactactccaattaaaagaagttngtagttattccagcaacatgtcaacctcctgcatgcttgctttttttgttgaaggtgagt

SEQ ID NO: 24873 - DNA, 121 bp, Artificial Sequence
  Synthesized
  misc_feature (61): n=t or c
ggaacaagaactggtgagaataaaaataaaggaatgtttattgctgtactgctcaaaacangttacctcctgagacttttgttcctcagtatcttgagaagaagacttgaaaaacaccaac

SEQ ID NO: 24874 - DNA, 121 bp, Artificial Sequence
  Synthesized
  misc_feature (61): n=t or c
aggcagaaaatcacatcgtgattgagagcagtgcaatagatggtgctttctaacagcttgnagctttacaactgccagcgctgtgaggtctttagttcagactgcccacacacacgaaaga

SEQ ID NO: 24875 - DNA, 121 bp, Artificial Sequence
  Synthesized
  misc_feature (61): n=a or t
caatctagcatgctgcaagcctaggtgtgagtggggagtctttacagttctagttgcaggnattaaaactgcctaactattggccctgagttgaacacaaataacagggtacttattgatc

SEQ ID NO: 24876 - DNA, 121 bp, Artificial Sequence
  Synthesized
  misc_feature (61): n=a or c
tgtttgtttgtttgtttgtttgtttggctctatctacctgcttattttcatgaaacttgcnatacaatccacttgaatcttccatctctcttccaaaataagacaagggcgtgcactataa

SEQ ID NO: 24877 - DNA, 121 bp, Artificial Sequence
  Synthesized
  misc_feature (61): n=a or g
ggtcccacggtgcctgtgcggtgccatgaatcagagcacagcgttaagggagggcacagcncaaccttttggggcagtaaaacggtaggaataggcgcgaatcggttttgtgcgcttgaga

SEQ ID NO: 24878 - DNA, 121 bp, Artificial Sequence
  Synthesized
  misc_feature (61): n=a or g
agctgatcctcagggtaaacctaatccctccacatttccaaagtcagagtatctaatcccntaacaccccacactattgtcatttcagactcccagataaatgccagcgcaccaaactgtc

SEQ ID NO: 24879 - DNA, 121 bp, Artificial Sequence
  Synthesized
  misc_feature (61): n=a or g
tctcttctcttgctgataacatcaatgccatggatgagaagaacaaggtgacttctatgantttaatctagtgctttgcaaaacgacaccttaaaacaatttatcttgtagtactattcta

SEQ ID NO: 24880 - DNA, 121 bp, Artificial Sequence
  Synthesized
  misc_feature (61): n=a or g
attgcttgttcactctgtgcccaacggcacagccaagtgcagccattgggtgtttgtagcngtttggcccacacggacctgaaccaaagcctcctgacatcactggggtgatccctctgag

SEQ ID NO: 24881 - DNA, 121 bp, Artificial Sequence
  Synthesized
  misc_feature (61): n=t or c
actaggcagcatcactgaaagaggcagtcagtaagtgctatcagatagactttgacagctnaaaatctcaccctgtgctgtataatggtgaacacactctgagacgaggtccttcccaatg

SEQ ID NO: 24882 - DNA, 121 bp, Artificial Sequence
  Synthesized
  misc_feature (61): n=t or c
gaatacatccagcatacccataaaacacgagtaagaaagtcaaagcacacatttgccaagnggttctgctaagccaaaaccagctttcatcggaaagaagttgcaaaaagacaagctttgg

SEQ ID NO: 24883 - DNA, 121 bp, Artificial Sequence
  Synthesized
  misc_feature (61): n=a or g
tgtgcttggaaacaaaatggattcttcaagaggggcaatactccacctgaaaataggcctnaaatgtgaacgtgcaggtattcactcaaagcacaagctgtgaatcttgctgtgatttcag

SEQ ID NO: 24884 - DNA, 121 bp, Artificial Sequence
  Synthesized
  misc_feature (61): n=t or c
acgtctcttctatttatttagcattaattttatttatgctatttaatgctttccagcttgngcatacctctgagtgtcaccatgaacgtatgtacataagaagcacatgctgtcagcttcc

SEQ ID NO: 24885 - DNA, 121 bp, Artificial Sequence
  Synthesized
  misc_feature (61): n=a or c
agacaaaatgaagcattagaagaatgttaatctcatagtgattctccaaataaatggcctncttacaattgatctgaagccaagcaacaaaatcatttgaatttgtgaggggctttatttt

SEQ ID NO: 24886 - DNA, 121 bp, Artificial Sequence
  Synthesized
  misc_feature (61): n=t or c
tacagaagcctgctaactagcctttaactgttggagattatattctatttcttgataggangctatacacagtagaaatttttacatcatttaagagtagaaacctttttctactacacat

SEQ ID NO: 24887 - DNA, 121 bp, Artificial Sequence
  Synthesized
  misc_feature (61): n=t or c
gcattcagaggtaaagatgtctccttcctatggtgattgtctggtgtaaaaaaacaaatgntcctattggaacaaaagcagctgtagtttgttttagattgaaaaagaaagaaagaaaaca

SEQ ID NO: 24888 - DNA, 121 bp, Artificial Sequence
  Synthesized
  misc_feature (61): n=a or g
taagtttttccacaaatgtatgttccttttccatcagaacttcagtaggtgtccatccatngcaaacacccaacaggacagcagggaatgctgacaagggggatggagcaagttgcatgtt

SEQ ID NO: 24889 - DNA, 121 bp, Artificial Sequence
  Synthesized
  misc_feature (61): n=a or g
ccctgtgtggtccactgaggagggacaaggacttgggtggtgctcaggtctccaggatatntctggggtcccttaggatgacagacacgaatagtcagactcctgaaggaattagggtccc

SEQ ID NO: 24890 - DNA, 121 bp, Artificial Sequence
  Synthesized
  misc_feature (61): n=a or t
attagcactttgagtataatactctccagatgatacagaaatggttctgaagggcatcagnctcatctctgcctgcaatttggatgggaactccatgcatggctatgtcaaaggtttcaaa

SEQ ID NO: 24891 - DNA, 121 bp, Artificial Sequence
  Synthesized
  misc_feature (61): n=t or c
cagtggaataattcaggaagtaatctgaaactcctttcctatcaccaaacctcacgtactngttcaggtatcacgtattcctgagactcgacacaaaaccaaaactgaaatcctatcagga

SEQ ID NO: 24892 - DNA, 121 bp, Artificial Sequence
  Synthesized
  misc_feature (61): n=a or t
cattgggcagcactgagcagccgctcgtttaggtgaaaatggaaatgatgatttcagcacngagaggatttttgaggagtgcctgcatgacctgtgggtggaaaacccattcagaggtggg

SEQ ID NO: 24893 - DNA, 121 bp, Artificial Sequence
  Synthesized
  misc_feature (61): n=t or g
ttcatactctcaaagctaaagtgggttatttcttacagttctccatacaatagcaattatnttctggataaaacatttctctgagtaacatggaaaaaataatcaataaagcagaatttat

SEQ ID NO: 24894 - DNA, 121 bp, Artificial Sequence
  Synthesized
  misc_feature (61): n=t or g
tccctgtatatgacttcaactacaggcagacttaggttgatcaagatatggatgaaaaggncttagttttgagaaggccttatcactgaaactaaatcagtacaagattactgttgggatt

SEQ ID NO: 24895 - DNA, 121 bp, Artificial Sequence
  Synthesized
  misc_feature (61): n=a or c
tgttttgagataaatatgaattctgaagattaccacagtagcttttcttttgtcctacagntctagattaaactttctgctggcttttttacaggatgagtaacagagaagttccttcagg

SEQ ID NO: 24896 - DNA, 121 bp, Artificial Sequence
  Synthesized
  misc_feature (61): n=t or c
agaaccatagcctacaagctatagaacagggcttccccatatgccttgtccaggaaggacngggcagctggtggagcaaaacactgcttgggatgctggaactgtgctcatcctctgctag

SEQ ID NO: 24897 - DNA, 121 bp, Artificial Sequence
  Synthesized
  misc_feature (61): n=a or g
cagccaccccgggctcaactggagcaactggtgctcgctggggcttaacagagctgaaatntgatgcccacctgagctggatagggataaggctgaggtacttaatgccttctttgcctca

SEQ ID NO: 24898 - DNA, 121 bp, Artificial Sequence
  Synthesized
  misc_feature (61): n=t or c
ctaggatgctaagggcctttcttagctcccatacagcagactactgcactttttcttatgncagtcatggaactgcaataccatgggaacacttagacctacagtgttttacagtggggtg

SEQ ID NO: 24899 - DNA, 121 bp, Artificial Sequence
  Synthesized
  misc_feature (61): n=a or c
tttcagaattaaccaacgccttaaaatgtgtgtgtgtatttagttttcaggaagccaagcnaaacctactttaacattgtctaactgtaatttcagacagcaacatactctttcttcatag

SEQ ID NO: 24900 - DNA, 121 bp, Artificial Sequence
  Synthesized
  misc_feature (61): n=a or g
atatgccttgatttcttaatcacatgttatggaatgattgcaatttccctcaatctccccntgcctccagggaaatatagcgaggccgatctctggcagctgtctttcctaatcccctgtg

SEQ ID NO: 24901 - DNA, 121 bp, Artificial Sequence
  Synthesized
  misc_feature (61): n=t or c
catgttcacgtactgtggataccacagggcacattccttgagccggtaaaaacacagagantcaatggcagggctgctgcctcccaccctgccccagccagcagccacactgtgctgccag

SEQ ID NO: 24902 - DNA, 121 bp, Artificial Sequence
  Synthesized
  misc_feature (61): n=a or g
ttgcctgtagtgaacaaagtattgcttatggtctgaggtcagaatctggtgcaacggaacngtgacattccagcagatttgagataaatgattccattccagcgagcgctgcatgcggctc

SEQ ID NO: 24903 - DNA, 121 bp, Artificial Sequence
  Synthesized
  misc_feature (61): n=t or c
aattttcaaatatatatttaagattaaaatattgagcacgtccagttgactttagaaaaantaggagcttcatgaaaaaaaatgtaactggatttattccttgttgcaatattgatctgaa

SEQ ID NO: 24904 - DNA, 121 bp, Artificial Sequence
  Synthesized
  misc_feature (61): n=c or g
tatgtatgtacatacatgtagacatacaaatgtacatatgcacatactgtattctgcaaancagtacaggtgaggtcttgtaccagcagcactccccagatcagtctgtttttattgacat

SEQ ID NO: 24905 - DNA, 121 bp, Artificial Sequence
  Synthesized
  misc_feature (61): n=a or g
gaaagcaactggaagtgggatgaggatggggataggatgagagcacggtggtgtgaagcanttggatggaggcatggtgggatggagatgcgggggaatgaatgcagtggggtgaggatgt

SEQ ID NO: 24906 - DNA, 121 bp, Artificial Sequence
  Synthesized
  misc_feature (61): n=t or c
agaaaagtggagctgggagaggggtgagacaagatttgcgttacgtacaggcagttctgtngtcacagaggtgaaggatccaacgtattgctccaccacaggctgcccaacactagactgg

SEQ ID NO: 24907 - DNA, 121 bp, Artificial Sequence
  Synthesized
  misc_feature (61): n=c or g
ttaaaaacaaagttatgttagaggtgtctgcttcctctactctttgtccgagggcttgaanaaggcagcctgggagcaattgcttttgttttttaaaatagtcattcttaaataatacagc

SEQ ID NO: 24908 - DNA, 121 bp, Artificial Sequence
  Synthesized
  misc_feature (61): n=c or g
cctctggataacaataaaatattggcctgttaaattgtgatctgtgttgttctttgatganattgctgctttgagctactgaaagagtgtctttaattctcctgccctggagattgtgttt

SEQ ID NO: 24909 - DNA, 121 bp, Artificial Sequence
  Synthesized
  misc_feature (61): n=a or g
aacaaagtatatgtggtgtcagagagcttaattcatactcagactgcaaaaagcagtgtancgttccttatctttacattttaaaggctcaacttgcttaaaacttgcgttccagaacttg

SEQ ID NO: 24910 - DNA, 121 bp, Artificial Sequence
  Synthesized
  misc_feature (61): n=a or g
ttgacaaccctaaaaggaaaggtacaatagcccacagaaaatcttcccagctgaacctgcntgactcagtgctctgactctcaatgctggatagtcagctgcctctcttacatgcttttga

SEQ ID NO: 24911 - DNA, 121 bp, Artificial Sequence
  Synthesized
  misc_feature (61): n=t or g
tcagtatatctgtcaagtcatctgtaaacatttcactgcctgaagtgattagcacactgangaaacacaatgtcagtatctgtcttatggacaaatttatcttcatctgcattaatttaaa

SEQ ID NO: 24912 - DNA, 121 bp, Artificial Sequence
  Synthesized
  misc_feature (61): n=t or g
ataataagagtctagtatgtatgttgagcgttgcttccataataatttcaaatactcggtnttgccaattgccttttaggtaggggttatatttatagtttaattttacaagttgtaattt

SEQ ID NO: 24913 - DNA, 121 bp, Artificial Sequence
  Synthesized
  misc_feature (61): n=a or g
tttagttaataaggaaatctgttttcttctgtttgtgtcaaggccaactgatttttcaganaactcaaatatatctcttcattgttccgaaatccaggtcctccaatgctttttctttgta

SEQ ID NO: 24914 - DNA, 121 bp, Artificial Sequence
  Synthesized
  misc_feature (61): n=a or g
accatgtctaaagaaagccaattaactggtattgattattggttggtggtagggatgagtngttcgaggtacaggagaaggctttcacatccttttagttcctcaggcaaatctatgcttg

SEQ ID NO: 24915 - DNA, 121 bp, Artificial Sequence
  Synthesized
  misc_feature (61): n=t or c
tgtgtggttgtttggctgtagtaggtgatatcttggcaaagctaatgggatctttcccccngtatttctgctcacacatcctgttcatcctatcctgcaaacccattctgttcagtttatt

SEQ ID NO: 24916 - DNA, 121 bp, Artificial Sequence
  Synthesized
  misc_feature (61): n=a or g
gtaagcactattaagaagccaggatctctttcagtctctaggagcaagctgattaagtcantaatcagtaacttcaatcactgatccaagcgactgcagttgcaattcaaactgttcctca

SEQ ID NO: 24917 - DNA, 121 bp, Artificial Sequence
  Synthesized
  misc_feature (61): n=t or c
tcactgtattgaggtacaaaggtggaaagttcctgctgtagttgagagacggtagcagtancattacactaacacgaggcaacagacctgatacggagatgcggatcagcatcatagcaga

SEQ ID NO: 24918 - DNA, 121 bp, Artificial Sequence
  Synthesized
  misc_feature (61): n=a or g
tgacaggaagggaacggcgtttctattacttgatctcagatgtgatacagattacttgatncagacattattcccttcttagaactcagaggaaggaatgcaggacaaatgtggatcacct

SEQ ID NO: 24919 - DNA, 121 bp, Artificial Sequence
  Synthesized
  misc_feature (61): n=a or g
aaggcagtaattggtatgaagagcaagggttagaggagaagggcctgattcacaaacctcngcagggaacttttcctacttgattttggaaaactctccataggcttcaaccaacagcgct

SEQ ID NO: 24920 - DNA, 121 bp, Artificial Sequence
  Synthesized
  misc_feature (61): n=a or g
tatatttttcatctgctaaaaaaagaaaaaaaaaatgtgttatcactcttctgtttatgcngtcagagtcaatggaaagagtaaaaaggacaggaaggagaatcaggatgatcagacatct

SEQ ID NO: 24921 - DNA, 121 bp, Artificial Sequence
  Synthesized
  misc_feature (61): n=t or c
gttttgtatacctgctgagatgaaccccaaatacctgctgctttagaatcataactgagcngatgagtgcactgttcagttttgttgtgtctgctttgggtatttgctttttgtttgcttg

SEQ ID NO: 24922 - DNA, 121 bp, Artificial Sequence
  Synthesized
  misc_feature (61): n=t or g
ataagcattgtcatactaaaagaaccactcttgttcctgcactgaccttactggaactgcngggtcacgaagggcaaaaatctgtatctaaggcacagtgttggcaagcagctaaaaatac

SEQ ID NO: 24923 - DNA, 121 bp, Artificial Sequence
  Synthesized
  misc_feature (61): n=a or g
ggaaaaaaaaaaaaaagaactgtgagggaacaggtggtcctttctgcacgctgaactccanagggtgcaggattgaagttctgcgttcagtttaaacatgctggtacggacagtgcccatg

SEQ ID NO: 24924 - DNA, 121 bp, Artificial Sequence
  Synthesized
  misc_feature (61): n=t or c
aatcagcagacatgctgtgcaagtgaaagatgtcatatccccccaccaaaaggcagaaatnggtagttctccttgctcagcttcttgtgaagaaactttctcctacagtgggactgcagct

SEQ ID NO: 24925 - DNA, 121 bp, Artificial Sequence
  Synthesized
  misc_feature (61): n=a or g
tgcagcactgaaagccattaactcctcacattcatcatcctgcacaatagctagctttcgngaagctgcagataactcaccagatactgcaaaacctgctgtctggatttagatgtctgtc

SEQ ID NO: 24926 - DNA, 121 bp, Artificial Sequence
  Synthesized
  misc_feature (61): n=t or c
aaagggcaaaataagtccaacagccttatgtgttctgcagtgtgggaaattaaaccgtgcngaaaaaaacacaagaggccacaggctgagaaaggatccctggacagccgctgcgcagctt

SEQ ID NO: 24927 - DNA, 121 bp, Artificial Sequence
  Synthesized
  misc_feature (61): n=t or c
cagcatttgtggctggcacaagatttaagtacggttatgtatatatgacatatttatgtanagttatagatggccatgtctttaggttaaagaagttcttttagtgcctgcagctgaaaat

SEQ ID NO: 24928 - DNA, 121 bp, Artificial Sequence
  Synthesized
  misc_feature (61): n=a or g
cttatcatatagtcaaggtcaagcatgcattgctgtgctgctctgggacagtgcctgaacnaccaagaaaagacaaggaagttttcaggagagtacatgtgagaccattactgtgactgaa

SEQ ID NO: 24929 - DNA, 121 bp, Artificial Sequence
  Synthesized
  misc_feature (61): n=a or g
ctttatcctctccttgcacgccacatcctcctgtccactgaccaccttagtggctctccanctcactcgagtgttttagtttattttttgtaccagggatcctacaactgagcacaatgct

SEQ ID NO: 24930 - DNA, 121 bp, Artificial Sequence
  Synthesized
  misc_feature (61): n=t or c
ctctaatccatttcccacattggtctgacagagtttgagatggttgcacttgaggccacantgcaagacccatctattattctgccttttgccagagactgatttgaaggggtgtgaattt

SEQ ID NO: 24931 - DNA, 121 bp, Artificial Sequence
  Synthesized
  misc_feature (61): n=c or g
gctgggaatggtcatcaccccgcttcccacagcccttctgtggtgctgccctgctgcatcnctttgccctacaccttcccattagaggaaccatccagttctgtgtataaagcaagccttc

SEQ ID NO: 24932 - DNA, 121 bp, Artificial Sequence
  Synthesized
  misc_feature (61): n=a or g
gcaattactccaactttatttccagacctaactgcaaggggtgctctatagtccatagaangagatttaaaaaaactcagaggtgactcatcccagctgcataggctacttctatcagtct

SEQ ID NO: 24933 - DNA, 121 bp, Artificial Sequence
  Synthesized
  misc_feature (61): n=a or g
tggaggtacagaatgagtcagtgctagccaatgggaaaagtggctgatccatcctagaggngaatgaaattggccatgtgtagcagaaatgctgagttatggcttgaaacagtaattgagc

SEQ ID NO: 24934 - DNA, 121 bp, Artificial Sequence
  Synthesized
  misc_feature (61): n=a or c
ctttcaggtagcatcagaatgccattgtgttaagctttatacaaggcctccatgtgcagtntttctgagcaattaaactacgtaatagttattcttataaccatcagtttttataaaattc

SEQ ID NO: 24935 - DNA, 121 bp, Artificial Sequence
  Synthesized
  misc_feature (61): n=t or c
gaaaaaaacttaaagtggcttaaaattctctatgattctaaggacaatattacatagtacnacttttcttcagctaacgtgttttagttcaagtgaaaatatgttgatagtctacttgggt

SEQ ID NO: 24936 - DNA, 121 bp, Artificial Sequence
  Synthesized
  misc_feature (61): n=a or g
attgtcttgtaaggatgcatgctgcattgtgatttagatgtaacactaaaaatcaaaaganaagtgttaatgaaccttctgatgtcttactgcctttctacaatttttaatcagcaaaatc

SEQ ID NO: 24937 - DNA, 121 bp, Artificial Sequence
  Synthesized
  misc_feature (61): n=c or g
tgggacaattttgtctgaatctaataatagccagaggtggtggacggcacaaaagaaaaancaggtcgtgtgcttttagctagccagctaattctgagctctgcagccatcagcgggaagg

SEQ ID NO: 24938 - DNA, 121 bp, Artificial Sequence
  Synthesized
  misc_feature (61): n=t or c
ggcttgaaaggctcctgtcacacttcccttcgtgtgtgctttgaatttatagctcctcatngcctgaagaatccctctgagctaggaaatatatgagaaaaggagatggtgcctccctcca

SEQ ID NO: 24939 - DNA, 121 bp, Artificial Sequence
  Synthesized
  misc_feature (61): n=a or g
gctcaagcagagactctatgtaacaacatgcagtggattaaaaagggagtgtttgcataangggatgttcaggttacaaaaaaggaatggatatttcggagggagcgttccattataggag

SEQ ID NO: 24940 - DNA, 121 bp, Artificial Sequence
  Synthesized
  misc_feature (61): n=t or c
aggtgccttgggactgcaaagagcgtctatgtgctgggagctgttgtctgggggaaacaangcagagagcctcaagatctaagggacaggccagcggggtcttcccatgccatgctctgcc

SEQ ID NO: 24941 - DNA, 121 bp, Artificial Sequence
  Synthesized
  misc_feature (61): n=a or t
accatagttcaaagattatttggtgcctctttgtgccaaaataattagccttcagctcctngaagttgccaaaagtttccaaagggaaaaccctgttcttgtaaacctccagtttgagatt

SEQ ID NO: 24942 - DNA, 121 bp, Artificial Sequence
  Synthesized
  misc_feature (61): n=t or g
tcctcttgcacgataaggaaaaagaattcaacctgtgactgtcattggtacccactgtggnacacgatagcaatgaagataatagatttgaccagagtgcactgtgattttgaacagaaat

SEQ ID NO: 24943 - DNA, 121 bp, Artificial Sequence
  Synthesized
  misc_feature (61): n=a or g
ctgtgctggaatccaaccacgctccaatctagctagacaaaggtatttttcaaattcattntacaacttaattatggtttgtgcttgttatcaggcaaagttaaaaatatatatatacaaa

SEQ ID NO: 24944 - DNA, 121 bp, Artificial Sequence
  Synthesized
  misc_feature (61): n=a or g
agagcagagtccagaggcagttaacccagagccacttacaaaagataaatctgttgaaagncagtatttccttaaatcaaagagcttgcgggagggttttctctttaggaaaaagatccat

SEQ ID NO: 24945 - DNA, 121 bp, Artificial Sequence
  Synthesized
  misc_feature (61): n=t or c
taccagtaggcaggtgtaggacctgtaagcagttaattgccagggctctgcagatgtcgangatttcttctgagacgtctgcagctcatattatctgatagtagctcattcagttgatgaa

SEQ ID NO: 24946 - DNA, 121 bp, Artificial Sequence
  Synthesized
  misc_feature (61): n=t or g
ggctacaagcaacaaagtacaagtgttacagggcctctcagggagaaagaacaaagctaancaaagactcacagctttaacacaaagagaacctgccccttcaaaagctgaagtctgcaat

SEQ ID NO: 24947 - DNA, 121 bp, Artificial Sequence
  Synthesized
  misc_feature (61): n=t or c
aaagtcagcgatctgagcatgaggggctgagccaggttttagaggcataagagtgaaacgngtctgccatttaaagccctttcaaagacattctgcaccttctgtgtatatctgaatcaga

SEQ ID NO: 24948 - DNA, 121 bp, Artificial Sequence
  Synthesized
  misc_feature (61): n=t or g
aaacccccaccattttgcagctaacccaatgtaaattcaaaagtctatcaatgtggaaatntatattgttcaaaatctattcggtctttattcacataggaggtaaaggcaatctgaatgg

SEQ ID NO: 24949 - DNA, 121 bp, Artificial Sequence
  Synthesized
  misc_feature (61): n=a or g
agtcaatcacagttaaagttggtcttcctcagctttgaggctggatgagcactacacaagnccctggtgtgaccacaaccccaccagtaaaagcaggcactaagcatcacctagcatctgc

SEQ ID NO: 24950 - DNA, 121 bp, Artificial Sequence
  Synthesized
  misc_feature (61): n=a or g
tatctatttctctcatgatctatgacaatggctatgcacagtggttttcagggtatatctntagtttgtgccatcacagtcttgcagacagttccttctggttcgctggcgcactgtattt

SEQ ID NO: 24951 - DNA, 121 bp, Artificial Sequence
  Synthesized
  misc_feature (61): n=t or c
ctttctgtttgcctctattttgtactatttcaaggttctttagtattagaagcagtgctcnttttagcatacttttgtacgatagttcattttctattgtatatatgctttacatacatac

SEQ ID NO: 24952 - DNA, 121 bp, Artificial Sequence
  Synthesized
  misc_feature (61): n=c or g
aattagcctggttctaaagttagatggtttgatggtctggaatgtctttttccacaaagantacaagtacccatgaggcatgttaaactttaattgaaagagcttatcaatgagtgacagc

SEQ ID NO: 24953 - DNA, 121 bp, Artificial Sequence
  Synthesized
  misc_feature (61): n=a or g
cacatactgaagttgtcctcattccgatccgtttgaacattacctgtaacatagcagcacnaaaatgcaactagagtttgaacagctggggttttgttggtgggtgctggttttgcctttt

SEQ ID NO: 24954 - DNA, 121 bp, Artificial Sequence
  Synthesized
  misc_feature (61): n=a or g
ggggaacctcatccatgtacctgaagcttcgaattagatggatagagccaggctcttttcngtaagtgcccagtgagaggacaagatataaaatgggagcaaactgaaacacagaaatttc

SEQ ID NO: 24955 - DNA, 121 bp, Artificial Sequence
  Synthesized
  misc_feature (61): n=a or g
tcaggggcaatgctgacacaacagctctctcaattcccactcacaggctgtttttaaaagnaggcagctgctaccagctgcaaaatgagacctagatggtggccaagtaacaggacatcgc

SEQ ID NO: 24956 - DNA, 121 bp, Artificial Sequence
  Synthesized
  misc_feature (61): n=a or t
agcttttcattggtctgtttatccccacagttgcaattttcctgtgctaagttaatgctgngcaatgttttcccttattgaatgaaatttctgtattgggaggaaaaaataatcaataaag

SEQ ID NO: 24957 - DNA, 121 bp, Artificial Sequence
  Synthesized
  misc_feature (61): n=a or c
tgcctggtataacataattgagtcaaattcaatggtgtggtctccaaagatgctttttctnaatagccttgtaacgaaatggacacagctgcaaaagatgctgttttacagtatcaactgt

SEQ ID NO: 24958 - DNA, 121 bp, Artificial Sequence
  Synthesized
  misc_feature (61): n=t or c
gtcattgctagcatcccctacaccaatccatccctacaccttttctcagccctgagggcantgcacagcagtccttcccttagccccacattctgtcctctcaccaaccttacgcaaagtc

SEQ ID NO: 24959 - DNA, 121 bp, Artificial Sequence
  Synthesized
  misc_feature (61): n=c or g
aaggcattaaaaaaaaaaaaaaaaaaaaaaagcatgggttggactaaatcatctagcaganctctcttctctgttatcaaaacagagctgttttttcctaagggatgatactgcaggtgat

SEQ ID NO: 24960 - DNA, 121 bp, Artificial Sequence
  Synthesized
  misc_feature (61): n=a or g
aatctcagcaaagggcatttacaactttgtaataaatgcaatttctcagaatccagctctnctgttgttcagtccccacagactcttggcaaggaaagggaagtgtcccatctctcacagt

SEQ ID NO: 24961 - DNA, 121 bp, Artificial Sequence
  Synthesized
  misc_feature (61): n=a or g
gcacactcaaatgcacacaatgaagtagaaggacaggaggttttcaaccctatttcttgcntgtcaaacccacacatccaacttatttttctggaagtaaagagaaagggacatgggttcc

SEQ ID NO: 24962 - DNA, 121 bp, Artificial Sequence
  Synthesized
  misc_feature (61): n=a or t
tacacagctgagccccactgtaaaacagaagttactggggttacatattaaaatatagaancataatacatcaaagaaaaggatacagcaaaataatgcgagagtctccttttccttgttc

SEQ ID NO: 24963 - DNA, 121 bp, Artificial Sequence
  Synthesized
  misc_feature (61): n=t or c
ctgactgtgtgaagtagaggaacttgcagaaaatgtaattgcgaatatttaaaggagattnttaagatgaactgatgcaagattgagataaatgaaacttgtaatatcagatgcttgtgaa

SEQ ID NO: 24964 - DNA, 121 bp, Artificial Sequence
  Synthesized
  misc_feature (61): n=t or c
gtccatctacaatgaaacaccaatacttccagttttgtttttaggagggtgagccttctgncagcaaatccccactggcatcaactgatccatggcttgacttcaccaagcactttgacac

SEQ ID NO: 24965 - DNA, 121 bp, Artificial Sequence
  Synthesized
  misc_feature (61): n=a or t
gaatgaattcttgagttttcactatgttattaatacataaatatattaatatttaaggctnctgtatatataaagcacctgtaactggagatggcatggacatgcagtcagatctcagcct

SEQ ID NO: 24966 - DNA, 121 bp, Artificial Sequence
  Synthesized
  misc_feature (61): n=t or c
aatgtggtctttttatcccataaaactttcaggccaacaccttactccttgtttgccccantagcatttttagcccatattgagcctgacttgatcatttctcttttttttttttttcctc

SEQ ID NO: 24967 - DNA, 121 bp, Artificial Sequence
  Synthesized
  misc_feature (61): n=t or c
gccctcattcctctccccaaacaagttgacttcaggtcattaataggattttatttgcgancttgtgtagaaagtctcacagccctgggagaaagaaatgtagctgcagtggcagggttgg

SEQ ID NO: 24968 - DNA, 121 bp, Artificial Sequence
  Synthesized
  misc_feature (61): n=t or c
atggtgactcatgagagggtccctgcccttttttgagctcccccactgagactttcatcanagacatacacaaccatctgtatagtaaagccttccttcttcttggttcacaaattcccat

SEQ ID NO: 24969 - DNA, 121 bp, Artificial Sequence
  Synthesized
  misc_feature (61): n=t or c
tagatcatcgaatcaatctctgaaatagaccaacaataagcatgttgacatgcaacaacanagggcattcacaaagttaacaattcagctatctatcacaagtttaactgaacacgtacaa

SEQ ID NO: 24970 - DNA, 121 bp, Artificial Sequence
  Synthesized
  misc_feature (61): n=t or g
cagaacacttgaataaagaaccagagttagtaacaagaagaaaggcagacccggtcaactnctgctgcgggtggtcctttcaaagtaagcacctcctctctgagaaataccccaaataatc

SEQ ID NO: 24971 - DNA, 121 bp, Artificial Sequence
  Synthesized
  misc_feature (61): n=t or c
tttgtaggcattgtttgcaacacgggtggctgataaaaataattgtttcatttcagtgttncagctctctttcagaattgtgtattgaaactgtattcaactgaagaaatggtaagttacc

SEQ ID NO: 24972 - DNA, 121 bp, Artificial Sequence
  Synthesized
  misc_feature (61): n=t or c
aaagtgcataattctcatattaactattccctggaaacttcaactccttcttcattatccnataagcagtaatccccatcacagattttatgcaagcaaataaaacctctgagcatctgca

SEQ ID NO: 24973 - DNA, 121 bp, Artificial Sequence
  Synthesized
  misc_feature (61): n=t or c
ggactaacagccacaaggatgagacctccacctccagctcccatttcaggtttaagccttncctactttaaaccttagcctgaaaaacattctaagaaatattgctgttaattctcagctt

SEQ ID NO: 24974 - DNA, 121 bp, Artificial Sequence
  Synthesized
  misc_feature (61): n=t or c
aaacattacttgctcactaatccatcatcacattgctaacagatctagcttaatcacattnacaatcgtagtttttttgattacacaaattattagtcaagtctcgtttcatttagtctct

SEQ ID NO: 24975 - DNA, 121 bp, Artificial Sequence
  Synthesized
  misc_feature (61): n=a or g
ctgactgcaaatgggacacggggatctctctgattcacgcttaatttgctatcacaatgcntggttacacttatgccttgaaggctagcagtacctatggcagtaaaaatctcaggactag

SEQ ID NO: 24976 - DNA, 121 bp, Artificial Sequence
  Synthesized
  misc_feature (61): n=a or g
ctgagtgacagacatgagagaccctgagtttattaagctgaggccaggaggtgttactgcnctacatttcatcattttctataatgcctattgtgtgccatatatctatgctgctcaaatc

SEQ ID NO: 24977 - DNA, 121 bp, Artificial Sequence
  Synthesized
  misc_feature (61): n=t or c
tggtgggctgtccacgctgtaccaccttgcatttggtggaatggcaaagcaaatccctggntagctgtgattgggtttgttaggtcagatataatgccacagaaacaaacctaacctggct

SEQ ID NO: 24978 - DNA, 121 bp, Artificial Sequence
  Synthesized
  misc_feature (61): n=t or c
ctctcacacttcaggcagcatttcttgttcagcaagttggtgatgcagaattgtacatttncaatggcactttgtgtgttattagcaattctatgtctatataattgtgtaagaattgcta

SEQ ID NO: 24979 - DNA, 121 bp, Artificial Sequence
  Synthesized
  misc_feature (61): n=a or g
tcataaaaaagaaaaaagtaattaaaatctcaagtgaataatatcactctcctttacctcnctcttagttttcaatggcaaaatgtgttccaattcattttaagttgtagtttcaaaaagg

SEQ ID NO: 24980 - DNA, 121 bp, Artificial Sequence
  Synthesized
  misc_feature (61): n=t or c
ggacacaactcgggcaaggaggagagctcagtatgaatgagcccagtaatgaggaaaatcngctgtgggacaacaccatagttctcattttcagtgtttgcaaaaatcccttgagtgccaa

SEQ ID NO: 24981 - DNA, 121 bp, Artificial Sequence
  Synthesized
  misc_feature (61): n=a or g
acaaagatcaggacaaaacacagccctagagctagtgatgtaagtcacttctttccaacangtgttcagaagccatttctccatgaaacacacagataacaacaacagatgacactagatg

SEQ ID NO: 24982 - DNA, 121 bp, Artificial Sequence
  Synthesized
  misc_feature (61): n=t or c
ctgaggtattttgagccttcacgggagcagaaagaatggaagggtgtgaaacagcccttcntcaggagatctgcaggttgatttttcaagttgaagaagcccagatctgactccaaataga

SEQ ID NO: 24983 - DNA, 121 bp, Artificial Sequence
  Synthesized
  misc_feature (61): n=a or g
ggacacctctcaccaatggcagaggtgctgatctccccctctgagggatccacacaggaanaactatccttcctcaaggcattctgggacaagcttggccttacccacattacttcacaag

SEQ ID NO: 24984 - DNA, 121 bp, Artificial Sequence
  Synthesized
  misc_feature (61): n=a or c
tgactaaacaacttgctttctaccttagtgttatcactgcattaataaagaaaagattgtnttgtcctctttgttgctgaggagcaattgctttacaatactggaaagcataaagtgttgg

SEQ ID NO: 24985 - DNA, 121 bp, Artificial Sequence
  Synthesized
  misc_feature (61): n=a or c
acgtaattgagccataattcacagttactggtaagaaagcgtgggacacagtatgagcagnagcactggaactttatattacagctatctccaggggagattatttttattaaaatctggg

SEQ ID NO: 24986 - DNA, 121 bp, Artificial Sequence
  Synthesized
  misc_feature (61): n=a or c
gtggagcatcagcagtcagcacacagaagtcctctgtttgaaaaggggcgggcaaacctcngaaacttttagacttggccatttgtccaccaacacctgaaccattcttttttcttccata

SEQ ID NO: 24987 - DNA, 121 bp, Artificial Sequence
  Synthesized
  misc_feature (61): n=t or c
ggtgaaggcaggaggctcctgtgtgtggcatccaagggagacttttcacctttggatattntgttggtttttctgaaaaccacacgagcaggcagctcattttctgttggcagtgattctg

SEQ ID NO: 24988 - DNA, 121 bp, Artificial Sequence
  Synthesized
  misc_feature (61): n=t or c
tggatgcagcatgtttttacatttctgtgaagagtgaatgactcctgcttgtaaatctttntgacagggtactgcctgttgcagtggatacagccctgaatatcacagcacaccatccaaa

SEQ ID NO: 24989 - DNA, 121 bp, Artificial Sequence
  Synthesized
  misc_feature (61): n=a or g
agtttctccccacccgaactgcacagctgcagtgtctataggagtgtctattcaggagccntgcagttagatctgatgcttctgcatttttgtcagctcaggtgttctcttggtgtcctgt

SEQ ID NO: 24990 - DNA, 121 bp, Artificial Sequence
  Synthesized
  misc_feature (61): n=a or g
ataatagggctgtcatggaataaagaagattttttcaaagagctgaatgtgcatcagtccnggctgttaattcctctggtctttcactctgctttccttatgttcaaagtgagagctgaac

SEQ ID NO: 24991 - DNA, 121 bp, Artificial Sequence
  Synthesized
  misc_feature (61): n=a or g
ctcttgagcaaccttagcccagcagagagctggatctataccagaccctcacttgtgcagntcctaccaccatttttggctggatttgcaaagatctaagtttgaattctatttgtaaaat

SEQ ID NO: 24992 - DNA, 121 bp, Artificial Sequence
  Synthesized
  misc_feature (61): n=a or g
tcctgctaaataattatagtaaattaagttgagggtaggtaactcttgggtgtacgtgcangacttcatgtctttaattatcttctgacttcagaaatgtttccaaatgttagttcaatat

SEQ ID NO: 24993 - DNA, 121 bp, Artificial Sequence
  Synthesized
  misc_feature (61): n=t or g
cagacacaagtatggagctcacacattgtgggcatgtttaaaatctgaaccatctttgaanctgtttggatttgtcctgcattaaatgagaactgagcttcactgcatttagtgtacaggc

SEQ ID NO: 24994 - DNA, 121 bp, Artificial Sequence
  Synthesized
  misc_feature (61): n=t or c
tttgttcagtgattccttatcacccctcaacagctctgagatgctctgttaattttagttnggccctgatgcacaaaaatgactgtctctgggacttggtgcacctaatctgaatgccaga

SEQ ID NO: 24995 - DNA, 121 bp, Artificial Sequence
  Synthesized
  misc_feature (61): n=a or g
aagtggaaaaatgtattttagcagtttcttcatttcagtgctgatagcaacacctgacttngttctacatatacagctcttttatgctccaactctgccatgttggaagaagttattatag

SEQ ID NO: 24996 - DNA, 121 bp, Artificial Sequence
  Synthesized
  misc_feature (61): n=a or c
tgtaaaaagaattaagttatcttagtctgtctaagtatatgggaggaaaatttaccacttntgagaaatgaattaatttcctgaatacaagtctactgttatttatttttgcattatttaa

SEQ ID NO: 24997 - DNA, 121 bp, Artificial Sequence
  Synthesized
  misc_feature (61): n=t or c
tcagaggaaaactattgtgtgagggcccgtacaaatacagcgcgaggcgtaaggagctccnagtctgaaaagataagatggacacaaatggctggaaagcacagaatacaaaaacaaacaa

SEQ ID NO: 24998 - DNA, 121 bp, Artificial Sequence
  Synthesized
  misc_feature (61): n=t or g
gcagctcatcttcaagacagcgcagggctgtgtgtgacagaagagcctgtgctttcactgntaatacctttattattgtgtatctctgggtaattgcctatggatttacactctactggtt

SEQ ID NO: 24999 - DNA, 121 bp, Artificial Sequence
  Synthesized
  misc_feature (61): n=c or g
acaacaacatcaacccttgaggagatgttaatgggttaatgcagtgtggtttgagctttgnacttctgatgactgcggtgttctctggctgctctacgcactgtgtttggggatgcttttg

SEQ ID NO: 25000 - DNA, 121 bp, Artificial Sequence
  Synthesized
  misc_feature (61): n=t or c
ttcaggtgctgcacactcatagtttggcagctctctctgctgctgcacaggaatctctccnttccagagccaacaccaccacagccgtgccgggaagggctctgctaatgggtctcagctg

SEQ ID NO: 25001 - DNA, 121 bp, Artificial Sequence
  Synthesized
  misc_feature (61): n=a or g
tactaaagccttaaagttgtgttccttggttctgaaagggtaaaccgctagccaaaccaanatgaaaacaatatccttaaaggaacgctatacagtctgaatgcagaagcatcatgtttat

SEQ ID NO: 25002 - DNA, 121 bp, Artificial Sequence
  Synthesized
  misc_feature (61): n=a or g
agatgcctaagtgttagggcatctgtttaatacatttctttcttttcatgcagtcacaggnacaaacagatttctgcccttatgttctacaaggcatttgtagcagcatcttagagagaga

SEQ ID NO: 25003 - DNA, 121 bp, Artificial Sequence
  Synthesized
  misc_feature (61): n=t or g
agtccaatcccctgctaaaacagctttcctgcagtaggtcacacaagaaagtgtccacatnggtcttttccaggaaaagcacttccacatcatctctggtgatcttgttctagtgttccgt

SEQ ID NO: 25004 - DNA, 121 bp, Artificial Sequence
  Synthesized
  misc_feature (61): n=a or t
ctttatctacataaaatgttgcatgatacattgcaatgtatagataattgcagggagatangggaaaggaaaatcctctttctaaatgatgaattaaaatgtgttaactaggtaaacattc

SEQ ID NO: 25005 - DNA, 121 bp, Artificial Sequence
  Synthesized
  misc_feature (61): n=t or c
aaatgtttgactggcttagagcagaggcttgaactcgtgagttctgctaaatggccaacangtgagaaatcctgggtatttattttaaaaaaagttggtgtgtgtgaagactcgaactttg

SEQ ID NO: 25006 - DNA, 121 bp, Artificial Sequence
  Synthesized
  misc_feature (61): n=t or g
attgtagttctttttcaatttctcccaagaatttactgagacgtaacatatcaggctagtngtcttttcttccttttgtcctcccctctaattccatgcctgaatatgcttacagaaacca

SEQ ID NO: 25007 - DNA, 121 bp, Artificial Sequence
  Synthesized
  misc_feature (61): n=a or c
gggacagcaatctctgttggggcaggaaagccttgcacaactgggatgagcacacaagaanatgtgagactgtgagccagccctcagacaaagaagatcaagctggcaatagatcaggtgc

SEQ ID NO: 25008 - DNA, 121 bp, Artificial Sequence
  Synthesized
  misc_feature (61): n=c or g
gtcaagttaagaattgggataaatcccaaaccaataaatagatgtgaggtgatttcttagntaagagaagatgatggtctccagcagtgaagcaaagtgcaagtgaactgtagtattaatt

SEQ ID NO: 25009 - DNA, 121 bp, Artificial Sequence
  Synthesized
  misc_feature (61): n=t or c
gagacatggtcatactggaaagagtagtgaagtacctaatttatgccatgtcactactgtnacattgtgatccaagacaaacatagattaatgtgatctacttagcagataacaatggacc

SEQ ID NO: 25010 - DNA, 121 bp, Artificial Sequence
  Synthesized
  misc_feature (61): n=a or g
taatttgtcacaaaagttgtccaggacttttctctcctttatttttcagagggggaaaagntgaatatcaggaattacagctgaggctgcacagaggcagacaggagagtacctgccggcc

SEQ ID NO: 25011 - DNA, 121 bp, Artificial Sequence
  Synthesized
  misc_feature (61): n=a or g
ctcggaaaagagaggaagagattaatattacagaaaacttgaaagatctagcttctgagangggagagaagaacagtttcctaatactgtacataccacaaatctctcttttactaaaaca

SEQ ID NO: 25012 - DNA, 121 bp, Artificial Sequence
  Synthesized
  misc_feature (61): n=a or g
aagatatgattaagaaaataaacatccatatggaaatattactatgcatccaagcacctantctttcaattctgccagaagcaaagtggtctgaataatttatggagaggtttttcttcta

SEQ ID NO: 25013 - DNA, 121 bp, Artificial Sequence
  Synthesized
  misc_feature (61): n=a or c
cttcatattggacagaggttttattaatgcaatttcttccttccaaacgaaggtagcaaanacctcacgtacctattttggtgtgacgctctcctgcaagaagagaaaagccattgggggt

SEQ ID NO: 25014 - DNA, 121 bp, Artificial Sequence
  Synthesized
  misc_feature (61): n=a or g
tgcagaaaggagcatgcagcaggtagtgtgtgtgtgtgctgttggtttctctgtgataccntgtagctgtagtttttcctgttctactcattgttccagagcactgatgctaaagtcagca

SEQ ID NO: 25015 - DNA, 121 bp, Artificial Sequence
  Synthesized
  misc_feature (61): n=a or g
ttaatagctctcagagaaaaagattaaaagacaaaaataacctaattagaaaggatttacngtggggagttgaattgtttgtgctcagagcaaggcaacattggatctgaagtacaagaca

SEQ ID NO: 25016 - DNA, 121 bp, Artificial Sequence
  Synthesized
  misc_feature (61): n=t or c
gtgcaaaatgaataaagacattcatagatcatcaatggtttctaaactttaagaaaaattntgcagctgacccacagtatgcaatgagccctgcatgctttatctttcattttgtagttgt

SEQ ID NO: 25017 - DNA, 121 bp, Artificial Sequence
  Synthesized
  misc_feature (61): n=a or g
gatctcaaatttgctaatgtgcaggcaagtgctgtctgtgactcaccctcgcttagcaggntgcgctcgcagcaaagccatgcatctctcctcaacaagatcaaagagacctttgcatcac

SEQ ID NO: 25018 - DNA, 121 bp, Artificial Sequence
  Synthesized
  misc_feature (61): n=a or g
tttttcttaggttgttaggaagtaagccatgcctggatcagtgtaaatgtgttgtttagtntgaaatacctgttgtttttgaagtccaaaccaataaagcaaggtctgttaaggttagaaa

SEQ ID NO: 25019 - DNA, 121 bp, Artificial Sequence
  Synthesized
  misc_feature (61): n=a or g
tcagatcatatacaccaatgtagacaaagagagagagatgtggagagatttgtagacatcngtaaatacagccagttgacttttgatgaactgaggaccagagaaagaatagctaatgatt

SEQ ID NO: 25020 - DNA, 121 bp, Artificial Sequence
  Synthesized
  misc_feature (61): n=t or c
aatttaatggaaagagcacaaaaaaatttcctgcaaataataaagaggaagaggggctagnctgtataatctaaaataagtaagaaactggtctgctggcacttaagttctaagaaggtct

SEQ ID NO: 25021 - DNA, 121 bp, Artificial Sequence
  Synthesized
  misc_feature (61): n=a or g
actatcagaagtattattgtgattttcatgtgagttgccactcaggctaatttactcaatntaggatgcatttattgctctgcaaaagatacctgaatgtacattaggtaccttccttcac

SEQ ID NO: 25022 - DNA, 121 bp, Artificial Sequence
  Synthesized
  misc_feature (61): n=a or g
ggtgccaggagaaatgaagttagattgtatttgtgcctcaggacctataagggacagtcantgttactgtgcttgtccagacagaactaccccatctggggagctaattcacaatagcaca

SEQ ID NO: 25023 - DNA, 121 bp, Artificial Sequence
  Synthesized
  misc_feature (61): n=t or c
ctcgtttttaatgcctttttctcccttaagatatggaagccagaggcgaaactcatttatntctatttcaaaaccacactccaggttaaaaagtaatctgtgtatctgtttttaccattat

SEQ ID NO: 25024 - DNA, 121 bp, Artificial Sequence
  Synthesized
  misc_feature (61): n=t or c
tgatttcacagatactgtcagttcctctctgcctgaactccagcatcaagaataactgaantcttctgcacatctctaagctatcactgctatttaagaacttacacacacaacaagcagc

SEQ ID NO: 25025 - DNA, 121 bp, Artificial Sequence
  Synthesized
  misc_feature (61): n=a or g
ctgttggaagtatggcttcccagtctgcctcaagctgtaattcccaccttgcagcagtaancgtggactgcttcagagctgtcagcatactgtggtgcagctgtgtggtcactactttcga

SEQ ID NO: 25026 - DNA, 121 bp, Artificial Sequence
  Synthesized
  misc_feature (61): n=t or g
tggtagggaaggtgccacaaatagcttcttcctccagttctgctgttaactaagatctggngtaaatctgttggtgtttgtgctgtgggagcctgaggttgggtaaactaaaatcacgagt

SEQ ID NO: 25027 - DNA, 121 bp, Artificial Sequence
  Synthesized
  misc_feature (61): n=t or g
ctggggctgtctcccttgttgggatcattgctgtctccatgccatcccatcccaacacatncattcccatctcaacctgtgccgtgtcatgccatgccatgtcatcccatccctgctcccc

SEQ ID NO: 25028 - DNA, 121 bp, Artificial Sequence
  Synthesized
  misc_feature (61): n=t or c
ttacatttctgccagagcccagatgaatatatggctctgagtacagaaagtgctccttacntgtggaggaaacatatcattatgtcactataatatgcattacaatatagagcctgctaca

SEQ ID NO: 25029 - DNA, 121 bp, Artificial Sequence
  Synthesized
  misc_feature (61): n=a or g
atatacttttccctgtctcaatagcttgaggaagtggcgctgacagaatttggaaagggcnccatacacaaatgtgttaaaataaagtttatagatttaacctgtatatatgaatctctgg

SEQ ID NO: 25030 - DNA, 121 bp, Artificial Sequence
  Synthesized
  misc_feature (61): n=t or g
ggtttcagccagcattgctgatttcacttcttccaaccaaaaatttaaggggatgcttagnataaaacacattaaaactggagtcaagcatatactgatgggatatattaacatgaggcct

SEQ ID NO: 25031 - DNA, 121 bp, Artificial Sequence
  Synthesized
  misc_feature (61): n=a or g
acccattttattatatttcccctacacagcatagcctgtaattgctcccccaaactgtagnggatttcattcttcccatcctttttctctctctctctcacacacctcaatctcatcttct

SEQ ID NO: 25032 - DNA, 121 bp, Artificial Sequence
  Synthesized
  misc_feature (61): n=t or c
atatgtaaaagaatctaacctgcatatgaatatcagagctcaaacccatctgacttttccnctgtatgctaaatattaccaaaggaaaaagataaaagaaagaaaccaagaaggactgcag

SEQ ID NO: 25033 - DNA, 121 bp, Artificial Sequence
  Synthesized
  misc_feature (61): n=a or t
cttgaatgggggttggcaagtgagacagtgtttgccagaaactgttgatgggaactaatcnttcttattacctccgttaccctggattcacttttctggtggatctgctgtgctgtggcag

SEQ ID NO: 25034 - DNA, 121 bp, Artificial Sequence
  Synthesized
  misc_feature (61): n=a or g
tagggaggttcttctattcaaagagacagttttcctgcagaatttgaaataattaattgtnttaaagatgctgtttctagtgtggtgaagccatggcatattgcttttttactatgataat

SEQ ID NO: 25035 - DNA, 121 bp, Artificial Sequence
  Synthesized
  misc_feature (61): n=t or c
atagaagtctttaggggagtaagaaaaaaaacgtaggggagtgaagaccataaagaaattncttatgtttaggagaaatagatccgcagaaggagtataggcaggattgctccatgcactt

SEQ ID NO: 25036 - DNA, 121 bp, Artificial Sequence
  Synthesized
  misc_feature (61): n=a or c
gcttcactcttcattgcctcagtcttttctaagtcttccctgatcttgcagcgtccatgtnaaatgacttcatgttggaagagttacacacagggtacatgtaagccaaatcagtggcagt

SEQ ID NO: 25037 - DNA, 121 bp, Artificial Sequence
  Synthesized
  misc_feature (61): n=t or c
cttaccagctcttctttttgtccttcctgatggtgccatactatggaatgctgacttcatncatatgtaagtaaatgaggaagttcttccttctttgcccctggaaataatcaaaatggat

SEQ ID NO: 25038 - DNA, 121 bp, Artificial Sequence
  Synthesized
  misc_feature (61): n=a or g
aacatccaacctgatgcaacttaaagccattctcatcaccagtatgttacacgaaagaggntactgggttttctcttcaattactttattagttgtggtgggttgtgctagctgccctgct

SEQ ID NO: 25039 - DNA, 121 bp, Artificial Sequence
  Synthesized
  misc_feature (61): n=c or g
aggtttacaacctgtggatgactgtgagtcaatatgtggatgcaaagagttccaggtaaangctgatggtttggtgaacggctttttctgctctgctttccagacatcatgtgtgactggc

SEQ ID NO: 25040 - DNA, 121 bp, Artificial Sequence
  Synthesized
  misc_feature (61): n=t or c
aacatcctacatatattcacctctaatgtatacagagaattccatttgaacctctgattanacccttaggttattataaccacaactcactttcactactgacttggacaaaagcatgatc

SEQ ID NO: 25041 - DNA, 121 bp, Artificial Sequence
  Synthesized
  misc_feature (61): n=a or g
acttaactgtcccgcctgtggaaaatgcagggaaggaaatggtgcctgtatttggacattngggtattcactattgaaataggatgccttgtctcccatttcagtgcaatatttagttaat

SEQ ID NO: 25042 - DNA, 121 bp, Artificial Sequence
  Synthesized
  misc_feature (61): n=t or c
tgtaatcgagcatgggatgaaaaaaacgacgaacgccaccagatctgatgtttattgaacngggtgtgggtgaatcacagtagggtttttccacgctttctgtgcaaaagctgtctctctg

SEQ ID NO: 25043 - DNA, 121 bp, Artificial Sequence
  Synthesized
  misc_feature (61): n=a or g
taagtgctctcgtggaaacaaattgataagggacatggcagttgcttgtatatttgcacantgattggatttgcatagcttgtttcattccctctaatactttattctgattttaaacgaa

SEQ ID NO: 25044 - DNA, 121 bp, Artificial Sequence
  Synthesized
  misc_feature (61): n=t or c
cgctccaagacctgctgccagcgcagtgcccagtgcagcaaccaattgtgctggcagcctngaatgaatttggtgcagccatgtgctccatgccaccaggtgatggtgacacacaagcaga

SEQ ID NO: 25045 - DNA, 121 bp, Artificial Sequence
  Synthesized
  misc_feature (61): n=t or c
agctgtctaaccactgggaacaaaggggaaccatagatttaactgctgaagctttacgtcntgaagcagttattactgttagagaagaaatggaagataaattcagggatggttcttgccg

SEQ ID NO: 25046 - DNA, 121 bp, Artificial Sequence
  Synthesized
  misc_feature (61): n=c or g
tttataatcttcattttagaaagacaaaatgtctgaagattagagcaggtaaacatacttnagtacttgattttatctgtgaaaacataaggaatatcactctaattatattggccttaaa

SEQ ID NO: 25047 - DNA, 121 bp, Artificial Sequence
  Synthesized
  misc_feature (61): n=a or g
aaaacaacaggttacaaatttaccacacggcagtttaagacaagtttatttttaccttacncacactggcttcagcttatagaactgcccaatatctaaactaattaagaggtgtttccag

SEQ ID NO: 25048 - DNA, 121 bp, Artificial Sequence
  Synthesized
  misc_feature (61): n=a or t
cagtttttagatgtcaaaccacatccccatccattcacttacaaaggcactgtccctgttngtgtggcttgccttagacatgcacaagctgacctcccttatggcatatgcaagaaaagca

SEQ ID NO: 25049 - DNA, 121 bp, Artificial Sequence
  Synthesized
  misc_feature (61): n=a or t
ctgcatggcttgttctcaggctcctgtttgcaacacctgccaggccaagcctttcaagganctctgcctgattttgtaaacacagcctctcagttaactccactaaataaaggaggggcaa

SEQ ID NO: 25050 - DNA, 121 bp, Artificial Sequence
  Synthesized
  misc_feature (61): n=c or g
ttgattcaaatccatctgcagttaaactacaaagtgaattcttgatttcatcttagacttnaatgtgtattctaattgtgcagaattttagtgaagaaattaggctcataatgacatataa

SEQ ID NO: 25051 - DNA, 121 bp, Artificial Sequence
  Synthesized
  misc_feature (61): n=c or g
cttgttgaagcgctctatgagaaccgagtgccagtgttggtcatctaggaggctgcccagngtgacggatgtgtggctgttagtgaaatgcaggttggagtcccctggaggggcagaaaca

SEQ ID NO: 25052 - DNA, 121 bp, Artificial Sequence
  Synthesized
  misc_feature (61): n=a or g
actttcagacttcctactctgctccactaaaaagtattgaacttcacttgctttagcaggnaagtatacgtgtcaaatatttcaggtaaacagagcatacttagaactgtccattttgcat

SEQ ID NO: 25053 - DNA, 121 bp, Artificial Sequence
  Synthesized
  misc_feature (61): n=t or c
cactgctgagtatctgcagtctcctaatatacatattttaatcccaatttcttgccctgtngttgttaggaggaggatgtttggagggagatgatttcactggttgggtagttcagataaa

SEQ ID NO: 25054 - DNA, 121 bp, Artificial Sequence
  Synthesized
  misc_feature (61): n=a or g
tagatgccaatagatcagcttttatttgtgccacttgatgacactttttttttgtagagtnttcaatgcagtttttgttcgtcataataattaattgattgaaacttgtattgcttgggaa

SEQ ID NO: 25055 - DNA, 121 bp, Artificial Sequence
  Synthesized
  misc_feature (61): n=t or c
atttggtccacgatgctctgcaagaggtggctgtgcttgtcctgctgtaccgcccgctctngcagctcctccagaccactctgataaacagggacatcaaagggctcagcacccacaggga

SEQ ID NO: 25056 - DNA, 121 bp, Artificial Sequence
  Synthesized
  misc_feature (61): n=a or g
attggccttatttgttggaaaggggaaggaaaataaacttgtgggagaaaataaacctgangaaagtgttataagctttccattgagacatcgtgataaatatcagaggtggagtagagaa

SEQ ID NO: 25057 - DNA, 121 bp, Artificial Sequence
  Synthesized
  misc_feature (61): n=t or c
tgagttcaagaagatggttcacgaaggtatagtcctgtccaacatgaccaagaactgcagnctggccctagctgtagtcacagcacaactataattaacagtgaacttataacgagaagaa

SEQ ID NO: 25058 - DNA, 121 bp, Artificial Sequence
  Synthesized
  misc_feature (61): n=a or g
acacaggtgataaggcaagaagctatctggaggtcatgctaagatcagacaaaggtgggangaatcaggaatgcacatagttacatctgtacctgctctgtctgcagcagctccaagctcc

SEQ ID NO: 25059 - DNA, 121 bp, Artificial Sequence
  Synthesized
  misc_feature (61): n=a or c
cctggaacacctccagagctttcacttcctatgtacccttcctaaatcagaattttcagcnccttcattgatgctaaaaggtcaaggaataggaaagaagaactatcaccagcaaagtgat

SEQ ID NO: 25060 - DNA, 121 bp, Artificial Sequence
  Synthesized
  misc_feature (61): n=a or g
tctcaaacttttatatttgggtttggttttcagcaagctgtatttcttctgcagaccgctntaattcctatggtacatgtatttctaactctaaaagggttaaatgagacctttcttggca

SEQ ID NO: 25061 - DNA, 121 bp, Artificial Sequence
  Synthesized
  misc_feature (61): n=t or g
gctttttacattaaaaagacagcccatctgcaatacgtactgaaatacctactggcagganatactcacttgattccataggcaaatattgtaagtccgattaaaactcctatactgccat

SEQ ID NO: 25062 - DNA, 121 bp, Artificial Sequence
  Synthesized
  misc_feature (61): n=t or c
tgaggatggtaaaatctctgtgaaaatcttcatttaaatagaactgtgtcatttcaccttngaatgctggggaaagggtaaagcaggcagatggagaagagtagttctattcaccttttga

SEQ ID NO: 25063 - DNA, 121 bp, Artificial Sequence
  Synthesized
  misc_feature (61): n=a or g
gccaaaaagaattactgttttaaccaggctcccagttactgaatcgtttatcaaaagtcanattaaataaaacctgatggaattaaattctcttgtaagctaagaaagtatgaacttgaaa

SEQ ID NO: 25064 - DNA, 121 bp, Artificial Sequence
  Synthesized
  misc_feature (61): n=c or g
ccaaaaaagaagggcttacagcccgcagaagaggctgagggtttgctttgatcagtgcctnatcaacagaactgcccacaaagccagaaaagcgccttgggaggctgccaaagaactagtt

SEQ ID NO: 25065 - DNA, 121 bp, Artificial Sequence
  Synthesized
  misc_feature (61): n=a or g
aagaaaagaaggatataggacaaatgtgtatgaatatgcacatgagcaagacactagttgntctcacttatgatattagacaggcacttgagcagctggagaaaaaggcagatatgcctgt

SEQ ID NO: 25066 - DNA, 121 bp, Artificial Sequence
  Synthesized
  misc_feature (61): n=a or g
taaaactttcctccccctactgtcctgtattcctcaaagagtgtacattaccaatgaaggngtaaagctcagaatatatacttctgacagagtattgagcttttcaagactgataaataaa

SEQ ID NO: 25067 - DNA, 121 bp, Artificial Sequence
  Synthesized
  misc_feature (61): n=t or c
caagagacttggaagcttttttgtgaaggattctgagatgttacagcccttgattgcttgngaagatgtgccatggaccccaacatgtgtgttggctgtgtacagcacggtagggctcagt

SEQ ID NO: 25068 - DNA, 121 bp, Artificial Sequence
  Synthesized
  misc_feature (61): n=a or t
acactttgtgtctgtattcaaagcacacctattacaaagaggaggaaaagacgaggaaaanttttgcttccattattcttacaaacagatgtattttgcaaatggcatttgatattaccct

SEQ ID NO: 25069 - DNA, 121 bp, Artificial Sequence
  Synthesized
  misc_feature (61): n=t or c
tcatcatctatcccttatcctttgacttgttgaagcggctcatattagaggaatcagaagngagtatttctgagcatctcctggcaggcaactagtctcttttcagcagcagatcagacaa

SEQ ID NO: 25070 - DNA, 121 bp, Artificial Sequence
  Synthesized
  misc_feature (61): n=t or c
tggctgtaataaggttcattataaacataaggtataagcacagaggaaatagtcacaagcnatcatgatgttggaactcagtcacagcttttaggaatgtgtttattttatcgaaggacaa

SEQ ID NO: 25071 - DNA, 121 bp, Artificial Sequence
  Synthesized
  misc_feature (61): n=t or c
taaagtagcttgtctacaaaagctaaacaaaacacttgctgcatttcttggtgatgttagnctggattcccaattttttctaggaatgctttctcaaagatgaccatccctcactgattca

SEQ ID NO: 25072 - DNA, 121 bp, Artificial Sequence
  Synthesized
  misc_feature (61): n=a or t
gagctcagagtctctgcactggccaacagtcacaaaagtttgatttattttgattcatttntgggtaggagcttaaaagggttgtctaaaaattttactaggaaccaatgtgaaatctgta

SEQ ID NO: 25073 - DNA, 121 bp, Artificial Sequence
  Synthesized
  misc_feature (61): n=a or g
acgtttaaagccattactcatttttgttccagcccttccgcagagcacaatgaattaatcngggaattgaattagtgaggttagatccaattagctcaatttgacccagatgctctaacca

SEQ ID NO: 25074 - DNA, 121 bp, Artificial Sequence
  Synthesized
  misc_feature (61): n=t or g
attcttacagacaaatgaatgtttctgttacaaaaaagtgtaacctgagatttagaagttnatgcaatttatgtgagctcataggacaaatataccaggccaggattagaagagtttctca

SEQ ID NO: 25075 - DNA, 121 bp, Artificial Sequence
  Synthesized
  misc_feature (61): n=t or c
ggctggattatttttgacaaccaggaaaatattgtggaaagccattcctacgtagtttctntggtacgtggaggatatgttataaatcttctttctcctgaagcgacacacttccatttaa

SEQ ID NO: 25076 - DNA, 121 bp, Artificial Sequence
  Synthesized
  misc_feature (61): n=a or c
gatataggttagatgagtattgcatagatattcattagggtttgcatcatttaagttgatnttgcaagaatttattggttttcagctgagaaaattggtctgttcagtgacttcttaagtt

SEQ ID NO: 25077 - DNA, 121 bp, Artificial Sequence
  Synthesized
  misc_feature (61): n=a or c
atttaaagttccaggaaaggaaagaagcctggttattacaattgctttttggaatgaaggnatggggagcctaagttgcaaattgtaagacttgattctgttaccgttgctggattagatt

SEQ ID NO: 25078 - DNA, 121 bp, Artificial Sequence
  Synthesized
  misc_feature (61): n=t or c
caattcactttgaagggatctgccctcaatttgctcatcatgacaacctgagcattcacangaatagaaaacatcactgctgctcatatacaactgtgaggtgtaatgggaaaatcttgac

SEQ ID NO: 25079 - DNA, 121 bp, Artificial Sequence
  Synthesized
  misc_feature (61): n=t or c
caatcctctcttttcaggtgtctcaggaaccaagcacggggctaaagccagatcaaaatangtgttttctgggttgttcagacccagcagattagatttagctgatgcattcctgcaaaca

SEQ ID NO: 25080 - DNA, 121 bp, Artificial Sequence
  Synthesized
  misc_feature (61): n=a or g
gaatggtttttgcctgaactatcattcaccttctgttatgctgagttttaagatgtgtgcnttggaattacacttcgattttttgctagaatttaagatacatttatcattagcagtacct

SEQ ID NO: 25081 - DNA, 121 bp, Artificial Sequence
  Synthesized
  misc_feature (61): n=a or g
aaaaaaaactaatatggaccacagatgcaaaagtaacacgtcattatttctggacatccantgttagatgtgagtcaaaaggcatcccacatgataaatcaatcactgacctcctttattt

SEQ ID NO: 25082 - DNA, 121 bp, Artificial Sequence
  Synthesized
  misc_feature (61): n=t or c
ttccaaaagaattccactactgaaatgtaaacaaaagagaaaagaacaacggagtaaaacnaactccataacacaaaggacaaatgtgagaagaatgttttcacagtgctaagtatcactc

SEQ ID NO: 25083 - DNA, 121 bp, Artificial Sequence
  Synthesized
  misc_feature (61): n=t or g
tgccagtgctcctgtacctgctggggcaggggcatatccttgttcaattagattagaaacntgctagccatatgtgaacgttgtagtggtttttaacttgttgtagctttaataaaggaaa

SEQ ID NO: 25084 - DNA, 121 bp, Artificial Sequence
  Synthesized
  misc_feature (61): n=a or g
aaatatgtatttattccaatttaatgtagttatagtggcaacttgaaagttttatcccacngatgaacctgcaaattgactgaaaaaccctttttaatgcatcagacactgcaacatgcga

SEQ ID NO: 25085 - DNA, 121 bp, Artificial Sequence
  Synthesized
  misc_feature (61): n=a or g
ggtgaacagagccacagccatcagaatgtgcaaggatttgctacacaaacctccgcatacnagaaaaccaccctgtatcccttcttccacaatcactgcagacctaagcaaaggcattcag

SEQ ID NO: 25086 - DNA, 121 bp, Artificial Sequence
  Synthesized
  misc_feature (61): n=a or c
tgagttgcagaggctacaccaggatgtaattaagtaacaaggctggtgtctataattatantgattcttttaaaggttctcatttataggtgtaaatgctgtggccttaaaacaactggca

SEQ ID NO: 25087 - DNA, 121 bp, Artificial Sequence
  Synthesized
  misc_feature (61): n=t or c
acgtctttgtaatatcttgtagcttgtaatttccctttgtttagcaactattttctgtcanacatggtaaatataaatggtcaacaaggtggaaataatttggtataaactccattaaaga

SEQ ID NO: 25088 - DNA, 121 bp, Artificial Sequence
  Synthesized
  misc_feature (61): n=a or g
cactgcattctcttttttggttcagaatttattccataaaggtgtctgaacactttgtcanaggaaagaattcagcccaatggtagttatattctgccatacctccctcatttacactcaa

SEQ ID NO: 25089 - DNA, 121 bp, Artificial Sequence
  Synthesized
  misc_feature (61): n=c or g
tgaattggtaacaggatgaaatcgctcttccctgagcctatgagaattgtgtcaatccctngtgagatatgtgaatttactaactcataattttatatctctgtggttacctaagatcttt

SEQ ID NO: 25090 - DNA, 121 bp, Artificial Sequence
  Synthesized
  misc_feature (61): n=c or g
atgtctatttaagcatacaaatgaaaagcaatctgagttcggaggctgtttatctctacanatgtatttagacaaactatggaggaaagcccttctctgcttctgcctttatgtcaggcaa

SEQ ID NO: 25091 - DNA, 121 bp, Artificial Sequence
  Synthesized
  misc_feature (61): n=a or g
ttggtattttaaaggcttgcagaaccctgctttcaacagcctaactccttccttgctctcncatcttgtatgagcagcacgcagctctctgctgcagctgggcaggcatgccagagggacc

SEQ ID NO: 25092 - DNA, 121 bp, Artificial Sequence
  Synthesized
  misc_feature (61): n=t or c
tgaaattactgcctaggaagataaatgatatttccactgcagagactccacaaatagcgcnttaacaacttgttctccagatacgccttttccttagcctttcaaagctacaatgtcagac

SEQ ID NO: 25093 - DNA, 121 bp, Artificial Sequence
  Synthesized
  misc_feature (61): n=t or c
aggtgggcaggtaaggatttcggtctttattttaatctatatgtgatttaatctcaccttntggattggtatgggacaggagccattttaggcttcctttcaaactctacttctgttgtca

SEQ ID NO: 25094 - DNA, 121 bp, Artificial Sequence
  Synthesized
  misc_feature (61): n=a or g
accttccttaccagtcaccgcacattcccaattgatgattgaaatgaaggtgacctaaacnatgactgtatgtaccctgctttacccttagcaaacaatgctgcttgtgacccagtcacag

SEQ ID NO: 25095 - DNA, 121 bp, Artificial Sequence
  Synthesized
  misc_feature (61): n=a or g
gactgtacgtttccatcctgcagatgtgcccacaagtacatccttgagatctgacaaaacnaacaggttgtgcgcaaacactgtgtacgttttgcccctttcttcatcattaagagtaact

SEQ ID NO: 25096 - DNA, 121 bp, Artificial Sequence
  Synthesized
  misc_feature (61): n=t or c
aggggctatttacaacaatatccactgcgcagtgatggaatggtggctttcagagttcgangtgtctcagcccagtgctaacagctgggacgcggctctgtgtcaaacaggtgctggatct

SEQ ID NO: 25097 - DNA, 121 bp, Artificial Sequence
  Synthesized
  misc_feature (61): n=t or g
ccagctccaaccattaaaattcatgacatgagggaacagtctccatgagcaggttcagggntgccaggatccaccttgaaagcccagatagagagcagtgcagccctgaaagtttttggtt

SEQ ID NO: 25098 - DNA, 121 bp, Artificial Sequence
  Synthesized
  misc_feature (61): n=t or c
agtttgggaattaagtgttgctggatatgttcccagcagttggttttcatgcacccattgntctcagtagtgagtttactggaattgagtatagcggctgtggctttaggcccctagatcc

SEQ ID NO: 25099 - DNA, 121 bp, Artificial Sequence
  Synthesized
  misc_feature (61): n=a or g
gaatgccccagagagcagccaaaatccaatgctgtatgattacacttatcagtaaggaacnctaaatattgggttggcagcagaatgggttgaaggtatgaggaatggcagactctggcct

SEQ ID NO: 25100 - DNA, 121 bp, Artificial Sequence
  Synthesized
  misc_feature (61): n=c or g
cttcctgcaaagatttgggccgtttccaacagacataaggccaaagtacatgcctgtgaanaagctagaagcctttaatgaaaaataagattaggtatctcaattgtttggcttctcatac

SEQ ID NO: 25101 - DNA, 121 bp, Artificial Sequence
  Synthesized
  misc_feature (61): n=t or c
ggcagttattaaaacacaaagcccttcttgcctacaaatctgtgtgcttgatcttcccagnccaaatcctacaagtaacatgcacttgtccccagggcagcttgctcaaataaccacagct

SEQ ID NO: 25102 - DNA, 121 bp, Artificial Sequence
  Synthesized
  misc_feature (61): n=t or c
tagttagttattggaagcagaatgctgtttgctttcaacatccattcaacacaagaatacngaaatattgcccttcaagtataagtgctcagatatccataaatttagtgaactaatataa

SEQ ID NO: 25103 - DNA, 121 bp, Artificial Sequence
  Synthesized
  misc_feature (61): n=a or g
tttccgtagacttatttgtgatgctgactgagcagtgagtagcactgctcttactgccacncatgcatgccgctctcaaacatttcagcctttcattgtttttttttaacaagtagctgct

SEQ ID NO: 25104 - DNA, 121 bp, Artificial Sequence
  Synthesized
  misc_feature (61): n=t or g
aaaaaagccttctttgcttctcatagtaatcagatatgccagatccagattctcttgggtntttttgcattcttagttttggtggcaagttctgctttccctgtgcatttttcttcctgtt

SEQ ID NO: 25105 - DNA, 121 bp, Artificial Sequence
  Synthesized
  misc_feature (61): n=t or c
ttttatattagtttcacttttagcacaggcagcagagtagggcatctgcacggttgtaccnttaggaattaaattcaccttccaaccaaagtaatttgagtatttctgttgattttttagg

SEQ ID NO: 25106 - DNA, 121 bp, Artificial Sequence
  Synthesized
  misc_feature (61): n=a or t
ttgctgcctaccagatgccagtacagaaaaagaaaagaaaccacactgtactaaaagaagncaagttactgagaaggtctggaaggaagccatggtcatcataacctatactggatttagt

SEQ ID NO: 25107 - DNA, 121 bp, Artificial Sequence
  Synthesized
  misc_feature (61): n=c or g
agttggataagccatgtacatttttaaatgagcaaattgtgtgtactgtgataatactganataatacatgttgtgcatgtggaagggggtggagagggaactgtgacagttttcttctgt

SEQ ID NO: 25108 - DNA, 121 bp, Artificial Sequence
  Synthesized
  misc_feature (61): n=t or c
ctgtgcaagtgcccagatactggtttttgtagatggccacttgtgtggtgaagggcattangacaaggaagcagaggacagcagctcattcttgcagtgggttctaaggcttctggagtta

SEQ ID NO: 25109 - DNA, 121 bp, Artificial Sequence
  Synthesized
  misc_feature (61): n=c or g
gagtaataggagatctgatgtttttctgaagaaataaatgcaatgaagtgttagacagganataccacgtgccacagaagcactgtttgaactaaagttaggtcaacgttaacattttttt

SEQ ID NO: 25110 - DNA, 121 bp, Artificial Sequence
  Synthesized
  misc_feature (61): n=t or g
acatgggctgaaaacccaacgagacaagaccgtgaaagagaaatccactgagatccacgantacaaaggcacattgttggctctgcaagtgcctgagccatgagtcacccgaggcggggaa

SEQ ID NO: 25111 - DNA, 121 bp, Artificial Sequence
  Synthesized
  misc_feature (61): n=t or c
aattttttattttattttattttattttttagctctgaacttctgagttgtacattttttnccacagctacttaattatgtgcccttggaacaacattgttatggcaagtgaggcactgaa

SEQ ID NO: 25112 - DNA, 121 bp, Artificial Sequence
  Synthesized
  misc_feature (61): n=t or c
atgaagtatgggaaatagaaaccattttagagtccatatttagataaaaacaggatatgcnataaatgacaccaacacaactccatacaactccatatacaagggcatatccatacaccaa

SEQ ID NO: 25113 - DNA, 121 bp, Artificial Sequence
  Synthesized
  misc_feature (61): n=a or g
aagtgtgcttctatggccagtgactagcagaattcttcccatcactcactgtcttccaatnatgtagaaacagcgtgttaggccaaactatttaagtatgaggattatgaccaagaggagt

SEQ ID NO: 25114 - DNA, 121 bp, Artificial Sequence
  Synthesized
  misc_feature (61): n=t or c
ttgtgaaaaatagagaaaaaaaaaaaggaaagaaatgaaaggtatcccttgaactttgagngaagaaatgttaggaatcaagttctgtaactgcttacttacagacacatgtgccatctac

SEQ ID NO: 25115 - DNA, 121 bp, Artificial Sequence
  Synthesized
  misc_feature (61): n=t or c
attgaaatgctccgaagataccttataaaatggaagcctagaaattcttccctctgcttangagaatttgttgaaaagcagtcagctcaatagcaaacattcagtgttcctatcaggacag

SEQ ID NO: 25116 - DNA, 121 bp, Artificial Sequence
  Synthesized
  misc_feature (61): n=a or t
gcataacgttgctccctgctgtctatatccctagacaatggctggttcacaactattttanctgttttggattctacttttttgtgcatcctatagcccttctaaatattttgcatgctaa

SEQ ID NO: 25117 - DNA, 121 bp, Artificial Sequence
  Synthesized
  misc_feature (61): n=a or g
gtgagagcttcaggaaaactgggactgtagctgtcccacagtgaaaacagggagagtgatncagggagtgggctgaaacatttttctgtcctaattaaggacaagactagctcagactagt

SEQ ID NO: 25118 - DNA, 121 bp, Artificial Sequence
  Synthesized
  misc_feature (61): n=a or g
gtgtgtcttaagcaaggaattgcaactcatggcatttatctatctctatatttatatcctntttttcaatactcaaagtcctggcctcagtatttagctgattctcataatgttagctcta

SEQ ID NO: 25119 - DNA, 121 bp, Artificial Sequence
  Synthesized
  misc_feature (61): n=t or c
tctacacttgtgggaaagggtgggaagaagaggacatgctcccacaatccactgtttcaanccagcatctcttccccctactctctaggtcctcaaccacttctgtgtagcagaaaattac

SEQ ID NO: 25120 - DNA, 121 bp, Artificial Sequence
  Synthesized
  misc_feature (61): n=c or g
acaacatcttcttgtaaggcatacactagttagtatacagtatttgttaaatgagatgganttgttatttctctttcacctctttcccatgtgacattatttagaccaaagcatatgggtt

SEQ ID NO: 25121 - DNA, 121 bp, Artificial Sequence
  Synthesized
  misc_feature (61): n=t or c
atagaacctttaagagcagaagtcaggctacccgggcacaaaggcggctaaatctcctccngggacattaatcatttttctttgacatgttttgctaattagacgaagcgtttccctcgat

SEQ ID NO: 25122 - DNA, 121 bp, Artificial Sequence
  Synthesized
  misc_feature (61): n=a or g
accagattcttccatgatacagtgaatggaagtaatattggttatacttaagtaatgtgtntgttggacagcagaaaaactgaagctgtagcactgtattatgtgcatcctacttcaaatt

SEQ ID NO: 25123 - DNA, 121 bp, Artificial Sequence
  Synthesized
  misc_feature (61): n=a or g
ttgttcatacccctctactgatgggatggagacacaagactgctccaggctacagaggacnccacagttactgtctggaaaccagcagtgacaatacagatcattcttaccgtgtaggatg

SEQ ID NO: 25124 - DNA, 121 bp, Artificial Sequence
  Synthesized
  misc_feature (61): n=a or g
attttgtttacacttcagaggcaataatttcagagttgcatcctcagtcccttctgaagcntctgccatgggagcaagattagaaaaagctaccaacttctaaaccaccatagttaaggta

SEQ ID NO: 25125 - DNA, 121 bp, Artificial Sequence
  Synthesized
  misc_feature (61): n=a or g
aggtcaagtgataattattttaaaagaggtaagatggttagaggtaatgtggaccatcacngtgtgtgaccagctgtatatcatgagctaaatgaattttatcaacttttcctttcttaat

SEQ ID NO: 25126 - DNA, 121 bp, Artificial Sequence
  Synthesized
  misc_feature (61): n=a or g
ctgcctgtgctgcataggttacagtcatcccttaaggacaagctccaacacgagctaagcnttcaggagccccaatacaatcgtctccttttccaccagttctgtatccaccctggaagtc

SEQ ID NO: 25127 - DNA, 121 bp, Artificial Sequence
  Synthesized
  misc_feature (61): n=t or c
actcatctagatctgcccatgtctatctcatgggacacaaatccaactcttcagaaaaatncagctgactctgagacaagtctggatggagaatagtgccctcaatcctctgtgcaagaat

SEQ ID NO: 25128 - DNA, 121 bp, Artificial Sequence
  Synthesized
  misc_feature (61): n=t or g
gatcagattcataaccttatactcccattatggtgacctcagccaaagttgagcatagaangagagatcaaattccaaataacatgcactttttggggggcaaaaacccttcatgaaaaga

SEQ ID NO: 25129 - DNA, 121 bp, Artificial Sequence
  Synthesized
  misc_feature (61): n=a or t
acactggaaggatgaaacctctgttacaacaaatctgtttccccgagggctcctcttgtgncagacacacagcgtaaggcagatggacagagctgcccagactggagcagctttccatccc

SEQ ID NO: 25130 - DNA, 121 bp, Artificial Sequence
  Synthesized
  misc_feature (61): n=t or c
gccttcttctcagcagaacacttcaggaccccgtgaggaggtgaattttgccttcctaagntaataagcaaaagcaagcagcacaaatcaggcactgcagtgctcctgtatcccttttact

SEQ ID NO: 25131 - DNA, 121 bp, Artificial Sequence
  Synthesized
  misc_feature (61): n=c or g
acagcacaacgcacgggtgggaaaagcggctttattgtgtcctgcagcaacaacagcagcnatctgtaacggcacacagaagccagcagccgaccccagcagccacgagggacggggacgg

SEQ ID NO: 25132 - DNA, 121 bp, Artificial Sequence
  Synthesized
  misc_feature (61): n=a or g
aaatgtcaaattctgtaaaactcactcacaattctgcagggaggaactctttttttcagtntaataaatgagagttgggaaattcagtagcaatgaaatagcttatgaaaattctctgaat

SEQ ID NO: 25133 - DNA, 121 bp, Artificial Sequence
  Synthesized
  misc_feature (61): n=t or c
aagacacagagcaccccaaaaactgagtcctaggagacagcctggatggcatcacaatgancaaggctccctagcaaaccccagcctagagggagtgcaggagcactcggagaccacaggt

SEQ ID NO: 25134 - DNA, 121 bp, Artificial Sequence
  Synthesized
  misc_feature (61): n=t or c
gttgggttgttaagtgagaggttacattcctctgttgaagctgcctgagggctgcagtgcntcccctgcatcacagtttttagaaggggtcccagtgaagatttgggaattcaccgaccag

SEQ ID NO: 25135 - DNA, 121 bp, Artificial Sequence
  Synthesized
  misc_feature (61): n=t or g
ttgctgcctggcacagacagacagacagctgtgttacagatctgagcagccatagagcacngggttgcacagagattattctaatcctttcattagcttaaatccttcttttctccagcat

SEQ ID NO: 25136 - DNA, 121 bp, Artificial Sequence
  Synthesized
  misc_feature (61): n=t or g
agctgtctttcgttgactcaaagatttttacaacacctccgtgcctcatctttgatttganccagcagaatggtttattgtaacatcaaatgatcttatgttcgctcgaaggacgcttcct

SEQ ID NO: 25137 - DNA, 121 bp, Artificial Sequence
  Synthesized
  misc_feature (61): n=t or c
agcatggaagggataagtcagcagctctcagaatctcacttccccagagtatctgctgcantgtagtaggggaatcaatttatgcatttatgttactaagaaatgtaaatataccaagcat

SEQ ID NO: 25138 - DNA, 121 bp, Artificial Sequence
  Synthesized
  misc_feature (61): n=a or g
gttcttaacagcattagtgttgctggagacagcagaactcttgccatcagcttcagggacngtagaagggtcctttgttccccttcgtacttcacatctctttcttcctggtacctcttag

SEQ ID NO: 25139 - DNA, 121 bp, Artificial Sequence
  Synthesized
  misc_feature (61): n=t or c
tttcgttttcagggctgctggaatatcttagcaaaaaaaaaattcatctaaatcaaaaggnttcacagaaatagaattattccagcaggagaatctggtttcttcttttgtgtcttgtttg

SEQ ID NO: 25140 - DNA, 121 bp, Artificial Sequence
  Synthesized
  misc_feature (61): n=a or g
ggctccctctccacatcccccttcaagataagtcttttttccagcaagtaccacaatgacncttgtgtcctgacagtgtcttgttgttctatttgtaacttaatttctggtggcagaagaa

SEQ ID NO: 25141 - DNA, 121 bp, Artificial Sequence
  Synthesized
  misc_feature (61): n=a or c
gcagacctaaaaggcacaatctggaagtctaagatagagatttgtgctactgcggagttgncctgcatattaggagtcacactggtgtgaattcatctggcaaggggctggctgaaagctt

SEQ ID NO: 25142 - DNA, 121 bp, Artificial Sequence
  Synthesized
  misc_feature (61): n=t or c
ctcattggaggcggtgtgtcagagagtgatcaaagatgcttagacgagctctgagccctanttctgttcctgctgctcaacttccctcgttgtgcagtcctcaccacctcgcctccacaaa

SEQ ID NO: 25143 - DNA, 121 bp, Artificial Sequence
  Synthesized
  misc_feature (61): n=t or c
aacttcctaagtgtcctttacatgcattatttctaattagaagtgcagtgttacagcacanagataggaatactaggcattttcctttttttttttttccaaaatatactttttcagtaca

SEQ ID NO: 25144 - DNA, 121 bp, Artificial Sequence
  Synthesized
  misc_feature (61): n=t or c
actcactggaacaagagaagggaggagatgcacagcagcactgggcaaggcaagacgtgcncatcacaagccaacttaaacaggtgaagagccagctcacctggtcattcacccgctgcac

SEQ ID NO: 25145 - DNA, 121 bp, Artificial Sequence
  Synthesized
  misc_feature (61): n=t or c
gaatgtatatttaaatatatattaaatatatgaatatatgttacatacatttataccgttngtgtggggacagactgacatatctgggagcttttgccataggactgcattagggttcttt

SEQ ID NO: 25146 - DNA, 121 bp, Artificial Sequence
  Synthesized
  misc_feature (61): n=a or g
aattgatactgctgagtagttcctggactttgagctctgtccttaattagaggcagtaatntctccttcccactgagatttcttattttgcctaataacacaggattatcagctttcaatt

SEQ ID NO: 25147 - DNA, 121 bp, Artificial Sequence
  Synthesized
  misc_feature (61): n=a or c
aaatgtctgattacattaataaaaaaaagcaaacataattttgatcctaaaataattctanaatgcaagtaacagtgatgtttgccttttaatctaacagaaatgataacagcagattatg

SEQ ID NO: 25148 - DNA, 121 bp, Artificial Sequence
  Synthesized
  misc_feature (61): n=t or c
ttgaaccattcctcttcagaaaacaaaacaaaaccccacagctgtaaacagagaggacagntctccttttcacaactaatttttggcatttcagaatcaaaatgaatgaattactgtgaaa

SEQ ID NO: 25149 - DNA, 121 bp, Artificial Sequence
  Synthesized
  misc_feature (61): n=a or g
actttatgggatcatcatcaaggtacgaagtcaagtacaaatcccatctcgtgctttcaantgtgagatgctcagataaggctgctttaaacaaaataatcaggatttcgcagtgcagaga

SEQ ID NO: 25150 - DNA, 121 bp, Artificial Sequence
  Synthesized
  misc_feature (61): n=a or g
ttaccttctatgtgtgactactacaaaagataatgaatgtgtacccaaaacagcaaaatgntatgttagcaaaagcttaagtgtcatacattatctttgaggagacagaggacagaagagg

SEQ ID NO: 25151 - DNA, 121 bp, Artificial Sequence
  Synthesized
  misc_feature (61): n=a or g
tctttcaaacacttgccaaattcagcagttagcgcatatcacagctctgtaattccagctnaactgtaagttaaacttaaccaaagataagcagcttttatgtatgaaaccagggcagcag

SEQ ID NO: 25152 - DNA, 121 bp, Artificial Sequence
  Synthesized
  misc_feature (61): n=a or g
acttatgtgctttaagttaggcacgtttttaagtgtcttgttaaattgagagaaatttctngttattaggatacagaagatactgtaggaagaggtcaccaagtggtgatgaaaataaaaa

SEQ ID NO: 25153 - DNA, 121 bp, Artificial Sequence
  Synthesized
  misc_feature (61): n=a or c
ttgacagacgcgttcatttttacattagtgtattaaaaccccaaacagacacagtgttgangacacaagcatggatgctccctacaaattaccactcttgacttgcagaaataccacgttc

SEQ ID NO: 25154 - DNA, 121 bp, Artificial Sequence
  Synthesized
  misc_feature (61): n=t or c
cttcaagaccacttttttttttgaagcaaaatgttctatcttcagtgataagtaaaagaanggagaaagctggtaagaactcaggattttggtgtcgcaggaaaatgagtactactacaag

SEQ ID NO: 25155 - DNA, 121 bp, Artificial Sequence
  Synthesized
  misc_feature (61): n=c or g
aattgttttcttcagatacaggcaccattagtatgaagattattatcagtgattttattgntgaaactatttgtttgtaggaaagaaggaacagtatcactttaaaagaggagataaaggt

SEQ ID NO: 25156 - DNA, 121 bp, Artificial Sequence
  Synthesized
  misc_feature (61): n=t or c
gtaggaaggaatagcaggttgtataaaataaatctatgaagacctcatagcactattatangagactttaaggtctttactgatgctaatagatgcagccattacagaataaaatttggat

SEQ ID NO: 25157 - DNA, 121 bp, Artificial Sequence
  Synthesized
  misc_feature (61): n=t or c
atgaatttggaaccacttcagaagtcctgtcttgcctttgtgttgagtgttctggaagagntgatctgtaggtacaagtcctagtaaaatttcatatggacccaagccaagatgtgtacca

SEQ ID NO: 25158 - DNA, 121 bp, Artificial Sequence
  Synthesized
  misc_feature (61): n=a or g
tcacctctaaaataacgttgcattgaagtcttacagctgtgagctttgcggccatccaccnttagagggagtcagctgcacgtatcccagctctgctgctgagtggtccgacatggggtga

SEQ ID NO: 25159 - DNA, 121 bp, Artificial Sequence
  Synthesized
  misc_feature (61): n=t or c
tgttcccttctagatacctccagctttgtcaatttgcagcccatgcagtcccaaaaggttngtctttgctctttcaaggatttaagttcagaagctcagccagtctactgcattggccact

SEQ ID NO: 25160 - DNA, 121 bp, Artificial Sequence
  Synthesized
  misc_feature (61): n=t or c
ctgcagacttacggtgtgcctgagcaaacaaactgttatctgagtaaacctaattagtccngttagtccattactctcatgcccctgaagatgaaaaactggcacaactacttgtatatat

SEQ ID NO: 25161 - DNA, 121 bp, Artificial Sequence
  Synthesized
  misc_feature (61): n=t or g
tcgaaatctgaatgtatgacaaattatatgtccatgtgccacttggtgagtaaagtacagngacaactgataatatattaaaacttacaaacattgtgtttgcctgtgaagaaatgcattt

SEQ ID NO: 25162 - DNA, 121 bp, Artificial Sequence
  Synthesized
  misc_feature (61): n=t or c
gagaattctggatagtagagaccttgttctaactgcttactcaaagcaggggcaactctgngatcgggccatgttgctcagggctgtgttcaggcagattttgaaaacctccaaggacaga

SEQ ID NO: 25163 - DNA, 121 bp, Artificial Sequence
  Synthesized
  misc_feature (61): n=a or g
caagagttcaatctctgtcccatgtttggaagctgccatcgtgtgtgtccccactttaccntctgtgttgtcatgaggatgtgcacatgtgtacccatgcagctcagctgtgccagtagtg

SEQ ID NO: 25164 - DNA, 121 bp, Artificial Sequence
  Synthesized
  misc_feature (61): n=c or g
tccaaatggccctcttcttctttgcttcttgctgtcatagctgcagctttccctgcttcantatagttactgtttaagctagttgttctcatgccatccctacactgcttctgttccatcc

SEQ ID NO: 25165 - DNA, 121 bp, Artificial Sequence
  Synthesized
  misc_feature (61): n=a or g
ctggagggcttcttaggtatcccacagcaccactcttcacttcccgtggtgatgcatggcntgtgtctcttgaaggtgtgaggtgagcatcagcaggcttaaatgatgccatggtgacaag

SEQ ID NO: 25166 - DNA, 121 bp, Artificial Sequence
  Synthesized
  misc_feature (61): n=t or c
gcactggggctgaaccctatttacagtaatgtgcaggagatcagcctgagatctgctgccngggagtgcccagacatgtctctctgtatgatccttccagacacagaaaacaaaactttgg

SEQ ID NO: 25167 - DNA, 121 bp, Artificial Sequence
  Synthesized
  misc_feature (61): n=a or g
ctctatagttagtgcactcacctgaagacatagcagttggtaggtttgagctgctgctgcncagttagctttacagtgaatatggaaaataaaactcctgttaggcaaaaagcacaggtct

SEQ ID NO: 25168 - DNA, 121 bp, Artificial Sequence
  Synthesized
  misc_feature (61): n=a or c
tactagtagtaaacctcagaggaacaaaagcagattgggagagggttggaaggtgattcanaacttaatgcaggggccattctggctcagcatcatctcctgagacaattacagcagatga

SEQ ID NO: 25169 - DNA, 121 bp, Artificial Sequence
  Synthesized
  misc_feature (61): n=t or c
taaatgtatttatataaaattatatttctaactacaacctcttctgtggacagagaacctnatagcattgcgtaccttcagcacaggccagtcttcaactagccctcctgagtccaaagca

SEQ ID NO: 25170 - DNA, 121 bp, Artificial Sequence
  Synthesized
  misc_feature (61): n=a or g
gtcactgtaaagaagattgagaggatcatgttcctcctcaagcatctggggtcatcccttnacacgtacagcttgtgagcccatgtttggtcttggcctctttcataacatctttgctcac

SEQ ID NO: 25171 - DNA, 121 bp, Artificial Sequence
  Synthesized
  misc_feature (61): n=t or c
atgaatttgtgtttacacatctaatgtcacctaaagaccaatacccacatcagccataaantgaagtcccacattacctgttaactactcaggtggaacattacttggcccagcagaagag

SEQ ID NO: 25172 - DNA, 121 bp, Artificial Sequence
  Synthesized
  misc_feature (61): n=t or c
tatgcctgactctgatatcacacatgtttattactttctctcaaagtattgagtttctagnagaagaaatattaaattctcccatcatatgtaatttgtgtcttaccctccatccaacatg

SEQ ID NO: 25173 - DNA, 121 bp, Artificial Sequence
  Synthesized
  misc_feature (61): n=a or c
cagtagggttgtaactaggtgatctctaaggttgcttctaacccacaccagtctatggatntatgattccataaatctgtgacccttcaacatccagtaaatatactcaccaggtggtcaa

SEQ ID NO: 25174 - DNA, 121 bp, Artificial Sequence
  Synthesized
  misc_feature (61): n=a or c
gtttgttcctcgccgatttgcgtctcgaaaagcatttcgcgagtacttagaaactccttgnaaagaggaacgcgcttcgttcgtctctccccaccgaagggcacgggcatcgttcggtgct

SEQ ID NO: 25175 - DNA, 121 bp, Artificial Sequence
  Synthesized
  misc_feature (61): n=c or g
aatgaaacaagtgacaacaaatttggttcctgtgttattcctcagattctccagacttctnctataccagattttgaaggaccctggctcagtttgccagataactaaaatatgcttctaa

SEQ ID NO: 25176 - DNA, 121 bp, Artificial Sequence
  Synthesized
  misc_feature (61): n=a or g
tgatagcaagaactttcttaaaaacttgaccagtgtccactctcagtcataatctcagaanaactgctattgctccttgcttcctcattgtctgctctgtaggaatcagaaacccatcctg

SEQ ID NO: 25177 - DNA, 121 bp, Artificial Sequence
  Synthesized
  misc_feature (61): n=a or t
taactgtgtttccagttctgtaattgggactttaacccgctgttctgctaggattaggganaagtttgggggccattttggggtgactgtctggtgttgaagacagcttcaggtacgtgtc

SEQ ID NO: 25178 - DNA, 121 bp, Artificial Sequence
  Synthesized
  misc_feature (61): n=a or g
tgtttgttgttgtgtctcctcagagctttattgctccttacaactagaaggagctctgtgncggggggagaccggagaattcctattttacgcagaggaacgtctttgtggtatggattgg

SEQ ID NO: 25179 - DNA, 121 bp, Artificial Sequence
  Synthesized
  misc_feature (61): n=t or c
cgttgccgggcaggattggaggaaggtgctgcaacgtctgccccgttggtgccaaatctgnttctggccccagcacgattatgtcacggctgaggctgcgtggggctggaggggtgtggga

SEQ ID NO: 25180 - DNA, 121 bp, Artificial Sequence
  Synthesized
  misc_feature (61): n=t or g
taggattacatcattgccatattccctcacataagatctatcgatattccattgacaccantggggaaaaatgccagattatgtcagccagcttcatgtctgggctacgctgaacatgtca

SEQ ID NO: 25181 - DNA, 121 bp, Artificial Sequence
  Synthesized
  misc_feature (61): n=c or g
gatttctaagacttgttttcagtatttttagcccttaagtaagtgcagctggtcgataaantcaatcaattttctcattcataaaatagagttgtattctccttttatgtttcagagccag

SEQ ID NO: 25182 - DNA, 121 bp, Artificial Sequence
  Synthesized
  misc_feature (61): n=t or c
tgtcaagtctgattaaggctttgttttgcatatgtgagaggaagcaaaaagcatcgccttntgccccagggtcgctgctggaagagaaagaccagctgggacctctggtggaatgcagagg

SEQ ID NO: 25183 - DNA, 121 bp, Artificial Sequence
  Synthesized
  misc_feature (61): n=t or c
tctacctccagtataagatggatcatccctaggctggatactttctaagaggtggtcttcncctccaacatttcccacttctatgttgggaccagataccgtgcgtgcatgtatgggtaag

SEQ ID NO: 25184 - DNA, 121 bp, Artificial Sequence
  Synthesized
  misc_feature (61): n=t or c
aggatgctggtggtcggagcggatccacatgaggaaaccaaacatggcttcttggtgcttngtgaattctccagatgggagctggccgtggttttgtttggtttcgttcccccattccgag

SEQ ID NO: 25185 - DNA, 121 bp, Artificial Sequence
  Synthesized
  misc_feature (61): n=t or c
gtgatgtttttcctctttccagactttttgtattactatttttgagaacctttaattactntcaactttgtccagcaaactagtggaagcagagccacgtttgaagggtcttccttctctt

SEQ ID NO: 25186 - DNA, 121 bp, Artificial Sequence
  Synthesized
  misc_feature (61): n=t or c
ttcactgagactctcaattacgtgtcccttacaagctttaaggtttctacctcaatgactnccttgatcataggatcatttgtgcagattggaataggtttggaatacctaaatagtgtga

SEQ ID NO: 25187 - DNA, 121 bp, Artificial Sequence
  Synthesized
  misc_feature (61): n=a or g
ttatcacgtgggaaatccagcccatcatcctgccttgtcacctcacttttcaaaggctctncagagttgtagcaaatctcctcctacatcctaggctcccagctcaggcagcaaagctagg

SEQ ID NO: 25188 - DNA, 121 bp, Artificial Sequence
  Synthesized
  misc_feature (61): n=t or c
atgccacctgactattgtgatgggtccccagttgctctgcttggtcttacggagcaatcgntgctgctttgcttgcagtgacgacctaagcactgcaccccaccactactatccagagctc

SEQ ID NO: 25189 - DNA, 121 bp, Artificial Sequence
  Synthesized
  misc_feature (61): n=a or g
caaaaacagtctttttctccccctgccttcccaccccagcacaatacttaatcttaccttncactgttttaactcctcagttttgctgacaggctgcaagagtttgaaaggaaaaagagtc

SEQ ID NO: 25190 - DNA, 121 bp, Artificial Sequence
  Synthesized
  misc_feature (61): n=t or c
taactcaaattatttctggtctctataatccttgatgattgcgttgagatcttttctgaanaactgttatttagtaaatgctttgtttgccattcctaagtgttcctttatacaactgtag

SEQ ID NO: 25191 - DNA, 121 bp, Artificial Sequence
  Synthesized
  misc_feature (61): n=t or c
acacaaaagaaagtgtgttttcctgctaagatatatttcttgaagtacatagagtatatantcagtctaaagatatcatctgtatcttatggaatgtgaacataggattagtgttttatgt

SEQ ID NO: 25192 - DNA, 121 bp, Artificial Sequence
  Synthesized
  misc_feature (61): n=t or c
ctatggccctgcatgaacaaaatgataaagtgcactcctaaatgttcttggtttagtgganggtctgcacagaggagctgcttcagatccccaaggcagggaagtaggaacactggaaagt

SEQ ID NO: 25193 - DNA, 121 bp, Artificial Sequence
  Synthesized
  misc_feature (61): n=a or g
cgcttattcagagctagcaaccctaacttaggactcctggtaaagagctctctctcacttncactcagcaggctttgtaccatcagaacaacaacaacaaaaaagtccccagtacaaagca

SEQ ID NO: 25194 - DNA, 121 bp, Artificial Sequence
  Synthesized
  misc_feature (61): n=t or c
tattaaagactgtatggtctttaagcttcaaaaaaagtcacttactagagtcataaagcantttgtatagaaaagtattacgatcatccacatgaacaaacgcagtgcaagcactcttggg

SEQ ID NO: 25195 - DNA, 121 bp, Artificial Sequence
  Synthesized
  misc_feature (61): n=a or g
ccttctgatatcttcttcacagcagaagattaagttcaatttcaagaatccattggagaanaaatgcatgtagaattgaaaaagaagcattttgtcattaaaagaagacatcccagggcgt

SEQ ID NO: 25196 - DNA, 121 bp, Artificial Sequence
  Synthesized
  misc_feature (61): n=t or g
ggatagcactgaatttgttttaagagataacagcttttgatctgctgctattttttgtctntcctattgtcatgtttctcttcatcagaagtttctgtcaactgtttaatccatacaacac

SEQ ID NO: 25197 - DNA, 121 bp, Artificial Sequence
  Synthesized
  misc_feature (61): n=a or g
tgcacagtggtcaatgtgaagctatggtcagtgtgaaactatgctctggtgtaacactccngacccttcagcagcacgcaccagagagaaggtcagcagaaattctcccatcacctttctg

SEQ ID NO: 25198 - DNA, 121 bp, Artificial Sequence
  Synthesized
  misc_feature (61): n=t or c
aaagaggacatttactccagagtgctggagagaaaacgttctttcctaacaaatgcacagntccccaggccaggtcctgctttgctgctctctcaattacctccagtaacaacactgaaat

SEQ ID NO: 25199 - DNA, 121 bp, Artificial Sequence
  Synthesized
  misc_feature (61): n=a or g
ctccacacatacagttgaaatggcttagtaaagttaaatccatgcacagagcttgtccctntataacttgcctttgagaactggcatggcagtagctcaagtagtatttcctgtatttttt

SEQ ID NO: 25200 - DNA, 121 bp, Artificial Sequence
  Synthesized
  misc_feature (61): n=t or c
agcaactgccagaggccacagaatcaacccatgttatttggtccttcatgtcaccctgccngggcactgcctgaccccttctggtgctgtaggaaagaaagaggggagaagcagagatgtg

SEQ ID NO: 25201 - DNA, 121 bp, Artificial Sequence
  Synthesized
  misc_feature (61): n=a or c
tggtgcaaccattgtgcaacggcagtggaatatattatggcatatagaacttctgtcctgnacttctattctgtaatttgaatcttggtatttttggaccattgatgtagttagtggtttc

SEQ ID NO: 25202 - DNA, 121 bp, Artificial Sequence
  Synthesized
  misc_feature (61): n=c or g
cattagatcctttcttccatcataataagccattttttttcactcctagagatgacacctnactttttgccaaaataatttctaggtggaagaaacgttgatgtttttgttttcgttgtat

SEQ ID NO: 25203 - DNA, 121 bp, Artificial Sequence
  Synthesized
  misc_feature (61): n=t or c
acgcctatcagtccacagtggttaaccattttcaaatccaaatgctaattttcagccttcntacctaatcagtattgcgatactcaatcaactgaaccaacaaacattgtgacaactgtca

SEQ ID NO: 25204 - DNA, 121 bp, Artificial Sequence
  Synthesized
  misc_feature (61): n=c or g
ctgatgcacatcttccaactcttcagacttgaagactgttctcatgtttacagaggctganaccctgatagaattctggttatatcatgaaagaaatgtgtttctctccactcttgaagaa

SEQ ID NO: 25205 - DNA, 121 bp, Artificial Sequence
  Synthesized
  misc_feature (61): n=a or g
ccagaggatgtacaccaccaactccagggactttctggttccttaaaagaaacaagcgatnctcctttgagtcccagcagcaaataatgcagtgttctctctccaccagcatcagagctct

SEQ ID NO: 25206 - DNA, 121 bp, Artificial Sequence
  Synthesized
  misc_feature (61): n=t or g
ggcaagcatgtataacctttctttttcacttttgttagtgtaaattggaaatgtacttggngagagtttttccaaagacagtagaaggaacggtggaaggtatgaaaatatgatataatga

SEQ ID NO: 25207 - DNA, 121 bp, Artificial Sequence
  Synthesized
  misc_feature (61): n=t or c
aattaccctcacccgcgcaattcagcagtgagactgcaaggggaattctacttcactgctnaactgtgtgacctgaatactgcccgtcctaagctttcagcagagacacaccagctggtta

SEQ ID NO: 25208 - DNA, 121 bp, Artificial Sequence
  Synthesized
  misc_feature (61): n=a or t
ctcattttctgtcctccatgctctgcagtgtttgggctctggactgatgtcattgaattanaacaaggagctcacattttcctaaatccttaaatcttactatttggataaaatctgggtg

SEQ ID NO: 25209 - DNA, 121 bp, Artificial Sequence
  Synthesized
  misc_feature (61): n=t or c
cctgcaaaattaataaacctgaacagctttcacagatcagaaaggtgaacatgttatgaangtcagaaggatgccaaatggaaaatatatacatatatatatatatatatatatatatata

SEQ ID NO: 25210 - DNA, 121 bp, Artificial Sequence
  Synthesized
  misc_feature (61): n=a or g
caccccaacttcagtctttcatagcaaaatggtggggattttgttctacctgcttgatcantgcagcaactgggcactatggggcaacgaaaccacaggctggcataaagaaatccataat

SEQ ID NO: 25211 - DNA, 121 bp, Artificial Sequence
  Synthesized
  misc_feature (61): n=a or g
cgtggatgacactaagctgagtggtgtggtcaatttgcttgaggaatggaataccactcanagacaggttcaagaaacgggcccagcagacaagaggctcaatgactcaaatgcaaggtct

SEQ ID NO: 25212 - DNA, 121 bp, Artificial Sequence
  Synthesized
  misc_feature (61): n=a or g
catcaaacatttcccaccaacagaaaacactgaactgttgccacttcccaaaatcccagangcagaaggttgagataatttttgtcacttttactatgttcctgtggcttcccttccttta

SEQ ID NO: 25213 - DNA, 121 bp, Artificial Sequence
  Synthesized
  misc_feature (61): n=a or g
tgactcctgcttaggtcctacaatgatgccagaaaagcccgttaggacaatcttgtggaanaaaacaatttttatcgaagacattcctgtctgggcagatttctgacagcagatgttacaa

SEQ ID NO: 25214 - DNA, 121 bp, Artificial Sequence
  Synthesized
  misc_feature (61): n=t or g
gcgtacttaggtagtaatattacttttctatattaggcagtgttcacaagtgtgatagganaaccaatatacttcaaaaggcattgttaatctcctgtgtgcagatcactcaaaggatcca

SEQ ID NO: 25215 - DNA, 121 bp, Artificial Sequence
  Synthesized
  misc_feature (61): n=a or t
acatgagcactgagctctggatacagcaataacgttttaagtaggaaatacataaaccttnaattggctggcatctgtgttcgactaaatctgtcattcctctgttagaactggcaaactt

SEQ ID NO: 25216 - DNA, 121 bp, Artificial Sequence
  Synthesized
  misc_feature (61): n=c or g
gaaaaacagaacaatttaaagtttccacccattgtgatagggtttagtgaggacattctgntgataaactgtttcagcactgtcaaacctgcttattaatggaggcaagagaccaaaagtt

SEQ ID NO: 25217 - DNA, 121 bp, Artificial Sequence
  Synthesized
  misc_feature (61): n=t or c
atcctctcctaacctcaaaagcctgaagacagtccagagatccttttcagccttgactttntactattctgctatccaaatttcagtctttttctgtatctttttaatcagaagatttcta

SEQ ID NO: 25218 - DNA, 121 bp, Artificial Sequence
  Synthesized
  misc_feature (61): n=t or g
gaaatcacatatttttaaccagaagttacactatgacttctctgtacaataattaaccganatgtttcttgacatacatatactgaaattctctttgattttaaaaatcagcaatattgaa

SEQ ID NO: 25219 - DNA, 121 bp, Artificial Sequence
  Synthesized
  misc_feature (61): n=a or g
attaaaaattctactctacaaccttggagaacagatgtattccaacaacggcttactgtcnttgatgttcttggaatgtattgccatgctgcactattacaacacctgcacacattaccaa

SEQ ID NO: 25220 - DNA, 121 bp, Artificial Sequence
  Synthesized
  misc_feature (61): n=a or g
ctcagcaaagagctggcaccaggcgatgcactgttctaacacctggcatgcacttagtacngctttcaaccacgttggtggaaatctgctctgtgtttatggagagtgctactatttctgc

SEQ ID NO: 25221 - DNA, 121 bp, Artificial Sequence
  Synthesized
  misc_feature (61): n=a or g
gatatctgctagaaaaggaaagtgatgatgtccacagacaacaccagcagtgacctatggngatgaaaaggcaacagaaagaaattgctggaaagaatcagtgtgagtacatattcagtaa

SEQ ID NO: 25222 - DNA, 121 bp, Artificial Sequence
  Synthesized
  misc_feature (61): n=a or g
atgggggcttgtttatttccagcgctctgtctatttatggaaggccatgtcatcctgtgtnttctgtccctagaggcacaatagagagtctttttctttttttctctttttctattttttc

SEQ ID NO: 25223 - DNA, 121 bp, Artificial Sequence
  Synthesized
  misc_feature (61): n=a or g
tttcagctacagttgttacatttgccttgtaatagtatcataggccaagtcctttcaactncagttccccattctcacctctatcacatctttactattgtttcagttaaatctaatgact

SEQ ID NO: 25224 - DNA, 121 bp, Artificial Sequence
  Synthesized
  misc_feature (61): n=a or g
acaggaattcagagccagaccaaaatatgaggtcaaggaagtttcttttataataatagtngttatctgtttaatgtgtgatctggcagtgatgtgatgttgaccgtaagcaattaggtat

SEQ ID NO: 25225 - DNA, 121 bp, Artificial Sequence
  Synthesized
  misc_feature (61): n=a or g
aactgcttttagacttccatctaacttggacattttcagagtattacacaggaaggccaantgagttaggagcgcatgttcctacaaagggaaaatcaaaggaggaggtgagggggatcct

SEQ ID NO: 25226 - DNA, 121 bp, Artificial Sequence
  Synthesized
  misc_feature (61): n=t or c
ttattaatatgtccaatatagtaaatcatttgtaatattgcaaattaatttaagattctanggtggtttggtttgattgtctcctggttatgtcagaatttaggtaatacatttcaaataa

SEQ ID NO: 25227 - DNA, 121 bp, Artificial Sequence
  Synthesized
  misc_feature (61): n=a or g
taagtttgacaaacaacgtaacctggaagtgcagaatttggtgtgaggtataaaacttttnagaagctaattagatacttgggaaatcagtctgtgtttggagcttcactaacatcagcat

SEQ ID NO: 25228 - DNA, 121 bp, Artificial Sequence
  Synthesized
  misc_feature (61): n=t or c
attgcccaaaggcagaagtgcagttcctcatagtgagttctgagaatgtaacccttaatangactaaatagaatccctatgaatttttaaatagcaaatttatgctttccactagctactc

SEQ ID NO: 25229 - DNA, 121 bp, Artificial Sequence
  Synthesized
  misc_feature (61): n=t or c
aagccacgctcagtagctctgagttgaacaaacaccaaaattaaaggtcagaattttaganagataaaatcttcctggtcaaaatgacaccactggatgtgctttaaagcaaccctcgggc

SEQ ID NO: 25230 - DNA, 121 bp, Artificial Sequence
  Synthesized
  misc_feature (61): n=t or c
gatacttaaggatatttcctttctctacggcttatcagctcctttctgtctgcctgtatgnatcggcccgttggtatttttagatggtttgctggaaactttgcagcgtgctttcaagtta

SEQ ID NO: 25231 - DNA, 121 bp, Artificial Sequence
  Synthesized
  misc_feature (61): n=a or g
atttgtaataccatgtacaattacaagattttccatttaaatacatgccagcatgcagtanatcttccaacctatctcaaatgaagagatgttaattagtttttctaaattatgtcagaat

SEQ ID NO: 25232 - DNA, 121 bp, Artificial Sequence
  Synthesized
  misc_feature (61): n=a or g
accgtggatcagcatgtctttgtttcctctctagctctgtcaggcttgaggactgtataanggatagggagaaccctgtcccccttccccatcaacagaggatgttttgctgcagggtagg

SEQ ID NO: 25233 - DNA, 121 bp, Artificial Sequence
  Synthesized
  misc_feature (61): n=a or t
ctcagacatgctggcgatctttacatcactgtgtagtggatgattaaagaatgagctctcnctcagcatgacctttgtgtaacagtcacactggcagcccagcatggcttcagccatgggg

SEQ ID NO: 25234 - DNA, 121 bp, Artificial Sequence
  Synthesized
  misc_feature (61): n=a or t
cccgtttctcatggctggtggggtccagcaaagattggggtccagcagtgctaccatggcngtggatttggccaacacagcacattgctttggctgaagctgagagcttcccgcctcgctc

SEQ ID NO: 25235 - DNA, 121 bp, Artificial Sequence
  Synthesized
  misc_feature (61): n=t or c
gagaattttcacctaaggtagcaaggaaagatccttgcaaagtcatgttaacttttaatangtgtcagactttggtccatggttacctgctgggaagtctttgttaagtctgcactctccc

SEQ ID NO: 25236 - DNA, 121 bp, Artificial Sequence
  Synthesized
  misc_feature (61): n=t or c
tgaagtttcaggggctccaaaacctgccatctcatggaagaaaggtatccccttactacantgccgtggaactgcttgttttcttgcctactcctgtagatccatttgatattttgtgatt

SEQ ID NO: 25237 - DNA, 121 bp, Artificial Sequence
  Synthesized
  misc_feature (61): n=t or c
acctaagagacgagggaatggaagcaggtttctgctcagagcagcaagcaaatccatttcntgcatacttcacccacacaaatgccctcatacttcaggtatgaggttctggaacttgaaa

SEQ ID NO: 25238 - DNA, 121 bp, Artificial Sequence
  Synthesized
  misc_feature (61): n=a or g
gagcctggaactcacagtggtgtgtcaaggagcaggatgcatctattaaatgtacctctcngtctttgtaatgctgagtaaaggttgcttcctctcctgtgccatatgtataagaatcttt

SEQ ID NO: 25239 - DNA, 121 bp, Artificial Sequence
  Synthesized
  misc_feature (61): n=a or t
acaatctacctctcacaggattattggacacgagcatttctcacacatccatgaaggtatnattgggaaaaggagagcaaactgttttttgtgctcacttgtagtaatactaagcaaactg

SEQ ID NO: 25240 - DNA, 121 bp, Artificial Sequence
  Synthesized
  misc_feature (61): n=t or c
agacatactcctggtaatagccgctgttatttttactactgcctaatgcaggaacgttgcntttatgttgccctctgcctcaaggcatctttgcctggatatttgtgtcagctgttctctt

SEQ ID NO: 25241 - DNA, 121 bp, Artificial Sequence
  Synthesized
  misc_feature (61): n=t or c
tacatctaacgagagggctgctaaagaattctattaaactctgcattgaaaatctccctancctagtaatactgtgcaatctcttgattgcatagacatctgtatgtgagattatccaggg

SEQ ID NO: 25242 - DNA, 121 bp, Artificial Sequence
  Synthesized
  misc_feature (61): n=t or c
gaaaagattgttgtgaacacagaagaccaaacagtacttaaactccatttgctgtgtactngtgaataaaagaattggaagttccgtgttataatgctctcagaaagttgaatgagaattt

SEQ ID NO: 25243 - DNA, 121 bp, Artificial Sequence
  Synthesized
  misc_feature (61): n=a or g
aaagtcactttgggtttggttacagttcttattatgcatagttttctgcagttatatatgnttatataatttaaagggggtatcttgtaacctgaacctattcagttgtattagaagatca

SEQ ID NO: 25244 - DNA, 121 bp, Artificial Sequence
  Synthesized
  misc_feature (61): n=t or c
gaagtttcttttcaaaaggcgtactatcggtggcataagaaaaaacagctccttcaaccangaagtggtaggtaggccccatcctacccatgaacagttacggatgggagaaacagttcag

SEQ ID NO: 25245 - DNA, 121 bp, Artificial Sequence
  Synthesized
  misc_feature (61): n=a or g
tctcttatgtgctgtggttccaatctttcaaggacaaattctgtccttgttctgcttattntggcaatattgaggcaatagaggactcatgtccaacacttccaatactttagagaagggc

SEQ ID NO: 25246 - DNA, 121 bp, Artificial Sequence
  Synthesized
  misc_feature (61): n=c or g
tgggatgctgtcctgggctaagtgagctccccttgctgtgtgctgactctaggtggatttnttctctttgctggcagagagttttaatctaataaggagcctcttgtacagggtgggggtg

SEQ ID NO: 25247 - DNA, 121 bp, Artificial Sequence
  Synthesized
  misc_feature (61): n=a or g
atcaagatgccacattctctgtcccatgcaaggagagctgccccaaggagggcctcctcancccttctgttgtcttctggattaccatcgagcacttctcaccacaccttcctgaagacat

SEQ ID NO: 25248 - DNA, 121 bp, Artificial Sequence
  Synthesized
  misc_feature (61): n=a or g
tttttcatcatcagcttgagaaatcagagctaagaggtgactcatctctcccagagagggnagttgggcagagtcagggctttgtgaatgcagagaatacaaaatacctaagtgcagactt

SEQ ID NO: 25249 - DNA, 121 bp, Artificial Sequence
  Synthesized
  misc_feature (61): n=t or c
atcctccaggctccgcagtcacagctttcagcccgtcttcacaggggagaagctccaggcncttcagcatccctgtggccctccttctctttaaagcctaacccaaagagaccagtgtctc

SEQ ID NO: 25250 - DNA, 121 bp, Artificial Sequence
  Synthesized
  misc_feature (61): n=t or c
cacccaacaccaaaaacaagatagagcccctgggcagttccctgttgcttcctactcatgnatcatctttcattactgaaaaaaatcataactgtgttattgcttgctgaaaactggaccc

SEQ ID NO: 25251 - DNA, 121 bp, Artificial Sequence
  Synthesized
  misc_feature (61): n=t or c
tggtatgtttttgatgaaaacctgttcctttctcattcagaccagccctatgaaaacacanacatttctagctatttctcactgtgtgtaacttaagtaacatgctttagcaatgcagtgg

SEQ ID NO: 25252 - DNA, 121 bp, Artificial Sequence
  Synthesized
  misc_feature (61): n=a or c
gggacaaacggagaggaggggaacccatcggcaccgaccgcttcgggaaggggaaaaaaanccatcactgcgcccttcggttttcaagtttggcgaaccaacagcaccgctgcctgcagag

SEQ ID NO: 25253 - DNA, 121 bp, Artificial Sequence
  Synthesized
  misc_feature (61): n=t or g
accagatctcaatctagtcacaaccaaacatcatcaaagaatccaggcccatgtttgtagngagcgtgctggaacaaaacaagattgggtgtggaaacaaagaaacatcagtgcctgtaca

SEQ ID NO: 25254 - DNA, 121 bp, Artificial Sequence
  Synthesized
  misc_feature (61): n=a or c
tgaggcttctccatgaaatacactttttgctcccttttgctctgctacccaacggtagaanctgagagaatagcatggaactgcatcagggaggttaggtagggtgttaggaagaggctct

SEQ ID NO: 25255 - DNA, 121 bp, Artificial Sequence
  Synthesized
  misc_feature (61): n=a or g
ggacctggtgcaaccatcatcacttggagctctcctgctccacctggcctggatcatggancagctgcagcagcgatgagcaaagagctcaggctggtgttcaggatgatgagaagcccca

SEQ ID NO: 25256 - DNA, 121 bp, Artificial Sequence
  Synthesized
  misc_feature (61): n=a or g
ttcattgagtcagaagtgcttgtctaaagtgaaatgtgctaagatgtgtcatcttttaatnatatgaggttggaacactgaaatgagtatcaaagatgagggtgaatcagagaaataagta

SEQ ID NO: 25257 - DNA, 121 bp, Artificial Sequence
  Synthesized
  misc_feature (61): n=t or c
taaggttactttactttctagccaatctcaggagttctccatttaaggctttaaaattacngactataaactctctcaacagactcttaataatgaattaaataagcatgttactctactg

SEQ ID NO: 25258 - DNA, 121 bp, Artificial Sequence
  Synthesized
  misc_feature (61): n=t or c
ggagagaccttaaatactgtaggcagagagtcctctcactaggtcaggttacctgaagccncatccaagcttgcctcaaaccctgtgggacatccacaactttgtgttcagtatctgacca

SEQ ID NO: 25259 - DNA, 121 bp, Artificial Sequence
  Synthesized
  misc_feature (61): n=t or c
aatgaatgcttcttcatttctgtgtaattattttttgcatacaaatggtctgccatacctngtttatctgtggatatcaatgcaattaccttctcattgttgtactacaaaagctgttagc

SEQ ID NO: 25260 - DNA, 121 bp, Artificial Sequence
  Synthesized
  misc_feature (61): n=t or c
tacaacggttaacagaattctatatcctgcattatgaaaagcctatgcatgttatcttatnctccatcactttgctgctgtaatccagggaagcctgaagcaagaataaaaaaggccacag

SEQ ID NO: 25261 - DNA, 121 bp, Artificial Sequence
  Synthesized
  misc_feature (61): n=a or g
attcacaggagctgccagttctttaaaggaatgacattaaaacactggttttcatcatggnggaaaggcagaaagtgtagttaagaaaccagtttggcgaaattgctcaaacctaagaaag

SEQ ID NO: 25262 - DNA, 121 bp, Artificial Sequence
  Synthesized
  misc_feature (61): n=t or g
aaaaaaaaaaaaaaatcaatttctgcacatataaacttacactctagagacagtgcctgtngggtaccacatggctgtacagcaaatggcactgttagcagctgaaggtaacagatggaca

SEQ ID NO: 25263 - DNA, 121 bp, Artificial Sequence
  Synthesized
  misc_feature (61): n=a or t
gaactcagctttggtgtactggctgaggatgcttagctgctctaaagagtgaggaaggagntaggcaacactgtagggcagcaaaaatctaaactttggtgatggacatctcaatactgac

SEQ ID NO: 25264 - DNA, 121 bp, Artificial Sequence
  Synthesized
  misc_feature (61): n=a or g
aaaaaagatcaaaggaaggagagcagaatgagcttttaggctagtgatatttttgggtacntgttatccttgtgttgtgttctgtgactctgggaggtgtcctggagcatgctctctcctc

SEQ ID NO: 25265 - DNA, 121 bp, Artificial Sequence
  Synthesized
  misc_feature (61): n=t or c
ttcacacttgtacacatatatagatggacccaaatcttgagtgtaaatggagtactggatngatcaaacaatacaagaatcgaaagtgctgaggaggaagcacagaggtccttctctgtac

SEQ ID NO: 25266 - DNA, 121 bp, Artificial Sequence
  Synthesized
  misc_feature (61): n=a or g
accagttttcacagcaacaccttcaagctgtgctgttggatcagcttacaattcagcagcnaattccacaaaggtcaagactccagttctgtgtatttgtatataactaataccatattgc

SEQ ID NO: 25267 - DNA, 121 bp, Artificial Sequence
  Synthesized
  misc_feature (61): n=t or c
aagatatcagtctggatgtcaaaacatgagaaagttgggaatctttgctcatttttctcanccctactgctagaaacctcgcattcgaaacattatctggaagttcagtagagagggatcc

SEQ ID NO: 25268 - DNA, 121 bp, Artificial Sequence
  Synthesized
  misc_feature (61): n=a or g
agtctcattttgaaaaatggtagttataaacatttttcaagtattttctgatacccactcncattaggagaaaaaaacctctgttagtgtaatggaaaagagacagtaagggagtagcagt

SEQ ID NO: 25269 - DNA, 121 bp, Artificial Sequence
  Synthesized
  misc_feature (61): n=a or t
aaaaacccttctctgatgagaaaatggctagggagcacaatctagcagtgctgaatgctgnaaatgtctttgtctgttatattcacagcgcagaaagaacatattttttgagtcatgataa

SEQ ID NO: 25270 - DNA, 121 bp, Artificial Sequence
  Synthesized
  misc_feature (61): n=a or g
cataactcaaatttctgaaatacaacatttcttcctcaaaggacaaaagcccttaatatangttcttggtaaactactataactctgaagagaacatccaagaagtaaatatttgttttct

SEQ ID NO: 25271 - DNA, 121 bp, Artificial Sequence
  Synthesized
  misc_feature (61): n=t or c
cttttccaaagccactcatttggagaggaacagagataacaagatcccagttcctcaaatngggagatgctcctcttcatagctttgagtctggagagtgacagggcagtgaccctgagaa

SEQ ID NO: 25272 - DNA, 121 bp, Artificial Sequence
  Synthesized
  misc_feature (61): n=a or g
cccatattctgttaaaacaacggaaattaccatttgtttgaatttgtagcatgaataaggnaagatatttataaatgaacgatgccaatctcaatgctgatagattacatctcactttttc

SEQ ID NO: 25273 - DNA, 121 bp, Artificial Sequence
  Synthesized
  misc_feature (61): n=c or g
cctcccttccctcagattttttaacatttttgtttctttctgtacccaggcaagagctttnctgcagactgcttcatatttagcacctcatatgtatgagccccactttaattttgcaata

SEQ ID NO: 25274 - DNA, 121 bp, Artificial Sequence
  Synthesized
  misc_feature (61): n=t or c
tccttccctaataactttgcctgtttatccacagacaacacagcatcacagtcaacattancatagtaccttttggttttataaccatcttggtagcataatattgcaaaattaccaatca

SEQ ID NO: 25275 - DNA, 121 bp, Artificial Sequence
  Synthesized
  misc_feature (61): n=t or g
aggatgcaacgcagggtgttcacccctgagtgcccaggattcttatcttgccaaaggaganagaaaggcagacgcagaggattgaagctgggatcttaaagttagtgggggaacaaaatca

SEQ ID NO: 25276 - DNA, 121 bp, Artificial Sequence
  Synthesized
  misc_feature (61): n=c or g
ctccccttctaagaatgttctcattatgtttcagcatgtgattcacaacagcatcaacttnaaatgagcactgcattaactcactggatactgctttaaggacaggtgctttctaattgga

SEQ ID NO: 25277 - DNA, 121 bp, Artificial Sequence
  Synthesized
  misc_feature (61): n=c or g
ctcactgtgcaccttcatgaccaaccgacgactgtgtgtacatccatagctcacactgtgngtgttggctcccccagttctgctgcaggaataggtaggcagcactcaagctttccttttc

SEQ ID NO: 25278 - DNA, 121 bp, Artificial Sequence
  Synthesized
  misc_feature (61): n=a or g
tgtgtgagtcattcccagctcagtaccaggtatcctggaggcatctctgaaacactgtccntgttatgagagtatgatgctacactcagaaacttgctttatgaagacaggagtggctggt

SEQ ID NO: 25279 - DNA, 121 bp, Artificial Sequence
  Synthesized
  misc_feature (61): n=a or c
gaacctggatggacatcagaataacggtgcacaactaaagcaattcattcaggtgaatatntcactgttttataaagaaagccatgtgctgttaggttttggtttctgtaggtccctgccc

SEQ ID NO: 25280 - DNA, 121 bp, Artificial Sequence
  Synthesized
  misc_feature (61): n=t or g
tatatactgattaaaatcaggagtagattttggaagtgaatgaaagagatgaattgtcagngaacatctgagtaccaaaattgagcgaaaaacattataaaatgtttaagtcttattgatg

SEQ ID NO: 25281 - DNA, 121 bp, Artificial Sequence
  Synthesized
  misc_feature (61): n=a or t
actgcttaaaactcttttggacaccaggagtactcatgctagtgagaatccttaagcagtntaattttaaatgtttcacctatgcagcttatgaatctgttatgttcttttgcattgcctc

SEQ ID NO: 25282 - DNA, 121 bp, Artificial Sequence
  Synthesized
  misc_feature (61): n=a or g
tctgagccccgagatctgcttcagactaggaagaggatattgtaggtggccttctgaaacntctctgagtaaatgcagcgctttcacccatcttcactcacgctgaggatagaagagacct

SEQ ID NO: 25283 - DNA, 121 bp, Artificial Sequence
  Synthesized
  misc_feature (61): n=t or c
catgcaccacttctgaaggagagcatccactgcaaacaaagctcttagtttcatgcttgancagcttaatttatgatggagtgactggcccggtagatgaggggagaacagtggatattgg

SEQ ID NO: 25284 - DNA, 121 bp, Artificial Sequence
  Synthesized
  misc_feature (61): n=t or c
tagcacccaagcatgggggttgctgagtaacagccatgtgtgaggacaataatccggagangaagggcacaagcaaatgcagcaggcaccatctgaacataaggaaacacctcttgctgag

SEQ ID NO: 25285 - DNA, 121 bp, Artificial Sequence
  Synthesized
  misc_feature (61): n=a or g
tttcttttctttttccctccctcccttggactctgtccagtgacttcgtatctatcttganatgcgttgcccgaaatgagacatcagaacctaactaagaccgtgtcagtgttgactgtag

SEQ ID NO: 25286 - DNA, 121 bp, Artificial Sequence
  Synthesized
  misc_feature (61): n=a or g
aatgtgtcttggttttaaaatatatacagctttcccaagtcagttcagaatgatcagtaanaaaacacatcattgatgtgaccctcatccaaattccggtttcctgtttcaaatcgtagaa

SEQ ID NO: 25287 - DNA, 121 bp, Artificial Sequence
  Synthesized
  misc_feature (61): n=t or g
ttgcacacgcacgtgccaagggccaagggcgtgcaagctgggagttgctgcttcccagttncagccccatcctacaagaaagatgccgggcagattattttttgctggtacaactggaaaa

SEQ ID NO: 25288 - DNA, 121 bp, Artificial Sequence
  Synthesized
  misc_feature (61): n=t or c
ttacctagaactcaaactttgtcagctagcataccctcctgcacatgaaggatgaattcantgtagaagaaagcttgtacgagaagtcccagtagggaccgatcccttgcagttcccagtg

SEQ ID NO: 25289 - DNA, 121 bp, Artificial Sequence
  Synthesized
  misc_feature (61): n=t or c
ggtctctgggggctgcgtgcccttgggaaaggcagaagcacacagggggaggtgctgctgngtcaggtgagagtcagtgcggacccttggattcacaccaagcacgtgaatcacagtgatt

SEQ ID NO: 25290 - DNA, 121 bp, Artificial Sequence
  Synthesized
  misc_feature (61): n=t or c
ctctaaagggggagaaaaatcatcagtagctgagtgcgtgtccatcagtgccaccatgtanaacttggagccacaagccaacccgctgagcagataggtgccagggcagcaaggcagtgct

SEQ ID NO: 25291 - DNA, 121 bp, Artificial Sequence
  Synthesized
  misc_feature (61): n=t or c
agatttctagggcacttactgtagaatgcagccagtttgtagacttggttatggtatacanaaggaagaacttacttggtatggataagcccacagaggcacacctgacattataaaaatt

SEQ ID NO: 25292 - DNA, 121 bp, Artificial Sequence
  Synthesized
  misc_feature (61): n=a or g
ttaacacgaagttgccgtgcagttttcttaaccaaagctccttctccctcgtaggtgggcngatgggaaaggacctcttgcagctgagttctccccagcagaagtgaagagtctgatccga

SEQ ID NO: 25293 - DNA, 121 bp, Artificial Sequence
  Synthesized
  misc_feature (61): n=t or c
ccctccaacccaaagaattctatgattctatgagtccttttactgggggtctacaaacatnaccaaaggtaatctactgctgccacctcaaaaactgcttcctacttagcagctggagccg

SEQ ID NO: 25294 - DNA, 121 bp, Artificial Sequence
  Synthesized
  misc_feature (61): n=t or c
catcaggctgaaatgtaaccgggctacagccagagtttctggctaataagtgcaataagcngtagagccctgccagaggtgggactgctcgttatatagagagagtaaacagaagaacatc

SEQ ID NO: 25295 - DNA, 121 bp, Artificial Sequence
  Synthesized
  misc_feature (61): n=t or c
gagggcaaatagcggctgcaaattgtgaatttgtctgagctcctttctgaaaatgcttgtngcaggttgttggtgtccctgcaggcttcctaaaatacaacacaaagcacccaacccaact

SEQ ID NO: 25296 - DNA, 121 bp, Artificial Sequence
  Synthesized
  misc_feature (61): n=t or c
tgaatcagtaaatagagtaatttcttatttttactctggatacgctttataatgtaaaaanattctttatactctacaaacattctgatgtactttacagagatttctccaccagcattct

SEQ ID NO: 25297 - DNA, 121 bp, Artificial Sequence
  Synthesized
  misc_feature (61): n=t or c
cagagctatatcaaagacagagcctttttcttgttccttttatggaccaaaagaatctcangggtgatgctaaacttttatttccttcctttctcacaagggcacattctgcatttgagta

SEQ ID NO: 25298 - DNA, 121 bp, Artificial Sequence
  Synthesized
  misc_feature (61): n=a or t
aatcattcaggtatgtgcatattacccttgtcaatcatgtgaaaatcacactgacctggtncaaaacagaatcctcatgttggcaaaattaatgaagtaatgtatagcatgacactcattg

SEQ ID NO: 25299 - DNA, 121 bp, Artificial Sequence
  Synthesized
  misc_feature (61): n=t or c
ctcagcacagtgggcctaaagctcagaagggaactctgtgcactgttataaatttctaaangttatcttttgctgaagattccagaatgaccttgtctcatagaagtaatcactgaactat

SEQ ID NO: 25300 - DNA, 121 bp, Artificial Sequence
  Synthesized
  misc_feature (61): n=c or g
ttagaactgaaaagtaaaggctttatttaaaagtcagctaggataggacagagagtcacanagactttatctgccagtaagattccctaaacctaaattattaatcaattaaaataaacaa

SEQ ID NO: 25301 - DNA, 121 bp, Artificial Sequence
  Synthesized
  misc_feature (61): n=a or c
atttttttatttttttttaatcacgagacaacaaatgttgcactatttcacctctacagancaacgctaaaatgttacatataggcttcaccagccttaaaaaccatggcgggggcagcag

SEQ ID NO: 25302 - DNA, 121 bp, Artificial Sequence
  Synthesized
  misc_feature (61): n=t or g
tggagttgatttgcttaatcagtttgacaaataatatcctctatgaaaagcccactgaaanttggtgtgatactggtgaatctttagaaagataccacaatttagccttgattaaaggttt

SEQ ID NO: 25303 - DNA, 121 bp, Artificial Sequence
  Synthesized
  misc_feature (61): n=a or g
tttaaagggctattggctttatgaaataacagcatgtcccattcaggtacaaaatattccntgaaaaccagctagtttgttaactgtttctcaaattattttattagacattattcatacg

SEQ ID NO: 25304 - DNA, 121 bp, Artificial Sequence
  Synthesized
  misc_feature (61): n=t or c
ttaggaaatgaagctgttgacttagagccagccctaagtagcaatataaaagttgatagantggaggaacatttggaagtgaaaaaagaactccctgttgaaatgttgataagaatccagt

SEQ ID NO: 25305 - DNA, 121 bp, Artificial Sequence
  Synthesized
  misc_feature (61): n=a or g
gattaggattaataccagagtcgtaaggaggataaaaacctaaaaagggagaggatcatgngttattttcaaaagggagccaccaagctgtacagttggatcttggttgaaatccactatt

SEQ ID NO: 25306 - DNA, 121 bp, Artificial Sequence
  Synthesized
  misc_feature (61): n=t or c
tttctgaatgagagcatgagagaattcatggacctcttctagaaactgtaagagtctacangttctccatcccctcctaaaagttcaacaacagatatcaattaattttgttagctgttct

SEQ ID NO: 25307 - DNA, 121 bp, Artificial Sequence
  Synthesized
  misc_feature (61): n=a or t
tcaaaaaatgatgacatgaacaaaatagcagaataattgtactggaaaaactttcatgcanattaaacttatcttctgtaccacctactcacaatttcagtaaaggatgacatctctgtgc

SEQ ID NO: 25308 - DNA, 121 bp, Artificial Sequence
  Synthesized
  misc_feature (61): n=t or c
aagcaatgggacatcaacctgacatctgccttgggagcacgagtgtttgtggctggtgacnggagtgaaggaacagcgctgccgtgaaggctcagaggagcacagccgcagtgtttacatg

SEQ ID NO: 25309 - DNA, 121 bp, Artificial Sequence
  Synthesized
  misc_feature (61): n=a or c
gaattaaaatctagcctgagtgaaatcattcaatttctggaagagtctccattcaagatancttgtgtaattctactacctactaatggtagtaggtaatagtacctactacctgctaatg

SEQ ID NO: 25310 - DNA, 121 bp, Artificial Sequence
  Synthesized
  misc_feature (61): n=t or c
gaatggataaaagtgcctaatgtaaaagactgacaagcagggaggacttctcagcaccttncaagaattttggcggcttttagtgctgttcatggagttgagatctttattcacaagcact

SEQ ID NO: 25311 - DNA, 121 bp, Artificial Sequence
  Synthesized
  misc_feature (61): n=c or g
caaagcacgcattagaagcactgacactgcgatgatcactaattactaacaggattttcanaagtaggcaaacttacgtctttacatgaatgtcaggcatttaagtcacaaattagtcctc

SEQ ID NO: 25312 - DNA, 121 bp, Artificial Sequence
  Synthesized
  misc_feature (61): n=t or g
gtcaccatctcggggaagtcgagcactgcagctgacagggatttcagtcaacaccacgganctcctgcgtgtgttctgtgtcttcaggaggggcaggcatcatccgccagccctactgcac

SEQ ID NO: 25313 - DNA, 121 bp, Artificial Sequence
  Synthesized
  misc_feature (61): n=c or g
atgtgacttcagcattgccaaatctcataatttgcaccctgagtcttatgtcagtttgctntttcttttccattaagcttcagctcctggggtcatacaattaaagaagaatctcagctta

SEQ ID NO: 25314 - DNA, 121 bp, Artificial Sequence
  Synthesized
  misc_feature (61): n=t or c
agaaggaaggttacaaaaacagggctgcagaaaagcaaaaggtcatatgcagacacttcangttgattctgggagattattagctgcacagtgactagcacacttgacagtaccttcatga

SEQ ID NO: 25315 - DNA, 121 bp, Artificial Sequence
  Synthesized
  misc_feature (61): n=t or c
tttattgtttgaactttaagggtgctttaatttccattcccttgtccaattaagtagattnatctcctcaggcagttcttctgatccaactctgaaaagagaagagggaaatcacagggaa

SEQ ID NO: 25316 - DNA, 121 bp, Artificial Sequence
  Synthesized
  misc_feature (61): n=t or c
gtgatggactttagagatttcagcaactgaagttttatatctacccagaatatctctgctncatagatatataaaactagcacaacacacacacacacacacacacacacacacacacaca

SEQ ID NO: 25317 - DNA, 121 bp, Artificial Sequence
  Synthesized
  misc_feature (61): n=t or c
cataggatttgtcagatgtttctaaaacaacatcttccaggagtctgagaggtctcttagnagctatgacaatggtttaatggaacataatttccagtaaaggaaactaatttactatttc

SEQ ID NO: 25318 - DNA, 121 bp, Artificial Sequence
  Synthesized
  misc_feature (61): n=a or g
atgtgtgtgccatgttcctgctgtgctgagatctgccaggggtgggtttagcaggcaatgnggagggcagcacagcctgggtcagtgtccctgtgatggattacaggtttgtgtggttctt

SEQ ID NO: 25319 - DNA, 121 bp, Artificial Sequence
  Synthesized
  misc_feature (61): n=a or g
cttttagggaccaagacagaaatgttcagaaattggtgcaggagatgctctcctgcacagnaaggggtttgcagaactcactcagacgtcctggaaagcttaacagaaggtcatgactttg

SEQ ID NO: 25320 - DNA, 121 bp, Artificial Sequence
  Synthesized
  misc_feature (61): n=a or g
ggaagcagcagaccatcccagccttttccttgcagtgaatttagatcctttcaacttaccnctgaagaataatggagttagaaaacccataagtagcacaagatagaaaggcagtaagttg

SEQ ID NO: 25321 - DNA, 121 bp, Artificial Sequence
  Synthesized
  misc_feature (61): n=a or g
tttgtttgttttgtgaacgtgaaaagtactttctcattctgatccttgtgaaaacgcagtnaattctttactttttggggagtaaaacagtaagtgactttacctctctcatttgattatt

SEQ ID NO: 25322 - DNA, 121 bp, Artificial Sequence
  Synthesized
  misc_feature (61): n=t or c
tctttgctagaaacacctccttcttgcactcttgcatgatacttgcctttttcacagctgngcacattttgtctcagtttcagtagctgacaattttctgacagtcttctgtgactgcctc

SEQ ID NO: 25323 - DNA, 121 bp, Artificial Sequence
  Synthesized
  misc_feature (61): n=c or g
atctctatataacacaaagaaataactccctaaatgtgttatccagggatgtttatgtacnaaatatcttattccggaggtttacaaaaacaaacaagcacatgaactaagaaggggcact

SEQ ID NO: 25324 - DNA, 121 bp, Artificial Sequence
  Synthesized
  misc_feature (61): n=t or c
ctttatccaaaggagctttgtcaaaaggtgacctcttttatatttgtgggttcatatgatngtaacaactaaagacttagatttttgacataataatgcaatgcaaagtacatatgggaaa

SEQ ID NO: 25325 - DNA, 121 bp, Artificial Sequence
  Synthesized
  misc_feature (61): n=a or g
ctatgcacatacataagagttgcaaccacccttcactgcattattgctatactcagatatnggggaatgcaattcatctgaccaatgtgtgtgtatatatatatataatgcatataatgta

SEQ ID NO: 25326 - DNA, 121 bp, Artificial Sequence
  Synthesized
  misc_feature (61): n=t or c
gaccaaattcagcccagcataaatgcagagagcttcagtggtctgtgttagataggaaggngaaagttcctgcagtgttgaaactatgaatatgcaaatgtgcacagtgactgtggcaatt

SEQ ID NO: 25327 - DNA, 121 bp, Artificial Sequence
  Synthesized
  misc_feature (61): n=c or g
aaaaaagagcttaagattactcaattattaaccaggagttagaagcctgtaaccaaaccanaataaatcttagccacaactgaattaaagcatttgccagttcaaaccccagcttcagtta

SEQ ID NO: 25328 - DNA, 121 bp, Artificial Sequence
  Synthesized
  misc_feature (61): n=a or c
atttggtctcatcttttttcctcccaacatataatttcatcaccaaactgaccctaaacanaggtctttcactcgagtagtaagaaatataattttcctgtaagcacagaaacagcatatt

SEQ ID NO: 25329 - DNA, 121 bp, Artificial Sequence
  Synthesized
  misc_feature (61): n=a or g
acagctctgtttgatattcatgccgttgtctgattcaaagatgatgatgaaatagtcctangaaaatgccctcaaaaggaaacaaagcaaaccttgcatccacataattagcaatcaacac

SEQ ID NO: 25330 - DNA, 121 bp, Artificial Sequence
  Synthesized
  misc_feature (61): n=a or t
tctgtcagagatctctttctaaatctcacatcttcacctttaaacgtcatctttctcctanattagtctttctgcaactatttcgtgagagtatttctgtcatcttgactaaaaaaaaaac

SEQ ID NO: 25331 - DNA, 121 bp, Artificial Sequence
  Synthesized
  misc_feature (61): n=t or c
gctcctgtgctccaacacagccctgatgccacatccccatcttgtgtcaccttgtcccctngttgtgatccacaacaaaccactgatttggtagatcccgtcatcttcagtgcctgagaac

SEQ ID NO: 25332 - DNA, 121 bp, Artificial Sequence
  Synthesized
  misc_feature (61): n=a or g
cctccttccccaccttgaggtgaggatgtgcccatgcagacgtaggagaggcaggaggttncaataaggggatgtgtgtcccaacatagaaagccaaaactaaacagattcaacgaagtgc

SEQ ID NO: 25333 - DNA, 121 bp, Artificial Sequence
  Synthesized
  misc_feature (61): n=t or c
tttacaccgtgcccaggcgttgggttaaccctttgctgcagtgtgtgcagggtgggatcantaaaggtgcttctgctctgtgctcctgcagtgcaaaggagagggaacaaactgctcctga

SEQ ID NO: 25334 - DNA, 121 bp, Artificial Sequence
  Synthesized
  misc_feature (61): n=a or t
tgagaaattcttggtcagtgtaatggagccattcatgtcactcttgtgtatgacaatacantagaaaaaaatccctctatatagaatattttaaaattaaaaatgaatacagtttaattga

SEQ ID NO: 25335 - DNA, 121 bp, Artificial Sequence
  Synthesized
  misc_feature (61): n=a or t
cactaatctaggcctatcattgatgtaagagattgcttacatatcaatataataaataccnctcactagcagcataaaaatttgctttgctttctgtaacataatatgaaatttatgccag

SEQ ID NO: 25336 - DNA, 121 bp, Artificial Sequence
  Synthesized
  misc_feature (61): n=a or g
ctggagtggctcaaggttcagctctgcctgcaaagcccgttatcccagagcataggagtgnggcacttctgctgatacgctggtctttatgtagggctgcaccatcagtgtactaattgtc

SEQ ID NO: 25337 - DNA, 121 bp, Artificial Sequence
  Synthesized
  misc_feature (61): n=a or g
aaatgcagtcaaggcttggcaggtcaacattttttcctccaatgaatattctgataatatngttaaaaatagttgtgtcaacgttggtggcaatggatacgatacaaaatgtttgtttata

SEQ ID NO: 25338 - DNA, 121 bp, Artificial Sequence
  Synthesized
  misc_feature (61): n=a or g
ttcttttatggtgattacttctcaattatcttgtaatttttcagctatgattttgagacanggatttgcagtctttgtagtaagatttgctccagcaaacaaaacaaattcagaagacaat

SEQ ID NO: 25339 - DNA, 121 bp, Artificial Sequence
  Synthesized
  misc_feature (61): n=a or t
ccaaatcttcctcctttctgcgttgtttttattccatggaaaaagtgttccaatgtgcttnaagtttgtttccagtcggttttctttctttttttttttctttgttctcaggtttgtatgg

SEQ ID NO: 25340 - DNA, 121 bp, Artificial Sequence
  Synthesized
  misc_feature (61): n=t or g
tccctttgcaagagtagaagtatttctcttgtttttgtggatggttacttggctgataacntcagctaaaatgataattagactttgtaaacaagattaatttggaatcagaagaagctca

SEQ ID NO: 25341 - DNA, 121 bp, Artificial Sequence
  Synthesized
  misc_feature (61): n=a or g
gttggtacctggaagttcttaaactcccaggaacagtgcagttgattaaattgactcagancaagtgtcttcaaacaacactttttccttccttgaaaggctcaaggcatgtagagaaaga

SEQ ID NO: 25342 - DNA, 121 bp, Artificial Sequence
  Synthesized
  misc_feature (61): n=a or t
tggggaaagcagtgaaaaaaaaaataaaaaataagtgtaatggtgttgtctaaagacttangttctgatgctatatattccagatctgttgcagaagccacagaggttgatctcaacatga

SEQ ID NO: 25343 - DNA, 121 bp, Artificial Sequence
  Synthesized
  misc_feature (61): n=a or g
atagcttgtcccaatcaccgttgtaacacattgtcataaatctctctgctacttccttcangaaaaagtaacaaaagatctcaagcaccttgttgcaacctactcttcaatactttaattt

SEQ ID NO: 25344 - DNA, 121 bp, Artificial Sequence
  Synthesized
  misc_feature (61): n=t or c
agagatgagtgttaactttgacatacttcacactgaaatctcttttaccaataaagttccngtgaaaacagtagttttacacaaagatataaagaaataaattgctttccatctctaaatc

SEQ ID NO: 25345 - DNA, 121 bp, Artificial Sequence
  Synthesized
  misc_feature (61): n=a or c
gtatatctgaaagaaagggacaaaagattcctaagaatgttcagtaactctgtagaaattntctctcatgttgaaatgaagtttctatgcatccttccatgcctggctggacagtttccaa

SEQ ID NO: 25346 - DNA, 121 bp, Artificial Sequence
  Synthesized
  misc_feature (61): n=a or g
gaagctctgcttggtatctgaaagcacaaaggaaggcaaaactgagctaggcattagaaancattaaagcccaccttggtttcttagagctcggaggacaagggaattgtcagctcaaagt

SEQ ID NO: 25347 - DNA, 121 bp, Artificial Sequence
  Synthesized
  misc_feature (61): n=c or g
ctctgtgaattggttaccctcttaaattaaaccatttctctgcagtgctttgcagcggctnaggagcagcccttcattttgatgtggaagggagcaaaaggggaggattagctccaggcag

SEQ ID NO: 25348 - DNA, 121 bp, Artificial Sequence
  Synthesized
  misc_feature (61): n=a or g
tcccacttcatgatgagggcttgcaccaacacaccaggctgtgcatatagcccatatttgnggtgaaacctccctccccacctcctatccctgctgtataactggagatgggacttgccac

SEQ ID NO: 25349 - DNA, 121 bp, Artificial Sequence
  Synthesized
  misc_feature (61): n=a or t
gggtgcaaatgggaaatgtcaaactaaaaaatcagtagaaaatgaccgtcctcccagctcntactgtttcgcagttctaaggcagtagccactgttaacaagaatgaaacaagagcggcat

SEQ ID NO: 25350 - DNA, 121 bp, Artificial Sequence
  Synthesized
  misc_feature (61): n=c or g
atgaaaaattctaactagattaagatgtcaaaatcactgtacaacacaaaattaattcccngagttaaaattagacacaccactcgctggtgatttctatactgacagctcagctgaaata

SEQ ID NO: 25351 - DNA, 121 bp, Artificial Sequence
  Synthesized
  misc_feature (61): n=a or t
cagaaacactgaagcatttacttctagcattctaacttcctaaatgtactttaagacggcntttataacatgtaacaattctaactttggtcattatgaaagcaaataagctgttcaggtg

SEQ ID NO: 25352 - DNA, 121 bp, Artificial Sequence
  Synthesized
  misc_feature (61): n=t or c
caattccagttttgaagctgtacttcacaccaatatggggtcctgcccaccctgctgctanctttgaacagaagtcagtgcttcattaacctatccagatcaattgctaaatgttctggat

SEQ ID NO: 25353 - DNA, 121 bp, Artificial Sequence
  Synthesized
  misc_feature (61): n=a or g
ttgtattttaggagaaacactggcttacgttaggtctaccagccccatctgtgttaatcanaagtttccagccattagcaccactcatatgcacaatctttgcacaccctctccacaccac

SEQ ID NO: 25354 - DNA, 121 bp, Artificial Sequence
  Synthesized
  misc_feature (61): n=t or c
ctaaatttgtgccatatagcaggaggcatgcctccagctaggtcaagggttcttatcatcncttcgtgctgctcacgcagatctctgcagcaaggtctcagctcgggttgagagccaaaac

SEQ ID NO: 25355 - DNA, 121 bp, Artificial Sequence
  Synthesized
  misc_feature (61): n=t or c
tgcaatatacgactcatcaaaatcctgttactgattcttctaatctaatctctagcactancttgtacctcagagtaaaatttaaggctgtcgtgtggacgcaagaccagctccaagcaac

SEQ ID NO: 25356 - DNA, 121 bp, Artificial Sequence
  Synthesized
  misc_feature (61): n=a or t
atgtgtttatcacataacaattaaagacaagtaaagttttgcaaaacaaggtcgtttctgnctgccctatacacagttaagtttttattatataacattttgtttctataaagccttcact

SEQ ID NO: 25357 - DNA, 121 bp, Artificial Sequence
  Synthesized
  misc_feature (61): n=t or c
ctctgcccgctcccaggagatacggtttccctgcccagtgcctttccttgccctgctttcnccactctctcattcattttatgccttcagctgatgcagaaatggggctggagcaggtgag

SEQ ID NO: 25358 - DNA, 121 bp, Artificial Sequence
  Synthesized
  misc_feature (61): n=a or g
cagtgaacacgtttgcagaggcaggcaagcgccctggcagctcaagtcattgtgccagagntgctggcactttttggagagcattgctaatgatgtgcagtaacaaatatggacagttcta

SEQ ID NO: 25359 - DNA, 121 bp, Artificial Sequence
  Synthesized
  misc_feature (61): n=t or c
ttgtgagttagggggcgtttgctctctaattaatgcttctaatttttcctgtgttcccagngtagttttagagccaatgagttgacatgtaattagcatcctcgcttctttacagccttcg

SEQ ID NO: 25360 - DNA, 121 bp, Artificial Sequence
  Synthesized
  misc_feature (61): n=t or c
gttgaaatcccctctttgtgtgatcgcatggggatttgaatgtgggtctcagaactcctcngagagtgcccaaccgctggcacattctggatgagaatctgtcctgctgaagctgttctgc

SEQ ID NO: 25361 - DNA, 121 bp, Artificial Sequence
  Synthesized
  misc_feature (61): n=t or c
attttccagccttaaggcagggtccagcatatcccagacagaggcatatcatggtgatccngagtaatgcaatggactctcactttttctttccagaactaatccttttcccacctaaaat

SEQ ID NO: 25362 - DNA, 121 bp, Artificial Sequence
  Synthesized
  misc_feature (61): n=a or g
tctctggtccaggcttacaaacactaacttcagacaagcaagactgaatgagaatgcaaanttattctgaatacctgttaactgtaggagagcgtgttaaaccttcttcatcaccaaaact

SEQ ID NO: 25363 - DNA, 121 bp, Artificial Sequence
  Synthesized
  misc_feature (61): n=t or c
tacttactttttttcatttcagaaagagcagaaattgtccagaattatttcttcatttcangtgcccttgagattccaacaaggagtgttattttttgtccgtatgatttcagattggtat

SEQ ID NO: 25364 - DNA, 121 bp, Artificial Sequence
  Synthesized
  misc_feature (61): n=a or g
cattgatgcttgaagtacattttacgtttcttttacgatgtgttaagtttatatgggacanctggtaatggtaggtgagacaacaaagatcatcttctgattagtgctcaaaacctccaga

SEQ ID NO: 25365 - DNA, 121 bp, Artificial Sequence
  Synthesized
  misc_feature (61): n=a or g
ttctaccactgtctctgaagaggcttaatcaccacttcttgagtttgaaacccaccagaancattaagattaataagcactaatgtcacttcttttctgatgactaaaagtcttgtatatt

SEQ ID NO: 25366 - DNA, 121 bp, Artificial Sequence
  Synthesized
  misc_feature (61): n=a or g
gatgcagagtcagacttactacatttattgaggcatttgactccactgggttcctgatacnttcttctttggagtgtgtcagcaaagtgttttactaccttaaggtacctgtgatattcca

SEQ ID NO: 25367 - DNA, 121 bp, Artificial Sequence
  Synthesized
  misc_feature (61): n=a or g
tttagcttccaggttgtcttgaataattggacacttaaaagccagcagggggaaagtgcancacacctggctgccctgctctgctcgcatcaccctctccatgcccttgtgccacgaccgc

SEQ ID NO: 25368 - DNA, 121 bp, Artificial Sequence
  Synthesized
  misc_feature (61): n=c or g
cacttgaaactaagttacactgttgtaatagtctcggctatctctcacaaactcctaacanggagaattcctttaccagagcaggtgttttggtggtgccatcttctttcgggaaattacc

SEQ ID NO: 25369 - DNA, 121 bp, Artificial Sequence
  Synthesized
  misc_feature (61): n=a or g
atgttgcaacatgactcacacatgagaagtcacttgaatattttcagatcattttcgcttnagttggattcttagaacttctgcacagtataaaaagtacttcaaaatgaatgacagtatt

SEQ ID NO: 25370 - DNA, 121 bp, Artificial Sequence
  Synthesized
  misc_feature (61): n=a or g
acctacaatacctatatctcctacataccttacatcccctacgtcacctacatcacctacnacccctgcatcccttacatcccctatgtctctcgctctctaatccctgcctctctcttcc

SEQ ID NO: 25371 - DNA, 121 bp, Artificial Sequence
  Synthesized
  misc_feature (61): n=a or c
cgactcagcaaaaaaaaagtagttagttcaaagaatacagttttactgtatacaatgatgnccagccaactttgtgacttgcctaaagggtcaacaccaaaatcaacaatccataatccat

SEQ ID NO: 25372 - DNA, 121 bp, Artificial Sequence
  Synthesized
  misc_feature (61): n=a or g
gaaattctgaatgtattgccccttacaacaaaggcaacgagctgatcatattaaaaatgcnaaactccaccaacctgggagcagcatactccaaataaaaattgttcgtgatgactctatc

SEQ ID NO: 25373 - DNA, 121 bp, Artificial Sequence
  Synthesized
  misc_feature (61): n=t or c
cagcatcacactgctgtgcctttgtctgtcctcagatctctggaaacacattctttcctcngctccacctctttaataaacattttctgtcttgtcctcctgattgtttctatttatctcc

SEQ ID NO: 25374 - DNA, 121 bp, Artificial Sequence
  Synthesized
  misc_feature (61): n=t or g
gtggggttggtgctgttggttaaagggcaaagaaacccacagctgggcaagctgcaaaccnttccctgtgttcgactgtaggacatgggcaggcactgggacaggttggtaaccggggcaa

SEQ ID NO: 25375 - DNA, 121 bp, Artificial Sequence
  Synthesized
  misc_feature (61): n=a or g
ttaagcatgacaccagaacacaagctctgttgtagctctcatgtttgtttcaactgcctcncatactacacacaacaccagcagacctcagccagtcacatctgcacaaaggactcctgaa

SEQ ID NO: 25376 - DNA, 121 bp, Artificial Sequence
  Synthesized
  misc_feature (61): n=a or g
aggagagggaatggggtcagtgtgggctgtccacgcatcctccagcccaaggagccagagngagggaagagttcttccttaccttgcagtgtcagcaccattcgtcatcaaagtactaatt

SEQ ID NO: 25377 - DNA, 121 bp, Artificial Sequence
  Synthesized
  misc_feature (61): n=t or c
cacaaaagctatgtatcacacacggcagctagcaagtggcaaactagttacttggctgaantaaggtcttcactagaacaaccatgtttctgtatagatgttcaggacgcacatctaattt

SEQ ID NO: 25378 - DNA, 121 bp, Artificial Sequence
  Synthesized
  misc_feature (61): n=a or g
aacaataagagtggaagaggttggtctaccaccttttcagaagtctctcttacagtatctntagactgagaactaatgaagtagctgctgcaaagtaagagtaaaacagggaaagcatgtg

SEQ ID NO: 25379 - DNA, 121 bp, Artificial Sequence
  Synthesized
  misc_feature (61): n=t or c
aaactacagcagaagatccataatttcctattatgacaaagtgatattgatttgattgatngtttcagattaaaagaataagctgcagagtagcattctttcaccacaagcattttcactc

SEQ ID NO: 25380 - DNA, 121 bp, Artificial Sequence
  Synthesized
  misc_feature (61): n=a or t
aaagaagggagcttctaatatgggctgctactttgtgttgattcattaaaccttggttttngtgtaaatggtgactgtgtttccaagatatatgcctgttgatagaacaatctgtatctct

SEQ ID NO: 25381 - DNA, 121 bp, Artificial Sequence
  Synthesized
  misc_feature (61): n=c or g
atgggagaatgtggggaaaaacaaggaaaaaatggggaaaagatgagaagatggggaaaantgggagaaaatagagtaaaattggggaaagtatttgaaaatcgggaaaaatggaaaatga

SEQ ID NO: 25382 - DNA, 121 bp, Artificial Sequence
  Synthesized
  misc_feature (61): n=t or g
ttgccatagagaggggctcatcccttggcctgattcagatctcattaatgttgggtcagtnaggggatgatggaactccgtgcatttactctggttgtgcccccaagagctcaagaacaga

SEQ ID NO: 25383 - DNA, 121 bp, Artificial Sequence
  Synthesized
  misc_feature (61): n=t or c
ttgtaattgattctgagataccttccattacaaagagcatgcatcccatcctgctcattanagaactaaggtacttcatgaataacttctcgacctctggtcacgagcatctgttcaagac

SEQ ID NO: 25384 - DNA, 121 bp, Artificial Sequence
  Synthesized
  misc_feature (61): n=a or g
aaggccttgacctgggccctttctgtagagataaaacctagttcctaccttgaattttagngagtcagatattgtgacgagtgcagagattcagcaaaagtagcaaaaaaaaaaaagtaga

SEQ ID NO: 25385 - DNA, 121 bp, Artificial Sequence
  Synthesized
  misc_feature (61): n=t or c
gtattatttttactattacgttttctactgcaaactgtacaaacttcacacactgagctcngcagatgtgtcagcgcactgctgtttttgcactacacgcgatgataaatcacggatccca

SEQ ID NO: 25386 - DNA, 121 bp, Artificial Sequence
  Synthesized
  misc_feature (61): n=t or c
cactgctttaccccctgacctctcctccctgctcctcatggcctcatgtggttccagcgangggtgcattatcaagaacacccccaggagtatctgaaagcagagcagctctgcttgcacg

SEQ ID NO: 25387 - DNA, 121 bp, Artificial Sequence
  Synthesized
  misc_feature (61): n=t or c
taagtagtgccaaggatgctgtcatggccaagcctaatatatgcgtaaaataggtaatttngcaacaattatctcaggcactgatgaagtctaatgctaccaaggactccaacaccagaca

SEQ ID NO: 25388 - DNA, 121 bp, Artificial Sequence
  Synthesized
  misc_feature (61): n=t or c
atttattcattcttctcacactttgagagaaactgatcccatgaaacctactctccactcncttccttgacattatagtctgactaaatttatcttaatcaatagtgtcagaaaggcagtt

SEQ ID NO: 25389 - DNA, 121 bp, Artificial Sequence
  Synthesized
  misc_feature (61): n=a or c
acacgaagactgtatcatcacatacacctgacacaaagctaagtgggctacaaaggtaagncacctcaccattaatttccctttctcttccatacgtgtttgtgctgtaccattatctgtc

SEQ ID NO: 25390 - DNA, 121 bp, Artificial Sequence
  Synthesized
  misc_feature (61): n=a or c
catatctgctttaaatacatgatatttctttctggttgcagctagtagaaacagacaaaanagtgtttagaaaaatagactgttatttgaaatacatttctcatgaatggctaaatcaaaa

SEQ ID NO: 25391 - DNA, 121 bp, Artificial Sequence
  Synthesized
  misc_feature (61): n=t or g
gcaacttaagctctccaatgaaatgatgttattatatcaacactgtacactagcttagcantacttcagaaaaatatgcagtcaacactcagtactttaacttttcaaaacacacttatgc

SEQ ID NO: 25392 - DNA, 121 bp, Artificial Sequence
  Synthesized
  misc_feature (61): n=t or c
attttaatttctgaaggtggagctcccaaggaaatacgaaatttgctctggcatttgttcngggtcctgctaccctggagttttagggtataacttttatcacccacccatagggcctgag

SEQ ID NO: 25393 - DNA, 121 bp, Artificial Sequence
  Synthesized
  misc_feature (61): n=a or g
gccttctgaaaaccactcttgtgatagactgttgtgtttttctgtcatgtagaattactgntactaatcctcatctctgtgtttcaccattaaaatgaaatttaggcttagcctaaatcct

SEQ ID NO: 25394 - DNA, 121 bp, Artificial Sequence
  Synthesized
  misc_feature (61): n=a or g
tcactggaacttctcaccacttcaatgtatcttcatgctttctggcactggagctgttgcnggaccaactgatctctctcttggttcagtctggagcacaagctgcctatgttttataggt

SEQ ID NO: 25395 - DNA, 121 bp, Artificial Sequence
  Synthesized
  misc_feature (61): n=t or c
gctttacttaagggagagaagtgttctggagttacagtctacttctgaaattccactcttngcacaccactgaggttaagtagctgcctcttctgaatgcattagctctactcagatcttt

SEQ ID NO: 25396 - DNA, 121 bp, Artificial Sequence
  Synthesized
  misc_feature (61): n=t or c
gtctcgatgcagggtagaagcagggtttcccaggaggtgatgctgactgctgctttctgtntcccttgcaggcgtatctcactgacttcctgtgtcagtttgcacagcagccctgctatgc

SEQ ID NO: 25397 - DNA, 121 bp, Artificial Sequence
  Synthesized
  misc_feature (61): n=t or c
aaccacgttgttggctgtgtgggactgtactattttggctgtaggtatttcattcatgagngtagcatacctcctttgagtcctggtttgtggatgttggagcggggcagaggcaggagct

SEQ ID NO: 25398 - DNA, 121 bp, Artificial Sequence
  Synthesized
  misc_feature (61): n=t or g
tgtttcgtggctctagtgtggacgtttataagaaatttccacattcctttctgactcactntgccctttttccctagtcacatttatggtcaagacagaactgaaggactcccagattatg

SEQ ID NO: 25399 - DNA, 121 bp, Artificial Sequence
  Synthesized
  misc_feature (61): n=a or c
atttggtctaacagtcaagaacagaattgttgttgatgttaggactaaagttgtgaggggnagcctattatagacacatagaatttaccaagaagagacctcctggacactcagctttgca

SEQ ID NO: 25400 - DNA, 121 bp, Artificial Sequence
  Synthesized
  misc_feature (61): n=a or g
gaacttccctaaacagatcgtatgtaatgcattcatcactacagaactggaatttcctacnggtcaaaaaacaacgcattataattaaaagacagcgtggaaatacatgaacacaaaagct

SEQ ID NO: 25401 - DNA, 121 bp, Artificial Sequence
  Synthesized
  misc_feature (61): n=t or c
aggcttaagcttgaccttaagcaacatttattattaacatcaacgtttgcatttacatctnggaatatcttgtactaagcatttaacatgtggttaagagattcactcagtcagagctcaa

SEQ ID NO: 25402 - DNA, 121 bp, Artificial Sequence
  Synthesized
  misc_feature (61): n=a or g
attacagatttacatcatagtctcactactgcagtgctgtctgtaattgatgacaggtggnagatgcttgacataaacaagattcagatgtaatccatgaggcaaattgcagggtaacacg

SEQ ID NO: 25403 - DNA, 121 bp, Artificial Sequence
  Synthesized
  misc_feature (61): n=t or c
cagccttcactccccagaacaccccagatgaacacagggacagatgaaaagctcctctccnggatgcctaccttgtgtcaaatgctgcctgctcccaccagcccattccccagcagacatg

SEQ ID NO: 25404 - DNA, 121 bp, Artificial Sequence
  Synthesized
  misc_feature (61): n=t or g
tttttccccaaagaaatatgtgcagagaaatacctgcaatacgtagaaattacatgacttnctggtcaatgtaaatagtatccctgaggaagctagagtagacaggattagatttgaagat

SEQ ID NO: 25405 - DNA, 121 bp, Artificial Sequence
  Synthesized
  misc_feature (61): n=t or c
agcagtgcagcttgaggcagatgagtgctcagaacaagtgctgcaatggcacagcctttangggtgagagactccgggtgaaaggaggagggggtgcaggctgtgtgcagacagatgtcag

SEQ ID NO: 25406 - DNA, 121 bp, Artificial Sequence
  Synthesized
  misc_feature (61): n=t or g
aaaattaccattctctggttaaggttgctctgctccaaatgactggacagttgcagaaganagcatttttttcaatagttttgtgaattatatgcataatttcatttgcttacttgtcccc

SEQ ID NO: 25407 - DNA, 121 bp, Artificial Sequence
  Synthesized
  misc_feature (61): n=t or c
taaattccgagctctgcctactaagaatgccgtgtcacactgaggcaatctgttcaccacnttttaccactgcttcaagttgtaccaagtacaaaaggtttatttgactcattaatatgaa

SEQ ID NO: 25408 - DNA, 121 bp, Artificial Sequence
  Synthesized
  misc_feature (61): n=a or g
ttcttactagaatcaacttaaatgctcttgtattttggacatcttaactttgattccaaangccactcctctcttttaagaagcagaatactttcttctcaaaaaagcagagaagaaaagc

SEQ ID NO: 25409 - DNA, 121 bp, Artificial Sequence
  Synthesized
  misc_feature (61): n=a or c
tgctgaaaactcaggtaacttctccctctgggtgaaaggtgtctttgtaatcctggggtgncaatccaaggtagaaatcggctaaataaagtatcaagagcagctcaaaaataaaaatacg

SEQ ID NO: 25410 - DNA, 121 bp, Artificial Sequence
  Synthesized
  misc_feature (61): n=t or g
ctccaggaaacccaagcctggcaactgaccaagtagctcatttacctccaattaacaaatnatacctatgggccatagtggtgtgtaacagactgagatctgcctacatactggtcatatc

SEQ ID NO: 25411 - DNA, 121 bp, Artificial Sequence
  Synthesized
  misc_feature (61): n=t or c
acgtggcatccagcagaaacattattgtaacaggtaacagaatcattgtgtatatctgacnattaactctacccagtcttacagttatgctaatgtcttttgaagaatacattaccagaga

SEQ ID NO: 25412 - DNA, 121 bp, Artificial Sequence
  Synthesized
  misc_feature (61): n=c or g
atattgagttggataggtaagtcaaaagaaagttgtttctttgtcttatccttgcaaaagnaactgttatggcagagtaaggcctgccccactcacagaggtgacgattcacattttattc

SEQ ID NO: 25413 - DNA, 121 bp, Artificial Sequence
  Synthesized
  misc_feature (61): n=a or g
aacctcagctgatatagaggagagaaattccaaaaggcagagggaatgagaacatagcctntaagagagaactgaaagaagtgagtagagaaaagaaggttaatagaaaatctgctgaaaa

SEQ ID NO: 25414 - DNA, 121 bp, Artificial Sequence
  Synthesized
  misc_feature (61): n=t or g
caataacctgaagctgaaatctggatttctgagcagaaatacacacttactccaaaaactncatctgtcacagaagtacagcaaaagcactaaaaatgcttagacttccatgacttcatcg

SEQ ID NO: 25415 - DNA, 121 bp, Artificial Sequence
  Synthesized
  misc_feature (61): n=a or g
aaagaagggtttagaattgctaagaatgcagttttatttacaacccaatgcctcattacgnaacctgttacagtatgctagctctcatgctccaagctgacaaacgtgttttatcaattta

SEQ ID NO: 25416 - DNA, 121 bp, Artificial Sequence
  Synthesized
  misc_feature (61): n=t or g
tagcctttgcatacatttcctaccttctcacagtgttgtatctacaacacctggggtgtcntgttgctgggaacgctgtccagagctagcaagacatggagtctgggtgctgagtgcacag

SEQ ID NO: 25417 - DNA, 121 bp, Artificial Sequence
  Synthesized
  misc_feature (61): n=a or c
gtttacaggcaatcactcatagattaaatttcttccagaataaagatttaggacctaatgncaaaataacactccatgagtcctcattagaatgcctggttcagctgactcctgccacact

SEQ ID NO: 25418 - DNA, 121 bp, Artificial Sequence
  Synthesized
  misc_feature (61): n=t or c
ggcccaaactgcactcaccagctgaccacaagcttccacactgcccacactttcttggcanaacaccctgcataaggaacaagcatctcattcctgtgcaggcttacagctttctatcttt

SEQ ID NO: 25419 - DNA, 121 bp, Artificial Sequence
  Synthesized
  misc_feature (61): n=t or c
cccttattcttggcattatttaaaatgtgtgttggtggatcctattaaaacttggtagagnctttcaaagtgagatcctcatcagatttttgcatttttggtgacttttgttaaattagag

SEQ ID NO: 25420 - DNA, 121 bp, Artificial Sequence
  Synthesized
  misc_feature (61): n=t or c
aaaccgtaggtataaaacagagaatcatgactggcagagttaatgctttacatagaactangaaacaaaatattttgagaagcaggataaaagtaatacagttggaagccttcctttaata

SEQ ID NO: 25421 - DNA, 121 bp, Artificial Sequence
  Synthesized
  misc_feature (61): n=a or g
ctgtggggggctgaggctgtgttcctgagcaagtgcaagcggtttgatggctttcatcccntgtgccagggagctgaaatcacttctcaggagcccaagagctagcagggcagggatgtct

SEQ ID NO: 25422 - DNA, 121 bp, Artificial Sequence
  Synthesized
  misc_feature (61): n=a or g
aatatttatctgttacccttcttgagatttagatacatgacgtcagtggtattagcatgancctgatcagtaatgatgttttaacctacacagtatgaattccaaaatacacaagcatcat

SEQ ID NO: 25423 - DNA, 121 bp, Artificial Sequence
  Synthesized
  misc_feature (61): n=a or c
aggaagagagaacagccaaaaaaaaaaaaaagaagttacattaggattagtgttggcagcnctgctatgagagaacgcccagaggaaggagagaggttttaggtcctgtctgtaaaggggc

SEQ ID NO: 25424 - DNA, 121 bp, Artificial Sequence
  Synthesized
  misc_feature (61): n=t or g
aaaggtccctaaaaggtgggcaagtaagatcagctctggatgtagatcacatgccattagnctcctgaatcccaagctagcaaattattgtgacatttttcttccagtaatgatgtgaaat

SEQ ID NO: 25425 - DNA, 121 bp, Artificial Sequence
  Synthesized
  misc_feature (61): n=a or g
tcaggttgtgtttcagccatgggtgcgttactgtatattttatgagcaactgcaaccccanccttacagtgagtcactgcaggaaggaggagagcctttctgcttttggcaggcgtgaggc

SEQ ID NO: 25426 - DNA, 121 bp, Artificial Sequence
  Synthesized
  misc_feature (61): n=a or g
gtaatactgcagatcttcaataatacagaatataccaggaatacatgctaacagggcacanggaaagatagaaaacatgaaatatttagtatggaattgggagagactccagtgtaaacaa

SEQ ID NO: 25427 - DNA, 121 bp, Artificial Sequence
  Synthesized
  misc_feature (61): n=c or g
tttagaaataattgttttgttttgttcgtctgcctctgaaacaaaatatataattttagtntctttatcttttcctatgaaaatagcaaaactgtagtaatggattgctttgccaataaat

SEQ ID NO: 25428 - DNA, 121 bp, Artificial Sequence
  Synthesized
  misc_feature (61): n=a or g
agagaaaaaacactgaaccatactcaagacaatttgtactggaggaaaatgaaatagaagngaacagaacagcaggacaaaaactttttgggatgcaacatggaagaagaaaagttacgta

SEQ ID NO: 25429 - DNA, 121 bp, Artificial Sequence
  Synthesized
  misc_feature (61): n=c or g
gtttaatgacatctaagcaaatataaattaagatagctgaagattcattgtttctcagccnttgggagggcagtctgttgttagggagagaatgatggtgggcaatgcagggagcactgcc

SEQ ID NO: 25430 - DNA, 121 bp, Artificial Sequence
  Synthesized
  misc_feature (61): n=a or g
ttgtgacccgggggtttgagaacgggattccaggtcgccaaacaaaaaaaagcagtttacntttgagacaccgttttcggttggtataaatgcgtgagctgcacgttttcaaatggctgta

SEQ ID NO: 25431 - DNA, 121 bp, Artificial Sequence
  Synthesized
  misc_feature (61): n=t or c
gcagaaccagattgagagtgctctggagtcgaggaacaagacactaaaaatgaaaagtacngattaagtggttgcaagatcagatttgccaatcaaccacactgtttagcagatgaagcag

SEQ ID NO: 25432 - DNA, 121 bp, Artificial Sequence
  Synthesized
  misc_feature (61): n=a or c
gttccccttgctcctggagaccatgtccatatgacctccatttgaaaactgccctggggantgatagttaggaagggtctcactttgctagattaccaagttgcttcctgtgtgtagacaa

SEQ ID NO: 25433 - DNA, 121 bp, Artificial Sequence
  Synthesized
  misc_feature (61): n=a or g
gaaaaaatctacacgtgtaaaaaagagaaaaaaacctgttaatatttctctgttggttacnccttgttatctgtcactcatcagcccaccctcaaaactccaagtgttctaagtttccttc

SEQ ID NO: 25434 - DNA, 121 bp, Artificial Sequence
  Synthesized
  misc_feature (61): n=t or c
agaagaataaaataaaataattaaaatcaacaaaataaaaatcttctaactcaaattccantcccttctgggagttgtaataatcttttcttgcacacaatacagttctgactttcagcca

SEQ ID NO: 25435 - DNA, 121 bp, Artificial Sequence
  Synthesized
  misc_feature (61): n=t or c
cagtatggaaaacctttttgatttgggacttaatgctcctgtttcctcttattgacactgnacaccctattcctcagtcagaaaatgatatttcacttttctctgtattagattgtggata

SEQ ID NO: 25436 - DNA, 121 bp, Artificial Sequence
  Synthesized
  misc_feature (61): n=a or g
aggaaagcatgtcattaatttcctttcgaaatgcaggcaactgtgttctcctgctgtttcntcagctcagcatgctgagtacctggctgggagcactgccactcgcaacgtgccatgtgtt

SEQ ID NO: 25437 - DNA, 121 bp, Artificial Sequence
  Synthesized
  misc_feature (61): n=t or c
actttgtctcttctatattccttaaaacacatagaaaactgatgtacgctatttatgatcnttcatttgcttacagttgtttagcatttcacacactcggtttgcagagaatgaagattgg

SEQ ID NO: 25438 - DNA, 121 bp, Artificial Sequence
  Synthesized
  misc_feature (61): n=t or c
taaactagctgagttgtcctggagcttttgttttcattgtgttctggccctactttcctangaagcgtggtaggacagggaaaggtgcaagaaggtctgactccaggtccctgcatgcttc

SEQ ID NO: 25439 - DNA, 121 bp, Artificial Sequence
  Synthesized
  misc_feature (61): n=t or c
ggacttaattttaggagtaaattgactaagccaccttatggctggataacagcatctgcantgcctgcttaacttcaagcatcttcaagttgttagcccaaaacacagacagaatcgaagc

SEQ ID NO: 25440 - DNA, 121 bp, Artificial Sequence
  Synthesized
  misc_feature (61): n=a or g
caacttctcttcagggctttctcattttctttcactgctctatctggtagtctgctgctanggataaagtaggcctaatggaggagggcagcaagggcttctctttttctaggggaaaagc

SEQ ID NO: 25441 - DNA, 121 bp, Artificial Sequence
  Synthesized
  misc_feature (61): n=a or g
ccatataagtgatatctgggagggagaagaaaggaagtcaaaatgcaaaatggactctggnacaataagacagcactgatgccatcctcagagctgagctgttatccacaaaacctaacaa

SEQ ID NO: 25442 - DNA, 121 bp, Artificial Sequence
  Synthesized
  misc_feature (61): n=a or g
gtagtgcccattattttccgttttgggagattcacttttcaatctgcgtccaactcattcngaagccttttgtgtatgtgatacatggatgatacatggatctctgtgaacagctctgacc

SEQ ID NO: 25443 - DNA, 121 bp, Artificial Sequence
  Synthesized
  misc_feature (61): n=a or g
ccttgacttttgctaacagaatctctctctcctgtcctgagaatgtttatttgccacatgnggaacttcttcatggggagttgtttgacttcagatataaaattgaaggtgtgagaaaaag

SEQ ID NO: 25444 - DNA, 121 bp, Artificial Sequence
  Synthesized
  misc_feature (61): n=t or c
tgctggtttagagcagccaaaaatttggcactgttacatttaagattggtggtaccctagngttcatctgtgcgaccctgtgtgtttctttccccagatttcatgtctattcattgatgag

SEQ ID NO: 25445 - DNA, 121 bp, Artificial Sequence
  Synthesized
  misc_feature (61): n=t or c
aaaattaggtcagtcatcaaaagctgcatgtcttttctctagaacaagagaaagctggcantggtgttccctctagagttatcagtggaaaaacaatctacacatgctgcagtatttcatt

SEQ ID NO: 25446 - DNA, 121 bp, Artificial Sequence
  Synthesized
  misc_feature (61): n=t or g
cagtggtgtccatcttccctcctctagggaggcttgcaccttgctcagcctggggtgctangaagagtctgttcaggcttctctgacccttgatctattactctgtacagtatatatgtcc

SEQ ID NO: 25447 - DNA, 121 bp, Artificial Sequence
  Synthesized
  misc_feature (61): n=a or g
gtattctttctattactgcattcagacgtccttaaacgtgaaggcagtggaaaataatggncttggtgcctgcttgtaaataaaaccctttctcagtcaacaaaagagaaatagagagatt

SEQ ID NO: 25448 - DNA, 121 bp, Artificial Sequence
  Synthesized
  misc_feature (61): n=a or g
tatacaaagatgacttagccagactcagcctcattgcattaggtacatattcccaataacnagaagtctttgctgagcttcctaatacctgttttccctcttcagagaatttggaaccaat

SEQ ID NO: 25449 - DNA, 121 bp, Artificial Sequence
  Synthesized
  misc_feature (61): n=t or c
gccctagagacacttcaaattgagcacagaccattgctctttaacctggagcaaaaagatnctcacttgcccagcacacttgccatcagtgcctgcccttgctgctgtctcagagcctccc

SEQ ID NO: 25450 - DNA, 121 bp, Artificial Sequence
  Synthesized
  misc_feature (61): n=t or c
ttatgacacagatgggaatcacatttttcttcagataagaacacttcttgtagtcattcantctgtatttcatgagacactagcagatacagtgagctatttcactctatttctgcttata

SEQ ID NO: 25451 - DNA, 121 bp, Artificial Sequence
  Synthesized
  misc_feature (61): n=a or c
ctcctacttgacatgcaatgacattatcccacagaagcaagagacaaattgtaattcctgntgtaattataggccttagtaggtatacagggttgttaggtgcagagcaactgttcctacc

SEQ ID NO: 25452 - DNA, 121 bp, Artificial Sequence
  Synthesized
  misc_feature (61): n=a or g
ttaggatgctgcagttagccacgtatgtacacacacacaacatgatccttgtaatattacnaaagcggttttactttctgcccagtacagtttgttgtgcaaaggcacttttcaatcactt

SEQ ID NO: 25453 - DNA, 121 bp, Artificial Sequence
  Synthesized
  misc_feature (61): n=a or t
tgagtcataagcacatgagctgaaagaagctgaagacaaaatcatgcatctctgcttaatnccatcacatgatgagtcctggggcccttcatttaattggagagccgagcagtggagagac

SEQ ID NO: 25454 - DNA, 121 bp, Artificial Sequence
  Synthesized
  misc_feature (61): n=a or g
cccaaaatatctgagtctgacataagatagcaagcaaaaaattaaacgaatgatacatacncatgtagacatttcattccattaaaagccacttctcgttatttatttagctaccattgca

SEQ ID NO: 25455 - DNA, 121 bp, Artificial Sequence
  Synthesized
  misc_feature (61): n=t or c
gcgggtagcaacaggcaacaaccagctccatggggaccactgacatctccccaatgtgagntttttccgccacggagatgctgggcaatgagagcagcctggcgtgggaacaccagcatgg

SEQ ID NO: 25456 - DNA, 121 bp, Artificial Sequence
  Synthesized
  misc_feature (61): n=a or g
atacgtcttaacggttttattcatttatttttggatgaatagaggctgaaggagcacgctntgtatttacagacttgtcatgggtcagtcacgggcgtggtggttactgtgctccaggagc

SEQ ID NO: 25457 - DNA, 121 bp, Artificial Sequence
  Synthesized
  misc_feature (61): n=a or g
caaggactggtgtttgatcctggatcgtctcttcatcgtgtcttgtgacatgacaaatccnggacaaagatgtaatttgatgcatcccagggaagtgctttcgtaacaaggcttttgagca

SEQ ID NO: 25458 - DNA, 121 bp, Artificial Sequence
  Synthesized
  misc_feature (61): n=t or c
gtgggatcaggcgctatccttccgatcaccaacctgacattgttcttgctaattggaatangcagttcctgctgaagataaatattttaaagagttattagatagaagtagttcgagaatc

SEQ ID NO: 25459 - DNA, 121 bp, Artificial Sequence
  Synthesized
  misc_feature (61): n=c or g
agactgggagttatgaagaggcttttcataatattttggaggtcttaagaagctctctctnattagagaaagacaggatagattgtgagggctttcattaaccaccttcaccttctctatt

SEQ ID NO: 25460 - DNA, 121 bp, Artificial Sequence
  Synthesized
  misc_feature (61): n=a or g
ttcaagtatttcactaaaaccaacacaagtgagtaatagatatgcaataagcagaggagangtgaacctactgatagtaagaaataaatgttttatccttttacaaaggagaaactatgaa

SEQ ID NO: 25461 - DNA, 121 bp, Artificial Sequence
  Synthesized
  misc_feature (61): n=a or c
aatgaaagctcaaggtcacctctgatgataattgaaaagaaacttcagagttctttaaagntgtggtttatttactgggacatagtgtgtcgtatggagaaatactggaaacattggtatg

SEQ ID NO: 25462 - DNA, 121 bp, Artificial Sequence
  Synthesized
  misc_feature (61): n=a or g
ttaatcaaagacatgagaataataagttattcagtacttataagggatttcatcacaagangatttctctccagggagaaaaatagaggaattaaagaaaaggagccatcatggcagtgca

SEQ ID NO: 25463 - DNA, 121 bp, Artificial Sequence
  Synthesized
  misc_feature (61): n=c or g
cccttttcattcaattattcctgtaaatgggatttaagacaaaattgcatttaaataatangaatgacaatacctggcactggcatggcactttctatcaatgtttgtcaaccagcacctg

SEQ ID NO: 25464 - DNA, 121 bp, Artificial Sequence
  Synthesized
  misc_feature (61): n=t or c
atgaaatgtatgaatgctgtagaaatacaggctgtgccaccgtccttacatgtttttgatngcagcacgatgatggctttcaaggattattacttgtaaaatgttgtttctcttactaatg

SEQ ID NO: 25465 - DNA, 121 bp, Artificial Sequence
  Synthesized
  misc_feature (61): n=t or g
tattaacatcttcaattaagaattgtttgacttcttcttttgtccacttttcaatatgttnatatacatgcagcttctcttttttctcagtgtttgcattttccattctttaaagaaaaaa

SEQ ID NO: 25466 - DNA, 121 bp, Artificial Sequence
  Synthesized
  misc_feature (61): n=c or g
aaacacagtaagttcaggactcaaagatgagcagaatggaatttatttttgtaggtagagnttgcagcagtcctttagggtttgggttaaagtcctgtttggttctactttgttaaaggct

SEQ ID NO: 25467 - DNA, 121 bp, Artificial Sequence
  Synthesized
  misc_feature (61): n=t or g
ggctgggctccagcttgattctcagcttctaaattcccctgtgaagtagggctttgggtanaaagaaagccaaacagatagatctgcaggttctcaacaggagcaagtgctgaatggaatt

SEQ ID NO: 25468 - DNA, 121 bp, Artificial Sequence
  Synthesized
  misc_feature (61): n=t or c
ggttcacagctttctttcacttacctgaaacatacggtgtcacatcacttctggcatcatntatcaccccaagcactggaatctcctgtccatctgtcctttcggccttccctgggtggga

SEQ ID NO: 25469 - DNA, 121 bp, Artificial Sequence
  Synthesized
  misc_feature (61): n=a or g
ggtgacctcagtttatttgtgagtggagggtactattatttacaacaaatgatttccacangtctctcaagctttatccagcacttcatttttctatcagttttcactgtgtaagtaatca

SEQ ID NO: 25470 - DNA, 121 bp, Artificial Sequence
  Synthesized
  misc_feature (61): n=a or c
gttgcatgtttacactaaaactttgccttcggagctaatattttctttggtactactcatnctcttctttttgtacaaatcttccattttatacttttatacttttatacttgcacatgta

SEQ ID NO: 25471 - DNA, 121 bp, Artificial Sequence
  Synthesized
  misc_feature (61): n=t or c
ttgcattcacaatactctacaaattaagtaaagtcttgttttgcgcattctgacttactancaacatatattttattgagaagctggattctgaagagtatttaatatgttgatgcattac

SEQ ID NO: 25472 - DNA, 121 bp, Artificial Sequence
  Synthesized
  misc_feature (61): n=a or g
ctgctcttcccttcactgggggtcaccctaaaaacctctgcaacctacagcgagggcagcnctcactcccctggcaccacgcttttctgtgcctccagcatatctgatgtgagtcctctgc

SEQ ID NO: 25473 - DNA, 121 bp, Artificial Sequence
  Synthesized
  misc_feature (61): n=t or g
gaattttgacattgcttcaaatgtgacactttcatgaggcaacctttctttaaatgacttntgcattgtcttttaaatgcagcaactgcatttatccaacagcctgttgtctgttcagagc

SEQ ID NO: 25474 - DNA, 121 bp, Artificial Sequence
  Synthesized
  misc_feature (61): n=a or g
ggatggaacatctttctgaggctgtgtacactgctgttctgccagcaaggacacctcttcntttttctttatagatatatttatgcaaactttttttcttctgtttcttccgtctaggtgt

SEQ ID NO: 25475 - DNA, 121 bp, Artificial Sequence
  Synthesized
  misc_feature (61): n=t or c
acaaagcaccaggaagcagacagagatatttttctactgaatgggagtcagtacaacatgngtctagacatgcttgccacttgccactttctgcagcttgggcacatgtagtaatcatagc

SEQ ID NO: 25476 - DNA, 121 bp, Artificial Sequence
  Synthesized
  misc_feature (61): n=t or c
tacaaacatccagtctcttaaaaaccacgtatggaagatgcaaatctgaattctgccattnttctcaaatttttatggaaagcttgatccaggatcaacagcttgggcagttagaggttac

SEQ ID NO: 25477 - DNA, 121 bp, Artificial Sequence
  Synthesized
  misc_feature (61): n=t or c
ctttacgtctcactcgttttcaaaacaatgtctaaaacttgaaactgtattaacccagcanactgcaagaagtaaaaatgaaacatcatccatatagacctcacagttgtatcaatgcacc

SEQ ID NO: 25478 - DNA, 121 bp, Artificial Sequence
  Synthesized
  misc_feature (61): n=t or c
ctcctgcttcaaatttgaagttacacttgcacagtgtgaagtgtgaagtgtcagtcagctnctggaactacaaggactttaactgagaaaatttttaattaagaaagcattagaggtcagc

SEQ ID NO: 25479 - DNA, 121 bp, Artificial Sequence
  Synthesized
  misc_feature (61): n=t or c
taaaaagtcaaactagttagcctcagtaagtcagtgttgctcacagtttgtttcacaaggncaaaaactttagttcgggaagcattcctttgaacatcttatttaaaaaaacaaactctca

SEQ ID NO: 25480 - DNA, 121 bp, Artificial Sequence
  Synthesized
  misc_feature (61): n=a or g
gtgggcattcgcataatctctatttttctttcttctggccagcttaccattgaaatccctngaaagataataccagtatctcttcatattaaatgaacactaatattctactgtgatagca

SEQ ID NO: 25481 - DNA, 121 bp, Artificial Sequence
  Synthesized
  misc_feature (61): n=t or c
ttctgcagagtgctaagtaaacagctgcaaaattaatacaagaggtgtagctgcccactanatgtctctgaaatcttacaaacagatactctttataagcgcagaagtagaacttacccag

SEQ ID NO: 25482 - DNA, 121 bp, Artificial Sequence
  Synthesized
  misc_feature (61): n=a or c
ggctggtgcttcctcaggggacaccacagctgctgtgggaggagatatcttcctatagccntggggaacctttgccagctcatttccctccagataggtttctaagagcaaggcaagcctt

SEQ ID NO: 25483 - DNA, 121 bp, Artificial Sequence
  Synthesized
  misc_feature (61): n=c or g
cagtgttttagcagccagaaggcttctcacctccttgcgctctctccttgttgtagctacnaggctttgtcacatggctgggcctctagttgctgcaggcctaaaacttgctttggctgca

SEQ ID NO: 25484 - DNA, 121 bp, Artificial Sequence
  Synthesized
  misc_feature (61): n=c or g
tgttaaacgtatcaataaacaatatttgtctgttctctgactgaagaatgcattttaattncaagtctcctaaatgcaacatcctagcaattatctagaactacatttgctctgtgacttc

SEQ ID NO: 25485 - DNA, 121 bp, Artificial Sequence
  Synthesized
  misc_feature (61): n=a or t
catttgcattgttcgaagtgactcctaacgttgcgttctctcacccgctttcagttcaagncagtgctctcatgctcacattggaacgcgcctgcagctcagattttatgcagctgtattg

SEQ ID NO: 25486 - DNA, 121 bp, Artificial Sequence
  Synthesized
  misc_feature (61): n=a or c
tctgaactgatactgtaatttagtccagcatttatttatcagtgtttggataactatacanaacatacatcacgtttttttggatattacctgagaatgaggtaatgtcattctaatggac

SEQ ID NO: 25487 - DNA, 121 bp, Artificial Sequence
  Synthesized
  misc_feature (61): n=a or g
tgcctccaggtgcttggcaacaagcttctgactgcctaggtggatcgctccttcccggacnttcccagtggggtgctggttgtcaatcatcccaattccccctttgccctgctgtgtcagt

SEQ ID NO: 25488 - DNA, 121 bp, Artificial Sequence
  Synthesized
  misc_feature (61): n=a or c
gggctacaagcatgcaaaatcatattcttctgagtgaacagtttaataccccttttgtaanataaaggtctgctgctctattttatccagtagattctgcctaaatatggtatttcagtga

SEQ ID NO: 25489 - DNA, 121 bp, Artificial Sequence
  Synthesized
  misc_feature (61): n=a or g
caaatgcaaagcagcagcactggtacaaatgctttggctgcactgtgcacgctttgttatnacaggttccagcagcagctgtaccaacgcaaacccaaaacctcagccatgtataattgaa

SEQ ID NO: 25490 - DNA, 121 bp, Artificial Sequence
  Synthesized
  misc_feature (61): n=a or g
ccacccctatgggagctgccttctgtggggttgggtggaacagctctgagcatgggggtcntggctgactgtgtctctccatccgcagtacatcgtcctgtttgtggccaaggtgctgatg

SEQ ID NO: 25491 - DNA, 121 bp, Artificial Sequence
  Synthesized
  misc_feature (61): n=a or g
cagaacatttcttctgagatatatgaaggtgggaagacagccactggtagaatttcccctnttgcaatgcctctttattatttcattaaaatccttgtaatacacaaaacaataaaagaaa

SEQ ID NO: 25492 - DNA, 121 bp, Artificial Sequence
  Synthesized
  misc_feature (61): n=a or g
cagatacacagtcccgaggtcataaacaagtaagttcacaataactagtttgtcaaaaatnagtttgtagccaaaactttcttataagaagggtaagcccattggaggatgggatactata

SEQ ID NO: 25493 - DNA, 121 bp, Artificial Sequence
  Synthesized
  misc_feature (61): n=a or t
tgaaacaagtgcatttatggagcagagcacatatgctaccatttgattctatgataaacangtttccaggagcaggacactggacggacacatctggaaaacatgatggcaaagaaagagt

SEQ ID NO: 25494 - DNA, 121 bp, Artificial Sequence
  Synthesized
  misc_feature (61): n=a or t
aggacataaccttctacataaggcttgcactttaaagcacccaagggcttaccttcactcntaagaagctttatggcacctaactaaaagctattttattagccaaaagtgtttctgtgtc

SEQ ID NO: 25495 - DNA, 121 bp, Artificial Sequence
  Synthesized
  misc_feature (61): n=a or g
attgaaattcatttgcatatgaaatatgttttgcaatttatttggttcagattcttcgcanaatgttttccatcaggtgcagctgaggctggcacttctgggaagaggtgagagcagggca

SEQ ID NO: 25496 - DNA, 121 bp, Artificial Sequence
  Synthesized
  misc_feature (61): n=t or c
tgaaggcaaatgagtaatgaactgacagcagaacaaaaccaaacacattaccatacaagancataatgacttactaattattttccatacagaatatttattttgcttctttatatgtagg

SEQ ID NO: 25497 - DNA, 121 bp, Artificial Sequence
  Synthesized
  misc_feature (61): n=a or t
agaaaacctatttttaattcaaacatcaaaaagcagtattctgcagtgaaagttgcaaggntatgcagtaaggagcctggtgcatttccatctttactgttggagttgctgtgggagaaat

SEQ ID NO: 25498 - DNA, 121 bp, Artificial Sequence
  Synthesized
  misc_feature (61): n=a or g
ccagtataacgctgtgtgattttttttaactgtagtctcagaaatacatataaacaatggnaaaaaatgaagataacagaaatataaaaattagagaagctgtaatggttatctccagtac

SEQ ID NO: 25499 - DNA, 121 bp, Artificial Sequence
  Synthesized
  misc_feature (61): n=a or g
aactgttacatcatttgcagccttgtaactaggtactccatggagcagcacaaatctgagnttgatggagaaatttgatggtgccactctgtactcttcaccattttctgcagtggcttcc

SEQ ID NO: 25500 - DNA, 121 bp, Artificial Sequence
  Synthesized
  misc_feature (61): n=a or g
catatgaagtcactaaaaaagtctgaaatcagacttcggtactgcagtttcagtgagcatnagtactttctctgaacacgtgactgatttacagtgtcctatttcttccacaaaagagcac

SEQ ID NO: 25501 - DNA, 121 bp, Artificial Sequence
  Synthesized
  misc_feature (61): n=a or g
atggtctacacatgtaaaatataacctcctcctccctttcccccaggaattcaagaaaccnatgttattcctcacatatgtgagtgattagtgaatttatgagtaccctgtgggcacacct

SEQ ID NO: 25502 - DNA, 121 bp, Artificial Sequence
  Synthesized
  misc_feature (61): n=t or c
ccaaacctgaattctggccccaaaggccacatatctgcagagcggacgcagttcctgatgngcttcaccggcgctttgttggctcctttctgtttggcttggagttgttttggggagggcg

SEQ ID NO: 25503 - DNA, 121 bp, Artificial Sequence
  Synthesized
  misc_feature (61): n=t or g
caggctcttagaaaataactagatataaagctttcaaatgatgtaaattccttaagatggncttttagggcagctacttctcttttaactacttcccctgttttcctcagatcatcaggct

SEQ ID NO: 25504 - DNA, 121 bp, Artificial Sequence
  Synthesized
  misc_feature (61): n=t or g
aggataacttcaaatgattgtgatggcacagtgagtcacactaaaaattcaggaaacattnaagtcgtgattggctgcaaagactctgatgtttttgtgatgactgtcttactgtaaaaaa

SEQ ID NO: 25505 - DNA, 121 bp, Artificial Sequence
  Synthesized
  misc_feature (61): n=a or g
gaaaaaaaaagaagcatttgaaactccttgtttaaattagcagcacatgtcaaagccaacngattttttttggcagaaggattctgcaggccttgctggacacgtgaattccaacagggaa

SEQ ID NO: 25506 - DNA, 121 bp, Artificial Sequence
  Synthesized
  misc_feature (61): n=t or c
tttccaacttttgaaccagatgcttcagatttgcaaaattataagtaaagccctcaatagngtgtcacagttccagcctagcctagttctgtgactaatgaggcagagggacccacagact

SEQ ID NO: 25507 - DNA, 121 bp, Artificial Sequence
  Synthesized
  misc_feature (61): n=a or g
agccctgttttcagaggtgctatacctgatttaaaatgcgtagcacctcagcagttctaantgtccaactacttttatgtaggttcataaacaccatattaattccataactatgattgca

SEQ ID NO: 25508 - DNA, 121 bp, Artificial Sequence
  Synthesized
  misc_feature (61): n=a or g
ggtttgtttgttgcttacatgtgaactactccaagagtcttctgtcatcagactggtttcnttgccaagagcaaactttatttcttgtgaatatcccgtgacatccatcttgtgctaggag

SEQ ID NO: 25509 - DNA, 121 bp, Artificial Sequence
  Synthesized
  misc_feature (61): n=a or g
ttacccacgctgcagcactggcaaaagcttttgtgtgcatctggcccatccctgtagcccnactcatgggacttttcatctcactttctgtacgctgggctgaaaactaccactaccaaaa

SEQ ID NO: 25510 - DNA, 121 bp, Artificial Sequence
  Synthesized
  misc_feature (61): n=t or c
aatgcaggtgcaggctcacatgctgaataccaacatattactaacctgaggttatacttgntgactttttgtgtgaatttatttcttcctccacagcagatacaaacatgcgcagcaatat

SEQ ID NO: 25511 - DNA, 121 bp, Artificial Sequence
  Synthesized
  misc_feature (61): n=a or g
aatgctaaccaggttacagcttagctaaaagactcttcaaagatagtaagtcatttgtganaagacatttgttctcttgattctgtactgaagttcatattccgtctcatttgactgtaac

SEQ ID NO: 25512 - DNA, 121 bp, Artificial Sequence
  Synthesized
  misc_feature (61): n=c or g
ggaaaaagcatactattcttctgtctgcctttgcacttcaggtactgtcagtgatgcaatnattctaaagtaaaaaaatatttatgtagtaccaaagtgtgactgagaagtcattcatgaa

SEQ ID NO: 25513 - DNA, 121 bp, Artificial Sequence
  Synthesized
  misc_feature (61): n=t or c
tgtttctaaaggtctggagtttggtgggagaagtgctgacagagcaatacattagcagtangtgttctaagaagtaaagcagagttcagccgctggtcaactttctatctgcctctgtgta

SEQ ID NO: 25514 - DNA, 121 bp, Artificial Sequence
  Synthesized
  misc_feature (61): n=t or g
caagacctcatttccttgtccagtcccaacatccttttccaactcagaacagcgttagtgnccaatgtctgagaacaagtggaaagtctggatgtgcctgggcatgcaatgagaccatttt

SEQ ID NO: 25515 - DNA, 121 bp, Artificial Sequence
  Synthesized
  misc_feature (61): n=c or g
gactctgcatatccagttttctttggaaattctgacattcaacatttacttaccaacagtnagttaagtgatgagttctctgtgcaatattccagcaaccagattactgcacaaaactcct

SEQ ID NO: 25516 - DNA, 121 bp, Artificial Sequence
  Synthesized
  misc_feature (61): n=a or t
cagctcaggtctaggaaggagctcagccacaggggcacagtgatgtgtctcagaagagggncaggtgaggatttgccactcagagacccataggctcagcatgggtgctgtgcccatgcaa

SEQ ID NO: 25517 - DNA, 121 bp, Artificial Sequence
  Synthesized
  misc_feature (61): n=a or g
tggcggttttacctatgaaagtctgaaagctagagaacctgttatgttcaatttctaatantaaacttccactgtaacacaactgttcctgctcctttctttttcttgccttaacagaaaa

SEQ ID NO: 25518 - DNA, 121 bp, Artificial Sequence
  Synthesized
  misc_feature (61): n=a or g
ccaacttttacctttcctatatttttgataaaaattctacgatgaagcttaacaaaaaacntatgcagaatttgtcatcagagatctgaagagtaatggcaagataaccttgtaaccacat

SEQ ID NO: 25519 - DNA, 121 bp, Artificial Sequence
  Synthesized
  misc_feature (61): n=t or c
ggctcctgtttttgtgggacgcagaccgcatgctaccagatacttcattgttaatgaaaangagccccgcaaaaagtcagcccgttccacctcccgactccaaaggcagttccggatagaa

SEQ ID NO: 25520 - DNA, 121 bp, Artificial Sequence
  Synthesized
  misc_feature (61): n=t or c
ctggacaggctggggagctggacaaggaggaaccttaagaagagcaagtgtaaagtcctanatctgtggaggagtaactgcaatcgtcagtacagcttagagactgatctgctggaggtga

SEQ ID NO: 25521 - DNA, 121 bp, Artificial Sequence
  Synthesized
  misc_feature (61): n=t or c
ctgaaagataagtatgccacaacttctgaaacccaaaatttgcaagatatccccttagttncggtaccagttcttcggtctgggcttggtcttgtgaggcttgttgatgttactgagacct

SEQ ID NO: 25522 - DNA, 121 bp, Artificial Sequence
  Synthesized
  misc_feature (61): n=t or c
tatctacagtggaggctggcaagtagggtggcccatgcatatttttgtagagagccatgcntttgatacaactctaaatcactacaaccataatattctccaaagaggtatgcacattatg

SEQ ID NO: 25523 - DNA, 121 bp, Artificial Sequence
  Synthesized
  misc_feature (61): n=t or c
ctggatataaatcaggctttaggattttttacttctgtaatatgttacatattgaaaacanagacaatgtgatatccattaagaaaaataattctggaatgttcttgtgtgttaaatgttt

SEQ ID NO: 25524 - DNA, 121 bp, Artificial Sequence
  Synthesized
  misc_feature (61): n=a or c
tgacagaaattttattatatcatctaataaaagtacttcttactatgttgtcagtttaccntttgcaggctcccagtttcataccatcggatcaattttgctctcagcttccaggacagag

SEQ ID NO: 25525 - DNA, 121 bp, Artificial Sequence
  Synthesized
  misc_feature (61): n=a or g
ccagtgggctctcttcccagatctgacttttccttcttacctaaatcacatcctgtattcnctgctcttcccacttctccttactcccaacatccccctgctgcattagagttttctggaa

SEQ ID NO: 25526 - DNA, 121 bp, Artificial Sequence
  Synthesized
  misc_feature (61): n=t or g
gcattccttaaagcacccaccagctaacttcctaatctgactgaaaaacgttgtgaaggantaccccagcccttcacccaagggaccagctccccgctgagcacagacttttcaagctgct

SEQ ID NO: 25527 - DNA, 121 bp, Artificial Sequence
  Synthesized
  misc_feature (61): n=t or c
tctcaagaacaacagccttagtaattgtgcaaggtctgttcagcttgtaagcagtctgaanctgagtcttaactatggcaggtcagtttcttaggcagtcttgattttcgctatagggaag

SEQ ID NO: 25528 - DNA, 121 bp, Artificial Sequence
  Synthesized
  misc_feature (61): n=a or c
ccttcactggtaagtcacctttccatgtactgccctctgagtcataattaaataggagacnttgctttcaaagcaacatacatatttcctgctgcaggttatagcagagttatataactgt

SEQ ID NO: 25529 - DNA, 121 bp, Artificial Sequence
  Synthesized
  misc_feature (61): n=t or c
gtgtgaaaaatatttctgtttgatttaagctgcgctatttgctgcctactaggtcttacanatgagaaatggggaacaattgtttgttactatctctaggctactctcaattttgtatata

SEQ ID NO: 25530 - DNA, 121 bp, Artificial Sequence
  Synthesized
  misc_feature (61): n=a or g
ttccagaaggaaggtacttgcagaactgaaagccagatggaatgaagactgctggtcccanaggcagaaagaatgggccttcctctgccacaccccagtaagaaagagagcttgctggtcc

SEQ ID NO: 25531 - DNA, 121 bp, Artificial Sequence
  Synthesized
  misc_feature (61): n=a or g
ccgaaaaggcaaacatttactctttattttgaggaaatacagaaatgggtgttcagcattnaagtgttcatcatgagatacccttcagtgcaatgataaatatggaatgggatagactttg

SEQ ID NO: 25532 - DNA, 121 bp, Artificial Sequence
  Synthesized
  misc_feature (61): n=a or g
tgtccggtgctcgggtctgggatgaacccagctactgcagccttgggaagaggagggggtngagatgacctgttggttgcccctccgtgagtttccacaaagaaagagtacaagcccagtg

SEQ ID NO: 25533 - DNA, 121 bp, Artificial Sequence
  Synthesized
  misc_feature (61): n=c or g
cctttatattgtgagtgcccttagaaaaaacatatctctgcttccactgaaggggttcctntactcttattgggaaagcatcagtcatacaaagactatcaaaatatttgtcagagagatg

SEQ ID NO: 25534 - DNA, 121 bp, Artificial Sequence
  Synthesized
  misc_feature (61): n=a or g
taatgagctgaaagaaggttctggaagactttcccatcattgcttaaattagacactgtcntccacttcagtacggaaagtagaaagaggaactgaaatcttgcttttggtcaggttctgt

SEQ ID NO: 25535 - DNA, 121 bp, Artificial Sequence
  Synthesized
  misc_feature (61): n=a or g
tcctctgctgttaccagtaggcagaactatctgaattgggccacctgggtaacttgagaanctccaagaggtccccttccagatatccaacaaggatggccttgggaataaactccccatt

SEQ ID NO: 25536 - DNA, 121 bp, Artificial Sequence
  Synthesized
  misc_feature (61): n=a or g
tgtatttgcacagagtgctgcaagaagctatataaacccctggaattatgtgtgtgcactntcaaaactatcaacataaatctgtctgcttattctgactgaagaactgattctgaaatct

SEQ ID NO: 25537 - DNA, 121 bp, Artificial Sequence
  Synthesized
  misc_feature (61): n=a or g
atcagtttagctattctgacttcatatagagagactttcatctgacttgcacaatgtgccngattcctgagttgtgctagtttgtctaattcagtgcaacaataagtgtctagttattctg

SEQ ID NO: 25538 - DNA, 121 bp, Artificial Sequence
  Synthesized
  misc_feature (61): n=t or c
aagagtaaagcacgtgaattaaaacaaatgctttaagtttccaaggatccactttttgtangtatgtaccatgctgcatatatttctagtcattctatcagaactattcaaattttccttt

SEQ ID NO: 25539 - DNA, 121 bp, Artificial Sequence
  Synthesized
  misc_feature (61): n=a or c
tcatgataagctacaacaggggaaagcctgactcaccaggatttacttgtctgtgagtaantcttcccctgtagctgtacacatgcacagtgtttatgccaagctttgtgtagtcagtatc

SEQ ID NO: 25540 - DNA, 121 bp, Artificial Sequence
  Synthesized
  misc_feature (61): n=a or g
actacataattgctgatggcagttgtccaatgcatccttctgactcccaggctctcccttnctccacttctgggtggtcatctgacccggcatggaatgttccattgcacaaaacaaggaa

SEQ ID NO: 25541 - DNA, 121 bp, Artificial Sequence
  Synthesized
  misc_feature (61): n=t or c
agagactccacaaatatcatagacgtggacaagaacatcctaatgctcttgctggatatcncctgcttacatagggagtcagaggccttagaatcttgttcagagctactcctttacataa

SEQ ID NO: 25542 - DNA, 121 bp, Artificial Sequence
  Synthesized
  misc_feature (61): n=t or c
attaccaaactatttcttctggctcagtgcctcttgcaaaacaaaaactgctcatttcctncaagcaaagacagtcattagggtaagtttcatacatcatcttgttcattccaatttgcat

SEQ ID NO: 25543 - DNA, 121 bp, Artificial Sequence
  Synthesized
  misc_feature (61): n=a or t
tgttgcttttttaagtcattgagatcaatccaaaccagcatacctgggaacgttattattngaatcctcactttcatttgccaggccaccaaataagtagcacttgttaccatacaaagaa

SEQ ID NO: 25544 - DNA, 121 bp, Artificial Sequence
  Synthesized
  misc_feature (61): n=t or g
gtacttagtacagccttagtactgcctctgctctaagacagccgtttaaatatagtaggcnaccagcactaaatgagaggtggagctgcaatgaatggaggaggagcaaggaaaatactta

SEQ ID NO: 25545 - DNA, 121 bp, Artificial Sequence
  Synthesized
  misc_feature (61): n=c or g
taaactgaaaaacaatgagcaaaactgtatgagacccagacattggcagaccacttctttntgcatgatagacacaatggagatattttctgtgcttccccactagacttagctgcaagca

SEQ ID NO: 25546 - DNA, 121 bp, Artificial Sequence
  Synthesized
  misc_feature (61): n=a or g
tactagagacaacatcctgtctagaagaggacaatacaaactgcagaactaaagtcttccnaacaacttatcttgtctctcaattgttcaaaactcaggctcctactgaagtcttgtggta

SEQ ID NO: 25547 - DNA, 121 bp, Artificial Sequence
  Synthesized
  misc_feature (61): n=t or g
ttgagcaaacatgacatagacggtaagagagggagacaaggagagaaggcacggataactncaagggctttgtttattcccatgtactgtgaggctgggagggcaccactgaaggaaaaga

SEQ ID NO: 25548 - DNA, 121 bp, Artificial Sequence
  Synthesized
  misc_feature (61): n=t or c
gcttaataggtatttctaatagctattccatattgctcaagaacatagcaaaataacaacnggcactacagaagtacaatggtttaattcaagcacgttctatgtgcaaaaagttctcttc

SEQ ID NO: 25549 - DNA, 121 bp, Artificial Sequence
  Synthesized
  misc_feature (61): n=a or g
tggtgtagcatttgtagtcaccgtggatgctgtttcttgatatttgcctcatttcttggtngatctactttaacaatcacatacatttgagcatttgaactgagcattctcatgcagttta

SEQ ID NO: 25550 - DNA, 121 bp, Artificial Sequence
  Synthesized
  misc_feature (61): n=a or c
caatgagtcaaggctgagcaagtatcacaacattctatgtgtctttcctacttgcaaaatncatgctaaaacctctttattacttaactactctcctctacttggcactcattataccaca

SEQ ID NO: 25551 - DNA, 121 bp, Artificial Sequence
  Synthesized
  misc_feature (61): n=t or c
atggtgataataacagcagctgatttgttgacaatgtcataatttccctatgaatagtatnataacatagtcatggaagcatagctaattgaagtctgacttgaaactaaggggaatttgg

SEQ ID NO: 25552 - DNA, 121 bp, Artificial Sequence
  Synthesized
  misc_feature (61): n=a or g
ataaataaaacatgaagttgaagaacatttgtgagaagtatatgtattttcacaggaaacntatttaggcaggcagtcacagcacctaacctcaggtactttctctagttgcaacaattca

SEQ ID NO: 25553 - DNA, 121 bp, Artificial Sequence
  Synthesized
  misc_feature (61): n=t or c
tacaccagaggtcagtacaatcctcacctgttccaatcttgcagtgcaattctacctcctnctacactggtacaagctcaaagggtcattcttgtctgctctcttcagtccagctgtaact

SEQ ID NO: 25554 - DNA, 121 bp, Artificial Sequence
  Synthesized
  misc_feature (61): n=a or c
cacagatacggcttgtggtccactgatatcagcagggtacatgtaagtcttccctgaactnaaatatccatttcagtctccacgtccaacagatacaggaaacacacactgtttatataca

SEQ ID NO: 25555 - DNA, 121 bp, Artificial Sequence
  Synthesized
  misc_feature (61): n=t or c
acaggtcatcagattaagtttaggataaagagttactacctaggagtccacctccagtccnctctcaaagcagagtttagcccagtccatagcatatacgctagtgtaacaattgttctgg

SEQ ID NO: 25556 - DNA, 121 bp, Artificial Sequence
  Synthesized
  misc_feature (61): n=t or c
agcatgttatattttgtggttctcattcaatgcttgactattgaagaacttcccatctttnactttattgcactgcagagctcatttacactataccccataggaattttctctgccattt

SEQ ID NO: 25557 - DNA, 121 bp, Artificial Sequence
  Synthesized
  misc_feature (61): n=t or c
gcacaaactcagattagcttcaggccaagtactcaccactatttggtcttctgaagccaangatacactgctgtcatcaaagtagtaccacttgccattcaccttgttctttgcataggca

SEQ ID NO: 25558 - DNA, 121 bp, Artificial Sequence
  Synthesized
  misc_feature (61): n=t or g
atctaaagtttggttgcattgttgtcttcttatctctacaaactgtgactttgttctgganagtattttgctctttcttctctcagagattctcatctctttctgtctgtcagttgctatt

SEQ ID NO: 25559 - DNA, 121 bp, Artificial Sequence
  Synthesized
  misc_feature (61): n=a or g
gtcatctgcttttatgtgatttgtaaaatactattcattaatctcccaaaaatcatctatnttcaattcattccattttagcagccacgttatttctgctagcaattgggaactcgtttat

SEQ ID NO: 25560 - DNA, 121 bp, Artificial Sequence
  Synthesized
  misc_feature (61): n=a or t
gagcaatgtctctaatgaagattctgtaagcagaagctgagaaagtttcccaattcacacnagaaaacataggaaaactcacgagcctttcaggaaaggggtagggaacatggagaggagc

SEQ ID NO: 25561 - DNA, 121 bp, Artificial Sequence
  Synthesized
  misc_feature (61): n=t or c
ataactcagcttcatctttcccattttgctgcatccatctcctatcacactacttccaagngctctaaggaagagggaatcctgcagtaaggtcccgtcttctagctcctctttttcctgt

SEQ ID NO: 25562 - DNA, 121 bp, Artificial Sequence
  Synthesized
  misc_feature (61): n=a or g
ggccaaattgcaggaagcagtataaatccacactagaaaattggcatcaaagttttttagnactcagaatactcatcaactgccaattagaggccagataaaatccccgtgggcatcagtg

SEQ ID NO: 25563 - DNA, 121 bp, Artificial Sequence
  Synthesized
  misc_feature (61): n=t or c
atgaagaatggcacacaaacactatacttgacttagcagcacagagagggaaaataatatnggtctgagaaagccctggttggccagaagtgggcaggtttaataacgggtttccacaagc

SEQ ID NO: 25564 - DNA, 121 bp, Artificial Sequence
  Synthesized
  misc_feature (61): n=t or c
ctcctcctgctggggaggcactcagctgctggaaacggagacccacagaacaagtggctgnattaccagatcccacctggatttaaggctccacctggagctgggtcggactccgagccca

SEQ ID NO: 25565 - DNA, 121 bp, Artificial Sequence
  Synthesized
  misc_feature (61): n=a or g
ttctgtcctgagctgtccttgaggttcacacgttcagtgcttctagtgcttctctgccatnaggacatatcagcagcaacaaaatctttcagaccagatcatgctcttgtagctccatctt

SEQ ID NO: 25566 - DNA, 121 bp, Artificial Sequence
  Synthesized
  misc_feature (61): n=t or c
atgatgcatgagcttacacagggagtgtgaacataggtataaaaaagtttctggactgtangtactaaacatctaccatctaacacatatgatagtaggccgaaaataagtaaacagtaaa

SEQ ID NO: 25567 - DNA, 121 bp, Artificial Sequence
  Synthesized
  misc_feature (61): n=a or g
tttaaatgttgagatagtcattacacgttgcagtttttaaaagttgtatgcttggctttcnttgctgtgagtgtctgtggagctttttctgtgttgtttttttcacttatcttgccactta

SEQ ID NO: 25568 - DNA, 121 bp, Artificial Sequence
  Synthesized
  misc_feature (61): n=t or g
cttgatagccactgagaaactactagaaacacaaagtctctaatatgtaagttctccagcntaagtcgaagtaaaccaacacttgaaaactcttatactcccttcctctagtcaagaaaaa

SEQ ID NO: 25569 - DNA, 121 bp, Artificial Sequence
  Synthesized
  misc_feature (61): n=t or c
gatgcaacacaaagtcatttctccttcagtccctatagacacacaaaacatttcatactcnttcaaaaatcactgaagttacaaaactcattacactctagcttaattatatccctttttt

SEQ ID NO: 25570 - DNA, 121 bp, Artificial Sequence
  Synthesized
  misc_feature (61): n=a or g
ttgatttcctttttaactgcatttctgcacaacatatttctatctagtttgccaatggccntttttagagtagactacaaagcagagtgaggaaaaaaaccaattaaattggtgaactgga

SEQ ID NO: 25571 - DNA, 121 bp, Artificial Sequence
  Synthesized
  misc_feature (61): n=c or g
ttcctgtgcttcctctgctggagaggaaccaggcctgggtcaccttcccagtgcaggtctntccctctggcacatgagtaaagctacagagacccacatgcttgtatttcttgtgttctct

SEQ ID NO: 25572 - DNA, 121 bp, Artificial Sequence
  Synthesized
  misc_feature (61): n=a or g
ccaaacagtactgttgctttttgctgaaacagaagatctcaaagccagttctgttgatttntgagaacttgtactacaccagcaactactgacaggaggaacaacacgcagatgtcctctg

SEQ ID NO: 25573 - DNA, 121 bp, Artificial Sequence
  Synthesized
  misc_feature (61): n=a or g
cagttgtgtggccagacagcttctgcaacctatgcctctgaccgatgtattcatgtgtcanatcagcatggctagttgtgttttatgcagtctgtgcagggctctttcctctgctttctgt

SEQ ID NO: 25574 - DNA, 121 bp, Artificial Sequence
  Synthesized
  misc_feature (61): n=t or c
ctttgaatcataaattgaaagatgaatttaagttacaactgtcataacattttaaagttanagtattacatattgttaaccttctgtgggggcagttttttaagttatgtttttttgttct

SEQ ID NO: 25575 - DNA, 121 bp, Artificial Sequence
  Synthesized
  misc_feature (61): n=a or g
gagaggtttggtaggaagccacgtgttctgtcttgtagcagacactgacagcatcaatcanatgctctctccaccccaaataatttatcatcagttatccatatgaagatgcactgatgca

SEQ ID NO: 25576 - DNA, 121 bp, Artificial Sequence
  Synthesized
  misc_feature (61): n=t or g
gtcatacataagtaaaaaagagatgtaaagtaggtatgaaacatgcctggtagttttatgntagagcaagttgtcaatttctcaaattctactttctgtatactgtaatccatcagagttt

SEQ ID NO: 25577 - DNA, 121 bp, Artificial Sequence
  Synthesized
  misc_feature (61): n=c or g
actctgcaaatttatatgcaggacccgcagttgctaattggaagctgaaaacatcagacantctgctagcagtagcctatttctgtactaataggattattgaaaactctgtccttacata

SEQ ID NO: 25578 - DNA, 121 bp, Artificial Sequence
  Synthesized
  misc_feature (61): n=t or g
tgaaaacctgcttctagagttttgtgcttttggagatgaggaaggctcagaagctgctctntatggctctgtcagcagtaaggaaccaagtcctctaacagcagatttgcattttgtagta

SEQ ID NO: 25579 - DNA, 121 bp, Artificial Sequence
  Synthesized
  misc_feature (61): n=a or g
agtgcctgtaaaatctttggggctttgtcttagatggggggcaatttttatttcctgacantagtaagaatgtgcttaacaggcaaaggagttgtaagaaatgagagagaatgtctgttca

SEQ ID NO: 25580 - DNA, 121 bp, Artificial Sequence
  Synthesized
  misc_feature (61): n=t or g
accttcaaaacagacactcaaccatatgaagcccattcagagagaatgaatacaacattancgttttgctgtcatagtagtatttctgtaatagtaactttttgaagttctggcaaagttg

SEQ ID NO: 25581 - DNA, 121 bp, Artificial Sequence
  Synthesized
  misc_feature (61): n=t or c
gcctctctgcacaaacagtctcttggaacgacactgccattagctgtagagacaaattcangctgtctacagtcttaggcggcctttttccaatctggtcattcctgatgtctcatctgct

SEQ ID NO: 25582 - DNA, 121 bp, Artificial Sequence
  Synthesized
  misc_feature (61): n=t or c
gaggtactgaggcagagctgttctttaaccagaatacattcagaaccaaaaaagccagtancaagtaccaatcagatcagaagaatttctttcccctcccatggcattgctttcctcctaa

SEQ ID NO: 25583 - DNA, 121 bp, Artificial Sequence
  Synthesized
  misc_feature (61): n=a or t
agttaatttaataaagtaatacactatttactatactagtgagagtgaatttagaataagncccagaataatttaggacccaagaaataaaaatgtgcatactaaacatacatgtatatac

SEQ ID NO: 25584 - DNA, 121 bp, Artificial Sequence
  Synthesized
  misc_feature (61): n=t or c
ggattgcccatctcctccttcaatatttatgaaacagcctctgaccatctgcaaaagtccncttccaagaggtcttgtgcagtttgcctagtaaacagtgggctcaggtgaatctccagag

SEQ ID NO: 25585 - DNA, 121 bp, Artificial Sequence
  Synthesized
  misc_feature (61): n=t or g
ctgagaaaggatgaagaaacatgtcagtttgaaggttgtgatctcaaatgaggactagcantcagcatactaagctgagcagaagagctagaggatttattttctcctgacatctctgagg

SEQ ID NO: 25586 - DNA, 121 bp, Artificial Sequence
  Synthesized
  misc_feature (61): n=a or g
tgtgatcatacattccctctacgaaagcaatttgtgttttggcatgattatgtgcatacantatgagtcacaggacaaaatgctgtgggtatgctccttcatagagaaactgatagaacat

SEQ ID NO: 25587 - DNA, 121 bp, Artificial Sequence
  Synthesized
  misc_feature (61): n=t or c
gtacacttagttctccagaatatgtcatgtccaaattcttacagtggggataattgctctntgttgtctactgcctgcttcccaacagatacctcttgtcagtgtgcattctttacatcaa

SEQ ID NO: 25588 - DNA, 121 bp, Artificial Sequence
  Synthesized
  misc_feature (61): n=a or g
atgagctctcaccattttcatatctctcccttgagattttaattgcattaagaaatgactngccttaataaacttctacagcctctaataattataatcaaataagttatccatatataaa

SEQ ID NO: 25589 - DNA, 121 bp, Artificial Sequence
  Synthesized
  misc_feature (61): n=t or c
ctctttaaagcagaaaagagacaccagcacaaagaggagtacctgatgcctacatgagtgnatatacatacatataaacaatgtttaccaggaagctcttttaaaatctgcctaattgctt

SEQ ID NO: 25590 - DNA, 121 bp, Artificial Sequence
  Synthesized
  misc_feature (61): n=t or c
ttgaacactgccactgtgcagtttgatgatgggttttgcaggtggagatctatggactccnagtagtaggagggttgtagcaaccctttgttcttggagattcctccacactaaagcctat

SEQ ID NO: 25591 - DNA, 121 bp, Artificial Sequence
  Synthesized
  misc_feature (61): n=a or c
atgctgtacaggttttatgcattcattaaacatcacatttataaaatctatttccaacagnaacttttccaacttcaaagcattgccaatcatgctttaaaggcacacacacactgaagtg

SEQ ID NO: 25592 - DNA, 121 bp, Artificial Sequence
  Synthesized
  misc_feature (61): n=t or c
cttattctgatcacaggacagatatgcttatacttacaagtagaaagacaagattcttgangtccataatgcacataatcaacctgctgtaaaactgggaccagaacgtggtcaaaaataa

SEQ ID NO: 25593 - DNA, 121 bp, Artificial Sequence
  Synthesized
  misc_feature (61): n=a or g
gctgccaattttacatttacatttagtggtgcatttacaaattaaacacagtgcctgcatntatttggtctggaagagtgtaaatggatgtaatcatagtagagacagaaaagagcttact

SEQ ID NO: 25594 - DNA, 121 bp, Artificial Sequence
  Synthesized
  misc_feature (61): n=a or g
cactctgcactcagacacctcaggcaacagctgctttgaggctggtgcctcataggggcangaaatcatgttgaacaactgtaaaaacctttaattctcagtaataagccctctcttatca

SEQ ID NO: 25595 - DNA, 121 bp, Artificial Sequence
  Synthesized
  misc_feature (61): n=t or c
atgaaggaagaagagtcagacaaagcgatgggctggcaatctctgatcatctccatattgntctaatgaggaactccactccgaggatataatctaaactcctttcacatcttttgtccta

SEQ ID NO: 25596 - DNA, 121 bp, Artificial Sequence
  Synthesized
  misc_feature (61): n=t or g
tgctaccatcagctgtaaattaatcaacacagcccttccaccatgtgagtacctacggtgnaaggctgacgtgtgtagctgtgagcacctcagtacattctgtgtggttaacagaaagcga

SEQ ID NO: 25597 - DNA, 121 bp, Artificial Sequence
  Synthesized
  misc_feature (61): n=t or c
atggcttgctcctgtttgatctgaggaagaagtggatcagaccaagcagctgtgctgcccnttgggatctgtggttgtcatcacctgcattgtgggaggcagctggggtggggggctgtgc

SEQ ID NO: 25598 - DNA, 121 bp, Artificial Sequence
  Synthesized
  misc_feature (61): n=a or c
ctgttaataaaggaataagtgcttcagttagcttgagtggggaatactgaaccctagtctnagacttcagatgcaatatacataaaacgctcagatcattcgttaagggccagctttgaat

SEQ ID NO: 25599 - DNA, 121 bp, Artificial Sequence
  Synthesized
  misc_feature (61): n=t or c
cacattccttccaggaagaaccctaattgtaaggtgaaaccctaaagaagtcctgagccangcaggcagtcttgtcattttgcctttctcctaagctttgaataacctccccatcagtctt

SEQ ID NO: 25600 - DNA, 121 bp, Artificial Sequence
  Synthesized
  misc_feature (61): n=c or g
gagtacttcacagctgtaaggacagaagcttatatgagccaaggccacctcctcctcttanaatttcaacatcagcaagtacattgatcacaacacggggcagatcatcctccctgtcaca

SEQ ID NO: 25601 - DNA, 121 bp, Artificial Sequence
  Synthesized
  misc_feature (61): n=t or c
cccccagttctatgactctatacatatatatgtatacacacacacaatcaagtgataaaanagaaaatccagaagtcctagtggcatcccttgggctcttgtagacttttcatccagtttt

SEQ ID NO: 25602 - DNA, 121 bp, Artificial Sequence
  Synthesized
  misc_feature (61): n=t or c
gacagcccaagcccttgggaagtctgacccacctgacactgaactcaggtctcccctttangccaccaaccactatgtatcaggtaatgtgtctaagagcttatcatagggctggtatccc

SEQ ID NO: 25603 - DNA, 121 bp, Artificial Sequence
  Synthesized
  misc_feature (61): n=a or g
aagggaacaacaaaagaggagaggagtcatcctgacatggttaagtgatttgtgtgatgtntaaacaagatctcctgcagaattaaagaatgatccattctccagtgagtttcacagaatg

SEQ ID NO: 25604 - DNA, 121 bp, Artificial Sequence
  Synthesized
  misc_feature (61): n=a or g
gctgacacttgacaaaaggagtatcagaacgtcatgaaatctattaaaattgatattaacntgtaaagataatcagtgggctcctaacacagaatggtgtagaattatatgaaggagcaaa

SEQ ID NO: 25605 - DNA, 121 bp, Artificial Sequence
  Synthesized
  misc_feature (61): n=a or g
gagtaagtctcacagtaaatgtgattacataacatagaatgccaccaaaacaaaattactngagtttgcaggaaaatacttgaggttaataacacaacagcaggcgtggaggacaacaaag

SEQ ID NO: 25606 - DNA, 121 bp, Artificial Sequence
  Synthesized
  misc_feature (61): n=t or c
tttgctgaaaactgaagccaccttcaccttacaggtgttcaggataaaggagttctgaaangctttgagtcaattgtgattagatttgtggtgcactagattgtttgccatcaaaattaat

SEQ ID NO: 25607 - DNA, 121 bp, Artificial Sequence
  Synthesized
  misc_feature (61): n=t or g
cactctgcactcccaaggatgggagtaaaattcatggaagaaagcagaggaggaagaatantgctccatatcttatagaaagagtgtaatggtgaagcctgacttcccctgaaaacagtct

SEQ ID NO: 25608 - DNA, 121 bp, Artificial Sequence
  Synthesized
  misc_feature (61): n=a or g
cgatggggagttaaacccacccacagcttccaaacccagcaggcttgagcaaagccgagcngaaaaagcactaactctattttcatcttaagcagccgagcctcccgcgccagctccgatc

SEQ ID NO: 25609 - DNA, 121 bp, Artificial Sequence
  Synthesized
  misc_feature (61): n=t or c
cttatctggcacagatactgccatgctgaatggcacacaccgagacaagctggctgagtgngacaggcatcagaaacctgatgtataccctgtgctgcattatcacaaggtcttcttttca

SEQ ID NO: 25610 - DNA, 121 bp, Artificial Sequence
  Synthesized
  misc_feature (61): n=a or g
aaagtacaaactacagtttgtgatctctgatagttctgtgccaatgttattaatgccctcnttcacgcaccccggaaaaataccagttcacatgattaccttgtttccatgtgtttgctgt

SEQ ID NO: 25611 - DNA, 121 bp, Artificial Sequence
  Synthesized
  misc_feature (61): n=t or g
aacatttcttttgcacagctcatgcattttgacctcctgctcatgctaagaggtcaccganctctgtcacgtcgtcattccttcctatgggaatggccatcggctgaaggtcatgtcctgc

SEQ ID NO: 25612 - DNA, 121 bp, Artificial Sequence
  Synthesized
  misc_feature (61): n=a or g
tcagtagtgctttctgccactgcaaacaatggcaaagatataaggtcaaatttaaacttcngaactttatctcaagtaattccaataccttgtttgccaataggatagaggaagattttat

SEQ ID NO: 25613 - DNA, 121 bp, Artificial Sequence
  Synthesized
  misc_feature (61): n=t or g
aagagtcatcaaaagcccagagaattcatgggaaagagttaagagatttttattcttgaanaaactttttagttgtgtgttggttaagactgtaatacatgcgtttgttccttttccagta

SEQ ID NO: 25614 - DNA, 121 bp, Artificial Sequence
  Synthesized
  misc_feature (61): n=a or c
gactacagcatattcaaaatggagttaccagtatcattaggagaacctaaagattatttanaaatgaagactgaaggagacaaaatgcttgtttagtctagtaaaagagaggatgcaaggg

SEQ ID NO: 25615 - DNA, 121 bp, Artificial Sequence
  Synthesized
  misc_feature (61): n=t or c
cagccctgtagaccctatctttggcccttactaagcctcatgatttattaaagcagacttnaggaaaccttgctggattcaccaaagcattttgagatggtttcatctgaaatgctaattg

SEQ ID NO: 25616 - DNA, 121 bp, Artificial Sequence
  Synthesized
  misc_feature (61): n=c or g
ctgactccacacagggaaactcagacctgacattgaggcgctttgcagcaatgactgtgtntccaagtacaagaaatgcaggcttttttggctagggtttcatctctgtgcttatacttca

SEQ ID NO: 25617 - DNA, 121 bp, Artificial Sequence
  Synthesized
  misc_feature (61): n=a or g
ttacaaagttagcatctttcctgttgggaaatactctggaccagaaggctcacaatggagnagaaaatatcttaagaatgttcagaagtggcttctggcaatgcttcttaggctggttctc

SEQ ID NO: 25618 - DNA, 121 bp, Artificial Sequence
  Synthesized
  misc_feature (61): n=t or c
tgattctgtgaagtaacttttcttcccaagaacacttttcagggaagatgtcagtcagcanggctgaagattgtcacattttgcagtgtttttgaggggactccaagaaacaggagtagaa

SEQ ID NO: 25619 - DNA, 121 bp, Artificial Sequence
  Synthesized
  misc_feature (61): n=a or g
ttctccacatgaaaatctttaagggcaaaaatgttattgaagggttgtattaacacagatnttttatgacatctcaaacatacagaaagtatatgttgtaattttgcatacctaatgtctg

SEQ ID NO: 25620 - DNA, 121 bp, Artificial Sequence
  Synthesized
  misc_feature (61): n=t or c
actgtcatcacatagttgagaaactgaattacagattacacagagctgtcaatgatgatgnggaaaactccacctcctcattaaccagctaattctgcacaatggacgtacactttaattc

SEQ ID NO: 25621 - DNA, 121 bp, Artificial Sequence
  Synthesized
  misc_feature (61): n=a or g
ctgggggagggaaaaagacttcaccggtggtggccatcataagcatacgccagccttgccngaactaccacagctatagaagaaatgggcattttaaaatgaaaaaataatcaaggagagg

SEQ ID NO: 25622 - DNA, 121 bp, Artificial Sequence
  Synthesized
  misc_feature (61): n=t or c
ttctcttctgctctctgatgctcttctcttcattctcaggtagtagatcctgttggcttcngggtaggtgactttgcagagggggattttgtaaatggctgggttgtctgaagttatcagc

SEQ ID NO: 25623 - DNA, 121 bp, Artificial Sequence
  Synthesized
  misc_feature (61): n=a or g
ttctgtggctgccttaccaagtgttgtttagaaggcctctgtatgctgttgtataaagccnaacgacactatgtacatactttaaagcaaagatggcttttgaaaaattgtttttaccttt

SEQ ID NO: 25624 - DNA, 121 bp, Artificial Sequence
  Synthesized
  misc_feature (61): n=a or g
taaaaagggcaatacatgagttgtgtttctaactgccacttgttcctttggttttgcaacntttttcatccattgtttgaggagagaatgaggtctaatggaagacacttgtcaccttgta

SEQ ID NO: 25625 - DNA, 121 bp, Artificial Sequence
  Synthesized
  misc_feature (61): n=a or c
cagagggcttttggttcttcctgcagcacctgcaacaaatgtagtttcattgtttccctgnacactgccatcctgcccaactacaagctgcctggaaaacatcaggcaggcagaacaagca

SEQ ID NO: 25626 - DNA, 121 bp, Artificial Sequence
  Synthesized
  misc_feature (61): n=a or c
cttcttgtattgcaatacaatatttttaggtattaatgctcccattaatatccgtaataangaagcacgtggttgcatgtaaaatggtatctaacataatcccttccatcttatttgctac

SEQ ID NO: 25627 - DNA, 121 bp, Artificial Sequence
  Synthesized
  misc_feature (61): n=t or g
tgaactaaggtttcctatatgtctcaggagtgactaaagaaagagatggttttttctatgngatgaaaaaatttatgcaaatctcaatgcttctggcaggataaggaaacaatcttctgtt

SEQ ID NO: 25628 - DNA, 121 bp, Artificial Sequence
  Synthesized
  misc_feature (61): n=a or t
ttttgatagtccttgttcctctttgaattttctgtttcttaaaatttcctgtgcaccattngttatcttaaccactgctgagtgttgagctgatgttccatagagtcaaaataacaaagta

SEQ ID NO: 25629 - DNA, 121 bp, Artificial Sequence
  Synthesized
  misc_feature (61): n=a or g
ctggcatgactgctccaagttctccgtgagacacagcatctcatgctgagttcttacacancaaacacttctgcagtctgtttcaaagactcattgccttctgtgtttgtatttagctcct

SEQ ID NO: 25630 - DNA, 121 bp, Artificial Sequence
  Synthesized
  misc_feature (61): n=t or c
tttactgggggcacccacagggcagcaccccttcgatgagcatttctcatcgccccacggnagggacgcgagacagatctgacacagctggaggagttctttcttcttctcgtaaaacaga

SEQ ID NO: 25631 - DNA, 121 bp, Artificial Sequence
  Synthesized
  misc_feature (61): n=t or c
cagacagcaaagcttccatcaagaaaggtttctctccccggggttatttcacttgtggtangagtggaagcagcacgttcccacttcagtcgacagctcttgggaggcggctgctgctcag

SEQ ID NO: 25632 - DNA, 121 bp, Artificial Sequence
  Synthesized
  misc_feature (61): n=t or c
gggaaaaaaaaggaaagatcttacctttgcaaactcaatattttctaagggtattccactnaattcactcagctgtgaagtgaaaaaagagtggatttaatactattccacaacattatgc

SEQ ID NO: 25633 - DNA, 121 bp, Artificial Sequence
  Synthesized
  misc_feature (61): n=a or g
agatccactactatttctgtctctagcactatgaagaatacagcaaacttaaaagatggcnactgttaaaggcagataagatcaggcccctgtgtaacagaggcagaaaatctagaagttt

SEQ ID NO: 25634 - DNA, 121 bp, Artificial Sequence
  Synthesized
  misc_feature (61): n=t or c
ttttttcttgtagaatcaaaggacacttaagcagtattccccaggatttattaactcagangaaaagtatagcttctaaacagaccagagcttcagaatactaagatgtattttcagacca

SEQ ID NO: 25635 - DNA, 121 bp, Artificial Sequence
  Synthesized
  misc_feature (61): n=a or c
tgtttctttctctccttggcattctggtgtgacagctgctcatctgactattggatgttgnataaatatatagaaaggatatgctctggaagggctcttacaggtcttctagtcccttcct

SEQ ID NO: 25636 - DNA, 121 bp, Artificial Sequence
  Synthesized
  misc_feature (61): n=a or c
ggatttgtgccattctacgaagttacaaattagacccaagctaaccagattgttatggatntgggcctagtcattacactgattttgtggttacagagcaagaggttgtgccttttcaaca

SEQ ID NO: 25637 - DNA, 121 bp, Artificial Sequence
  Synthesized
  misc_feature (61): n=a or g
atgctgcaatttttctaaaagatattctaattgcaggctgaccgtggtcttgagaccaacnctgaaagtccatcgttataagtgcttcccccttgccctttaagttgtccctgaacaactc

SEQ ID NO: 25638 - DNA, 121 bp, Artificial Sequence
  Synthesized
  misc_feature (61): n=a or g
tgacccaaagcaccatcatattaaagaggacttacagtggtccagactctctcccacacantggatgacttgcacagcacctgaagcctcccagtagcattcccatcagcccattcctgcc

SEQ ID NO: 25639 - DNA, 121 bp, Artificial Sequence
  Synthesized
  misc_feature (61): n=t or c
tctaaaatgttttcagacatatggctgaaaaaaatattaatcgattgcttgtgttagtacnattactttatatcggatgttcctcctggaatctaaagatagatcccctcagctgacacat

SEQ ID NO: 25640 - DNA, 121 bp, Artificial Sequence
  Synthesized
  misc_feature (61): n=a or g
ggccatggagtgctgactattgggaaaaccaaagataataagcataatctgtccttgtgtnaagggatgcaaggatgaccatagagcaggaaaattctacaagatgtagtgaggcttgcgg

SEQ ID NO: 25641 - DNA, 121 bp, Artificial Sequence
  Synthesized
  misc_feature (61): n=t or c
taattaccattgctttatcaatcacagaaaacacagaactgtgcagtggaagacctaaaangaacatttggtatgttcagatattcaggtaatctcgcatctcctccgagagagaagacac

SEQ ID NO: 25642 - DNA, 121 bp, Artificial Sequence
  Synthesized
  misc_feature (61): n=a or g
agctcaccaacatagtatttcctctgctgaagatcacagatcaacaactgcactgaaccanggaaggagaatttggtgaaatgggcaggggtcttttgctggcctctgaaagtttgggagc

SEQ ID NO: 25643 - DNA, 121 bp, Artificial Sequence
  Synthesized
  misc_feature (61): n=t or c
cttatagctgaatcacaatatgttactggtctgcacaatatgctttataatatgtagtttntgagtcttgactggcaagatggtatcataagaaaagctgtgaaaagtctcttggcttcat

SEQ ID NO: 25644 - DNA, 121 bp, Artificial Sequence
  Synthesized
  misc_feature (61): n=a or g
agaacctgactgatgctaaagcgtctaaaatttgagtaagtgagaaacaataaatacgaancatttagaagccaagaaaacagtaagtcctcacaatttaattattcacttgaagctaagg

SEQ ID NO: 25645 - DNA, 121 bp, Artificial Sequence
  Synthesized
  misc_feature (61): n=c or g
cctgtgcacaggggctgcccaaggctactgctgctctagaacgtgtgcagaagacactaanataaggaatacaccttgagttgaagataacatggtttatttcttcatgatattcagatta

SEQ ID NO: 25646 - DNA, 121 bp, Artificial Sequence
  Synthesized
  misc_feature (61): n=t or c
tttttacactgctcagcatcttgacctaattttagcctcgccaaatgtagatcttgagctngaaggggttatttctggtaccatgtccattggtttttaccagaaggtaatttagtttcat

SEQ ID NO: 25647 - DNA, 121 bp, Artificial Sequence
  Synthesized
  misc_feature (61): n=a or g
attcccattttgtgctgccagttcatttcataaacactttctattccaagagcaaactcantaacggaagcattgaatagaacccaagctctttcacttaccttaagaagaaaaaaaccta

SEQ ID NO: 25648 - DNA, 121 bp, Artificial Sequence
  Synthesized
  misc_feature (61): n=a or c
gtgaaaatgccgataggaaggtttcttccccaacttcccatgaataatattgcttctctgntatattgcattacttttccactggagcttctcaggcaattttttcctgcctgattaaagg

SEQ ID NO: 25649 - DNA, 121 bp, Artificial Sequence
  Synthesized
  misc_feature (61): n=a or t
gtcgtagtgtcccgttcccagcactcgcaggctggatcctgctacagcctggctttggacntctgaaagttctgttcccgttcttttcccacagtccagatcagtttaaagattcttctta

SEQ ID NO: 25650 - DNA, 121 bp, Artificial Sequence
  Synthesized
  misc_feature (61): n=a or g
cccgcagcagcgagcttgaaagcttccctggagaatgacagaggatcttgttaagctcacngcagcagagaaggggtccaaggccaaaacaaattgctaggacagaaagctccctctgaaa

SEQ ID NO: 25651 - DNA, 121 bp, Artificial Sequence
  Synthesized
  misc_feature (61): n=a or c
ttctgaaacactgatgtccaactgttgaaagcctttgccaatcaaaacattgtggccttancccgttttaataatctaaggcatcaatctcccccttagcgtttgtttgatgtgttctgcg

SEQ ID NO: 25652 - DNA, 121 bp, Artificial Sequence
  Synthesized
  misc_feature (61): n=a or g
gtgcctcccacccttttatagaacagcagaacagccactttcactgccaccgcaggcaganggacagaaccacctgtgcattatagctctgaaaaattcacacgtgattgctttctgccca

SEQ ID NO: 25653 - DNA, 121 bp, Artificial Sequence
  Synthesized
  misc_feature (61): n=a or g
taagactgcatagcattctacggaaagaaaatccatctctggccttcagaggcaactgganaagccaacaagcatagagcatgctgcatgatgaagagaaggggagtgttgttgctatgtg

SEQ ID NO: 25654 - DNA, 121 bp, Artificial Sequence
  Synthesized
  misc_feature (61): n=t or c
atttaaataaagatctctttgttcatgaaagatgactattctttccagcaacaggcatgangtcattctgatataaccatcccagtaactgcatgaaagaaattttgcattgccacagctg

SEQ ID NO: 25655 - DNA, 121 bp, Artificial Sequence
  Synthesized
  misc_feature (61): n=t or g
aagtaggtggttaaccaattgcaaagcacagatctaaaccagcatgaatttcagagaaacngcacaacataagtccttgggagacaggcttgggtagaatgaaatggggttttcaaattca

SEQ ID NO: 25656 - DNA, 121 bp, Artificial Sequence
  Synthesized
  misc_feature (61): n=t or c
gaataaagacagttcagtttataccattaatctaaatcacaaatgacgctattaagaattnagaattgctaactgtgatcaaaatgctataatcaaaacctgagatttcaaaaaagtagat

SEQ ID NO: 25657 - DNA, 121 bp, Artificial Sequence
  Synthesized
  misc_feature (61): n=t or g
ctcttagcttgggatcattttttcacatgcctgacaaagtatctgttattaggagaacttngatgagaagatttaagtatgttcactactaggtaaaatcaaccagtattttcacatggat

SEQ ID NO: 25658 - DNA, 121 bp, Artificial Sequence
  Synthesized
  misc_feature (61): n=a or g
actgaataagtctgactgttgtacttgcaacaaacttctctgacacctacagcttggctangagatgtggaaataaagatgagcttctaatcaacacacagcctatccctggaaggaaagc

SEQ ID NO: 25659 - DNA, 121 bp, Artificial Sequence
  Synthesized
  misc_feature (61): n=a or g
ggcttagcttcatcttcagaaaacattaacacaaatacatacacactgcatatcagttagnccaagagtggtgttcctgccttttccagatactactcagaatgatagattcacagaatca

SEQ ID NO: 25660 - DNA, 121 bp, Artificial Sequence
  Synthesized
  misc_feature (61): n=t or c
gagttttgcaggtcatatgagaggttattgaagctctaacttactcctcctgtactttctnacttctcggtcagatcattaaaatatgattgacaatatttgcacaggaaaatttgaaggc

SEQ ID NO: 25661 - DNA, 121 bp, Artificial Sequence
  Synthesized
  misc_feature (61): n=t or c
ccatgaactgatgggttttgaagagaaggtgattggcactgaagctgtgccacagtgtgancttcccaccttggatacccatatgggatgcatccatcagggcctggtttgggggcatttt

SEQ ID NO: 25662 - DNA, 121 bp, Artificial Sequence
  Synthesized
  misc_feature (61): n=a or g
atcactcatactttctttcagaaacgacagcctccacctagaacttatcttcattatttanttgttgctttatgcaagcaaattctctcagtataacccagggcctcatctctctctgtct

SEQ ID NO: 25663 - DNA, 121 bp, Artificial Sequence
  Synthesized
  misc_feature (61): n=a or g
gcccagaagagaaaacttatgtaaacttctctgctcagacacaagttttattctcgttctnctaaaagtttctgtgttaagacaacagttttgcaagggcttactgatacaggaaatggac

SEQ ID NO: 25664 - DNA, 121 bp, Artificial Sequence
  Synthesized
  misc_feature (61): n=a or g
catcctgctaacatacctctggaagacctttggcctactggcgtttgctatgtgttctgcncaaatctctgtataaatttaggttcaaagaaacagtttagcaaaaataagaaaaggtgaa

SEQ ID NO: 25665 - DNA, 121 bp, Artificial Sequence
  Synthesized
  misc_feature (61): n=t or c
tctttgactgtcagctgtgtatctctcaccagcactgcgttcacttaaaatctggtattcnagattaaaataaccattagtcctcagttgagcttgaccactgttcagtcaaaaagggtat

SEQ ID NO: 25666 - DNA, 121 bp, Artificial Sequence
  Synthesized
  misc_feature (61): n=t or c
atttcacagtaaaggcagcagtcaaaactattaataacctattctacttagactctcttanaaagaaaaacattgtatgactcaatggcatacttatcaccttacttctgcatatctctgg

SEQ ID NO: 25667 - DNA, 121 bp, Artificial Sequence
  Synthesized
  misc_feature (61): n=a or g
ttcctctgtctgataaggactgcaagtcaggtgcatggcaggaaaatagacagaggtcaantctgaatttcatgttttagagagactggtatatcagaaaagagctggaagtcaaagacaa

SEQ ID NO: 25668 - DNA, 121 bp, Artificial Sequence
  Synthesized
  misc_feature (61): n=a or g
cactgaaagaaagcacagcagtaaatcactgcagaatatacgaggtagagtttaagataantatttttttggtaacacaggcaatgcagtcatggatagctacatcaccttcatctccact

SEQ ID NO: 25669 - DNA, 121 bp, Artificial Sequence
  Synthesized
  misc_feature (61): n=t or c
taatgcgtctgagagccctgtcatcctgagcccttggctgagaagcagcagtgaccaatgngtagttcaagtggctgtttataagtttttccagcaaagtggagaatatattgctcggatc

SEQ ID NO: 25670 - DNA, 121 bp, Artificial Sequence
  Synthesized
  misc_feature (61): n=a or g
ccagtatatttatgctcagatatcagtgaacatatgtcttaagacatgcaactttgaaatnaagttattcatattgcatgcacttccacatggctaagtatttgcaactcagggagtgatc

SEQ ID NO: 25671 - DNA, 121 bp, Artificial Sequence
  Synthesized
  misc_feature (61): n=a or t
taattgccattacccattgcatctcattgaatcaagagatatcctttctgattgatgcagngtgatgagcaatcacttgtaattgattggaattcactcagtatagaatgacatgctcagt

SEQ ID NO: 25672 - DNA, 121 bp, Artificial Sequence
  Synthesized
  misc_feature (61): n=t or c
tcagcgcccttgatggagggcagaagagatgtttgttcatttgtgtgctttaatatataangttaacgattaaagccctaattttcatcaggatagaggtatgtgtaagaagagttttaga

SEQ ID NO: 25673 - DNA, 121 bp, Artificial Sequence
  Synthesized
  misc_feature (61): n=t or c
tcactcataaacactgactcagctttaaaacaacagatttcttttggtgaaaggagaaacnacaccaaaatagcaatcgtgtaagccttgtagcaggcgaaacgtacacttttcaaagcat

SEQ ID NO: 25674 - DNA, 121 bp, Artificial Sequence
  Synthesized
  misc_feature (61): n=t or c
atgaaatatattcagcttagcagttcttcccacaaacattatttcagagtaaaaggaaaangagggtaagcaaatatttccaggtaagcaccacagacatcattacacagttgacttgttc

SEQ ID NO: 25675 - DNA, 121 bp, Artificial Sequence
  Synthesized
  misc_feature (61): n=t or c
cccggtgggaaggcaggggggaccaactgtacctctcatagcccccaatgtgaagggagcngagccccacatgtgctccctgaaagcaggggcctcaatgctactgcttctgtcctgggtt

SEQ ID NO: 25676 - DNA, 121 bp, Artificial Sequence
  Synthesized
  misc_feature (61): n=t or c
aggaatgaaaagaagcttctcacttggccaaaataaaaaatttggctgcctttagctcagngtgggataaagaatttactgaccgagcagagaaggagaggtttcaactgcctaaataaca

SEQ ID NO: 25677 - DNA, 121 bp, Artificial Sequence
  Synthesized
  misc_feature (61): n=a or g
gagtgaggattatccacgttctgtcttttggagcagaagaaattaggcactgccattagcntgacaagcacttggataacatgtgcaactgaaaagttgaaaagaggtctcataaaatagt

SEQ ID NO: 25678 - DNA, 121 bp, Artificial Sequence
  Synthesized
  misc_feature (61): n=t or c
cctttctattgtaagattaagtagacattttcactttcgtgtacacaaggagtgaaattgnagccccattcaatctgatggaactttttctactgacttcaatgagactaggacttcaccc

SEQ ID NO: 25679 - DNA, 121 bp, Artificial Sequence
  Synthesized
  misc_feature (61): n=t or c
ttctacagtctgctaatcaaactctgataaacactggctagtaatactaacaagacatcanagactttttaatggctaaatggaatctagtgctgaaaatgagatttctgtaagatagaaa

SEQ ID NO: 25680 - DNA, 121 bp, Artificial Sequence
  Synthesized
  misc_feature (61): n=a or t
taaccaattgttgtggatgctcaagatagcaggacacctgtcatgcagtaggtgcacctcnatgtagctccttggtaattaaacaatgctcaaaagcagctgtattttacaggagacgtac

SEQ ID NO: 25681 - DNA, 121 bp, Artificial Sequence
  Synthesized
  misc_feature (61): n=t or c
tcaaggcattagggagtttctggtgcttagagactgtggacaagggcaaagctgcctgctngcgtgtaggcttgctctagttcttgtgcagagtggtcgtgtcttgggtgatagttaatgt

SEQ ID NO: 25682 - DNA, 121 bp, Artificial Sequence
  Synthesized
  misc_feature (61): n=a or g
ccaagcagatttaatctgctgtggagaaaagcataacctgtttacatcagcgtggtttgtnttggatggcacaagctggttattctcatagccttggaaaggttttcccttgttgaaacct

SEQ ID NO: 25683 - DNA, 121 bp, Artificial Sequence
  Synthesized
  misc_feature (61): n=a or g
aattgctgctgtaaatcagcagagtgtgctgtaagccagccgtgacaaatatcctgaggancagctatgcaaacaagatggttgataaaaacagaggaagaactacatgtcaagatgtgga

SEQ ID NO: 25684 - DNA, 121 bp, Artificial Sequence
  Synthesized
  misc_feature (61): n=a or g
ttacaaatatttaccaagctttgggttaaaaatgaagatacaaagcgaaatttcagggggnaaaaaagtacaaacaagatgtttatcacactggtgcaagaccatggtggggggaccagtt

SEQ ID NO: 25685 - DNA, 121 bp, Artificial Sequence
  Synthesized
  misc_feature (61): n=a or c
gggatcttgagcctgaccagaaccacatgcagagcaggagcttcaaggctattcaacagtnagtcagtcccctcttcctgcagggatctgagggactgcagcagcttcacagcagctatga

SEQ ID NO: 25686 - DNA, 121 bp, Artificial Sequence
  Synthesized
  misc_feature (61): n=a or g
tatcttagcatgtgacagaacagcacgaagacaattaaaaccaacacaataattcacattncaactgggctgagcagtagaattcatctgaccacgttacaggctgctgaggaaaatcctg

SEQ ID NO: 25687 - DNA, 121 bp, Artificial Sequence
  Synthesized
  misc_feature (61): n=a or t
aaccctctggggacactgtgtctgtagttgtacactcagaccaacagagtccacatcagantctgtgcagtacatacagtttgtacccattttagcgaggcaaagtacctctaattcatgt

SEQ ID NO: 25688 - DNA, 121 bp, Artificial Sequence
  Synthesized
  misc_feature (61): n=a or c
gtcgaggcttttcctaagtcttattgtatcattataagagcaaaatcgcttctccttgctntagcaatgtattcagcattcggtttacagaagttttccctactgctgtgttcatcaacta

SEQ ID NO: 25689 - DNA, 121 bp, Artificial Sequence
  Synthesized
  misc_feature (61): n=a or g
tcaggagatttttgaagtcacattaactgaaatgtttccacatcatatctgcatcattcangaaggctgatagttgagcatcagtgaggtggaatgcttgaatagcacagtaaggacagaa

SEQ ID NO: 25690 - DNA, 121 bp, Artificial Sequence
  Synthesized
  misc_feature (61): n=t or g
agcactgatttctagctcaagctgttttatcaagactggctaataaaagcattatgtttcncatctagggagagcggaaggcagaaaaaatgatcactaagatatgcttgtatagacttgc

SEQ ID NO: 25691 - DNA, 121 bp, Artificial Sequence
  Synthesized
  misc_feature (61): n=t or c
tgttttagtgtagctgagtatcagctacattgctcttgacctgcagttgtcatgcagtgangccagcagcactccacttgttagcagtgttcaacaacgaaaatggagagtgagtatgttt

SEQ ID NO: 25692 - DNA, 121 bp, Artificial Sequence
  Synthesized
  misc_feature (61): n=a or g
agtaactgatgcatagctctaacactatttactatgacagaaggtttagtgaaggactaanaggtgttataaacagttattgagttgttcttcaataacaggttacagaggctgttgcact

SEQ ID NO: 25693 - DNA, 121 bp, Artificial Sequence
  Synthesized
  misc_feature (61): n=a or g
agcaaaagagtttggctttgagcattacttctgcaagcactacaatggaaaaaacctcttngaacttttgcttgaagaattgcaactactggtaaacaatctttgtctttgtttaccagta

SEQ ID NO: 25694 - DNA, 121 bp, Artificial Sequence
  Synthesized
  misc_feature (61): n=a or g
cattgcaatcttttaatgtatttgttttcaattctagttgggaaaggggctggggggaagnggaagggacaatcaccaacagccaaaccaaacaaaaagaaccagatgatgcttcttactc

SEQ ID NO: 25695 - DNA, 121 bp, Artificial Sequence
  Synthesized
  misc_feature (61): n=t or c
cctgcgtaagcttttcttttacccagctcttcacaagccttagtggcccatctgcaggatntctctgagctttctctgctgcccttctgcagctgccatcgcgaagccacctgcaccaggc

SEQ ID NO: 25696 - DNA, 121 bp, Artificial Sequence
  Synthesized
  misc_feature (61): n=a or g
agtttcctttctgttcaaaatatccatcagcttttacacagctctagatatttcttgtttnctccagcactttgtctatctccacaaaaatctgttcaggagaggaaagtggctttcattt

SEQ ID NO: 25697 - DNA, 121 bp, Artificial Sequence
  Synthesized
  misc_feature (61): n=a or c
ctccttaggtctgtagccctttgagacatgcaccatggttcaggcactgaaagccatccangtttccttatccgctgtgtacaattatagagagtacaatccacagtccactgctgggatt

SEQ ID NO: 25698 - DNA, 121 bp, Artificial Sequence
  Synthesized
  misc_feature (61): n=t or c
tttacaatataagtaaatattttacattaactcggctctgaggaagatgaaaaagggattngttttgaccagttaacacgagacatttcaatatagggaatattggtgtttctacaaatca

SEQ ID NO: 25699 - DNA, 121 bp, Artificial Sequence
  Synthesized
  misc_feature (61): n=t or c
cgcgtaatgcctgcccccaaagttctgctctctgaagcatgagagattgcagggtggtttnctatctttgtattgttaccttttcctctttctgccacgcgatgtcacccaggggtggttt

SEQ ID NO: 25700 - DNA, 121 bp, Artificial Sequence
  Synthesized
  misc_feature (61): n=t or c
gtgtggctaaattcccctcctctgtttctaaaatcagacagtccactctagctgtatgtgngtctagcaaacaactattcccctccatatttttaaggcttaaaagatgtagtaggtgtct

SEQ ID NO: 25701 - DNA, 121 bp, Artificial Sequence
  Synthesized
  misc_feature (61): n=a or t
gctgaaaaatctgctgaggttcagagctcagtgctctgccagtaagaaacagtaatattancttactggtaatactaataggggtagcagactaacttcagaaagttttactataacactg

SEQ ID NO: 25702 - DNA, 121 bp, Artificial Sequence
  Synthesized
  misc_feature (61): n=t or c
ttaatttcattatgtaaaaaaacttgtgtctaacagaagataaaagattaaagaaagcctnttgctgtgctgtccactgtgcatatttaattttagtttgtctaacttaagaactcccatg

SEQ ID NO: 25703 - DNA, 121 bp, Artificial Sequence
  Synthesized
  misc_feature (61): n=t or c
tttttttttttttttttttagtctataaacttcatgtttttggtgctatttgctgtgttanggtgatttgaaacatttgagggattttaggtctgaggtacatacagctgtttgaaaactg

SEQ ID NO: 25704 - DNA, 121 bp, Artificial Sequence
  Synthesized
  misc_feature (61): n=t or c
gttacacaaatgtcctgattcttcacttcttgtgaagtcaggtctatagaatattgctgcngttttgtaacggttccatagttcttttccacagtttatttatatctaatcagttgagagt

SEQ ID NO: 25705 - DNA, 121 bp, Artificial Sequence
  Synthesized
  misc_feature (61): n=t or g
acccctgcttggaatgaattctactttgatttacaccattccacactgactttagccagtnatatgctggcttctacctaaatgcccacagagctcagaaatgctgctgcaaacagaactc

SEQ ID NO: 25706 - DNA, 121 bp, Artificial Sequence
  Synthesized
  misc_feature (61): n=t or c
tttgaggcagacaggcagagcaggggcagtgagggacttcacaggttcagaacaacgctgntcttgcctctcatcagctgtagtgcctgaatgactgtccttcccacattacacaagtgaa

SEQ ID NO: 25707 - DNA, 121 bp, Artificial Sequence
  Synthesized
  misc_feature (61): n=t or c
gacgctcccaggctgccacaaaatgtccactggggactaagctgaggccgcagcgctcatnctcccatcactccatgtttaatctgagccccggtctgcctgacgaaattgggaaccggat

SEQ ID NO: 25708 - DNA, 121 bp, Artificial Sequence
  Synthesized
  misc_feature (61): n=a or g
ggcaggcttcctgtacaaggattatttaagaccaggacttcaatttcctccaaatcagacnggaaatcagacttcagacgtgcatcagtggataaactgggtgtaggattatttagtgtga

SEQ ID NO: 25709 - DNA, 121 bp, Artificial Sequence
  Synthesized
  misc_feature (61): n=t or c
gagctgctgaaccaaccatttggctgtccacaagaagactggttaaatagctgacgtgtcnaaaatgacatcatagccaaagctaagattttcttatcctctgccaccacattggactcct

SEQ ID NO: 25710 - DNA, 121 bp, Artificial Sequence
  Synthesized
  misc_feature (61): n=a or g
tgacttcaaacacctgccaaccatgagcctctagcgtttacagtatcagtcagtttaggancgatacaacacggtaaaactgggttttctgctaggccagagtcctggaattagcctcgtg

SEQ ID NO: 25711 - DNA, 121 bp, Artificial Sequence
  Synthesized
  misc_feature (61): n=a or g
tgaactcttccttcagtttagtctgtaagagactggagaatcacgactgcttatgctatancataaaaataggaaacctgctttatgaacttccatttgtaatcaatacgtgcagtgagat

SEQ ID NO: 25712 - DNA, 121 bp, Artificial Sequence
  Synthesized
  misc_feature (61): n=a or c
tttcttttctcacatgtgatccaccattcagagtctgagagtcctctgatatagctggcantattggaaactggctcttttctctaattttcatattgcagaaactcagcctgaggcattt

SEQ ID NO: 25713 - DNA, 121 bp, Artificial Sequence
  Synthesized
  misc_feature (61): n=t or c
tgctgtatggttgggctttgctgactaccagcttcaagtttatttccatagccatagcatntaaaattcttgttctaggaaggaaagatagtggtgttagaccaactagtttgagccataa

SEQ ID NO: 25714 - DNA, 121 bp, Artificial Sequence
  Synthesized
  misc_feature (61): n=a or g
ggtatgtaaaactaagaaacaataataaagaaataaactaaggaattgctatcaaacctgngagaggtattgtttcatgagcttttgaagctggaggctgtgccttggttctggtttttga

SEQ ID NO: 25715 - DNA, 121 bp, Artificial Sequence
  Synthesized
  misc_feature (61): n=a or c
aacataatacaaatgatatacactttctcatgctaaggcaggtcaggttcgggcagcttgnaggatgcatgcaggcacaggtacctggtatgaaggtacctgaactcaccatttctctgtg

SEQ ID NO: 25716 - DNA, 121 bp, Artificial Sequence
  Synthesized
  misc_feature (61): n=a or g
agaattactgattatatctgaaatgcactacatgaagagcggtcagtgtactttgcattanctcagtgcttttgatatgttgtcattgattgatatgaagtcattgatatgacttccaaca

SEQ ID NO: 25717 - DNA, 121 bp, Artificial Sequence
  Synthesized
  misc_feature (61): n=a or g
ttgctcagtttgatcacttatgtcaattctctttgctggacagcagtttcttctgcatggnggaaaccacagttcctaaaagtaaatcctttttaaggacctagcctacgatgcaatatcc

SEQ ID NO: 25718 - DNA, 121 bp, Artificial Sequence
  Synthesized
  misc_feature (61): n=c or g
gaaggttttcttattttcttgtattagcagcaaggaatcctcccttctggggactgaaganagagtttttcttgtgatggctgagtagccagcaagacaagcatttgagtcctttgggtat

SEQ ID NO: 25719 - DNA, 121 bp, Artificial Sequence
  Synthesized
  misc_feature (61): n=t or g
catagatctgatagtactgaatatgttttcactagtgtatacgtacttaagcttttaaaanggccagtttcagaaagctggtaattcgagttaggctctgaggaaaaactgcttttagcaa

SEQ ID NO: 25720 - DNA, 121 bp, Artificial Sequence
  Synthesized
  misc_feature (61): n=t or c
tgaaactcaaaagaaacattccagtgcctgtgaaatcactgccttatatctgaagtgccangaaccagcattcctgtccagcgtagcagctttctcgctcactcccacagctgctttatct

SEQ ID NO: 25721 - DNA, 121 bp, Artificial Sequence
  Synthesized
  misc_feature (61): n=a or t
gctgcagcctcatccccagacacagctggggatatggtcagaatcaggctcagtaaatccnatcaacaaaacattttcattgattttcaattccacacaagctatttctactgaaagtcaa

SEQ ID NO: 25722 - DNA, 121 bp, Artificial Sequence
  Synthesized
  misc_feature (61): n=t or c
agggtttgatgtacaaaacacctaccagtcagtctgctgagtttagctatacagagccggnccactgtaacactgcaagcaaacagttccaatgcctaaccattaagaatcatattcccac

SEQ ID NO: 25723 - DNA, 121 bp, Artificial Sequence
  Synthesized
  misc_feature (61): n=a or c
aatgtttttagtgagtccaggcacttgccccttctcctaggcgaaaggttcatgtagtctntgtggagccaaagtacgtggttatagccggtttggcagggaggcgggttctggcagtcct

SEQ ID NO: 25724 - DNA, 121 bp, Artificial Sequence
  Synthesized
  misc_feature (61): n=a or c
agacaattttgtggaaactttctctttgaaactcaaattgcggatgtggaagagcactacnttttacatggaggatgatttagtaagggattctccacgtgcacatctccccagtagactc

SEQ ID NO: 25725 - DNA, 121 bp, Artificial Sequence
  Synthesized
  misc_feature (61): n=a or g
gagtactggtgtattttccaaaaatttccaagcaagtcctaagcttcctaagcacgcttcnttggcacttagagtttcctgtcttccttaagaactttgaacatatctcttcatcatgctg

SEQ ID NO: 25726 - DNA, 121 bp, Artificial Sequence
  Synthesized
  misc_feature (61): n=t or c
aaagaaaggctagtgaaatgatcaagggatttgagcagctgcttcacaatgcagggcttcntttaacatctgcagtacagaaaaagtgaatgctgaggaaacctgaagggaacaaaagcag

SEQ ID NO: 25727 - DNA, 121 bp, Artificial Sequence
  Synthesized
  misc_feature (61): n=a or g
gagaaactgcactgctgtcaccggattccagagtcacagtagccaggatctgctcaaactncttcttgctgtgttcagtccttgctgagtgttctcctgccctttcctcaggtctccaatg

SEQ ID NO: 25728 - DNA, 121 bp, Artificial Sequence
  Synthesized
  misc_feature (61): n=t or c
cgtgctccccaaagaggatgctcggcccatttccacatattcagcactttcttcccctccngggttcttttctgcagcagcaggaaactgtgcaggcacacatcatccactgctcccatct

SEQ ID NO: 25729 - DNA, 121 bp, Artificial Sequence
  Synthesized
  misc_feature (61): n=a or g
taaatggttggcacttagtggttgatcactgtcaagtcatttgtaagcataaggttctacnaagctcttctgccatacagggagttccgtggtcctcctttacctgttgcctgagccttgt

SEQ ID NO: 25730 - DNA, 121 bp, Artificial Sequence
  Synthesized
  misc_feature (61): n=t or g
ctaacattttcttctgcacttacattcattacaccaaggggcttgaactttctgcccatgntttgtgcatcagatatgtcttctattagatgttcacttggaaaatgaacaggaatttgtt

SEQ ID NO: 25731 - DNA, 121 bp, Artificial Sequence
  Synthesized
  misc_feature (61): n=a or g
acatgttaacaatgtcagtgaaagagaacagtgggaagaaatcacagtatcaaagaaatcncagtgtcagtatgacaatactctgacttcgtgagagatggatgtgtaagaaaaagctttt

SEQ ID NO: 25732 - DNA, 121 bp, Artificial Sequence
  Synthesized
  misc_feature (61): n=a or g
tgaatcagtaatatgaaaatatcatagttatatcaaacgtcatatgagaaaggaaaaagcnaattaggattacttcacagataccaagtctgttagcagaaacacgaagattcagggtgta

SEQ ID NO: 25733 - DNA, 121 bp, Artificial Sequence
  Synthesized
  misc_feature (61): n=t or c
ttcagaagagaattgtggtattctcaaatattaattacttctggcatctcatttaagatanggagcgtttctcaccctattccagtggatgtgatgcttccagaccctgctttccagcagc

SEQ ID NO: 25734 - DNA, 121 bp, Artificial Sequence
  Synthesized
  misc_feature (61): n=t or g
catgcaaattggcttcatctaaaacatcctggtgagtatgtcggatgagagttttatggtncagccttagaatattgctagaagattcaagacagggcaaactgagcaacagaaaagcaca

SEQ ID NO: 25735 - DNA, 121 bp, Artificial Sequence
  Synthesized
  misc_feature (61): n=t or c
ttcctctgtttcatccaatttatccaaactctttttctgaaatcattcctgctgtcatttntctccagttgtattttaacttgtattctctttactgtgttggttttgttcctcaagtttt

SEQ ID NO: 25736 - DNA, 121 bp, Artificial Sequence
  Synthesized
  misc_feature (61): n=a or c
cgatatgaagacagaaatagcaggagctgaaaaacaaataaaaccaatcattcaataaaangatgaccagttttacaggatgcttaatgacaaactgttgagacccactcaaatacagtac

SEQ ID NO: 25737 - DNA, 121 bp, Artificial Sequence
  Synthesized
  misc_feature (61): n=t or c
ctaaatttatgagggtgttttcactgcatatttgatatggcagtcccattcttgcttttcntgtgtgtaagacctaaattccactgctaaccaatggggagaggtggtgcaagaagaaact

SEQ ID NO: 25738 - DNA, 121 bp, Artificial Sequence
  Synthesized
  misc_feature (61): n=a or g
tccctcagaagcagcagcaagagctgggaggggttggaaccagcagtgatgtgcagggtgngaaacaccaaggtgacctgtttggacagcacaaggtgtgcgcatgagcacaggctgacaa

SEQ ID NO: 25739 - DNA, 121 bp, Artificial Sequence
  Synthesized
  misc_feature (61): n=t or c
tttccagaggaaacaaacacaggtgatggtctgtttctaactataagactttgcaacatcngttggctttagcccttgcttagtttcaaaattataagcagagaatcataaatacagcttt

SEQ ID NO: 25740 - DNA, 121 bp, Artificial Sequence
  Synthesized
  misc_feature (61): n=a or t
ccactggtatacaggtcaaaaagttcagcgatctattgaaaattcagctttggagctggcngtgcaagaattagtctgataatacaagccagtattctatgatctgtgtacataatcatac

SEQ ID NO: 25741 - DNA, 121 bp, Artificial Sequence
  Synthesized
  misc_feature (61): n=t or c
gctgtaatttacaaatgcaattatttaaccttgtttacaactccagaaacatggccacatnctttgaacgggaggagactactagtattgaagtttgaagcttgatgagcagtaatgggat

SEQ ID NO: 25742 - DNA, 121 bp, Artificial Sequence
  Synthesized
  misc_feature (61): n=a or g
ctcattcagcagtgagcccacattttccctaggcttctttctgttagtgacatacttaacnaagactttcttattgtccttgactttcctaactagatttaattccaagtgggccttagcc

SEQ ID NO: 25743 - DNA, 121 bp, Artificial Sequence
  Synthesized
  misc_feature (61): n=t or c
tttttcttttcccactgtggtatcagctgcagccacaggtatgaatcacacgttgttaacnttactttagattcacagctgcttaggaacacgttttcataaaggataatagttatagaat

SEQ ID NO: 25744 - DNA, 121 bp, Artificial Sequence
  Synthesized
  misc_feature (61): n=a or t
atttttttccatctgggagcaaacaagattaattgaagtttcgttacaaagagaagtgaantatgaaattgcagttaaccagaaacatacgttttggtatataacccaaaaattctagtga

SEQ ID NO: 25745 - DNA, 121 bp, Artificial Sequence
  Synthesized
  misc_feature (61): n=a or g
tactggcatgcatagcagtattacccaattctatgtttcattgatattttcccttttcccnttaggaattcaaacattatagacagactggggaagggatagtgggtaaattcttctgagc

SEQ ID NO: 25746 - DNA, 121 bp, Artificial Sequence
  Synthesized
  misc_feature (61): n=a or g
aatagcatttgcaatgtctttatattcatggatgaatagaagtaaagaaaagatgcctccntgaggacagtgaagccatgtgattcctgaaatactgttgttgatgcaagtgttgggatct

SEQ ID NO: 25747 - DNA, 121 bp, Artificial Sequence
  Synthesized
  misc_feature (61): n=a or g
taagtttatgggatgtttgtcattattttttaatgaacactttgttactacagctgttggnggcagacttagcccaaaacaaggcatttttgaagatctagcacttccattttgtagcagt

SEQ ID NO: 25748 - DNA, 121 bp, Artificial Sequence
  Synthesized
  misc_feature (61): n=a or c
ccaaagcacatttcccagagggctagatatgatgcactcactcttattcctgaaactgatnaactctttattaaatacatgtcatatatatgcaaataaaatcaaatgttaagaaagtgag

SEQ ID NO: 25749 - DNA, 121 bp, Artificial Sequence
  Synthesized
  misc_feature (61): n=t or c
tctatctccggaaggagcttgctcagccattctttggggaaactgtcatccctctttcttngacctcagaagaggtgccctaaaatgcagcagcaatgacaaggcaataagcctttcttct

SEQ ID NO: 25750 - DNA, 121 bp, Artificial Sequence
  Synthesized
  misc_feature (61): n=a or t
tgtttcatacaccttgagtgcacgctcagctactaaccagtgcttggcagaactgtaattngttctctggcgcacaccgtccctttcagaatgctttccattctggttttcagggaactag

SEQ ID NO: 25751 - DNA, 121 bp, Artificial Sequence
  Synthesized
  misc_feature (61): n=a or g
tttgtaccacacatctctaaaacataattcacagaagctgaataaggatgtacagaaatcntgagtggtgttatctggtgggcaatattagctcagattagtcacgccactccaaaacata

SEQ ID NO: 25752 - DNA, 121 bp, Artificial Sequence
  Synthesized
  misc_feature (61): n=t or c
ggaaactcagttaaggaaagaaagttcgttagcggagctgaggtaccgtctctgtcaagancaagacctcctgtcctaccttctgcttcttgttgatgtgtccaatgttgccttgtttggg

SEQ ID NO: 25753 - DNA, 121 bp, Artificial Sequence
  Synthesized
  misc_feature (61): n=t or c
atagtgatctttacttgcacttgtgttgccagtgcttcatctcttatgcagtgcatttcanttccctaatccttcaggtatttccacctttcttgactgatcagttcctatcagaagtcat

SEQ ID NO: 25754 - DNA, 121 bp, Artificial Sequence
  Synthesized
  misc_feature (61): n=a or c
gaagcttcagtactctgaattacctctttgagtgtctaagagagatggtcagagaacctgngttagtaacacaaactaaagttactcctgaccataagagccacaagtgttacaactagca

SEQ ID NO: 25755 - DNA, 121 bp, Artificial Sequence
  Synthesized
  misc_feature (61): n=t or c
taaaataaaagatattcagttctggaaagctccacaaggtgatccagtgactatttcgaancctgatgatgtttatctggggatatagcccatgtgggaggtgctccagagctggtattcc

SEQ ID NO: 25756 - DNA, 121 bp, Artificial Sequence
  Synthesized
  misc_feature (61): n=a or g
aatatatattatagtacttttaaaaagagtagtatctgatgtgataccataattacccaancctgcactgttctgtggaggtaacataaatttagtgacctgtcactcagtcgcatggact

SEQ ID NO: 25757 - DNA, 121 bp, Artificial Sequence
  Synthesized
  misc_feature (61): n=a or g
ccatattattgtggtctactagacccacggttgttgaatagatgagttatagagatggganctgatgggatatagagaattatctttatcttgtgttgaaaaggagatgagcctggagatg

SEQ ID NO: 25758 - DNA, 121 bp, Artificial Sequence
  Synthesized
  misc_feature (61): n=a or g
tttatatgatattcagaaccaagacatgataaatacttaagcttttccctttgtatcaggnttgtaattggttctttccaagctgaacgattttgtgtaaacctgtaaaataatgttgtat

SEQ ID NO: 25759 - DNA, 121 bp, Artificial Sequence
  Synthesized
  misc_feature (61): n=a or g
ttttctccttggtgcttggacggctcctgagcagggcactacaagtgttcatgaaggaacntgatgaaaatggtgtggcttctttgaatgagtagtatggtcaggttgtggttggacttga

SEQ ID NO: 25760 - DNA, 121 bp, Artificial Sequence
  Synthesized
  misc_feature (61): n=t or c
gcagagggggagaccgaccctgtgatgcacctgagcatgtccaagtgggagctgggctgcngtctgcacgtcccaatctctttgagacccaggttcccacagtctgcaatgactttctgaa

SEQ ID NO: 25761 - DNA, 121 bp, Artificial Sequence
  Synthesized
  misc_feature (61): n=t or g
aagtaaggtaaggattcaagtgggctgagcaatgtgaatttacagtggctgggatctagantctatagcatcaggaattttcctattttttcctttctgacttgtaatctgaagaagagaa

SEQ ID NO: 25762 - DNA, 121 bp, Artificial Sequence
  Synthesized
  misc_feature (61): n=t or g
tttttagagtatactttggtataactactaacaagctagaagataaattccaaaatcattncttgcttgctgaaaatgagagagttaatgagggaattcttaattctttttttgtgtgtat

SEQ ID NO: 25763 - DNA, 121 bp, Artificial Sequence
  Synthesized
  misc_feature (61): n=t or c
actattgtttcagaggttcaagaatagctctctgaaattctcttaactgaaacatctgtgnctatagatacctaaaattgaatgattaggacacacccctctactgaagatctcatattta

SEQ ID NO: 25764 - DNA, 121 bp, Artificial Sequence
  Synthesized
  misc_feature (61): n=a or g
acactgtcttatagaagcatcatttccaaaagctttaccctttttcagagaatggaactcngaagatggatcttttgaaatgtgtgttcatttctctaggctttcctggtaggaaacatgc

SEQ ID NO: 25765 - DNA, 121 bp, Artificial Sequence
  Synthesized
  misc_feature (61): n=a or g
taaatgaccaactccactgcaggatgagtgggggcacaagggtctttcagatcatgagagnatgagctctcacagtcagtgatagacactcaattggctttaggtctggctgagctgttac

SEQ ID NO: 25766 - DNA, 121 bp, Artificial Sequence
  Synthesized
  misc_feature (61): n=a or g
tctggggcagcacaactgtctaaagttcaacttcagttcactttaataataagttaacttntcttactgcactgtgtaattttcatctgtaaacatttggatggcatgttatcatacttac

SEQ ID NO: 25767 - DNA, 121 bp, Artificial Sequence
  Synthesized
  misc_feature (61): n=c or g
agcagcaaaaataaacaacttaaccagccctacttacataaaatgacagcaggggatcttncagctgagggttctgaaaatttcacaggggacctaattctgaggaactacttctgtaacc

SEQ ID NO: 25768 - DNA, 121 bp, Artificial Sequence
  Synthesized
  misc_feature (61): n=a or g
aaaccccgcaaaaccccaactgtttcagcatgaggtcccgtcccggaaggagagagcagcncagttatcagttcgtttcgcatgcggcaggacagaggctgcccggtgctggcgacccggg

SEQ ID NO: 25769 - DNA, 121 bp, Artificial Sequence
  Synthesized
  misc_feature (61): n=t or c
atctgaacccctgtatgaggtctatgtagaatactgagcagattttttgtcccctgagganttaattagaagaacagcttttctctgaacaataaaaatgtctctgattagacagtcgtac

SEQ ID NO: 25770 - DNA, 121 bp, Artificial Sequence
  Synthesized
  misc_feature (61): n=t or c
tctctgcttattggagatagccataatttcactttccagcagcttctctgttaagaagttncttatctcttcacagttccctgcaagctcaaactccacaggatcagaaggaaacagtcag

SEQ ID NO: 25771 - DNA, 121 bp, Artificial Sequence
  Synthesized
  misc_feature (61): n=t or g
agcaaagttttcagtctcaagacggtgcttccttaattgaggacgggaagaacaaattgtnttatgacaaaaagagatgcttttaatatccctctgttcaaaggggtcaggtggtactggc

SEQ ID NO: 25772 - DNA, 121 bp, Artificial Sequence
  Synthesized
  misc_feature (61): n=t or c
agagagagattagaggtaatgtcaatccatgcctcaactgctgtcactgcatggcctgatncttttgaagactcaagaggtggatattagaaacatactttacaatgagaaaggaccacac

SEQ ID NO: 25773 - DNA, 121 bp, Artificial Sequence
  Synthesized
  misc_feature (61): n=c or g
ttgagatgagataaacatttcggcattttagcaatatatgtaaatctgctaagggctactnaatctagagctcctcagtacttttctgcaaaaatggagtgtgttttttttggtttgtttt

SEQ ID NO: 25774 - DNA, 121 bp, Artificial Sequence
  Synthesized
  misc_feature (61): n=a or t
acactccccagagccccctctgccttttcccaatcacttggaagcacagaagcgtgcccangcatgtgctgctcccggattaaagctccacgtgtgcttttgtcatacaccccatacagca

SEQ ID NO: 25775 - DNA, 121 bp, Artificial Sequence
  Synthesized
  misc_feature (61): n=t or c
tagaatccacagttcatgtccactttctaattacattcatgtgaaaattaagcagtttagnttccagaaggcagggtttatccaggctgtgcaagctctgcacccacagcgcatctcccac

SEQ ID NO: 25776 - DNA, 121 bp, Artificial Sequence
  Synthesized
  misc_feature (61): n=t or c
ctgctctgaggctctgtttttctctttccaatattgacgttacagctaattgagacaagtngctgaaggagaaacaggaggatgttgttttgccatgctaagtagttcagctgacaaactt

SEQ ID NO: 25777 - DNA, 121 bp, Artificial Sequence
  Synthesized
  misc_feature (61): n=a or t
caagcttaggcttccaaccacattgcacaggggagctgggcagtagattatgacaaaaccncatcccgtgggtgactgcaccaaagttctgcatcaccaaagcatctgaatccagttttgt

SEQ ID NO: 25778 - DNA, 121 bp, Artificial Sequence
  Synthesized
  misc_feature (61): n=t or c
aacgggatcgtcatgttggacggaccctttcgctcctatgaggaactgtctgttcaggtanggaaaggtttgtgaaggagtcagacatggagccaccctgctgtgattcactgcgtatcag

SEQ ID NO: 25779 - DNA, 121 bp, Artificial Sequence
  Synthesized
  misc_feature (61): n=a or g
ttgctatagaagtttctgtagacacgctttgtaagcaaagattgcttggactctagcaggngactgaacattttgtgaaaagatgtacagctatacactgagcaggacagggttcacatta

SEQ ID NO: 25780 - DNA, 121 bp, Artificial Sequence
  Synthesized
  misc_feature (61): n=a or g
ctgcctttctggaagttagagtaccttcaggtgtgagaacaggatgggttaggcaaaatantgaggaatgtggcaggaagggataacgatctcccttacctgtgttagagttctcagctat

SEQ ID NO: 25781 - DNA, 121 bp, Artificial Sequence
  Synthesized
  misc_feature (61): n=t or c
gtagcttgatgatacagaaacctgtagttcctgggcttgctaggccatctcactcatttcncatggtagtgcttccccagcagtcttcagaagtggagactttggaaggaattttctattc

SEQ ID NO: 25782 - DNA, 121 bp, Artificial Sequence
  Synthesized
  misc_feature (61): n=t or g
gtgaaagagcaactgattgggaaatattgcaggggtgtttgcaaatatgttttatgaaganaattccagtatctcatagatttacatggctaggtactgattctttaaaaaaaaaaaaaaa

SEQ ID NO: 25783 - DNA, 121 bp, Artificial Sequence
  Synthesized
  misc_feature (61): n=a or g
atggggactcataagacccagcgtagaggtcaacctgtggagcttttgatggggaaaaacnaaattaaaaagtggaataagcattccagtctttgctgggtccattgtagggtgtttttag

SEQ ID NO: 25784 - DNA, 121 bp, Artificial Sequence
  Synthesized
  misc_feature (61): n=a or g
ctggagttctgctaaatacttaaaattttccaatttatggcagtcaggtatggggaaaatnttcattctcatgaatgttaagtgatgtgaattcaggaggactttggatttactacaggaa

SEQ ID NO: 25785 - DNA, 121 bp, Artificial Sequence
  Synthesized
  misc_feature (61): n=t or c
tggagatgggaggctgcaaattggaggtctgtcacacttctttccaaaagcctaaggatgntcagtaaagtaaccaaaatgaattctgtagaggaaacacttcaaaattcaaaaaactaaa

SEQ ID NO: 25786 - DNA, 121 bp, Artificial Sequence
  Synthesized
  misc_feature (61): n=t or c
gagcaggattcctctccttccgtgctttacttgtccccagacccatccctggagaattgcncagggacacaggattgtacctatgtaatatcagggtagtgcagagaaaatactctaaaag

SEQ ID NO: 25787 - DNA, 121 bp, Artificial Sequence
  Synthesized
  misc_feature (61): n=t or c
tgctccttaatgcaactatgctatcaatcagtactcctcaggtcagtgaattttaaggaangaagaagtacggctggtgctatcattcactctctctgcacagtaatttggaacacaatga

SEQ ID NO: 25788 - DNA, 121 bp, Artificial Sequence
  Synthesized
  misc_feature (61): n=a or t
ttcagatgcagggtcctttgccatctcttttctttagtttttctcctgaagcatggaaacngtatctttaaagtctgtcctagatagctgataaactactgctttaagaaaacctgctggg

SEQ ID NO: 25789 - DNA, 121 bp, Artificial Sequence
  Synthesized
  misc_feature (61): n=t or c
gtattaaatgtatatgagcatcagagataggaaatataagattttgctctgatttcataangatgcttatttttgtgagtgtagctaagaagaagtgagtacgctgaattcaatggaaggg

SEQ ID NO: 25790 - DNA, 121 bp, Artificial Sequence
  Synthesized
  misc_feature (61): n=a or g
gcacttttactcaagctgaatgagggcagtgtattttttaggagaatatatcttgctcccngccattatgtgtgccagtactaggtttcaaagcaagattttcttacttgtggtcatgaca

SEQ ID NO: 25791 - DNA, 121 bp, Artificial Sequence
  Synthesized
  misc_feature (61): n=t or c
taacttcttcatagcctttataacatctctgtaagggcacagcactcctgctctgtaactngggtgctggtgctgttcttaagctccagggtgcagaattacaatcctgaacgtatttgaa

SEQ ID NO: 25792 - DNA, 121 bp, Artificial Sequence
  Synthesized
  misc_feature (61): n=a or g
acaggagaaaatgcggtagaaaaacctgccctgaacagcagtcacatataattcaggttcntgatgaaccaaacttaacttctctaagctctgtgtgtcccgactctaaattcattcatta

SEQ ID NO: 25793 - DNA, 121 bp, Artificial Sequence
  Synthesized
  misc_feature (61): n=c or g
aggtttttctgtggtccatacccatcaaagacatacctgcaaaaatagagcttttgtccangattttatctccaggatacattctgcaagtgctcttgttttttgagactcactgctgtca

SEQ ID NO: 25794 - DNA, 121 bp, Artificial Sequence
  Synthesized
  misc_feature (61): n=a or t
gaaagaggttaagcagatgtagttcttggaaatacaaatttactactttccatcacaagtnatctgttcgcttgcctcattggaatgtctgggaatgtgataagtgatcaaaaaaattctt

SEQ ID NO: 25795 - DNA, 121 bp, Artificial Sequence
  Synthesized
  misc_feature (61): n=a or g
tctgagttagagagtcagcagcaaactggcagggcagcttggcatgaggatttcctggagntagggatgaacaacaggagctggaccggtccccacacgacagggagacagggaggctcaa

SEQ ID NO: 25796 - DNA, 121 bp, Artificial Sequence
  Synthesized
  misc_feature (61): n=t or c
ggcagagaatactccgaagagttttccggaaagaggctcttctccctcagcactgaagtcnatctattcagtgctgaaggagagtaagagactgttttgggaaggagagggctccttgatg

SEQ ID NO: 25797 - DNA, 121 bp, Artificial Sequence
  Synthesized
  misc_feature (61): n=c or g
gtacagatttgtaacagtcagaatttagatttagattgaaagtccattgaaatttcataanagactatcccaagattgtaagtattgaaagtgcaaaataatcactttctatttttatagc

SEQ ID NO: 25798 - DNA, 121 bp, Artificial Sequence
  Synthesized
  misc_feature (61): n=t or c
acaaggtagttcttaacatacaagacatatgactctttattcagtctctcaatcaacacanctgaatccttgatgaaattgcaagctttccagtagaaggtagaaagcatgatagttcaaa

SEQ ID NO: 25799 - DNA, 121 bp, Artificial Sequence
  Synthesized
  misc_feature (61): n=t or g
acagtgacacgcctgaaagcgaggtacagaaaggagagtgctgaaaaccaaggcactgtanggctgctgcctcaggaagtccagtttacagtgagttactgggaaacgctcggctattcga

SEQ ID NO: 25800 - DNA, 121 bp, Artificial Sequence
  Synthesized
  misc_feature (61): n=a or c
gacctggtgaccttaacctttgcattggtcaccctctttggcttgttaaccaagtatcacnatttcttgaagaattacctatacgtaagctaactgtactgttttccattttattctagta

SEQ ID NO: 25801 - DNA, 121 bp, Artificial Sequence
  Synthesized
  misc_feature (61): n=a or g
aataaataaatattaccatcagccaagcaacagaaatagaacaaacctggtatagatacangctgtcagcaccaatgtgaaactagactgttttcttgtataagtactgtgtaagagaaca

SEQ ID NO: 25802 - DNA, 121 bp, Artificial Sequence
  Synthesized
  misc_feature (61): n=t or c
taggaagattcataaaactaccccacatatgtgaaacctaaagtgcatgaccatcagatanttgtgtatctttgtcacccacaaatatgggagagattcccacaaaacacaatcatacttt

SEQ ID NO: 25803 - DNA, 121 bp, Artificial Sequence
  Synthesized
  misc_feature (61): n=a or g
tgacaggctggtatcattcttcttcacaacctctctcatcagcaaattttgaactctctgnttcttaaaatgtcctgtctattttgcaggtttaaaaggctgaccccatcctggttgtaag

SEQ ID NO: 25804 - DNA, 121 bp, Artificial Sequence
  Synthesized
  misc_feature (61): n=t or c
gacattgctcctggacaggcagcagcctccccacaagtgactgcatggcacaaccggagcncacggtgtggtttgcagtattttgggtcaggacatgaagcagagatgctccaggcttggc

SEQ ID NO: 25805 - DNA, 121 bp, Artificial Sequence
  Synthesized
  misc_feature (61): n=a or g
ttcaggtctgtaggatgtgctgtttaaaaaggtttccttgtctgagccacagaagaactcnggcatggaatagatgaggcgatgtagatgggggatgatggaatagatggggggctctgtg

SEQ ID NO: 25806 - DNA, 121 bp, Artificial Sequence
  Synthesized
  misc_feature (61): n=a or g
ttggcctacaccgtgtgagccagctatctccataacacacccatgtgcactgcaggaggcnaacctctctgctgctcgggtattttcaactcctaaagggcatagtccctaaagggagttc

SEQ ID NO: 25807 - DNA, 121 bp, Artificial Sequence
  Synthesized
  misc_feature (61): n=t or c
tgccccttcgtgtggtctggtgtgtaactaaaaggactcagtgcagtgctgagtgatattnaaggaaagtaaccgctgtttaaatgagtggccagggtttctttttgaaaagaacatttcc

SEQ ID NO: 25808 - DNA, 121 bp, Artificial Sequence
  Synthesized
  misc_feature (61): n=a or g
tgttggatgtcagtttgatgcagtggttttagaaaaaagcaaactagttcccaggctaaancagggcctcaacaatagggaaagtaaaccttttcagtgtagctttctctaagtaaacata

SEQ ID NO: 25809 - DNA, 121 bp, Artificial Sequence
  Synthesized
  misc_feature (61): n=a or t
aaaagggcacgcatgttgtacagactggcaacttaaccttagccagcacctcatttgcacnggcctttgactgttggatattgtcactactgccaagtgctgaagacgactgagaaatggt

SEQ ID NO: 25810 - DNA, 121 bp, Artificial Sequence
  Synthesized
  misc_feature (61): n=t or c
ggaaaccaagcagcaagggcagtctgttacagttttttggatttggattgccctttctganaagcttttggattcttggatccaccaaccaggactcagaatatctgaagataactgcctt

SEQ ID NO: 25811 - DNA, 121 bp, Artificial Sequence
  Synthesized
  misc_feature (61): n=a or g
ttatctttgtgaattgttaaagcaaagtaatgaatgaatacttaccacttacataaaattnataaaatatgtattctgcagtgaatggcagctttttcattctctatagtgcactcaggat

SEQ ID NO: 25812 - DNA, 121 bp, Artificial Sequence
  Synthesized
  misc_feature (61): n=t or c
gttgtatgtgtccaagaacacattctgccttccaaagaagtacagagagggtacagagtcntcatgcacttgtgcttacaaaacaaattcacagtgaagattaataattatattcacttat

SEQ ID NO: 25813 - DNA, 121 bp, Artificial Sequence
  Synthesized
  misc_feature (61): n=t or c
tttgtactgcaagctgcacgcttccttttcctccttgttttaattctgttcatagttctcnttcctctgatgctttggtttcctgcctcagaagctttctgaaaccttgccctccctatca

SEQ ID NO: 25814 - DNA, 121 bp, Artificial Sequence
  Synthesized
  misc_feature (61): n=a or g
aaacaaaacaaaacaaaaaacaaaacagaaacattaaaagacttttaagaaatctaagcantcacttttcctcagggacttgctcaaactagcattgcaggtcacaaaaagaggaatgaac

SEQ ID NO: 25815 - DNA, 121 bp, Artificial Sequence
  Synthesized
  misc_feature (61): n=a or g
acacagttcttaggatgcaggaatacagcacatctggctgttctcttttcagccaccatcngatgcagcacagttacccaagtacgttgaggtgtatgtagttctggacaaggctctggta

SEQ ID NO: 25816 - DNA, 121 bp, Artificial Sequence
  Synthesized
  misc_feature (61): n=a or g
gggaaagaaaagtaatcagcattttcccacattagaacttgtcttgctaaacatggaaacntgaaaagagaatgtagaaaattgatgactttcagttgattttggagttataacaagatct

SEQ ID NO: 25817 - DNA, 121 bp, Artificial Sequence
  Synthesized
  misc_feature (61): n=t or c
ttctgaacttcactgactatttatacctcagttgaattgatttaatttaagaaatagctgnttgggtaattatttcactatttttgttagcacatgatggatttgcattgccactttgttc

SEQ ID NO: 25818 - DNA, 121 bp, Artificial Sequence
  Synthesized
  misc_feature (61): n=a or g
tttgatatttttttaaataaagtgaaagtggtaggttcaaggaattccatatttgagaacnagggcaatagaagtgataaaactgctacctggatggtctaaaatcagcaacgatttctgt

SEQ ID NO: 25819 - DNA, 121 bp, Artificial Sequence
  Synthesized
  misc_feature (61): n=t or c
tttgtacaattcgcattgccttcaagtgtctcaccgtatcagatcataactcaggattttntgatatctcttgcttcattttcttaagtatctcttgatgtttcaatcagtgcacagctgc

SEQ ID NO: 25820 - DNA, 121 bp, Artificial Sequence
  Synthesized
  misc_feature (61): n=t or c
gctctaagctgaagttttctcaaaacagcactgctggtgtttttgtcacatattggtttgntgctcctgctgaagtgcttgggatgctgtttgcagctctgggcagagaccagtgccgggc

SEQ ID NO: 25821 - DNA, 121 bp, Artificial Sequence
  Synthesized
  misc_feature (61): n=a or c
taagccagtaagcaagaaggcccacaaaaagacagggctaaacatagcaggacagaaaaanatgagaatgaaaagaaattactgtctacaagagtaagttccattagtaataattaaggct

SEQ ID NO: 25822 - DNA, 121 bp, Artificial Sequence
  Synthesized
  misc_feature (61): n=a or g
ggaaagtaatacaaattttaaaagaacgaaaagtatgaataaggttaaattaagttgaatnggttttgagtgtttgtgaatacaaaagtaatagattttcacatgggtttcaaagatgttg

SEQ ID NO: 25823 - DNA, 121 bp, Artificial Sequence
  Synthesized
  misc_feature (61): n=a or c
tgctaccctgatgcaccccacggcattgcaatcctattactgacccacttccctcccaccncccaagtttggttctacttcggcgtggttggctccttcctcttcatcctcatccagctca

SEQ ID NO: 25824 - DNA, 121 bp, Artificial Sequence
  Synthesized
  misc_feature (61): n=t or c
cgctctctgggtctctttttcgctctgacaacatgtcaatctaccttctaacagttcttgngttaaaataatctctcttaatctgaagtttttctccattgttttatatcgtgaaataaag

SEQ ID NO: 25825 - DNA, 121 bp, Artificial Sequence
  Synthesized
  misc_feature (61): n=t or c
gttcacatttttattagaaacctgaactgctcagcagaggctcctggagctttgggtctcnggtgtacccacgctgatgagctcagcaatgagcctgatgctggaattaccttcaacttta

SEQ ID NO: 25826 - DNA, 121 bp, Artificial Sequence
  Synthesized
  misc_feature (61): n=t or c
ttactggtgagaagaggaggacaacagtttgcacttgggccaatgctttcttctttgtccngtagtttttccaaatgacaagtcctacttaaagcagtgaaattcaccagactaagcgagc

SEQ ID NO: 25827 - DNA, 121 bp, Artificial Sequence
  Synthesized
  misc_feature (61): n=t or c
atacaagtaaaatccctgaggcagaacaaagccttattgaaagtagacacgaacctgtccngttataatttgggagagttttgaattggttttaacggaccgtcagaaatagacctccaga

SEQ ID NO: 25828 - DNA, 121 bp, Artificial Sequence
  Synthesized
  misc_feature (61): n=c or g
cagatttcaactagaagataaaaggtgctcaggcattgttagttaaaggatttcttaggtngcaagtaaccataaagttctccaaaatattaatgtatttctcattccatcaacttggagg

SEQ ID NO: 25829 - DNA, 121 bp, Artificial Sequence
  Synthesized
  misc_feature (61): n=t or c
tcagatggagatgagggtcacacaagctttacagctttacatacctttgcaaataatctgngttattctgttgtcaacatactgtggcatcttttggctttactacttgaccttctcagct

SEQ ID NO: 25830 - DNA, 121 bp, Artificial Sequence
  Synthesized
  misc_feature (61): n=a or g
tgttgccatttatttcattttgaagaaaataagcaaataggtatagcgcagtctatgaggncccccgtgctctagaaatttttggaaatattcaaaactgaatgggacacactcatgaata

SEQ ID NO: 25831 - DNA, 121 bp, Artificial Sequence
  Synthesized
  misc_feature (61): n=a or g
ttgccaaccactggatcaagaactagatcaggatagagatgataccctcagactgttcggnatgggccttgtgaccaccagtggttgcagtttaacagctgaatccagaacgtaggaactg

SEQ ID NO: 25832 - DNA, 121 bp, Artificial Sequence
  Synthesized
  misc_feature (61): n=c or g
cgtggtgcttccaggtctgagtgacattcaccaacctgaaccccagaaagctgatcgaaancaatgcaagcacgtgctctgtgcactcttggaaggggaaaaaaaataccacatacacttc

SEQ ID NO: 25833 - DNA, 121 bp, Artificial Sequence
  Synthesized
  misc_feature (61): n=a or g
aactatttcacatagtatatagagcacgctgctattttaaatgtgcagatgctctcttgcncaaactaggtaactttcatttgttagagaactcatgcagacagtatgtattttaacatgg

SEQ ID NO: 25834 - DNA, 121 bp, Artificial Sequence
  Synthesized
  misc_feature (61): n=a or g
gctctcggatctgctgtacttctttgcaacgatccgctggaaggaaaaaagtaaagcaagnaagttagaagtagctgactgtgccctgtgagccacaaatggacagcagggacatggcaaa

SEQ ID NO: 25835 - DNA, 121 bp, Artificial Sequence
  Synthesized
  misc_feature (61): n=t or c
agaatgattgcaaatgcagaaaagttagaagggcagagtaacatattgtataaaatgctgntgagattgagtaattctgaatcctcgtccttttgtttgatgcatatccttgtagaatgta

SEQ ID NO: 25836 - DNA, 121 bp, Artificial Sequence
  Synthesized
  misc_feature (61): n=a or g
ttatgtcagcatgggcacatttcagtacttcatcagaagaagtgctcaggagcatttagcnatgagcaatttgtgacttgtcgttcactcagtattattagcaaacagcatgatgtttatc

SEQ ID NO: 25837 - DNA, 121 bp, Artificial Sequence
  Synthesized
  misc_feature (61): n=a or g
gatagactataatgtgaagctctggtatcacaagatcaaaatgtctggatatattgttttntctactatcttcttacagggaggacgtgtatattagtaacagcaaatgcttccagtgcca

SEQ ID NO: 25838 - DNA, 121 bp, Artificial Sequence
  Synthesized
  misc_feature (61): n=t or c
catattttggtcccaaagagtgttagctgacaggccaaacatggagttcagcctttcaganaaagaacacgttctaggtgttttcacaagaactgcaagctactgaatgacagccttccgg

SEQ ID NO: 25839 - DNA, 121 bp, Artificial Sequence
  Synthesized
  misc_feature (61): n=a or g
atgaatgctttcattgctccttcacataggatatggctagagtgatcctccatcacccctnaagagctacacagatggcaagattctgcaagaaagtactttattacctatgttcttcaca

SEQ ID NO: 25840 - DNA, 121 bp, Artificial Sequence
  Synthesized
  misc_feature (61): n=a or g
ctgtgggcacaacccatagacatccctttcaaagcactaacttccagtgatactcacatcnggtttggcacttggctatctggatatttctgcatggtagaaaataataattggatgaaaa

SEQ ID NO: 25841 - DNA, 121 bp, Artificial Sequence
  Synthesized
  misc_feature (61): n=t or c
gtcccatcagtttacaaagggagtagctctgcggagctctatctaatgatacccctggccngaacccttccaagacaagctggtgttcctgatgttgtgcaaatgcaggaaactaatgaaa

SEQ ID NO: 25842 - DNA, 121 bp, Artificial Sequence
  Synthesized
  misc_feature (61): n=t or c
ttctatgacgcacagtggaagaacctgccctgcaccgctgagcccagagggactcttcccnatccttccaccttaccataggtaggacaagctttatttcttctgagttgatccctggaga

SEQ ID NO: 25843 - DNA, 121 bp, Artificial Sequence
  Synthesized
  misc_feature (61): n=a or t
ttgccatgctaacgttatgaatggtgaccttaatcttgtaccagactcctccatggacganagcatggtgtcatatttgaggccagattactgatgtaatggtggcagtgtcaagtaggaa

SEQ ID NO: 25844 - DNA, 121 bp, Artificial Sequence
  Synthesized
  misc_feature (61): n=a or g
cttcaagaccttaattttttttggacctggatgttgtgccatcgccacacatttcaaagtnccctctgcacaaggaagctgtgggtggtattctattagaatgaatttaacagaatgtatc

SEQ ID NO: 25845 - DNA, 121 bp, Artificial Sequence
  Synthesized
  misc_feature (61): n=a or g
aatatttacagtgcagttcatatgaaagcagggcactaaaagattatctgacagaaatccngaaggtgcagtgaaagtgtgtgtgagtatggacattgagagcggctgaactgtgcttccc

SEQ ID NO: 25846 - DNA, 121 bp, Artificial Sequence
  Synthesized
  misc_feature (61): n=a or t
ttttggcatatctaaaatggtttctctgaatatgtgcaactcagatccgttctgatcctangccactataaatactgattatttcatgtcctgcacagcatatgttgggcaaccaagttca

SEQ ID NO: 25847 - DNA, 121 bp, Artificial Sequence
  Synthesized
  misc_feature (61): n=t or c
ggcattagctaggataaaaggacacccagtttatgtagttggctttgtgtgcaagcatccntattgtatctaattaggacaagctggttattttctcctgcagtgctgcatgcagtattgt

SEQ ID NO: 25848 - DNA, 121 bp, Artificial Sequence
  Synthesized
  misc_feature (61): n=a or g
aaaaaatgcaaagccaaaggaatgagtaggaacattttgtacttttctagcaaagactctnaaggatcataattatcctttaatgtgtggtcacttacccccacaggtattgttgtgttga

SEQ ID NO: 25849 - DNA, 121 bp, Artificial Sequence
  Synthesized
  misc_feature (61): n=t or c
atgtatacatgaaagcaggacctagagcatctgtatgtaacatcatacatgtgaaggctgncggtgtatctgatacaactctggaacgcttggaggagggaagaggaggacaagtgcataa

SEQ ID NO: 25850 - DNA, 121 bp, Artificial Sequence
  Synthesized
  misc_feature (61): n=c or g
aggaaggggggaggttggcagcaattttcagctgctgtaagcttatttaaagtcctaattntcacagtacttctttatatccccaattaaactttaataaattgcttaattaacattttat

SEQ ID NO: 25851 - DNA, 121 bp, Artificial Sequence
  Synthesized
  misc_feature (61): n=t or c
tgtaagaagtaaggtactattcagtttgagaaaagaaatcagaatctgtcctcaaaagagntccagaacctctaaaccatttttaggatgtagcttcacagactatcactcagaagtacag

SEQ ID NO: 25852 - DNA, 121 bp, Artificial Sequence
  Synthesized
  misc_feature (61): n=a or g
agtgcttctgtggctgcaggagttaactcagggagcttattatggtgaagatcatgccaancatactcactttttaagactgctcagttactgaatgaatgtgatatgcgtttgcacaagc

SEQ ID NO: 25853 - DNA, 121 bp, Artificial Sequence
  Synthesized
  misc_feature (61): n=a or g
gtccttaggcctaatgacaggttgatgtagaatttattttcttggcagaaatagtgattcngatgtaaacttgtgtgtatcgtacagcaaatcttttgtttcttttcagttttcttcagtt

SEQ ID NO: 25854 - DNA, 121 bp, Artificial Sequence
  Synthesized
  misc_feature (61): n=a or g
atgttaaatgaaagaagggatttcagaatttaagtatacaacaattcttgtggtgttaatntgatgatgggtttgtataggctaggcacaagtatgtctgctataacacagtagtcacaga

SEQ ID NO: 25855 - DNA, 121 bp, Artificial Sequence
  Synthesized
  misc_feature (61): n=c or g
gcaagtttactccagactgagacaagtacattaattttaataacatagatactccagaatncttcttcgtcaatggtagcgcagccatgttgattcactctagaggaaaaggggggctctg

SEQ ID NO: 25856 - DNA, 121 bp, Artificial Sequence
  Synthesized
  misc_feature (61): n=a or g
aaaagtttatcttctctatcacaatgctttttacagactcggaacccacagcttctgcagncaaactcatttctctccctctatcctcaaggaaaagctgatttgatattttttaagagca

SEQ ID NO: 25857 - DNA, 121 bp, Artificial Sequence
  Synthesized
  misc_feature (61): n=a or g
agttctgccacagtctctcctgaagggctacgacattcaaaacttaactttttacttcagnagctacactgtgcaacaggatttggatgaaaatgtccatgctgaaattaaatggaaccat

SEQ ID NO: 25858 - DNA, 121 bp, Artificial Sequence
  Synthesized
  misc_feature (61): n=a or g
ccagagtgtatctacactgcctgtaatatgtattttccacaactcacagtggaattcattntcactgacttagtatcttaaagtttgatattaaatctgaactggtcactctgggctttcc

SEQ ID NO: 25859 - DNA, 121 bp, Artificial Sequence
  Synthesized
  misc_feature (61): n=a or g
aagctgatcacaaaaatgctgtcagtgaacaacatgagaccatgtgattaatttttccatntgagctgtttgattatgacagcctcttagtttcagatagcttccaatgtggactgaaaag

SEQ ID NO: 25860 - DNA, 121 bp, Artificial Sequence
  Synthesized
  misc_feature (61): n=t or c
gccatagtgtacaaatggtaagaatgatcatttattgtgtcttccctctggacttcccatncattcttactggactgtatgtaactgagaatgtgagggaagcctgtcacctgcatctcat

SEQ ID NO: 25861 - DNA, 121 bp, Artificial Sequence
  Synthesized
  misc_feature (61): n=a or g
agatttatgaaatcaacacataacctgcaaatccagcctgggttgctccattttttaacangtatgaatatgacacttgtcaaaatgtgcgcaggaacaaagcattaggaagcacatcctt

SEQ ID NO: 25862 - DNA, 121 bp, Artificial Sequence
  Synthesized
  misc_feature (61): n=a or g
atcataggtccaaagcctggctgctttctccaggtattcccaaatctggtcctctctccantacttgttaacagaagagtgattatattacttcttgataatcatagtgtgtataattctg

SEQ ID NO: 25863 - DNA, 121 bp, Artificial Sequence
  Synthesized
  misc_feature (61): n=t or c
tcattcagttgttggtgcctcctatttgaaaggaaaaggctaacgtaatgttaggtgatgntttaaactgtaggctctgcagggctgagctgtttgggctgcagaggagtctgcctgcatc

SEQ ID NO: 25864 - DNA, 121 bp, Artificial Sequence
  Synthesized
  misc_feature (61): n=a or t
atattcagtctgctatttcagaccagctggcaagctgtccaggctgcttgtatggcagaantgccttccagtgctcactcccttaagatccagtgcctctgcctcttttccctgttgcctc

SEQ ID NO: 25865 - DNA, 121 bp, Artificial Sequence
  Synthesized
  misc_feature (61): n=t or c
cacaaagagcaggaggttcttgctgagtttctccaaggctggtctcactgtagctgttttnctctcaaagagacagcagcatagtggtcttcaaaagaaatttcagacagcagatgacaag

SEQ ID NO: 25866 - DNA, 121 bp, Artificial Sequence
  Synthesized
  misc_feature (61): n=t or c
ctgattatacatagtgtaactagcatgacagtgtaaggcacctgcgaacattcatcttgtngcctccacgctggcagaatactcacaatccatacaaattgaataatttgtttcaatcaga

SEQ ID NO: 25867 - DNA, 121 bp, Artificial Sequence
  Synthesized
  misc_feature (61): n=t or c
gaaagtcaatagttctggtgacactgagcatttctatcgcaatacagaataccagctttgngtttttcactgtctgaaaactgaattgctaggatgtccttttgtttaaactggtgaaaac

SEQ ID NO: 25868 - DNA, 121 bp, Artificial Sequence
  Synthesized
  misc_feature (61): n=t or c
caagaatttgtagccatcatctgggaatccccattttcagctttcactgttaatgctgtangagcctcaaggtttgttttgaagttctctttgatactggccacgaataactgattgtcag

SEQ ID NO: 25869 - DNA, 121 bp, Artificial Sequence
  Synthesized
  misc_feature (61): n=t or c
gtgttttctcatgtataacttgaaagtgtttccctttctcacttttgccttaaaggtgtancacagcttccagaggagctgactgatgtagtaccaggtgttggccttgcttcgcagccag

SEQ ID NO: 25870 - DNA, 121 bp, Artificial Sequence
  Synthesized
  misc_feature (61): n=a or g
gagctagattacaggcaggacaactatgacaagatccagctactcttgcggcctcattccntatcaacagttttctgagctactgatttaagtaacgtaatggatttcactttctctccac

SEQ ID NO: 25871 - DNA, 121 bp, Artificial Sequence
  Synthesized
  misc_feature (61): n=a or g
tccttacttctctcttactcaggatatctcagcagcagtcagccctcgcaggaaaaatagnaagagggacagcagagctgcaaaacatatctggtcagagaggtcaaagcagtggcttccc

SEQ ID NO: 25872 - DNA, 121 bp, Artificial Sequence
  Synthesized
  misc_feature (61): n=a or c
tgtacgtcttcgaatatttatttttaacccaaacccaaatttaaacaaaatatttatctantctcttccaaacatctagaggatgttgctaaatttacatagcccctaatataaattaaca

SEQ ID NO: 25873 - DNA, 121 bp, Artificial Sequence
  Synthesized
  misc_feature (61): n=t or g
tttaattagaagactaacgagaggatgtaccctatgggtctaactgcaatagaaggaggcntcagccagcagcattcacaggaggcctgaagctgtgaagctgaaagttccctcatctcct

SEQ ID NO: 25874 - DNA, 121 bp, Artificial Sequence
  Synthesized
  misc_feature (61): n=t or c
ccaagcactcttcatttatgagttttaaagctccagaagtttggctagtcatacctaccangatgtagatatcttctaaaacatgctcagctgtgtgaccctgtgttcttcaagcacgtca

SEQ ID NO: 25875 - DNA, 121 bp, Artificial Sequence
  Synthesized
  misc_feature (61): n=t or c
gggtgataatccatcaagccaggctgggcactttggccagaccccacaaaacacactgctnttttcagtttctgcatcagctcatttctcccttgagcctgttgctgtctgcaaacaaact

SEQ ID NO: 25876 - DNA, 121 bp, Artificial Sequence
  Synthesized
  misc_feature (61): n=t or c
ggccaggtctggctttgttttgctttttgtggctatgaattgtacactcatcttccccganaatttcaaccagacagaagtgctctgttaagaggtttggagcctttcccgatcagcaagc

SEQ ID NO: 25877 - DNA, 121 bp, Artificial Sequence
  Synthesized
  misc_feature (61): n=t or c
tgcacatgatttgttttgaatgcatagatcaaagccacggtgtaagacaacctctagaacngaagtccatttatgatccaaacacatgtagctgatttgaaagtaacaatgcacagacaag

SEQ ID NO: 25878 - DNA, 121 bp, Artificial Sequence
  Synthesized
  misc_feature (61): n=t or c
ctggaatactaatttgcaagaaaaatggacttgagaaagagaaaactactcaggagcgtantgaattcagtaaatagtctccactgaagagcttgataaaataggagaaatattaatattt

SEQ ID NO: 25879 - DNA, 121 bp, Artificial Sequence
  Synthesized
  misc_feature (61): n=a or g
cagcgtgatgcagatagagttgttggacaatcttcctttcagctgtggggtagcaagagtnggcttgccctggaatatcactgaatatcacctgaagtggttcctttacccatctgtctgc

SEQ ID NO: 25880 - DNA, 121 bp, Artificial Sequence
  Synthesized
  misc_feature (61): n=t or c
aagtgattacctctttatccttccttctgtaagggcaagtaattccttcatcatcagattntgagatcagtgtcaatataatcttagataatgattttggagaaagcagtcaaattatgga

SEQ ID NO: 25881 - DNA, 121 bp, Artificial Sequence
  Synthesized
  misc_feature (61): n=a or g
aaggtgtttttgtacccattccaaactgaatgttaggatttctcaaacttcctcagaactnggaacccagagcacttttcaggggtgattcatctttggatttttgcagatttctgtgtca

SEQ ID NO: 25882 - DNA, 121 bp, Artificial Sequence
  Synthesized
  misc_feature (61): n=a or g
gctgaccctttgcacagcccttgctctcccagccacaacgctgtacacaacgtgcaagcantattcatctgcattacctctcgggggtggggttctggtcataggcatcactgtagtgcta

SEQ ID NO: 25883 - DNA, 121 bp, Artificial Sequence
  Synthesized
  misc_feature (61): n=t or g
aacaagctgtgatgagcccaggatatttaaggcttctctcccaaaccaatcctttcatcanagtaaatgcaagattctgctgtgacagaagcagccctgaggggcatggttagcgggcatg

SEQ ID NO: 25884 - DNA, 121 bp, Artificial Sequence
  Synthesized
  misc_feature (61): n=t or g
tgctttccagttttctccttccccctttctccgcagtcctttcccaggaggctttttgaanagtaaacctgctctgtgccttttgcttttccttccaggggagttggtctgaagctgccag

SEQ ID NO: 25885 - DNA, 121 bp, Artificial Sequence
  Synthesized
  misc_feature (61): n=a or g
taaacactgatgcacctctttcttgttacaactgccccaaaatatcttgcactccatgacntggtggagaggaggcacagttcacacaactaagagaactccaaccaagcctctttctata

SEQ ID NO: 25886 - DNA, 121 bp, Artificial Sequence
  Synthesized
  misc_feature (61): n=a or g
ctccaaaaatacagagccaaatttagtcatctgcatgattatcacgtgtattatgtgcaantggatgactcatcattgcagtgctcagctgggcatcccttgcaaggtccctcaagaacgt

SEQ ID NO: 25887 - DNA, 121 bp, Artificial Sequence
  Synthesized
  misc_feature (61): n=a or c
ctcatctctttggatcacccacagttggtgaagtgatgggtgagttgaccaaagcttgtgnaataatttgccacggtaagttctgctaaaaaaaatagcacttgtatcaagttaaataacg

SEQ ID NO: 25888 - DNA, 121 bp, Artificial Sequence
  Synthesized
  misc_feature (61): n=t or c
tgagggcacagatatcacccgttggcacagaggtgtcacccacaaataccacctgtggggngtggaggtcacccatagggtgtggagatgtcacgtggatgcagagatgttacgttaccca

SEQ ID NO: 25889 - DNA, 121 bp, Artificial Sequence
  Synthesized
  misc_feature (61): n=t or c
tctttgtcttccactacaattcttacttttatagcttgtatacatactcctatataataancagtagcagaattcatgagtaaaagaagtgctaatagatccctctgcttttagtatgcag

SEQ ID NO: 25890 - DNA, 121 bp, Artificial Sequence
  Synthesized
  misc_feature (61): n=a or t
gtgattagagaaactgcataaataattctccagctttagaatacaagaacactttgtgagnaaaggtatatagcatagctagtgtgcagcaaaggctacaaagtaccatttgccactgagg

SEQ ID NO: 25891 - DNA, 121 bp, Artificial Sequence
  Synthesized
  misc_feature (61): n=a or t
cttccacactgactctcaggccctcttccccaccatcattcaactttcttgaaaaacaatnggcacattttgctttttccaataccttcagcagcttggagaatgcccttcatgaactgtc

SEQ ID NO: 25892 - DNA, 121 bp, Artificial Sequence
  Synthesized
  misc_feature (61): n=a or g
gccaccactcagaggcttaataagctcaattgtctcaacaggacgaccctgttcagcagangaacgaaaagggtacagacattaaaaatgtcaaacagcagacttaatgaatgtggtaaac

SEQ ID NO: 25893 - DNA, 121 bp, Artificial Sequence
  Synthesized
  misc_feature (61): n=a or g
tagagtactgaaaagccattttactttaagatgctaaatacttctgtcaaacacccattcngattgtatgcttttaatagaaatgcaaattaacatttgattagtcaaaaaaaaaatcaat

SEQ ID NO: 25894 - DNA, 121 bp, Artificial Sequence
  Synthesized
  misc_feature (61): n=c or g
ggaaataaccataaaaagaaggaaacaaaacaaaaccaccaccctgtatttgtaaacactnaagcactgcagacagatgtttcagagtacctacagaatactaagttgcagatcatatttc

SEQ ID NO: 25895 - DNA, 121 bp, Artificial Sequence
  Synthesized
  misc_feature (61): n=a or g
aaaattaggaaaattttgaaaaaatgtattgtaggcttcttgcagaaacaggatagatttngcctacaggttgaaagatgaaaataataaaactgtgagtacacaggaacagtagctatga

SEQ ID NO: 25896 - DNA, 121 bp, Artificial Sequence
  Synthesized
  misc_feature (61): n=a or g
gattcacacaaatacaactctatctccgtccatatgttctgtgtgaaattgcaggtagccntcagattgtaggacagggacataaggctcagtgagctataggaaagggtactgcatcccg

SEQ ID NO: 25897 - DNA, 121 bp, Artificial Sequence
  Synthesized
  misc_feature (61): n=t or c
atcgtgggtgaaggagttataaacaaaggtggagtgcctttcactctgtgacagtccctangatcctggttcatgagcaaattagactttaaactcacctaacatttttgcagatactgtg

SEQ ID NO: 25898 - DNA, 121 bp, Artificial Sequence
  Synthesized
  misc_feature (61): n=a or c
acaagaacaaccatttaataattcacagtgaatgacacaggaggcacatctccgggtcagnagatcttgtcctagatcattcaaaacaaaaatctcccaaggtaatatcattaaagcaaag

SEQ ID NO: 25899 - DNA, 121 bp, Artificial Sequence
  Synthesized
  misc_feature (61): n=t or c
tattactttaatgcccatttaaccggtcaaactagtttcagtcaaacttgagacagtcctnagaacataagttgcagtatacttagaagaaatagatacattaattttcaaatcttggaac

SEQ ID NO: 25900 - DNA, 121 bp, Artificial Sequence
  Synthesized
  misc_feature (61): n=a or c
acaaatcaagaaaaactgaaaatctgttagagtaaaaataagcataggccatggtcactgncagtctcaagcaaatcagaagcatttatgagcaggtcatacatcagcttttccctaagtc

SEQ ID NO: 25901 - DNA, 121 bp, Artificial Sequence
  Synthesized
  misc_feature (61): n=t or c
tacacacacactggaaagtagccatataaaagtctgggctttggtcaatgagctgcagtcnagttctaaagtattactgtggatgcctgcttttcctttcccacaggaactaagggggcct

SEQ ID NO: 25902 - DNA, 121 bp, Artificial Sequence
  Synthesized
  misc_feature (61): n=a or g
ctggccgagggttatccatgctggggggctgcagagcagagatggagcagaaatctcaccnttgctcttgttatacacaacaccttcgtgtcctggggtgggtggattggatgcaaacagg

SEQ ID NO: 25903 - DNA, 121 bp, Artificial Sequence
  Synthesized
  misc_feature (61): n=a or c
atttattatgatttacctttgcctgaccttaatcttgcacagtatgcagaaaggagcaaangcacaagaccatctattacagctaagaacaggtgctatgtataatctctattacaagggt

SEQ ID NO: 25904 - DNA, 121 bp, Artificial Sequence
  Synthesized
  misc_feature (61): n=a or g
caaaaaaaagaggccaaatgtttccttgaattcttatccacccatgcccacaagatgcacngtcatcagaacaggactagctattccagataccattgattcatctatttcctgagcatcc

SEQ ID NO: 25905 - DNA, 121 bp, Artificial Sequence
  Synthesized
  misc_feature (61): n=t or c
ggctgtgtgttctctcatgggaatctctcctgccctgtcaccatgctgcttgttcttctgntcctgcccttgccagacttttattcctgctccttccagcactgggaggcatcagctgcca

SEQ ID NO: 25906 - DNA, 121 bp, Artificial Sequence
  Synthesized
  misc_feature (61): n=a or g
tgatgactgctttgaggctcatgaaaagggaaatgttctttccagataagtaatcccatcntacagcacaaacagcatcccccaaacagactccccggcagcatgctcgtttctgttggct

SEQ ID NO: 25907 - DNA, 121 bp, Artificial Sequence
  Synthesized
  misc_feature (61): n=t or c
ttcagacctatgggagaatatgtctttctgggaactactgtaataaatggcctttgactgntacatagaggaaaattgaccagtgttgatgcctacacacaggactggaggtttaactacc

SEQ ID NO: 25908 - DNA, 121 bp, Artificial Sequence
  Synthesized
  misc_feature (61): n=a or g
tctttccttcaaattagagtggtccaaaccacactactagagcaattggaagagctcctgnaatcggaagtctcccagaatgctgcagacgctcatctgctctgcattaaggtgccagctc

SEQ ID NO: 25909 - DNA, 121 bp, Artificial Sequence
  Synthesized
  misc_feature (61): n=t or c
tgcttgaggctggaagtgccattcccttccaggttctgcttttggggtcctggtcagacangtgcaaggacagaagagcaagggacctctgctgcccatcagaagggctgagctgctcagc

SEQ ID NO: 25910 - DNA, 121 bp, Artificial Sequence
  Synthesized
  misc_feature (61): n=t or c
ctatttggaggtaccccaaaagtgtcctgctgtttaaataaagcaagtatacatcattcanattttatgtatatgattggttttcctttgcacttgtaaaaatcattgcatatactgtgtg

SEQ ID NO: 25911 - DNA, 121 bp, Artificial Sequence
  Synthesized
  misc_feature (61): n=a or g
aacagtcttactggttttactgagcccataaacaaaaaaatcaaagttacttctgtcttgntgtgcaataaaaactggaagttatttacaagttaaaaatagccattttaactacgctgcc

SEQ ID NO: 25912 - DNA, 121 bp, Artificial Sequence
  Synthesized
  misc_feature (61): n=a or t
tgactgagtagcagtcagagttgtatgtattggagaggaatacaagtgtttaaggagcaantctgaaggtatttatggattgtttaattgtcattttaatttaggaatatatacttgcata

SEQ ID NO: 25913 - DNA, 121 bp, Artificial Sequence
  Synthesized
  misc_feature (61): n=t or g
tcaaaatacagtgtatgtattgcatattattctttatcagctcatgtgtgcataagaattnagctgttatacacacattatcaatgcagactcttaatttgcactttgagcagagttgtgg

SEQ ID NO: 25914 - DNA, 121 bp, Artificial Sequence
  Synthesized
  misc_feature (61): n=a or g
taggaaggtgtcagcttgtcaccctccctgagatgacagttttcactgtgttgctgagacnaagaccccttgaagaaatcttcctccaattttgtaaaatctgtgtgcatgaaaatagaat

SEQ ID NO: 25915 - DNA, 121 bp, Artificial Sequence
  Synthesized
  misc_feature (61): n=a or g
tttcattggagatatttagtgaaaagggataatcgagcagctgctctctagtgctgaagcncagtaactgcaggtttactgctcgctgcattgcattatatgtcagtaaaacttcctgttc

SEQ ID NO: 25916 - DNA, 121 bp, Artificial Sequence
  Synthesized
  misc_feature (61): n=t or c
atttccagcaaggacaaatcttccactgcctttggttgttctaattgttgattactctcanagttaaaaagtcaaggtcgcaaattatttctggtgtgagtcagagcaacccagtgtttaa

SEQ ID NO: 25917 - DNA, 121 bp, Artificial Sequence
  Synthesized
  misc_feature (61): n=t or g
atgtgtaagtcacacataggcaacaagatagtgctgtttatcttctctctcactttgaggntttctaaaactgttcaaactttctaaaactgttcaaacattttatggcataaactgtaat

SEQ ID NO: 25918 - DNA, 121 bp, Artificial Sequence
  Synthesized
  misc_feature (61): n=a or g
tgtggctttggaatatctccaaggagggaaggtccacaatctatcttagaaaactgttccntagctcagagacctacacagtgaataagtgcttcctgacagaaaaacttgtgttcctctg

SEQ ID NO: 25919 - DNA, 121 bp, Artificial Sequence
  Synthesized
  misc_feature (61): n=t or c
tactacaatgagacaaacttgggttggaagggaaaaaaattattttcagtgctcagcttcngataatgtaggaacatcttttcgttctctttaggctgaaccctagagaaagggtttccaa

SEQ ID NO: 25920 - DNA, 121 bp, Artificial Sequence
  Synthesized
  misc_feature (61): n=a or g
gatgtgctttgatcttagctggctttttgccactggtattcttagaaggaagctggagagnaggaattttggtgaagctctttccttacggatagtgcaaagatgtactaactgtactcca

SEQ ID NO: 25921 - DNA, 121 bp, Artificial Sequence
  Synthesized
  misc_feature (61): n=t or c
tttgaggttattaagatgggcaactgacaaccaattcattcagtttatccatatatcaatntgattctgacatatgcaagtgtcataaataacttgaggtttggaagagcatcgctgtgaa

SEQ ID NO: 25922 - DNA, 121 bp, Artificial Sequence
  Synthesized
  misc_feature (61): n=t or c
ccaggcactgccatgctcatcctcagaatagggcatacagggagtcacggcctccagacancagaatttggcacaatcccccgtatcccaccccaagcaagcagctccatcccaggtgccc

SEQ ID NO: 25923 - DNA, 121 bp, Artificial Sequence
  Synthesized
  misc_feature (61): n=t or c
tatgctacagcttcagtgatgttttaaaatgagctagtgtaaacctttcaaaaagttccangagccaagtatattgccttagaacaaaaagaaaagcagtgtctgcctctggcagatgaaa

SEQ ID NO: 25924 - DNA, 121 bp, Artificial Sequence
  Synthesized
  misc_feature (61): n=c or g
aactggacagatgagaacacctggctgctctcagaactagcactctgcccacagacactcngtctccatttaaaggagtagcaggaggctattatgaaatagctttcaatggcactaaatg

SEQ ID NO: 25925 - DNA, 121 bp, Artificial Sequence
  Synthesized
  misc_feature (61): n=a or t
ttgaatttcgcttttattttttccctaaagccagtagcacaaaataacatcaaaagtaaantttccagtgttaaatttgtatacgttcaaaaatctgaatgtaagctccttagttcaatca

SEQ ID NO: 25926 - DNA, 121 bp, Artificial Sequence
  Synthesized
  misc_feature (61): n=a or g
ggaagacttttggctactgtcctctttgaattggagggacaatttggataacttaaagaangaaaaacataatttgaagaatgacacatgatgaaaaatgaatgaattagttttaggagtg

SEQ ID NO: 25927 - DNA, 121 bp, Artificial Sequence
  Synthesized
  misc_feature (61): n=t or c
tgctggctgcctttgctacctcctctcgtcttcctaagggatttgttggggagctccctcncatcaggatcccccccttggtgagcacgtaaaaccaggtgccttttgttagctccaaagg

SEQ ID NO: 25928 - DNA, 121 bp, Artificial Sequence
  Synthesized
  misc_feature (61): n=a or g
ccaccctcagacagcaggttgctcagctgttcattccccttgtagaaataaacacagaganacttttcctcttccatctaagcactgagagatctggtcagaaagacagcttttattctgg

SEQ ID NO: 25929 - DNA, 121 bp, Artificial Sequence
  Synthesized
  misc_feature (61): n=t or c
gagacctgtttgctgcacgtccttatagccaagtgctggcatgttgtccctcagctctcangtgtttgcatatagcccaaagcagactgaaataaagtaattgcaaaagcagttagcagat

SEQ ID NO: 25930 - DNA, 121 bp, Artificial Sequence
  Synthesized
  misc_feature (61): n=t or c
agagataccttttgatgagttcattttgttcttcataagaactcaataaccacaccttttntgctcctgtgcactctcatgtcatattccttcatcttcaggtaagtaacaggtttagttc

SEQ ID NO: 25931 - DNA, 121 bp, Artificial Sequence
  Synthesized
  misc_feature (61): n=t or c
taccctaaaggctgtatacttcatgaataatgcagagatgacatatttttccttgtgatangtgttacatattttatactctccataggaagctaggttttggtaattgttttatgattta

SEQ ID NO: 25932 - DNA, 121 bp, Artificial Sequence
  Synthesized
  misc_feature (61): n=c or g
acaatgttacttgggcaatataagcaaagtactaaagaaaaagttgtcttctaactgtagnaaacactcttaactgcaggatgtgcccaccacttcttggtttgtgcaagtggttgacttc

SEQ ID NO: 25933 - DNA, 121 bp, Artificial Sequence
  Synthesized
  misc_feature (61): n=t or g
gcagcaaatccagctccagcactggtctgggttaacacaacgttaacccaggaggcggcancaggacttgtccatcaggtgctctcaggaaggcaccggcacactgcacgctgagctgtga

SEQ ID NO: 25934 - DNA, 121 bp, Artificial Sequence
  Synthesized
  misc_feature (61): n=t or c
tttcctagcagatggtggctgctggctgagaaggtgtctgatatccaatactgcagatctncccctactcaaagagcccaaccttttctttggaaaccacatgtacatgcaggttcatgca

SEQ ID NO: 25935 - DNA, 121 bp, Artificial Sequence
  Synthesized
  misc_feature (61): n=c or g
ctcagagaaccctgggaagaagagctattcactcagtgagacaatagtgacattgccaatnatcctcagtgatgataagcagccatgaacaattcccaacaccgcgggtggtgcacaactg

SEQ ID NO: 25936 - DNA, 121 bp, Artificial Sequence
  Synthesized
  misc_feature (61): n=t or g
tgtaaaaaacagcaaaataacagtgaaatatttctggcacttcagttatcgtcaagttcanttagtcaagcacacacagaaaaaggaggaaatcctcacaaatatactaagtaggtctgat

SEQ ID NO: 25937 - DNA, 121 bp, Artificial Sequence
  Synthesized
  misc_feature (61): n=t or g
tatatatgaaaaggagagaactatgattcagatatgttgaagcaacaaaggagggatgatngatttggcactgaagaagataaaagaattagacaaaatagagctacgacttctaaaataa

SEQ ID NO: 25938 - DNA, 121 bp, Artificial Sequence
  Synthesized
  misc_feature (61): n=a or g
gcatcaaagataccagttctgtaatgtcaggcctgcagttaaccacatctcatctctaggnaaaggatggttttcctcatctttcttgtttgtagccacagaagaacaactgctctgcttc

SEQ ID NO: 25939 - DNA, 121 bp, Artificial Sequence
  Synthesized
  misc_feature (61): n=c or g
atttaaatagaatatattgcatatagattataaattcggttctataaatagaatggtgtantttttggtttggatgttgctacaaacaatgttgtaaaatgttgtccagatttcagctgga

SEQ ID NO: 25940 - DNA, 121 bp, Artificial Sequence
  Synthesized
  misc_feature (61): n=t or g
tcaggtttccagggtttgggttcaacttcatttacttattgaactcaagccttttagcctncaacttcatttacttatagaacttaatccttttagccttcaacttcattaacttataaaa

SEQ ID NO: 25941 - DNA, 121 bp, Artificial Sequence
  Synthesized
  misc_feature (61): n=a or g
aggcaaacggcagaaggttttactgaaaaggctgctttatgggcttgtggttttgcttggngtagcgctgaggagtctgtaaaccccaggagcccggcagtgtgacaggctgacaggccgt

SEQ ID NO: 25942 - DNA, 121 bp, Artificial Sequence
  Synthesized
  misc_feature (61): n=a or g
tgattgatttttcagctgcgtattgcccagctcaaggtgcagctgttttgggacatcaacngcacagagagggactggagagtaggagagaagagggagaagtctgcctcatcctagaggt

SEQ ID NO: 25943 - DNA, 121 bp, Artificial Sequence
  Synthesized
  misc_feature (61): n=t or c
gttgttgcaagatctcataaacttgcttgaaaaggatgaaaagcttgaaaaggatgaaaangtcagagtaacggttgccttttgcttgcattctggctacaacttatttttggtagttctg

SEQ ID NO: 25944 - DNA, 121 bp, Artificial Sequence
  Synthesized
  misc_feature (61): n=a or g
tgaacttaccagccctccttttctttgattcaatctatcagaggtaggaaccatcatctanctcccattaggtcaatggaattggaggtagctcaagctgtgaggtcttgatatttgatat

SEQ ID NO: 25945 - DNA, 121 bp, Artificial Sequence
  Synthesized
  misc_feature (61): n=t or g
taacatacatggtaattggtatagcatacacacagagacagggaatattttacacaaatanctctgcccattttttttcttatggtaagcaacacctgccataaacacaagagcaactctg

SEQ ID NO: 25946 - DNA, 121 bp, Artificial Sequence
  Synthesized
  misc_feature (61): n=a or g
tcatgcctcatttttttggtaatacaaattgatggtggatgtcaaagaaaacagaccagtngttgaattgtaattccacaactaaagaatgaacaaaagtggatgagagtgaattacaaag

SEQ ID NO: 25947 - DNA, 121 bp, Artificial Sequence
  Synthesized
  misc_feature (61): n=t or c
cctcaatgaacttcgctagcaggggagcgtgctgtccctgcctcgatgcgagttcattgtncacaaccagtgttgctctgagagaaggcagaggcaaactggagcctggaagcaaaaacat

SEQ ID NO: 25948 - DNA, 121 bp, Artificial Sequence
  Synthesized
  misc_feature (61): n=t or c
atgtagtcactgtgcatcagtttggagacactctgggtcagtggcggaggttttagaaaantgagcatttaattggttcagccatcaaccctgatccacttatcttcatgtgttagcacat

SEQ ID NO: 25949 - DNA, 121 bp, Artificial Sequence
  Synthesized
  misc_feature (61): n=t or g
atacacttcaggttaacatcatgcaattagaaaagtcagaagacaagggaaagaagtgctncttctctaataagttaagaccaacttttattccattgcaaaaatgaattcttccattttc

SEQ ID NO: 25950 - DNA, 121 bp, Artificial Sequence
  Synthesized
  misc_feature (61): n=a or g
attaacaaatacatccaccttggctgaggatggacaaaagcctctgaagcagaatacctgnaaaactagacatggagacattgtagaacacttggacttagaacatgatggcattgaaagt

SEQ ID NO: 25951 - DNA, 121 bp, Artificial Sequence
  Synthesized
  misc_feature (61): n=c or g
acagtagttactgtggctgtgcaaccaaaaggcttacctcccattctgctgcatttgaganagcctcgcagagacgtatgggcgtcaaccttgaaggcaacaaaaaccaaccaaataaaac

SEQ ID NO: 25952 - DNA, 121 bp, Artificial Sequence
  Synthesized
  misc_feature (61): n=a or g
agattgtaattggtgacaacacaatcttgccaatccttggttcaaatgccatggaaaagtnccagttaaaggattttcaggtgtttcttagcagagatgataaaagtgactactcgagcgt

SEQ ID NO: 25953 - DNA, 121 bp, Artificial Sequence
  Synthesized
  misc_feature (61): n=t or c
ctgcatgatgagtggactttgcaaacacctcctattgattcaaacacgagagcatacagangtcatatgaatgttacgcagtgcattaaactcttgtggtttgatccattagtactactct

SEQ ID NO: 25954 - DNA, 121 bp, Artificial Sequence
  Synthesized
  misc_feature (61): n=t or c
ggagcagtagcaggtaggtttcccctcttgccactggattccttttatttctttaggctcnttgactttgttaacaggtgttaggtttgtgtccctctgaacatgagtgatgaaggctggg

SEQ ID NO: 25955 - DNA, 121 bp, Artificial Sequence
  Synthesized
  misc_feature (61): n=t or c
cgccatcacaaccatcagttcaggaaagcctgtgccatcaccgttggccaacatttccgtngccattggtatcagagtactcagcagaacagtgcacacgccttctccaacttggctaata

SEQ ID NO: 25956 - DNA, 121 bp, Artificial Sequence
  Synthesized
  misc_feature (61): n=t or c
ttatatttaaacattaatccacagaatttaagagcaattgtgctgtcaaataacaagaaanggagacagccttcagcaacaaagtctatataaaacaacagtgtcattatatgtatgtgca

SEQ ID NO: 25957 - DNA, 121 bp, Artificial Sequence
  Synthesized
  misc_feature (61): n=t or c
tcttcagtttattcagtacctcccttcatcaaactaccaaactatgtaacttaagatgcanatggactatgatgttgacacaagaaaaaatattttctaatcttataatcttcacacagag

SEQ ID NO: 25958 - DNA, 121 bp, Artificial Sequence
  Synthesized
  misc_feature (61): n=c or g
ggtgtttggttatgttttttatctgttaccaccccaacaaaacaggaacaaaaatctatangggttgtacaagagcgttgtggcaacaagggttcctgcagtctgtggatacaaaaataac

SEQ ID NO: 25959 - DNA, 121 bp, Artificial Sequence
  Synthesized
  misc_feature (61): n=t or c
gtccttgggcattaggtagcaaggggaatgaagtcagggaagagtcctgaatgcaatgcanactataaggatcgtttacacttacaacaaagaagatttgtatgcacaaggtacatatcag

SEQ ID NO: 25960 - DNA, 121 bp, Artificial Sequence
  Synthesized
  misc_feature (61): n=a or g
ctgtacgtacttccttcatattatgtttccctgtaagcaaacactgcagcttcccacagtnacattacatgatcatgtagaaggtgagagcatctatgtaattgcaaatgggatgagggcc

SEQ ID NO: 25961 - DNA, 121 bp, Artificial Sequence
  Synthesized
  misc_feature (61): n=t or c
attttggagggacttctctacactgaaagcatggccagcacctcttttgtgtatgagcctnagctggtggaattatacttacagtgtgatatttcttgctccgtagtagacatcccagtca

SEQ ID NO: 25962 - DNA, 121 bp, Artificial Sequence
  Synthesized
  misc_feature (61): n=t or c
cattaaaagttgtacagaagaactctaaaatatagtcataaaacagattcatgcagtcttntaagaagttatttatatatctgtgtgctaaacaggttttaaataaatatctgagtaccaa

SEQ ID NO: 25963 - DNA, 121 bp, Artificial Sequence
  Synthesized
  misc_feature (61): n=a or g
ctttgattcttgtcacattttcttgataattctttcctacttggatattccaatctcctangcatgatcaaaaccccatctttttaaaagtcctccctgtcagaaagctgtcttctgtttg

SEQ ID NO: 25964 - DNA, 121 bp, Artificial Sequence
  Synthesized
  misc_feature (61): n=t or c
atttaaaatacaggaaattactggagcataagaaactgcaaatcttaaatataaagtgcgngttttcagtccagtgggctgattgtggagactgggaaatgtatctgctaaaatactgaca

SEQ ID NO: 25965 - DNA, 121 bp, Artificial Sequence
  Synthesized
  misc_feature (61): n=a or c
gatagatggctacctgaaaataaaaagcaaacaacgtgcaaaattccaccatcttttcccnaaacacatgcagcctctgcatctgacttcatacgcgttctttgagatacggacattccca

SEQ ID NO: 25966 - DNA, 121 bp, Artificial Sequence
  Synthesized
  misc_feature (61): n=t or c
gacctttcttgctaaaaatcactgaccaaataaaacaaggctgtcattatttgattattanggagtcattttgttacccttggataccagaacaatgacctgaacagctagagaacatgga

SEQ ID NO: 25967 - DNA, 121 bp, Artificial Sequence
  Synthesized
  misc_feature (61): n=t or g
aagctctgcctatggccaggtcacagggatggggaatcctggctagataagtcacactttngtcaccccttcaggtcactgtcgaagaggacagctaccttgctcacccaacacgggacag

SEQ ID NO: 25968 - DNA, 121 bp, Artificial Sequence
  Synthesized
  misc_feature (61): n=t or c
acaaacacaaccagctgaagtccaataaaaatcttcttcagggcaaggatgcatttgcaangtacaaagcactcctgtttacagccgtgcaaacaattaggttttgcatttcttgggccag

SEQ ID NO: 25969 - DNA, 121 bp, Artificial Sequence
  Synthesized
  misc_feature (61): n=t or c
tgtgcctggatttgtatagatcaggagacagcatcttgagagctctatgtcaccacagccngtctgctcagaatggttgcaagggggtacgttaagataataaataaaaataaagggagcc

SEQ ID NO: 25970 - DNA, 121 bp, Artificial Sequence
  Synthesized
  misc_feature (61): n=t or c
tatgaaatggtgggagtgggggggaaggagtgttatcaggattcatgagaagatatgatangaaacgtgccttgcatcccaaattctcccatattaggtgcaaacatgctggtgatataaa

SEQ ID NO: 25971 - DNA, 121 bp, Artificial Sequence
  Synthesized
  misc_feature (61): n=a or g
aaatataacaccgtatggcactgaactgaataaggccctataatttacaggatgaattctntaaatattgagtgttatgaggctacaattccaacagataatcatagaatagaatcacaga

SEQ ID NO: 25972 - DNA, 121 bp, Artificial Sequence
  Synthesized
  misc_feature (61): n=t or c
tgtgttgaaaggaaggcagcctgatctgaagctgagtctggtgaatgtacagggataatgngaatccttgcaggtgagattcatccagcctgcgtccagacacccagactgcagttagttc

SEQ ID NO: 25973 - DNA, 121 bp, Artificial Sequence
  Synthesized
  misc_feature (61): n=t or c
tacattccacctggaagaatctcagtattacatgaaggtaattttagcttattttcctgtnctttgctctgaacagaaagaccgttcgtacaaaaaaaaaggctgttctgagaaagcacta

SEQ ID NO: 25974 - DNA, 121 bp, Artificial Sequence
  Synthesized
  misc_feature (61): n=a or t
gtgctttgtaacagacaaagaaaggtgtggatgttagctgtgggaatactccatcattatnatcatttccccagtgatgttataaatttaccttagttggaaactctttaatcaaggtgtg

SEQ ID NO: 25975 - DNA, 121 bp, Artificial Sequence
  Synthesized
  misc_feature (61): n=t or c
tgtttgtaattagagggcagaatggattgggaagcttacaggcatctcattcaatgagaangaggggatttgcatgtgctgcttgcgtaagtgctgcaggaactatgagcaaaaacgtctg

SEQ ID NO: 25976 - DNA, 121 bp, Artificial Sequence
  Synthesized
  misc_feature (61): n=a or g
tgaatatgttatcagccatatgaaaaatactcgactaattaagagctaaatccacactatngaaaccctaattagactaatcagtaggacaagcatagggcacatgcagcttagtgggatt

SEQ ID NO: 25977 - DNA, 121 bp, Artificial Sequence
  Synthesized
  misc_feature (61): n=a or g
ggatgacaaccttgatggtttctgaaagtaataaaaatcccttctcctcatgctgtcttgntatcttttttcatgatgatcagcaacgtactaccacatatggcttcagaatttttagtga

SEQ ID NO: 25978 - DNA, 121 bp, Artificial Sequence
  Synthesized
  misc_feature (61): n=a or g
ccacctttatcccatagtactgtgttctctcacggcattttgcagttggccatctgtatgnaaagcataaaaagctgcaacctggattgatatagtcgatcacattaaattcagcatggcc

SEQ ID NO: 25979 - DNA, 121 bp, Artificial Sequence
  Synthesized
  misc_feature (61): n=a or g
cccgttgtcctgagtgctggttgttgcaatccctacctagatatgcctcattctcccactncaagcatgaggactcacagttacagcttcctatttgctttgtgcaggactgcagatcatg

SEQ ID NO: 25980 - DNA, 121 bp, Artificial Sequence
  Synthesized
  misc_feature (61): n=a or g
tcacagcttacagacacatttgcttgggtagggactgacacaacattctcttccttccatntagtatttacactagataataagatagcagtacagtttttctctgccaacatgggaattg

SEQ ID NO: 25981 - DNA, 121 bp, Artificial Sequence
  Synthesized
  misc_feature (61): n=t or g
ccagaaggggtgatgatgagcactgcaggtgcaacgcgttgggaatgggtcctcagggtgnagatcacacagggtttacaatgctgtggtccctgcagcacctcatcctaaaggataccga

SEQ ID NO: 25982 - DNA, 121 bp, Artificial Sequence
  Synthesized
  misc_feature (61): n=a or g
tacagtgtagctctgaggtgaacaggtattgtctacttacgtgatgaagaaatcatataanatatttccccttttcctcccagcaccagctaggtgaaaacatgaaggactttagccttaa

SEQ ID NO: 25983 - DNA, 121 bp, Artificial Sequence
  Synthesized
  misc_feature (61): n=t or g
tcctgtatgtttaataaacaacaacgttagcaatgttgctgaggttctggagaaggaaatnatttgcattaatggctaagcttttcttttatttctttttattttctctgggaaagcccga

SEQ ID NO: 25984 - DNA, 121 bp, Artificial Sequence
  Synthesized
  misc_feature (61): n=t or c
ttgcagcacacttttactaatgagcatctgggatgagtatggtatcttgcactatggatcncatgatctgtacaataatggctgattttaattgacttttgctgcatatagctaatcccaa

SEQ ID NO: 25985 - DNA, 121 bp, Artificial Sequence
  Synthesized
  misc_feature (61): n=t or g
actccttttcaggaaagcattattttctgtagatggcaattttacatctggtgtgtaaagnctctgtaagaccttgcatacttctctctttgtctaaggcaaacttaatgcagtatattga

SEQ ID NO: 25986 - DNA, 121 bp, Artificial Sequence
  Synthesized
  misc_feature (61): n=a or g
ccagatgaaagacacagttttggaaaaggaaaataagtcctttttagaagtaattttccantgttctcccacctctaagatgaatctttcagtgtttgcatcacgctgcccacatttttgt

SEQ ID NO: 25987 - DNA, 121 bp, Artificial Sequence
  Synthesized
  misc_feature (61): n=t or c
gctattttccatttaaaatattcctgttctatgttccaggagttgataggtagcaattatntttgcttcagaatgttgtctgttattattatttatatatttttttcatagtttagttccc

SEQ ID NO: 25988 - DNA, 121 bp, Artificial Sequence
  Synthesized
  misc_feature (61): n=a or g
ctgtaagagaaactttggttcctgtttgctttcattgcaaggcaataccttattacgtaanctatgcatcagaaaacaagcactgcacgtcatgctccatcactgaaggtctacttcattt

SEQ ID NO: 25989 - DNA, 121 bp, Artificial Sequence
  Synthesized
  misc_feature (61): n=c or g
atttactgtttagcctctccaagcaaaaatacagagggaaattaccacagaattcttcctnaagacccttgccttcgtagtgcacttcttcttcatatggagttgactttttcaatgaaac

SEQ ID NO: 25990 - DNA, 121 bp, Artificial Sequence
  Synthesized
  misc_feature (61): n=a or c
cactccaacgtttgtccttaccacactttctttcattttcctttgagagttttgaactttncattaaaggacatgttaattacccctggcttaatctttactcatatagaagtcgaattga

SEQ ID NO: 25991 - DNA, 121 bp, Artificial Sequence
  Synthesized
  misc_feature (61): n=c or g
ttcccttttcttcatgttgtatatacatttaatgaacagcttatgttgtgtatgactgtancactgttaattaataagtaatagtataaagacttgttaatccacagtactttaaattcat

SEQ ID NO: 25992 - DNA, 121 bp, Artificial Sequence
  Synthesized
  misc_feature (61): n=a or g
gccttataaagagctagtagagaaaaatcacagaatgatactctaagcagagaggtagacntttgccagattaactgtaagatgtggctgcttgacttcaaatagatgttccgattaacca

SEQ ID NO: 25993 - DNA, 121 bp, Artificial Sequence
  Synthesized
  misc_feature (61): n=t or g
atctctagaaaacctaataggaagtcaatgtttaatgaaagataaagaatacagtatcatnctgattattctcagaattacccaaaactgggaaaccattctggcgactgcaaatctttaa

SEQ ID NO: 25994 - DNA, 121 bp, Artificial Sequence
  Synthesized
  misc_feature (61): n=t or g
agtatggtggaagcatgcaagatcgatatcaccaatggaactagaggatttgcttttttcntaaagtatgaatgaagcaatgatgcttttgtccagcactgctcttttgcatgaagcttta

SEQ ID NO: 25995 - DNA, 121 bp, Artificial Sequence
  Synthesized
  misc_feature (61): n=t or c
cattaaacattcgttaggaatattgttacggtattgaagatgttatgtgcctttttacatnctctctttttgaaaaacgtacatgaatcttcacttttagtggcaagaaatttcctttcag

SEQ ID NO: 25996 - DNA, 121 bp, Artificial Sequence
  Synthesized
  misc_feature (61): n=c or g
ccgtaccatgatgatgttgcctcgacgagaggctatgtgcaaaggagtgatcccattctgncagaaggaaggacagcttgttacgggaagcaacccctcctctcttccctgaagggctacc

SEQ ID NO: 25997 - DNA, 121 bp, Artificial Sequence
  Synthesized
  misc_feature (61): n=a or g
ttttaatacagatttgaagcaaatatgcaatttgattttgtatgccaaattactaggtgangagaaatcaccgtaagccatattgcatcagtatggtcatctggagaaataatttcttttc

SEQ ID NO: 25998 - DNA, 121 bp, Artificial Sequence
  Synthesized
  misc_feature (61): n=t or c
ataggaccatgtatttctgccaaggctccagaacaatgccttttgcttttgtggtgtttanctagtcatcgctagcacttgtggtgggagacaatgccttgtgccccattggcagggaagg

SEQ ID NO: 25999 - DNA, 121 bp, Artificial Sequence
  Synthesized
  misc_feature (61): n=t or c
tgatgtattgatcgtataaataggcatggatgtggaatatgatgctaggggaagcgtatancaaatttcagaaactgcagcaagttctctgttttatgaacagaggaaaaagtagaactga

SEQ ID NO: 26000 - DNA, 121 bp, Artificial Sequence
  Synthesized
  misc_feature (61): n=a or t
caactctaaggccaaagtttttctcatggaactacttactctgggtgcatccattttgagnctgcccatcctcaagacgtttttctttttgcttgatttttgagatgaggtgaatggaagt

SEQ ID NO: 26001 - DNA, 121 bp, Artificial Sequence
  Synthesized
  misc_feature (61): n=a or t
agagtacataagtggtatatagaaaggatatgactcagttagtaggacttgtgtaggtatnagtaaacaattcagcaagtacttaaaataaaaattgtgaatggctttgatttcatcacag

SEQ ID NO: 26002 - DNA, 121 bp, Artificial Sequence
  Synthesized
  misc_feature (61): n=t or c
agtccagtgaaagaaggagggttagagaagtcctctaggtgcctatttgcatttattagangcctcaaaccctttgtaatcctgagtcagattaagaaatgaagcatgctgcactgctgaa

SEQ ID NO: 26003 - DNA, 121 bp, Artificial Sequence
  Synthesized
  misc_feature (61): n=c or g
ggtgggacacacaattcagcacctttatgggaggaatctgcttccaactgtctcaccacanttatgatcatttggagtgactctgcaacttggttcagaggagatcttgaacccaacagca

SEQ ID NO: 26004 - DNA, 121 bp, Artificial Sequence
  Synthesized
  misc_feature (61): n=t or g
gcaccatccaccattcgccccctcaaagctgatgacgtattttaagcatttcttgcagctngcttcgccttgcagtcattccaacatctgcacagcgcaacagagacgtttctgttgcatt

SEQ ID NO: 26005 - DNA, 121 bp, Artificial Sequence
  Synthesized
  misc_feature (61): n=t or c
actagaagaatgtttaaatgatgtcttgaatttcattatagcatttcctcttattagactnccaatactgcataatgggctgatgaacataaagtgctgaatggtattcacagaaatacaa

SEQ ID NO: 26006 - DNA, 121 bp, Artificial Sequence
  Synthesized
  misc_feature (61): n=t or c
agcacaggtcaaaagccagctctttttctacacctctcccaaggtgcaatgctctaaagantcctttccaacatcagttcggccgctaaggctcatatacattttttattaagagctttgc

SEQ ID NO: 26007 - DNA, 121 bp, Artificial Sequence
  Synthesized
  misc_feature (61): n=a or g
aattttctaatggtctgaagtaaccaagttttcagacaaatttctatttattttgtcttcnctactctgctctgcagatctttaaaagaaaaaaaaattgaatttatctgcaattcaatgt

SEQ ID NO: 26008 - DNA, 121 bp, Artificial Sequence
  Synthesized
  misc_feature (61): n=a or c
ttttatttgaaaggggaaatgctgcaaggcagtagagatgactgagattactccataaaanaagagaactaaagattattgttttacagttacttccacttattgtcttctgttggtacta

SEQ ID NO: 26009 - DNA, 121 bp, Artificial Sequence
  Synthesized
  misc_feature (61): n=a or g
gagttcacagaagactaacaagtagttccttaaaagccgttggatatcgatgcaataaaanaacacacaagagtatgattttgcataatttttagtatttatagaatcaatgattttgata

SEQ ID NO: 26010 - DNA, 121 bp, Artificial Sequence
  Synthesized
  misc_feature (61): n=c or g
taaccgagtggatgccaaaacaaagctggaagctcaggtattcactgatactttggtcttnttttacagctcaagccatagagggaacttctggattttaggcgaagaggttatcctcacc

SEQ ID NO: 26011 - DNA, 121 bp, Artificial Sequence
  Synthesized
  misc_feature (61): n=t or c
atagtaaccttgaaaactcatacagtaagaatgcatttgtcaaaaaattgcagagaacatnggaaggtcagactagcttcaagaggcagcaggaaacaaaaccgcagcagaagggaacaag

SEQ ID NO: 26012 - DNA, 121 bp, Artificial Sequence
  Synthesized
  misc_feature (61): n=a or c
gactcaacagcccacacacagccctttgctcctgccatagatgaaggatcctgtcacaganagccatgctatgattttgtaagcaagtgtaatgttttctttttcaactgatcaaagccca

SEQ ID NO: 26013 - DNA, 121 bp, Artificial Sequence
  Synthesized
  misc_feature (61): n=a or g
gtaagcaatacaaacactgcatcttgtatcatctataaattttctgtgcagttcctggcanctgagaagtttgttgtgggaagaacagtgctagtggtcaacagccacctgaaacgtgcat

SEQ ID NO: 26014 - DNA, 121 bp, Artificial Sequence
  Synthesized
  misc_feature (61): n=a or g
tcgcttctctctgtatcctttatgactcagttgctcgctttgggattgacttcatggtagncatcccacatacatagctttcatctccggggcactcataaatgtatctctttgaagttgc

SEQ ID NO: 26015 - DNA, 121 bp, Artificial Sequence
  Synthesized
  misc_feature (61): n=c or g
ggaccctgactacatcctgcttcacactcagcctgcagataacaccagggccggttcaagnaggcttggtggcactgcaggcttctgccccatttctgcacagctccctttggacacactg

SEQ ID NO: 26016 - DNA, 121 bp, Artificial Sequence
  Synthesized
  misc_feature (61): n=a or c
aatcatgctcttccacatcttctgtctgcatcattctagacacttcctgcctgtttcctgnttgttgcttctactctccccttcttatccatgatcttgctgatatgttccacaactgtaa

SEQ ID NO: 26017 - DNA, 121 bp, Artificial Sequence
  Synthesized
  misc_feature (61): n=t or c
gtatgtccaaaaagggtaccttgtcttttgctacgttctgaagaccttatgagaatcatgngagtaagaggttaaattcaggtgttccaagttcagcgatgcaagatcacagctatggctg

SEQ ID NO: 26018 - DNA, 121 bp, Artificial Sequence
  Synthesized
  misc_feature (61): n=a or g
gtttttagggatggggatttcacagcagcagcaagaaatcatcagttctgttagccacagncatgcttccctttaagctaggatgggtgcttttgggttgagcttgcttctgccttctggg

SEQ ID NO: 26019 - DNA, 121 bp, Artificial Sequence
  Synthesized
  misc_feature (61): n=c or g
tggtagacgaggcctgcaggcctcagtgctgcaatgggttctttgagggaaatgttacatntgtacaacaacgaatctcaaacaggaggggcccaagggtgctcagggcttccacacgcat

SEQ ID NO: 26020 - DNA, 121 bp, Artificial Sequence
  Synthesized
  misc_feature (61): n=a or g
atccataaagtgaccaaccttggcactccaaaccagggtaccttggctttctaattgccanctccttagcctgtttaagaggatggcagtgagcgtgtttttcactattgtagaattttca

SEQ ID NO: 26021 - DNA, 121 bp, Artificial Sequence
  Synthesized
  misc_feature (61): n=a or g
gtcctgttgctgctccaagtcagtggcctggggatggctatggcagcattagagcagcccncctgtccctggcacattaactgcatgctggtgtgaggctgtcagggctgtttctgtggtt

SEQ ID NO: 26022 - DNA, 121 bp, Artificial Sequence
  Synthesized
  misc_feature (61): n=t or g
ctgctgtgagagcactcccttcttcaccttcctcatagaagagaatagaggacagatgggngcatggagctggcagggcgggattcaggcagtgaggggctgccaatggaagggaggggtg

SEQ ID NO: 26023 - DNA, 121 bp, Artificial Sequence
  Synthesized
  misc_feature (61): n=t or c
gaaaacgtgatgagaaaccacctagccttaaaaaaggaaaaaacatcatcatcctaagttntttcagctgtaaataagaacatctagatttgttttctgtaggacaaaagctgagatgacc

SEQ ID NO: 26024 - DNA, 121 bp, Artificial Sequence
  Synthesized
  misc_feature (61): n=c or g
ttatttcaacaagatcatgctttgtatggtatattttatacattctgttactttgtggggnatattgcttcaaaaatgatatctggcaagaaaaaataagacaacataaagtttatttaca

SEQ ID NO: 26025 - DNA, 121 bp, Artificial Sequence
  Synthesized
  misc_feature (61): n=a or g
ctgctcaaagcagcatggatggacgtagatggtaatctgtctccaggcctgtgagctgtcnctcatcagcttcaagctgcttttcagacagctttgtatttctctgtatttcttgcacgtt

SEQ ID NO: 26026 - DNA, 121 bp, Artificial Sequence
  Synthesized
  misc_feature (61): n=t or c
tcagtgcaagattttcccatcatcatcatcagtgccatttgtgatctacataggtctcatnggacatttggaaaaaggtcgcagagaccctttttctgtactgggaaatccaacccgagtt

SEQ ID NO: 26027 - DNA, 121 bp, Artificial Sequence
  Synthesized
  misc_feature (61): n=t or g
ttcagacatttaatacccaaacatacatggcgtgcagcttaaatgcatcttacatggtttncagcataacagccttctactggccaacacacaaaaccttagctgcacatgcagccttttc

SEQ ID NO: 26028 - DNA, 121 bp, Artificial Sequence
  Synthesized
  misc_feature (61): n=a or g
ccactgaatattttagtatagaatttgttggcagtgtgctggagtttcagcttgctgtttnttattcctcaagactatgattcacagttattaagactgactagtgaaagaccactatcac

SEQ ID NO: 26029 - DNA, 121 bp, Artificial Sequence
  Synthesized
  misc_feature (61): n=t or c
ctgctgcctatcagtgctttctgtgatgacaagaagctagtaaaagtaaaggcgtatattnagaaggattttgcaaatacgtatgggaaatatacactgcaacttccctcatggaataagg

SEQ ID NO: 26030 - DNA, 121 bp, Artificial Sequence
  Synthesized
  misc_feature (61): n=a or g
gcgctgcgtcggctaattgcggctccggcaaatgctgaatggtgtgaaaatttgaagtgcnttttgagggacgtttacagggctttatttcctcccgaatggaggattaatgtgtctgtaa

SEQ ID NO: 26031 - DNA, 121 bp, Artificial Sequence
  Synthesized
  misc_feature (61): n=t or c
gacatattaatgctgagattaaaagaatttttaagaggtgtaatttagaacatatgatctntataatgttgatacgtggtaatctgtaagaatgtaaactgtatacacttgaatcacaggt

SEQ ID NO: 26032 - DNA, 121 bp, Artificial Sequence
  Synthesized
  misc_feature (61): n=t or c
actgctgttttagagtattccagtgtgggaaactaagccagtgtttgaataactggacttncctatggcatgaggattttatttttgcttaggatttgatctcgttctctaatgtggttta

SEQ ID NO: 26033 - DNA, 121 bp, Artificial Sequence
  Synthesized
  misc_feature (61): n=t or c
tattcctcttatcatctgctgttcttcctccaggtaaaaggatgcttgcgttcaggcattnttctccaactaccatattactctaatgcaccttttaggtgctgcgtgctacctgtgcaca

SEQ ID NO: 26034 - DNA, 121 bp, Artificial Sequence
  Synthesized
  misc_feature (61): n=a or t
tttttattgcctgatagatgtctagctttatttggaggtgcttatagcagaaggataatcncctgacattgtacaatacagaacttcttcagggttccaaactcagctcacctttcttcca

SEQ ID NO: 26035 - DNA, 121 bp, Artificial Sequence
  Synthesized
  misc_feature (61): n=a or g
tttcagtacgttataaaaatagttgtccaaccattattaggtttaacacggtctcattttncactccaactatttagcgttgttatgttttttttggtctcacattccttgtcttacagca

SEQ ID NO: 26036 - DNA, 121 bp, Artificial Sequence
  Synthesized
  misc_feature (61): n=t or g
gtttcattagataagagcatttttccattgatttgatcaacgtcaaaagatacaggttcanttgctactctaggctctcatttcagttacatcagtactacttttcttatctctttaggac

SEQ ID NO: 26037 - DNA, 121 bp, Artificial Sequence
  Synthesized
  misc_feature (61): n=a or t
ctcaatattcattctaatattcatcacacaatattcgttctaaaattcatcaattctaatnaatctcatatttattatcttcagctctgtacactcattaagcaaagacaggtaagtgtgg

SEQ ID NO: 26038 - DNA, 121 bp, Artificial Sequence
  Synthesized
  misc_feature (61): n=a or c
tggcacctttgtcctatttctccattataggacagaaaatccaacttctgagaatccaacngttccctgaaagatgtgaagcagaccttttcagcacaacacactggattttctttcaagc

SEQ ID NO: 26039 - DNA, 121 bp, Artificial Sequence
  Synthesized
  misc_feature (61): n=a or g
cagcttccaaggcacaaccacacagatctggggccttctggattctgctgtgtgatttctntcactccaaaagcaatcgctatgctgtccttacatgggaccaacacaatgtcctgatgtc

SEQ ID NO: 26040 - DNA, 121 bp, Artificial Sequence
  Synthesized
  misc_feature (61): n=t or c
aacttacgaactgcatatgcttaatccttgtccatccttctggacctgagtgaaaaaggangcggacataatgggaaaattaaatgagatgtagtgttagagtcttctgttttaacctatt

SEQ ID NO: 26041 - DNA, 121 bp, Artificial Sequence
  Synthesized
  misc_feature (61): n=a or g
acaacttgttaatatttggcactggttgagactaccattataatttacaagaataagacanctttataaatcaagggacagtttgaaatgagagaggtttataaatacaataagatgtcta

SEQ ID NO: 26042 - DNA, 121 bp, Artificial Sequence
  Synthesized
  misc_feature (61): n=a or g
tgcttctgccttctgtatcagaagtgagcatttatctgtcaaaaccagttaagtctccctncatattactttcaatacaatgcaatatagataccagtttgatggtggttattttttcccc

SEQ ID NO: 26043 - DNA, 121 bp, Artificial Sequence
  Synthesized
  misc_feature (61): n=c or g
tgagcatttgcattcctacttctttgttttaaacagagctaacatttacccagcaagtaanaccaaaaatcgcacgagagcaataagaaatgaaaaactgagctaacttgttatttaatta

SEQ ID NO: 26044 - DNA, 121 bp, Artificial Sequence
  Synthesized
  misc_feature (61): n=t or c
aaagagcttgcttggttgcaatagggactccttaggtcttgtgcctttggcatgcctaaanttggttttattaagtcatgggactgcatgggaattctctcaggcagagttaatagcattt

SEQ ID NO: 26045 - DNA, 121 bp, Artificial Sequence
  Synthesized
  misc_feature (61): n=t or c
agtctgcccattaaattgtcgcacagaactgcatcacagccagctcacgctggcggtccancagccctgagcccttaccaaaggacgtgccaactcctgggaaggctgaggcaggagtgct

SEQ ID NO: 26046 - DNA, 121 bp, Artificial Sequence
  Synthesized
  misc_feature (61): n=t or c
aggattgatgtgaagaatgattaaaatttaaaatagatgtatatttttctgctgttttgtntccaagtcctgcctatgctctacaaacccatgtgaaaaaggtgattctgtatataaatga

SEQ ID NO: 26047 - DNA, 121 bp, Artificial Sequence
  Synthesized
  misc_feature (61): n=t or g
gtttggaggctgctaccagagcagtgttcacctacaccctcacatactgacatggctcctntgctgaagagtagtctttaaattaggagatactgaagaacgaggaaaggaaatcacagat

SEQ ID NO: 26048 - DNA, 121 bp, Artificial Sequence
  Synthesized
  misc_feature (61): n=t or c
accaatgtccttgggatgatgacagctatcttaggggtcttcctatataacaaggtaaggngttcatctgtttctctggctttgaactgttttgtaaagcaagttaacagcagaacagaaa

SEQ ID NO: 26049 - DNA, 121 bp, Artificial Sequence
  Synthesized
  misc_feature (61): n=a or g
gctgtgaaactgtcagagtacaagctagagtaacacacacactaccatttgctggataccnaaggaaaagctaacataatggcctaaaggctgtaagatcagtgctgcgctagccctgctg

SEQ ID NO: 26050 - DNA, 121 bp, Artificial Sequence
  Synthesized
  misc_feature (61): n=a or g
aaagataaacaatgacagttacattctctaggcatgagcagcatcattgaggacactacanttccctatcaatagtatctgagctgcacccatgctgtgagccagtatttgatcacataga

SEQ ID NO: 26051 - DNA, 121 bp, Artificial Sequence
  Synthesized
  misc_feature (61): n=a or g
caaagtaagtgccagtatccttgctaattttatcctgtagctaacagcaataagaaacaanaagcacaacaccaaaccatggaacctttgccccaaaggggatggattcagttaaatcttt

SEQ ID NO: 26052 - DNA, 121 bp, Artificial Sequence
  Synthesized
  misc_feature (61): n=a or g
ccaaaggtgggggcgtttaatggctgtcccacttgtcacaaacagatgaggtgtcaggcgntgcccagttcccatcacagggctgcatgttcttgtggccagtgcttcttgctggcctcta

SEQ ID NO: 26053 - DNA, 121 bp, Artificial Sequence
  Synthesized
  misc_feature (61): n=a or g
attatgctctcctctctatccaaacttagctctgccagcaaagctgctaccttcctatgtnacatttagtaccttgataataaggaacactgtgctatgcaccaattagtaaactcactct

SEQ ID NO: 26054 - DNA, 121 bp, Artificial Sequence
  Synthesized
  misc_feature (61): n=t or c
gtaacatctatctggcagagcaaaaggttttgctgatatctggaatgtatgtttatgtaangcttcttcatgttggaataaatgagaactgagcatggtaatgcccacaggtattacaggc

SEQ ID NO: 26055 - DNA, 121 bp, Artificial Sequence
  Synthesized
  misc_feature (61): n=a or g
gaaggcatactgcagcaaagagagcaccacggcatcattttaattctacaacttgaattcncataaaccatagatcaaaccactctactcagttgctgtttggctcagtactctgtagcca

SEQ ID NO: 26056 - DNA, 121 bp, Artificial Sequence
  Synthesized
  misc_feature (61): n=t or c
gcatggctgcaccctctacctcaaagcaaattttgctctacagcttgtgacacccagatanattcaaatttgcttacagtctgagagatgagatgtcattaagccttggcagcagatcttc

SEQ ID NO: 26057 - DNA, 121 bp, Artificial Sequence
  Synthesized
  misc_feature (61): n=t or c
caacactaagatgataaacagtgcccagcacaggggtcaaacagaaagaattgtgtcagtntcctataggagacagcccggccaaagaagcagaacaacagaaatagggtttcgctcacat

SEQ ID NO: 26058 - DNA, 121 bp, Artificial Sequence
  Synthesized
  misc_feature (61): n=t or c
gaaatgaggttaaatggcaaccagctccttatttaaagtgccttttctctgtttgttcttnagttattatatgatggctttattgtaagtcggtattattaaccttgcagtatctatttga

SEQ ID NO: 26059 - DNA, 121 bp, Artificial Sequence
  Synthesized
  misc_feature (61): n=c or g
agttgtcagctctttattatttcttaccatttcacatatcagtatggatctttcttttccntggttcacctcagatcaaaaagggtctcctttttcattttcctcctctaacagtgaaagt

SEQ ID NO: 26060 - DNA, 121 bp, Artificial Sequence
  Synthesized
  misc_feature (61): n=a or g
tacctgcaaatgaaacagaaaacaccatttctgaatgatgactgatgcgcttttaggaatnggcaaccattactatttgaagcgtttcagaatcctcaacttcctactctatatgcaagca

SEQ ID NO: 26061 - DNA, 121 bp, Artificial Sequence
  Synthesized
  misc_feature (61): n=t or c
aagggtaacagcctgcaacaatgtggcctacaaaaaaacctggaagttgctttgcaaaatnagtaatgcacaagtgtaatgctcatgtgtaatgctcatgcttctccatctagcttctgct

SEQ ID NO: 26062 - DNA, 121 bp, Artificial Sequence
  Synthesized
  misc_feature (61): n=a or c
aaaggctccttccacatgggcagcaaatactgtgcagatggatacacagcagtctagtggngctccatggtcctggtgagaggcaagataggtgtttgaattatgtgcttgcgtgatataa

SEQ ID NO: 26063 - DNA, 121 bp, Artificial Sequence
  Synthesized
  misc_feature (61): n=t or c
gacatggaagaaattcataaaccagagtatttaactaatgacttgatttctaaaaagaccngaagcttgattcaattactcaaatacaaaagtctcgtgccagttaagatttccccagtct

SEQ ID NO: 26064 - DNA, 121 bp, Artificial Sequence
  Synthesized
  misc_feature (61): n=t or c
ctggtgaccacatgatatattgattttaattttcaatgtttgccttgttccctttcagttntacagaatgcagctgagataacagtctagttgaggtacttgaagtaattgttatctttaa

SEQ ID NO: 26065 - DNA, 121 bp, Artificial Sequence
  Synthesized
  misc_feature (61): n=t or g
tgaggtacagattatgttactgaacctacgtttctcacaatgtggtgtgtatggtgtgtantagtggaagggcatagacatggtttatcttaatttatcaaaaggaaaggtaaatcctgtg

SEQ ID NO: 26066 - DNA, 121 bp, Artificial Sequence
  Synthesized
  misc_feature (61): n=a or g
ttcttacaggactgctgagatatgcaaaggtaaaataaaaatgttggaagttgcagtaacngcagtcactgcagctccagcctccttttctgtccttcccaggctgatcatctcagggtat

SEQ ID NO: 26067 - DNA, 121 bp, Artificial Sequence
  Synthesized
  misc_feature (61): n=t or c
gacctcctggctgcactggtttttaatgctctcatcattaacttttttctgtttcactctncttcatctggactctgttctacagctctagttaccaactagacagagtagcggtgtggtt

SEQ ID NO: 26068 - DNA, 121 bp, Artificial Sequence
  Synthesized
  misc_feature (61): n=a or g
cagaggccctttcactgcactccgggcatctctccactcccagggagggagttggttctcntttgtaaacgtggaataaatacatttggaataaaacgggctgtggctgctgatgtgcaat

SEQ ID NO: 26069 - DNA, 121 bp, Artificial Sequence
  Synthesized
  misc_feature (61): n=t or c
atagtagctggcacctgtggtctttgctaaggccgtttcagacagtgatggaagagacagngggatgggctggtacaaggtgtcacatttgcttgatagagtggtccaagcatcacagact

SEQ ID NO: 26070 - DNA, 121 bp, Artificial Sequence
  Synthesized
  misc_feature (61): n=a or g
tcaaatgattgttcatcgcatttaatcaacatattcatagctgttttctatcccagctgcnttgtttgcatatccagctgttgcaggcagcctgctctgtgcagaggggagatgcattttt

SEQ ID NO: 26071 - DNA, 121 bp, Artificial Sequence
  Synthesized
  misc_feature (61): n=a or g
ttttaggctgagtcatggagccatgagtcacgtgaatgttatagatggggcaggaggggancccttgggctttccttcttgagatgtagaaggatcagagtgctttatctgctactgtttt

SEQ ID NO: 26072 - DNA, 121 bp, Artificial Sequence
  Synthesized
  misc_feature (61): n=t or g
gtctagaaataaaactgcttcagaagtctgtgaatgagaagttagtgcaagagagtgatancttatattgtagcactacgatagtggctgtctatgacagtctgaattctgtgaatatatc

SEQ ID NO: 26073 - DNA, 121 bp, Artificial Sequence
  Synthesized
  misc_feature (61): n=t or c
ccagtgtctggaaatgtacaatacgtttccagccccttcagtcttgtaaaagcacatctcnctcacttaactttccttttatggattttattcttcatttttagtgcagttctttcctccc

SEQ ID NO: 26074 - DNA, 121 bp, Artificial Sequence
  Synthesized
  misc_feature (61): n=a or g
actgctcagtcagttggaggtatagaatagctggtattttggtagagtttagaggacttgnctccagaagataagcagtgagtgccatgaaaatcaaggtggtaaataaaagataacagag

SEQ ID NO: 26075 - DNA, 121 bp, Artificial Sequence
  Synthesized
  misc_feature (61): n=a or g
tcttgaagttgtcctccttgggcgaatccaccttgttttcatccagggaattgatgctgcngaaagggaagggttaaggggtggtggtagcatggggacacagggtagcagccctgtggcc

SEQ ID NO: 26076 - DNA, 121 bp, Artificial Sequence
  Synthesized
  misc_feature (61): n=t or c
caaatcttacctccctcttgcccctgttacttacgcaaatgtgcagtcacccttggattgntgaaattcaaccagtgcttcctttattgctctatcaataggaatgggtgggaagctggaa

SEQ ID NO: 26077 - DNA, 121 bp, Artificial Sequence
  Synthesized
  misc_feature (61): n=t or c
ggaatgtcccaagttttcctatggactgcccatgtctttccttcgaatacagaaagtaaangtcattatggtcctaacttcagtgatgcaatgcaatgttaaagtaatctgtaaatgaaca

SEQ ID NO: 26078 - DNA, 121 bp, Artificial Sequence
  Synthesized
  misc_feature (61): n=a or g
ctacaaatatctttcatgtcaccttttagatttagagggaaccttgcaatatctgtccaangtgaagactgatctttgcaatttctgttctgaataggaactgaggctttgttaaacaaac

SEQ ID NO: 26079 - DNA, 121 bp, Artificial Sequence
  Synthesized
  misc_feature (61): n=a or c
tatgaaaatcgttaataccaatagccaataacagtccctgcagccatattttaatactgcnatttgagataagttgttaaggctaatgtgaaatcatttctgggaagatacagattcattg

SEQ ID NO: 26080 - DNA, 121 bp, Artificial Sequence
  Synthesized
  misc_feature (61): n=t or c
agtcttgggcagccttactaagcagctctcacaaagtctttaccatggtaccaccacttantaaaagcggggtcatgggaacttcatcaggaaaaagacaaacctccttgttcatatgatt

SEQ ID NO: 26081 - DNA, 121 bp, Artificial Sequence
  Synthesized
  misc_feature (61): n=t or g
attacagcaatgaagggtatagaaaaagcagttttttcattctgcaaatttatagtgtctntcagaaactatccaatacttctaagctcctaaagttaattaaaacaacataaataaaaat

SEQ ID NO: 26082 - DNA, 121 bp, Artificial Sequence
  Synthesized
  misc_feature (61): n=a or g
aggtcacttccccctgggcattgtcctccagatctccatagtgtagcactttgtggttcanagcaaggcgacagtaccaaaatctttctggaactcagaaaaagtagagcaggctgagcag

SEQ ID NO: 26083 - DNA, 121 bp, Artificial Sequence
  Synthesized
  misc_feature (61): n=a or g
cccactgacggagctgagcagaacacaacatggcttaaggcagaagaagttgaaagagtantatatttcgacttatgcattgcaacgcatatttcccaccctagttgtagttcactgcaat

SEQ ID NO: 26084 - DNA, 121 bp, Artificial Sequence
  Synthesized
  misc_feature (61): n=t or c
gttgctgctgagcacaggaaatgctcatctgtgttcctaagaaatgaaagtaaaagggcantgacaaattatttacaggtgaagagagctggggctgttcagcctggagaaaagaaggctc

SEQ ID NO: 26085 - DNA, 121 bp, Artificial Sequence
  Synthesized
  misc_feature (61): n=a or t
acaaaggtaataataacaaaataaggtaataataacaaaatacctagtttatgctgatctngacatcttgactgcagacaattgtgtcactctacagcctgaaacattccaaccttgaaga

SEQ ID NO: 26086 - DNA, 121 bp, Artificial Sequence
  Synthesized
  misc_feature (61): n=t or c
cattttcatcaacaaagtgacacattctcccagaatggcagaaatcagaccaggaacctcngtggaccatggaatatgccaccacagctggaggactgttcctgcagccagcaggttccac

SEQ ID NO: 26087 - DNA, 121 bp, Artificial Sequence
  Synthesized
  misc_feature (61): n=t or c
gagctatcgacagggtgtcatttcatcacaatatcctctttctgctttacacaaagacttngatgaagggaattttttgttcgcttttgatggcagaggttgccatctctccagggagaga

SEQ ID NO: 26088 - DNA, 121 bp, Artificial Sequence
  Synthesized
  misc_feature (61): n=a or t
tgtacaggtgttgagattttatatatgggataagaaatggtgttatactccttttattcanctttacagatgttaacacttaaacaaattatccataacatgccagagacagttgtttctt

SEQ ID NO: 26089 - DNA, 121 bp, Artificial Sequence
  Synthesized
  misc_feature (61): n=t or c
ctggcacagattaatgaatctgagagagaattcttcccagaaaagcattgacacgcgttcntaaagcacaacgtgaggcgtccaaagcacaacggaaaccggggagaacgatcaggggcgg

SEQ ID NO: 26090 - DNA, 121 bp, Artificial Sequence
  Synthesized
  misc_feature (61): n=t or g
agattcccggtgcgttcagattttgagggttttggttttgtttgcccgtatcatgcagtanagccaatgattgtaaaaaatgtcattattacaagcaggttagaaacacagagcttgttta

SEQ ID NO: 26091 - DNA, 121 bp, Artificial Sequence
  Synthesized
  misc_feature (61): n=t or g
gtagcttacagatgccctgagttctgtcctatgctttacacttttatttccatttgggtgnccctaacatctcccactctcttctgctgtactttagtaattgcacagggttttcgggttt

SEQ ID NO: 26092 - DNA, 121 bp, Artificial Sequence
  Synthesized
  misc_feature (61): n=t or c
cctcctgttctccagggaggctgttcttggggcaagcttgtgactctggtctcttcactgncctccacattcgtgcagctgtcagagggctgctggaagcagggagtcccctgatattgct

SEQ ID NO: 26093 - DNA, 121 bp, Artificial Sequence
  Synthesized
  misc_feature (61): n=a or g
ccttccaatgactcaaaagatactggcagtagaatagggagtggctgtacctcccatcgcntataccaaaaccagttggaagcaaaggtcacttcagcagcgtttgcagcctccctctggc

SEQ ID NO: 26094 - DNA, 121 bp, Artificial Sequence
  Synthesized
  misc_feature (61): n=c or g
ttttaccattgggcaaggctaatataatcagctgtcacagctcaaatgacaatgattcatnacaccatagatatttggtctttttcatttgttataaatacagacacagatcgaactctac

SEQ ID NO: 26095 - DNA, 121 bp, Artificial Sequence
  Synthesized
  misc_feature (61): n=t or c
actgtgaggccccagtgcagtgtaccggtactgataattaaggcaggctgtgggagcagtnctgctgaccctgctctctgaccatcatgtttggtcatctcagaggtgctacaagcctcct

SEQ ID NO: 26096 - DNA, 121 bp, Artificial Sequence
  Synthesized
  misc_feature (61): n=c or g
ttaagaacaaaaaccttaatttataattttcaatattcaatttattggtaagagaatatanttgatatttagcactgagatacattgaatggcttcaaaattcttgaaattcttttattct

SEQ ID NO: 26097 - DNA, 121 bp, Artificial Sequence
  Synthesized
  misc_feature (61): n=a or g
ctgcttctttctgtagctgtggagctggccagctgtgtgacaccattgtctagaagtggtnttgcactgaagctgctgaaaagatccctgatgaaataaaacccaaattttaatttgcttt

SEQ ID NO: 26098 - DNA, 121 bp, Artificial Sequence
  Synthesized
  misc_feature (61): n=a or g
tggtagcagcattcaagaaaaggttatagtagataacaaactgatgacacagacaagactnaggcagacagacaaactcattctaaccatttttcaagacagacctatattattatgataa

SEQ ID NO: 26099 - DNA, 121 bp, Artificial Sequence
  Synthesized
  misc_feature (61): n=t or c
ttagatcttccacttcgttttttcccaaagtttggtgtaacattcttctttttccagtcantgtcttacttagacatatgtttctgaaatcataacattaaaatatatggttatcttcact

SEQ ID NO: 26100 - DNA, 121 bp, Artificial Sequence
  Synthesized
  misc_feature (61): n=a or g
actctctgaaggctgcaatatgctcaccgtcagcggggacctgcttttttgttttatgcanactaattggctccagtgggcacttggtgcatgtgcacattttaaggtctgggttttaagg

SEQ ID NO: 26101 - DNA, 121 bp, Artificial Sequence
  Synthesized
  misc_feature (61): n=a or g
ttgggaccacactgttcttcctttacttagccagactgaatgacttttggggggtattgtntcaaaaaagctactgtcacatgtatgcacctccaggactgtcttaagtggtaaataaaca

SEQ ID NO: 26102 - DNA, 121 bp, Artificial Sequence
  Synthesized
  misc_feature (61): n=a or g
ggtgaagtacgttactcgtgtactcgtgttgtgggacaataaagtcactgtattatattgntaattacaacagcaagtgtatagtaattcaacttcaatctgttatttttttttccattca

SEQ ID NO: 26103 - DNA, 121 bp, Artificial Sequence
  Synthesized
  misc_feature (61): n=t or c
actgcctgcatcccatctgctctggggagagggaggaagggcctggggggtccacatgtanccccatctccctatgggctctgctaacgtctccagctctttgcagctgcttcctatgggc

SEQ ID NO: 26104 - DNA, 121 bp, Artificial Sequence
  Synthesized
  misc_feature (61): n=a or g
agggagctttgctgtgtcctgcatcctatgatatcagccagctccagctcaagaggccacnctcatcctattcaccttcctcctcctcagggaacagatgcagagagtcagcacgtttcac

SEQ ID NO: 26105 - DNA, 121 bp, Artificial Sequence
  Synthesized
  misc_feature (61): n=a or c
catgaagcacatatatattggtagtgcaaatatggactggagatctttatctcaggtaagntctgctgttgtatattcaaacacctgagggaaaattaacgtccaagaacacaacagaaaa

SEQ ID NO: 26106 - DNA, 121 bp, Artificial Sequence
  Synthesized
  misc_feature (61): n=t or c
gagtgcagataagtgtaagacatgaaactatttgtgtttagcccctcaattttattttcantggggcttagctgctatgcttgatgttctcctcctccctgagttctgccttctcttgttg

SEQ ID NO: 26107 - DNA, 121 bp, Artificial Sequence
  Synthesized
  misc_feature (61): n=t or c
ttgcttgaattctttctcccaaataaaaaaaaaatcactccgtattttatggtattttaangcatacttttcagtccacctcacacacttcccaaagcacaggctttttaaacaccagttg

SEQ ID NO: 26108 - DNA, 121 bp, Artificial Sequence
  Synthesized
  misc_feature (61): n=t or c
gaccttatggtttccagggaccttatgggggaaaatgccaccatccactgccgtgatgtgngctccttctccttcccgttattaaaatgcctctgttccacagggcagtgagtgctcctgt

SEQ ID NO: 26109 - DNA, 121 bp, Artificial Sequence
  Synthesized
  misc_feature (61): n=a or g
gcgctccacgacagctctgcttcctgcatttcatgggtgagcagagtctggaagggaaccncttctcagagaacagatgtgggcaaaacccttcagcacacgaaaactattacatagctat

SEQ ID NO: 26110 - DNA, 121 bp, Artificial Sequence
  Synthesized
  misc_feature (61): n=t or c
gagcacttttaacgtgaacttcattgatacctgtaaggataatatcgcagatctttgggtngttgacagatttggaagagttcctgcctttgtaacttaagggctggcaacaagaagactg

SEQ ID NO: 26111 - DNA, 121 bp, Artificial Sequence
  Synthesized
  misc_feature (61): n=a or g
tgtctttacttgctgctgaagcttaatgatctcattcatcaggaaatgggtaaggccttcntgtccctcctccactgaaaatgtttgaacagcttatcaacttctcataaagtaatctaac

SEQ ID NO: 26112 - DNA, 121 bp, Artificial Sequence
  Synthesized
  misc_feature (61): n=t or c
catcccaactttgagataaaaaaggatcaattaaagctagcactgataagcaccatctatngtatctactgactgctctatggacattcttatggagacaaactacatgagataaaacttc

SEQ ID NO: 26113 - DNA, 121 bp, Artificial Sequence
  Synthesized
  misc_feature (61): n=a or g
atactaacaaacaccaggaataaaacagtacataactacaggacataggtggggacagacntcatacagagcagtttcacttctcaatttcagtcctctaacaagtgtggagctcactggc

SEQ ID NO: 26114 - DNA, 121 bp, Artificial Sequence
  Synthesized
  misc_feature (61): n=a or c
tttcttgatgagttctgcattatttgctggcaggtttatgcagtgcacctgatttctcatnctgacacaatacaaaggtcagatttgtggtatgaatgattaaaatgatttgcttgggtca

SEQ ID NO: 26115 - DNA, 121 bp, Artificial Sequence
  Synthesized
  misc_feature (61): n=a or g
gagagaggagaagatgccgtatctggcccttcgctagcggggatttgttttatcatactgnctttagagatttatcacttcctttaccttcctccatacacacagtgaagaaatctgcttt

SEQ ID NO: 26116 - DNA, 121 bp, Artificial Sequence
  Synthesized
  misc_feature (61): n=t or c
aatatgaccttaagaccaatagtaattcaaagtgaacaatgtgagaacctctgtttagagngctgtttcagaggaacattcttcccccaaataccttccttctgctagttacacaagtttg

SEQ ID NO: 26117 - DNA, 121 bp, Artificial Sequence
  Synthesized
  misc_feature (61): n=a or g
cccatgtgattacagaaaaaactatattctggatgagtccatagaaggccttgaacagtgnagtcacctcttccctcagcctgccagttcaattagccttgctgactgtgggaaaccacca

SEQ ID NO: 26118 - DNA, 121 bp, Artificial Sequence
  Synthesized
  misc_feature (61): n=a or g
tgccttctattggtgccttctctcatgctgtcctgatgaactgtgctgcccaaagccaccncaaagtcgcacatgatgttttgcttaaggattctgatctataacaagtcacttttatacc

SEQ ID NO: 26119 - DNA, 121 bp, Artificial Sequence
  Synthesized
  misc_feature (61): n=t or c
gtgtgcaaagtttcttcttgggtagcagggcactgctgatatccttttctctgtatctatncatagccatgcagatatctgcattttttccattctctgcttgctgcagtacttagttgtg

SEQ ID NO: 26120 - DNA, 121 bp, Artificial Sequence
  Synthesized
  misc_feature (61): n=a or c
tgcagggccagcggagcgcatcagggccacggctggggcttgtgtctcccttgggagcagnagcaggaatccttatctttgtaggtcgaggtggcgagacactgccagagccggagtgcct

SEQ ID NO: 26121 - DNA, 121 bp, Artificial Sequence
  Synthesized
  misc_feature (61): n=c or g
tgctatgcacagtgcccctcacccaactctgccctttctccagccagtctgcactataganatggcctgctctaatcacactcgggacagacaagcagaaggcaatctccaggcaagagcc

SEQ ID NO: 26122 - DNA, 121 bp, Artificial Sequence
  Synthesized
  misc_feature (61): n=t or c
agtgctttcagagcaagtatagaggggactcttaattctccttaagtatctatgatgttangctcctgccttgaccaacatgctgtgattctgtgatctgaccaggcttttaccttttcct

SEQ ID NO: 26123 - DNA, 121 bp, Artificial Sequence
  Synthesized
  misc_feature (61): n=c or g
tcacaactcgtcgttgaaggagaagctacttctactcctttgtttgtataatgttgagaantgcccagtgaacttaacctagccagtgtgaaatctggacttgtattcttgctttgttaaa

SEQ ID NO: 26124 - DNA, 121 bp, Artificial Sequence
  Synthesized
  misc_feature (61): n=t or c
taagaaaaaatgtactcaagttaaacactctttgatgaacagaactccttcagggaaccantgaaaatgttgctaactgatttccagtggagaaaattgatgagaactcagagaggatgaa

SEQ ID NO: 26125 - DNA, 121 bp, Artificial Sequence
  Synthesized
  misc_feature (61): n=t or c
tagggatttcccaccatcatttattactgtaaattgttcaacaacagaaatagtaagttangtaactaatactataaaacacggttcaatgcactagagaactgaacttcctttcctttta

SEQ ID NO: 26126 - DNA, 121 bp, Artificial Sequence
  Synthesized
  misc_feature (61): n=a or t
gaagaaggcaggtaatggtaatgatatagttcactgaatgtctgcaaagagtttctaccanttctgaaaaacaccatcaaggaaagaatgaacttgtttggatgatctgattaacaaatga

SEQ ID NO: 26127 - DNA, 121 bp, Artificial Sequence
  Synthesized
  misc_feature (61): n=c or g
cagattcactaagatacactgattgctagactgtccctaaggaaaaggggaaatgcaagtnctctgttgacacatatgcaccaaaatattaccaaagtgatttcttagacagtaataacta

SEQ ID NO: 26128 - DNA, 121 bp, Artificial Sequence
  Synthesized
  misc_feature (61): n=a or g
ttatgtttattaatctgtccaacacaacagagaaaaaataggatgtaactgtataataacngtaacaaatggaagctgggggttactgagactgctggattgagacatatcctcaggcttt

SEQ ID NO: 26129 - DNA, 121 bp, Artificial Sequence
  Synthesized
  misc_feature (61): n=a or g
agagcaacatcaggtcagactgaagccatttgtgttcagttttgcaaatgcaagtttatcncgtcccacagaggagactgcaaaagagctctggtggcttttggactgaatttacagtcag

SEQ ID NO: 26130 - DNA, 121 bp, Artificial Sequence
  Synthesized
  misc_feature (61): n=t or c
actgagtaacttgctatgtagctggaaggaactgctcatataagaccatacatgtgcagangaacttacagaatgaggtcaagtgatgtacagcaaattgcttggtttcctttggagatcc

SEQ ID NO: 26131 - DNA, 121 bp, Artificial Sequence
  Synthesized
  misc_feature (61): n=t or c
taagtaagagtcccctcagtcttgtctcctcaaggctaaacaaacccagttttgccactgnctacttatttgttttatgctccagctcctttctgaattatatgttcctcagaatggattt

SEQ ID NO: 26132 - DNA, 121 bp, Artificial Sequence
  Synthesized
  misc_feature (61): n=a or c
ctcaatgaaatagtggggcagagactaaactcttttctctcctgcagctaaagctgctacncaaggcactcttggctgcagtttgctgttgccccctgagctgggccaagggaggaacgag

SEQ ID NO: 26133 - DNA, 121 bp, Artificial Sequence
  Synthesized
  misc_feature (61): n=a or g
tgaaaacatggtactggattacagctttagctgaggaaaggaatggtagcacaataaattnagtcactcattccttgcacaaattaagagagtttctgtcttaaactttttaagtcatgtg

SEQ ID NO: 26134 - DNA, 121 bp, Artificial Sequence
  Synthesized
  misc_feature (61): n=a or g
gatgtgtgtgttttaataacagtatggatggtcagtttaaacatcatgctcatgaataagnttttactggatttaaatcaatgttactaaattgaactcagtagctgttgttttgcagtac

SEQ ID NO: 26135 - DNA, 121 bp, Artificial Sequence
  Synthesized
  misc_feature (61): n=t or g
tgaatccctcaaagcactagccatatgctagaaaatgcaccaaagcgaagaccttatgaanacctcttcagtccagcaccttctggctacatccacaaactgataacctggatctccaaat

SEQ ID NO: 26136 - DNA, 121 bp, Artificial Sequence
  Synthesized
  misc_feature (61): n=a or g
caccgggagctccctgagagcttaaccgtggggtaacggcagtggggattgaagtaaaggntacagcaaggagaataacgcaagagtgcaaaagcagcaagcaggagaaaagattgctcag

SEQ ID NO: 26137 - DNA, 121 bp, Artificial Sequence
  Synthesized
  misc_feature (61): n=a or g
gaagcttttgtgaacagttgctttctctttgactcaagatgtataatgagttgtcctcacntattgtaatagtggatgttgtgcacagcacatgtactgtaacgtactgctggaaaactta

SEQ ID NO: 26138 - DNA, 121 bp, Artificial Sequence
  Synthesized
  misc_feature (61): n=a or c
ggaggctgtgtgtgtgagagctgcagtgtctcagttatctggtgaccctggcaccagcccncacgtgaccaaggtggatgaagaatgggctcacactaaagctcacgacttggagacagaa

SEQ ID NO: 26139 - DNA, 121 bp, Artificial Sequence
  Synthesized
  misc_feature (61): n=t or c
cacaggcaaaaccatggcagttagtgctgctcattaggatctcaaggtgacatgatattgntgagtaattttaatgggtcctgattcatctggtccttcccacttgcttgtttctccactc

SEQ ID NO: 26140 - DNA, 121 bp, Artificial Sequence
  Synthesized
  misc_feature (61): n=t or g
tgactgcagagactgatcctcctggtttctttccaattgcaggaaaggtgttgacctgtgnttccctctctgttaatcttctatcagcctttcattctcttttgcttagcatgacattttc

SEQ ID NO: 26141 - DNA, 121 bp, Artificial Sequence
  Synthesized
  misc_feature (61): n=a or t
gtccctttctccctgtgcaaggtcacattcgtacatgcagggactgacacaatttgcctcngtgaattcctcaatatgttaactactgaaacatttaagctaattaattctgacataatag

SEQ ID NO: 26142 - DNA, 121 bp, Artificial Sequence
  Synthesized
  misc_feature (61): n=t or c
acccagggctgcagggtcaggcaggagcatttccttcatggggaaaaatggtaggaggtgncactgaagtttgccatatatcctgtttgcttgagcagaacctgaggaacagacagtatgg

SEQ ID NO: 26143 - DNA, 121 bp, Artificial Sequence
  Synthesized
  misc_feature (61): n=a or c
cacagggctggctgtgtcctacatcacatcaaaagataaagttggagctcaaacaggactngctcctaaaattggctatgtgccctcccatccaccaaaatacttaaaatgcttctatcct

SEQ ID NO: 26144 - DNA, 121 bp, Artificial Sequence
  Synthesized
  misc_feature (61): n=a or g
aaagccacagtctcaaagcagtttcagagcactgagacagggagaaatcccatgctccaancatgcaggcttgatgctggacctctccatgacagaagagagattaatcccccaaatatgc

SEQ ID NO: 26145 - DNA, 121 bp, Artificial Sequence
  Synthesized
  misc_feature (61): n=t or g
agcaattataccacattttattttccatcttcagctgcacattcttctataggaatcaacntatctctactatcagcatattaaagtatttctctttgtaaaatctttaatagaagagaaa

SEQ ID NO: 26146 - DNA, 121 bp, Artificial Sequence
  Synthesized
  misc_feature (61): n=t or c
ttttttaatttaaagttatctgtatggaaaacatgctcttgagtgtcttaaaaagtcttgntcagttaggaagtcatgggtaaagagcaaacaaaggataagtagaattaaaattaatact

SEQ ID NO: 26147 - DNA, 121 bp, Artificial Sequence
  Synthesized
  misc_feature (61): n=a or g
ggttgggtaatttatttcaccagcaggcttctgcctgtttatgcagtatatcccaatgganattaattagccatattaaaaattgcaagctaaaaataaaacatccctgcagatgctatct

SEQ ID NO: 26148 - DNA, 121 bp, Artificial Sequence
  Synthesized
  misc_feature (61): n=a or g
ctagaacaaacacatataaatggaccatgaataaatataagctggagatgagagaaaaccncccaaccaacaagagtcctggaacggctttctgcggagcagtgatggggagagagagatt

SEQ ID NO: 26149 - DNA, 121 bp, Artificial Sequence
  Synthesized
  misc_feature (61): n=t or c
gcagtatatccctaatggttcattctgtggtaaaggtgaaagcatggacctgtagaagtangggacagctatggacagctaatggagatgagtacacatgtcctatgcattaatattcaga

SEQ ID NO: 26150 - DNA, 121 bp, Artificial Sequence
  Synthesized
  misc_feature (61): n=a or g
acggcttatggtgtacagcccatctctctaaccttatatctctagggggctacttaaaatntttttgtagaatataaagatgcaatactgtgctcgcaaattcttaggactgcttgtggta

SEQ ID NO: 26151 - DNA, 121 bp, Artificial Sequence
  Synthesized
  misc_feature (61): n=a or g
agaactcgtgtcaaaatcccttccagatgtggaggtgctacctgatacctcggtcacagcncagacctgagctcctgctctgttccaatgagctgggctactgaaagagcaaaaatgcaaa

SEQ ID NO: 26152 - DNA, 121 bp, Artificial Sequence
  Synthesized
  misc_feature (61): n=t or c
tccagagatatggagcatggaaggagagcatctgcttctttagaggtatctggccaagganccttttcaacaccacacgggataataagaatggaaggaacccacaaagaacatgcaggag

SEQ ID NO: 26153 - DNA, 121 bp, Artificial Sequence
  Synthesized
  misc_feature (61): n=t or g
aatgtttggtaggattttagcactatatggcacatagtcattccaatggatgtagaaaaantttagtagcagatgtgccttctcatggccacagaggtcacagtcctgagggcagtgactt

SEQ ID NO: 26154 - DNA, 121 bp, Artificial Sequence
  Synthesized
  misc_feature (61): n=t or c
ccttcttgttgcctctgttttgtatggaaacatttgaaattctacgtgcaaaagtaagcanatgtatatacatacaaaaagagatttgcagaagacttatttcacagcagtgcagctgtgg

SEQ ID NO: 26155 - DNA, 121 bp, Artificial Sequence
  Synthesized
  misc_feature (61): n=t or c
ctggggacagatggagcccaaaagacccaaataatgtgtatttcataaatgctgagcaacntcagggggtgtttattgtgtctgtcatactgctgctgcttggaagtgtgcttgctgggtt

SEQ ID NO: 26156 - DNA, 121 bp, Artificial Sequence
  Synthesized
  misc_feature (61): n=a or g
ttcccacatgcagatagcagcagtctatcctaagatgcatcagtagccctgaggaagtccngcagccttaaccctgaacagaagtttctgcaatggattctgcgtcacgctggctggctta

SEQ ID NO: 26157 - DNA, 121 bp, Artificial Sequence
  Synthesized
  misc_feature (61): n=t or c
aatacaatgtgtttgagatgggggaaaaaagaaaaagaagcaaacaacagcactgctactntttatggtcggcagaggggagaacatcagacactgctccctatgatgtgttatgttggat

SEQ ID NO: 26158 - DNA, 121 bp, Artificial Sequence
  Synthesized
  misc_feature (61): n=t or c
caataatgaaaacattacattaaaaaacataatatttcaaatataaatttaatttttaatnggtcttcctagcatcttaatattggagctcaggtggaccgaatgcataccaacggttatt

SEQ ID NO: 26159 - DNA, 121 bp, Artificial Sequence
  Synthesized
  misc_feature (61): n=c or g
acacatttgtccaaccagttgagctttctacaccactcctcactcactgagccatatttcntagctgcaagcaggccacagcctactgcaaacatatacatacatatatatctgcacacac

SEQ ID NO: 26160 - DNA, 121 bp, Artificial Sequence
  Synthesized
  misc_feature (61): n=a or g
cctgctcttttctgtatcatggaactgtgggcttttatattgctttgaacgcatcttttcncatgaaaaaaacacatgggatagactgttggataatctctttactaatattgtgttttga

SEQ ID NO: 26161 - DNA, 121 bp, Artificial Sequence
  Synthesized
  misc_feature (61): n=t or c
atataatctcaacaaagtttttcacatatgtataatgaaaatcttccatacgaatgatcanatggcaatcgtggattgttattaacttctcaaaatgcttacgtgttctctgtattcttgt

SEQ ID NO: 26162 - DNA, 121 bp, Artificial Sequence
  Synthesized
  misc_feature (61): n=t or c
tattgcttgtgtgcacgtaaactaatgtttgctaactacagtcacaagccacacatttcangctgcatttacaactgaaccaagtcaggttcagctctgatcatcttctaaaatttctgct

SEQ ID NO: 26163 - DNA, 121 bp, Artificial Sequence
  Synthesized
  misc_feature (61): n=t or g
acagaaaggctgaagctttccacacagataaagttgatggggtgtgtgtagtaacattganctgcccttgcgtagggcttgtgtgtttgggattctgttgtacgtggaagcctaggaaata

SEQ ID NO: 26164 - DNA, 121 bp, Artificial Sequence
  Synthesized
  misc_feature (61): n=a or g
gtgtatgtttagctgctgcccgccctaccaccagcagcaaaatctatcacattacaagccntgtattttatgaccacaattattctacaacctttgtctctaataatgtgataaaattaat

SEQ ID NO: 26165 - DNA, 121 bp, Artificial Sequence
  Synthesized
  misc_feature (61): n=t or c
ttatgctcatgttagcccaagtatggttatgttgttactactccaacaccttgtactgcangcgataatcgagcattagtgacagacagctctgctctgatttactcagggcaactgtgcc

SEQ ID NO: 26166 - DNA, 121 bp, Artificial Sequence
  Synthesized
  misc_feature (61): n=t or c
taatgtatacaactttcactggataaggcagctgttgtaaattgttgggactgaccagttnattatgcttcctcgtacaaagaagaaacagaaaagactttactggcaatagaagtccctt

SEQ ID NO: 26167 - DNA, 121 bp, Artificial Sequence
  Synthesized
  misc_feature (61): n=t or c
ataagctacaataaccattatatgtgttctcataacttcacataacctacttatattcttnacagcagctttgcatttatgaatggcaccgagtgaccctcagagtttcaagcagattaaa

SEQ ID NO: 26168 - DNA, 121 bp, Artificial Sequence
  Synthesized
  misc_feature (61): n=t or c
cgagcgcggctcggtgggggcatttcggacagcagtggggctgctggcaaagcgactgtcntccaggtgaccggagaagtgcctttgcaccgggaacgttaataaacataaacgagagttt

SEQ ID NO: 26169 - DNA, 121 bp, Artificial Sequence
  Synthesized
  misc_feature (61): n=t or c
atccttttcttcacagagaaggatcttgtagctggtaagccatgcttctattgtttacagngttcttagatacagggtgtatgggaatttattgaacttggatggataaacccttttctat

SEQ ID NO: 26170 - DNA, 121 bp, Artificial Sequence
  Synthesized
  misc_feature (61): n=t or c
ctgagtatgagctttcgctgcagaactttaggaacctcattggattcttcgtttaaagacnagctgttatagtctctcttataaccagtactcagaaatacatctccaaagggaaaataag

SEQ ID NO: 26171 - DNA, 121 bp, Artificial Sequence
  Synthesized
  misc_feature (61): n=a or g
gtcgactgcactattatgcatgcatgggtaagtgtcaacacttgtcaaagcctcctgattnttatcctggaactggaagaaaattttgagatagacaagcttgtgttaaggggaagaggca

SEQ ID NO: 26172 - DNA, 121 bp, Artificial Sequence
  Synthesized
  misc_feature (61): n=a or g
cgaataaattaagcattatttggactaataaatatctgtattggtgggtaaattggtagcnagcttccagatctgtgtaaactagttgatagttgattgggaggtaggtgccattttcagt

SEQ ID NO: 26173 - DNA, 121 bp, Artificial Sequence
  Synthesized
  misc_feature (61): n=a or g
ttactgaagacacactgaaaacaacaccaaatctcaaattattttaacaagaaacgtactntgggtaaacaagcctaatgattgcattcactggtcagtcttccaccattcttgatttctg

SEQ ID NO: 26174 - DNA, 121 bp, Artificial Sequence
  Synthesized
  misc_feature (61): n=t or c
ggataagctacagattgaaatttaaaattcttgaaaagaaaggaagtaaattcctgccaangcacccggaatacattggctttctactgttgttatttgtgcacataaattactcagtttc

SEQ ID NO: 26175 - DNA, 121 bp, Artificial Sequence
  Synthesized
  misc_feature (61): n=t or c
aactggaaacagcgttctttaaaacacacatataaagtagcatatactgcagactaagtangaatgccatctgacaccacccttctccttccactatgtaagttcagtttctggttcaaaa

SEQ ID NO: 26176 - DNA, 121 bp, Artificial Sequence
  Synthesized
  misc_feature (61): n=t or c
atcacagcagcagttatagtgggagaaagaaggccaggagcagagctcaaagctcagcctngcctgtgcggctctcagatgattgccaacagtcccatcagtgccttttggaaacatttag

SEQ ID NO: 26177 - DNA, 121 bp, Artificial Sequence
  Synthesized
  misc_feature (61): n=t or c
attcttatgtccttccttctccaactgctgatgtacctctctaaatgggcatcacctcaantagctactgccttcacctttttaggaaagctttttatgaaccaatatttaatttggggat

SEQ ID NO: 26178 - DNA, 121 bp, Artificial Sequence
  Synthesized
  misc_feature (61): n=t or c
aaggcagaagcaagacaagcagctagtcccatacacatctgcataaaacaaagtgcagaanagcttccatgagtcacaaagcgagacaggtgacattactggcaattaattaccaacctga

SEQ ID NO: 26179 - DNA, 121 bp, Artificial Sequence
  Synthesized
  misc_feature (61): n=a or g
tggcataggaaatacaaaaggcaaaaccagacaatccagtaaatggaggaacataggaaangtctttcatacagactttatggtgggctgaggcaaacttgggtgagttatccacagtcta

SEQ ID NO: 26180 - DNA, 121 bp, Artificial Sequence
  Synthesized
  misc_feature (61): n=t or g
gtaacttttgagggaagtgctcagtttgccttgaaatgttgttttaaagtactaaaatgtnctctaagccgtgattttaaagagtaccaaccaagcagaaggaaagaaaaccccttcttga

SEQ ID NO: 26181 - DNA, 121 bp, Artificial Sequence
  Synthesized
  misc_feature (61): n=t or c
tcaggaaggtttttgctcaaacacactgcactacttagggatgttcatgtcaacaacgaanagcctggccatgatgttttggagatgctcttcttagtatgaatgtctgcagtggatgaga

SEQ ID NO: 26182 - DNA, 121 bp, Artificial Sequence
  Synthesized
  misc_feature (61): n=a or g
tgtctgcttgcagtaggtagtttaattggaattatcgtgtgtcagctactgcatgtcagcntgctttttcagatgtttacaaagagtaggttagggtaactgacccagggtgggtaaaaac

SEQ ID NO: 26183 - DNA, 121 bp, Artificial Sequence
  Synthesized
  misc_feature (61): n=t or c
cagagaattctttcaggatctgtcacagcttcacacatcgttgtacaatgggttattttgnttgacttaaattctgactcttaaatcctgatgtattcgggattgattcaagctcacaggc

SEQ ID NO: 26184 - DNA, 121 bp, Artificial Sequence
  Synthesized
  misc_feature (61): n=a or t
acgacatcagctggagtcggagcttccatgcggagctacaaagctgttccagttgtaccgnggtacaaagtatattgccaaagtagtgcagccatcgactaccttgggattggcctggtag

SEQ ID NO: 26185 - DNA, 121 bp, Artificial Sequence
  Synthesized
  misc_feature (61): n=a or t
ttccagttgttattgggccttttgttagcagagaaagcaaagaactcaattttacacagcnagagaagaaaatgtcaagttgtttgaaaaggaggagcaacatacagtcacagaatgggtt

SEQ ID NO: 26186 - DNA, 121 bp, Artificial Sequence
  Synthesized
  misc_feature (61): n=t or c
ttgacactgacaagaaggccaagagatttttcagctgacagaggacggctccgggtttcanggctttcaaaaagcaaaggccagctccagttcagtgtttgagaacaccagacagactggt

SEQ ID NO: 26187 - DNA, 121 bp, Artificial Sequence
  Synthesized
  misc_feature (61): n=a or g
ctctgaacccaccctacctcaatttccccatacaacagaattgaaccctcagcagccatgngactctctgtagtggggttgagttgggcttaacaccccctctccccccccccccaactca

SEQ ID NO: 26188 - DNA, 121 bp, Artificial Sequence
  Synthesized
  misc_feature (61): n=a or g
tgacacaaaggcattttcaaccctcaaactacttggatttgcagttcaacacagcaggtgnaaaatggggagcatgcacttgaagttaggcaatgcaaagtttcctatcagaagaaataac

SEQ ID NO: 26189 - DNA, 121 bp, Artificial Sequence
  Synthesized
  misc_feature (61): n=t or c
tcaacaccctctgccatggaactctactgatgcatctctccttcaggtcagcagcactgtnctctcaccttgcttcccctgtatcaaacgtgtgactgctgctctgaaagatgcgtccaag

SEQ ID NO: 26190 - DNA, 121 bp, Artificial Sequence
  Synthesized
  misc_feature (61): n=c or g
aaaatatagcaataaatagtgccaagctcctagaaaattcccctaagtaataaaaaggaantaccctccccacaatatgcagcataaatcagagaggaagcattacctcctggacattaac

SEQ ID NO: 26191 - DNA, 121 bp, Artificial Sequence
  Synthesized
  misc_feature (61): n=c or g
gatcatggaatcctaataatactgaggtgtgaagtcggagaacaaatctgacattcctggntgttagtttgtgtatcctgaactcggttttagagaatgctctatagatacaatgactccc

SEQ ID NO: 26192 - DNA, 121 bp, Artificial Sequence
  Synthesized
  misc_feature (61): n=a or g
tagtagtgataatccagtttccttcagaaacttgtataacatggtgttttaattcctgtcngttgtattatgcctcttattctctttcacttggtgtttgcatagaattgttttctctgat

SEQ ID NO: 26193 - DNA, 121 bp, Artificial Sequence
  Synthesized
  misc_feature (61): n=a or g
tctgcataggaactcacagggatctactacttttctgtataatctgtcttcagttgtaatntccattagctaaaagcactcatagggttttataatgttaccttaggacaccgagttctat

SEQ ID NO: 26194 - DNA, 121 bp, Artificial Sequence
  Synthesized
  misc_feature (61): n=t or g
ttgagtacattcatttgcagacagcttgagaagaaacactccatggagttgaattcacaanggggaattaatagagtatagaacatacttgtaactatcaaaatggatttataggcaaaag

SEQ ID NO: 26195 - DNA, 121 bp, Artificial Sequence
  Synthesized
  misc_feature (61): n=a or g
cagggattatctagaaacaagaatggaagcacctttgttaattccaggttgttagatgtgnatataaagccattctacatcactgtgtgccttctgcattcccttgtcttttgaacgtagt

SEQ ID NO: 26196 - DNA, 121 bp, Artificial Sequence
  Synthesized
  misc_feature (61): n=t or c
cttaatgcccatggactggctgcattaaactaaactattacaaatgcctgtttgtaaaacncacgtatgctgagcactgttcttgataattctctatgtgaaattaatatcatcagtatat

SEQ ID NO: 26197 - DNA, 121 bp, Artificial Sequence
  Synthesized
  misc_feature (61): n=a or g
agcatacagatacactgaatgctgtgaggtcctgggaagtgttactcttgtcacacaactnctaaggatgacaaataagttgatcaaaacaatgtggggtttttttttaatgaaatccagg

SEQ ID NO: 26198 - DNA, 121 bp, Artificial Sequence
  Synthesized
  misc_feature (61): n=c or g
atctacaacttgctgttggaaggaagggttttacaatctccatttcaagtatcagaccttnggtgtccccctcttggaacaccgtggctggagagcaccctgggctcgtttcagagatgtg

SEQ ID NO: 26199 - DNA, 121 bp, Artificial Sequence
  Synthesized
  misc_feature (61): n=t or c
tcacagctttaggaagtgtttttttcaagctgagctgtgtttcttgaattcttggagctantatgctttggatgatatcaaacagtactaaaaatccaccacagcccctgctcctcactgc

SEQ ID NO: 26200 - DNA, 121 bp, Artificial Sequence
  Synthesized
  misc_feature (61): n=a or g
atgatccagcagttgagaacagaaacatcagtattaatcatttccgttataaaaagttacnttacatggatattctcttagactcactgtgaaacggttcctacacaaatattaattgaac

SEQ ID NO: 26201 - DNA, 121 bp, Artificial Sequence
  Synthesized
  misc_feature (61): n=a or g
gtgggatgaatcagattattgtgcagtcaggtatgcagtagatttggcaaaaggtaagtgncagcaccatgggatctgagaggatcgcgtggatgtggcagcagagggatgaaggggcagc

SEQ ID NO: 26202 - DNA, 121 bp, Artificial Sequence
  Synthesized
  misc_feature (61): n=a or g
tctagccatttgctgtcagggcagtagaggaagacttgtagcagcccttggaagacgggangggtggctttcttatttatccctggtctgtagcaggtaagggacaagaaggagtagattt

SEQ ID NO: 26203 - DNA, 121 bp, Artificial Sequence
  Synthesized
  misc_feature (61): n=t or c
tcatgaccatcacagaggtcacagcatggggggagaagagcacttcatcgatttcaccacnaaacattctggaataatggcttttcaagcagccgatgttaaatagatatgaaaagataat

SEQ ID NO: 26204 - DNA, 121 bp, Artificial Sequence
  Synthesized
  misc_feature (61): n=a or g
ttctacatgcctctctataaacaagctcctcttctaacatacaaacttaccacctagatgnaaaaaaaagagcaaaaattgcaaagttggcaatagctgctatctctcagacttacagaat

SEQ ID NO: 26205 - DNA, 121 bp, Artificial Sequence
  Synthesized
  misc_feature (61): n=t or c
gggaacattacttaagaatttttattgcaatcagaaaaaaaatctcttacttcaacggttnggacatagagacatcagcactgtactaagaactgcccatgacaaatgactgatagaaaat

SEQ ID NO: 26206 - DNA, 121 bp, Artificial Sequence
  Synthesized
  misc_feature (61): n=c or g
atttcatttcacatggtccttcttttagatacgtgcttagaggtgttggggacattgtgantgcttgctctgtagtctgagcattcagaactgaagctgagattgtgtcctttcaaggagg

SEQ ID NO: 26207 - DNA, 121 bp, Artificial Sequence
  Synthesized
  misc_feature (61): n=a or g
caaacgggtccattggaaaaagagtggcagggggtgtcagagggttttttctgctgcttcnccatcttttctcccagaggcactcataccagagtgcccggcgttgcactggacgttgtcc

SEQ ID NO: 26208 - DNA, 121 bp, Artificial Sequence
  Synthesized
  misc_feature (61): n=a or g
gtctaggccagtaaaagttaatgtaaatgcatgacagacttagaacactgagtgcaaaccnctctgaggtagaacaaaagcaagcctttgcactgacatgaaggtatcttgatactgctag

SEQ ID NO: 26209 - DNA, 121 bp, Artificial Sequence
  Synthesized
  misc_feature (61): n=a or g
gtctagctatattgatgctggaaagcaatgttttggctgctggggctggtatttacatttnaagctgaaatgcctgcttctctgcttggagatgaggttgtccatccacaggaactatgtg

SEQ ID NO: 26210 - DNA, 121 bp, Artificial Sequence
  Synthesized
  misc_feature (61): n=t or c
cttgagaatataaatagacaatagcaaataggattaaaagtgtaatagcaccagtgcaacngctagcgaaatactacagccagttctagaatccagctcaaaggcaagcaagacctgaccc

SEQ ID NO: 26211 - DNA, 121 bp, Artificial Sequence
  Synthesized
  misc_feature (61): n=t or c
ccattaatggctatttgtatggtgctggtctgaatactgagaggaggaggaaaggtacagnctttcttttgtgatcggttgattattcttttttttcagacaaacactggaatcagaggtc

SEQ ID NO: 26212 - DNA, 121 bp, Artificial Sequence
  Synthesized
  misc_feature (61): n=t or c
ggattcataatgaccagatctccaagcatcttaggcaaccagttccaaatctgctctcctnggtgactttccttgggctggcacttgggcaccctagataaccaagtcctcccctcctccc

SEQ ID NO: 26213 - DNA, 121 bp, Artificial Sequence
  Synthesized
  misc_feature (61): n=t or c
gttctccactcataaatcctgtattatttctggtactgacacatgttcagtatccaccctncttcctgaacaacctccctgacaatctccaatgctcttcaaggcaaggtaactgagttcc

SEQ ID NO: 26214 - DNA, 121 bp, Artificial Sequence
  Synthesized
  misc_feature (61): n=a or g
tctaatccagcctgtcggactggtgatgcctcaggagcgtagtggagaaaatattaacacncctttctgtagctgggttgcacagcctcagcacggatgtgatgtccagagcaggggaagc

SEQ ID NO: 26215 - DNA, 121 bp, Artificial Sequence
  Synthesized
  misc_feature (61): n=t or c
tttctccccatgcccatatatcatcacaaatatccctggcactggcatatgccccctgtanctaccccaactgtaacttataactgctgtgcacttccatttcccacctttgacactggta

SEQ ID NO: 26216 - DNA, 121 bp, Artificial Sequence
  Synthesized
  misc_feature (61): n=a or c
aatatatgctttttctccaacagacttttgggtctttttgtggctttctccctctctattnctaattcagctttactttccttttctctagaaaagaaccaaccttaaaatgagaagctga

SEQ ID NO: 26217 - DNA, 121 bp, Artificial Sequence
  Synthesized
  misc_feature (61): n=a or g
accagtgcaatcaacagggatttcctgctcccattgagatccaacttggatttctgagctngcgctacacacatttttgtcttgctagcatttgcaattaaattaatctcagcttcttcca

SEQ ID NO: 26218 - DNA, 121 bp, Artificial Sequence
  Synthesized
  misc_feature (61): n=a or c
cggttgtgaaggtgataagacaacgaaccagaagtgcacctcttaaacagaaacagccgtntgttgacatgcaaagaaagtaattcctttgaaggaaactattgcagcttttcccgcccct

SEQ ID NO: 26219 - DNA, 121 bp, Artificial Sequence
  Synthesized
  misc_feature (61): n=a or t
aaggacatagtgtaacaggaaaaatttaccaaagagttggaatctgtaatatgagtaactntctgttctgtatctcagtgtgcatttttcagcttgctacccaaacacagaaacactgaaa

SEQ ID NO: 26220 - DNA, 121 bp, Artificial Sequence
  Synthesized
  misc_feature (61): n=a or t
aatgctgctcttgcacttactccagtctctgagcaacatgctttgttcttggtaagctaangcaaggaaaggttcttccgctataatcaagtcaatactgtaatctcagtttatcccttga

SEQ ID NO: 26221 - DNA, 121 bp, Artificial Sequence
  Synthesized
  misc_feature (61): n=a or g
agagtcctgacaaaatgagccataaaattacaatatttccaagcactccgtaattctggcncggacggctcttcatcacggaatctgaaagctcagaaaatataaaactcattagattaaa

SEQ ID NO: 26222 - DNA, 121 bp, Artificial Sequence
  Synthesized
  misc_feature (61): n=a or t
aaacataaaatgcagaagctcctgatttcagttctaattttcaagtcagtgacgtggtacntcaaattaattatcatgtactataattagctatataattcgctataataaaaaataactg

SEQ ID NO: 26223 - DNA, 121 bp, Artificial Sequence
  Synthesized
  misc_feature (61): n=t or c
gcaaaagccgtttgaaactggtaacactgctggactctcagaggaaccaccaattttgccngatgaggttcactcacagggcttcgttgacttcagcaaatctttccgcacaaaggccagg

SEQ ID NO: 26224 - DNA, 121 bp, Artificial Sequence
  Synthesized
  misc_feature (61): n=a or t
gaggcggatttgcccctacccccatgcagtgacaacagcagtcctgttacagcatcacagngggacctgtattcaatccccaacgccatctgcggggttttgaggctacagctatctccca

SEQ ID NO: 26225 - DNA, 121 bp, Artificial Sequence
  Synthesized
  misc_feature (61): n=a or c
gtactcttcaaacaggctttcaccttctcctttagtcccaaccatggtccaggctataccnctggtgggtcctgctcaactgcagtgatgtctgaggccattacagacctctgaagttctt

SEQ ID NO: 26226 - DNA, 121 bp, Artificial Sequence
  Synthesized
  misc_feature (61): n=t or c
ctctgagagcctccacactgaaacaaaatctttgtgcggtccctttcctttggactcgagnaaaagcctttgatgctaccatcaggtatttccacttgtaacaggaattaactcagatgtt

SEQ ID NO: 26227 - DNA, 121 bp, Artificial Sequence
  Synthesized
  misc_feature (61): n=t or c
cgcaccacaactcacgtgagcaagaaggggcagagaaaggccaggttttcttttctttgangaagcaaacaacataaaattaaatacaatgcagctccagcctcattccctcgaccaggca

SEQ ID NO: 26228 - DNA, 121 bp, Artificial Sequence
  Synthesized
  misc_feature (61): n=a or g
ctctgaaatgtcactgactggcgttagaacagagtagaataactgttaaaaaacaacaggnaaatatgtcttgatgaagtgttcattcttcactgaaaaaaaaatataatacagccctcag

SEQ ID NO: 26229 - DNA, 121 bp, Artificial Sequence
  Synthesized
  misc_feature (61): n=t or c
atgtgtgtatttgtacaaatgagaaagtccagccaaacatttcaaaggaatagaagataangtaaagaaaaagaggtatttcttgccagaagtatgtagagtagatacattaagatcagaa

SEQ ID NO: 26230 - DNA, 121 bp, Artificial Sequence
  Synthesized
  misc_feature (61): n=a or g
cacctttgctttggcatttctatgctttgcatgcagaagggggatgggaggaacagcaatnaccaacacaggcattttaggtaatgtacctcaccccccattctcctttttgaatcagaaa

SEQ ID NO: 26231 - DNA, 121 bp, Artificial Sequence
  Synthesized
  misc_feature (61): n=t or c
caccaggatgcctcatgttggggacagagatccgtgaaggccatgccatcccaccagcaangacatatcgccttggaggaacctgtggccataataaccatcacagcccaatgggatgtcc

SEQ ID NO: 26232 - DNA, 121 bp, Artificial Sequence
  Synthesized
  misc_feature (61): n=t or c
ttcactgtgtgagtatcatgatgtagatgtatgttgtaattttgaagggggactctgaggnagtgacagaccaacctccgtgtctgcgttcttaagcatatctgagaatcagaatctaggc

SEQ ID NO: 26233 - DNA, 121 bp, Artificial Sequence
  Synthesized
  misc_feature (61): n=c or g
tatatatattaaaaaagaataaaataatgcatttcctgtttctgtgcttcaggaaatgtantaaatacacgtattaattgattagcaaatacaagacagcttttaatgccaggatcttata

SEQ ID NO: 26234 - DNA, 121 bp, Artificial Sequence
  Synthesized
  misc_feature (61): n=a or t
aaagactagagaagttgaagtcttcactatttcagattttttttcaaatacattgaacaantgtctgccagagattactgtggcaaattcgattcttctttgaacaacagtaaactacctg

SEQ ID NO: 26235 - DNA, 121 bp, Artificial Sequence
  Synthesized
  misc_feature (61): n=a or g
caatgctggttactcctgaaatcacccaaggatacagcctgcctttacactcccaagtctnggccatgttttccagatcctagctattctttacatcagaaagtttgtctaacatgaaatc

SEQ ID NO: 26236 - DNA, 121 bp, Artificial Sequence
  Synthesized
  misc_feature (61): n=a or g
ataaataaagaggctttgctgaatagaagtaatgttgtgcctttccactatgatccttgtnaaatattaacaacactaaatcttttttctactgttttacattaagtgcatgtaaaataga

SEQ ID NO: 26237 - DNA, 121 bp, Artificial Sequence
  Synthesized
  misc_feature (61): n=t or c
agaagctggcagtctaatgacaaaatgctgtgtggctccaagtctatgaacgtgttactgnaagcgcatgagcaacacacctcacccaggcacacaggagtgctgtgacacaagagatgca

SEQ ID NO: 26238 - DNA, 121 bp, Artificial Sequence
  Synthesized
  misc_feature (61): n=a or g
caatagctaccatttccttatccgtcactgttgctttgtaaggatttggctttgtaacagncttcacgtgctgtccaggtgagaggctttgcagtggcagagttttaaccatagctagaat

SEQ ID NO: 26239 - DNA, 121 bp, Artificial Sequence
  Synthesized
  misc_feature (61): n=a or g
cgtggccaatgaggacgggcggaggatcgcagccatcttgaacaatgcccattacctaganaacttgcacttcaccatcgacggggtggacacgcactacttcatcaagcagggcccgtca

SEQ ID NO: 26240 - DNA, 121 bp, Artificial Sequence
  Synthesized
  misc_feature (61): n=t or c
aatgacaaggctctgccaggatggctgtactggtgttaagtattttctgcatccacggtgngacgggatttacacagagtagcttctgattgctgctccttcaaatataacccaaatgcag

SEQ ID NO: 26241 - DNA, 121 bp, Artificial Sequence
  Synthesized
  misc_feature (61): n=a or g
tgtagcatttccatgaagcaaactgttctaactgcttattagtaactgaaaggattcctcnaggcctctgctgttgtttgtatgtatatggagaaaatgtcaatatacaagtaatttgaga

SEQ ID NO: 26242 - DNA, 121 bp, Artificial Sequence
  Synthesized
  misc_feature (61): n=t or c
aagaccaaaaggattcacagagttcttttgtaaaggtaagaagttacgctgtttccagcangtatcatacaacaggtagaaatattggaaatgggaagaaaatttttcctcaggatcttct

SEQ ID NO: 26243 - DNA, 121 bp, Artificial Sequence
  Synthesized
  misc_feature (61): n=a or g
aagaaaagatgctattttttttttccattaaagaaggattaagaagtagcaacatgtggancattaagctatagtataatcactttaaaaaaaaagcagaaagacaagtattgacacagtc

SEQ ID NO: 26244 - DNA, 121 bp, Artificial Sequence
  Synthesized
  misc_feature (61): n=t or c
ttctctcctcagtctttccatctcctcaaaactgagcctaagtttaccaggacggaattcnctaccagaattttcagattcttcatggccaccttcatttatctttacagaaaatggagag

SEQ ID NO: 26245 - DNA, 121 bp, Artificial Sequence
  Synthesized
  misc_feature (61): n=t or c
aacttagttgttctaaatgctttttacattagttactctaaatgctttctacatataaatnagtaatctgagtgtatgtttgtctcagctattgatgttctgtttcccagccccaacttag

SEQ ID NO: 26246 - DNA, 121 bp, Artificial Sequence
  Synthesized
  misc_feature (61): n=t or g
cagagagaatcctatggctaagcagctattcttatgcaaggacattattaaatgatatttngggattttattgcgcactattttctacctataaaatttaatattatgacaagtcaagtca

SEQ ID NO: 26247 - DNA, 121 bp, Artificial Sequence
  Synthesized
  misc_feature (61): n=t or c
tacacagttggaaaataaaattctgcatatagcatttccaaaacttgcatcccttcttcanttcatccctcaaaaatagttacattgacccagaaaacaggaaggagatgaaagaggggta

SEQ ID NO: 26248 - DNA, 121 bp, Artificial Sequence
  Synthesized
  misc_feature (61): n=t or c
tccaggagagaaattttagtgaagtcctttctagctatcatcagtgttcattcagatttanaaatagataaatactctctactctcagcctgttttgtactgaagcaaaggaaagtagatt

SEQ ID NO: 26249 - DNA, 121 bp, Artificial Sequence
  Synthesized
  misc_feature (61): n=a or g
cccctgagatccttacatctttctgttgcatgaagcactgctgttagatacaggcagacantgacacttccttacttgttattaatttcttacaggcaaaattccatctctctattttatt

SEQ ID NO: 26250 - DNA, 121 bp, Artificial Sequence
  Synthesized
  misc_feature (61): n=a or g
caatgtaacattacaaattctaaataaaactgttttgttactatctgctctcctactgcantatggataaatacttaaatgacataaaaactggaagatagaactgatgtgaattatggca

SEQ ID NO: 26251 - DNA, 121 bp, Artificial Sequence
  Synthesized
  misc_feature (61): n=c or g
tcttcttttcttttcgggcaggtttgtgtggccacctgcctcggagcagaaggaaggctgncctcctcctacatctgaccactgacattaggcttgcggggctgcatgacccagcagagag

SEQ ID NO: 26252 - DNA, 121 bp, Artificial Sequence
  Synthesized
  misc_feature (61): n=t or c
atacttcatctttaggcctatcatcaaagaacgctcagcattacaacaagccaaacagccntttggacaacaaatctgtgagggggtgacgtgtgaaggccccggaatcagcagaaatgtg

SEQ ID NO: 26253 - DNA, 121 bp, Artificial Sequence
  Synthesized
  misc_feature (61): n=c or g
tacttgaaaatgagcatcctacaaagccatcgatacgcaagttccaaagtcctcctgaatnctcttctttgagtccacatccaataaactgatgaaagacatgacagcacctgctctgatc

SEQ ID NO: 26254 - DNA, 121 bp, Artificial Sequence
  Synthesized
  misc_feature (61): n=a or g
cagttcagaacttccctgcagcattatgttccactaccttcagaagaaggaacacacaaantcccattagtaagagtgtccctgtcttgttgcagtcattgtaatttttccattctgtcat

SEQ ID NO: 26255 - DNA, 121 bp, Artificial Sequence
  Synthesized
  misc_feature (61): n=t or c
tttaataatatgcatttcaggacacagatggacattatgtttccaattttgcagaatcttntgggttgtaataagcaatccacattctatccaaataaataaagatctttcatctgagctg

SEQ ID NO: 26256 - DNA, 121 bp, Artificial Sequence
  Synthesized
  misc_feature (61): n=t or c
agagcccgaccctgggaggggccttggaaagaagcagcaatgccagctacacaaacccagnacacagaaagaatcctggctactttttcttagcaggtaattttgaattagctgagggaag

SEQ ID NO: 26257 - DNA, 121 bp, Artificial Sequence
  Synthesized
  misc_feature (61): n=c or g
ctcttttcctctctgaccctttcttaccaaagatccaccagctgagccgtggtgcttccgntctgtaagcagcaaggatgcttgtaaaagccatcaacaaaaacttggctttttgcacttg

SEQ ID NO: 26258 - DNA, 121 bp, Artificial Sequence
  Synthesized
  misc_feature (61): n=t or c
catcatgtcctaccatgtcccccacatcccgtgttctcatgtcccccatgtcctaccatgnccccagtgtcttcatgtcacatcctaccaagtccagacatgtccccagtgtcctcacatc

SEQ ID NO: 26259 - DNA, 121 bp, Artificial Sequence
  Synthesized
  misc_feature (61): n=t or c
cagaggaagaaagctgatatgcaatagggttactcaggctaaagtccaaacttcctacagngatgaaaacaaaaaaagtgcttcatttatctcagcaaaatgaaagaaggctggagctaaa

SEQ ID NO: 26260 - DNA, 121 bp, Artificial Sequence
  Synthesized
  misc_feature (61): n=c or g
ttgtttcctctatcttgccctttccagggttactcggttcaggccatctctgagctcccantgttttctcagacatttttagttttttaaagtctcattttgttgctaatagtgtagatgg

SEQ ID NO: 26261 - DNA, 121 bp, Artificial Sequence
  Synthesized
  misc_feature (61): n=t or c
tacactggagagtgattgctatcagcagtaaagaattaatctgctgtagaatttatctttntggctctttctacaggttccaaaaaaaagttcaaacagatgtaagagagtaacagcccaa

SEQ ID NO: 26262 - DNA, 121 bp, Artificial Sequence
  Synthesized
  misc_feature (61): n=t or c
ggctgtcaaggcagaatcattgcaactacagaagtgttttattttctcgtaggaaggttgnacgtatttattttcattcaggccatgctgtccctggaaagttgctgctaagaaccaagac

SEQ ID NO: 26263 - DNA, 121 bp, Artificial Sequence
  Synthesized
  misc_feature (61): n=a or g
aatacagtattctccagctaaattccaagtatcacctaattaatcaactgagtatcacacnctaattaataatgtttattctagctactgcactgtgaacacattgcacatccattagtct

SEQ ID NO: 26264 - DNA, 121 bp, Artificial Sequence
  Synthesized
  misc_feature (61): n=t or c
tggagagatctggaggtaatagttcagaggagaaattcctgacaaattgagcagacacctngggatgttcctgccccacgccattatcattgcacagtatggctgtgcacaccatccttgt

SEQ ID NO: 26265 - DNA, 121 bp, Artificial Sequence
  Synthesized
  misc_feature (61): n=a or g
tccagccagtggttcagcaccagtttggcctcacatcctacttcccaaaccttttcttgcncagtactctgcagcatcccatggggtctggatacttcagagccacaccttcaggactgca

SEQ ID NO: 26266 - DNA, 121 bp, Artificial Sequence
  Synthesized
  misc_feature (61): n=a or g
ctgaacaccttcagaaagacttcagatcctctgctctaaggaaatcccctaaccagcacanggctttaacaacacccatgggcctcagtgagcctgtggctctgtgcagggtgccatgcag

SEQ ID NO: 26267 - DNA, 121 bp, Artificial Sequence
  Synthesized
  misc_feature (61): n=a or g
aagccatgacatgtggcattcacacgcatctgacagatttccatcccaggagcaccttgcntgaaagattttatgggtggagatggatttggagctggatagcatctctggaatcccactg

SEQ ID NO: 26268 - DNA, 121 bp, Artificial Sequence
  Synthesized
  misc_feature (61): n=a or c
ttgaacgctaattagacacagtagcacgctacagggggagagacgcagcactttcagactnccataaccccttacagctatatataggtgtataaaaatatataggtgtatatataggtgt

SEQ ID NO: 26269 - DNA, 121 bp, Artificial Sequence
  Synthesized
  misc_feature (61): n=t or c
tttgtactgattgtactagaaatcgttgtttcttctggttaatatgggtaggttttgaagngctaggagtgtgaactggattgtgaaccagattttaccattgcttttctgctagaatttc

SEQ ID NO: 26270 - DNA, 121 bp, Artificial Sequence
  Synthesized
  misc_feature (61): n=t or c
atatgtcacatgtagcaacagcaaggggttattagtatgaatgacctggcagtcagcctcnttcccaagcctcagataatggatctttttatcctcttcctttccctcattctccttctcc

SEQ ID NO: 26271 - DNA, 121 bp, Artificial Sequence
  Synthesized
  misc_feature (61): n=a or t
tttaattataaaatagctacatgagagaaaaacatcagcttctgaccatgtatccattctntttgctgtaaaaatatgtaatccatattgcctgaactttatttctaaagctgttattatt

SEQ ID NO: 26272 - DNA, 121 bp, Artificial Sequence
  Synthesized
  misc_feature (61): n=c or g
ttggctgctctttccatttaattgttagtgaacagactcttcaggaggttcggagttttgnctggctggtttttgtacactggtagggaataaagtactccaaattgtcaacttcgtaaat

SEQ ID NO: 26273 - DNA, 121 bp, Artificial Sequence
  Synthesized
  misc_feature (61): n=a or c
ctaggataccatttggtggtcaactgtctctagtgcagttgctattacttgctaggctganagacatattagcttttatcccccctaatggttggactaccaaacgttttcctttatttaa

SEQ ID NO: 26274 - DNA, 121 bp, Artificial Sequence
  Synthesized
  misc_feature (61): n=t or c
tttttgtgatggagggtttagctgagtaaattattgcactgagttaataaagtgatcatantggatagttaattagggcttgtatttacacagttcctgtagaaatgattgttttgtagat

SEQ ID NO: 26275 - DNA, 121 bp, Artificial Sequence
  Synthesized
  misc_feature (61): n=t or g
gaagaagatatttctgtatttctatatgagatgtggatgtactaatgccactgtgtaaatnagtttgagacttgatttgataacaaatatgataccagatatctaagaaatggttttacag

SEQ ID NO: 26276 - DNA, 121 bp, Artificial Sequence
  Synthesized
  misc_feature (61): n=a or g
ccttcactttttaaggtttttctccctgcctaaaacataccttgcagttttcaatgcgatnctgccaggaaatggctttgcaggtaagcaaggcaggtttgggtttctttgccagcagtca

SEQ ID NO: 26277 - DNA, 121 bp, Artificial Sequence
  Synthesized
  misc_feature (61): n=t or c
ggaccattagactcttctgtgtggttttttaacttgcattctcttgtgcttgtggtttatngacttaaagtttgtatagattcccaggcaccaaatattttattgagttgaccaactgggt

SEQ ID NO: 26278 - DNA, 121 bp, Artificial Sequence
  Synthesized
  misc_feature (61): n=a or g
tccttgctggcagggtgattcacatcagtgctcaaccacgggcttactgagcttcacagancatttgctatttaagagggatggaaggctgaatgaaaagctgagtcaggatttaaagaag

SEQ ID NO: 26279 - DNA, 121 bp, Artificial Sequence
  Synthesized
  misc_feature (61): n=t or c
tataatgtaatgccacctctgacagccttggcgcctggctgcctgatgaaatattcatggngaggagaagcagtggaacttatctgctccgtattgttcagatgcagcaacttcaagtgag

SEQ ID NO: 26280 - DNA, 121 bp, Artificial Sequence
  Synthesized
  misc_feature (61): n=t or c
ggaacacaactttgccttctagctttctcctgtctctgggcctggtcttactttttggccnttggctgtggtctcatgttgtcagatttgattttcttgcaaatattctactttggagcag

SEQ ID NO: 26281 - DNA, 121 bp, Artificial Sequence
  Synthesized
  misc_feature (61): n=a or g
ccaggactacttcccaaacagagacctcgactgtgccaaacaaagggagcgcttggagacnccgaggagtgcccactaacagccactgtcatgcacaggggctgagccccacggtgctgcg

SEQ ID NO: 26282 - DNA, 121 bp, Artificial Sequence
  Synthesized
  misc_feature (61): n=a or g
ttccattactatttccccaaacttgtgcgagtctcctagctaaacaagggcacggtgcaanttctagcatcctgctgcatgaacctcattaagatcgctcctactcatcctaccctacagg

SEQ ID NO: 26283 - DNA, 121 bp, Artificial Sequence
  Synthesized
  misc_feature (61): n=a or c
caggatctttttttccaactataagctctgaattggtagtgtgctccctggtcccctggtntcatttatcttgtattccttccactcctctttgtgtgtcgcctgttcttctccatttacc

SEQ ID NO: 26284 - DNA, 121 bp, Artificial Sequence
  Synthesized
  misc_feature (61): n=a or g
tctatgccactcaggccataaatgtaaggcattacattcctttctcatctaagtgcaggtngatatctttgtccctaattaaagttgtggtaaattctacatcttgccagcacagagctag

SEQ ID NO: 26285 - DNA, 121 bp, Artificial Sequence
  Synthesized
  misc_feature (61): n=t or g
attgcaacacaagaaaccaaagaacagtaatgtcaagagagttttagatactgacttatcngacagtaatgctggttgacttttttgctgcttgaattgcagaaacatccatctatatgca

SEQ ID NO: 26286 - DNA, 121 bp, Artificial Sequence
  Synthesized
  misc_feature (61): n=a or g
gtgccagtgcctggtctatgtctgctgatctgtcctggctacctacttgtcttggctgctntttcacttgatatttcaagggtactcagacttacgtgtgttatgtgtctgttctgcttcc

SEQ ID NO: 26287 - DNA, 121 bp, Artificial Sequence
  Synthesized
  misc_feature (61): n=t or c
gactgaaataggtttgcacaaatcctccaatcaaatgcttcataacagtgggacagatcanccacctcagtaacacatggcaggaaatacccagtggagttctgggaaggctgaaggtttt

SEQ ID NO: 26288 - DNA, 121 bp, Artificial Sequence
  Synthesized
  misc_feature (61): n=t or c
tgtgatccacctttgtcttccttttgttggtaacttcagaggctgagagccatgcaaacancaacagcgaaatacaaccatctacagaacaaacacagaactaaacaagggagctgtaaaa

SEQ ID NO: 26289 - DNA, 121 bp, Artificial Sequence
  Synthesized
  misc_feature (61): n=a or g
tctgacttcagcgtggcccaccctgctgcttttaacagtaggaataaggaaaaacactganataagtgccaacgtgaacattcttcttgccaggagtaaacattactgtaaagatcaacct

SEQ ID NO: 26290 - DNA, 121 bp, Artificial Sequence
  Synthesized
  misc_feature (61): n=a or g
aggaggggaatggtcaatctctgaagtcagcccttgggagaggatgtgctagtgaaatgcnctgttttgaggtaagactgtagattcaggatttgcactcagatctgtagtaagcgcacag

SEQ ID NO: 26291 - DNA, 121 bp, Artificial Sequence
  Synthesized
  misc_feature (61): n=t or c
tgtacctcttgccaacaactggtatatatctgcagctcatgggctgaaatatgatttaagngtctgtatctttcgcaggctattcctaccagttatatgctatattgtgcagggagggcct

SEQ ID NO: 26292 - DNA, 121 bp, Artificial Sequence
  Synthesized
  misc_feature (61): n=t or c
ggtctcaatcttacttttataataaaatcacacacgacagtggaatgtccttggcataagngttcagatgtccagcaaataaacctgtaatcataaacacatctactagcatctaatttga

SEQ ID NO: 26293 - DNA, 121 bp, Artificial Sequence
  Synthesized
  misc_feature (61): n=t or g
cttcaaaaaaaagcaaaaagcagttctaggcactgctctggattggttgactgtttctttngttataatccccttgaccaagcattcaaggcttgtgaagggcttggagaatatttccttt

SEQ ID NO: 26294 - DNA, 121 bp, Artificial Sequence
  Synthesized
  misc_feature (61): n=c or g
aggaggcaggaagctctgctgctgttgaggtgctgggatagggatgctgctttgcacctgnaaccattccaggagaaatcctaacttgtgtcctagaccttcccttatgtggccaccactt

SEQ ID NO: 26295 - DNA, 121 bp, Artificial Sequence
  Synthesized
  misc_feature (61): n=t or c
gcatcaccaccaccaccaccgctgccaccggcggaaagagaagaagcagaagtccttgganaggaccacacatcagctggccgatggggaagctggtaagagctttgtgtttaacgagggt

SEQ ID NO: 26296 - DNA, 121 bp, Artificial Sequence
  Synthesized
  misc_feature (61): n=a or g
cctcagaacaacactacagagaaatgccacacagaaacccccttgaatacatgctacttangattatttccaagcaagtgctgaaatagcaaggaattcaagttctcttttcctaactggg

SEQ ID NO: 26297 - DNA, 121 bp, Artificial Sequence
  Synthesized
  misc_feature (61): n=c or g
caccttgtgtgctgtgccaggctcagctccggcagagaaattttgccccatttctgagatnagggttctggactttcacaatgctcagtcctcagcaaagtcagaagggacacggggtgct

SEQ ID NO: 26298 - DNA, 121 bp, Artificial Sequence
  Synthesized
  misc_feature (61): n=a or t
ttcaagacataatggaactgtttgcttaacaaacaccatagccctaggtttataagaagcncatcatatttgttctggaatgctacattccaatgaactttgatatcctacttggaaggac

SEQ ID NO: 26299 - DNA, 121 bp, Artificial Sequence
  Synthesized
  misc_feature (61): n=a or g
agaagcatatcacagaaaggatgaaagagtaaagtgtttttttttgcagtaaatttcaganaactgaaaacataacacaattagacacatcagggagccacaatgaataagagaccatttc

SEQ ID NO: 26300 - DNA, 121 bp, Artificial Sequence
  Synthesized
  misc_feature (61): n=a or c
actgtctcataaattgcactgataaatcacttgacaaagaagtaaacttgtcattgttcanattgggtagctggtcagtaatgaatcagaggctggcgagcaacagagatatccttatcat

SEQ ID NO: 26301 - DNA, 121 bp, Artificial Sequence
  Synthesized
  misc_feature (61): n=t or c
ttgtaaataataatgactaaaagaggggtactgtcctgtttcaagctgccacatcacaccncaaaattagctcctgtacagtgacgtgtctgcgcaaagaaggatggtgcaagaggaaagc

SEQ ID NO: 26302 - DNA, 121 bp, Artificial Sequence
  Synthesized
  misc_feature (61): n=t or g
ctttccattaaatccacaaagcttctaacagcagacttcatagtatttgatttggtgagantttctcacatttgtggatggatttatctgcccccctaccccacccccataccttttcagt

SEQ ID NO: 26303 - DNA, 121 bp, Artificial Sequence
  Synthesized
  misc_feature (61): n=a or g
ttgcaaagtgctgccctcattttataaaggaaaaggccaaacgtgcagtgatagcagacantcataacactgacttccactgtttagatattgaatacttaataacaggtcttttgtaact

SEQ ID NO: 26304 - DNA, 121 bp, Artificial Sequence
  Synthesized
  misc_feature (61): n=t or c
cgtgaaattagcagtcgagtaatacatatgccgtagccaaaaggaaaacaattagctgcanggatccactgagtttatctactgattctattgcattttcagctccaaatttgatggtttt

SEQ ID NO: 26305 - DNA, 121 bp, Artificial Sequence
  Synthesized
  misc_feature (61): n=t or c
gatggtttctcaagaaatagtttgaaaagagtgaggctgtgcagtgtacactgaaaggtgncacatactaatcactaaatgaactgctgagaatacttttgagaataatattaatctgaaa

SEQ ID NO: 26306 - DNA, 121 bp, Artificial Sequence
  Synthesized
  misc_feature (61): n=a or g
caaagtagtattttagagtgattttactaatttgctttgaaaaaaattaactgaacttcantcatgcaacttcagtacaactgaacataatatatactactaggtgtgttaaagaaaggaa

SEQ ID NO: 26307 - DNA, 121 bp, Artificial Sequence
  Synthesized
  misc_feature (61): n=a or g
cttgagtttctctatgttacaaaaatgagccttattcttagtacaactgagaaatagaccnttgagtagacctgaaaaccccaattaggttttcagcttttccgttcctctctacagagag

SEQ ID NO: 26308 - DNA, 121 bp, Artificial Sequence
  Synthesized
  misc_feature (61): n=t or c
gatggtgatataaaaagctcttgctgaaaatgaagtagaaattgcagggagatgcgagtcncttcctcagagtgctctttgattttactctgagctgatttgggttttccttttgatcatg

SEQ ID NO: 26309 - DNA, 121 bp, Artificial Sequence
  Synthesized
  misc_feature (61): n=t or g
tctctaactgtccaaaaaggccattaatcaaatgagcacccatgacgtgcgtgagatgtgnctgtgtgcgcagccccgtggaaatcagcctcctcacatggcagggcaggagctcagagcc

SEQ ID NO: 26310 - DNA, 121 bp, Artificial Sequence
  Synthesized
  misc_feature (61): n=a or c
cactgtaggaggcccagcagcacccttctctctcccacagactagagccaacagagacctnatgtggccactcctgtccgtgaggcaatctgtagggaccgcatcctaccaagtgcagctt

SEQ ID NO: 26311 - DNA, 121 bp, Artificial Sequence
  Synthesized
  misc_feature (61): n=c or g
gcctttacctttccacatcaccccagtcctgtctgtgcagcaataaagacatgaggatggnaaagcactggctgagacaacctcaggcaggtgttctgcttgctcaagtagagccttgtgt

SEQ ID NO: 26312 - DNA, 121 bp, Artificial Sequence
  Synthesized
  misc_feature (61): n=a or t
tggagctgagggggtgctgggagaacgtgagctcgtggtgtgcattgacagcctgtgggtnatcagcagaactttctgcaaacagaatgtttgttgcaggtcttgaacgttgcacttaaat

SEQ ID NO: 26313 - DNA, 121 bp, Artificial Sequence
  Synthesized
  misc_feature (61): n=a or g
tcggagatgttgcaagacaacagattcagaagcaggggctttcctctacttaattttacangctgattttacattctacttaaaaagttattttacttttcagtttcttaaagtattatgt

SEQ ID NO: 26314 - DNA, 121 bp, Artificial Sequence
  Synthesized
  misc_feature (61): n=t or c
aacctaatagtgtttcacaccttttggttccagagaagttacaaaaagagcagctaaaaanctagtttagacttttttaatactctcgctgacatctgatattggcagatgcattcacatt

SEQ ID NO: 26315 - DNA, 121 bp, Artificial Sequence
  Synthesized
  misc_feature (61): n=a or g
gatattggttgttatggttgttagctcaaactctttatgccacaagatactgagtcctgtnaaagcaaggagtataaaggggaggctctgccatagatctctgcaataggtctctgcagta

SEQ ID NO: 26316 - DNA, 121 bp, Artificial Sequence
  Synthesized
  misc_feature (61): n=a or c
attatctccagagcactgaaaagcaccagaagttgtctttgcatgttaacatacatgtggntgcagcatgtctagtatacatcaactcacctgtcatagatggtgccagttttctttgtcc

SEQ ID NO: 26317 - DNA, 121 bp, Artificial Sequence
  Synthesized
  misc_feature (61): n=t or c
tgctccacttcaaatgatgtacatttacctacaacatgactatattggttggcttccaggntattcatttgcaaagcactttgaaagaactggaatgtaaaatttgatagaagaagccaaa

SEQ ID NO: 26318 - DNA, 121 bp, Artificial Sequence
  Synthesized
  misc_feature (61): n=t or c
tttggcagccacatctggcaattcacatccttcctctgccctgcttgacctctttgtattntatcttccttctgtgcgctttatgatggcagataggcgctatcacttgagaaatcttgct

SEQ ID NO: 26319 - DNA, 121 bp, Artificial Sequence
  Synthesized
  misc_feature (61): n=a or g
tcttaatcatcaatcatggaacattgctgttttgcttgtttctgtcttgagtgaaaacatnagggataatttctcagtgagagaatgaaagcaaaacaagaggtaaacgttcatattgcac

SEQ ID NO: 26320 - DNA, 121 bp, Artificial Sequence
  Synthesized
  misc_feature (61): n=a or g
aaatttaactgtgttaaaaactgtgttcaatctcttatgtgaaaagtaagatactatgctnagttacatattttaaactctaagtgctgtatggccaaaagtccgtatgtctttccttgct

SEQ ID NO: 26321 - DNA, 121 bp, Artificial Sequence
  Synthesized
  misc_feature (61): n=a or g
ttttgttataattctgcatattgttcaaggttgtatgggatgaaaaggattatagacacanatactctttaatttagatatgatcaagttattctgaagaaatacttctgtggagtaagta

SEQ ID NO: 26322 - DNA, 121 bp, Artificial Sequence
  Synthesized
  misc_feature (61): n=t or c
ctttctgcatcccagagaaatagctctactcgcattaagtcattttccagtcattctccantggccttacaaatgagtttgtctcccagcacaaaagcgttcttcagttgtctgaaaagtt

SEQ ID NO: 26323 - DNA, 121 bp, Artificial Sequence
  Synthesized
  misc_feature (61): n=a or g
tctatatatatcctataatgccaacatcatgctcctgctgaggtaaagttatatgccaggnggcaggattgtggtgggctgtatggagactggaaatactgctgtcccgctgctgtttggg

SEQ ID NO: 26324 - DNA, 121 bp, Artificial Sequence
  Synthesized
  misc_feature (61): n=a or c
cctctcagagataagaatcaaggaagagaattaccacctgcagtagataaggactgaattngacattacttgagaaagatccatgcattcaagtccacttgactgaccatatctatggata

SEQ ID NO: 26325 - DNA, 121 bp, Artificial Sequence
  Synthesized
  misc_feature (61): n=a or g
taatgtagcctgtgacaaacaactgtgtaaataagcagtccaaatcaaggaaacagtaacnaagagatggaaaaggatacaaagcagtgatcactgccacccatctcctgtgtgcagcaat

SEQ ID NO: 26326 - DNA, 121 bp, Artificial Sequence
  Synthesized
  misc_feature (61): n=t or g
agaaagaacctgggaagccgcttctcctctcacctctgcaggtgattgacttgcagcgggnaagggccccatgtactggggtaagccctagagatctcacagcatttctcagatgaaagag

SEQ ID NO: 26327 - DNA, 121 bp, Artificial Sequence
  Synthesized
  misc_feature (61): n=a or g
tgcagctgaccatgctccttgcagactgcagacgtgacctgttcaatctggctgttaaatnggcattttgaagcagtgcagaacaaagctgcctgctgggaggagaggtgccaacaatgca

SEQ ID NO: 26328 - DNA, 121 bp, Artificial Sequence
  Synthesized
  misc_feature (61): n=a or g
aaatcagatagacagaatttcctaaatgatattacagcaaaaaaacagcaggtcatccccnatgctatatgctgcccaaatacactgtgagaccgaaccttcctgcatatagcctgaaacc

SEQ ID NO: 26329 - DNA, 121 bp, Artificial Sequence
  Synthesized
  misc_feature (61): n=a or g
gatgagcatagttccagccaaacaaaaactaaaaatcctgcctctagcatagttgttaaangggagagagtgaatatattaaactctgctagaagcttttaatactgtctgtgactgtgtg

SEQ ID NO: 26330 - DNA, 121 bp, Artificial Sequence
  Synthesized
  misc_feature (61): n=t or c
ggatattctgtctatgataaatactactgcaattcatcataccttgatcagatcaatacanagtatactgagggctgcaatccaacctagaacattgtgtaacgtggacaatgaaagcact

SEQ ID NO: 26331 - DNA, 121 bp, Artificial Sequence
  Synthesized
  misc_feature (61): n=t or c
cctgttacacagttcataagatagccacaagaagaaaaacttactttactacatctcctcngagttttatcctgcaaagcttctaagagctaatttttgacttttttaaattaatgacaaa

SEQ ID NO: 26332 - DNA, 121 bp, Artificial Sequence
  Synthesized
  misc_feature (61): n=a or c
cttttaaagctcttgttatcatctggctcttgtaccactgtaagtttatgttaaaatcctntctctcttcaacgaccttcaggttatggtgtcttgataacacaccttaaagttttattag

SEQ ID NO: 26333 - DNA, 121 bp, Artificial Sequence
  Synthesized
  misc_feature (61): n=t or c
agagctgctgcagcttctcgttggcgtagttgatgcagaactgctcaaagctgttgaggtngaacatctcaaacctgtggggcagcagattgctggctggggtaagacacagccatggacc

SEQ ID NO: 26334 - DNA, 121 bp, Artificial Sequence
  Synthesized
  misc_feature (61): n=a or g
gcagatgcctatatatttcacttggaagggaaaataaacgatgttgttcaaaccttgtganatgtacctatccaggtacgcttcctgccagcatgggtgaagttttccattgtgtaaactc

SEQ ID NO: 26335 - DNA, 121 bp, Artificial Sequence
  Synthesized
  misc_feature (61): n=a or g
gtagcaaaagtactggtaattcctctgctgccaagcgtggtattgatgtactgatgctcanaaactgaatcaaggctcttacgttgaatggcaagacaccactgaacgaacgcttttgcct

SEQ ID NO: 26336 - DNA, 121 bp, Artificial Sequence
  Synthesized
  misc_feature (61): n=c or g
gttatatttgatcacataaaatcctgtagctcataagacagggggatgttgatttttgcanacgtggtgatgtagtgacaggagtcagcagcagtttaaccagagtccatagccactctgc

SEQ ID NO: 26337 - DNA, 121 bp, Artificial Sequence
  Synthesized
  misc_feature (61): n=a or g
acaaaacaaaacacaaaaccatgactgttcagatgaatactgaggtatctttgccggctgnaggtttcagtgcgccatgctgtttcactgttattaagacaaaactgagacacagcgacct

SEQ ID NO: 26338 - DNA, 121 bp, Artificial Sequence
  Synthesized
  misc_feature (61): n=a or g
ttcaagatttttatcaaatacatacacagtgggatttgagtacactcccagcaattagccncagacaacatgctgagtagggcagttgacacaataacaccaacaagaaaactgggactgt

SEQ ID NO: 26339 - DNA, 121 bp, Artificial Sequence
  Synthesized
  misc_feature (61): n=t or c
ctctctcttcctttttttgctttattcccagctgagtgactgctaccagggggtggtgttngatggcctggagaccctctttgcacgcagcatggcatctgctctcctctgcctgctcaaa

SEQ ID NO: 26340 - DNA, 121 bp, Artificial Sequence
  Synthesized
  misc_feature (61): n=t or c
tacacaccaatagggacatccttcttaccactggtgatacactaatgtgaggagagcatcntcttactacactgagctatggatatctaactcagaagacagcgtagcttgcataagaagt

SEQ ID NO: 26341 - DNA, 121 bp, Artificial Sequence
  Synthesized
  misc_feature (61): n=a or g
atctatttgggaaagcacctatagctcaaacagagatggttgtactgctttgggatccccntcagaagtcatccatctctgaatgtaaaccagagtcttggtactgaagaaaaactcctcc

SEQ ID NO: 26342 - DNA, 121 bp, Artificial Sequence
  Synthesized
  misc_feature (61): n=a or g
catggatctctctgctttgtcattgccatacagattttcttgacttgcctgcagactctcnaactcttccatttgccatatagcaagagagtgtaaaatacaacgccagtctgtaaaacgc

SEQ ID NO: 26343 - DNA, 121 bp, Artificial Sequence
  Synthesized
  misc_feature (61): n=t or c
cctcgctctctcattgtgttcccaggcactgagctctcgccccaaaataagagggttccantcccatccccttcctgcaggaccaggagttggatttcagcccttccttccaagagttcag

SEQ ID NO: 26344 - DNA, 121 bp, Artificial Sequence
  Synthesized
  misc_feature (61): n=a or g
tcactcaaaactaaatgaacttgcaaaatgtgctttgttaagttgtttttataagtttgcntaaccactgatttcctgtaacagcatgaataaagtggggatgaaagatttttctttttaa

SEQ ID NO: 26345 - DNA, 121 bp, Artificial Sequence
  Synthesized
  misc_feature (61): n=t or c
cagacatagtgtgcttgaatgtgtgctacagggatggtggaccttttgcagacctgctganttccgagtccgtgagaaatacgtaaaagttcaacaggtgtatatcactacagttactact

SEQ ID NO: 26346 - DNA, 121 bp, Artificial Sequence
  Synthesized
  misc_feature (61): n=t or g
tatttctttggttcagtgggaccatcccttctgaacaaattgaaagtgctcaggagtgagnaaagcaatggccccgtgctctttttgtctgtaggtcaaaacccaaccaccagaatttgta

SEQ ID NO: 26347 - DNA, 121 bp, Artificial Sequence
  Synthesized
  misc_feature (61): n=c or g
caaggagataatttctgtttgaaaagaaaaagatgttacatagacctgaactcattattcncatgattcatttttgaaaaacatacatcataggaaagaagctttcctgctttttaattat

SEQ ID NO: 26348 - DNA, 121 bp, Artificial Sequence
  Synthesized
  misc_feature (61): n=t or c
agtaaagtacatttcaattttttatagttttgaccaggatggcaataggggcagcaactgngtgtcagagttcatgtatgcggtataatgggcaggatttgcttttcagggcatgtgaaca

SEQ ID NO: 26349 - DNA, 121 bp, Artificial Sequence
  Synthesized
  misc_feature (61): n=a or g
acatcccttccaactcaagatgtgctgtgatcctacagttctattctatggctttccctcncttggtagctcaggcttcagggtctgcataattaatgtcagtgcaagactgaggtgtccc

SEQ ID NO: 26350 - DNA, 121 bp, Artificial Sequence
  Synthesized
  misc_feature (61): n=t or c
tgcatggttgtatttctaaaatcctgatcagtggatgaaatagagttaattgttctgtagnacagggtcctccattgctctgcctgggattccttccagaatctgtctccgcaaattaaga

SEQ ID NO: 26351 - DNA, 121 bp, Artificial Sequence
  Synthesized
  misc_feature (61): n=t or c
ttgtttcatagggcagaagctttatgtagcattcatgtccaaccatggagccatgctgccngtggttatcttggacttattacctgctgtgtcatcccctttgccccaacaaatctctctt

SEQ ID NO: 26352 - DNA, 121 bp, Artificial Sequence
  Synthesized
  misc_feature (61): n=a or g
ctttgcaggaatccaacccagcaaggagtaggagggcctgtgctgacattgcagtgaccancagtagaccccactcacccatgtctagctgctttctgtagtcccagagctgcagtgcaga

SEQ ID NO: 26353 - DNA, 121 bp, Artificial Sequence
  Synthesized
  misc_feature (61): n=t or c
gaaagaggttgtaaaggagcttttgctcctcccttctggcagtcagagctacggcttgcancttattcatttagatgtaacaaaagggctaattatatcagtatgtgatggggtgcctcca

SEQ ID NO: 26354 - DNA, 121 bp, Artificial Sequence
  Synthesized
  misc_feature (61): n=t or c
tgtacaaagtacttgaaggtaatataagcttattcacataatttgtcatagagcttaatangtactgtttatgcttccagaatcaagatgcattgtataaaaggatgatgctttgccttcc

SEQ ID NO: 26355 - DNA, 121 bp, Artificial Sequence
  Synthesized
  misc_feature (61): n=t or c
acaatttactgatactgaactcttaaaaattcacacttaaaaattcaagacattctgggtnaatttctgagttcccttgtacgctgaaaggttgactgtctacacatagaacacacagctg

SEQ ID NO: 26356 - DNA, 121 bp, Artificial Sequence
  Synthesized
  misc_feature (61): n=a or g
tcatcctgtctacacaatgtcaataagcagatgaaggatcatggtccttctttttgtttcnagactggcctgctgagcatgtcatatcacctgacctaggtcaaccatggaacctgtgtca

SEQ ID NO: 26357 - DNA, 121 bp, Artificial Sequence
  Synthesized
  misc_feature (61): n=t or c
gaatatttgcctgatgtctgaccaaagtacttaaagtgtagagcatgtcctggtgcagtgngcaggttcccagctggaatctacttacagcaatagcataagaaaaatgggagtaaaaacc

SEQ ID NO: 26358 - DNA, 121 bp, Artificial Sequence
  Synthesized
  misc_feature (61): n=t or c
cctgatcgatcttcataactcatctggcccacaaatgtactgtaggagaattaatacgaantgcataattcagtgtgtagtcatcagcaactacttctcttctcctgtctgaactctgctg

SEQ ID NO: 26359 - DNA, 121 bp, Artificial Sequence
  Synthesized
  misc_feature (61): n=t or c
gttgagcaagaagcacctgaagatcagagcagtccattaccagctttccttccactactgnacgtggcagcaactgtgcttgtatcttgtttagctacctcagtttcacatatttaatttc

SEQ ID NO: 26360 - DNA, 121 bp, Artificial Sequence
  Synthesized
  misc_feature (61): n=t or c
tctgcataagaaagatattagttatcagatgacttcaaagaggacgcacaaaatttccacntgaaacaattaatgacgaagatatgaatggacagatttagaagattgaggggagtaagaa

SEQ ID NO: 26361 - DNA, 121 bp, Artificial Sequence
  Synthesized
  misc_feature (61): n=t or c
cacaagttcctctctgggataaaatgaaaccagatacagatgcataaccagtctctgttangctacaaggactcttaacaatctgagcatttatcaacatatgattcacttcaaaacttga

SEQ ID NO: 26362 - DNA, 121 bp, Artificial Sequence
  Synthesized
  misc_feature (61): n=t or c
gagggaaacttgctgtaagtaaggaccacagaaatgctttgttgcccgattattttcaagncatgtgcctgtctccaggacagtttattaagagcaatccataggtaacttgtttctttct

SEQ ID NO: 26363 - DNA, 121 bp, Artificial Sequence
  Synthesized
  misc_feature (61): n=a or g
cttcttggggcttttaaaaatcagtttgctttggttgaaccacctcctgtttgaacacacncacccttctcattgcaggtcagatagatggtactgctcaactagtctctgtacagtgtta

SEQ ID NO: 26364 - DNA, 121 bp, Artificial Sequence
  Synthesized
  misc_feature (61): n=t or g
tagatacatttcagtgcaactttgcctggcatatgtacagtttctgaagagctgggaagangaaatctgattttctactcttccacaagctgaacagaactgtgttcttgtcgttgtttac

SEQ ID NO: 26365 - DNA, 121 bp, Artificial Sequence
  Synthesized
  misc_feature (61): n=a or g
agcttagcagtaaccagaatggtgctgtggtcctgataacagctctgcacacaagtcaagnatggcaggatactgctgctgccctacaagatggacaactctatgctatcagcttgggagt

SEQ ID NO: 26366 - DNA, 121 bp, Artificial Sequence
  Synthesized
  misc_feature (61): n=a or g
gaaaataaaagagaaaaaagcctggttgtactgtctgtatgaaacaaaagtttgcttctcnttctctgtgcagaaaaacaaccctgggaatgctaccagcagccaaaatgagagctgtttc

SEQ ID NO: 26367 - DNA, 121 bp, Artificial Sequence
  Synthesized
  misc_feature (61): n=a or g
taatgatcagcacagataaaaatgttttgatggattgaaagaacagaagcaatccgaatgngttgtcagtggcgaatgaattaccgattcacactgctgcaagttgggaattgaaaggcct

SEQ ID NO: 26368 - DNA, 121 bp, Artificial Sequence
  Synthesized
  misc_feature (61): n=a or g
aaggcttgttcttactttcatgtcttcaaatggttgataacatggtggaaggtctctgatntgctttaaggaacactacacatttgtagaagactctttagtctgtgatgctgattctcag

SEQ ID NO: 26369 - DNA, 121 bp, Artificial Sequence
  Synthesized
  misc_feature (61): n=t or c
cactgaaggggagaacagtttgcagctaggggcactgaagcccttacaggtagatgatggnttgatcaaaggtcatgcttcaaaatgcttctaaaggaaccagcctggctgaaggtctctt

SEQ ID NO: 26370 - DNA, 121 bp, Artificial Sequence
  Synthesized
  misc_feature (61): n=a or t
tgaaatgccttaaggattctctttaccaagtctctgaatacttctgatacggtgattttantcggtggacagcaggtctgctgaatacaaaaaaccggttgagcccttaagattacatcag

SEQ ID NO: 26371 - DNA, 121 bp, Artificial Sequence
  Synthesized
  misc_feature (61): n=a or g
aaagacttctgcaattatgatacgggcgggtcaatagcataacgtaaaaatgttctcaccnaagataatggccaaattttccctcacggttgatgaaatcacatcattgataaagaaaacc

SEQ ID NO: 26372 - DNA, 121 bp, Artificial Sequence
  Synthesized
  misc_feature (61): n=t or c
gttctgcgtatctgaaaaccaaaaaggaaactgtccatcatcttcttcctcgtttcaggangtcttgtgtttctgttaatagagcccctggctcttgctctgtattgacctgcattgcatg

SEQ ID NO: 26373 - DNA, 121 bp, Artificial Sequence
  Synthesized
  misc_feature (61): n=a or g
tataccccctaacagaacgttaaggatgctaaaacaccaggcagctgctggacggtaacangggtatgcaacgcagcagccaggagccctgacagcctcccacagatacctgaggctcaca

SEQ ID NO: 26374 - DNA, 121 bp, Artificial Sequence
  Synthesized
  misc_feature (61): n=c or g
cggctcaggctaaaaagatgcagtgctatgaaatggcagtgacacacctctgacctccccnaggaaagcagtagctctgctgtacactcctgcctgtcattggctgggcgcaaccagatat

SEQ ID NO: 26375 - DNA, 121 bp, Artificial Sequence
  Synthesized
  misc_feature (61): n=t or c
aaaacacagcaattatttaacccaaggagtgaaaagggaagataacagctttccacaaagncaaaaaaggaataatctttttgtacctattgtactggaaaagaggtaatgcatttttggt

SEQ ID NO: 26376 - DNA, 121 bp, Artificial Sequence
  Synthesized
  misc_feature (61): n=a or g
ttttttttttttatttaaaggttcagattttatgttcactgttggaaagatcatttgtaanggattgtttcaggagttttgccttttcctttacagacctgctagaaatttctttatacat

SEQ ID NO: 26377 - DNA, 121 bp, Artificial Sequence
  Synthesized
  misc_feature (61): n=t or c
agttgaagccttgtcccataaatatcctttgtccaggagagggagaaaggctgcagtcttngcaggcaatgacatgaagtacagggccaccatagcagtgtcagtttgattttaaatgaaa

SEQ ID NO: 26378 - DNA, 121 bp, Artificial Sequence
  Synthesized
  misc_feature (61): n=a or g
ttttagggcagccgttgtatatgcacattttcaccagaagacctttgtcatgtccaaaganggaagtgttatggtaccgctgctgttggttgtttttgtgtgagtgctatgcatgtctgtt

SEQ ID NO: 26379 - DNA, 121 bp, Artificial Sequence
  Synthesized
  misc_feature (61): n=t or g
gaagtctgttaggtggtgtttcctggccatctgtattggctcttagatttcccccactgtnaatttcttttcttagatatcaagaaatgtaatcttaccgagctcaaataatgctctaaga

SEQ ID NO: 26380 - DNA, 121 bp, Artificial Sequence
  Synthesized
  misc_feature (61): n=a or t
tgtggattgaaaaaaggaataccttttaagaataataaaagtccattatatggtttgtttngtctgtagaaatttaatgtgagacccatctcatgttcttttatctccatcactgagatcc

SEQ ID NO: 26381 - DNA, 121 bp, Artificial Sequence
  Synthesized
  misc_feature (61): n=a or g
tcacttgtgttatctaaaaggggattataatgacaatgattatgtccaactgagaccaggnaaacaaagtgatctcacagcactgttagtagcgggatacagaggaatgcatcagtaattt

SEQ ID NO: 26382 - DNA, 121 bp, Artificial Sequence
  Synthesized
  misc_feature (61): n=a or g
cagtccggttcataaaagtcaaaatccaaaaggcgattctcatccaagatcgttctgctanaaggaggtcaacatgcagaataataaatttagatatgaaaaactatatgattcgagacag

SEQ ID NO: 26383 - DNA, 121 bp, Artificial Sequence
  Synthesized
  misc_feature (61): n=t or c
gcggggaccccaagacagatggatgcaggccaggtgctgtgcaggcataaagcattacacncctgcacctcttgggaggagcacccacgaatgcagcgcatttcccttggcagaggactca

SEQ ID NO: 26384 - DNA, 121 bp, Artificial Sequence
  Synthesized
  misc_feature (61): n=t or c
gttcttataggaaaagtgaactaaggtcccaagagacatgaggataaattgagacaaatangtatacaggcataaaacacaagtcaacttaattacaattactgatggacctttttgttaa

SEQ ID NO: 26385 - DNA, 121 bp, Artificial Sequence
  Synthesized
  misc_feature (61): n=t or g
gccctgctgctgtctggctaataccttcagcctttgtgcagttcacatttttattgcaatnaccggaattaccacaccaaacaaatgacagctgtcatttgtaccgttccagatgaactac

SEQ ID NO: 26386 - DNA, 121 bp, Artificial Sequence
  Synthesized
  misc_feature (61): n=t or c
acagccgggtgtgtttggtgctgtgtccttaatgctcatggccaggaatctgccgtgtgcngcgcagctgagcgctgctttcctttagtgcttcattgagcatctgttgtgaaacagatcc

SEQ ID NO: 26387 - DNA, 121 bp, Artificial Sequence
  Synthesized
  misc_feature (61): n=t or c
tatatttgtacagaggcaatatgccttaatttgtctacttgttgttgatacagacatgagncccgcttgccattaccgaggtataacgctaaaatacttaacatccaacttaggaaaattg

SEQ ID NO: 26388 - DNA, 121 bp, Artificial Sequence
  Synthesized
  misc_feature (61): n=a or g
accacaaaaccagcaaaagattttctagtttcatttgttcattcctaccattctgaaaacncagaatattcattttcagtcagggtcagttgcgcatctgagaaacactgacatccttctt

SEQ ID NO: 26389 - DNA, 121 bp, Artificial Sequence
  Synthesized
  misc_feature (61): n=c or g
gagcacaaatagaaaatacttcctaagctgtttctacatgttgacctgcctttgctgcttncttgctcacagacacagctgtgaaagggtctgtagtcaacccacaggtgttggtattagc

SEQ ID NO: 26390 - DNA, 121 bp, Artificial Sequence
  Synthesized
  misc_feature (61): n=t or c
tgcataaagtgacacagaagatcacagacttaatttgttgaagtatctgttatttactaangtatcttcttctgacagtactaaaatagctgatgaaatagcgtatcaatttatcactcat

SEQ ID NO: 26391 - DNA, 121 bp, Artificial Sequence
  Synthesized
  misc_feature (61): n=a or g
agtcactattaaatgctgatcgtgactggaaggggagacgagttgtctcaggatgctagcngatgtctatgataggtcaatcagagcagaggattacaggagaaccaaaaaagttgggaat

SEQ ID NO: 26392 - DNA, 121 bp, Artificial Sequence
  Synthesized
  misc_feature (61): n=c or g
tggggttggcaaggcagaatttggtgtgtggggcagctggacataacccacaatggcaaanagtacaactatttgtacatggaatggggttaataaggttaatacgttgggtgcaacacct

SEQ ID NO: 26393 - DNA, 121 bp, Artificial Sequence
  Synthesized
  misc_feature (61): n=t or c
tttgttgcatcagcaaccagagggaggggtttttaataggaaaaaattgttctaaagcccncagtactgaaaggaaaccttggtttgtgtgtacttatcctggtgggaagaggcagggctc

SEQ ID NO: 26394 - DNA, 121 bp, Artificial Sequence
  Synthesized
  misc_feature (61): n=t or c
catcacaaatcaatgaacgccaaggaatcctatatctaccaaaggctacagagaactgttnttactttttgtcatcacaccctctgctggtgattttctactccagtaggaaagttaaaat

SEQ ID NO: 26395 - DNA, 121 bp, Artificial Sequence
  Synthesized
  misc_feature (61): n=t or c
atccaagctgaggggagggagcagctccagctgcttgagaggttaaagagggagaaggcanccaaaccttgtagctgctcatgcccagatactgttctgtagtctgccctcagcctttgtg

SEQ ID NO: 26396 - DNA, 121 bp, Artificial Sequence
  Synthesized
  misc_feature (61): n=a or c
gtactctgttctgttccccttcagtcacaagtgcaaagctgcacttcaggtaaagaaaggnttagcaaaagcttcaggacaagagggaaacagctgtggtgattggaatttagccagtgca

SEQ ID NO: 26397 - DNA, 121 bp, Artificial Sequence
  Synthesized
  misc_feature (61): n=c or g
gctgatagagactgatgaactaggcctaacatgtggacctgctagtactacctggttaaantcaatactcagcacgtagtcaacattccaggtcttgccctcagctattcagagatttgaa

SEQ ID NO: 26398 - DNA, 121 bp, Artificial Sequence
  Synthesized
  misc_feature (61): n=t or c
cctgtttacaccaaggtgaaaaaaatcacatgtaaattaatgaaaattcttcattggcttngataaattttgtgtgagtgtacagagagaagtaagtacaactgaatcatgtttactatcc

SEQ ID NO: 26399 - DNA, 121 bp, Artificial Sequence
  Synthesized
  misc_feature (61): n=a or g
gggggtgcagggttctaacttatatttacctccagaaatgaaacaggaagatctggggagngtggaggtcctattcttttggggtttgttttgtttagtcttttttgttcattttagtctg

SEQ ID NO: 26400 - DNA, 121 bp, Artificial Sequence
  Synthesized
  misc_feature (61): n=a or g
tcaaacaaacagtgtaatctattaaagtcctttcagccctctccctccctgttagcttacnttaaagagcatcactaatatgatatttgtttccacagtgccaaggagcaatgtgcaactt

SEQ ID NO: 26401 - DNA, 121 bp, Artificial Sequence
  Synthesized
  misc_feature (61): n=t or c
gacaggatcactcctagacccagccctgctatcaaatctgtatttcactaaacagtaatcnctttcagtgcagtcatacaacaggtgacacctcaaaatgcgaggccatatactgctcact

SEQ ID NO: 26402 - DNA, 121 bp, Artificial Sequence
  Synthesized
  misc_feature (61): n=t or c
ctcaaagagcacgtctcgaaggcagttctcaaaatctctacactaactctgcacaaagctngaagaacgtaaaatctcctcacctttacaacctctcttgacttggagatacgtggaccat

SEQ ID NO: 26403 - DNA, 121 bp, Artificial Sequence
  Synthesized
  misc_feature (61): n=a or t
caagtaaagcaaaaaggaactcacttcaacatcaattgtggaacatgtttatttcttgcgnctctgaattattcttcccagaacataatcaagatcagttcctgctcaaaacaaaattaag

SEQ ID NO: 26404 - DNA, 121 bp, Artificial Sequence
  Synthesized
  misc_feature (61): n=t or c
agtgctgttatgaactgaattacacatgcgtagacatccaggcaagccaaatccagacacntgtgttgaacgatgttgctaaaggtaagtgaagaacatgcaccaaccttcgacatctaat

SEQ ID NO: 26405 - DNA, 121 bp, Artificial Sequence
  Synthesized
  misc_feature (61): n=c or g
atgctttgcaggaatttgcagagattttgcaattttagcattttaccacatacacagcaantgaaggcagcaacagaatagtaccacagcacttgtactcagcagcatattagagccttga

SEQ ID NO: 26406 - DNA, 121 bp, Artificial Sequence
  Synthesized
  misc_feature (61): n=a or t
tatgatggatgttttttttcaagttacaattgtgcaagagagtgagatcctacggtcaagngtctgacaaaaatgaggaatttgaatactgtaatatcacagcataaaagtcgtatttatt

SEQ ID NO: 26407 - DNA, 121 bp, Artificial Sequence
  Synthesized
  misc_feature (61): n=t or c
agaaacagaaaatctaggagctctgctaacagcctggactttgaaatgaggtttggacgangtgctttatgtcttctgcttcaaatttgacaacagctgtttgtaaccatccaacctgtag

SEQ ID NO: 26408 - DNA, 121 bp, Artificial Sequence
  Synthesized
  misc_feature (61): n=t or c
acacctgccatgctgactgcaatggtgatatattttgcgtgtgttggtgttttgtatttantgtggctccgccttgcagacaaggccacgtagggttgtcttggcaggacaaagtctcaga

SEQ ID NO: 26409 - DNA, 121 bp, Artificial Sequence
  Synthesized
  misc_feature (61): n=a or g
cagccacactgcgtaacaccaccgtgggacaaagcctggagccacccaaccaggtgcttcncctaccggcataaaatgcagcttgctggctatgcagcctgggtggaggaattttccctca

SEQ ID NO: 26410 - DNA, 121 bp, Artificial Sequence
  Synthesized
  misc_feature (61): n=t or c
cccagggatgagtacagggctgaggtggaactgtcacatgaagggaatatttccaggagcnggaaagctggtagatcatagcttagtcaatgtgcttgaactctcatgatcttccacatga

SEQ ID NO: 26411 - DNA, 121 bp, Artificial Sequence
  Synthesized
  misc_feature (61): n=t or c
aaaacgcccacgaacatttcctcaaaagcaggggatggccccgtgctctgcaaagctgaanggcagcgaaagaatcccatggcagaggattacctgtcgggatcaccctgtgctaaacacg

SEQ ID NO: 26412 - DNA, 121 bp, Artificial Sequence
  Synthesized
  misc_feature (61): n=a or g
ttagatccgctatgaggcccacgtaaagtgcattaccctgtatatctgctgcaggagttcntcttcctctctggcaccagacaaccccagggccgcactgctgggttggagccaggaggcc

SEQ ID NO: 26413 - DNA, 121 bp, Artificial Sequence
  Synthesized
  misc_feature (61): n=a or g
cttaagagctcaccagccctgcaacaccaccatccaatctcagtcctggcacggatgaaangtagagtaggactccactggtactggtttgagttattttggcattgtgtgctgtgtccca

SEQ ID NO: 26414 - DNA, 121 bp, Artificial Sequence
  Synthesized
  misc_feature (61): n=t or c
catttgtagatacaggagctttgagagaaagctaacaagatagaaggcaggacaagtaatnggagggagaaaatggcatggaggcaccgaaaagcttccctaggttataatagctggagat

SEQ ID NO: 26415 - DNA, 121 bp, Artificial Sequence
  Synthesized
  misc_feature (61): n=t or c
ctatcactaccataagtatgaaggcttgggtttgtttgttctttggtttaaagtaggcatncaaatgtggtaatagaggcttcaagtctgtgaattctaagtgaaagaaggtatttcaatc

SEQ ID NO: 26416 - DNA, 121 bp, Artificial Sequence
  Synthesized
  misc_feature (61): n=a or g
gggccaccaggattgggatctgctcacctgccttccctcagcttccacacccgagcggacnccactgaggacactggtagactctccttagaaaacatttaattacaatctaagctttatg

SEQ ID NO: 26417 - DNA, 121 bp, Artificial Sequence
  Synthesized
  misc_feature (61): n=a or g
gagataacaaatttgttgtctactgtgaatataaatcttactgagggaaaagaaatgtcantgtctgagcaccactgctcagaaaaaaagaagtgaagctctctgctatggccagtattgt

SEQ ID NO: 26418 - DNA, 121 bp, Artificial Sequence
  Synthesized
  misc_feature (61): n=a or g
tgtagagatgtcagacccagcactgagcctacagactgtaattgcaacaggtagcaaaacntttctcactttctcagtgttatgagttatggctaaacacagctctctcctgatcccaagt

SEQ ID NO: 26419 - DNA, 121 bp, Artificial Sequence
  Synthesized
  misc_feature (61): n=c or g
atctggatgcatggtgaaattggttttgctcattccttctctgacttgatttcagatctantcccctagtcagcaaaataaagggctggagagttttccagttacctttcctcaaaggtga

SEQ ID NO: 26420 - DNA, 121 bp, Artificial Sequence
  Synthesized
  misc_feature (61): n=t or c
ttattgttcaaaacccatttcctatacatttgtaataagagaacagataactgtcataatnctggaaccttagctttccttagccactatagggggcttttatttttcctctaagaatcat

SEQ ID NO: 26421 - DNA, 121 bp, Artificial Sequence
  Synthesized
  misc_feature (61): n=t or c
caggtgagcgggagccagcagtaatggtgacacatcagcaggagcagccgtgtgagtggcngggggcagccgcacagactggacacaagcacagaccctcttgaccaaaatcttgccccga

SEQ ID NO: 26422 - DNA, 121 bp, Artificial Sequence
  Synthesized
  misc_feature (61): n=a or g
ataccaaaatcaaacagaaaaccctctccacgcacttcagcagccagcagcaaaacctccntctgccgagatggttatcttgacgagtgtgcttcttagggcactgcctcacttggttctt

SEQ ID NO: 26423 - DNA, 121 bp, Artificial Sequence
  Synthesized
  misc_feature (61): n=t or c
ttttacttccatttatttctgtagttcttcagtgtaactctctaatctctgaacaatagcntaatgggcctgaatccttgacatcagtgcttctcctcacactgcagcacagtacggtggg

SEQ ID NO: 26424 - DNA, 121 bp, Artificial Sequence
  Synthesized
  misc_feature (61): n=t or c
gtgtcgctcttatgggaagaagggtagcccatgtatgtcaccctgttttattccaggttgnaactaaagtcaacccaatctaaaacacaaaagccaaaaacaaacaaacaaacaaacaaac

SEQ ID NO: 26425 - DNA, 121 bp, Artificial Sequence
  Synthesized
  misc_feature (61): n=t or c
tgaagtggcttgccaggtggctttccgtaggaatcagcagctttagttcccttggaagtcnagcctgtacagaagtccctctgctgattggtgttttatcttactctgctgatagttttaa

SEQ ID NO: 26426 - DNA, 121 bp, Artificial Sequence
  Synthesized
  misc_feature (61): n=a or t
ctaggtcttgactgcttgagatattatatatgtatgtggaaatattttgattcacccaggngtcccaaaaatgaactttaggctcattctgaataattcatagaactgctagggatctcta

SEQ ID NO: 26427 - DNA, 121 bp, Artificial Sequence
  Synthesized
  misc_feature (61): n=t or c
taccaagtcagtttacttctgtggctgctttccaattgaattagggcttgccaagtgctanggagcattgtgagatttgtgaatgagaagcactaagagaagactggatggctacctatta

SEQ ID NO: 26428 - DNA, 121 bp, Artificial Sequence
  Synthesized
  misc_feature (61): n=t or c
gtgaatttactattgatataaataaatgagagtcagagaatataatctcaatgatctacangtatccaaagtttgacagggaaaaaattgactaattgccataaaagctcaatgtaaccat

SEQ ID NO: 26429 - DNA, 121 bp, Artificial Sequence
  Synthesized
  misc_feature (61): n=t or c
caaatactagaaacacttatctttacagtggactgttcaagaaaaagtttgtctacggctnattgtcctcaaggatcaaagtgcatgacatttgaaccatggaaagcatgatagctaaaaa

SEQ ID NO: 26430 - DNA, 121 bp, Artificial Sequence
  Synthesized
  misc_feature (61): n=t or c
agcatttcctttcagataagaccccaagctcattctttctcacctgcagtggaggagtttncaatcaacaagggtctgaagccgaacatggaaaagaaagcagtagaccaactagctcctg

SEQ ID NO: 26431 - DNA, 121 bp, Artificial Sequence
  Synthesized
  misc_feature (61): n=a or g
tgccccagattttgtgtttgctttagattttggggaattccaggtgatggggaaatatacntggtcccatcttcatctttctgcacacttctttcatttccaagttaaaaaatagccaagc

SEQ ID NO: 26432 - DNA, 121 bp, Artificial Sequence
  Synthesized
  misc_feature (61): n=t or c
tcctgtgttttatggacggttaagctagataatctaatcatccctcctggccttgcactcnacacagttggaggttgcaataaggattggaaagctccatcttattaaataccaaggcaaa

SEQ ID NO: 26433 - DNA, 121 bp, Artificial Sequence
  Synthesized
  misc_feature (61): n=t or c
ctgatagaaaaagaagcactgacttcagtgaatctgcatgaagctcacagcaaaagcacanctctcagctcagcaagaagtagggtcaggaagccactgaaggcaggcaggaggaggaatt

SEQ ID NO: 26434 - DNA, 121 bp, Artificial Sequence
  Synthesized
  misc_feature (61): n=t or c
ccatggctgctcttgactagcatggccatcattactaagctactggactcttgcgtatgtngagcttctgttttggtgaagtagtgacatttacattaattccttggcccagcctgcagat

SEQ ID NO: 26435 - DNA, 121 bp, Artificial Sequence
  Synthesized
  misc_feature (61): n=a or g
ttagagattgtactgacaattggaaatattgtatcatcatttcattaccacctggcttggngagaggatcacccagtaattcggttttgtaggcatccactgagataaagcaagggaggag

SEQ ID NO: 26436 - DNA, 121 bp, Artificial Sequence
  Synthesized
  misc_feature (61): n=c or g
tatatgcattatttacaaaaacagtctatattttgtgtctacattggaaatgtgtcaaaantgagtgctagagcagttggtaaagtgtggctctcaatactgcatcaagtctttaacagtt

SEQ ID NO: 26437 - DNA, 121 bp, Artificial Sequence
  Synthesized
  misc_feature (61): n=t or c
cacttgggatgtgagtacctctgttctggacgcacgtttctactggagctctccttcctgntggcacacctgtggcttccagcagctccatcctgcttttcctccaggaaagcaagaatgt

SEQ ID NO: 26438 - DNA, 121 bp, Artificial Sequence
  Synthesized
  misc_feature (61): n=a or g
cagaaataatgcagccacgttagcttagtgctttaatgcttcaagctgttccactgtgctntggagcatcgagatctgagcaggttgcgttgagccactttggatatggacagagctgtcc

SEQ ID NO: 26439 - DNA, 121 bp, Artificial Sequence
  Synthesized
  misc_feature (61): n=t or c
ggataagcaaaactgggaggatcctattgaaaatgaggtgatagctctttaaaccaaatangcacctttccacttctcacagaaagcacacacataagttaaacttctaaataagagcaca

SEQ ID NO: 26440 - DNA, 121 bp, Artificial Sequence
  Synthesized
  misc_feature (61): n=a or g
tgtggggatgcacacatccccttggtgcatgggctagacagaaatcacttttggggttttnctcccacactgcaagccagcaaaactcactgcaagttcaccaggctcatctttcttaaga

SEQ ID NO: 26441 - DNA, 121 bp, Artificial Sequence
  Synthesized
  misc_feature (61): n=a or g
tcgcaggaggatttggatgctgcaacatggagattttcaatgtctatccattaagaatccngcttccaaaagctttcctgtagcacactcctgtgagcagtgactcagctcctccacagcc

SEQ ID NO: 26442 - DNA, 121 bp, Artificial Sequence
  Synthesized
  misc_feature (61): n=a or g
ttcttataaacaaggccttactgatgtgcgaggaacagtaatatgtggcaaaaactccacnttaaccaaagtaagcagtataaatggggtgtaggaatcccttgttagactaaaaatctcc

SEQ ID NO: 26443 - DNA, 121 bp, Artificial Sequence
  Synthesized
  misc_feature (61): n=a or g
aaatactgtctctttaagcgatcttgataatcttgacaacctaatgagttcagaacaagtngtataggaggcatgtgaatcaaaagaatgtggtggttcccatctagaaatcatcgttatt

SEQ ID NO: 26444 - DNA, 121 bp, Artificial Sequence
  Synthesized
  misc_feature (61): n=c or g
taaaagaatgcgctaataacctcatagccatattcattctccgggttcttgggagtgctgntttctgtctcattcgtgacttctaaaatgtttctaaagtgagctgtaatgaggccaaaga

SEQ ID NO: 26445 - DNA, 121 bp, Artificial Sequence
  Synthesized
  misc_feature (61): n=t or c
aggaaatagaacatttaagaagtgataacttctcatttacctgaaactacagacaaatctnaggtctctccagacatttcggcacaaagcacacttttttaaagggtgtgactatgtacag

SEQ ID NO: 26446 - DNA, 121 bp, Artificial Sequence
  Synthesized
  misc_feature (61): n=t or c
gaacagagctcatcattttgtttttattagatcagttgacataatactgagaagcaggtancatagtatttctatcttttgcatgcaggtgggcagcaattcccatgatgtaccctgcttc

SEQ ID NO: 26447 - DNA, 121 bp, Artificial Sequence
  Synthesized
  misc_feature (61): n=a or g
tagctgatgaagaagaatccagtcagtgcagtcagttagttaacaagccatgtgttaggtntctatacaagcagaactgaggctggaaattagtagactcagtataaaaatgacagtggaa

SEQ ID NO: 26448 - DNA, 121 bp, Artificial Sequence
  Synthesized
  misc_feature (61): n=a or g
gcatctctcactcagggaagtaaagagttgctaagcttggcacatggatgctttggtcaantgcacattgcttttactcagaagaggaaaagaaagtctgtccgttggggaaggatgccct

SEQ ID NO: 26449 - DNA, 121 bp, Artificial Sequence
  Synthesized
  misc_feature (61): n=a or g
cccattgtcaccacctgtccctgagtcccacatcccagcgggtgccacttccttctgaccntgcacctgatctgaatctcttaacatttgccattataggcatggtttaatccagcagtgg

SEQ ID NO: 26450 - DNA, 121 bp, Artificial Sequence
  Synthesized
  misc_feature (61): n=t or c
gtcaaaacaaacaaaaaagacaatataaccataacaattcctcagatttcccagcttgcanttgctttctgtgtgtcctgcttcttttaattgaagaaaaagaaaatggcatctttattct

SEQ ID NO: 26451 - DNA, 121 bp, Artificial Sequence
  Synthesized
  misc_feature (61): n=t or c
ccggatccccactgagtgtgtatattcctggaactacagggcatgcagcaacacctccctnaaccccaaagcagggctcttttattcatacctgagacgtggaagaggcttggaaggcaca

SEQ ID NO: 26452 - DNA, 121 bp, Artificial Sequence
  Synthesized
  misc_feature (61): n=a or c
tatgttctaatgtaacatgtcaacagaacaaaggctgaaaacataaggagcagtgttcttnactcactagaaggctgagcacaccagtgttctaatgcagggcagactgtgagcaaataac

SEQ ID NO: 26453 - DNA, 121 bp, Artificial Sequence
  Synthesized
  misc_feature (61): n=a or g
ctgaacgcacagagtttgtgagaagcacagaagttgctcttgcacctgtaccaggtattangagtacacatcttaccttcccagttagaagctgcttttagaagcacaggctttgttaata

SEQ ID NO: 26454 - DNA, 121 bp, Artificial Sequence
  Synthesized
  misc_feature (61): n=a or g
cgctggttaagtgtcagcattgctattgtagacgctctttctgcagcaaaggaagtccctnatcctaaaagcagtttttagacaagtccccgcatattttcagggataaatctgggcttgg

SEQ ID NO: 26455 - DNA, 121 bp, Artificial Sequence
  Synthesized
  misc_feature (61): n=t or c
aaagagatcaggcatacttagtcggggcttaactccattgggctttgagcagccttcctcnactgctccattgcttgattgtcctcacagaggaaaagggtttttttttttaatctccact

SEQ ID NO: 26456 - DNA, 121 bp, Artificial Sequence
  Synthesized
  misc_feature (61): n=t or c
aacgccaattctaaatttctgtctttgaagatggagaagctgaaagaaccaactgaatgcntggtaattcaaatccttgttaacaagaaaagaaatctgtatttcagttcattatgaagta

SEQ ID NO: 26457 - DNA, 121 bp, Artificial Sequence
  Synthesized
  misc_feature (61): n=a or t
tggaggtctcttacacagaaggccttttaaggggcattagaaattgtaaatagggctttcnttcatttctgaagccttctttatactgaagcccatgaatcatgccaactgatgccagctt

SEQ ID NO: 26458 - DNA, 121 bp, Artificial Sequence
  Synthesized
  misc_feature (61): n=a or g
gtggagctgtcatattcagccagcaggaattgctaggtctagggacgtttcttttattccntcagtgctcctggtttgccagaattgtcccttcttatgtaaaaagcttgttccttcagca

SEQ ID NO: 26459 - DNA, 121 bp, Artificial Sequence
  Synthesized
  misc_feature (61): n=a or g
tctcagaagagagaggccctggaaaagccttccaaggtttgtagctggagcaaaaacacanaatgcagatgggatttatttaattcacaaaaaggattgtatggtacattcacgcccaccc

SEQ ID NO: 26460 - DNA, 121 bp, Artificial Sequence
  Synthesized
  misc_feature (61): n=t or c
gtgctgagtaaacggccccatggtcaaagattaaaaacatatttgtgtttgcatcaacccntcagccatgcatttatgaaataggttttccttttcctttcattatccttccctaccactg

SEQ ID NO: 26461 - DNA, 121 bp, Artificial Sequence
  Synthesized
  misc_feature (61): n=t or c
ctgtatgagtagatgggatcctcacagtttggcacactgcaagcatatgaattgttccagnaaatcaagtccacttcctagctccagtcagacaccagataaggacgctgcacagacatgc

SEQ ID NO: 26462 - DNA, 121 bp, Artificial Sequence
  Synthesized
  misc_feature (61): n=a or g
gaacttcctgctgttcaaagtgcaaatatcctactagaaggaaataacaatgtactgaatnacataaagaaccacagtctttaaaaatatccacaccagtgaaatcactgtaattaagttt

SEQ ID NO: 26463 - DNA, 121 bp, Artificial Sequence
  Synthesized
  misc_feature (61): n=a or g
cctgtgccaatctctgctgtctccgtcctacaccagctgttgggatgccacctgatcagcnttatcagacattgcttctttcagtttcttttcttccctgtttgcctcatctttttgccaa

SEQ ID NO: 26464 - DNA, 121 bp, Artificial Sequence
  Synthesized
  misc_feature (61): n=t or c
ccccatcactcagatcactaatgaagatgttaattaggattggattcccagtagccccttnagcctgttttcaacccacctcagtgaaaattctccatatgaaaagtattcactgtattac

SEQ ID NO: 26465 - DNA, 121 bp, Artificial Sequence
  Synthesized
  misc_feature (61): n=c or g
atgtcacctaattccatgcatgtaattgccgtttctgtagcatgtagttaccattttttanaagtctcatatattttcataagagcactcagctattaaatccttagatctggtctttggc

SEQ ID NO: 26466 - DNA, 121 bp, Artificial Sequence
  Synthesized
  misc_feature (61): n=t or c
gtccatgtgcacaacgcacccaagcagacagaaaggcatgggccatatctttgtcacgatncaatttgatcgctgacttttattcaaaaacttgatttttcatctatcacctccatggtgg

SEQ ID NO: 26467 - DNA, 121 bp, Artificial Sequence
  Synthesized
  misc_feature (61): n=t or c
tcccatgtgctaaagtgtaaactaccaactaatccgtagcagttttacaggagagagtcanttaattaacacttttaatttcagatgtgaaagagaggtctgggaagtgaagagaggcttc

SEQ ID NO: 26468 - DNA, 121 bp, Artificial Sequence
  Synthesized
  misc_feature (61): n=a or g
acttcagttaatttcctagattctttttcattgtttgacttgtatcttaggaatgaaaganagggcagcactgtatgatatttcattcagttctccattcatagtatgatacatttcacat

SEQ ID NO: 26469 - DNA, 121 bp, Artificial Sequence
  Synthesized
  misc_feature (61): n=t or c
cccagatgccacagatggctgggcttttgatggacagtgatctggaagggagtgaggaacnagcaggctccgtcctcagacatccctctgttaccacatcctaaaaggaggccttgcagag

SEQ ID NO: 26470 - DNA, 121 bp, Artificial Sequence
  Synthesized
  misc_feature (61): n=a or g
aatccaaaaataagaggaaaaatctattaggactagaaaggcctaactggaggatctgggnaactcaggtcctctagaaatgagagtaattgttgttccttcctccacaacaaacaaacaa

SEQ ID NO: 26471 - DNA, 121 bp, Artificial Sequence
  Synthesized
  misc_feature (61): n=t or g
tggtgggagcccagcctcagtgctgctggcagtggtgggcttaagggtgggcacactccangactggtgttggaaagtttttaataaaatcagctctgctatttgtactaaaattttgcac

SEQ ID NO: 26472 - DNA, 121 bp, Artificial Sequence
  Synthesized
  misc_feature (61): n=a or g
ggaggggtgagggagcagcgcagctctgctgctgcatcacagcacggtccttatgcaaagnatgtctccttcagaaacatcaaagggaagccaccagccggggctgacacggcctttctcc

SEQ ID NO: 26473 - DNA, 121 bp, Artificial Sequence
  Synthesized
  misc_feature (61): n=a or g
gcccatccccaagacaatattggtggaatttatttcctaggtaaagaaccatcaactggantccaaaattctcacttggagagcaagctggcaagccagctcaagtgcagggcataccacc

SEQ ID NO: 26474 - DNA, 121 bp, Artificial Sequence
  Synthesized
  misc_feature (61): n=t or g
ctttacagcaagtaactgccaaacataccaataaactattatttactacgtcaattacaanaagttttcaagcagctatctctataatcatgtggatgttaccaatgaatgctggaggatt

SEQ ID NO: 26475 - DNA, 121 bp, Artificial Sequence
  Synthesized
  misc_feature (61): n=a or g
ccttgtgggaggatctgttggcagctgggggggggctggggctcccgtccttgcctgcatncaccccatcacatggatgaggtgaagggaggagaggaggaggaagcgcttcctcctcaca

SEQ ID NO: 26476 - DNA, 121 bp, Artificial Sequence
  Synthesized
  misc_feature (61): n=a or t
ctccttcactgccatgtgtcatctctattgaaaacctttgaagccaagtgcaggtaaaagngccttccctgtgatgtgatgattctgtctccccttcagctttctccagtgcttcaaggcg

SEQ ID NO: 26477 - DNA, 121 bp, Artificial Sequence
  Synthesized
  misc_feature (61): n=t or c
aaatgaggtcttaaggaatcaatggaagattctcttccatttttctttgcaagtcatacgntttctataaccatgtttctatcttaatttgcctaactagtgactcagtattttcttgctt

SEQ ID NO: 26478 - DNA, 121 bp, Artificial Sequence
  Synthesized
  misc_feature (61): n=t or g
ctcttctggggtttcagccttcagcacctgggctagcagtactgaacaatgccagacaaancaaaggctcacacatttactgcctgtcagtttcagtttcccaaggtttttaggaacagtt

SEQ ID NO: 26479 - DNA, 121 bp, Artificial Sequence
  Synthesized
  misc_feature (61): n=t or c
attaaccagaggttttaaactgtatgaagtagaagacgttgtcttctgtacggtagagttntgcatgctttaatttggcgaccaatctttgatttgtttttttttttttttttaatggcaa

SEQ ID NO: 26480 - DNA, 121 bp, Artificial Sequence
  Synthesized
  misc_feature (61): n=t or c
ttggctatgatgttggtataactgcatcttaggcacaaagcatatggtagattttaagcanctgaattagttcttatacttaatcttcagcaattttataacataaagtatttgcagaaat

SEQ ID NO: 26481 - DNA, 121 bp, Artificial Sequence
  Synthesized
  misc_feature (61): n=t or c
gggaagacgaacccaaagtcccgaaccactgaaacttttatctccagatggttctcttgcntccactgttctgcctccggtaaccttgcttgggagacaaaattattccccacagtttgcc

SEQ ID NO: 26482 - DNA, 121 bp, Artificial Sequence
  Synthesized
  misc_feature (61): n=t or c
acatgaggtaagccatcatccttaacctctccagtcttcagcctcttttccaatccctcangcccttccctccagcaaaacaggataattgttttccttatgctttattcttagaatttct

SEQ ID NO: 26483 - DNA, 121 bp, Artificial Sequence
  Synthesized
  misc_feature (61): n=a or g
gaaattctttctcacagctataccatttggtattttattatgatgttaaaggcatgttttnatcctgttagacatcacttaatcttggaaatgaaaagattagcctcttataaacatactt

SEQ ID NO: 26484 - DNA, 121 bp, Artificial Sequence
  Synthesized
  misc_feature (61): n=t or c
atagtaatctgttcctcatccatagcatatatcaggttcaaaggcaatagtgtatttctangttcatttcactgaaaggtttctcttactagaatgcactgaccagtgctttagtcctaca

SEQ ID NO: 26485 - DNA, 121 bp, Artificial Sequence
  Synthesized
  misc_feature (61): n=a or g
aacacagtgtagtcttctgaatgggtcacattctagagatcatatataaaaatgcagcctnctattttcttacagagctgaaagaagggtcagattattctgagtcatgacatgaaaagct

SEQ ID NO: 26486 - DNA, 121 bp, Artificial Sequence
  Synthesized
  misc_feature (61): n=a or t
ccagcaatattgtttgcaaacagatttctctcaaaaatacttgacatgcctctcatggccntttcatctttggacaggacaacaggcgatgttcaagacatatgtagtgttgtggaatacc

SEQ ID NO: 26487 - DNA, 121 bp, Artificial Sequence
  Synthesized
  misc_feature (61): n=t or c
tctttatagatactgatgatctcagcttaactaggatctaggattttagatcttgaggttnattcatcagggacatctccccttctatgtcttcagattctctttatacacaaaatgtgct

SEQ ID NO: 26488 - DNA, 121 bp, Artificial Sequence
  Synthesized
  misc_feature (61): n=t or c
ttattgtagctgctcattggacaacttcccatataatgtcaaatttcaaatcaggaacatntggagccaaagtaaaagtcactccggtggcagctgtgagagcagctccgtcacatagttg

SEQ ID NO: 26489 - DNA, 121 bp, Artificial Sequence
  Synthesized
  misc_feature (61): n=a or g
tttcatttttcaaattctaacatctctcttacgcatcttatctcactccagactggtcccnttgtttttgcctaggggatgacttcagcaccacagctggaacggtaaggtatcccttgtt

SEQ ID NO: 26490 - DNA, 121 bp, Artificial Sequence
  Synthesized
  misc_feature (61): n=a or t
atgtagaagcacagcttgtttaggtacaggcaggaagaaagcaatctgagaaccagagaancactttgcatgggggagaggcttcaggaaaagggagatcataggatggtttgggttggaa

SEQ ID NO: 26491 - DNA, 121 bp, Artificial Sequence
  Synthesized
  misc_feature (61): n=a or g
tatacttattttctacacacctttcatactacaggtatgaaatggaagagcagttgaaacngtagggactgtgaaaacatttcaggaattcaagggaagatgagtgaaaaaggctctagta

SEQ ID NO: 26492 - DNA, 121 bp, Artificial Sequence
  Synthesized
  misc_feature (61): n=a or g
gaaaatagagctgctaatagtctgttctctggcttctgtctcaaaaaatgggccacaagangttggctcaaatgtgctgcttttcagatcatatgcagtgtgaatttcctatatttcatgt

SEQ ID NO: 26493 - DNA, 121 bp, Artificial Sequence
  Synthesized
  misc_feature (61): n=a or g
ctgtcaaggcagaaattaggttggtttgacatgatctgctcttgacaaactcgtggtgctngtggtggtgtggggcttttttctcgctttattaaattcccgggccttacaagctgtgata

SEQ ID NO: 26494 - DNA, 121 bp, Artificial Sequence
  Synthesized
  misc_feature (61): n=t or c
gggatactgtacaggcactgcatgtcacagtgcactccctttgtaggttaccagcttcctntgaatttcacgtaacaacacctgccacacacatctgtgcctggacaacaggattttttct

SEQ ID NO: 26495 - DNA, 121 bp, Artificial Sequence
  Synthesized
  misc_feature (61): n=t or c
catgaggagtggtagtaacagtaacaacaagcagacattttctttttcctagcacctttangtgctgtatttgccagcttctgccatgctccgcagtcacatctgtaccatggctcctggg

SEQ ID NO: 26496 - DNA, 121 bp, Artificial Sequence
  Synthesized
  misc_feature (61): n=a or g
aaacacgctgtgtcataacaggagtgtcatagccaagcaaaggtcatctgctgctttaacntatgtcacatattgttatggaggagattctccaaatgactgtacttgcagctagtcctgt

SEQ ID NO: 26497 - DNA, 121 bp, Artificial Sequence
  Synthesized
  misc_feature (61): n=t or c
gctgggcttgtgcatctccaaacacaccccacaggccacttgtgagcacacacagcctctngacagaagagctctccctgttctatctccccttaaccagagcccaaacctcacccttcct

SEQ ID NO: 26498 - DNA, 121 bp, Artificial Sequence
  Synthesized
  misc_feature (61): n=a or t
actgggaatgatgttactaatggccaaaaaccttgaagataactatctggggacaccaccnccgaaactcatcagtcctacggtttgttccttgagtcagggcattggcttacaaaacctg

SEQ ID NO: 26499 - DNA, 121 bp, Artificial Sequence
  Synthesized
  misc_feature (61): n=t or g
tcccctgcgctgccgatgttctgccagcccagagcaggatgtccagagcgaggattaggcnagaggtaatgatagttctttcaaagtggctggataaaattagacacatataatcagtggt

SEQ ID NO: 26500 - DNA, 121 bp, Artificial Sequence
  Synthesized
  misc_feature (61): n=a or c
ggaaaggcaagatccaaggtgtacagctgggccaagggatgctgagtggaagggaaggctntacagggctgttattcagacactcaaggtccatttgctgcccagtactcaaagcccatgg

SEQ ID NO: 26501 - DNA, 121 bp, Artificial Sequence
  Synthesized
  misc_feature (61): n=a or g
taatggagagagtatgtgactaaacagtcaataatcattatgatcaatggagagatctcanttttatcttgtcaaagactatttgagcctaataagacattcatctgatctgccaacataa

SEQ ID NO: 26502 - DNA, 121 bp, Artificial Sequence
  Synthesized
  misc_feature (61): n=t or c
ccacgtatgtttaatactgagctagatttcacctcattgcattattacactgatcggcagngggtatagcaaggaagacataggctgacatcagctacttttaagcttttctcttcttccc

SEQ ID NO: 26503 - DNA, 121 bp, Artificial Sequence
  Synthesized
  misc_feature (61): n=a or t
agcactcaccttactcagggagcagcaggctcacaaacagcacagctgtggttggaggagngctccaggtccacctgtgtccccatcctctcagtcctgcacctatggcagctccacaacc

SEQ ID NO: 26504 - DNA, 121 bp, Artificial Sequence
  Synthesized
  misc_feature (61): n=t or c
atggggagaggagcggggcgaggggagagggcacagccagcaggaagagcacttcttcacngccttcagctccacggccgctcatgcaagaagtaaatcactttcattaatgccacgcaca

SEQ ID NO: 26505 - DNA, 121 bp, Artificial Sequence
  Synthesized
  misc_feature (61): n=t or c
ctatcagtgatactccacacaaaaagaaatgtgctgctctatggccatgagaatgctacanatttcatttaatacccttaaacacagattcagactcaaggctctaaccactacatggaag

SEQ ID NO: 26506 - DNA, 121 bp, Artificial Sequence
  Synthesized
  misc_feature (61): n=a or c
catggttatggtacatattccttacatacttgtcatttcttccaggttttctcaaatactnctggctttttgtaacagcattattagcaggaacagcctattgaatcactgaaaattcaac

SEQ ID NO: 26507 - DNA, 121 bp, Artificial Sequence
  Synthesized
  misc_feature (61): n=t or c
gttgtgcagctggtttgcaaagatgggttttatgaagaccctgagaaggagaaacttgcanggagcagtgcctgtggtcacgaccactgctggaatagcatgcaaatccctgttcattacc

SEQ ID NO: 26508 - DNA, 121 bp, Artificial Sequence
  Synthesized
  misc_feature (61): n=t or g
gcaaaaggtgagagatccagcacatctgacaggcagcagcaatggatacgtgactttagcngtgccgtatgggtgccgtacttcaaaagcttgtattttcattcgaatatccgcttcttta

SEQ ID NO: 26509 - DNA, 121 bp, Artificial Sequence
  Synthesized
  misc_feature (61): n=a or c
tcaaacccatacagtgtttcccactgactacatattttttgtttccttagtcatataaaancttatgctgatatttctattttacccatgctacatttgccaggcaggagataccggttga

SEQ ID NO: 26510 - DNA, 121 bp, Artificial Sequence
  Synthesized
  misc_feature (61): n=t or c
taatcttttgaaagataaaatttcccacaaaacacttggaatagtgcacataagcattctngtatttaatgtcttctcacagcaaattattttacatcttccgacataactctgcatgaac

SEQ ID NO: 26511 - DNA, 121 bp, Artificial Sequence
  Synthesized
  misc_feature (61): n=t or c
cgtcaaggggacagtgacagtagtcagataaatacagtcacatgcagataaaatcattacntctatacttatctcaccctggagagtgctgtctgcatggagcttcctagccttccccaag

SEQ ID NO: 26512 - DNA, 121 bp, Artificial Sequence
  Synthesized
  misc_feature (61): n=a or g
acacatgttcatatgcatttgcatgctggcatgctgtggctttatgtagggagggcccccnttgagagagctgatgcagacctgtgatgtctgggtgtgggcagccttgtgctggggtgct

SEQ ID NO: 26513 - DNA, 121 bp, Artificial Sequence
  Synthesized
  misc_feature (61): n=t or c
catgccggtttgggattacaaggtttatccaagcaataattggtgatgtgatcggggccgncataatgagcttttacggctcaaatcactactgaagagctgagcaggcagctgcagacct

SEQ ID NO: 26514 - DNA, 121 bp, Artificial Sequence
  Synthesized
  misc_feature (61): n=a or g
gttctccttgttcttttttttttttcctgtggcacctgtaagcatcctagtttcatgtganccagcttaaatataaagcaaatacaaacagcagtgtgagaagatgaatcgccctgatagc

SEQ ID NO: 26515 - DNA, 121 bp, Artificial Sequence
  Synthesized
  misc_feature (61): n=t or c
ctgtgcataagcatgtaaatacaaacaaattggtggttactgatgaatttttaaaaacagntcttttaatactgtatatattattaagtgcatctttttcgcagcacaggcttttaatatt

SEQ ID NO: 26516 - DNA, 121 bp, Artificial Sequence
  Synthesized
  misc_feature (61): n=c or g
acaggagcacgccagggctctccagccttacaaaaaggttgttacgtattttggaatgctnttagaaatgccatatctttctatgtggttccacacgtacatacatacgtttaaaatgaaa

SEQ ID NO: 26517 - DNA, 121 bp, Artificial Sequence
  Synthesized
  misc_feature (61): n=a or g
ataaaccctgatacgcagagcagccctctgtgttgattcacctgttgtgtgatcaccatcntgcccgacctctgcccatcaacacacgtttcgtgatacccaactggggctgagtccacgc

SEQ ID NO: 26518 - DNA, 121 bp, Artificial Sequence
  Synthesized
  misc_feature (61): n=a or g
cctcgttgggaaagcagttgtgacttcagattgagtcattgttgtccagggatggaaaacntttggttttttttcatccgtgcatgagcctttcttgctcctcagagctttcatggtatag

SEQ ID NO: 26519 - DNA, 121 bp, Artificial Sequence
  Synthesized
  misc_feature (61): n=a or g
tccacatacacacagacaaattagccatatttgaacctttttaacatttcactctttttanctataaaccaactagtgtgtgaacctttgcagaataatggaggaggatctgtttgggaat

SEQ ID NO: 26520 - DNA, 121 bp, Artificial Sequence
  Synthesized
  misc_feature (61): n=a or g
atcctgagaatctctcttcattttcacacacccacagctcgtagctttattcacagagttnggaagcttacatcattccatagattgagcaaacactgtatgctgcaatatcaaactttta

SEQ ID NO: 26521 - DNA, 121 bp, Artificial Sequence
  Synthesized
  misc_feature (61): n=t or c
accaaagactctcaacattagaatcacaaatatctattaaaataaaaaggttcaacttgcnacgcaagatttaactaaaacaggttcagtgctggttaaaaacaagtattagtgctcaagt

SEQ ID NO: 26522 - DNA, 121 bp, Artificial Sequence
  Synthesized
  misc_feature (61): n=a or g
aaatggacggcaagtatgtagagttcaaaggaagtatcgtggttcagctggtggaagccantgtttccaagctgttgggatgctgtgctgcggacagtcctggtagacgttggaacttgcc

SEQ ID NO: 26523 - DNA, 121 bp, Artificial Sequence
  Synthesized
  misc_feature (61): n=t or g
taccctctggaaatttgctttgaaaactgaaaagttcacgtttagaaaattctcctttctnttgtaagggtaagactggtgatggctgagataagcatttctgttgattgtgtgtctctca

SEQ ID NO: 26524 - DNA, 121 bp, Artificial Sequence
  Synthesized
  misc_feature (61): n=a or t
tctgtttctgagaacatgagggtctggagaagcacatgagggtctggagaagcactgcagngacacatctcaatggcactgccctgaatcccaggtctacggagaccacacaaaggacagc

SEQ ID NO: 26525 - DNA, 121 bp, Artificial Sequence
  Synthesized
  misc_feature (61): n=t or c
cacagtaagttcaaaatggcttaattcacagatacaccaaagaattcctaaatcagaacanggcatttaagttcacttccctaactgcaaaccctgtcttttatgtaggtcactctgaaag

SEQ ID NO: 26526 - DNA, 121 bp, Artificial Sequence
  Synthesized
  misc_feature (61): n=t or g
ccagtgtgaggcagagggatccgttcggtggggctgaggaggggaggtggttctcatcatnctttgctgcggggtgctgtcaacttcagctttgctggtatcttccccaacacaacccgct

SEQ ID NO: 26527 - DNA, 121 bp, Artificial Sequence
  Synthesized
  misc_feature (61): n=a or g
gacttcctaagccccatcctcaccagacactgcgaagtgccactggttgtccccacaaagncaatatcagtgtcccaggccactgtttgaaagaccaattgtcaaggaaccgggcaagtgt

SEQ ID NO: 26528 - DNA, 121 bp, Artificial Sequence
  Synthesized
  misc_feature (61): n=t or g
gtttgacatgaaaagaaacggtattagggccaatggaaaactcctaagtaatactgtagtnttagctattttgaagacaaatgtttcttcttattcagttctgcagaactgtaaaatagaa

SEQ ID NO: 26529 - DNA, 121 bp, Artificial Sequence
  Synthesized
  misc_feature (61): n=a or g
acgccccactatggccacatggcactcggctcccttactttcagtgagtatcactgcatcnttccagaaggcttctagctcagtgtcttaccattttgggcttgtcattttggggcacctc

SEQ ID NO: 26530 - DNA, 121 bp, Artificial Sequence
  Synthesized
  misc_feature (61): n=c or g
ttgattgccccacagggtgagagattaatttttagcctactaacctacgtgtacatagcanagattgcaacagcaacaccatggccagcctgggatttgcctgcatgcctcctgttattta

SEQ ID NO: 26531 - DNA, 121 bp, Artificial Sequence
  Synthesized
  misc_feature (61): n=c or g
tcccatgagcctcagccacccggcacaaaccatcacagctctgtaagtctgaaccctcctngacgctccgaggccatcagcctcctgcctggcctcactgctgtcccggtggctgtgacaa

SEQ ID NO: 26532 - DNA, 121 bp, Artificial Sequence
  Synthesized
  misc_feature (61): n=t or g
tcagaaggaacagccacagagcacccacaccacagcgggcacccaaccacagcaaggcacnctccctcatgctaagcttcaggaacacagcacacggacacacgtgttcggcacagctaaa

SEQ ID NO: 26533 - DNA, 121 bp, Artificial Sequence
  Synthesized
  misc_feature (61): n=t or c
tctgcagggtgagaaaagcagctgatgggttctgaaagctgcattctgggtcaagactagnatcccaagggcctgcatgagacctgcacctgggcacagagtgggcgttgccctcagggct

SEQ ID NO: 26534 - DNA, 121 bp, Artificial Sequence
  Synthesized
  misc_feature (61): n=a or g
catgggatgggacacacgtgcccctggactctctaggaccctgggtcccaccaccacaagngtggtcttaaccaatccagtggctgcatcaccagctcgagtccttcctctgagggactcc

SEQ ID NO: 26535 - DNA, 121 bp, Artificial Sequence
  Synthesized
  misc_feature (61): n=t or c
cgcttcggctggactcagcacggcaaagtgtgagtttaccatacctgccttgatgtcacanggtgcaggaacgcatggcccagggcatcatgcgggtgtgcgtacagtagacgccccactc

SEQ ID NO: 26536 - DNA, 121 bp, Artificial Sequence
  Synthesized
  misc_feature (61): n=t or c
cttccctctcagataacagaattttcagacgacagatatgttcacacagaagcagaaatanggagtaaggagatggaaaaaatactggagaaaaacatcaactgtggctcgagcaggaagg

SEQ ID NO: 26537 - DNA, 121 bp, Artificial Sequence
  Synthesized
  misc_feature (61): n=t or c
gattgcagatgactgaattttaatgtactagtgcaacatattcattcttgttcatgctttnctgattctaattcagacgacagtgaaaaataataccacccaatgctaaagtaaaatggac

SEQ ID NO: 26538 - DNA, 121 bp, Artificial Sequence
  Synthesized
  misc_feature (61): n=a or t
catacctatatcaaaactgataattgctacctgggtgaagcacaaaatacagaaagacagntcctaaacagttatgcctgaacaatttctaacagctgtgcattgaccgactcaaatctct

SEQ ID NO: 26539 - DNA, 121 bp, Artificial Sequence
  Synthesized
  misc_feature (61): n=a or g
gtgggaactgctcagctctgtcacaacacaaagcccaaagagctgatgctgttgggttacngtgagccagcaatgaaggcaggagcagaccatgggtctcctgcccatctggtgccctgga

SEQ ID NO: 26540 - DNA, 121 bp, Artificial Sequence
  Synthesized
  misc_feature (61): n=a or t
aaaagtccccccttgctctctaacagcggagccggtcgtagaagtgagaaatatttttaantggagcgcgatctgctcctattgtttaacagagggaaaaaatatatctatatataatgag

SEQ ID NO: 26541 - DNA, 121 bp, Artificial Sequence
  Synthesized
  misc_feature (61): n=t or c
ccttacccacggtgacagacgggctacagaaactcgagacctgagcagattcaattttganaataaggtaacagttctgttttgtttgaaaagctcatctgctcattctgcaaatgatatg

SEQ ID NO: 26542 - DNA, 121 bp, Artificial Sequence
  Synthesized
  misc_feature (61): n=c or g
tctgcatctgatgcacactactcttgcttaaaacaagcccttctgatgtctgcagtgctcnatagccactgcttcgggtagatctcaaaacataagtgagataaacagctggctggcaagg

SEQ ID NO: 26543 - DNA, 121 bp, Artificial Sequence
  Synthesized
  misc_feature (61): n=t or c
aatgtaattgaaggcagcagatggtatctagaaaatcagatatacttgtttagaaacacantttaaattcacaaatagtaaatgtgctcctagtgaacactgattttttttgttttaaaat

SEQ ID NO: 26544 - DNA, 121 bp, Artificial Sequence
  Synthesized
  misc_feature (61): n=t or c
taaaaaggcagtgagaaaggtctagcctcaaataacaaatgggaacacttggtgtcaagangaacacaatgttccagttcaacatctccctcctcacacccccattagtttaaatgtcata

SEQ ID NO: 26545 - DNA, 121 bp, Artificial Sequence
  Synthesized
  misc_feature (61): n=c or g
agctgtacttgactgacaattcaaaatagagaaaacctgaatggcttcacttcttgatttntcagcagttacaaaaataattacagatgttggcaaaagaggtagcattccaggtttatct

SEQ ID NO: 26546 - DNA, 121 bp, Artificial Sequence
  Synthesized
  misc_feature (61): n=t or g
aagctagaaaaggataatactgtgtagaggaataaatgaagaaaaaactgtttataagtgntggttactggcaggtagataagcaccacatatttgttcgctcaccactcatgccccagtg

SEQ ID NO: 26547 - DNA, 121 bp, Artificial Sequence
  Synthesized
  misc_feature (61): n=c or g
cgcagagctgctctgcagaggctttgcattgggaagaaaaccccccaatttcctgccacangctttgtgcaatttacctcctgggcagcgagccctgccttggtgttaagcaaaattgctc

SEQ ID NO: 26548 - DNA, 121 bp, Artificial Sequence
  Synthesized
  misc_feature (61): n=a or g
gatatcctggcacataaatttacttcttagataatctaaataaaagtcaattttctgcacnttttcatatatgtagctagcattccttatctgctacagaagaatggattctgatttttac

SEQ ID NO: 26549 - DNA, 121 bp, Artificial Sequence
  Synthesized
  misc_feature (61): n=t or c
tgctacagcaaaaggaagaaaacaaggatcagagtcaggctggcagtaagaaatgaaattngggttctgctctctctcaaagagaggggcaagatgagttgttagaacattattggttatt

SEQ ID NO: 26550 - DNA, 121 bp, Artificial Sequence
  Synthesized
  misc_feature (61): n=a or g
agtgcttgtacctgaccatctaaagaaagtaaactcctatttaattttaagatccttctangaaatcaatctctctttaaaaagttcccagagtttccaaattatctgaaaaattgttaag

SEQ ID NO: 26551 - DNA, 121 bp, Artificial Sequence
  Synthesized
  misc_feature (61): n=t or g
ttatattcatattcaccgattcccttttgaggtacatttaacttatttctgcatttaaaanccaatttagctgctccaaggtaagcacaattatacctatgacattcctgagagatatctg

SEQ ID NO: 26552 - DNA, 121 bp, Artificial Sequence
  Synthesized
  misc_feature (61): n=t or g
aatcttgaaatatttgtagatcttgaagaccaatcctagaaaatacgtactttttccatgnctcagtcctgactcacccttggcatatcaagttggattgactgtgctgtagcttgtatgt

SEQ ID NO: 26553 - DNA, 121 bp, Artificial Sequence
  Synthesized
  misc_feature (61): n=t or c
ctcctgtgctgccttggcctttgcttggctgtctgatagtatcttccttgccctatgcctngcttctgggcagagttgatttatggtaagagggaatctgagacaaactcagagtgctttt

SEQ ID NO: 26554 - DNA, 121 bp, Artificial Sequence
  Synthesized
  misc_feature (61): n=t or c
gctgtactgccttgctcgggacaaggaaactgctcctaacgaaccattcctccatctgcanaaccactctctcatttggaaatgccatcaattaaaaaagaaaaaaaatggagaaactcag

SEQ ID NO: 26555 - DNA, 121 bp, Artificial Sequence
  Synthesized
  misc_feature (61): n=t or c
tgtgaacagattgtctaagttcattctcattgtgtcagtcaatgtttttactttcatcccntgtgtttggcaagaaaagggcaagcaggcgttgtgaaagtaaaagttctgttttctccga

SEQ ID NO: 26556 - DNA, 121 bp, Artificial Sequence
  Synthesized
  misc_feature (61): n=a or g
tgctgtaaagcaaggaaataaaaagttttgcagacttagtgcaaacagatgtaagaattcnattttctttgttctgcccgacaagcaattggtttgactggggctttaaacatttgaatag

SEQ ID NO: 26557 - DNA, 121 bp, Artificial Sequence
  Synthesized
  misc_feature (61): n=a or g
gacaattcaaaacaatcaacatgttgtttcagccttgcttgtcacttaggttcagacttcncatgtcactgctagttgccttaaagcagtctctccaaaatatgtcattttttctcataac

SEQ ID NO: 26558 - DNA, 121 bp, Artificial Sequence
  Synthesized
  misc_feature (61): n=t or c
gctatagtatatagaaaacaaatcacatggagcacaacattcaaagctctttaaacaatanacaacagacatgacaaaccctaactgtggaatattatgagtagaaatttagggatgggtt

SEQ ID NO: 26559 - DNA, 121 bp, Artificial Sequence
  Synthesized
  misc_feature (61): n=a or g
aatgacacttgaagtacatcaagtgcctctgaagggttagctcaggtactcgggcaccacngctgggcgagggctttcagctctcctgtcaaccaacgtgaccgctgctgctctccatgtg

SEQ ID NO: 26560 - DNA, 121 bp, Artificial Sequence
  Synthesized
  misc_feature (61): n=t or c
ttcaacatctcatgtcccctaactatggcagaatgtcagggcttataatccttaagttcantgcacagactcgcagctccattttgcctccaaaaacagacattggaaaaccctttggaag

SEQ ID NO: 26561 - DNA, 121 bp, Artificial Sequence
  Synthesized
  misc_feature (61): n=a or g
ttcaatagattcataaataatggaagttaatattccactacaatacttatgtaaattatanaggcagatatatgtggactggaaatacaaacacagtatttttttccattagtatttcttc

SEQ ID NO: 26562 - DNA, 121 bp, Artificial Sequence
  Synthesized
  misc_feature (61): n=t or c
agttaatagaatgccaaggtttaatataaaataaatctgcactgaaaattgctaaaacttngctacaagttagtgacaaagttcccataactttgagatgtaacacagctttgaaatagag

SEQ ID NO: 26563 - DNA, 121 bp, Artificial Sequence
  Synthesized
  misc_feature (61): n=t or g
tcactttctgcattataggcgcagatgtcctaatgtgttttaataccacctccaaatacanacctgcggttggtttgggtacaactaatgttcgttgctgaatcctgtatggaccagagta

SEQ ID NO: 26564 - DNA, 121 bp, Artificial Sequence
  Synthesized
  misc_feature (61): n=a or g
tggctttttaaggaaatcttcttgggggttatgctgggaatctgtgctggctgctgcaacnctagggacagggaagctgtttggcatctgtatttgtaatgatgcagattggatgtgatgt

SEQ ID NO: 26565 - DNA, 121 bp, Artificial Sequence
  Synthesized
  misc_feature (61): n=a or g
gaggaatcaattatctgtcttggtgagaaccggggagcggggggacacattgtggataaanaagggaaaacagtacttgaagtaatggacaagaaagtccagtctgcctcctgtatttcag

SEQ ID NO: 26566 - DNA, 121 bp, Artificial Sequence
  Synthesized
  misc_feature (61): n=t or c
aaatgtatttgcagctagtaaagagggaagagaagggaagactttgatcatagctctgacnataatgtggttagtaattctggcactcaaaatgatggcaaaaccatcagccatccatact

SEQ ID NO: 26567 - DNA, 121 bp, Artificial Sequence
  Synthesized
  misc_feature (61): n=a or g
ggagatcccacagtgtgtcaggatggccaaaactgccaagggcctcagcactctctagacnaaccaagaatctgcagggcacaaggcatagtctgtaaccatgctgtcccttccctccctc

SEQ ID NO: 26568 - DNA, 121 bp, Artificial Sequence
  Synthesized
  misc_feature (61): n=a or g
tcctgctctcccctatttgtatttatcctggaatctcataacaattttgaggtagagatgnaaggatggaggaatactcacgcagctcagcctctgcatttctcctcgattcactctctta

SEQ ID NO: 26569 - DNA, 121 bp, Artificial Sequence
  Synthesized
  misc_feature (61): n=t or c
tgctcagtcactagttcagactgtgatctaatgtttcccatacaagtgggcaatataaaanacaaaaaggatatgctgctttccatctagcaatatcaccagaaccccctgggccaatata

SEQ ID NO: 26570 - DNA, 121 bp, Artificial Sequence
  Synthesized
  misc_feature (61): n=t or c
ccattctgaacttcctgagaacagaggcaggctgtctttatcagatagtttttgattattngagcctggaacagcaaatgacaacttgatgcccaagaagcagctccttacccacttttaa

SEQ ID NO: 26571 - DNA, 121 bp, Artificial Sequence
  Synthesized
  misc_feature (61): n=t or c
agtggtgtcaaagtatgatcttgcgttagtagaaatacatgcatgttgagccaagtaccantgcatactcttgcaagccaaagaggcttgtgtttttttttatattgaccccagtccctct

SEQ ID NO: 26572 - DNA, 121 bp, Artificial Sequence
  Synthesized
  misc_feature (61): n=a or g
atgagcattgaatgaatgtgtcaggttggttcaacttcatttgtaatctcatagttcaccngaacagagaatgtatcttccatgacgttgacagttttattcatgggggcatttaataaaa

SEQ ID NO: 26573 - DNA, 121 bp, Artificial Sequence
  Synthesized
  misc_feature (61): n=a or t
aaggaacaggttctcatatcagagtggaagttctcacagtcaggtagctaggagctgaaancagagatcagagtacctctgaaaagtttcatatcttttggactttgataattaagtcttt

SEQ ID NO: 26574 - DNA, 121 bp, Artificial Sequence
  Synthesized
  misc_feature (61): n=t or c
gttcattttatgcaacacatgaaatatatatacacatgtattctcatgtaaacaaacgttnattgccataagcagtggtctggagaaatctttacaattggaatgaaaccatgtagtatat

SEQ ID NO: 26575 - DNA, 121 bp, Artificial Sequence
  Synthesized
  misc_feature (61): n=t or c
ctatcttgttatgctggcccattctcctggcactcagcatcactattactcacacaaaggntggaagtgtcaggagagactcaagaggagcacagcacgcccgaaaagcagctgtgcacat

SEQ ID NO: 26576 - DNA, 121 bp, Artificial Sequence
  Synthesized
  misc_feature (61): n=a or g
agaagggataacacagagaggttgagttggccttaatactgaaaatatatattgtgtgcancagataatatcttgtacagtttttttaattttctgattgtagataggtgtgattttatat

SEQ ID NO: 26577 - DNA, 121 bp, Artificial Sequence
  Synthesized
  misc_feature (61): n=t or c
gcctgtcatttaattagcacctcagacactgaagattttagaactttgtctatacttccancacaatttttcattccttcatgaaatccttacagaaaaaaacaaattcaaatcatacaga

SEQ ID NO: 26578 - DNA, 121 bp, Artificial Sequence
  Synthesized
  misc_feature (61): n=a or g
ggcacggtcccctttgacaccaacccagcagccaccatttcaaggccagcttataaggctnctgacatctttgaaatgacatcagaactggagacctgctttgtcaaacttacaataagta

SEQ ID NO: 26579 - DNA, 121 bp, Artificial Sequence
  Synthesized
  misc_feature (61): n=t or c
tggtgtgtaagctgtggatttggggcaacagaataagcagagaataggagccaccctaatncaaccatttacttttcaatacatggagcagtaaataagtgttttaaaggaaggagaacaa

SEQ ID NO: 26580 - DNA, 121 bp, Artificial Sequence
  Synthesized
  misc_feature (61): n=a or g
agattggtcctgtaaatgggaaggagcatcctcatgccaagaggagaatggttagatctgnttcagatcatctgatggtgttttaagttctttagcgccactgctagaaaaaaacgtcttc

SEQ ID NO: 26581 - DNA, 121 bp, Artificial Sequence
  Synthesized
  misc_feature (61): n=t or c
gggctccgcgctgtcgccggggaagggacctcctccggagcatctcttctccgtgcgctcncccaagcagatcaaaatcgagtcctctggtgctatcaccgtggtgtccaccacgtgcttt

SEQ ID NO: 26582 - DNA, 121 bp, Artificial Sequence
  Synthesized
  misc_feature (61): n=t or c
tcctatctcaggttttaagttttcaatctgcacaggaagttacctctatgttgattaatcntccaaccttggactttaagaaaattccatgcttagacactgagaaacttcgaaattatat

SEQ ID NO: 26583 - DNA, 121 bp, Artificial Sequence
  Synthesized
  misc_feature (61): n=a or g
aattcctctagctcacagttaaggcatttagaaatacactgaagtcatctgttctcttccngatccctttcctcttaagtactgatttctgtctacaagcttaatacaagcttattgacat

SEQ ID NO: 26584 - DNA, 121 bp, Artificial Sequence
  Synthesized
  misc_feature (61): n=t or g
cacctagtggctgttgcagacagcagggtctgggatacctttggctaaggaggaaagaggngttgaagagttagagtgggagggaggtaaatcaaggcttctgccctgagtccgtgaggag

SEQ ID NO: 26585 - DNA, 121 bp, Artificial Sequence
  Synthesized
  misc_feature (61): n=a or g
atacaaaatgcgaaagaaggcattttgagttgttcagacttctgtatcctttctatattcngaggtcttcatgtcacatagcagcatcaagtccatttgaaagagcatcacattaactcac

SEQ ID NO: 26586 - DNA, 121 bp, Artificial Sequence
  Synthesized
  misc_feature (61): n=c or g
tttcagaaacgaaggtcaaaccaaaaatcctcaggtgcaggaaattggtgctgtctcttcncaggaccaggagatgtgtgccattaactaaaggagagcagaattccatcccatttgttgt

SEQ ID NO: 26587 - DNA, 121 bp, Artificial Sequence
  Synthesized
  misc_feature (61): n=t or c
agttatcactgccaaagcacagctctttctctcaacgtcctgttctgattataagaacagnaatttgccagctcccaacttcctgttattaagccaatttttcaattttcagaaggatttg

SEQ ID NO: 26588 - DNA, 121 bp, Artificial Sequence
  Synthesized
  misc_feature (61): n=a or g
tcctatagcaccttggaggaggtcgctgtgctggtggtgctcctgtctgagaaaacacacnggctgtttggttcccatcatcctcacttctgaaacaattaaagaacaaaaggaatcacac

SEQ ID NO: 26589 - DNA, 121 bp, Artificial Sequence
  Synthesized
  misc_feature (61): n=t or c
ggccttcagggccacttacagtgttttatgctctgaaagatatgatgctctggaaaacttncagaattagtagtgaattttccagtatcccagtgccatcgtggctctgggcttcctgaac

SEQ ID NO: 26590 - DNA, 121 bp, Artificial Sequence
  Synthesized
  misc_feature (61): n=a or g
tcagaaaaagatggaagaaaagcatccggtatggctatctgggcccattattatgatgctntatttcctccctgcagctggacaaggggtaaattcctatgcttccagttgacacgcacag

SEQ ID NO: 26591 - DNA, 121 bp, Artificial Sequence
  Synthesized
  misc_feature (61): n=a or g
tccataaatgatgatgttgctaataaggtgatgtgctcagcacgtccgaccttggctcccnaggcagagaactgcaggctttgtctccatcccaaacctggagcagccccagcacaaagca

SEQ ID NO: 26592 - DNA, 121 bp, Artificial Sequence
  Synthesized
  misc_feature (61): n=a or g
catatttcttattactggaaaaagctcatcattgctggacagctcaagagggttaatgagngaaatatgacagaaaagggactgggtgacatagagcatcatgtcaagataataattcaga

SEQ ID NO: 26593 - DNA, 121 bp, Artificial Sequence
  Synthesized
  misc_feature (61): n=t or c
attccacagctggaattgatgctgacacacagccccatacaatgacaccaaaaggatgctnttccaaatggctttgggctggttgctttaacatatgactaacagctttctggtttttgtt

SEQ ID NO: 26594 - DNA, 121 bp, Artificial Sequence
  Synthesized
  misc_feature (61): n=t or c
acaatttaaaggatttcttgacccacgtgttgccaacctacagacgtcctttagcacctcntccagccacatcccagctttgctgctcaatggatactggcagttcttctcccttccctgt

SEQ ID NO: 26595 - DNA, 121 bp, Artificial Sequence
  Synthesized
  misc_feature (61): n=a or t
gtgcagaaacagaaatatttcttctaccacagcaccatttccatggtgctccagatcctancgcaggaaaacagacatgcatgaatgacctaatatgggacgtcttcctacacttcccaca

SEQ ID NO: 26596 - DNA, 121 bp, Artificial Sequence
  Synthesized
  misc_feature (61): n=t or c
aagtcctcactcccccaggcagttttctcacttatttcatcatagcccatgcagcctttcncattcataactgtgtttgtttgtcagctctttgttgtgttgcagtgctcctgttttctga

SEQ ID NO: 26597 - DNA, 121 bp, Artificial Sequence
  Synthesized
  misc_feature (61): n=a or g
tgagcggcacggatttagctcccaggctcctacagtgtggcaaaggtaaagtgaacacacnaaggaaagctgctgagttggtggtagggaaaaatatggacacaaaaagggcgaagcagca

SEQ ID NO: 26598 - DNA, 121 bp, Artificial Sequence
  Synthesized
  misc_feature (61): n=a or g
agcaagtggctacagaaattatgcctatgctctgagatggacaataggaccaaggaatggnaatgcattcttcctgccgtgaagagttttagtgaccacaaatagcactctcatgataatt

SEQ ID NO: 26599 - DNA, 121 bp, Artificial Sequence
  Synthesized
  misc_feature (61): n=t or c
tattgacaataatactgaactgatattaagtgcggaaaaaaagtctaaataatatagatcngacactgacaagagcttctacatgtagtggaaggaagaacagtggaattttcattgcttt

SEQ ID NO: 26600 - DNA, 121 bp, Artificial Sequence
  Synthesized
  misc_feature (61): n=t or c
ctgctgccctggttctggattgaaccgcagtggttttcaggaccactctcccggttgcccngtcctgaatgttttgagctgtaaattctgatttggtgattgtatggaaggtttcagcctg

SEQ ID NO: 26601 - DNA, 121 bp, Artificial Sequence
  Synthesized
  misc_feature (61): n=t or c
agacttgaataaacactgtctcttcttccttatcatatcttgtcctctgtgatgtctttgngtctgtccttacatagcctcaatcctgcagactgctgtttattgcaggaggatcagtggt

SEQ ID NO: 26602 - DNA, 121 bp, Artificial Sequence
  Synthesized
  misc_feature (61): n=c or g
aagggaaaaagcattgtttttgaggagcagtagatggaaaagcagtttgatttcaaaatancgccgttaacctgatctgcatttttggaagtgaattttttgacagtcaaaataaacgtgg

SEQ ID NO: 26603 - DNA, 121 bp, Artificial Sequence
  Synthesized
  misc_feature (61): n=a or g
acactttcctgactcttgtactgcctccaaactaccaaaatagtcaagcacctcgaattcntgcagcagcttttcttctctgctaatggactgaaaaatggctgtgattaatgaggcaggc

SEQ ID NO: 26604 - DNA, 121 bp, Artificial Sequence
  Synthesized
  misc_feature (61): n=t or c
tttttccagaaatttgtatatttatctgcacgggagccaaatattctcgtagagctacctnggctattgcaaagagagacttattttaagtatccagatgcattaatttgatattatactt

SEQ ID NO: 26605 - DNA, 121 bp, Artificial Sequence
  Synthesized
  misc_feature (61): n=t or c
aatgtacttcagtgactttttacctcgagagcaacttgcttttggaaaatgatatcagcangctgagaggtgaagcctacctgttggttgttgaactgctggtcattctcacttcatttta

SEQ ID NO: 26606 - DNA, 121 bp, Artificial Sequence
  Synthesized
  misc_feature (61): n=t or c
ctagcagcccctgctccatgctctagtcaccctccttcatatcagacagaaaccagagatnggttgtagtctgaagatgctaaataccactttgaaacataactccgagatatgtacttta

SEQ ID NO: 26607 - DNA, 121 bp, Artificial Sequence
  Synthesized
  misc_feature (61): n=a or t
gtttttgcctgttacatgtgttaggatctcactgaactttatcttttatggccttgccctnagaaacctgtcctgtcaattcctcattgagttcctaaaccagtgcaaacaaaaattatta

SEQ ID NO: 26608 - DNA, 121 bp, Artificial Sequence
  Synthesized
  misc_feature (61): n=t or c
tccaatgctgccaacaactccaagtgactggagcatggatgtgtgcctcctgaccatgtgncacaggctatgatggagtccccattaatttgcattgtgtttgacaccaggaaaagcacac

SEQ ID NO: 26609 - DNA, 121 bp, Artificial Sequence
  Synthesized
  misc_feature (61): n=a or g
gaaactcgcgtgacacccggagcacagcagggaggatcgttcagccaaaggatctccccanaccaaccctttttctttctgtccaagctctcaaagcaagccgcgccgcgggacaccgagc

SEQ ID NO: 26610 - DNA, 121 bp, Artificial Sequence
  Synthesized
  misc_feature (61): n=t or c
tactcaggaatggagaagacctgaaactgccaggggaatgcagactgggaaagctcagcangtactgcagggagcacgcatggcatcgggatcagcactgacaaagctgccagggcaaagc

SEQ ID NO: 26611 - DNA, 121 bp, Artificial Sequence
  Synthesized
  misc_feature (61): n=a or g
cactgaagttaaaggcttccttcacctacatcagcctgcaatttggatcagaagcatcagngtgtaccataagggcacttttttcataaaagattttttgaatggctatatgaaagctgtc

SEQ ID NO: 26612 - DNA, 121 bp, Artificial Sequence
  Synthesized
  misc_feature (61): n=t or c
gttcaaaaccctcatacagtttaaaccaggatcagaaataatgaaaaagagctggagtaangaaagtcagcatattccaatcattccagctgatagttatttctttaagagactggaaatt

SEQ ID NO: 26613 - DNA, 121 bp, Artificial Sequence
  Synthesized
  misc_feature (61): n=t or g
ctctctgagtgctggtgttgtcgttgtcccttaggattctcctgctgaaagtttcgtgggngaggttttaggggctgaaaagacctttgtggcatttatagcacaagtcttgtttatatgc

SEQ ID NO: 26614 - DNA, 121 bp, Artificial Sequence
  Synthesized
  misc_feature (61): n=a or g
ctttactgtattgttcctgatagaactatgtgacctaacgtcacacctctgtgcatattcntagaacctcttaatttttgtgcagctcttctgagctgtgaactatacactattcttagtg

SEQ ID NO: 26615 - DNA, 121 bp, Artificial Sequence
  Synthesized
  misc_feature (61): n=t or c
ccaaacctgtatgaacaatatagcaccatcaagattcttctcattagcatagtatgaacgncttgttcacctttgaaatgtctgaaatcacagcaattaactatatcacaaggctcaaatg

SEQ ID NO: 26616 - DNA, 121 bp, Artificial Sequence
  Synthesized
  misc_feature (61): n=t or c
cagatgaagaaagggttgggaagtggtgcaaaggaggaaaaatcagaacctgcttaaattntggcttctctgaagtgctcgcaatgcaaatgagacctgcttatgaggtgccagaaagctc

SEQ ID NO: 26617 - DNA, 121 bp, Artificial Sequence
  Synthesized
  misc_feature (61): n=c or g
ccttagaatggagaagagatctccttctgtaagatctcatgagcctgttgaggtggtgctntgctgcagttttgcctctttgcagaatttactggaatcacagctctaaatactgcatcgt

SEQ ID NO: 26618 - DNA, 121 bp, Artificial Sequence
  Synthesized
  misc_feature (61): n=a or g
agagcagaatacagctgttactataacatgatcccacctggagtagtcacggacagcagcncttctgtaacatctacagtagacgacgcatggcagtgggtaggtgtgagtactgtaccac

SEQ ID NO: 26619 - DNA, 121 bp, Artificial Sequence
  Synthesized
  misc_feature (61): n=c or g
aataatttctctctcagaattcctggagaaagaacttctctgggatttctccaattcttantagtgattattggatctacgggttttctaagaacatgcaattacttccaaggaactttta

SEQ ID NO: 26620 - DNA, 121 bp, Artificial Sequence
  Synthesized
  misc_feature (61): n=t or c
agactgctccaggttacttaagattcagtggaatatgcaactagagttccactccacagantccttcttcactttttactaaatttaccatggacttaatatgaatggcttgaggcaggta

SEQ ID NO: 26621 - DNA, 121 bp, Artificial Sequence
  Synthesized
  misc_feature (61): n=t or c
ggcaaaggtgaggtaatacctgtaaattgatgttctttctttcattgacccagaaaatagntttctatttgaagtgcatgcaagaccaagagctcttttgtacccctggtccctccatctc

SEQ ID NO: 26622 - DNA, 121 bp, Artificial Sequence
  Synthesized
  misc_feature (61): n=a or g
cagtactcctccttttgtcatgacctcatagaaggtccttggagaagctgtgtaatggagngtgtatcttggagagaatcagaagctgtggtgtcatgggcagtgctcctgatacaacttg

SEQ ID NO: 26623 - DNA, 121 bp, Artificial Sequence
  Synthesized
  misc_feature (61): n=c or g
ttccattatgcttgctacagttgtctatcttgcttcttgcaaacccgtccctccctctgtncagatgcactgtgatgggtctggatcaaggcagggagagcttctttgggaccaaacccac

SEQ ID NO: 26624 - DNA, 121 bp, Artificial Sequence
  Synthesized
  misc_feature (61): n=a or t
attggagcagttgacctcagcactacaaaatctcacagaacagttgtaacaatggatgaanctacttcaggtatcataactacagtaatagaagatgatgaaaagcctgtggacctgactg

SEQ ID NO: 26625 - DNA, 121 bp, Artificial Sequence
  Synthesized
  misc_feature (61): n=a or g
ctccagtgtgtcagttcacccaagtccacagactggttctcctcattcaacaaaattaacncttaaaaaaaaagctattgactttttatctccccattcaaaccaaattaaccgagtccat

SEQ ID NO: 26626 - DNA, 121 bp, Artificial Sequence
  Synthesized
  misc_feature (61): n=a or g
ttctgttatccaacaagaccagcacagaagggcagtgttacagttggttgacccttcaccntagcatcagacagtgtaccaagtgctagaatgctactttatttttaacaattaggagtgc

SEQ ID NO: 26627 - DNA, 121 bp, Artificial Sequence
  Synthesized
  misc_feature (61): n=a or g
agggtcttccttacggtacaggaatactaatttgcacgttaccaagagtttagtagcacanagggattgctacaaattaccaaattacttctttaaataaaagaagtactaagcacatgag

SEQ ID NO: 26628 - DNA, 121 bp, Artificial Sequence
  Synthesized
  misc_feature (61): n=t or c
cagctgcgtgcggagtgacggcaggcacgccgtgctgaggtaagggcgcttccacatctcncctgttgtttcctttcttgaacgagttgccactttgcagagcctcactcgctcaccttct

SEQ ID NO: 26629 - DNA, 121 bp, Artificial Sequence
  Synthesized
  misc_feature (61): n=a or g
attgcaaattagaaaatgtcacagattccaccagacataaatcacaacttttttttgcccnaaatatggaattaattgaagtgtacagcccagatcacaaggccaggattttcaatggagc

SEQ ID NO: 26630 - DNA, 121 bp, Artificial Sequence
  Synthesized
  misc_feature (61): n=t or c
tctggtggtgagcagagcctccagcagctcagctgatggcggtggggtggatgctaaacangcaggaagaggtacaggataaggataaagccctcatttgggttggattgtgttcggtttt

SEQ ID NO: 26631 - DNA, 121 bp, Artificial Sequence
  Synthesized
  misc_feature (61): n=a or g
atgtagaaagactgtgtgactgaattgaactgtttaagaggatgaaaagtcaaagagcagncaggatttttgctgtggatacctgtaaatcttgttgctttctgcttggcttgaggttggg

SEQ ID NO: 26632 - DNA, 121 bp, Artificial Sequence
  Synthesized
  misc_feature (61): n=a or g
aaagtaagtatgtgtctttttttttcgtttttttcttactgaacttaaaaatacactacanttcaccaattaacttgtaagatggaaatgatgtcacatgacagagaactcaaaataaaat

SEQ ID NO: 26633 - DNA, 121 bp, Artificial Sequence
  Synthesized
  misc_feature (61): n=t or g
gcagatgctgttaccatgacaaatcactttttaatcagtcataattttgcactaagtgctntataactgccctttgtttcactacttaaaccatcaatggctaacactggaagtcacagac

SEQ ID NO: 26634 - DNA, 121 bp, Artificial Sequence
  Synthesized
  misc_feature (61): n=a or t
tgaaaaatactgtaatttgttgttttattctttttatcattttgttataaactatctctgngactctttcacaagtagcctctgatgctccccttagttgtttcccattccttttcttcta

SEQ ID NO: 26635 - DNA, 121 bp, Artificial Sequence
  Synthesized
  misc_feature (61): n=a or t
gtctggtacaagaaatgctttgcttactgtcagtttattgtgccacttcttttgaactttnactttttctaacttataaacatttccaagtgtagtgtttttctggtgtgtgtgcaaattt

SEQ ID NO: 26636 - DNA, 121 bp, Artificial Sequence
  Synthesized
  misc_feature (61): n=a or c
aggccaaaacaaaagaggtattgagtatctcagccttttccttgtcctacaccacaacgtnagctactcagttctgcagcaggcacatatatttcttcaccttccttttgctgccggtatt

SEQ ID NO: 26637 - DNA, 121 bp, Artificial Sequence
  Synthesized
  misc_feature (61): n=a or t
aatgaagaatattcaactattacgatcttcatttccagagcatctgagtttagaacatacntgtgtagtcatgaggctatttagatctatccatagttgctgcaggttttgttactgagtt

SEQ ID NO: 26638 - DNA, 121 bp, Artificial Sequence
  Synthesized
  misc_feature (61): n=t or g
ccatcagccttattgtggtccatgttgagaattactaattaacatcagaaataattaacantgggactttacagtctcagataaattaggacaaaactgcatatgtgtgacattcagacta

SEQ ID NO: 26639 - DNA, 121 bp, Artificial Sequence
  Synthesized
  misc_feature (61): n=a or g
caccgtataacactccaattctgccagtacagagggcagacggcacctactggctggtgcnagacttaagaaaaagtaatgaaatagttctcaagcaacaccccgtggctcctagccccta

SEQ ID NO: 26640 - DNA, 121 bp, Artificial Sequence
  Synthesized
  misc_feature (61): n=a or g
ggagctgataaagatgaagaaaactgtggaagacctccctgtacccactgctgcctgcctngctcatcagattgctttcaaccctccggcacgacgtgcctcttccccgtgggcaggagga

SEQ ID NO: 26641 - DNA, 121 bp, Artificial Sequence
  Synthesized
  misc_feature (61): n=t or c
catggcacaccctgcatggagcctcctgctgcccagcatgggaaactgggaagcaatttgngatgggagaatgatgggatgaagccatggaggcccccaggttgtggaggtctccaagcca

SEQ ID NO: 26642 - DNA, 121 bp, Artificial Sequence
  Synthesized
  misc_feature (61): n=a or t
aaaaatatttatcaagtggaaaaaagcagcagttacatcagtaatacatcagaaatactgnggtagatacatttctgtatctgtcctctatgattccgtgttgcagctgaagagcagaacc

SEQ ID NO: 26643 - DNA, 121 bp, Artificial Sequence
  Synthesized
  misc_feature (61): n=t or c
agaagaaacgatcttctacttgtattaccagactgaatctgtcattgtgcacctggttctncttacattcaaaatattactggcactaatagaacttgccatttgaaaagtgtttccacat

SEQ ID NO: 26644 - DNA, 121 bp, Artificial Sequence
  Synthesized
  misc_feature (61): n=a or c
caccttttttcccagtgcttcttaatttgcatgcttattgcatgcttaaaggaagaaaggncattttcttaccagcgtggctgaaacaggcaaaacatcattttgtgacttctgtctctgc

SEQ ID NO: 26645 - DNA, 121 bp, Artificial Sequence
  Synthesized
  misc_feature (61): n=t or g
acgtcaattaacgtttttaagaatcatttaatgttttgtatctttatttactttaccaaancttttaagactttctaggatataagaactcctttttttatatgacagcacttctatgtct

SEQ ID NO: 26646 - DNA, 121 bp, Artificial Sequence
  Synthesized
  misc_feature (61): n=t or c
tgttcctagaaaaacagatcagatctttccaaggagtaatcacagatatcaatcctacctntgcagctaactaggtaatccagagggattggacttcagtgaaatcataacaggcagtgta

SEQ ID NO: 26647 - DNA, 121 bp, Artificial Sequence
  Synthesized
  misc_feature (61): n=a or g
ctcaattctttatcatctcaaaataaacagaacggctctcttttgaaggccacacttagantgaggcaatgtagaagctgaaaacagtaagtactgcagtcagaggtctttgatttacggg

SEQ ID NO: 26648 - DNA, 121 bp, Artificial Sequence
  Synthesized
  misc_feature (61): n=t or c
atgttctctatttgcatctgcttagcttctactttttgcctttttgacttcataaaaatantctaggaaagatgtttaggcatacccaagagtggaacctttgtagggtgaatccagcaat

SEQ ID NO: 26649 - DNA, 121 bp, Artificial Sequence
  Synthesized
  misc_feature (61): n=a or g
ctgaatatgggttttaagctctgtttctattatacgatttcttataccttgattaatattntgaacgataagtgcaacatttgtcttaatgcaacacagtaaatagaagttgcataaaaag

SEQ ID NO: 26650 - DNA, 121 bp, Artificial Sequence
  Synthesized
  misc_feature (61): n=t or c
tagtaattatgatcatgggtctggtagcagatatgtacactaggccacttctttaccttgnttaattttttccactgcttgatgaaatttggggagtacggcaatggttttcgagtcttat

SEQ ID NO: 26651 - DNA, 121 bp, Artificial Sequence
  Synthesized
  misc_feature (61): n=t or c
acatgaagcagattgagtggcaggtgtgtctcaaagaactattatctgcactcaagtcttnaagaagaaaggtcagaccccgaatgtacgcccaagatcctggagcagccatcagccactc

SEQ ID NO: 26652 - DNA, 121 bp, Artificial Sequence
  Synthesized
  misc_feature (61): n=a or g
ttcagattaggggaaaataaacatgaagttgaaatcagattttcttggcacggcgcttaangaaggcttgcatgttacatatctgatgatattgtctctataataagtaccatggttatgc

SEQ ID NO: 26653 - DNA, 121 bp, Artificial Sequence
  Synthesized
  misc_feature (61): n=t or c
caactgaagcacaacactgcttagggaatttttccctggcagctgaagaaaattagaccangggatctctttagaatatcacctcaagcgttcacaaattccatcccatcgctttacgaac

SEQ ID NO: 26654 - DNA, 121 bp, Artificial Sequence
  Synthesized
  misc_feature (61): n=t or g
ctactttactgaattatttcacagtggctgcagccccattttcaaataatagctttaagtncctcttgaaaaatgccacaggagttcttgttatctcaagagattagactgtgtattcaac

SEQ ID NO: 26655 - DNA, 121 bp, Artificial Sequence
  Synthesized
  misc_feature (61): n=t or c
gttcacctttagttaatgaccttatttatagaaaatctgcctctgcatggtaaatagccancctcagtgacaaaatcttttcaaagtgtcaatttctgtcttagcaaatgactggactaat

SEQ ID NO: 26656 - DNA, 121 bp, Artificial Sequence
  Synthesized
  misc_feature (61): n=t or c
gagcttattagttccctaattatttcctctttctccaggaggaataaataggcatctctgnggttccctgtactgggctgcatattgcaaacgtgatcgtcggtctgctcgaggcaatgat

SEQ ID NO: 26657 - DNA, 121 bp, Artificial Sequence
  Synthesized
  misc_feature (61): n=c or g
ccatcttaaaatgtgtaccggtgcttttctactttaagattttatgaaattaaatgcatanactgcacgtatataattgcacttctcttatagtgacagagttctttcagaactaaacata

SEQ ID NO: 26658 - DNA, 121 bp, Artificial Sequence
  Synthesized
  misc_feature (61): n=a or g
atggcaaacctacacgtgattggtgatcacatcccgatgggaagacaaagtactaccattncaggtattgccaaggatcactccctaaaggagctgaggagttctgcagcttccaggtgga

SEQ ID NO: 26659 - DNA, 121 bp, Artificial Sequence
  Synthesized
  misc_feature (61): n=a or t
tagcaatacatcgttttctaatggcttgatccttgtgccattttatatttactttaaacantgaagaaacatttctctaggaatctccaccttttggttttttgtttgtttgtttgtttgt

SEQ ID NO: 26660 - DNA, 121 bp, Artificial Sequence
  Synthesized
  misc_feature (61): n=t or c
taaatccattaacaaaaccaggccgagcctgcataacttttgattctcctggtggaaaaanggcactgagtgtatttctgggaatgacagacagccaccgttcccagcgctgccacgtgaa

SEQ ID NO: 26661 - DNA, 121 bp, Artificial Sequence
  Synthesized
  misc_feature (61): n=a or g
cttcagagatgccatgagtagatctgtcatttatctgtttgaattgagttggattgtcctntgctcatgcttctatatttgagattaaaagggaaaaaagagagcagtgtttacactaact

SEQ ID NO: 26662 - DNA, 121 bp, Artificial Sequence
  Synthesized
  misc_feature (61): n=a or g
aagagaagacagaggggaagcatcatggtagcctatggcttcttcacgaggtgagcaaagnggcagttgctggtctctgctctctgatgacagtgacaggacccaagggaatggaaaggaa

SEQ ID NO: 26663 - DNA, 121 bp, Artificial Sequence
  Synthesized
  misc_feature (61): n=t or c
cattggaaagcaagtgtgattttagtgtgttactgataagtaacaaaactttgtgagactnaatgcagcaagaaatagcaggaaaacatctgcagtctaaacttaacgtaccagaccccat

SEQ ID NO: 26664 - DNA, 121 bp, Artificial Sequence
  Synthesized
  misc_feature (61): n=a or g
ctaagattttctagctgtaagtacatcatcagaactttcactcatcagatgtctctgctgnaatacttacaaggcaggattgcacttgatttgttcaccttcctttccaggaacaagaaaa

SEQ ID NO: 26665 - DNA, 121 bp, Artificial Sequence
  Synthesized
  misc_feature (61): n=a or g
ttaagacaatctttctgactgaaaccggatctggatggctggaaagccgaaatcaccatcncctgtacagggagaacacagccagtaagacaagaggcagatgagatgatagcgctgcatg

SEQ ID NO: 26666 - DNA, 121 bp, Artificial Sequence
  Synthesized
  misc_feature (61): n=a or g
caactgcatgtgcgttgccatcaagtgagttcactgcaccgcacagcaactctgtgctttnccccatttgcctgagaggggcttcctggaagatgtgcagtgtagcaattaactggcatga

SEQ ID NO: 26667 - DNA, 121 bp, Artificial Sequence
  Synthesized
  misc_feature (61): n=a or g
gtaacgaaatcctgccgtctgagtggtcagtgagatgaggttctggggtctcttcccccangggatgctctggtgggctcctagattcagggcagtgctggtaagcagaaagcttctaaaa

SEQ ID NO: 26668 - DNA, 121 bp, Artificial Sequence
  Synthesized
  misc_feature (61): n=t or c
agtcatccatattaacacaatacttgcatggtctggagctgtttaaacaaaacctccttcnatagctaaaagtttcaaggaaattagccaagtaataagactaaacattttcttaggagta

SEQ ID NO: 26669 - DNA, 121 bp, Artificial Sequence
  Synthesized
  misc_feature (61): n=a or g
cttgccagtgggataatcacactgagcttcactatgggggagtggattcacttggcttaangatctgaacttggaacagcgatctgtccttgagacaaacaggaaaggtgttcttgacgca

SEQ ID NO: 26670 - DNA, 121 bp, Artificial Sequence
  Synthesized
  misc_feature (61): n=t or c
tttggacacacgcattagctaatttccttgggttctgatactagctatcaaattccaccanccccctgtctctgggctgcttttttctttcctttttttttttttttttttctttctttct

SEQ ID NO: 26671 - DNA, 121 bp, Artificial Sequence
  Synthesized
  misc_feature (61): n=a or g
cttttgtgaatctactgcagagatttagtatacaaagtctgagttttgcagagactgtaantccttcttagagaagttatacctagcttacagtcataaataatagtctcgatctttttgt

SEQ ID NO: 26672 - DNA, 121 bp, Artificial Sequence
  Synthesized
  misc_feature (61): n=a or g
agcagtaattccatacaatgactccttaacatcggtaaatgcatctgagtaactgcagctntcaaacactgccaaacgtggaccaagccctcaaaagtctctatatatgctcatttaacat

SEQ ID NO: 26673 - DNA, 121 bp, Artificial Sequence
  Synthesized
  misc_feature (61): n=c or g
ttttcagttgaggtaacatagctgccagttcctggagaacaacattgttattctttgagtnttactgtccttacaattttcttatttagtaacttcatctctccactcctgaaatactacc

SEQ ID NO: 26674 - DNA, 121 bp, Artificial Sequence
  Synthesized
  misc_feature (61): n=t or g
tttatcttattcttgataatcctttgccagcactttccaacagaactttccatgccatganacccactgtagaggatctgggagctatgaggaaatgattgcactttcagaatgagagggg

SEQ ID NO: 26675 - DNA, 121 bp, Artificial Sequence
  Synthesized
  misc_feature (61): n=t or c
gcaaacaccaaagctgtgctggaggacagagctcagttggggctggaggagctcagccttntatccccagggcgatttatcctacctgcacatccagcttggttaagagcccttcctgaag

SEQ ID NO: 26676 - DNA, 121 bp, Artificial Sequence
  Synthesized
  misc_feature (61): n=t or c
ttccattccctgcgctctgcgccaaggctgggagctccagaagggtttgtttgtgttttcntttccctctccccagaaacatctgggcaggaaaagcacaatgaagaaattataagtgaca

SEQ ID NO: 26677 - DNA, 121 bp, Artificial Sequence
  Synthesized
  misc_feature (61): n=t or c
cacagggagatacagcgcatttcattggcatcaccttctgcttacaatctgaagtattacntatatgcagtcatgttaccctgattctaggcagggtgcatgctagttttggtaggaaagt

SEQ ID NO: 26678 - DNA, 121 bp, Artificial Sequence
  Synthesized
  misc_feature (61): n=a or g
ttggcccattccatggcatttcctgcctcttccacacacactcaggatcccacatgcctcncaagccgttcaccaactgcagcccggcagatggaggagctgggcagagctctgcagcagg

SEQ ID NO: 26679 - DNA, 121 bp, Artificial Sequence
  Synthesized
  misc_feature (61): n=t or g
gaatcattactggaaagaataggcaaaaaaaccaccataaaattaatgttcataagctgtntaacccagatgaattcagaaatacctcttggtaaataacatcttttaaatggaataaaat

SEQ ID NO: 26680 - DNA, 121 bp, Artificial Sequence
  Synthesized
  misc_feature (61): n=t or g
tcagatgcagaggacagcagtgagccaggagggattaaagcagccaaaggaaagctggaantggtactgtgtcttctaccaaacagacctggcttttgagcacctctcctgcactgctttg

SEQ ID NO: 26681 - DNA, 121 bp, Artificial Sequence
  Synthesized
  misc_feature (61): n=a or g
gcagctttaatagtagtccctacactaacaggcaattctgtttcctttgatggagatttgngcttttgctgctggagcaggtgatcttcctgccctggagcatgcagtcggcatgtgtaca

SEQ ID NO: 26682 - DNA, 121 bp, Artificial Sequence
  Synthesized
  misc_feature (61): n=a or g
aggataaaatccaggcaatgtgtatggaagaaagtccaatatttttagtaatctgtctttnttatgaaaccacaaatggaaataaatggagtgtaattcatgtaggtaaggaaagttagtt

SEQ ID NO: 26683 - DNA, 121 bp, Artificial Sequence
  Synthesized
  misc_feature (61): n=t or c
aaagttttcatataaagaacagcgtggtgacaatgcatctgatgactcttcagtctgcttntctcaatccatgtatctatttcttttttcccttgtgctgctggcacatcttcagtgctgt

SEQ ID NO: 26684 - DNA, 121 bp, Artificial Sequence
  Synthesized
  misc_feature (61): n=a or g
gctgtttatttcaatgtggctaaccttacagtagttacttcaatgcaaatacttgagtcanttgtctcgattgacagcagacaatatgtaacttgaattttcatttattttagaaaattgc

SEQ ID NO: 26685 - DNA, 121 bp, Artificial Sequence
  Synthesized
  misc_feature (61): n=t or c
gccctatccaaaaacttggaggcaacagaagatacagcaaaagctacagctgaagagcacntgtgttcaggaaggcatagaagaaaagaattacactgtattatcacactgccagctattc

SEQ ID NO: 26686 - DNA, 121 bp, Artificial Sequence
  Synthesized
  misc_feature (61): n=t or c
cgccaagtgctcagtaaagaaggagatcatgtgactgcttgcttgcttattctgacccacntcccttaggtcagcagcatcccatgttgctcagaggtggcacaacagcatcccttctctg

SEQ ID NO: 26687 - DNA, 121 bp, Artificial Sequence
  Synthesized
  misc_feature (61): n=t or c
tgtaatacttctgttctatgtaagcccaattatgaagatttaaatcaccttcataaatganataggactcctaatggaccaaaggacgggggtgaagttagtgtgtgctaataatacaaat

SEQ ID NO: 26688 - DNA, 121 bp, Artificial Sequence
  Synthesized
  misc_feature (61): n=a or t
cacacaaagtgaaaaagtgaaaaaatatttatgagggtggtcaattcctctcagataatgngtgatgacttgtagcctgtgccttgctccaaatgtgaaggtggacagtcagggatgtgcc

SEQ ID NO: 26689 - DNA, 121 bp, Artificial Sequence
  Synthesized
  misc_feature (61): n=a or g
gatcctctaacttctaactggtcttcccaaatctgttcatggctgattcctctccctgatnctacccccacacatctgacctttgatgatgctgccttcttgcctccagcacattttcttt

SEQ ID NO: 26690 - DNA, 121 bp, Artificial Sequence
  Synthesized
  misc_feature (61): n=t or c
attcacaaaaaaaggagccagccaggcagagagcaacatgcaccactgtatgtcctactgngcatcataaggtacatcaaggggtgcacccattttccagtgagcagatttcttgtcaaca

SEQ ID NO: 26691 - DNA, 121 bp, Artificial Sequence
  Synthesized
  misc_feature (61): n=a or g
tgtcgtcctgaacagaatgcacatcaaggaattaggattttcctttgtagaaaaaagcttncctacttcaattcgttttacattttgcaaaaagctggttggtgccctctctagagagcta

SEQ ID NO: 26692 - DNA, 121 bp, Artificial Sequence
  Synthesized
  misc_feature (61): n=t or c
tcttgtacactgggtttggattctgtttctctccattgctaagagcttatcttccaatttnggcttaaaatttgggtaatacatctttttcagagcatggtagaaggaatagatgcagtga

SEQ ID NO: 26693 - DNA, 121 bp, Artificial Sequence
  Synthesized
  misc_feature (61): n=c or g
ggcccttccgatttcctgccgcagcgggggccggggagggccaatcactgggggaagccanacggggacagtgtttttttccaggccggatctgaggatcattaatgggagcaaactagcc

SEQ ID NO: 26694 - DNA, 121 bp, Artificial Sequence
  Synthesized
  misc_feature (61): n=a or g
gcttttaatttattcagcttctaggggttacttaggacacaaccttgcaccattaaagacngtacgttttgccatgaagaatgtggagcatagccaggctcttactgtactgtgctaagta

SEQ ID NO: 26695 - DNA, 121 bp, Artificial Sequence
  Synthesized
  misc_feature (61): n=t or c
cttggggtaccaaaaagctgctttgcagatgctttgaccaacaccaccaaataaaaaggtngcaaaccaaaccctggagaccattcaccatccatgacacctgtccaaccaaatccttctc

SEQ ID NO: 26696 - DNA, 121 bp, Artificial Sequence
  Synthesized
  misc_feature (61): n=t or c
catcagaggcagattgtggtggtggtattggatataggccaatccttcttgtcaacattangttacatgttgattgcatacaacagaaggcagtagaggggcagtctgacagaaccatgtt

SEQ ID NO: 26697 - DNA, 121 bp, Artificial Sequence
  Synthesized
  misc_feature (61): n=a or g
tattccaaacatttctgcacgtatgacccaaacaaacagcaaaattcaggtcttaagcaanaaagataatggattgtgatgcccaatcatcttcacagtcttctaacacatgcactgcaac

SEQ ID NO: 26698 - DNA, 121 bp, Artificial Sequence
  Synthesized
  misc_feature (61): n=t or c
agcaaaaaattcagcccttggcactgtgtgtttgcatatctaagaagaaggagaatatttncatgcaattagattatccctagtccttgtgtgaccacttcctcgcatgctacacactgaa

SEQ ID NO: 26699 - DNA, 121 bp, Artificial Sequence
  Synthesized
  misc_feature (61): n=a or g
aaagtaagccagactgaacttttgctccatacaacttttcccatgccttcattcacttctntacctcttttctccactctcattcagtgtgctgaatgacaaagacaatactcagttactc

SEQ ID NO: 26700 - DNA, 121 bp, Artificial Sequence
  Synthesized
  misc_feature (61): n=t or c
tgaagatgaatgattttagagagttttacaccatccagcctaacaaatagttatttgtttngtcttgcttaggacgagatagctgacttcctcactggcatcctcactcgagcagagagcc

SEQ ID NO: 26701 - DNA, 121 bp, Artificial Sequence
  Synthesized
  misc_feature (61): n=a or g
taaataagcaagaaaattctttatttgagtgaaagtaccctggcagatctgtatctcaatnataaaaaggacggaggatttaattgcccaggctaatcaatgtgtcctactccatattctg

SEQ ID NO: 26702 - DNA, 121 bp, Artificial Sequence
  Synthesized
  misc_feature (61): n=a or g
atcaggttaagttagttgagcaaggttaagatcactggaaagacaaataaacttgaaggcncattatctgttatcactgaagtcatacgtgaaatataagtagttctgaaaagtttttatg

SEQ ID NO: 26703 - DNA, 121 bp, Artificial Sequence
  Synthesized
  misc_feature (61): n=a or t
agttattgtgtcctaggtttttttcattattttttctatctctttggtaaaacttatgaangcttgtgttcctattgcctattgtattgtactctcataatgaaatgtctctgttcccccc

SEQ ID NO: 26704 - DNA, 121 bp, Artificial Sequence
  Synthesized
  misc_feature (61): n=t or c
tctgagttgttcaacaacatttcagctgagtctctgggaggagtttatatgaccctttttntgtctggatcagtcatactggtgttttataaagtgataaaagtaagaatgtcagataata

SEQ ID NO: 26705 - DNA, 121 bp, Artificial Sequence
  Synthesized
  misc_feature (61): n=a or g
cattttctttattcctgggccagggttgtgttgttgaacttcttcactttggggaatccanctttctttgagtgcctctttgctctgaagcacagaaactctgactgacaactcgagttac

SEQ ID NO: 26706 - DNA, 121 bp, Artificial Sequence
  Synthesized
  misc_feature (61): n=a or t
cagtaaagctgaagagccttccagggctgcacttgatcagcacctgctactgtgttaaacnagaaacatgaagaacttagataatgctgacttgttagaacacagaaggacaagaatgcgt

SEQ ID NO: 26707 - DNA, 121 bp, Artificial Sequence
  Synthesized
  misc_feature (61): n=t or c
gtgagtgaaaataataggaagcattcatggacgtggcaaacatcaagtttttctggaatgntgaaattctgtgaatgaagtttggatttgcttgttgggtttgaggttttttttttttttc

SEQ ID NO: 26708 - DNA, 121 bp, Artificial Sequence
  Synthesized
  misc_feature (61): n=t or c
taccaaaagaggcattataaacgtcccagggtttgcctcccggggagtgctaaatggtggnggtggtccctgaggatgctgcagctcttattctgctgcttaccttcctcacatcatttcg

SEQ ID NO: 26709 - DNA, 121 bp, Artificial Sequence
  Synthesized
  misc_feature (61): n=a or g
atcatttctttgcccctgtaatagccttggttttttagcctcaaaatttttgtctatactnaaaccactgcaaaacagagcacactcttcttcactacattcaggaaactgaaagtgtccc

SEQ ID NO: 26710 - DNA, 121 bp, Artificial Sequence
  Synthesized
  misc_feature (61): n=t or g
ttccactacataacaatcttacaaattttctgacccttagctagaaagctacaaaaattanaaagctgttaaaccacacattcctttgaaatgtttgttaggaaaatggatttgaactgaa

SEQ ID NO: 26711 - DNA, 121 bp, Artificial Sequence
  Synthesized
  misc_feature (61): n=a or g
gattttgtggctgtaacctgacagagggaaatttataagtaagctttattacaaatggtcncatataacgaaatgaaaggaggaggaggaaagtgcatgagagaatcagaatctcctctct

SEQ ID NO: 26712 - DNA, 121 bp, Artificial Sequence
  Synthesized
  misc_feature (61): n=t or g
aagacgagattgatgagtgagtgcattcaggtgagaatacattgcacttagcagagggacngtcagagctgtgaactacacacaaccatggctgggctgagaagggacctcagggtccacc

SEQ ID NO: 26713 - DNA, 121 bp, Artificial Sequence
  Synthesized
  misc_feature (61): n=a or g
catttcctgctttttctctgccagagaagccagaggtggagcagggtgagatgatccgcanttgaactcttgttacctttatcagcttctctaccaaagtcttcatcacctcactgttacg

SEQ ID NO: 26714 - DNA, 121 bp, Artificial Sequence
  Synthesized
  misc_feature (61): n=a or g
acatctgtagaacctgagctgaaatctcacacgagcgctttggtttctctcactacgcaanttgaaggtccctggtgaaatttagtgtacccttgctagacatggtactggtcactgaaaa

SEQ ID NO: 26715 - DNA, 121 bp, Artificial Sequence
  Synthesized
  misc_feature (61): n=t or c
cactgtctgacatttggcagagcaaggaccccttccaatccttgttcagatctgtccctgnagcgacaactgcataatagagactgaaatccttcagactgaggcaaagcctcagattttc

SEQ ID NO: 26716 - DNA, 121 bp, Artificial Sequence
  Synthesized
  misc_feature (61): n=a or g
acatgagccatctgaggtgaaccacgtttcacctctgagacaagcaggattaccatataanaaaatagcaaccaccatgacgaaccagcatgtttttcctagggacaagggtaatagacca

SEQ ID NO: 26717 - DNA, 121 bp, Artificial Sequence
  Synthesized
  misc_feature (61): n=a or g
agcctgctcatacccagtgcttgctgtcttcagccaagtgctttacaacattacattcacngctttacatcttctaaaaccatatcatgtgcaaaagtgaaggcagttttcaccacatacg

SEQ ID NO: 26718 - DNA, 121 bp, Artificial Sequence
  Synthesized
  misc_feature (61): n=t or c
tctgtttactaactgttgaaggattctttctgataatacttaacagtgtaccatagaagcngtattatgtacattttatcaaaaatactctccactgagctgttattcaaaagtcaagaca

SEQ ID NO: 26719 - DNA, 121 bp, Artificial Sequence
  Synthesized
  misc_feature (61): n=a or t
aaaatggcatatggtggatggctcaatgaaaatcttcataaggaatgagaatataccagcntaaaatccattatgaattaaacttcaagattcaaggctgtccaaaacacaccaaagaaca

SEQ ID NO: 26720 - DNA, 121 bp, Artificial Sequence
  Synthesized
  misc_feature (61): n=t or c
ccactgaaaaaaagccaggtactagactaacacaggacctcatttgtgaatcaaaatatanacagcagtgaaacccatagggcacaatccatttcagtcatgaagtttccccacttgacaa

SEQ ID NO: 26721 - DNA, 121 bp, Artificial Sequence
  Synthesized
  misc_feature (61): n=a or g
ttgccatacttcttggaccttggggatctaagtaattttttaaggagatgtgaagctaagntaacaatgaaagagtccttaataaatgtgtgttttgttttgcaactgttagatccattac

SEQ ID NO: 26722 - DNA, 121 bp, Artificial Sequence
  Synthesized
  misc_feature (61): n=a or g
gtattatgagcttgaaggcggtaagtaaattaatgaagaaatggtcacatccttacacaanaatggggctttctatagaaatatgaatacagaaataagaaggaagcagttttgtaaaatg

SEQ ID NO: 26723 - DNA, 121 bp, Artificial Sequence
  Synthesized
  misc_feature (61): n=a or t
taactattttaaaacgttctatgattttagagcatccaaaaggtcaaagtttaataactanggtgtataattccctctaccttcagctctgcctctagtgttattaacttatctacagtct

SEQ ID NO: 26724 - DNA, 121 bp, Artificial Sequence
  Synthesized
  misc_feature (61): n=a or g
gagtagggtaagtatggatccttttctaacccacagagagggtaattattaatgatgctcngtgtgagtttactttcactgaaccaaaagttgggtgaacttgccctcaggaagctagcat

SEQ ID NO: 26725 - DNA, 121 bp, Artificial Sequence
  Synthesized
  misc_feature (61): n=a or g
gaaacgatttctgaatatgactatcccctctcataggtttgtgttacacagattcaaaccngtccacttaaactgaatcatttctgctcactagagaggctgtttgacagctggatatttg

SEQ ID NO: 26726 - DNA, 121 bp, Artificial Sequence
  Synthesized
  misc_feature (61): n=t or c
aaaatttagaggagaagtggagaaagctacagcaggggattgcatccactcacagttttcngttgcatagaaaggaaattctcaccagtgctgttgcatcattcagattggaaaagacctc

SEQ ID NO: 26727 - DNA, 121 bp, Artificial Sequence
  Synthesized
  misc_feature (61): n=a or t
ttcagagcagccctcatttatttattaactctggtaatatatcatgccatgtattcaaccngcagttgagtcacattatatcaaaaagaaattaaaacagcaaaagaaagcattaaagtac

SEQ ID NO: 26728 - DNA, 121 bp, Artificial Sequence
  Synthesized
  misc_feature (61): n=t or c
acaatgttaaaataatgtgaaaaactatataaatatctgaatttgcaattctgatattgcnaattttttgtcacattgaggtagctgaaaaagagttaacagactttcagtgtactttcca

SEQ ID NO: 26729 - DNA, 121 bp, Artificial Sequence
  Synthesized
  misc_feature (61): n=a or g
ctgtgagagagcagctcctgggtctgctatcggtgtagtctggggcttgagcttgattganttaaggtggagcaaggtgagcttcatggaagatactcctcaacctctgcttgtggtggag

SEQ ID NO: 26730 - DNA, 121 bp, Artificial Sequence
  Synthesized
  misc_feature (61): n=t or c
tttaactctctgcggcttgcagtgcagcccacagcttttgcaagagcttgctgatttttgngtctcaaaattcccattcgggtatgaactactggtcttctgagttcatgaccctctgtct

SEQ ID NO: 26731 - DNA, 121 bp, Artificial Sequence
  Synthesized
  misc_feature (61): n=a or t
ttgcaaagtaaatggtgtaacaggttcattaacatgattcagagggtattggagagacagnaaggtaaatttaaaactacaaaaattggtctgaaagaaattggaaggcttaattgcagtg

SEQ ID NO: 26732 - DNA, 121 bp, Artificial Sequence
  Synthesized
  misc_feature (61): n=t or c
tatcactctactgcaaatggacttcagaaaactgttggttttactgttttaagaagctttngtagcctctaatttttctcttaggagaaaattcaatcaatgcttgcataaccagtcagta

SEQ ID NO: 26733 - DNA, 121 bp, Artificial Sequence
  Synthesized
  misc_feature (61): n=a or g
gagcaaaaaattactttaatggcctacaaccaaggaaggatttttcacttgcagttacacncaacagcccaactgcttcatggcatggaggtgagacaatgatcatagctcaggatgtctt

SEQ ID NO: 26734 - DNA, 121 bp, Artificial Sequence
  Synthesized
  misc_feature (61): n=t or g
tacttttctgggcttaactttgtcttgtaagtcgtactggcctatccctttataacttatnccaagccaccaagggattccttgtttatcctgaaaaaagaagcctgcatgaaccaagagc

SEQ ID NO: 26735 - DNA, 121 bp, Artificial Sequence
  Synthesized
  misc_feature (61): n=a or c
tgcaaagttgagaaaacaagacaaccaagaggatgctagttaacatagcttggtatgcctnctaaagtgcctcctggctgaaattatagttactaatttttgccaagagattcatgatacc

SEQ ID NO: 26736 - DNA, 121 bp, Artificial Sequence
  Synthesized
  misc_feature (61): n=t or g
acagcaatgctccaacacgtgtgcacaaagaacacaggggttacttttcagagaaacccanatttttagggaaaatgctacctggatagcatgtctctctgtgcttagagtgccctttcct

SEQ ID NO: 26737 - DNA, 121 bp, Artificial Sequence
  Synthesized
  misc_feature (61): n=a or g
gtccatatcagccaaatctattccacatttgcccgtcctttcagattgcgcacagattgcngtgacaaacacctgagagtcatcagtttgcctcttccacatcgtgccagacagccacagt

SEQ ID NO: 26738 - DNA, 121 bp, Artificial Sequence
  Synthesized
  misc_feature (61): n=a or c
ctgaaaccttggagatcttctgaataaggagatgcagcagaaaccaccaacagctgcagtnataagcagcaccttcttctagtggaaattgctgctacttcacactgcacaaccagcagac

SEQ ID NO: 26739 - DNA, 121 bp, Artificial Sequence
  Synthesized
  misc_feature (61): n=a or g
ctgtagggattgataagctgtgctgaagctgatgctgacctagagttgaaacccatatagngatatcacctgggcaaacggctcatcctgagtgttggtaagagcagcgccactgatgatg

SEQ ID NO: 26740 - DNA, 121 bp, Artificial Sequence
  Synthesized
  misc_feature (61): n=t or c
tccccagtcagccctcctctgccagaaaggatggaggatggtgttagggctcagccacttngtttggccgggacctcaatgccctttatttccttgctgggaaccgtagggcattccaggc

SEQ ID NO: 26741 - DNA, 121 bp, Artificial Sequence
  Synthesized
  misc_feature (61): n=t or c
catttgttaaattaaactggaaagaaagagagttggtttttgaagtaaaactgttctttanctaataaagctttgcaatattgggtagcattttagccattttaagctctctaacttattt

SEQ ID NO: 26742 - DNA, 121 bp, Artificial Sequence
  Synthesized
  misc_feature (61): n=a or g
tattccccttttctgtcagtcagaaaaatcctcaaggaaaacagccatacagaaatgaatnttgtttagataaagtaaataatgaaagaagcagtacactaggttttttgtttgtgtcttc

SEQ ID NO: 26743 - DNA, 121 bp, Artificial Sequence
  Synthesized
  misc_feature (61): n=t or g
aaattacattccatctattacaagctgccattgattcgagggccaatagccatgacgtctnacactcccgatacaagaattaaagtttgttggtggtgccatctttctttcttcttttaat

SEQ ID NO: 26744 - DNA, 121 bp, Artificial Sequence
  Synthesized
  misc_feature (61): n=a or t
atagctgaaatcaacaaaagcaagttggctgaagggaatgaaagaaggaactgggaacacngctattccccgcagctttcagcttgagctgatgcccatggtgtggaggagagcctgtgtc

SEQ ID NO: 26745 - DNA, 121 bp, Artificial Sequence
  Synthesized
  misc_feature (61): n=t or c
gtatccaaatgctatccatgccacggtgatttcacggcaataaactgaagcacaagaccangtttcacacaccctgtgtattctcttgtagaaacaggccagctgcggcacacctctgaca

SEQ ID NO: 26746 - DNA, 121 bp, Artificial Sequence
  Synthesized
  misc_feature (61): n=t or g
ggtcaacctctggtaaagcatcagcgacaagtgaaggatatgttgaagccagtaacccccnctatgttctgagaatagtataaactcaatatacaaagtggaagaaaagtcacacttggtc

SEQ ID NO: 26747 - DNA, 121 bp, Artificial Sequence
  Synthesized
  misc_feature (61): n=a or c
cataatatggaaagtgtaggtgacttttacaagctagtcaaaagcaacctctctaaccagnagttgtactggcttccctgctccaagggagctcatttgagattcattgactgatccacaa

SEQ ID NO: 26748 - DNA, 121 bp, Artificial Sequence
  Synthesized
  misc_feature (61): n=c or g
cacgccccagctcagcactgagtgccagcacagacactcctgcccatctgggtgcaaagantttgtttttgccagcaggctccccgtgtcccccacagtcccgctggccagcattgttccc

SEQ ID NO: 26749 - DNA, 121 bp, Artificial Sequence
  Synthesized
  misc_feature (61): n=a or g
gagcttgctgcctctctcaatctgcgttccgcattttgaggtatttacaggtgaccatgcntttcccatcatgcctctttgggttctttgtggagtctttacttatgggcgttaactaggt

SEQ ID NO: 26750 - DNA, 121 bp, Artificial Sequence
  Synthesized
  misc_feature (61): n=a or c
tctctgctgatgctgggtggagaatctgccctgaaataattgggacttgcattgaaccacncccttgtgctgtgcagtgtggttactcactagcagacacccacatgctcatttagtggat

SEQ ID NO: 26751 - DNA, 121 bp, Artificial Sequence
  Synthesized
  misc_feature (61): n=a or c
taatggagaccctttacctttttgaaggcaaagggtaactatcaatatggactacataagnatgctaagagttgaagcacattatggcaatggcaacaaacctcacagtaattgattgtct

SEQ ID NO: 26752 - DNA, 121 bp, Artificial Sequence
  Synthesized
  misc_feature (61): n=t or c
ggtggcagacacagggaatggcaggcagccagcatgtcttctaaggatggagacgaaaggnagatgtgctgagctgggaaggcattgctaccgactgtcctcttgcaggaagtgtgccggg

SEQ ID NO: 26753 - DNA, 121 bp, Artificial Sequence
  Synthesized
  misc_feature (61): n=a or g
agtgctctgtgaagcatttcaaactgtgcacctgccagtgtaattgattgagtattaacancacacacaagaaacaactgagattttccacaaaaaaaaccctgccaggtgcaacctttca

SEQ ID NO: 26754 - DNA, 121 bp, Artificial Sequence
  Synthesized
  misc_feature (61): n=a or g
aaggcacaaacagggctgatcctgcatcgctcatgggcagcacagatgtacttgggcaaanactgaaataccacgtttaagatagtgaacttcagcgagctagtagaattcttcacacaca

SEQ ID NO: 26755 - DNA, 121 bp, Artificial Sequence
  Synthesized
  misc_feature (61): n=a or g
tgtgagctgtatgtaacgtctgcaggaagcagctctccgttcataatcttactggagccantctcttcaagtcagttgctggataacctgtgttatacattgatcagttatttcctgaagg

SEQ ID NO: 26756 - DNA, 121 bp, Artificial Sequence
  Synthesized
  misc_feature (61): n=a or g
cacctgtgccttcctcatcgacctcagcgccttctctcgcaggtgcttttctagatcatcnaggttgtcctctggttcactttctgtctccttgaaacaaagagaaagcatttcttcacaa

SEQ ID NO: 26757 - DNA, 121 bp, Artificial Sequence
  Synthesized
  misc_feature (61): n=a or c
ctacatagtactgagtgacagtgggggtgatgctgacctatactattagaggaatagcacnagaagggttctaaagaacaagctctgccaagcttattgggagctaaacaagagtgaacgg

SEQ ID NO: 26758 - DNA, 121 bp, Artificial Sequence
  Synthesized
  misc_feature (61): n=a or g
cacatcaggagtagacctggcaattacggctgcgttacaacatatcggtggctttgttacngactctcaccataacgcacctactgatccacgctctgacgaggacccaaccatcaatgcg

SEQ ID NO: 26759 - DNA, 121 bp, Artificial Sequence
  Synthesized
  misc_feature (61): n=a or g
cttctgatttgatttacttcttattccctattacaaaatcggcattgttctttcattcagnaccctagattttatttaaatacagctctagccgctggctgacactataaatgaatgcaaa

SEQ ID NO: 26760 - DNA, 121 bp, Artificial Sequence
  Synthesized
  misc_feature (61): n=a or g
cctgctggacattctggtgttgttgcaggtgggaagtatgatgtacttcttgccctgtgtnttacactcacattagtgtgcattctgtaaggatgcaggggcactgtctgctcccctgctt

SEQ ID NO: 26761 - DNA, 121 bp, Artificial Sequence
  Synthesized
  misc_feature (61): n=a or g
taatagaggtacagaaggaatgcgtatttattccgctctttggataagtactgtttctacnccatttcataaacataaaagatcaagatagtaaattttgctaagaaaggctgaaaatgtt

SEQ ID NO: 26762 - DNA, 121 bp, Artificial Sequence
  Synthesized
  misc_feature (61): n=a or g
ttctctactgccatctactgctcaagtacaagaaaatttatgaagaagaaaagaaacaccnacttaacacagaccagaatgctgcagagcacgcgataaggaagaagcacatgttgctatc

SEQ ID NO: 26763 - DNA, 121 bp, Artificial Sequence
  Synthesized
  misc_feature (61): n=t or c
ttcgtccaaaatacaagtgatctgagccagaacttcctacaaaggtcatagccctctctcnttcttcctgttaaaaacatgaccttttgatctctggtagttttcagacacacacacacac

SEQ ID NO: 26764 - DNA, 121 bp, Artificial Sequence
  Synthesized
  misc_feature (61): n=t or c
attgctcatccacatcaagagagatgggctcttgatggggcctccatgaagtggtctattnttctcccttcctgctcaaatgtatgaaaatctaagccaataatgagttcattcaaaagtc

SEQ ID NO: 26765 - DNA, 121 bp, Artificial Sequence
  Synthesized
  misc_feature (61): n=a or t
tgaacaaaacactcatcttttggcaagaactcaagcttaccttgaccttatgctctgatgnatacactagccgagtaatactttttgctgtgccaattattaataaaaactttccaacttt

SEQ ID NO: 26766 - DNA, 121 bp, Artificial Sequence
  Synthesized
  misc_feature (61): n=a or c
atggtggatttattacccttgtataaatcagagcataaaaacatcttgtttaccaaaggcnataactgctactgagttccttaaaaatcctttctccatcactgagtaaaaggatatgtaa

SEQ ID NO: 26767 - DNA, 121 bp, Artificial Sequence
  Synthesized
  misc_feature (61): n=t or g
acagttatttgtacttctcatttgcgcctctgatgaacagatcttcaaatgtttcggtacnaaaggatggctagtgacccaagccagtgtgtcttcattgtcttttataacaagcagaaag

SEQ ID NO: 26768 - DNA, 121 bp, Artificial Sequence
  Synthesized
  misc_feature (61): n=a or g
acctgtgctacagaagatccatcctagcaggtgaatctgctggggaaggcagtgttcctgncaggttccatctcagctctctgtatcatttcaagcaacttgctttccttttcttgtcttc

SEQ ID NO: 26769 - DNA, 121 bp, Artificial Sequence
  Synthesized
  misc_feature (61): n=a or g
gcttcaccaaactgttggacaagagatcactgcaaccaaataaattcagaaagacagaccnacagatgaggagctcactgtgcctgggtggtatgctcagtgcgctgggctgtacgtggga

SEQ ID NO: 26770 - DNA, 121 bp, Artificial Sequence
  Synthesized
  misc_feature (61): n=a or g
tgttctcagagtttatctcaccggcggttaatatgtttggaaatgaataacaccggaatcngggaagttgctcatatttgcttatttatttactgtattgggtttagtttggttggttgtt

SEQ ID NO: 26771 - DNA, 121 bp, Artificial Sequence
  Synthesized
  misc_feature (61): n=a or g
tcttgcaaaaaatacattgatagtcattttatctgagtgattcagttctgagaagatgtcntttacatgaaaagtacctggtgtttgatgttagtacagcagtcacaagtaaaatcccttc

SEQ ID NO: 26772 - DNA, 121 bp, Artificial Sequence
  Synthesized
  misc_feature (61): n=a or g
gttagctgacatatttcataccaattatccacagtttacaagaaatcatgaacaatctgcnaatgtggataaaatgcttgacctagtcaacaaagtttttgagagctttgctttcttctgt

SEQ ID NO: 26773 - DNA, 121 bp, Artificial Sequence
  Synthesized
  misc_feature (61): n=a or t
atgcaagctaatcattcttgtattcagtttgtgtaacagagaggtagctgtaaagttgttnctttcacaagaaaatctgatctttagtaacagttctgtaaatggaaattgattttttttt

SEQ ID NO: 26774 - DNA, 121 bp, Artificial Sequence
  Synthesized
  misc_feature (61): n=a or c
catactctatgccattcattgattcaaccacttaaaaagggaacactgtagtgtacaagtnactatgggacttgcaagatattgcactcagctgagccttacaggagtgattgtgtctgca

SEQ ID NO: 26775 - DNA, 121 bp, Artificial Sequence
  Synthesized
  misc_feature (61): n=a or g
gttcctcagctttgcagagggatacagggaatgtggatacaaaggttagacagagcatagnagagcacagtccttgctgattagtagttaagcattggtgattagaatatattgtgccaca

SEQ ID NO: 26776 - DNA, 121 bp, Artificial Sequence
  Synthesized
  misc_feature (61): n=c or g
gggtctgggctgccccatttgtgctcactgtctccatgccttgttagcctgtggctcctgntgatagctgccagtggttcggaagggtcagtgaactacagcctttgctagtaccagttaa

SEQ ID NO: 26777 - DNA, 121 bp, Artificial Sequence
  Synthesized
  misc_feature (61): n=c or g
gcaataggctggctgtatctcactgactcatcagcctttctccctgcagttcacagcaatntcttactaaaccacaaagacaccagaaacactccagtccttttcactctatgatgggctc

SEQ ID NO: 26778 - DNA, 121 bp, Artificial Sequence
  Synthesized
  misc_feature (61): n=t or c
acagatcgcgaaaagaaattaaacagctgtaaagatctctctagagcatgacatataatcncgtgaaggataaagaaatcagtagcagagtaggaaagtaagactgtccacctccttttcg

SEQ ID NO: 26779 - DNA, 121 bp, Artificial Sequence
  Synthesized
  misc_feature (61): n=t or c
catggtgaaagaacaaaatccatttttttcataggtgaaatgtgttcagtctttggaacangaagatagatggccagcaaacatttaattagatattgtccagcccccttgttgaagtaat

SEQ ID NO: 26780 - DNA, 121 bp, Artificial Sequence
  Synthesized
  misc_feature (61): n=t or g
gtatttctctgattctgtaatctttgtttccacacagcagctagaagagtcacaagttgcnttgctcgtgacctatcccagacctgttaggtttgtcttgtttagaagtttcttgcatcta

SEQ ID NO: 26781 - DNA, 121 bp, Artificial Sequence
  Synthesized
  misc_feature (61): n=t or c
attagggagccttcctgggaaggggctttgtgaataaggcaatttatgagcatgcttgtgntcaagcacagaattcttgcagtgtttgactttatgcaaaacgtcccgattgtgtgctggg

SEQ ID NO: 26782 - DNA, 121 bp, Artificial Sequence
  Synthesized
  misc_feature (61): n=a or g
ataaggacacacgtattttcactggatattatcagatatgaattattgatgtcctgtacancaccataattaatgctgatcttacagttccttgcaaaattttgttctcatgctagggtta

SEQ ID NO: 26783 - DNA, 121 bp, Artificial Sequence
  Synthesized
  misc_feature (61): n=a or g
gggcagaaggggtgtagcaatgggtcctggaaggatactttcccatcctgatgcttgccanaagagaagggaatccaaatgcacacactctgtagaaattaaattaataagtgtccttaaa

SEQ ID NO: 26784 - DNA, 121 bp, Artificial Sequence
  Synthesized
  misc_feature (61): n=t or c
ttgaggctgaagtatagatcttgcttctctttgtcaagaggataggattgaaaagctgttncaacatgcagaatataaatcccagttagtagtggacacctaacttgcatatgtgaaacat

SEQ ID NO: 26785 - DNA, 121 bp, Artificial Sequence
  Synthesized
  misc_feature (61): n=a or c
atccccatttttgccgcttcacttttgacatttgcaaaagattgggcacagaaagatacangcaccaaagcaatgctttgcaactggcagagctctgcttgccagcagacatgggcagccc

SEQ ID NO: 26786 - DNA, 121 bp, Artificial Sequence
  Synthesized
  misc_feature (61): n=t or c
aattggatagtgcagttaccagagggcaagaaagtttcagtggatttacaagagatcctgntgaaaaatgaatactcagaagtgatgacagacataatttcacagttcctgtgacaaagga

SEQ ID NO: 26787 - DNA, 121 bp, Artificial Sequence
  Synthesized
  misc_feature (61): n=t or g
ttatatcttataaaggttttctggttatcaacgatggtacctttattaaggatgtatttanttatttattaacaatgctcaattctcctgagaaacaagaactaatatttctattttgcaa

SEQ ID NO: 26788 - DNA, 121 bp, Artificial Sequence
  Synthesized
  misc_feature (61): n=a or c
tttctcgtgatgctgacatacaattccaaactcaaatgtcgatttgatttgaggttgtttnttttacaacatgagaccaggttttggagctgatcctgtctgccaggatatcgtggcttgt

SEQ ID NO: 26789 - DNA, 121 bp, Artificial Sequence
  Synthesized
  misc_feature (61): n=t or c
tgtacagaagaataaaactgatatttaaaactaaaaagcatttcagtttcagatttttctntcatcatggagctagcagttgacacttgtggtcattgctccattgtcaaaacccatccta

SEQ ID NO: 26790 - DNA, 121 bp, Artificial Sequence
  Synthesized
  misc_feature (61): n=a or g
cacgtaggaggaagaagcaaagggttctgcttttccagctcaggactcagaggaggaagcngtctcgatgcatcctgtggaatggcttcgttgggcggcttggctctgtgcaggggagaag

SEQ ID NO: 26791 - DNA, 121 bp, Artificial Sequence
  Synthesized
  misc_feature (61): n=t or c
gagatccaccacagatgagtgaaaaagtttcaagcctggactgcaaggagctggtgtattnatttgtacataacaaggcatctccaacaggaaagcctgggagcaaataattctataatct

SEQ ID NO: 26792 - DNA, 121 bp, Artificial Sequence
  Synthesized
  misc_feature (61): n=t or c
ttttcactccaagaggaacttctatttttgcatatattgtagggctcagaaagattccccngaatccagtgagacgcggtgcagtgcctgcatggagacaatccatggacgcaaaccgtaa

SEQ ID NO: 26793 - DNA, 121 bp, Artificial Sequence
  Synthesized
  misc_feature (61): n=a or g
taccccaaactctctcctgtgctttcgggcttaaaataaccaaaattgaaaggttgattcncagaataaaaattcaatctgatccaacaacaatggggttaaaagtatagttttattttag

SEQ ID NO: 26794 - DNA, 121 bp, Artificial Sequence
  Synthesized
  misc_feature (61): n=a or g
gatgctgaccttcccttctctatgtgttttccttcctgtctttatgtacagcacatagganctgagataacagcaacttattctgctataatgctttggatcgatacctggatgaaactgg

SEQ ID NO: 26795 - DNA, 121 bp, Artificial Sequence
  Synthesized
  misc_feature (61): n=t or c
ccattcaaaaggctttctaatgtctcagaggtcacagacatcactaaatgcagaaacagancctgaacatgaggcaaacatactgctctaaggaggtcatactgcacctacacgaggtgag

SEQ ID NO: 26796 - DNA, 121 bp, Artificial Sequence
  Synthesized
  misc_feature (61): n=t or g
aatttgtaggaatattgtgcttgtgtacaccactgttaataaaccataccactgaatagcncactcatactcccagaagtgaggacgtaattctgtcctcacttttgagttgaaggtggga

SEQ ID NO: 26797 - DNA, 121 bp, Artificial Sequence
  Synthesized
  misc_feature (61): n=t or c
tgtttcagctcctaggggaggtggtcctattttaatttttgaccactttatttttagcaanggggagtctcctttttaatttagtttatttttttaatgctacatgaaaccttctgtgcta

SEQ ID NO: 26798 - DNA, 121 bp, Artificial Sequence
  Synthesized
  misc_feature (61): n=t or c
ggcagaaaacataaggcaatatgtaaaaaacagaagtacttattaaaatcatcaatttggnattggtcatagctaggtgaaattgctgtcataactgcagttttccactggagagctgata

SEQ ID NO: 26799 - DNA, 121 bp, Artificial Sequence
  Synthesized
  misc_feature (61): n=t or c
taaactgcagcttctctgcgcctccctgtgaatccaaagccctgtttactacatcatcccngacccaaactgcaggcagtatgaagacttcaggaatactgtgtggtggccactgaagcag

SEQ ID NO: 26800 - DNA, 121 bp, Artificial Sequence
  Synthesized
  misc_feature (61): n=t or c
tactctagagaaggccataatggcatactttggctctgtttcctgcaaggtcacgtttatnccccatcagttcagagacagcagaggttattagtaatatgtatgctacagccgagatata

SEQ ID NO: 26801 - DNA, 121 bp, Artificial Sequence
  Synthesized
  misc_feature (61): n=t or c
tccctactctattaggttaacagaatttctttcattagttcctctatttgtacgtgtccangcctgctttgtcattctacaaaacacacacagagaaatattaaattagtttcaatgtcta

SEQ ID NO: 26802 - DNA, 121 bp, Artificial Sequence
  Synthesized
  misc_feature (61): n=a or c
actgtatagggcaacagattttaaaatggaaacataaagtcttgcatgttcatttcttccntgtgctctgctttagtcagccctattaacagccaaatgattttatgagctatagattcaa

SEQ ID NO: 26803 - DNA, 121 bp, Artificial Sequence
  Synthesized
  misc_feature (61): n=a or g
tatggaaactactaactgcttccaaggaacagcagggaaatcccatgaaaactgcaattanaataactgtaaagaattaaaatagctcttgggcactttttattattgttttgggttgtca

SEQ ID NO: 26804 - DNA, 121 bp, Artificial Sequence
  Synthesized
  misc_feature (61): n=a or g
taatgaagttctctcttgaagcttggacacaaactgcttcatgtctggaataaaatcctcnaaagtagaaacctgtatatttaatattaaaaaaaaaaatgacaacagcaatagaatactc

SEQ ID NO: 26805 - DNA, 121 bp, Artificial Sequence
  Synthesized
  misc_feature (61): n=a or g
tgctttgttattccaatgtatacagtcctttgaggagagagtaaatgtagcctttaagcancttgcaaggaaagggttgaaacaatttattaaagctattccaagctgagtttattaaagt

SEQ ID NO: 26806 - DNA, 121 bp, Artificial Sequence
  Synthesized
  misc_feature (61): n=a or g
gccagcagctctgtgggacccgacagcccgctttaacgaggacaccataagcagctgttcnttaaggcgaggccggaggcctttgagggcacctcacctcctggcccgtggccgcctccat

SEQ ID NO: 26807 - DNA, 121 bp, Artificial Sequence
  Synthesized
  misc_feature (61): n=a or g
tttttgatcttacaattcctttcacagcaaaaaatcaattgaaatagctgtaacttaagantgagaaagagtctgccactatacatgaagcaaagaatcttcaaggcagctctctcccaca

SEQ ID NO: 26808 - DNA, 121 bp, Artificial Sequence
  Synthesized
  misc_feature (61): n=a or g
cagccagcacacaacatatacgctgcccttctgaggctgtcacagggcgctctacacaagnggagcaagcaaagtgcataagaacaggagcaacttactggtggcaatggacttctaacat

SEQ ID NO: 26809 - DNA, 121 bp, Artificial Sequence
  Synthesized
  misc_feature (61): n=a or g
aggcttcctttgtgattctactttcccactggaatttttaattcaattgcacaggaggaantattactctcaaagcagaagtatcctgggaaaataatttctgagattcccctctgtaaac

SEQ ID NO: 26810 - DNA, 121 bp, Artificial Sequence
  Synthesized
  misc_feature (61): n=a or g
aatgcctggagttgagtagcagttttgtgtcccatagccacggcggtagcatccagaaacngtctgtagggcacagcggatcagactgctcatggattagatgcaagtcaaaatgagaaaa

SEQ ID NO: 26811 - DNA, 121 bp, Artificial Sequence
  Synthesized
  misc_feature (61): n=a or g
ttattaagtcctattactcatagcagagcttgctttattgatgagtttactcccccttgtnattttcacaatcattttcagttactgaacacattaaaacaaacaaacaaaacgtaaccaa

SEQ ID NO: 26812 - DNA, 121 bp, Artificial Sequence
  Synthesized
  misc_feature (61): n=t or c
attaataatattctgtaatacagtcaagagctctacatgaatgttttacgctagctgatgngcaagttacaattctaagccagaactgggcctaaatgacacctcctactttcatttgcag

SEQ ID NO: 26813 - DNA, 121 bp, Artificial Sequence
  Synthesized
  misc_feature (61): n=a or g
tatattatgatggagtgtagtcagactttagaccttgaaccactagttttctatatctacnttagtctgagtttttaatagtttgattttgaaaggttgagtgtattggtcagaaatgtca

SEQ ID NO: 26814 - DNA, 121 bp, Artificial Sequence
  Synthesized
  misc_feature (61): n=a or g
atctgaggggaacacagaaaggtggccttcaggttgttgcctgtagcacaggagccaaagncatggtctcaccagccccatattcattttccaagaacaagtttgtcagcttgtattgagc

SEQ ID NO: 26815 - DNA, 121 bp, Artificial Sequence
  Synthesized
  misc_feature (61): n=a or g
atgctatggtaagtagcatatgttttagataccggcgagatcatatgttgatatgaactancaaacctctgctatctatcatagactgtactcactacacataggtaatctatataaaaat

SEQ ID NO: 26816 - DNA, 121 bp, Artificial Sequence
  Synthesized
  misc_feature (61): n=a or g
gtagatacagcttaaatccaccaggaaaaaaaatgggctttcagttctattgagctgaaanaaggagacttctagggctgtgctttccaccctggtgctaggaacctaaccacttcacaca

SEQ ID NO: 26817 - DNA, 121 bp, Artificial Sequence
  Synthesized
  misc_feature (61): n=a or c
aggataaatgtttgttaccaaaggaaattctaagatgcaactgtgcagctcagatgtgaanttttggtgaagcatgatggtttagatgtgatgattactctacatgcttaatctactgaat

SEQ ID NO: 26818 - DNA, 121 bp, Artificial Sequence
  Synthesized
  misc_feature (61): n=t or c
ccggagagaaattaaacacttgtttttatataaaacaaaataaaatctggcaaggtgactngtgctgctgcaatacacaacacctctccctttgctgaagagaatttgattagatttgggg

SEQ ID NO: 26819 - DNA, 121 bp, Artificial Sequence
  Synthesized
  misc_feature (61): n=a or g
tgtccacattcaatgtgtgaacattgaactgttcacataaacttctgcaatctatttttantgggtccagttgtattggcttggagaccccagcaacctccaaaggaagaggctttctgta

SEQ ID NO: 26820 - DNA, 121 bp, Artificial Sequence
  Synthesized
  misc_feature (61): n=a or t
atatacgtttcaagccttctcctgctttgagatggttgtcatgtattaatcattctatacngggcattcccatacaaacatacatcattcatttcacacaaattcagctatttaaagctgt

SEQ ID NO: 26821 - DNA, 121 bp, Artificial Sequence
  Synthesized
  misc_feature (61): n=t or c
gcattgcctgcagggatggtgcagcgggcagaaagtaaagctaaaccagccccagctcctncacttgttaaacagcatcacaggggaggaagaattacatttgcttccctggttttgcaga

SEQ ID NO: 26822 - DNA, 121 bp, Artificial Sequence
  Synthesized
  misc_feature (61): n=t or c
cagtgatctacccccagttgtcaactttctcttgtggaatgcagagatgtattcacattanctattatctattttgagaatgatttagttatgtcagggaagtcagccttacctcatgatg

SEQ ID NO: 26823 - DNA, 121 bp, Artificial Sequence
  Synthesized
  misc_feature (61): n=t or c
taattcatagtatgtttagattaaaaaaaaaaaaaaaaccttgttaatccttactgtcacnccggtcatcacgtaccaagcaagaactaaaaatactggtaatcatagcatctggccagct

SEQ ID NO: 26824 - DNA, 121 bp, Artificial Sequence
  Synthesized
  misc_feature (61): n=a or g
cattggatgaattaaaatatggggttttctgtgacagtagtgacctgagctaaataacgcngatctttctccttgtccacaatacagctagtaccaacagctgttttgcaggagagcaaag

SEQ ID NO: 26825 - DNA, 121 bp, Artificial Sequence
  Synthesized
  misc_feature (61): n=a or t
atgtgtattgaggagataatttagcagtagaaacagtcttgggagcgtttgtaagaaacgnatctcctgccagcccagaatacttgcagaaaagcatagctggatagttgggatttaaatg

SEQ ID NO: 26826 - DNA, 121 bp, Artificial Sequence
  Synthesized
  misc_feature (61): n=a or g
cagaagaatcttcatcttcagatgaaatgaccagtattggcttctgtcataaaggtaaaanaaattgtgataaaagcaccatttttttttttttaagtaaaacttaaagaaaagaaaaaaa

SEQ ID NO: 26827 - DNA, 121 bp, Artificial Sequence
  Synthesized
  misc_feature (61): n=a or g
cccattatatgtcccagcttgctttgtgcatgatcatgagatgtcttaagttgataatatnaagttattttcttagactcctatgtatagattttctcaaaatacatatgcagaacttgaa

SEQ ID NO: 26828 - DNA, 121 bp, Artificial Sequence
  Synthesized
  misc_feature (61): n=a or t
gctgcatattcatgaagttctgtggatggaaaaacaaaatttagtgctttagactttcatncattacaaggtcttaatagcgcctccagcaatgaaaaaatcttaaatgtaaatgaaggtg

SEQ ID NO: 26829 - DNA, 121 bp, Artificial Sequence
  Synthesized
  misc_feature (61): n=a or g
ccaaagcatcatttttctgagggatcgttctgttcactattaataatgcgctgttcctctnctgtgtttgcatttgcttttctccccacagtggcttaaggttgcctttatttgcattacc

SEQ ID NO: 26830 - DNA, 121 bp, Artificial Sequence
  Synthesized
  misc_feature (61): n=a or g
agccttctgccacaagtgcaggttcgcactcatggcggcaacagatcaatgcattgctgtntgcctctagtgaagtcattaggatattttatttctttttcattcttttagatgcagattt

SEQ ID NO: 26831 - DNA, 121 bp, Artificial Sequence
  Synthesized
  misc_feature (61): n=t or g
aacaaaggtattgtggtggtattgcaagctatggtgttcatatagtccaagtaaattagcntagtagttgtctaatttcttccttattaagaccaaacctttttttataccttaacaagac

SEQ ID NO: 26832 - DNA, 121 bp, Artificial Sequence
  Synthesized
  misc_feature (61): n=c or g
aatttgacttttgttggaaatatgaggtacttggttattttcccattaagggacaagctanataagcttcttttttgattgccataggattacacgtttattgctaccagcatgcagtaac

SEQ ID NO: 26833 - DNA, 121 bp, Artificial Sequence
  Synthesized
  misc_feature (61): n=a or g
tttggctgtcttctcctagagtggatattttccctgattttctacacactgccagagaagnactaggtgttcatttacagttgtggttatggttatacttaacccagccagctggaagcag

SEQ ID NO: 26834 - DNA, 121 bp, Artificial Sequence
  Synthesized
  misc_feature (61): n=a or g
attacgttgtttatcacctaggaacttaagagcttacaatactgtatatatctcatagtgncagttttaattgcaattcaatctttagacaacagagctgataagcaagtgctctgactta

SEQ ID NO: 26835 - DNA, 121 bp, Artificial Sequence
  Synthesized
  misc_feature (61): n=a or g
aacaccatctggaatcttcacagcctgtgtgccattaaactcaaagacttggtcgctgtcntgaccattatcagtaggaagtcctatcgtccagttcgcagcactacttggagaaggaagc

SEQ ID NO: 26836 - DNA, 121 bp, Artificial Sequence
  Synthesized
  misc_feature (61): n=a or g
agtgtttggaatgcagcatctctgaccttgaatttactttctcagtcccatgcagcgctgntggctttgatgccatcaggaaaaggattcagcctctccaatttcccacttcccttacatt

SEQ ID NO: 26837 - DNA, 121 bp, Artificial Sequence
  Synthesized
  misc_feature (61): n=a or g
tttagccaatattgtgattttctttgataggctgactcatgatctgtgcacatcaggaccngcaataatggtagagtaaatttccctgctttgacatgaatataccctatttccctcttct

SEQ ID NO: 26838 - DNA, 121 bp, Artificial Sequence
  Synthesized
  misc_feature (61): n=a or g
ttggaccccagcagaacagtgggtatttgcccgtcgagtttcagactatcttgtttcccantaaggttatgttaccatagggaacaaaagggaagaaatttgcaggcagaaatggttaaaa

SEQ ID NO: 26839 - DNA, 121 bp, Artificial Sequence
  Synthesized
  misc_feature (61): n=t or c
tatttgagtttgcctgcagttgggagtatgtggaccatgttgcacgtatgcatagaaacgngttgtatgtcttcaagagatgatgtgggctggatttacttcccgagaagtcttttaaagt

SEQ ID NO: 26840 - DNA, 121 bp, Artificial Sequence
  Synthesized
  misc_feature (61): n=a or g
tcactatgtaaagaaagctaggatgcaggagcctctttgctaatgaaagtcttccaggacnccttagcgatgaccataaatagttgacattttctacatcatggccagttttgcctttttg

SEQ ID NO: 26841 - DNA, 121 bp, Artificial Sequence
  Synthesized
  misc_feature (61): n=a or g
ggaggaggctgggggaaggcacaacctcacaagctgctacaggcaaagtcttcaagaagancaagccagagaccaaacaggctccagaatgtactgtgtgaacttcactagctctcctgtt

SEQ ID NO: 26842 - DNA, 121 bp, Artificial Sequence
  Synthesized
  misc_feature (61): n=t or c
cccaacctcagggctccgtggtcagattgcatggaatgttcctcctctacagcactgaagntgggagcatcccttgcaaataatccctaaggaagaggaaatgcaggggatggagagctgg

SEQ ID NO: 26843 - DNA, 121 bp, Artificial Sequence
  Synthesized
  misc_feature (61): n=t or c
aaagacacatctctaaaacaattggccaattgctttatatcccccttgcaaaggaatgaangttgtctgctcagaattcaggaaataaatacaatacaaaccatatttactttgacaagtc

SEQ ID NO: 26844 - DNA, 121 bp, Artificial Sequence
  Synthesized
  misc_feature (61): n=c or g
aggccactcttccttattcccagacccaggctatcccatctctgtcagtgtcatgcggctnaatgttctgttctgctaatgaccgtcctcattatgacttggaagaacacagaaagaggag

SEQ ID NO: 26845 - DNA, 121 bp, Artificial Sequence
  Synthesized
  misc_feature (61): n=t or c
ctccctagagaatgtcctaagaaccaaaccatgagctctttggaaagtctccatctcatcngctcatcctcttctaccttacagaaaggagtgagattgacttgctggttaccacacttcc

SEQ ID NO: 26846 - DNA, 121 bp, Artificial Sequence
  Synthesized
  misc_feature (61): n=a or g
gaaagacttcagttatttttgtttatttttccatcctttgtgatgcttgcctccggcatcnggacatgaaaagccaacaagctccagcttcctgccaggtcctttccaacaccacgctcta

SEQ ID NO: 26847 - DNA, 121 bp, Artificial Sequence
  Synthesized
  misc_feature (61): n=a or g
gacaagtgaattattgatgtcagttctatataattacttgattttacagtaaggactaatnctcatctttctgaatcttgactttcagcctgtgagatatacctacgcaaggaacaattct

SEQ ID NO: 26848 - DNA, 121 bp, Artificial Sequence
  Synthesized
  misc_feature (61): n=c or g
gatcggactggaaattggctattaaattaaggagaaaatagaggaaaaacagaactgactnagaagatgcattattgccacagtgatgtaatagcatcaaacaacaaatgcaacttctgaa

SEQ ID NO: 26849 - DNA, 121 bp, Artificial Sequence
  Synthesized
  misc_feature (61): n=t or c
ttttaaaacccagaagcagaagacattcagacacttttccaatattcacagtaagttcagncagtcatgcatagtactgagaaatatggcattagcaaatgaagattctttgcatgcatta

SEQ ID NO: 26850 - DNA, 121 bp, Artificial Sequence
  Synthesized
  misc_feature (61): n=a or t
tctgaaacttctagttttctagaaaaacaaagtttatcaaacctgagatttgttgcctaanactacaccaaatgaaaactgtaagagtgaactgaagggttataatggcatgtgtgctaga

SEQ ID NO: 26851 - DNA, 121 bp, Artificial Sequence
  Synthesized
  misc_feature (61): n=c or g
gggcaagcaaataaccacaaggttttctgttaaagtgtatcacagcttttcctttggcagnttttctgctctaaccaaaggtggtaatgctgcttgaaagataatggaacattttctgagg

SEQ ID NO: 26852 - DNA, 121 bp, Artificial Sequence
  Synthesized
  misc_feature (61): n=t or c
ggtttgaaaaccctgtcttgcacaataatgcactaattaaaataatgttgaagtgcttttnccccccacaccttctggtttttctacctcagtctactgctcacttctgtttgcacagctt

SEQ ID NO: 26853 - DNA, 121 bp, Artificial Sequence
  Synthesized
  misc_feature (61): n=a or c
taaaatattatatagcacctacttcaccaagaaatgcactaagggtgtggaaatgtttcantttgtctgctctagggacagaaggctgaatgatgtaggaggaagaaaattgctgatacca

SEQ ID NO: 26854 - DNA, 121 bp, Artificial Sequence
  Synthesized
  misc_feature (61): n=a or g
tccagtcgtcctccatttgcagtgcttctaagactactggcagtgagctccgcactccctngttaacatttgtgagatcgtctaaattcaaccacacgtatgcaaaagagctagggagatg

SEQ ID NO: 26855 - DNA, 121 bp, Artificial Sequence
  Synthesized
  misc_feature (61): n=c or g
attaaacagtgaagcagcactacagagacagagatagatcccgaggtacctggttttatgntaacaaaacaagggtggcaaggcacttgcaaaagtctgcccagagaagctgtggatgccc

SEQ ID NO: 26856 - DNA, 121 bp, Artificial Sequence
  Synthesized
  misc_feature (61): n=a or c
taaacacactgtttgaggagaaagaaaacagagaaccaaaacaggcacaacccagggagantgcaacaggccagtgtgaagagcagagctggaaagatgaggacctgagtgtgataaaagg

SEQ ID NO: 26857 - DNA, 121 bp, Artificial Sequence
  Synthesized
  misc_feature (61): n=a or g
acagaaacaaaaaacaaacaaacaaacaaaaaaatcaccaattcaataatctcacactttngagaacaaaattgcaataaaataaacacttccccctcctcctcctttattcacagaggta

SEQ ID NO: 26858 - DNA, 121 bp, Artificial Sequence
  Synthesized
  misc_feature (61): n=t or c
atgtgtgagacaatgaaaactatttttttgtttcattgccccactgttgttaagacaaaantgaattatattctctgattttcaaactaatttgtcaatctccagggaacaggaaaggaaa

SEQ ID NO: 26859 - DNA, 121 bp, Artificial Sequence
  Synthesized
  misc_feature (61): n=a or g
atagtctctgactttcaatatgccatctcccaatctgtctaacccatgggcgactacccanttccctggcagctaggcaaataattcagcatttagcagagctgggtcagtgcatagggag

SEQ ID NO: 26860 - DNA, 121 bp, Artificial Sequence
  Synthesized
  misc_feature (61): n=a or g
agtagctgtgactgaccttcctcacagattgggtcgctgtcattcctgcgttttgtctggncaagtccacgtatgtcccgattgtctggggaggtgctggtgtgtcgttccaattgcttac

SEQ ID NO: 26861 - DNA, 121 bp, Artificial Sequence
  Synthesized
  misc_feature (61): n=t or c
aagaggtgttgctggagggaagctcctctgcctccttttctattttctcatcagatgaaantgaagtcaaaggtctcttcattttctaaccccaagactcatctttgtctccttttcatgc

SEQ ID NO: 26862 - DNA, 121 bp, Artificial Sequence
  Synthesized
  misc_feature (61): n=a or g
tgccacactgcagaagttagttatccttctggcatccagagaggctgaagcaccgtggcanggggtgagcagaaggaaagggaaaaacaagtgagaaatgcaggagatgtctgctacaatg

SEQ ID NO: 26863 - DNA, 121 bp, Artificial Sequence
  Synthesized
  misc_feature (61): n=a or c
tgttcctgtagtacagatgtccccattagtgtctttggtgatgtgttagtggcaaaccggnccctgttcttgctttacccctgtgatgaagaatggagtatttccatatccagtgctgttt

SEQ ID NO: 26864 - DNA, 121 bp, Artificial Sequence
  Synthesized
  misc_feature (61): n=a or g
cacctgcctggtgctgtcctgtgggtgatactacgatttgcaagttgttaaaagtttaggnggattcagaacattctcttccaatggtttctaaatatttcatggctgtcatttgaagcag

SEQ ID NO: 26865 - DNA, 121 bp, Artificial Sequence
  Synthesized
  misc_feature (61): n=t or c
cggtctcaggtaattttgggggatctggagagagagaaggttgcacctacatttgctatcncactgcatctgacctgttaaaagcactatcaactttatggacagctgagagggcattact

SEQ ID NO: 26866 - DNA, 121 bp, Artificial Sequence
  Synthesized
  misc_feature (61): n=t or c
aaaacggtgtgtcactgtaagaacacttcgctaggagagaaggaatgagttgacctctgangagatgtgtgtgtagttcgtttacttgaactattgacttgaatttctgtagtgcgtctgg

SEQ ID NO: 26867 - DNA, 121 bp, Artificial Sequence
  Synthesized
  misc_feature (61): n=a or g
aggatggccggtctccgctttgttggctctctgttctcttccactgttggtcatcccaacnctgtccccactgaggatatggtggaggagcaaaaggaacggagggcaccgaggagggggg

SEQ ID NO: 26868 - DNA, 121 bp, Artificial Sequence
  Synthesized
  misc_feature (61): n=a or g
ccctcagcgctgccagagcagcactggtgcttacagacagtggtggcggcacactgtgctntctgtatttggtcagaccgggaccaatagaacatgagagaaaaatatctttgaaaaaatg

SEQ ID NO: 26869 - DNA, 121 bp, Artificial Sequence
  Synthesized
  misc_feature (61): n=t or c
gctgctcctcctgcctccatttccccaccggtgggaataaatacctgcccttcaagccctntccattaccaaccggttaatcaccatgtaaaaatgacagcgataggatttttggggagga

SEQ ID NO: 26870 - DNA, 121 bp, Artificial Sequence
  Synthesized
  misc_feature (61): n=a or g
ggtagtgtctaaacgatatttagtctcaatcacctttcacatgcccaaatgtggtatttcngaaacatgaagctgtgcaatctccatcattggagatatgcaaaatgtgaggaaacaaggt

SEQ ID NO: 26871 - DNA, 121 bp, Artificial Sequence
  Synthesized
  misc_feature (61): n=c or g
gttacatttatcgacaggagagtgctccagaagggtactgagttggtacaggacagccatntccagggtctgctgtccaaaaagcacatccaaaaagaatgctggtgctccacaggcagct

SEQ ID NO: 26872 - DNA, 121 bp, Artificial Sequence
  Synthesized
  misc_feature (61): n=t or c
tgtgtcatttctaacctgctgcaccagccttgagagctacctgtcagaatttctgcttgtngacggatagtaacaatggatactgtctttggatccttctgatcaagtcagaagtagttca

SEQ ID NO: 26873 - DNA, 121 bp, Artificial Sequence
  Synthesized
  misc_feature (61): n=t or c
tccgcacacatgatccaaaggacaaagatagaggaaggtgttcagggaaagaaacagaagnatttggccacggcacatcgcacagcatcacaacctgtgtttgaaactaaaaataccacaa

SEQ ID NO: 26874 - DNA, 121 bp, Artificial Sequence
  Synthesized
  misc_feature (61): n=t or g
gccagcacctcacctcactctgataggactgataaagataggattgattatgcttcatgangtttaaataccatcagcagttgtcacaggaccccatctagggttaacaaaattaaataac

SEQ ID NO: 26875 - DNA, 121 bp, Artificial Sequence
  Synthesized
  misc_feature (61): n=t or g
atatagtcctcttacctacatcaacattttttatgagatacacaagaaatctcagtaaggnaaacgatacttttgtaaacagttatgctaattaataactgcacttctatttggagatgtg

SEQ ID NO: 26876 - DNA, 121 bp, Artificial Sequence
  Synthesized
  misc_feature (61): n=a or g
ttattcgatgcctggagtagctttataacaggacataagtaaaggactaatgcaaagtgcnaatgtttccttagttccctctaacagagtccaaagtgcagacaagctaatgagatttata

SEQ ID NO: 26877 - DNA, 121 bp, Artificial Sequence
  Synthesized
  misc_feature (61): n=t or c
tcaaagtttgtaaaattcagaagtctctgaagtcaagaacacagataaatgtatcattgcntaagctagatttacactggcaccaacaacaaaatctccagttctcaaacactagtaatac

SEQ ID NO: 26878 - DNA, 121 bp, Artificial Sequence
  Synthesized
  misc_feature (61): n=t or g
cagaaataaaaataggcctgggttgaaaaaacactgctaaaggactgaaaattgaagccancaggccagaagaaattctcaaataaatgtgtatgcatggggtgagtcagtagcactgcta

SEQ ID NO: 26879 - DNA, 121 bp, Artificial Sequence
  Synthesized
  misc_feature (61): n=a or g
cttctccttcgcctaggaaaaaaatgagggggaaattattttgaattgcagaacaagaacngaagactttccagtgtgagttaagctgcacaaaactccttcaggaaacacatgagagtat

SEQ ID NO: 26880 - DNA, 121 bp, Artificial Sequence
  Synthesized
  misc_feature (61): n=c or g
tttgtcatcttttgttcaattttacttcctgtttacttccctgttgaggacagctttgctntaagttggttaggtatgggatggcagcgtggctgtccactagttagtaaatcaaaagagt

SEQ ID NO: 26881 - DNA, 121 bp, Artificial Sequence
  Synthesized
  misc_feature (61): n=a or g
ttggggtggaccgacggagctcctctttctcctttatccatttgatctttgaaggagagancgatggtttgcacacatctgggcttcacctggagggtccaacagaggggatggggaagga

SEQ ID NO: 26882 - DNA, 121 bp, Artificial Sequence
  Synthesized
  misc_feature (61): n=c or g
aggatattgcaaatagcggtttggcttttttccccttgacttcatttcttcagcaaccagntgccatctagcaggagaatattagccttttgttgttgttgaaaaagatagaatttaatgc

SEQ ID NO: 26883 - DNA, 121 bp, Artificial Sequence
  Synthesized
  misc_feature (61): n=t or c
gggattgctctcttctgcccacattctttggctatcaagagcccagtgcctctcttgtaanagcgcatgacctacaacaacagtggagatcatctgcactggtttctgctgtgtttcacac

SEQ ID NO: 26884 - DNA, 121 bp, Artificial Sequence
  Synthesized
  misc_feature (61): n=a or g
agatgaaatgctgaaagacttgtataggttttactcatctatcttttgaaataatacctgngtacatgcacctctggagccaaagcatattgataaagtttcagaaacaaacatctaaaca

SEQ ID NO: 26885 - DNA, 121 bp, Artificial Sequence
  Synthesized
  misc_feature (61): n=t or c
gagctttttcctatagatcatgtaaactgcatatgactgagattaatagaatcacccatgnttttaatattgcctgttctaaaccccagttttcagctccttcagattttctgaactgtaa

SEQ ID NO: 26886 - DNA, 121 bp, Artificial Sequence
  Synthesized
  misc_feature (61): n=t or g
tacttttgtaacatcatactgctaacaagctatgaggctgaaggaacagtggactactatnctagctgcaacccccaacagttttgataggacaccgcagtgctcagacttctgtactgaa

SEQ ID NO: 26887 - DNA, 121 bp, Artificial Sequence
  Synthesized
  misc_feature (61): n=a or g
aactccaggcagaggtatggcagtgtatatacatagttaagtagtcaagatgtgtgcatcntagaataatggccaaatagtgaataatgctcaatcaaactgagcagttctcattcaagtt

SEQ ID NO: 26888 - DNA, 121 bp, Artificial Sequence
  Synthesized
  misc_feature (61): n=a or t
aacaacaatttttccttggagactttatgaagcctctaagtctgattcattttatggcacnttctgagaaagatggagaataaaaagaatgcattttcttctttctgtaagtccatcaact

SEQ ID NO: 26889 - DNA, 121 bp, Artificial Sequence
  Synthesized
  misc_feature (61): n=t or c
tgcaattaggaggctgaaaatgcctgaaaacttgctcctggaactatggcactatgcagcnacagaccatgttgattacagagatatcagttgtttcttgtgttgggcagcacggtgacgt

SEQ ID NO: 26890 - DNA, 121 bp, Artificial Sequence
  Synthesized
  misc_feature (61): n=a or g
atatatattacatttaaagatgtcaaaatcagaaggttacaagattattaaatgaactctnctaaagtcctgttaggtactgcaatataaggcctggacaggaaggagtaggcaagattca

SEQ ID NO: 26891 - DNA, 121 bp, Artificial Sequence
  Synthesized
  misc_feature (61): n=a or g
cctgtggaataaggaagatgctaacacatctgcagtgaggaagtgtgtgttaagccccttngttaagatagtccctcacaggcaaaatagaaggcatgtaggtatggaaatgtcactgttt

SEQ ID NO: 26892 - DNA, 121 bp, Artificial Sequence
  Synthesized
  misc_feature (61): n=t or c
aaagcgtgaactgctgttgagatttagaagtttgtggttctgtgtttgttgcaacatttcnaagcgtctgttgtatgtatttgtgattatttctctgtgcgatttctatggttgcctttta

SEQ ID NO: 26893 - DNA, 121 bp, Artificial Sequence
  Synthesized
  misc_feature (61): n=a or g
ccacatcttgctgagggacccaaacaactccagtcctgtggttgacttggaagctacaccntttgcaactctgcttctttgacaaccaggcaatcacatgcaagggactgatgttattgtt

SEQ ID NO: 26894 - DNA, 121 bp, Artificial Sequence
  Synthesized
  misc_feature (61): n=t or c
gtaagaaagcagcttctccttcccatattggcaacaataacaattcctcctgtggtattcntatcttcccttaggggacaggcactacaagcaggaaaggtgggagtgtggcctttaattt

SEQ ID NO: 26895 - DNA, 121 bp, Artificial Sequence
  Synthesized
  misc_feature (61): n=t or g
caactaatttcatagttcagaccaattcagcaaatgtctcacagtgattatattctgtaantacttgcaaacgacagcaataaaatgaggaattccatgaccaaaaaaaaaaaaaaaaaaa

SEQ ID NO: 26896 - DNA, 121 bp, Artificial Sequence
  Synthesized
  misc_feature (61): n=a or g
tgtagacataggtggtctgaactctctggaaaacagaaacatggtcacagcagaagagaanagcatccttccttcacaaccagaggctcctgtgatgacagacataacacctgatctctcc

SEQ ID NO: 26897 - DNA, 121 bp, Artificial Sequence
  Synthesized
  misc_feature (61): n=a or g
ttgttggaagatttaaaatccctctagaattgtatccagaaagaagttaaagcattatcanctaataattaaactcataacaggtcagatactccccagatcagatatcttattgacagta

SEQ ID NO: 26898 - DNA, 121 bp, Artificial Sequence
  Synthesized
  misc_feature (61): n=t or c
ccccccccccttttagataacctcaacacaagcattaaataccttcccatctattgcaatntaggtggcagtaccacacaacacccaaactggaaatggttcacacttgctcatgaatctc

SEQ ID NO: 26899 - DNA, 121 bp, Artificial Sequence
  Synthesized
  misc_feature (61): n=t or c
tcccttccacctctaaggattctatattcccatcgggttggagtcagcagagcagggctgngaggcagaaatgagatggagctgccaaagctcccatcccacggggctgaggagtggggga

SEQ ID NO: 26900 - DNA, 121 bp, Artificial Sequence
  Synthesized
  misc_feature (61): n=c or g
tgcgactatgcataagcatctctgttgccatggcatagtcatttgcaggttcagtaaacanaggacctcttctagttattgttgagcaccctctcctggctctctgctatttgcagataag

SEQ ID NO: 26901 - DNA, 121 bp, Artificial Sequence
  Synthesized
  misc_feature (61): n=t or c
ttccacacatggatgaaattttggctggcagaatatctccgctgctggcggcagatgctgnaattgaatgtgaaatttggaggtgctgcccgttcaatgaaactcactgcaattgcaaggg

SEQ ID NO: 26902 - DNA, 121 bp, Artificial Sequence
  Synthesized
  misc_feature (61): n=a or c
gttgttggtgagccctccaaggtatgtatgtttgagccctggggctggacatgcttcctgntatgctctgaagaaccaatgtaatgcttaacctgggggagaaatctcagctctccttctc

SEQ ID NO: 26903 - DNA, 121 bp, Artificial Sequence
  Synthesized
  misc_feature (61): n=t or c
agcttggcaatgttagaaaagacattttttccacctcttccttcttcttgactaataagtnaagcattaagcattttatgtaaacgagactgtaaatcacaagcattaattgcaacctttc

SEQ ID NO: 26904 - DNA, 121 bp, Artificial Sequence
  Synthesized
  misc_feature (61): n=t or c
actttcagccaaggggttaagacagctgtttactcagttcctgcagacctatcatttgtcngatgcattccttttccattcagctgtttggtgtgggttttttttttccaagtaaattaag

SEQ ID NO: 26905 - DNA, 121 bp, Artificial Sequence
  Synthesized
  misc_feature (61): n=t or c
tcaaagaaatatctttatgtttctgctttgtttctttaacacagaggtagaattgaagagntgccttcctaagcactaatgtcctgaaagtgttttgggttttttttttttggtagagact

SEQ ID NO: 26906 - DNA, 121 bp, Artificial Sequence
  Synthesized
  misc_feature (61): n=t or c
gatcttttgaataccaacaataacatttttattataggattcatttacttgtggtcctagnttgggtttgaaagtcttagcaaactgacagttctgatttggtcaacaagtctgcttgggt

SEQ ID NO: 26907 - DNA, 121 bp, Artificial Sequence
  Synthesized
  misc_feature (61): n=a or g
aagcaagctgtgggaaatgaggtgctgctgagaccctacctgcccaggtggactatttacnaagctgaacaaggaccagagcagcagaccccaacgagggcacatagcttgtcaagaaaat

SEQ ID NO: 26908 - DNA, 121 bp, Artificial Sequence
  Synthesized
  misc_feature (61): n=t or c
ttcagctgtagggctttgatcatgtgattttgataacttagggaataaaaggctgctttgncttgcctaaagaaataacgtctggttccttgatttagcttcttgacaagttatctacaat

SEQ ID NO: 26909 - DNA, 121 bp, Artificial Sequence
  Synthesized
  misc_feature (61): n=a or c
ttacaaatgattcatcaatgcacatgcagaatagagacaaaattcattaggatgaagcttnaactataccctgttcaaagcaccaagcaccaaggaatgagttccctccagcagacactgg

SEQ ID NO: 26910 - DNA, 121 bp, Artificial Sequence
  Synthesized
  misc_feature (61): n=t or c
ttctgccagtgtaggtgattgatcctaccctctgatctacttctcactcagaatggcatanctgtgtgagtgtatgagacaagggagtctgtcacaacctccagaacaaacctactgtaat

SEQ ID NO: 26911 - DNA, 121 bp, Artificial Sequence
  Synthesized
  misc_feature (61): n=t or c
aaagtcataaaaataaagcagttttttatacaattttggttgccaaacagaattcctccanagtccacaagaatgtggaaggtgatatactcagctaacaggcccagctatgagccatagc

SEQ ID NO: 26912 - DNA, 121 bp, Artificial Sequence
  Synthesized
  misc_feature (61): n=a or c
tgatagccaatgtctctaagtggtccttctttactatcccttctatgtaacattatattanttatggccgatctcccgaggaaaaaaggtggtaagaaggtaagctaaggtcactgtttcc

SEQ ID NO: 26913 - DNA, 121 bp, Artificial Sequence
  Synthesized
  misc_feature (61): n=a or g
gacttctcacaaagtttttgagacatgtgaaggaaaaagcttcatctttgttaacagggtngcttctgctttccttgtgatttgattagaaaagctccttcatgaagtaggagatattgct

SEQ ID NO: 26914 - DNA, 121 bp, Artificial Sequence
  Synthesized
  misc_feature (61): n=a or g
aagaatctatcacactgtacgtgtaaagttgtctgtttagcttaggtaatctttctcttcncattcaactcaaacgtgcatcctatgttcctggcattaagggaaatggcagaagagagag

SEQ ID NO: 26915 - DNA, 121 bp, Artificial Sequence
  Synthesized
  misc_feature (61): n=a or g
ctgccactccacaagagatttcctttttaaaaagcaagaaaaacttacggagaaagaagtngtaaggaccatctcctcgggacaactaaagtaattttattattcaaagtttatcactgca

SEQ ID NO: 26916 - DNA, 121 bp, Artificial Sequence
  Synthesized
  misc_feature (61): n=t or c
gcaactttgtccaacagcactgggaggcagaggtcctgaggataaacctggtattatcaangctcatcttcaaagtcatttaccagtttactacacataagtctctagctacgagtccaga

SEQ ID NO: 26917 - DNA, 121 bp, Artificial Sequence
  Synthesized
  misc_feature (61): n=t or g
gtaattaagctgttccttcacccaataggcaaattcctactgctttaggaaaatacggtgngttgatggttagactaactgattttagagatcttttccaaccttaaagatcctatgactt

SEQ ID NO: 26918 - DNA, 121 bp, Artificial Sequence
  Synthesized
  misc_feature (61): n=c or g
gctgatcccaagaactgacttcattgtactgtagtaggagcctaatagaatatacaaatantggagtactaagcaaagtgattcctatgtcagccagctacagatgaccaaaaaaaaaaaa

SEQ ID NO: 26919 - DNA, 121 bp, Artificial Sequence
  Synthesized
  misc_feature (61): n=a or g
ctgtgtttctctttccagtttttattctctaatatcctgcaggtgatgcccagaggacaangtgtaaagtgacaaagaaacaacctgcttaatcctttgcaaccaggtgctgctgattttc

SEQ ID NO: 26920 - DNA, 121 bp, Artificial Sequence
  Synthesized
  misc_feature (61): n=a or g
cctgataaacaggtactgatgatgttcaaacagccaaagtccctcaaaacaacagcgaagnaagacaacgaaattgacaacaaaagacaacaaaattgaacaacgttcaattttgaaaagt

SEQ ID NO: 26921 - DNA, 121 bp, Artificial Sequence
  Synthesized
  misc_feature (61): n=a or g
tcatgaaaccacagagaactgagaaatcaaatacatactgagagtagctcagagtctcccnagctcaagtgtcagtgctccagtattaggctgactattgaccactgtaaaatgttgctgt

SEQ ID NO: 26922 - DNA, 121 bp, Artificial Sequence
  Synthesized
  misc_feature (61): n=t or c
acttatgatgggagtaggaggggggaaggacagacaggtaatcattttatcccatagtttntttaacgcccaagttatgttttacattctgtaacacagatgtctattcttttgagtttga

SEQ ID NO: 26923 - DNA, 121 bp, Artificial Sequence
  Synthesized
  misc_feature (61): n=a or g
ttgttgttgttcagaagtcttacttttatagagtaagcctgtttttcctaaattcctaacnttcaaaatcatacaggaagccataaattattgtattcataaacatatttgaaggataact

SEQ ID NO: 26924 - DNA, 121 bp, Artificial Sequence
  Synthesized
  misc_feature (61): n=t or c
cagctcatgtgtcctgcttctacctcatcattctttgttaggatttagcactgcttcctantgacagatttaattgataagtaatagaaactgcatcaatttgatggacaggtgggacttg

SEQ ID NO: 26925 - DNA, 121 bp, Artificial Sequence
  Synthesized
  misc_feature (61): n=t or c
aattttagtagggcaattgccatatgggatttatatttatggaagcatagtgtgaaatggntctgattttgtttccttagctggattagtttcacctacttcttgtggtgctctctggttg

SEQ ID NO: 26926 - DNA, 121 bp, Artificial Sequence
  Synthesized
  misc_feature (61): n=a or g
catgtcaggagagaagcagaaaatacattgctcaccatatgtagtagctgtaggatagctncttcaagcatacatccgttcacctgcatcaaaggattcaatcacagaaaggtatgacaag

SEQ ID NO: 26927 - DNA, 121 bp, Artificial Sequence
  Synthesized
  misc_feature (61): n=a or g
ggaaaatgtcagttaaagcagggaaagctggagactgggaaaagactgagggctccaaatncactgcagacccggggttgttgttattaaaaagcacttccagttacaggatggttcgtct

SEQ ID NO: 26928 - DNA, 121 bp, Artificial Sequence
  Synthesized
  misc_feature (61): n=a or g
tggtgctctgcagaagaaaaactataattactttgaaaggagtagatcatatctgatctcnttcagaacttagtctctgtatttatgctcatattaaagtatgatgaacatcagtaaccag

SEQ ID NO: 26929 - DNA, 121 bp, Artificial Sequence
  Synthesized
  misc_feature (61): n=t or c
gacaccttctgctctgacttgtccctgtggaagaaggtacaagattccttttctaactatngagaaaaactaatgatatcatagcttttgttataatcgttttgaaagtttgagtcttttt

SEQ ID NO: 26930 - DNA, 121 bp, Artificial Sequence
  Synthesized
  misc_feature (61): n=a or g
ccctcagactccatccaggctgaagagtaattgccatttttagacagttttgaaacaaacnatgacaaaaacactctctgagcacttttccctctctgccgtccctctcctcccatgcaaa

SEQ ID NO: 26931 - DNA, 121 bp, Artificial Sequence
  Synthesized
  misc_feature (61): n=a or g
tgcatagccccacgacttaatgaaatctccctcagctgcagaaatgaaactcctgacctcnttaccctgtgctgacccacctacgattgcaccacaaggcttcgtatgaaatcctcaaatt

SEQ ID NO: 26932 - DNA, 121 bp, Artificial Sequence
  Synthesized
  misc_feature (61): n=a or g
attgaattaagaactggaattaaggacattacagcagtcgtgtcctactatacatttccantgaacagacaataacgtgactgtcattctgctgacagtgactttaccaccttagttacca

SEQ ID NO: 26933 - DNA, 121 bp, Artificial Sequence
  Synthesized
  misc_feature (61): n=t or c
ggcttatatcactgatctatgaaagatatgtgaaatggcagtctggttttccagggatggnatagagcctctgtctgctgtgatcacgtatatactaaaaattgcatccgtttttttcata

SEQ ID NO: 26934 - DNA, 121 bp, Artificial Sequence
  Synthesized
  misc_feature (61): n=a or g
caaatgcaaatcttgttcgttcaagggcagaaggagttgaaaggcttacgctctgggcagnaggagcatcacctggacattgttatccattcacctctctgagaagagagcaagcagcaat

SEQ ID NO: 26935 - DNA, 121 bp, Artificial Sequence
  Synthesized
  misc_feature (61): n=t or c
ctactgctgtactttaatagacatgctggcatgaaaatacgcagtaggaattattgggtangcacacttcacagtgtgttcttaaattcagttttagtatttcttcttttgatgaacaaaa

SEQ ID NO: 26936 - DNA, 121 bp, Artificial Sequence
  Synthesized
  misc_feature (61): n=a or g
cctgaaacaacttcaaagtcttattgcaaaatgaagttaattcagaaatgagaatggcaanccatcttttttgtgttatgtttcaaattatgtgatagcatattatttttctatcaacaac

SEQ ID NO: 26937 - DNA, 121 bp, Artificial Sequence
  Synthesized
  misc_feature (61): n=a or g
tagtatagatatgaggacaatatttggtcgctttcttgcttgtcctgtactgtgctgttcnttaacctgtaattaagatgcttccataacgtgcacatccatagcatttgctgaggatctc

SEQ ID NO: 26938 - DNA, 121 bp, Artificial Sequence
  Synthesized
  misc_feature (61): n=t or c
gcagtggtacgtgggctctgccctgcagtaattgcccatgcaagtgttgctgacagtttgngcgttgatatattgatattcagttaacaatttatgggtggatatactgatactccacata

SEQ ID NO: 26939 - DNA, 121 bp, Artificial Sequence
  Synthesized
  misc_feature (61): n=t or c
actgtgtgtatctttctgaagaagtacagtattcactgcccatttaactgtaatgttattngtgttaaaatgattggaaaatgtccatatgtgtgagctgacttggctgctctcagttgcc

SEQ ID NO: 26940 - DNA, 121 bp, Artificial Sequence
  Synthesized
  misc_feature (61): n=a or g
aatcctacaaaacaatctcagctcttcccttattccctcatatgatgaaggcagacaacantactaggagacttcgacagagaaaaagagaagaacctgccaaatgatggaacatagctgc

SEQ ID NO: 26941 - DNA, 121 bp, Artificial Sequence
  Synthesized
  misc_feature (61): n=c or g
aaacacttgatttatatgcagaaagtgagatttgaaaatgaatcttaaagaaatctgatgntgttttgaaaccttgcataatcaaaaggaagcagtactgggattgtactatacctcatta

SEQ ID NO: 26942 - DNA, 121 bp, Artificial Sequence
  Synthesized
  misc_feature (61): n=t or c
gtagatcgcagtcgtggctgcaccaatagaaccacagaattcaggaactctaaggaagttngctgcccattttctgccttgctccttgttgggatgtgcccagagctgagctgtgttttga

SEQ ID NO: 26943 - DNA, 121 bp, Artificial Sequence
  Synthesized
  misc_feature (61): n=a or t
aaagaatgggtagatgccaaaagagagccaggcttccttttgctgtttgaagcccactggncacagctaccatgaccgtggagactgtatcttcaggtggctccagcctggttccttctgg

SEQ ID NO: 26944 - DNA, 121 bp, Artificial Sequence
  Synthesized
  misc_feature (61): n=t or c
cccttggtgagacagttccctgtcatatttactggactaggtctgcatctagggaagcccngcgatgttattgccatcttgtctaactgcacccaagaacaggtcttttgaagaatggaga

SEQ ID NO: 26945 - DNA, 121 bp, Artificial Sequence
  Synthesized
  misc_feature (61): n=t or c
ctgtccactgactgaacacaagtactccttcactatctgctcctattctgttgatggtganattcttgtactggtgtaatccttgggtcactcatgccaacacttgaaagaagttaccttg

SEQ ID NO: 26946 - DNA, 121 bp, Artificial Sequence
  Synthesized
  misc_feature (61): n=t or c
gggagagatacttggcaatatccagggagctttcactcctacctgaagttgcagacagcgngctattaacctgaagatctacatggccaaagaaagcaaatttggctagagtctccagtga

SEQ ID NO: 26947 - DNA, 121 bp, Artificial Sequence
  Synthesized
  misc_feature (61): n=t or c
tgacaattgctcttatttcatttaaattcttctgagctgcagccaccctgaaatactcaanagttgtgatgattcttttgaggaatgttcttatataacagaaggaagccagcagacatct

SEQ ID NO: 26948 - DNA, 121 bp, Artificial Sequence
  Synthesized
  misc_feature (61): n=a or g
aactattttaagcatgaaactgaatcaaagtaccgtatactgcaacatttttccagctgcncagcatgacaacaatgtattgaactccaacagtataacagatcactgctatatttattac

SEQ ID NO: 26949 - DNA, 121 bp, Artificial Sequence
  Synthesized
  misc_feature (61): n=t or c
aagttggaatttgatgagcagaatgtcagatttagcacaggatggagacgcttcttctgtngataataagtctctgtctggttaacagcttcagtatgctctggtttggaatgctacttcc

SEQ ID NO: 26950 - DNA, 121 bp, Artificial Sequence
  Synthesized
  misc_feature (61): n=a or g
caatcagtgctttctaggagatgatctgttcttgtggcaggaaaacagcggggcaagggcnggatttgtgatgcttgtttttcccttctttgctgctgaaagcagcactatacttccaggt

SEQ ID NO: 26951 - DNA, 121 bp, Artificial Sequence
  Synthesized
  misc_feature (61): n=a or g
ttacaaagcatagaaagctgaaaggcacaatatatggaagagctcaaaaccagcaccaatntatttgcttcagtattctctgaagcattacaaaagcaaagtcattttggtatgtacaacc

SEQ ID NO: 26952 - DNA, 121 bp, Artificial Sequence
  Synthesized
  misc_feature (61): n=t or c
agtgttttgcatgggccaagcaagagccgaatgtccatcctgagcccacagcaattagtgngaggatgagggaaatgatgaaccagctctgcttctcacaccctccatggccaagagccac

SEQ ID NO: 26953 - DNA, 121 bp, Artificial Sequence
  Synthesized
  misc_feature (61): n=a or g
gaaaggtcagcactgggaaaatacattcccttcattgaactttctccatattatttgcatngtcacttctggagccagtattaattgctagatattgttctgtgcgttttagtatgaaagt

SEQ ID NO: 26954 - DNA, 121 bp, Artificial Sequence
  Synthesized
  misc_feature (61): n=a or t
ggaggtatacagaactgctttggcaatcttcagtgttatcttgcagcattatcttgtattnagttacattgtgcatgtcttccatattactaaggaaccagactcccttgatcaaacaatc

SEQ ID NO: 26955 - DNA, 121 bp, Artificial Sequence
  Synthesized
  misc_feature (61): n=t or g
cagttttatgtctcagtgcactaaagtgaatcaatgtcattgtcactgatatgacatcaanatatttagggtttccgaaacatatgctactgcaacacagaggtgaaatgtgattttagct

SEQ ID NO: 26956 - DNA, 121 bp, Artificial Sequence
  Synthesized
  misc_feature (61): n=t or c
accaaggcttagagctctgtttattgcacactttgaataaaaatccccagagaagaaatgngaagttccagttgctgagaataaacttggagaaattacagtcttgacatatcctcattgc

SEQ ID NO: 26957 - DNA, 121 bp, Artificial Sequence
  Synthesized
  misc_feature (61): n=a or g
gagtaggcgtttaaataaattgtcctgcaaagccatcaattgtttctgataatgaagaaanacttaaagagattcctgaaggtatttaaacaacaagaagtgtgtgtaatgcacctaacaa

SEQ ID NO: 26958 - DNA, 121 bp, Artificial Sequence
  Synthesized
  misc_feature (61): n=a or g
gcattctacctgtgattctaggcaaggtgcagtcattgttgattgttttccaagaaaatgncaacctcaattcaaatcaattctttattctttttgattattaagcaagaagggcaatgtg

SEQ ID NO: 26959 - DNA, 121 bp, Artificial Sequence
  Synthesized
  misc_feature (61): n=a or t
gcacttgtcagtgctggttggttttgataatggtaggtatccatgcatgctgatattgatnggtactgatattgaaaagctttgatacgtaacattaggttttgaaattgatttatattaa

SEQ ID NO: 26960 - DNA, 121 bp, Artificial Sequence
  Synthesized
  misc_feature (61): n=t or c
gtgagcacaagagaggatactgctgacttgcatcctgcaggcagtgagagcgctcagtctngtggaggactgaaaagacacagagtggagctggaagatgcagattcagagaaatcgtcct

SEQ ID NO: 26961 - DNA, 121 bp, Artificial Sequence
  Synthesized
  misc_feature (61): n=t or c
atggaccaggagaatctgctttatgaagcttctgtaaggagaggacacagcctgagagcgntttgctataactataaacattaaaattagtattcccttattaataagggtttccaagatt

SEQ ID NO: 26962 - DNA, 121 bp, Artificial Sequence
  Synthesized
  misc_feature (61): n=a or g
tgaccaaaataagaaaacactgacctaaaatgactgctaaaacactgacaagggaaaaaantatgtcagcctgggaacttggcctggacactcagcctggaaaccagaggcatcctttggg

SEQ ID NO: 26963 - DNA, 121 bp, Artificial Sequence
  Synthesized
  misc_feature (61): n=t or c
tcagtaagaactgttccaagacacctttgtttcttgttgtttgaaatactgtattaaatgnagcatcagttcagattcatcagtaacttcttgaggccaaaataaaaattgaaaatatagg

SEQ ID NO: 26964 - DNA, 121 bp, Artificial Sequence
  Synthesized
  misc_feature (61): n=a or g
gtgtccctggtcttaagcaatatcacaggtcctcattttgatttaaagttaattcattttnaattaaagttccagtccctgccaatactccaagttcaaacccactccacaagtacactgc

SEQ ID NO: 26965 - DNA, 121 bp, Artificial Sequence
  Synthesized
  misc_feature (61): n=t or c
taacatctcatatttgtgttttttaaagtaattctcccgttctgtttctgcagtacatgcntttgtctgcagctaatttacatgctatagtactcctactcaaaaaaaaaaccataaaaat

SEQ ID NO: 26966 - DNA, 121 bp, Artificial Sequence
  Synthesized
  misc_feature (61): n=a or c
acaaatgcatatttatcactgaatggctgcaaacatctgcccacataataaccatctgtangaagctgtgaaatgcttagaggctgggaaatcctaaattctctttaagcacctatatttg

SEQ ID NO: 26967 - DNA, 121 bp, Artificial Sequence
  Synthesized
  misc_feature (61): n=t or c
gcctccaacagggcttgaagaggacttttacatttttttcatttttaggacagttgcaganatcatttaaacttcatgatagcctacacacaacagatcctcagcaagtttggtttcttta

SEQ ID NO: 26968 - DNA, 121 bp, Artificial Sequence
  Synthesized
  misc_feature (61): n=t or c
tctgagctaggcactttcacttcccttctattacctgcaagaaagtactcctttacaacanatagcctctagtgctcatagttcttagttttctccagatacaacaaaatataacaaaggc

SEQ ID NO: 26969 - DNA, 121 bp, Artificial Sequence
  Synthesized
  misc_feature (61): n=t or c
tttttttttagatttttttgttgttgttgttctgctttgtttaaattgatttgtgtgctgntggcttccagtagtgcatagaaattgttttgttttctttcgtggaacagaggcaaacttg

SEQ ID NO: 26970 - DNA, 121 bp, Artificial Sequence
  Synthesized
  misc_feature (61): n=t or c
ggccttgcttgctttggctcagatgcacagtgcttcatgggtcactagctgttaaaggggntggatgccatagcagtgcatgagatatgcacacccgaggcacgcccgcagtttcctttca

SEQ ID NO: 26971 - DNA, 121 bp, Artificial Sequence
  Synthesized
  misc_feature (61): n=c or g
cgtggcatacccacattctgacaaataaaacagagatcaagaaatctcatagttaacagangaagttaacatattacttcaaaataggcatgatgaatatcacaacgaattgtcacatttg

SEQ ID NO: 26972 - DNA, 121 bp, Artificial Sequence
  Synthesized
  misc_feature (61): n=a or g
tttaactgatttttcagatcagccttaaagatgctagaataaggacgatatatttctttgnttttacaatcagcacatactagggtagcaatgaactatcactgagtctctggagaccctg

SEQ ID NO: 26973 - DNA, 121 bp, Artificial Sequence
  Synthesized
  misc_feature (61): n=c or g
tactggatgtattatattaataatattctgaatatgtgtgtttttctggataagagtgtantctaatctgaactaactgaagtcctgaatttgaacgtttaactttttttaagcatttgag

SEQ ID NO: 26974 - DNA, 121 bp, Artificial Sequence
  Synthesized
  misc_feature (61): n=t or c
tcttggggtctttctctaggcattcccagccagcgctgtgagatgcagtacctttgtagantacaaggcactctcttcatgtattttaggactaaggctttataagtgcctgaaaatctta

SEQ ID NO: 26975 - DNA, 121 bp, Artificial Sequence
  Synthesized
  misc_feature (61): n=t or c
tgggtctggagaaactttttgtagtttcgtgggtatcgttccactgactaacaggagttanttgaagcttatttgcatagcaagcatgcattaaaatgcatgaggcatgcagggctgtggc

SEQ ID NO: 26976 - DNA, 121 bp, Artificial Sequence
  Synthesized
  misc_feature (61): n=t or c
acttccactggtggacagctggtgctgtcctcacaagcccacatccgggtttacaaagatntccatccacacaaaattctaccttcaaacagatctttttttgctaactgtgctcatttca

SEQ ID NO: 26977 - DNA, 121 bp, Artificial Sequence
  Synthesized
  misc_feature (61): n=t or c
ccatgaactggaacattaaggcaagggaaacactggatgtgttttcaaagctgtgtaagcngctgtggatcattgatcttgcttggtggtgcaagtgcatcacatgcagtcagcatttctc

SEQ ID NO: 26978 - DNA, 121 bp, Artificial Sequence
  Synthesized
  misc_feature (61): n=a or t
gtaaccaaggaagaatttgaggcagtgatgtaaaaaggagaatacttctgtatgtcagacnatgcagagttaattgtaggcaattttttttaaaagctgttttttccttcatatcatatgt

SEQ ID NO: 26979 - DNA, 121 bp, Artificial Sequence
  Synthesized
  misc_feature (61): n=a or c
aggagcacagattggaacaaatgctgcagagctgcagtgaccaggtgccctgatggctaangggtgcatatcccaggctgctgcacgttcatcgaggggcacatctggctgcggccaccag

SEQ ID NO: 26980 - DNA, 121 bp, Artificial Sequence
  Synthesized
  misc_feature (61): n=t or g
gaagccaaggactgcatggagtcaaatggttcttccagaacaagtttatacgtacaggagnttaagtagagtaaaataagtttgacagactgtctttcatgttctaggttgtgaaacttcc

SEQ ID NO: 26981 - DNA, 121 bp, Artificial Sequence
  Synthesized
  misc_feature (61): n=t or c
taaatcaacagccaagttgtctttctgctggcacaggtctgtgatggttaacaccaattanatacctaacccaacagcaattaattaatctatagagacaaccgagtcaagtgatattcct

SEQ ID NO: 26982 - DNA, 121 bp, Artificial Sequence
  Synthesized
  misc_feature (61): n=a or g
agaacccaggttttctaatctcctgaccaaacgcttacaagtcactaagactgtggagtcngaagaaaagcaagcatagttcaacactgtatctggatatgtattctccagatattaatga

SEQ ID NO: 26983 - DNA, 121 bp, Artificial Sequence
  Synthesized
  misc_feature (61): n=t or c
tcatgggatgggctctttgcagaaagggagagacatgcccttctcctagctctctttgccnaaggagaagggcaagttcagatgctgacaccagatgctcttcttgccccattgctcctct

SEQ ID NO: 26984 - DNA, 121 bp, Artificial Sequence
  Synthesized
  misc_feature (61): n=a or g
ggtttctactgccttttcagcatgggaactacaataatctgtccatttatttaacataggntggtcattagagtgaaacattttcaacttgcaggagttcacactttggcatttttcagtg

SEQ ID NO: 26985 - DNA, 121 bp, Artificial Sequence
  Synthesized
  misc_feature (61): n=t or c
gtttatcttcatcagattggaaagaagtgagaacagaatatatgaggtttattggatcttntgaaccttctggtacatttttatactaagtcttgaaatcaatcacgatatagaaagctat

SEQ ID NO: 26986 - DNA, 121 bp, Artificial Sequence
  Synthesized
  misc_feature (61): n=t or c
acaatctaacttgatattaacacaaaactcagtacagattgattagtttcaagcacagagnttgttacaacagtgtgaatatctatacagataagaaacagtttccagaaacacaagtttt

SEQ ID NO: 26987 - DNA, 121 bp, Artificial Sequence
  Synthesized
  misc_feature (61): n=a or c
tgtaatggagatggctttccttgccagcttggtgaaggagcctccaaagtcaaggcaccangagcttttggaagtccccagttgagctgtagcccaaaggccccttcaaagagaccactga

SEQ ID NO: 26988 - DNA, 121 bp, Artificial Sequence
  Synthesized
  misc_feature (61): n=a or c
atgtgtgttgtgacaagctctctcagatggtgagtagactgtttgtcaactcataactatnattctccaaaatagcgaagatttaacaatttgcatttagaaggctttgataaaaatgtag

SEQ ID NO: 26989 - DNA, 121 bp, Artificial Sequence
  Synthesized
  misc_feature (61): n=t or c
tcatggactgacatagagctatgctgacctccttccttaggacaggaccttacaattcctnctcttgttaaacactctgtgtaatgcaggaggtcccatcatggatagcacttatcttact

SEQ ID NO: 26990 - DNA, 121 bp, Artificial Sequence
  Synthesized
  misc_feature (61): n=a or c
aatctcacaaaagtcgagatgttatacatgggatgctgtaagaagacaacaaagaagctcntgcaggtatgcttttttggtgcactaatcaaagaagaggcagattaaatactccagaaaa

SEQ ID NO: 26991 - DNA, 121 bp, Artificial Sequence
  Synthesized
  misc_feature (61): n=t or c
cacaactgcagttgtttcagacaggctccgaaagatcatatacacttgtcctccctttgcntttcccctgcttcctcactgaccccaaccttgcagcaccttgagtacttcacttccatct

SEQ ID NO: 26992 - DNA, 121 bp, Artificial Sequence
  Synthesized
  misc_feature (61): n=a or g
agaggagggagaggtgtgtttgccaccctaagtgtggatcccatttctggagcattgtaangcaaggcaggcatcgaagggacaaatcgcacagtgttaatctgagtagtaatgatgatgg

SEQ ID NO: 26993 - DNA, 121 bp, Artificial Sequence
  Synthesized
  misc_feature (61): n=a or c
ttgcctttgatttagtttcagccatgatttagctgtttggaaaacaagcatacgtatggcnccacccattggtgtgatcactggataagccatacactgaagcagcaagtgttcctctgga

SEQ ID NO: 26994 - DNA, 121 bp, Artificial Sequence
  Synthesized
  misc_feature (61): n=t or c
tctgtcagtgtaatcacagtatccttctattgtcatgttcttagatatcaggatacagtangttgcaacagtggaagatggttgagctgttgaagtaacagtgtattaaatacattatcac

SEQ ID NO: 26995 - DNA, 121 bp, Artificial Sequence
  Synthesized
  misc_feature (61): n=a or g
gcacattttagggctcaaataaaatagatactgacaagcacactttcctttgccacaagtnaaatacattagataaaatacagctgtgccttaggtcagtgtaattcctgctgtatgcagt

SEQ ID NO: 26996 - DNA, 121 bp, Artificial Sequence
  Synthesized
  misc_feature (61): n=a or g
atctgggagactttcatgccaagcctaaagttgctcagctgtgctttctttgtgtcatttntccaaagagatgataagctgaaaacttgtcctgtgacataaagtcgtgcatgatgcccag

SEQ ID NO: 26997 - DNA, 121 bp, Artificial Sequence
  Synthesized
  misc_feature (61): n=t or c
agatggttcctcttatctgcagacaaagatccagagcaccattcattctttgtgtactctncagctacctcatgtatttcagttttgctgcttagccactgatagtgtatggcaatgtgtg

SEQ ID NO: 26998 - DNA, 121 bp, Artificial Sequence
  Synthesized
  misc_feature (61): n=a or c
ttatccccatttttagcactgtgagtttatttctctgtctagtactgcttctagtgctaanctctggaaatctctccttccaagcatcagaaatggtctctgcacagtacacgttattatt

SEQ ID NO: 26999 - DNA, 121 bp, Artificial Sequence
  Synthesized
  misc_feature (61): n=a or g
agccaggctgtcagtgagagctcctcatgtaactatttctcagctgactgatatgcaaacntattttgactttcttaaaacactaatgagaacacaaaggatggtgatgaattcaggcctg

SEQ ID NO: 27000 - DNA, 121 bp, Artificial Sequence
  Synthesized
  misc_feature (61): n=a or g
cgatgaacttagatgttctcatcctgccaccaacaggctagtaattactatctcaaaggcnttgttgagtttacaggcagtcaaacaggatgaaaacaacgcactgttgctgctctgccct

SEQ ID NO: 27001 - DNA, 121 bp, Artificial Sequence
  Synthesized
  misc_feature (61): n=c or g
cattacagccctcagaagccttcctcttcacacagactgctgctgggagatcctgtctcanacgacattaggcagcaggcttgaaatctcacagtagccaaagtctgtcagcccttcctaa

SEQ ID NO: 27002 - DNA, 121 bp, Artificial Sequence
  Synthesized
  misc_feature (61): n=t or g
ctaacccaagcatgctctcccttctctggaggaagtcaagcagcagcactgaggcataaangttcaagtcccttccagacgtcttgcctgcttctgccttgagtcactagaaaaacaaggt

SEQ ID NO: 27003 - DNA, 121 bp, Artificial Sequence
  Synthesized
  misc_feature (61): n=t or g
aaatctattccagtagaagcatatttatatgcagaattggatgtgtacaggttcaagcaancatcacaaaactttctacagacttgtaattaaattagaagcttttttaggacagggtcaa

SEQ ID NO: 27004 - DNA, 121 bp, Artificial Sequence
  Synthesized
  misc_feature (61): n=t or g
tacacaaacagtgtttccactcccacattctcctctcatcacactaccttccatttaaaangcaacttccccaggaaatggtcgtgctagattttgcataaagtgtatactgaaatcaagc

SEQ ID NO: 27005 - DNA, 121 bp, Artificial Sequence
  Synthesized
  misc_feature (61): n=a or c
tatatgatatgcatgaagataaaatctgacatgctagcagtgtaccttgagagtccaaaanttgctcagaattttagttttaaacatgagtacttcatgtgctcaagtacaaatacttgat

SEQ ID NO: 27006 - DNA, 121 bp, Artificial Sequence
  Synthesized
  misc_feature (61): n=t or c
ttagcttttcttagctgatattgttttgcataaaaggtctctgggaagaacagaattcacngttgctcaaccacatacctttctgtcttatggtgtaagaaggaacagggattttctaaaa

SEQ ID NO: 27007 - DNA, 121 bp, Artificial Sequence
  Synthesized
  misc_feature (61): n=a or g
agccactgaacacaaactgctgagatgcagctgtctgtgtggagtaccttggtcttttccnggtctcttctcatcaagatctcttgtcccattaagaagtgagtccacattttccttagct

SEQ ID NO: 27008 - DNA, 121 bp, Artificial Sequence
  Synthesized
  misc_feature (61): n=t or c
ttattttaaattatgcttgtggaaacacattcaagtaaacttgtcctgagcaagaacaaantatacatcctatgacctcctaaatgagtaatttttcaaaactgttcaaagagaagtgctt

SEQ ID NO: 27009 - DNA, 121 bp, Artificial Sequence
  Synthesized
  misc_feature (61): n=c or g
ttacccctttttatattcttttctggaaatcagatcttccagatgcaactgtttacctagnaacctgatgtagtctatacccctctgtcagtttggcagaacttaattctgttcccgcatc

SEQ ID NO: 27010 - DNA, 121 bp, Artificial Sequence
  Synthesized
  misc_feature (61): n=t or c
ggaaggcagcttagggagttaaagaatccactgactcaggagaccacaaaacacgcattanaagaaaatgactacttaacctgcatttacaaaggcattggccataaaacacttgaggcaa

SEQ ID NO: 27011 - DNA, 121 bp, Artificial Sequence
  Synthesized
  misc_feature (61): n=a or g
tgatcgtattttttaaacaaagctgacttctgtaataccactggcaaagctttgtcaacanagaactggtgttaatgttattgccacattttcaatgtaggcttcttagatgtttgaggct

SEQ ID NO: 27012 - DNA, 121 bp, Artificial Sequence
  Synthesized
  misc_feature (61): n=a or c
ctagccatttcagctgattgagccactgacattagtcgaattacataaagcttccagtagnaactttatttcctgggcacttctagaaatctattgcttttctatgtgtatctataaccta

SEQ ID NO: 27013 - DNA, 121 bp, Artificial Sequence
  Synthesized
  misc_feature (61): n=t or c
caacaggctacctagctttcagtttaacactcccttgaggattttcgttatcctttccttntctgctctcaaggttagctctagccagactatttctagcttcaacttcctggagataatg

SEQ ID NO: 27014 - DNA, 121 bp, Artificial Sequence
  Synthesized
  misc_feature (61): n=t or c
cttcaagcaagagaagtccagagaagcaagtgctttgcaagtcaactcctgcaaggtttcntccttatacaatatgagggaatgcaggctgcaatcccagcaccccacttaggaaatcatg

SEQ ID NO: 27015 - DNA, 121 bp, Artificial Sequence
  Synthesized
  misc_feature (61): n=a or c
atcaagtaacatttcccgatacaatgaactaacagcctaatacagacttgaagtgaaaaantattgattcctggatagataaagcatcagggagcacactcaatttattgaaacatgttgg

SEQ ID NO: 27016 - DNA, 121 bp, Artificial Sequence
  Synthesized
  misc_feature (61): n=t or c
tgaaacggggatgtgccaagaaaccaaccaataaaaatatctgttcatttacatctccagngtagcttttcccaaaatggtactaaaacattttatgatctataattctcttaatatgcat

SEQ ID NO: 27017 - DNA, 121 bp, Artificial Sequence
  Synthesized
  misc_feature (61): n=t or c
aaaaatatatccttgaaatgaaaacactttctgattggtttttactgttgtctgatatacngtctcttcttttcctcacatccaaactacacgaggaatgtaaatgactgctgttctttta

SEQ ID NO: 27018 - DNA, 121 bp, Artificial Sequence
  Synthesized
  misc_feature (61): n=c or g
acaaaatcttgtagtagaaggtatcgactccataataacacgcagccttgtagagtggaanagggagtaaattctcgtctttgatttcattggctggtcctccaacttttctgttattctt

SEQ ID NO: 27019 - DNA, 121 bp, Artificial Sequence
  Synthesized
  misc_feature (61): n=a or g
agtggggatatttcaaggaacctgaaaaagctggcatcaggatcctgctgaggtttggtgnaagttccatggacacttgctttgttcaaagcctcagcaaaacccaatggggcatgaccaa

SEQ ID NO: 27020 - DNA, 121 bp, Artificial Sequence
  Synthesized
  misc_feature (61): n=a or g
atatagaagtgttgaagactcattggccactggggagttttcattgttctgtgatgaaacngggctctcagaattggtttcttaggctcaggacacgttgtacagcagctggaagagagcc

SEQ ID NO: 27021 - DNA, 121 bp, Artificial Sequence
  Synthesized
  misc_feature (61): n=a or g
ctctgcgataatatttcactgagcagttcctagctaaggcaagaaactggaaaagcacacnaagtcatcagtgtacaaacgatgctgctacagctaatcacaaaaatgattatcttaattt

SEQ ID NO: 27022 - DNA, 121 bp, Artificial Sequence
  Synthesized
  misc_feature (61): n=t or c
atacaggtgtgttactacacgtaatgggacttcacttctcactcaacagagcaaatctcangtcaacttttaacgagaacctattcatcacagtcagcatagccctgctcctctcctatct

SEQ ID NO: 27023 - DNA, 121 bp, Artificial Sequence
  Synthesized
  misc_feature (61): n=t or c
ctcagctgcggagtggatatgaggcttcattcaaagttcagaccacctgttttgactcccngtatcagccagaccacacttcctttcttataccaatgagtggccaccgcttgaacttggg

SEQ ID NO: 27024 - DNA, 121 bp, Artificial Sequence
  Synthesized
  misc_feature (61): n=c or g
acgctttaggaaatggttgttccacacagttccacaactcttgttccacaactcttgctanaaacaggtttccccaaaccactttcattctgtgacctccttagtgttcaaggatacattg

SEQ ID NO: 27025 - DNA, 121 bp, Artificial Sequence
  Synthesized
  misc_feature (61): n=t or c
caagatcaaaggaaggatatgaattcccagcaggctccccatggggccacctgcaggcacngagcacagacgcacaggagagcatggagagtgagttcccagagaagagaaataaactgac

SEQ ID NO: 27026 - DNA, 121 bp, Artificial Sequence
  Synthesized
  misc_feature (61): n=t or c
gaaatgctatgtcaacagctcttcactagcaggccctttatttttattggcttcagttctntggctagtgttgacaggttaatttacagtaacagtaagagtcacctttacttgctatact

SEQ ID NO: 27027 - DNA, 121 bp, Artificial Sequence
  Synthesized
  misc_feature (61): n=a or t
gctggacagaaacacctgatgtcagtggcttctgagtggagttcataaccctacctaatcncattgctggtgcagcctaagagcatctacacagcatgttaggaccaagcatttagctcac

SEQ ID NO: 27028 - DNA, 121 bp, Artificial Sequence
  Synthesized
  misc_feature (61): n=a or t
tgaatttatgtatccttcagtcctgttacaacaacacttttacatggcactactcctaaancttgtccttttttttcaaagtcattttccacctcgactttatttttgcccttgcttgatt

SEQ ID NO: 27029 - DNA, 121 bp, Artificial Sequence
  Synthesized
  misc_feature (61): n=t or c
aaaatacaacagaccagctgccttcagtagcatttgtactttcctgctcctttcttgactncctgttcttcactctgtgtttcaagatgggaaagcgttagcaaagaaaagaagaaagata

SEQ ID NO: 27030 - DNA, 121 bp, Artificial Sequence
  Synthesized
  misc_feature (61): n=a or c
tgtttcagtgttttcgtctttttaaaactgttaataaaaatcaagcatggctttggaaacnaacactgagggtctaggctgttgtgctgattgcctttggggacagtaacaaaaaaacttc

SEQ ID NO: 27031 - DNA, 121 bp, Artificial Sequence
  Synthesized
  misc_feature (61): n=a or g
agttaaatacttctgaaagtagcttgccactacatcattaaaaagcaggagcaatccattntgcttgattatatgtaagaaataaaaccacacaaagattttttgaaaatgtgtaaaacct

SEQ ID NO: 27032 - DNA, 121 bp, Artificial Sequence
  Synthesized
  misc_feature (61): n=t or c
tgctagttaccttgcagtcaggaagagtactgtgcttgtcttcaactgttccttgggaaangtggccattttccttacagaaggtgttctgatgcacagttgaagtccgtggaatctgaga

SEQ ID NO: 27033 - DNA, 121 bp, Artificial Sequence
  Synthesized
  misc_feature (61): n=a or g
aagcatcattccacacacaaagttttggaatttgtcagctaaagagttttctggctaccanaactgatgtgagtagcatctgtttggtggtgtgcgttacctggggtgctgctcctgtcaa

SEQ ID NO: 27034 - DNA, 121 bp, Artificial Sequence
  Synthesized
  misc_feature (61): n=a or g
ttttcctgcttcaatctccagcattttcagggtaccagaaaacagtgaacaggccgagacncaaccgctatggaacagatttgctatctgcaactctcccacctagggcaagacatcaaac

SEQ ID NO: 27035 - DNA, 121 bp, Artificial Sequence
  Synthesized
  misc_feature (61): n=a or g
acagcagtagagtaaaatgtctttttctactctcgttcaaactcagtaagcacaaagatcntgcctatggtgctcactcagtatcagacatggtacaagtagagcatatattcatcatctt

SEQ ID NO: 27036 - DNA, 121 bp, Artificial Sequence
  Synthesized
  misc_feature (61): n=a or t
cacagaccttagaggagggtatggagcctcaaggcacattcttcatgatcagacaacagancagaacagctctaagtcacacaatcagtgtgagctggttatccaaaaccgatgggactca

SEQ ID NO: 27037 - DNA, 121 bp, Artificial Sequence
  Synthesized
  misc_feature (61): n=t or c
gtgtgtggtgggcacaagagggagggttatcactgcactgtgccctgctctccacagtgtnccactgtctcgtactcagtctgcaatcaagctacttgcaatcgactcatgaaaaaatatt

SEQ ID NO: 27038 - DNA, 121 bp, Artificial Sequence
  Synthesized
  misc_feature (61): n=a or g
aacttctgtgaaaacagaccatatgtttcccctccgttctctcacatgcttttctcacacngattttaaataaaactggagcctcatctgtcgaacacggaatgatatttgttttattggg

SEQ ID NO: 27039 - DNA, 121 bp, Artificial Sequence
  Synthesized
  misc_feature (61): n=a or g
ggctcctgcagcacattttgcaggtatgaccatgctcatgagttcctaggcaatacattcnctagatgagttaactggaaaatagtaaatctgccttaaatgcacctactcaaggatgaca

SEQ ID NO: 27040 - DNA, 121 bp, Artificial Sequence
  Synthesized
  misc_feature (61): n=a or g
gaactgccaaattaataacccatcagctgccagtaagcacaagaaataagtcgccttcctntcctgagatgcagattcatctacgaaggcgctcgataggcacaaagcgtctctccaggct

SEQ ID NO: 27041 - DNA, 121 bp, Artificial Sequence
  Synthesized
  misc_feature (61): n=a or c
tgttgggagtaatggctgtagctgctagtattaatgcatatgcaagagaaaacggaaaatntctaggcagcttggacagctctcttataccaattaagtctcttgcatatatataatgccc

SEQ ID NO: 27042 - DNA, 121 bp, Artificial Sequence
  Synthesized
  misc_feature (61): n=a or g
tttaaatcttaccaccctgttggatttaaatccctagggtgatggtcagccaagcctcacnaagacttgcacaaaggcaatgtaaatactgcgatgtcttacaggaggtgtgtgacagcca

SEQ ID NO: 27043 - DNA, 121 bp, Artificial Sequence
  Synthesized
  misc_feature (61): n=t or c
actggtggaaactacagcagtgacaaaggttggatttgggcagatctgccatctcaacacnctgttccagtggtgaagtacacacatcttttttttttcctttttttttttcacccctgca

SEQ ID NO: 27044 - DNA, 121 bp, Artificial Sequence
  Synthesized
  misc_feature (61): n=t or c
ttgctttctcttttcacctgagcctgagcacaagatgcccatctgaccttttaaacacaanacatcgctgtctatattatggttacaattatgtccaaagttttggggccgttggataaaa

SEQ ID NO: 27045 - DNA, 121 bp, Artificial Sequence
  Synthesized
  misc_feature (61): n=a or g
ccagcactgagtgcccatcactggggttgggtgccgtggtttccacccaccctgcgtttgngcagtgcagccaaatagagaccttacaaaggcacactggagatgaactttgggaatcagt

SEQ ID NO: 27046 - DNA, 121 bp, Artificial Sequence
  Synthesized
  misc_feature (61): n=a or g
agggttttgcaaaggagtgacgttaattccctcctcctcccataccaaaccaaggaaaganagagaatttgtctgagtttaaacaccacgtgcaattgtgacacattgtaaactctgtgtt

SEQ ID NO: 27047 - DNA, 121 bp, Artificial Sequence
  Synthesized
  misc_feature (61): n=a or g
aagcagggaacagccagttcagctgctgggcaacgaggaaaagaagtaagccctcagtgcnactccggtgagagcagggtaaagtgttgagctccttctgtctttgtcaaaattgcctatg

SEQ ID NO: 27048 - DNA, 121 bp, Artificial Sequence
  Synthesized
  misc_feature (61): n=a or t
ttatttactgaactgtttaggcactctaaaacattaacagtaatataggtgggtctacagnagccaaggatcatagggtcactatcttgaaggaggtattccagcactattgtcaaatcaa

SEQ ID NO: 27049 - DNA, 121 bp, Artificial Sequence
  Synthesized
  misc_feature (61): n=a or t
gtgaaggttggttatgccaaaaagggaagagtttgtaagcagctaagggacttcatttctnctttgaagagatctagtttggatattgctactttttccaatttattggagttttaccttc

SEQ ID NO: 27050 - DNA, 121 bp, Artificial Sequence
  Synthesized
  misc_feature (61): n=c or g
agcaaaacaccttcaaaaaaatgtctattaagcatgaacacatgagagcctgggcttaagnaactgaaaggtcaccacagttatttaagatattctactatatagtgcatacataaactat

SEQ ID NO: 27051 - DNA, 121 bp, Artificial Sequence
  Synthesized
  misc_feature (61): n=t or c
tcatgaagttacccaaactcaaagctgcctaccaccatttgaagtacgtgtgcacttaccnagctcactcttttcagaaaacatactgaaacacatggtaacaatggaaaggattagcagc

SEQ ID NO: 27052 - DNA, 121 bp, Artificial Sequence
  Synthesized
  misc_feature (61): n=t or c
gaccaatgtcgcataaacttggagatgtgtaccagtggctgattacccatctaggtcaaanaatacatttttctcccacagtattgtgaacagatgaacgggagtttccagttccttattc

SEQ ID NO: 27053 - DNA, 121 bp, Artificial Sequence
  Synthesized
  misc_feature (61): n=t or c
ttccaacctgagcaattctatgattctatattatgtcaaactggtaaacacctgtgcctcnatttggtaacatctagcttgatttcaaaaatccctgtcctgaaggatttgcaatttaaat

SEQ ID NO: 27054 - DNA, 121 bp, Artificial Sequence
  Synthesized
  misc_feature (61): n=a or g
tgaatgaaatattcgatttgacacaagtctatttcccttgtcttttaagaagctgttcacncgtctttaatatgccctgctttctattctgattttacccggaattctggaaacaattttg

SEQ ID NO: 27055 - DNA, 121 bp, Artificial Sequence
  Synthesized
  misc_feature (61): n=a or g
gcttgctgtaaaaggagtactgataatgttcaagcacaaattcattttcctgagaaactgngtctggacagcccaggaacttgacactcgcattggccatcatcaggtgctccagagaaag

SEQ ID NO: 27056 - DNA, 121 bp, Artificial Sequence
  Synthesized
  misc_feature (61): n=a or g
tgtattataagctaaaaatgcattcaattgtgcctacttacactttcattaaattacacantgttgactgataaaatagtataattgtttagtggtaagaacagcacgttcaattaagggc

SEQ ID NO: 27057 - DNA, 121 bp, Artificial Sequence
  Synthesized
  misc_feature (61): n=t or c
atttcagtcgagaaagaacaagaaagacctgagctggctattcatatgaagaaagaaattngtggaactgcacagctagttggcaagataagcaactccacttgcattccaatgcatgctg

SEQ ID NO: 27058 - DNA, 121 bp, Artificial Sequence
  Synthesized
  misc_feature (61): n=a or g
gagctctctcagaagcattaggtggtactcctggggctgatggcagagaattagcactcanttcagactggaacaggagagaacgtcccatgcaggagttttgtttctcatgtttggtgtc

SEQ ID NO: 27059 - DNA, 121 bp, Artificial Sequence
  Synthesized
  misc_feature (61): n=t or c
cctttttttttttcagctctgagtgcagggaattatctgggatcagatcacttagctgagngttgaaagaggacctgcaaaacatgttacattcctggtgcagaccacaactccagcttcc

SEQ ID NO: 27060 - DNA, 121 bp, Artificial Sequence
  Synthesized
  misc_feature (61): n=a or g
cagtgcaacctctactctctccttgaattgtacatataagaattataacagtgaagtggangtcattaagatggaactacttttctcacttgtttctgtgagacaagccaaaaatatgtta

SEQ ID NO: 27061 - DNA, 121 bp, Artificial Sequence
  Synthesized
  misc_feature (61): n=a or c
ttcttcatactggaatgcaaacactaaaaatctgcattcactgattcaaattcaggaaagnacttgttcagttctattctgcctatgaagcaccttggcagcttctgaaccatggcctcag

SEQ ID NO: 27062 - DNA, 121 bp, Artificial Sequence
  Synthesized
  misc_feature (61): n=c or g
atgtctggaaaagaaaataggaagaaaaatgacacagtacttagttttaaataataacatncattttggatgaacatctgacctgtgcactcagacagccctggtgtctgggcgtcacatt

SEQ ID NO: 27063 - DNA, 121 bp, Artificial Sequence
  Synthesized
  misc_feature (61): n=a or g
gtcacagagaatcctcgacctgaacaaatgacagctctccaagcatttgaacagaatacanacagcaagaacagctctttgcacagcaccctaaaagttaaggtgataaagaagttaagga

SEQ ID NO: 27064 - DNA, 121 bp, Artificial Sequence
  Synthesized
  misc_feature (61): n=a or g
agtgggcaaaagctgatagagtgcactggatgcaggcagaatagtcagaggaaaaccaatngggcatgatttggagagacagtatctttcacacaaccaatagcatttggagaaaatgaac

SEQ ID NO: 27065 - DNA, 121 bp, Artificial Sequence
  Synthesized
  misc_feature (61): n=a or g
atcttatcaaaccatctgtctacacgaggcacctctgagcagaggctcttcttccttttgnaaaggatcaggagacatcctttttccctttctgctgggattgtttggagttcggttgcga

SEQ ID NO: 27066 - DNA, 121 bp, Artificial Sequence
  Synthesized
  misc_feature (61): n=t or g
cctattcatgtttcctcaatttacaagagagtaactgggtcttcactgcagtcctaaattncagttgtatttagttttcaggagccatgtacctaaaacgaagttcttagtcctaaatatt

SEQ ID NO: 27067 - DNA, 121 bp, Artificial Sequence
  Synthesized
  misc_feature (61): n=a or g
tgaagtatgctacaggtcatgcttataatgttaagatttcaggccatggtcaaattatatntgtacttaaaaataatggaagatgtctgctgacaagattttcctacttggagctttaagg

SEQ ID NO: 27068 - DNA, 121 bp, Artificial Sequence
  Synthesized
  misc_feature (61): n=t or c
tgagcccaaggagacataggtgtggctggtggaacacactctggaacatgatgaacatganaggaaccctctcagaaagacagactcctccaacagacactgttggaggatcacagcaggc

SEQ ID NO: 27069 - DNA, 121 bp, Artificial Sequence
  Synthesized
  misc_feature (61): n=t or c
caagcttcctaaatctcactgaaacatacttaatcttgtgtctaggtttaactatgatggnataaaaccatgtgtcagttgcagagaaaaacaagaaaatatatttataaataaggtgcct

SEQ ID NO: 27070 - DNA, 121 bp, Artificial Sequence
  Synthesized
  misc_feature (61): n=t or g
catagttgttgttcctcatgttattttggctggttagacattgatggaggtttctgtgtgngttcctgaacccaatcaagtataagcacactcttttaggaaagacctaaatcagctgcat

SEQ ID NO: 27071 - DNA, 121 bp, Artificial Sequence
  Synthesized
  misc_feature (61): n=a or g
agtgataactgagagcctaacacatggtattcaaaagaggtggctatttaggagatgcctntattgtcctttcgagcactggggcttggatggatctactctgggatgtgactttcttgga

SEQ ID NO: 27072 - DNA, 121 bp, Artificial Sequence
  Synthesized
  misc_feature (61): n=a or g
ttgtgtttcagagagattgcccagagaaaggccccaggtcagaggtaccttctcccaactnctgctaggatatgaggttacaaaatctgattctcttggttattatttttttttccccctc

SEQ ID NO: 27073 - DNA, 121 bp, Artificial Sequence
  Synthesized
  misc_feature (61): n=a or g
gtccgtttgtgcaggatccttatctctctctgtgtaactctctgtgtttaattatatgcantgataattcttcacacgctacgagcgttattaagcaattcctgagataagtagttttctg

SEQ ID NO: 27074 - DNA, 121 bp, Artificial Sequence
  Synthesized
  misc_feature (61): n=a or g
atatttatctctacaaacacatttttgctcagttatgtggtatatatgtacactccctccngactgcgtgtttagagatttttttgataggtttttccagagatgttgaagtcagccctct

SEQ ID NO: 27075 - DNA, 121 bp, Artificial Sequence
  Synthesized
  misc_feature (61): n=a or g
tgccagcaaaacatcatgagcaaagtccttaaagtgaaaagatgaagccacatccaaactnaggtgagggagagagcagagtgagggatgtgagacactgtgtgcagggagtgctgctcag

SEQ ID NO: 27076 - DNA, 121 bp, Artificial Sequence
  Synthesized
  misc_feature (61): n=t or c
tgtttatgttgacgttttctttcattagaccgcaatcgctatgcatgtttacagcactaancctagatgttgaaattctagatagttaaaatatattcagtatcattgaagcctctgcggg

SEQ ID NO: 27077 - DNA, 121 bp, Artificial Sequence
  Synthesized
  misc_feature (61): n=a or t
aatctgtatataacaccacttcttagtgctaaaattaggccttggctgagttgccagcagngctgaatgtggtgaaccaaggaagaataaagcaaagggaaagggatttgcctgctacagg

SEQ ID NO: 27078 - DNA, 121 bp, Artificial Sequence
  Synthesized
  misc_feature (61): n=t or c
agtattcaattgcatcttaaaaggtggcaatgaacataaatgggtaattttttaggtactntggaagagcaacagatctcagattacaatatgttaaaacctaaccttgatatagtaaaga

SEQ ID NO: 27079 - DNA, 121 bp, Artificial Sequence
  Synthesized
  misc_feature (61): n=a or c
gttctgaagagataacgatgtatactttgtatggaacacactggaagaatttaagtaaggntgatgttgggaacttgttgagtagaacatgggtagcagaacagaatgtggggtagaaaat

SEQ ID NO: 27080 - DNA, 121 bp, Artificial Sequence
  Synthesized
  misc_feature (61): n=a or c
aattttataaatcagaagtgagatactgagaaagaagaattaatgaagacacaagggtggntgaagtatgctggaaaggttttgcttctcttggcaagacagtagcctgtactcgatgcta

SEQ ID NO: 27081 - DNA, 121 bp, Artificial Sequence
  Synthesized
  misc_feature (61): n=t or c
gcctcaacaaccacttgttgaaacagccatccaaaacacatgcaggtggtcccttgccatngcatttcaagaactaatggaaataagtcagtgatgcagcaaattaccccctaacaaacca

SEQ ID NO: 27082 - DNA, 121 bp, Artificial Sequence
  Synthesized
  misc_feature (61): n=t or g
ctcatttggaagatttgttccatgaactcttttatttttttttacaagtttcggacattanaattagttactgattaaactctgctgttctacccaaatagacatttgctatttcagtcag

SEQ ID NO: 27083 - DNA, 121 bp, Artificial Sequence
  Synthesized
  misc_feature (61): n=a or t
acagaaaaattaatacaaaaaattaaggtacaaaaagacagtgctaatggtatcaaaaacnactacatgtgtatttgataagataaacactcactgccagaaaatgtttttagaattgcct

SEQ ID NO: 27084 - DNA, 121 bp, Artificial Sequence
  Synthesized
  misc_feature (61): n=t or c
tgcgggtgtgtggtggtcgcccgtgcgctgttgtgttagtctgtgaggccggcgctgtgcngtggtctccgtgcaagggtatcagcgtccatcctttcacctgacgagatggggtgtagat

SEQ ID NO: 27085 - DNA, 121 bp, Artificial Sequence
  Synthesized
  misc_feature (61): n=t or c
agatagaacaccattctacagaataaaagaaggagggaccatggggtagcataaacatganagagtcagcttattttatgtgctgataccaatctagctccaaaagcacaggcaaacctat

SEQ ID NO: 27086 - DNA, 121 bp, Artificial Sequence
  Synthesized
  misc_feature (61): n=a or c
taaattcttgacattgtgaaagaattgttgaatacgtgacctttaggatgctgagtatttnacatatagtagagtacttcttcattaagtgtgatggtagccatgtaattggatcagtact

SEQ ID NO: 27087 - DNA, 121 bp, Artificial Sequence
  Synthesized
  misc_feature (61): n=a or g
ctcagtgccattgattgcagcactcttgagtcctgccattcagccagttattaatggtacnttgtttcagctctgagatttgtttctgaatttatgtaacttttataagataaatctagta

SEQ ID NO: 27088 - DNA, 121 bp, Artificial Sequence
  Synthesized
  misc_feature (61): n=t or c
acgtagcaggcagcgggagctcagcaccaggtcctgctccgatgcactttgtgttccttcngtttgcaggtgggagtccttggtcttggtgctgatgtatgccatctacatcgttatcatg

SEQ ID NO: 27089 - DNA, 121 bp, Artificial Sequence
  Synthesized
  misc_feature (61): n=t or c
aaaatgttttcaatataggcaaaggaaactagtttactctgacgtgcctggaagcatctcngtatcctctgaatgagagctttttcactcttctaatttttcaacttttgttgtctgtagt

SEQ ID NO: 27090 - DNA, 121 bp, Artificial Sequence
  Synthesized
  misc_feature (61): n=t or c
cacttctccttaacttcttgagggtgagcagtttactcagtgtactcttcactaagctccnccagtgagggttcaagacaggaatattagctcaaaaaaatgctgtgcctctttattaaaa

SEQ ID NO: 27091 - DNA, 121 bp, Artificial Sequence
  Synthesized
  misc_feature (61): n=t or c
aaagtgcaccaatgacaaggtgatgccacaccaagtgtcagccccaatacttagaatgctnctacagtttgttactcagagagtaatgcagtatgcctgcaaagtgcaagtaacaatgaga

SEQ ID NO: 27092 - DNA, 121 bp, Artificial Sequence
  Synthesized
  misc_feature (61): n=a or g
tatacagcttttaagaagcctatatcagtataaacaaacagcaacatcttgaattcagccnagatcctaattagatcagaagcaaactcaagttaaggcattaccgacttgtaacaacaca

SEQ ID NO: 27093 - DNA, 121 bp, Artificial Sequence
  Synthesized
  misc_feature (61): n=t or c
gtattccctgagctgggaatctaaacactgaggttaatttgtggctaaccatgcagcatangtgatagcagggcctggcagaaagctcttatttcctcaggcaggagctggtaattattca

SEQ ID NO: 27094 - DNA, 121 bp, Artificial Sequence
  Synthesized
  misc_feature (61): n=t or c
actcttacggtagacgtttagagacaaaaatctgttcaattggacatatgctgtttgctanagccacctgtatcagtgaaatggacttctcatgcaagtctgtgttttcaaacataaaagt

SEQ ID NO: 27095 - DNA, 121 bp, Artificial Sequence
  Synthesized
  misc_feature (61): n=a or g
cagtttcttcagtttctcaagcacacaacacgcaacgttgctcagataatttggaattacngtgggatctagtgacactatccaaactgtgctgccagtcacctctcataaggaggcaaga

SEQ ID NO: 27096 - DNA, 121 bp, Artificial Sequence
  Synthesized
  misc_feature (61): n=t or c
aggaaaaacatcatgtgctattgaaacaacctcaattattatccccaaatttctgagcctncttttaggtaccaaaaaacaagtacaggaataagcactttcaaaaaaggaaggcttaatt

SEQ ID NO: 27097 - DNA, 121 bp, Artificial Sequence
  Synthesized
  misc_feature (61): n=a or g
taggccttaggctatgatgcttgagttttgaaaaacatcctattgaaatgcaagagcacantatggaagaaaccaaaactgagtgccctgagagacacccaaggtcagagatggatggggc

SEQ ID NO: 27098 - DNA, 121 bp, Artificial Sequence
  Synthesized
  misc_feature (61): n=a or g
gcccagctgcatggatggctctgctggggccaatgctctacacaccagcaggctgtctggntctggctgtgccctataaataacccataagagacctcacatatagggcatatgatgctgc

SEQ ID NO: 27099 - DNA, 121 bp, Artificial Sequence
  Synthesized
  misc_feature (61): n=a or g
ccttatcaagaccttatccactgagcggtccactcgtcaaatccatgtttcttctgttaanagactaagatgtaatgtggaacagtgtcaaatgcacaaagatgttgtgtgggtcagtgtc

SEQ ID NO: 27100 - DNA, 121 bp, Artificial Sequence
  Synthesized
  misc_feature (61): n=a or g
cttggaatgatgcaacttgcttatttgcattaaaaagtctaaaattcttttgcatttccantgtcccatggtcaaatccatattcaagcacttttttttcttctgtagtttcatattatta

SEQ ID NO: 27101 - DNA, 121 bp, Artificial Sequence
  Synthesized
  misc_feature (61): n=t or c
caagacggtttcccttacggacacagcagaagggtggaagttgggagcaagccaaagcaangcctgcatctcttccaccaatagatggaatgtgcacgaagtaactgcccccctgcccttg

SEQ ID NO: 27102 - DNA, 121 bp, Artificial Sequence
  Synthesized
  misc_feature (61): n=c or g
cttgtacttccaggtcacataaaggtgcatgtatttggtacctaaacataggtatctcaanataaatctgtcctcacatagtctgagataggcattcatttagagaaagctaacacaaatc

SEQ ID NO: 27103 - DNA, 121 bp, Artificial Sequence
  Synthesized
  misc_feature (61): n=a or g
tatatatcttccaaaatggaatgagtttctctcaactacagaatgagttttcaaatctcangatcataacatttctctaaatcaagtacatttaataaaatgtctgccttttagttataat

SEQ ID NO: 27104 - DNA, 121 bp, Artificial Sequence
  Synthesized
  misc_feature (61): n=t or c
ttctgcacactgcaacaattctgtcagcaaagctgcagcagcaactgatgagcgttcacangggaccactcaaagctctgaggacaaagaataatctgtattggaaatggagaaggaggaa

SEQ ID NO: 27105 - DNA, 121 bp, Artificial Sequence
  Synthesized
  misc_feature (61): n=t or c
aactgtatctatagttgtatttatttacttagctgtatgccacactccaaatcaagtagcnaggtatgataaaaaagacataattaggtatgattccatttaactccatcagtaacagtaa

SEQ ID NO: 27106 - DNA, 121 bp, Artificial Sequence
  Synthesized
  misc_feature (61): n=a or c
acactcagatatgagtttcctcagcatctgaaggctgaaatcatttgaagaaaatgacatngcttaagcaaatacttaagggcatttcaaataatttcagtttttaacaactatttctact

SEQ ID NO: 27107 - DNA, 121 bp, Artificial Sequence
  Synthesized
  misc_feature (61): n=c or g
ttgatgggtagggctgagacattgggattggaactgctcgaagattggcttgcatacatcntcatatcaatcacataaactttcagaaaacaagttaaaacaaatgccttattttacactg

SEQ ID NO: 27108 - DNA, 121 bp, Artificial Sequence
  Synthesized
  misc_feature (61): n=t or g
aactccctacttgtcagcaaacgtccctttgtcaggctgaaaagtttgcatggcacattgngtgggcaccacgggcacagagaccccccagcagcactgcagttctgcagggagcactgtg

SEQ ID NO: 27109 - DNA, 121 bp, Artificial Sequence
  Synthesized
  misc_feature (61): n=t or c
ggtagactgaatatcattcacttttatttggaaataaagtcaactctgcaggaaccaatangaagtaacctcttgtaagggcctgtcacagtgatagcaaagcctatacttaatcagcata

SEQ ID NO: 27110 - DNA, 121 bp, Artificial Sequence
  Synthesized
  misc_feature (61): n=t or g
acagcaccattttggaagcttaccagtaccaggatacttctgggtcttggaccataagacntgcattttggatatgaatgacaagaccttcttttgaggcaaacaaacagaaagacttact

SEQ ID NO: 27111 - DNA, 121 bp, Artificial Sequence
  Synthesized
  misc_feature (61): n=t or c
tcgttctgaaagctatggaggaaaattgtctggtcttactagagagctgttgttttctgcnttagatcctggagatgaaggagaatgggcttgtggtaaacaacgtggcgttgtcaggcaa

SEQ ID NO: 27112 - DNA, 121 bp, Artificial Sequence
  Synthesized
  misc_feature (61): n=a or c
ttgatgatcatgttatgccctttttgtgtgctctgctacgaagcgatataacacagatgtnatttcaaacaacaagcgtaccatgcctcactaagagctggctgctaaatgagaaaccata

SEQ ID NO: 27113 - DNA, 121 bp, Artificial Sequence
  Synthesized
  misc_feature (61): n=a or g
gaccatctactgctgtaggctccgtgttaaccccatgctaaggctttgacttgctgtgtgncttttaactcaagtgggagtgtccactgtttcatctgttgatttaatttgctgatcgact

SEQ ID NO: 27114 - DNA, 121 bp, Artificial Sequence
  Synthesized
  misc_feature (61): n=t or c
ttttgtgctttctggcttggaaacatacagtcatttttagaagttatcacatgaaagattnacagagcttttaggggcaggcatgacacgtcacctactgatgtatgacaaaactcctcag

SEQ ID NO: 27115 - DNA, 121 bp, Artificial Sequence
  Synthesized
  misc_feature (61): n=a or g
gtctgacactaggaagggaagtggttgctgccctagcacctgcaggttaggtagtttgtgngcagatctggagtccaggaggattacttgggttgctaggaattgttggtacatttctctt

SEQ ID NO: 27116 - DNA, 121 bp, Artificial Sequence
  Synthesized
  misc_feature (61): n=a or g
gtataatgctctctttcccccagtaaagggtgctacttgaacccgatgaagaaggttaatnacttgttgccagtttcttcattcttcaggatcagggcttgaagcctagctcaaagatata

SEQ ID NO: 27117 - DNA, 121 bp, Artificial Sequence
  Synthesized
  misc_feature (61): n=a or g
gctctgttaattatgggaggtgagtttgaggattaataactactggtcccacagacacgtngtgcactgcagaaaataaacagggcgccttgttggtagtaactgatgaatagctcaatgg

SEQ ID NO: 27118 - DNA, 121 bp, Artificial Sequence
  Synthesized
  misc_feature (61): n=a or g
aggttactactacgacatataagaatcagtccaaggagggggaggggaaattatttaagangattgtatctgtacactcatagctaatgggtccattacacctctctgacgttcttcccag

SEQ ID NO: 27119 - DNA, 121 bp, Artificial Sequence
  Synthesized
  misc_feature (61): n=a or g
cttgaagttttcaggattcttttttcaaaggaactagtattcttcttaaatgcagttacantggttttcagccaatgtaaatgattctgtcaggaaactaaagaatcatgggcattatata

SEQ ID NO: 27120 - DNA, 121 bp, Artificial Sequence
  Synthesized
  misc_feature (61): n=a or g
ttactttaacagttctcttcttgctttacaaagaatcagtagccaatttacctataatacntacaaaaaatatagtatgcatgtgctcttccgctttcctctttcacccagaaatacaaat

SEQ ID NO: 27121 - DNA, 121 bp, Artificial Sequence
  Synthesized
  misc_feature (61): n=c or g
tacagtacctctaatctaagtaggtagtgcgtgttgcccatgataagtcacagatagcaanataactagcttgctgcattccctgccttgaacttctcctcttttctcaccagtttcttgc

SEQ ID NO: 27122 - DNA, 121 bp, Artificial Sequence
  Synthesized
  misc_feature (61): n=a or g
cgatttagagcagtgctctacagataggctccaaacccatatgagaatattccatgttcanaaattcctgctctaccaccaaaggaagaattttgcgtccttaattttgtcagtcttgcac

SEQ ID NO: 27123 - DNA, 121 bp, Artificial Sequence
  Synthesized
  misc_feature (61): n=t or g
ttcgtgcaccaaaagtattgtattaatgtatacttctgttctttccttctttagttgtttntaatagctgtaaggatgtaagtgacatctgcataaactgttgggaatttattgcccacct

SEQ ID NO: 27124 - DNA, 121 bp, Artificial Sequence
  Synthesized
  misc_feature (61): n=t or c
agtcagggctaattagtgcagtcagagaatgccaggccagctctgatgtgagcacctctgncagacaccatctaggacaagatacctccaaaagagcagtgctaccaagccaacagcaagg

SEQ ID NO: 27125 - DNA, 121 bp, Artificial Sequence
  Synthesized
  misc_feature (61): n=t or g
cttgttcaaatttcagtctctgttttcctttttttccccacttggatgcacagatgtacantccatcattaataagcaactaaggaaagtgaggtgagaaaaatacagctcatgacttttg

SEQ ID NO: 27126 - DNA, 121 bp, Artificial Sequence
  Synthesized
  misc_feature (61): n=t or c
aacaccactcttcagatggtatgagaccaagaggctgaactctgtgaaggccggtaatgcncaaaactgagaaaaagacattgacttacaatctgtgccaaacactgagagttacccttct

SEQ ID NO: 27127 - DNA, 121 bp, Artificial Sequence
  Synthesized
  misc_feature (61): n=a or g
gtctgtgatcatctggagtgtgctgtgtccagacacccctcatagcatggcacaaatatcntaggacaggaatcacccttatggcatgggacacggtggtggtgctttgttctaggggctc

SEQ ID NO: 27128 - DNA, 121 bp, Artificial Sequence
  Synthesized
  misc_feature (61): n=a or t
gctcttactgacaggaaaagagatatctctgcacttatacagtacgctttatggatatatngataggccctctgtgttgttggttcagcctctgcagccaccacacagcctccttcttaaa

SEQ ID NO: 27129 - DNA, 121 bp, Artificial Sequence
  Synthesized
  misc_feature (61): n=t or g
gacctgaagcacttgaaataactgtcttaagcatctcacgcagagtttggattctctagcngaactatctgggcactgaagtattaatgttatagctcataagatacaaatgtgggggggg

SEQ ID NO: 27130 - DNA, 121 bp, Artificial Sequence
  Synthesized
  misc_feature (61): n=t or g
taaaccaatttctattagttcagacagttaagtagatatatacccagctttgtgggaggtnagaatggcatctgaatggctttttgtatcgttgctggctcgggctgtacctgcacaagca

SEQ ID NO: 27131 - DNA, 121 bp, Artificial Sequence
  Synthesized
  misc_feature (61): n=a or g
gcaaccacgtattaatttcatgcacaaaaataactgcatcagaaaaacagcatcaaatgcnacaaagatttataacagcaagttacactcttagagctctgacaatgtactttctgttctg

SEQ ID NO: 27132 - DNA, 121 bp, Artificial Sequence
  Synthesized
  misc_feature (61): n=a or g
atcccatttttacattagttgctatggcaccagcaaagttcctggctgaccttggtagatnagagcagcgtaccagactgcccatcatgcttggcaatattgtcctggctttccacaagct

SEQ ID NO: 27133 - DNA, 121 bp, Artificial Sequence
  Synthesized
  misc_feature (61): n=a or g
cctccctgggcagcccatgccaacgcatcaccactggaacttaagcgtactgaacagaccncaaactctatcctaaaaactgtcatttgtgtcaacggcattatagatccactccacctcc

SEQ ID NO: 27134 - DNA, 121 bp, Artificial Sequence
  Synthesized
  misc_feature (61): n=a or g
ttcacataaaatatgccaaaacctatatcctgtgtccccagaatacacataagttatcacnagacaaatttatcctcgttttttatctcctcttgctttcctcaatccacagatttgcata

SEQ ID NO: 27135 - DNA, 121 bp, Artificial Sequence
  Synthesized
  misc_feature (61): n=a or g
ctcgatattccaacggggcaccaaagccataagatgctgttttcaactgaacagaggagcncatgatgctaacaaatgcctcatcacactgctccgctagcagatgaggatgaacaaatac

SEQ ID NO: 27136 - DNA, 121 bp, Artificial Sequence
  Synthesized
  misc_feature (61): n=a or g
ctgcaatcacttagagtattgtagcatgctgttttatgatctccttttggttaatcctagncttaatagtcaattattgagtcttcaaagctctatttgcaatcaagcatgtttttgtgcc

SEQ ID NO: 27137 - DNA, 121 bp, Artificial Sequence
  Synthesized
  misc_feature (61): n=t or c
tgtttttattccaagatgcagttgtgcagtggacatcaattttccgcttgtgtcagatttnatttcgtgcttcaccttacttttaaattatcattttgcatttaaatacagctggaacatc

SEQ ID NO: 27138 - DNA, 121 bp, Artificial Sequence
  Synthesized
  misc_feature (61): n=c or g
gccagttgtggttaatggagatccacagaacttggatcatgttctaaatcagctgtatggncaactatcaaagtaacagcttttttcttcgtttcctaactatagtctctaaaggtgaaac

SEQ ID NO: 27139 - DNA, 121 bp, Artificial Sequence
  Synthesized
  misc_feature (61): n=a or c
ctgccaaggaaattatttgccttccctaggaaaatgcttcattatgttatgaagtacattngctgttggctatgttcctattggcgaataatggcagtattactttgttatgtgtatttta

SEQ ID NO: 27140 - DNA, 121 bp, Artificial Sequence
  Synthesized
  misc_feature (61): n=t or c
atattttgagttgaagtcaaatgtgtatgtttgccccttcttattttcagcaatgtttcanggctgtgagaaaaaagaaaactggatgtttttctaaattgagtgttgtattcaaaatgaa

SEQ ID NO: 27141 - DNA, 121 bp, Artificial Sequence
  Synthesized
  misc_feature (61): n=t or c
cactctcctgcagttctaggcatgaccacaaagttgggccatgagaggctctgcctggaancagagacttgagcaggcatgtcaggatgagctcccaccactgtcctgcatacagcttgct

SEQ ID NO: 27142 - DNA, 121 bp, Artificial Sequence
  Synthesized
  misc_feature (61): n=a or c
cagggtattcttttgaaagcatcagctgtttctgccaaataacaaacaagtgtgatgagcngtgctaaagctagaccttgatacaacataaagaccctcccttgagaaaaggagaatagat

SEQ ID NO: 27143 - DNA, 121 bp, Artificial Sequence
  Synthesized
  misc_feature (61): n=a or c
tctgtagggaggaactgtacaggagaacagcgccagggcatggagttgagttggacgatgngtgtcagcccttcagctgctgtgcaaggctctctgtgcttttcttcagaagggcagatgt

SEQ ID NO: 27144 - DNA, 121 bp, Artificial Sequence
  Synthesized
  misc_feature (61): n=c or g
tcttagaatttattaagcaatccccttaacaattttataaccgcacagtactatagacatnctgtaggaagcccaaacataagacaccgtcaaaacattctttaaaagtgtcatttttcat

SEQ ID NO: 27145 - DNA, 121 bp, Artificial Sequence
  Synthesized
  misc_feature (61): n=t or c
ggaaggagggaaagaaagaaagaagggagagaaaaggtgtttggattgataaacccgaccncgaggcttggctaaaaacaaaataacaaacgaaatgagttgttctttttatttacctaat

SEQ ID NO: 27146 - DNA, 121 bp, Artificial Sequence
  Synthesized
  misc_feature (61): n=a or g
tccgacagctgtacaaaccatgcattgcagcaaagtgcttaaagggtttcttcctgaagcncacaagccaaggaaccatgatgtgcaggtgagtaagctgcaggccactccatgttaatgc

SEQ ID NO: 27147 - DNA, 121 bp, Artificial Sequence
  Synthesized
  misc_feature (61): n=a or c
tcttgcaactagtatttcttaatgcagatggtgtagcctagtgatggctcttcttgtgtgnaaaaggatgattaataaacctggatctgtaggatgctaggaaaattttcagatacactgt

SEQ ID NO: 27148 - DNA, 121 bp, Artificial Sequence
  Synthesized
  misc_feature (61): n=t or c
aggcagtttgtcttcctgtatcgttgctaattaaataacgatctcatttgaaaatgttggnagagattttcagtcttacaagactcctggactcagatgtattggtattggttctattcat

SEQ ID NO: 27149 - DNA, 121 bp, Artificial Sequence
  Synthesized
  misc_feature (61): n=c or g
cacccccctatcagctatttgcactttttggataatcaggagaaatcttcttctctcccanagccctttaatcctgcaccgttcttcatcctggcactgctccacctccccatccaggctg

SEQ ID NO: 27150 - DNA, 121 bp, Artificial Sequence
  Synthesized
  misc_feature (61): n=t or c
catcagatcttttaattattgaatttttgcattgttgagagtaatttctatgttagtctcnagtgattctgcagcctcgggatctgctgaacccttgaattagtctgaagaaatagaatca

SEQ ID NO: 27151 - DNA, 121 bp, Artificial Sequence
  Synthesized
  misc_feature (61): n=t or g
tatctacattctggcatgaggactcacactgcatttaacaaaacgcagttagaatttcttngaaatatttttcaaaacctggaagtcatttgaactatgataaatgtataaatctaaatta

SEQ ID NO: 27152 - DNA, 121 bp, Artificial Sequence
  Synthesized
  misc_feature (61): n=c or g
tggaatcgcttttatgcactgtttccttacagaagagacttaggccattttcttgtcttgnttttcctagctgcagtgctgggtagcagggagaagaggacgtgggtaacagcacaaaaag

SEQ ID NO: 27153 - DNA, 121 bp, Artificial Sequence
  Synthesized
  misc_feature (61): n=a or g
ctaattagagcaactctgaaaaactcagtgggaagagcagaagggaagaagagcatggttngctcatgaaacttaacagccaagctgaaatgcaaggagtcccagatggagcattgtttcc

SEQ ID NO: 27154 - DNA, 121 bp, Artificial Sequence
  Synthesized
  misc_feature (61): n=t or c
gtcactgggaatgacggcactatttcttccaactacattattaaattgtattggcttcagnagtcaattcaacagggccaaaattatcactaattatttcaattggtgttttcatctagca

SEQ ID NO: 27155 - DNA, 121 bp, Artificial Sequence
  Synthesized
  misc_feature (61): n=t or c
cagcatattgattgcttgccacaacttgatctcaactgtttagtcatgtgctgatggcagncccacatcattaaattcccagcatatctttcctgaagagcttgtaatccgtctacgtcag

SEQ ID NO: 27156 - DNA, 121 bp, Artificial Sequence
  Synthesized
  misc_feature (61): n=t or c
cttctctatttgttgttatatttatccagaaaggcttgaagtcttaaaagatgaggtaaangctaaagtgtttttaaactttttgttccaaaatcttctgatacttctgctttgtgatatc

SEQ ID NO: 27157 - DNA, 121 bp, Artificial Sequence
  Synthesized
  misc_feature (61): n=t or c
caaaatccccacctggcatctactgtccgtgccagcagcaagcctaccgtcagcaagcagnggggagctgcagggtgcaggctttgtagcccaatgtattcccagaaggtggcagtccaga

SEQ ID NO: 27158 - DNA, 121 bp, Artificial Sequence
  Synthesized
  misc_feature (61): n=a or g
agaatgagtacttgctctgcaacttaatctatgccatatagagagatcttaaaagtgtggntctgacttcattaaacaggcatatagaaagatgcctaggacaaagaatagaccatttgaa

SEQ ID NO: 27159 - DNA, 121 bp, Artificial Sequence
  Synthesized
  misc_feature (61): n=t or c
ataaatttcaaatctgaacattctgtctctcccctgatttgaacaacaacaaggcaaaggnggtacaaatgtcctgcctgcattcaatcaacactttctttgctgttttttatttctttca

SEQ ID NO: 27160 - DNA, 121 bp, Artificial Sequence
  Synthesized
  misc_feature (61): n=t or c
ttcttcttcactggggataacagcaccgatcatacaacagtggttaatctgataactgttngtctctggattgttactgggcatatatacactacacaccaaatatatctttgcaatagca

SEQ ID NO: 27161 - DNA, 121 bp, Artificial Sequence
  Synthesized
  misc_feature (61): n=t or c
aaagtgttcagagggccgaggaggagggtgatttcatagcccatcccaacagggatgtccntgtcccatccccagaacagcttcagctgctaccaagcaccagaatacagaacacccccat

SEQ ID NO: 27162 - DNA, 121 bp, Artificial Sequence
  Synthesized
  misc_feature (61): n=t or c
gtgccttattctgattttagggttttttttggtgaaagggctctcccataaggctgttacngtgacagatcgctgctcagcggcgtgagtgtgatgtgggctgtggaagaaaggaggcatt

SEQ ID NO: 27163 - DNA, 121 bp, Artificial Sequence
  Synthesized
  misc_feature (61): n=t or c
tatctctctgggacgccagaacggtaagcaatcttcttcctggtctttctggaattcaagnaaaacgatgacatggataataggagaaaaatgaaagccagttcaaaatcaaaagaggagg

SEQ ID NO: 27164 - DNA, 121 bp, Artificial Sequence
  Synthesized
  misc_feature (61): n=t or g
tttgttgccactgcgctgtaagggtggttatgtagtcgtatttgcaagttaaatgtgtctnctaccagcacatgttgtttcctgaagaaaatattccatatcagctaaatgcataatttaa

SEQ ID NO: 27165 - DNA, 121 bp, Artificial Sequence
  Synthesized
  misc_feature (61): n=a or g
ttgcagacctgattcttcactctgtggttagctaaaggtttatatagctctataaacattntattatacaattacactctcaaaccaggtgctcagatgctcggaatgtttgagcaagtgc

SEQ ID NO: 27166 - DNA, 121 bp, Artificial Sequence
  Synthesized
  misc_feature (61): n=a or g
agtgccatgaagacaacatccttcccacaggccaaggaggcagaacctccacgtgacagcntcaccatgactttgtacaattccgaatgcagctgatgagatcataagctgtgtgtcattg

SEQ ID NO: 27167 - DNA, 121 bp, Artificial Sequence
  Synthesized
  misc_feature (61): n=t or c
tgctctgctagtgaaaaactagaggctttcagtgcagtgtgttttgtaaatggggcattangactaaattcaattataaaacatcacacaaaaaggcattttagaattttctatgggagca

SEQ ID NO: 27168 - DNA, 121 bp, Artificial Sequence
  Synthesized
  misc_feature (61): n=a or c
tcttcctagcagggcactgcagagccagtggacatgctgacatgcagtgccattatttttnactagcaaaaaggttcttcagaatgccaagcatgatgccagaatacaaaacacttaattt

SEQ ID NO: 27169 - DNA, 121 bp, Artificial Sequence
  Synthesized
  misc_feature (61): n=a or g
ggtcctggagcagcagcacccgcagactgccgtaaacaggcccccaggaacaggggcatancattcccagcacacctctccactaaaccacatgagtaactccagcttgctgcaaatagag

SEQ ID NO: 27170 - DNA, 121 bp, Artificial Sequence
  Synthesized
  misc_feature (61): n=a or g
tactgttttgtttactctgctggaataaatgctcggcccatggcttgtgctcacctgcacntggccctgtgtgacctgaccaaaagggctggtgcttatgaagagagcagcaccttctctc

SEQ ID NO: 27171 - DNA, 121 bp, Artificial Sequence
  Synthesized
  misc_feature (61): n=a or c
ttgtttgatacatgtcattgttataagatgcttttaatgaggcatattctgcttgtttagnctatgtggaaaagctaacgcataatttccttttcatgtttcacttggttttctgttttgt

SEQ ID NO: 27172 - DNA, 121 bp, Artificial Sequence
  Synthesized
  misc_feature (61): n=t or c
cgagctgctttgagttaagcttctcaacacacctgctgggaggaaaacactaaaaagcacngcagagatggcttcaaatgacttatttcaactgggcattcgtttgagatacggcaaacaa

SEQ ID NO: 27173 - DNA, 121 bp, Artificial Sequence
  Synthesized
  misc_feature (61): n=a or t
aatattctttagatgatgctggtttgaaaaatggttaaaaagtgagaatatacaaactganatatcaaactcatttacagaagttctacatgggtgttgttattaatctaacattagggta

SEQ ID NO: 27174 - DNA, 121 bp, Artificial Sequence
  Synthesized
  misc_feature (61): n=t or c
tgacatagatttaaaactgtctcgtatgtccaacatttgggtgatgggtaaaaattgtgtnttctcatctaagttctgcttagaaaccgaacgcttctctaagctccaacatgtcaaccat

SEQ ID NO: 27175 - DNA, 121 bp, Artificial Sequence
  Synthesized
  misc_feature (61): n=t or c
tctaaggtccaagtgacagataccagaacatcagttatcacttcatattcttagagaggcnttacagcagattttgaaatgcaaaggaaagcctattgcatgtgaccacacgcagtctgtg

SEQ ID NO: 27176 - DNA, 121 bp, Artificial Sequence
  Synthesized
  misc_feature (61): n=t or c
aaacgttatgtttatgtatcaaaatgtatctaagaaatgccagagaagttttggaactaantgtttttctctctttatgtgccaccatgattcaaactaaacttaagaatttaaagaacaa

SEQ ID NO: 27177 - DNA, 121 bp, Artificial Sequence
  Synthesized
  misc_feature (61): n=t or c
tagataattactgagttgagacatgaaatatcactatgtcagtagttaagtgaactaacantgactttgatatacaggtatgaggaccagactcttaactagcataataaataggaaatct

SEQ ID NO: 27178 - DNA, 121 bp, Artificial Sequence
  Synthesized
  misc_feature (61): n=t or c
ttctaaaaaagcagttaaacagaagtacaagtatgtctcaatcaaattgattgacgaagtnttgaaaagtaattgaattttctccactgtagaaaaatgttcaaatttgaggttgtcattc

SEQ ID NO: 27179 - DNA, 121 bp, Artificial Sequence
  Synthesized
  misc_feature (61): n=a or g
acccagacagaccaacccttgcaaggcttccctctgcagcttcttagcaaggctgtgaccnaagggaagtacggcccacttggtctgtcctccctgctggtaacttgccaggagagtacca

SEQ ID NO: 27180 - DNA, 121 bp, Artificial Sequence
  Synthesized
  misc_feature (61): n=t or c
aaatagactaacttcgccctgctgggacgaagcagatctctccaagaactgcaggctaagngtgaccacagttgtgctggcccagcaatgagaaggcactttgttccctcagtccttctgc

SEQ ID NO: 27181 - DNA, 121 bp, Artificial Sequence
  Synthesized
  misc_feature (61): n=t or g
aatagactgcttacagtgtccttaaaagtaggtgtgccatggcacactctgttgttagaancttgacttcacaaaatttctgttcaatgacaagtgtgttcttgagtcttctcaattgtcc

SEQ ID NO: 27182 - DNA, 121 bp, Artificial Sequence
  Synthesized
  misc_feature (61): n=a or c
aagctgccaatgtctgagaaatctatactcctttcacctatgaatttatggagtctatatnatttacagtaatcaagagctctgaagctattagtatagcatattatctgttttttttaac

SEQ ID NO: 27183 - DNA, 121 bp, Artificial Sequence
  Synthesized
  misc_feature (61): n=t or c
gcaagtaatctaaactacaagacgaccctcccagtagttgtcaagatcagcaccaaggtcntgtcaatcagcacgtgacttgtgactgttttctaagcagcaacagactaagtaaacccta

SEQ ID NO: 27184 - DNA, 121 bp, Artificial Sequence
  Synthesized
  misc_feature (61): n=a or g
tactctttatgagctaacttaatctattttgagaagtctaaactgttctagaagtcaggantctcccaacagtgcagtgagttgtggtctcacatattgtagttgcagacagagtttagga

SEQ ID NO: 27185 - DNA, 121 bp, Artificial Sequence
  Synthesized
  misc_feature (61): n=t or c
aaaactagtaacctattgaccatgtaaacaaaacctctcattaacgttaattcataatagngcaatctggatgttcagctaaatcgcattgacaatttgtatcattatgatataggtgcat

SEQ ID NO: 27186 - DNA, 121 bp, Artificial Sequence
  Synthesized
  misc_feature (61): n=a or g
taaaaaccagcattttaattgcactgcaaacatctttcataagcagtcaccgcattcaccnacttatttcctttttaaatgagggcgttcgttccaagcaggcagagcaccctctgcccag

SEQ ID NO: 27187 - DNA, 121 bp, Artificial Sequence
  Synthesized
  misc_feature (61): n=t or c
aatattttatcaaataagaggctgctgtcatttctatgaaattcttatttttcatgctagntttaggaaactaaggcagaagacagacatacatagcagccaagtagtttctctaagagca

SEQ ID NO: 27188 - DNA, 121 bp, Artificial Sequence
  Synthesized
  misc_feature (61): n=c or g
ccccccctccaaacctcaacaaagcagggaaatacatgcacagtaaagagaacatctgctntgttggaatgtaccaaggcaaatcatgccctgcacctctgcgtggagagctcaggggctg

SEQ ID NO: 27189 - DNA, 121 bp, Artificial Sequence
  Synthesized
  misc_feature (61): n=a or c
aaccccttgctttgtgaggatgggatgaagcaaaccatggaaggcgttttgccactctgcnctgagaagcctctgagccccacatttctacatctcaaatgccaacagcagcaaaccctca

SEQ ID NO: 27190 - DNA, 121 bp, Artificial Sequence
  Synthesized
  misc_feature (61): n=a or t
ttttgaaaataaatgggtaactgcaataatattatcgtgaaaaactaggactcttacaacngtttcatatgtttatattcatgaggaaagatgacagcacatgtacttgatcatcttcctc

SEQ ID NO: 27191 - DNA, 121 bp, Artificial Sequence
  Synthesized
  misc_feature (61): n=a or c
atgttagttttgtggactttgtttgcagtgaaagaggagcactagtcacctccagagggtnattcatctaacccatcaatgatattgagaatgaatgaatttgtcccagaaggtgaatgac

SEQ ID NO: 27192 - DNA, 121 bp, Artificial Sequence
  Synthesized
  misc_feature (61): n=t or c
aaattcttgtgagctccagtaacaagatttcttcttgtgctgcacagggaaccagccatantccaattcataatattgtatcagaattaatgaaataagttgagagataatttcatatctc

SEQ ID NO: 27193 - DNA, 121 bp, Artificial Sequence
  Synthesized
  misc_feature (61): n=a or c
caatggagaaggcaggaagtgggctgatggggacctgctgggggtctttaggtgaataccngaaatgacatgatttaaacaagcagcttcaatcctagctgcagaattattaggcagatta

SEQ ID NO: 27194 - DNA, 121 bp, Artificial Sequence
  Synthesized
  misc_feature (61): n=a or g
tcccaattcctgcagcaccacctgggacaacctcagctccctttggtgcagaacacagacncacacccgaaggaacaagataacagcactgatgtcccgccagccactgccaaaccccagc

SEQ ID NO: 27195 - DNA, 121 bp, Artificial Sequence
  Synthesized
  misc_feature (61): n=t or c
aagttcagttctgcagatcacagcactcgtctactaaatttgagaaacatatttaaacacnttccaaacttaaatgtgtcaaaagagatgctttcgaacacaaaaagaggtctgaggatac

SEQ ID NO: 27196 - DNA, 121 bp, Artificial Sequence
  Synthesized
  misc_feature (61): n=t or g
tggaataagaagcattggcacttggggaacaggatggagaaacgaagtgtggagaaggaanaacaaagaccctgcagccccctccacatagctcttgggcctcaattagcagtgtgcagac

SEQ ID NO: 27197 - DNA, 121 bp, Artificial Sequence
  Synthesized
  misc_feature (61): n=a or g
gctgccagcatgaatgcacagagatgtggcagacagcatggcggaggtcctgtagtatctncatcatgggctgcggcttttgtgctagtcctgcagttctgtccctgctgccactcccacc

SEQ ID NO: 27198 - DNA, 121 bp, Artificial Sequence
  Synthesized
  misc_feature (61): n=a or g
aaaccctcatccagatttcagtgcttctgcaccaccagagagtaaccaggatgagtggccnggaggaatgcagccattggtggcagcgtggcgatgcccagcatctgcagagcagtgtttg

SEQ ID NO: 27199 - DNA, 121 bp, Artificial Sequence
  Synthesized
  misc_feature (61): n=t or c
taaatgtttgaatctactctactgcttctcataagtgttagttaactgtgacttactacanttgttgtccagccttttaagcagcaacttgtaaatgtagcatttcatgcttttattttag

SEQ ID NO: 27200 - DNA, 121 bp, Artificial Sequence
  Synthesized
  misc_feature (61): n=t or c
accccctgcacttttttttccccctaaagaattggatattggatacaatttagtgttttcngtaagtaactaaaataaactatagtctaaataatactggattacagaaccacaagccatg

SEQ ID NO: 27201 - DNA, 121 bp, Artificial Sequence
  Synthesized
  misc_feature (61): n=t or c
agcaaaactgtaattttgccatgtgaaaggaagatcagaacctcatgagcagatatggtcngatactgaataataacacattacacaaggcttctttgctgatatggtatctaaaggattt

SEQ ID NO: 27202 - DNA, 121 bp, Artificial Sequence
  Synthesized
  misc_feature (61): n=t or c
ggtattggaaaacattttcaatggaaatttgattacacccacattccttggtaaacgcctncttacttacaacacacaaatttctttaataggttatgtctgcaagaactgaagcttaaca

SEQ ID NO: 27203 - DNA, 121 bp, Artificial Sequence
  Synthesized
  misc_feature (61): n=c or g
ccttttcaacccaggccgttctatgattctgtgatttctgacattgaggaaaatgtgccanttttcatttcggtgagtacaaattggttcctaatttaagattttgcttttgtttgttgat

SEQ ID NO: 27204 - DNA, 121 bp, Artificial Sequence
  Synthesized
  misc_feature (61): n=a or g
gggagaacatactgaaacctgtatagctgcttaaatcaaggagattcagttagttcaaacntttcacttggtgttgtattaatagggaagaatatgtatgtaatgtactgaaagcagtaag

SEQ ID NO: 27205 - DNA, 121 bp, Artificial Sequence
  Synthesized
  misc_feature (61): n=a or g
aaatgtgtaataattagtgctctggcccgagtgcttcaggctctggactgttttatgacancgagatctgttcttagcaatcaacccagtccactggtactcacttaacatctttattatt

SEQ ID NO: 27206 - DNA, 121 bp, Artificial Sequence
  Synthesized
  misc_feature (61): n=t or c
acatcttctgaccttttcctctgtgtttcccaggtgctgtcaagcacacgaccagtgctanagcaaggcaaagttggtttgtgctgcctccaatgacaccccctacacgaagacatacaag

SEQ ID NO: 27207 - DNA, 121 bp, Artificial Sequence
  Synthesized
  misc_feature (61): n=a or c
gctcctgtaacccaaagctgacctgcagtcgtgcgcccttcccattgaagcagtccctatnagccccagcaaagccaggacagcaccaccttctcccttccttatcttcagagctgagaga

SEQ ID NO: 27208 - DNA, 121 bp, Artificial Sequence
  Synthesized
  misc_feature (61): n=t or c
aaacaccagtacagtatgcaaatacgctcagagttaagtataggcatgcccatatagtacnagcctgtattgggccagcagactaagaataaaaaactatcgtcctggaaaaaagatagaa

SEQ ID NO: 27209 - DNA, 121 bp, Artificial Sequence
  Synthesized
  misc_feature (61): n=a or g
ttctacctcttcaaagataactgtgagggttgaaactactttagtttttggcagaactacncactcatccaatgactgtgcaataaagtcctcattgtgatacatggcaaaagaatatgct

SEQ ID NO: 27210 - DNA, 121 bp, Artificial Sequence
  Synthesized
  misc_feature (61): n=t or c
ttatttgagatacttaagtgggctcaaatccaggaataacatacccaaagtaatttaactnagtgaggttaggaaagggagtttctacctgtaggaaacctatccaatcgaaaattatgct

SEQ ID NO: 27211 - DNA, 121 bp, Artificial Sequence
  Synthesized
  misc_feature (61): n=t or c
ttcccagtcatgttctaatggcctctggtcagcagcctagggaagtacaaaggagatgccnacatcactacttgaagtatttgtctgaacatcagtactttgacagccactggtgataaca

SEQ ID NO: 27212 - DNA, 121 bp, Artificial Sequence
  Synthesized
  misc_feature (61): n=a or g
cttaggcaggagcctcagctcaaaggaaaggggaggaagccccactataaggagctgcacngaacagagctcctcagggaaggagaacctccttatggggcaaggggaggtttaattggac

SEQ ID NO: 27213 - DNA, 121 bp, Artificial Sequence
  Synthesized
  misc_feature (61): n=t or c
ggcccgttgctttgctttcatcattaatcaaaagcagttcgggaacaacagtctagaagtngaagatctagtcttcaagcactgtgcctttgcatgtagagtaacagttagtgagagaggt

SEQ ID NO: 27214 - DNA, 121 bp, Artificial Sequence
  Synthesized
  misc_feature (61): n=a or t
cttgagattttgtgtagtttgaatatttaatgtaacaatagtttgctccctaataaagaanggaaagaaatttgggagactaggacataaatttgcctatttattcttgtgcgccgactac

SEQ ID NO: 27215 - DNA, 121 bp, Artificial Sequence
  Synthesized
  misc_feature (61): n=a or g
gaatgggccttcctcagactccttacccatgtgccccaagaacaaatgacagcctgtccancactgctggcttggtgtggactgcaacccctgttaaattctaatacaaaaacatcctcat

SEQ ID NO: 27216 - DNA, 121 bp, Artificial Sequence
  Synthesized
  misc_feature (61): n=t or c
tgcttttctgttgttgccagcggaacaaaaattgtatcagatattaaatcactgtggaaanacctttgaaatgttggttgaggtcatgcagctctaaacatcaccttgcctttttctcttg

SEQ ID NO: 27217 - DNA, 121 bp, Artificial Sequence
  Synthesized
  misc_feature (61): n=t or c
ctctgttagtaaaaagctaatttgcaaatagtcagaggaaagaccatgaccataataactngctatggttctacaatatgacactcttatttcaaccgtaccacagtacactaaggcaatg

SEQ ID NO: 27218 - DNA, 121 bp, Artificial Sequence
  Synthesized
  misc_feature (61): n=a or g
tattaagtcctagatcctctctgttgtaccttctcacatgagttaatcacattctcaatanggctagccacctgtccttctgttgaggcttaagattatgaccagaaatcagtgtaaacag

SEQ ID NO: 27219 - DNA, 121 bp, Artificial Sequence
  Synthesized
  misc_feature (61): n=t or c
ggaagaaattaagaattttagaaacacagaagagaacatgaagatgaataacatccagcanacatctgtcaagaacatatctaattcaatttccttctaagaaagaagccttatgaaaaac

SEQ ID NO: 27220 - DNA, 121 bp, Artificial Sequence
  Synthesized
  misc_feature (61): n=t or g
gaataactcacattaggacctctgaaatgccaggtagaagtgcaagaagagcaaccctatngcagcctgacttccaagatgcaccctacatggctggggaggggggcgtcttctgcaggga

SEQ ID NO: 27221 - DNA, 121 bp, Artificial Sequence
  Synthesized
  misc_feature (61): n=t or c
gcaccactccaaatgacactggcacatctgttctacacaagcatgaagaaattgacatttnaactcatcaaatgtcagtgatatacagctgaagagatgctgcaataatcacagaatggct

SEQ ID NO: 27222 - DNA, 121 bp, Artificial Sequence
  Synthesized
  misc_feature (61): n=a or t
gaagcctctgcagagaataaggttattgctgcctccttatcagatcccaaagctgcgtcangatggatgcgactttaacagcatcagaattcttaggtctttcgtgccacgtcctgtgttg

SEQ ID NO: 27223 - DNA, 121 bp, Artificial Sequence
  Synthesized
  misc_feature (61): n=a or g
gggaacaaagggaagataatgtaatttggaggactaagtgggagagccccgttcaggtggnattaggtcatcctggatgatgcacaacagcacgcaggtgccaaaggtggccctcaggctg

SEQ ID NO: 27224 - DNA, 121 bp, Artificial Sequence
  Synthesized
  misc_feature (61): n=a or g
caaatcttggagaagactctcactcaccagaatcaactgatgagagcaaatctgtaagacntattagggttggtccaacagaagtccagaggtttgagcagattgtatatgaagggcctgg

SEQ ID NO: 27225 - DNA, 121 bp, Artificial Sequence
  Synthesized
  misc_feature (61): n=t or c
cctatattttattaaaattttggtatgcttaaggactgtaaataattgcatatggttaccnttgcttctgtttgtacctaagcgcagtagtagtgccatctaatgttctaattaatctaca

SEQ ID NO: 27226 - DNA, 121 bp, Artificial Sequence
  Synthesized
  misc_feature (61): n=t or g
agctaaatttcagtctcagtacaattttgattcttctccagtttgtaaagccatgcccatnactacagtcataaatgctcttaacttttgggagaagtggctgcctccagagctacttatt

SEQ ID NO: 27227 - DNA, 121 bp, Artificial Sequence
  Synthesized
  misc_feature (61): n=a or g
tgaatctggtgtctaccgagcacttggacagcagctccaagctccaagcagctccaagcanttcagggaagatcaccaccaaggggccgtggttgtgcaagtcccttccaacgcaaccatg

SEQ ID NO: 27228 - DNA, 121 bp, Artificial Sequence
  Synthesized
  misc_feature (61): n=a or g
gtttctactacaaaccatgtagataggcagaaaacatcaagcacacaacagctcaagtgtnctaccctatgagaagttagcccatttcatgcatctccttgcagcctttttcatgcgcttg

SEQ ID NO: 27229 - DNA, 121 bp, Artificial Sequence
  Synthesized
  misc_feature (61): n=a or g
tcagcactgtttgctatagcagtagttaagttctctacgtgaacacgttgccatggagccntgtcccagaatcccagtcttgccctttgcagttaagtctctcttcaactccgtgttgtgc

SEQ ID NO: 27230 - DNA, 121 bp, Artificial Sequence
  Synthesized
  misc_feature (61): n=a or g
cttccaacatctatgaagaacccctgataacttcgctgttgttttactacctattcatttngtttccattggtttcaaatttgcttggctggttctttcttactactctttttcccttttg

SEQ ID NO: 27231 - DNA, 121 bp, Artificial Sequence
  Synthesized
  misc_feature (61): n=t or c
cacaggtttgcaggcagagcagcaagcagatgcttgagaagtaagtagcatggaataaacntcacccggagtgctttggctggcagagataaactcaagggagagatactgcaggagcatt

SEQ ID NO: 27232 - DNA, 121 bp, Artificial Sequence
  Synthesized
  misc_feature (61): n=a or g
tcatggatcaggtaggtcccatggtgacctgaagatgttaggagggtagagggacagcatngtccaaccattacacaggaagaaagtgagatggcagtaatctgtatgcaatgcacaatgt

SEQ ID NO: 27233 - DNA, 121 bp, Artificial Sequence
  Synthesized
  misc_feature (61): n=a or g
tagcgtcacgtctggctctgttgttaaagggggagaaggatcaggctgatggtgcgcctcngccccatctcatccgtaaattgtaggaaacaaaaagaatctccatcagagcagcgcttgg

SEQ ID NO: 27234 - DNA, 121 bp, Artificial Sequence
  Synthesized
  misc_feature (61): n=t or c
agttgtgtatggtgctcctgttcatcacccagtgatttctgtcttgggtgaaagccacagntttctgtgtcctgactcaccagattactactggggtacgtgagacacaggtttttgttat

SEQ ID NO: 27235 - DNA, 121 bp, Artificial Sequence
  Synthesized
  misc_feature (61): n=t or c
aaagatgttctttttatgttaatctgacaatactgaatcagtctttcagcatgataatttngttttgactgtcctatttccccatatcttgaacaggaacgggaaatacgcttgcctttgt

SEQ ID NO: 27236 - DNA, 121 bp, Artificial Sequence
  Synthesized
  misc_feature (61): n=a or c
ttacaaagggcagatttagttgtgattaagatggtatgttagcacaaatccaatagcaagnattccactgaagtctatggggctttaacatacttaaaacaaggcatctgctatgaatctc

SEQ ID NO: 27237 - DNA, 121 bp, Artificial Sequence
  Synthesized
  misc_feature (61): n=a or g
taaattatttctacacaagatatttgcctagctgtgtttgtatgtttaggaattttggcangatggattgcacaatatcaaaattgaggatttgttttgcattacattcttataagtaatc

SEQ ID NO: 27238 - DNA, 121 bp, Artificial Sequence
  Synthesized
  misc_feature (61): n=t or c
ctcatggggccttgctttggatgagatgcttgtcatagagaaaccacacctgtaaaggagntgatacttctaggaaggtgaatctgttttttcacacccccagacaacaagtggagcatgc

SEQ ID NO: 27239 - DNA, 121 bp, Artificial Sequence
  Synthesized
  misc_feature (61): n=a or t
tatggatttgtacttttttagaaatggagaaaaaacattttacttagaatggtgaaacttngtatttttatgccatctgtaacatctagcataggatgaaaaagtttttgtttcttaacag

SEQ ID NO: 27240 - DNA, 121 bp, Artificial Sequence
  Synthesized
  misc_feature (61): n=a or g
tatggcctgtatcctgccctggaagtcagacctttccctccttgtacctctgaaatatctnttttactccctgtgagtctttgagcctctaggatcactggaacaaaatgccatcaaagca

SEQ ID NO: 27241 - DNA, 121 bp, Artificial Sequence
  Synthesized
  misc_feature (61): n=a or t
ttcccacctccgtttctcaaacttttgttgaaggctgaacgttttgaacagagagatatcnatgtattagtttttgctgtgcatagtagtagcagtactgggctagcaatggactgacagc

SEQ ID NO: 27242 - DNA, 121 bp, Artificial Sequence
  Synthesized
  misc_feature (61): n=a or g
agttaataaaagagccatactaatttgtagtataccacacactcacccaccatttccccantgcttctgctgaactgtccacatgacagaaaatttcccaaatacaggaatacatttgcct

SEQ ID NO: 27243 - DNA, 121 bp, Artificial Sequence
  Synthesized
  misc_feature (61): n=a or g
tcttgagtgaatacttctctgtttggaacagcaacagcggagtccttggaacaaaaaattncagggtgtcctgtgaaattgtggtagcacagtcatgtcacggtgtacaaaaggtagctta

SEQ ID NO: 27244 - DNA, 121 bp, Artificial Sequence
  Synthesized
  misc_feature (61): n=t or c
gagcggtccctctcggctctgtgcgggcaatgagtgctggtggctgtgggtcctgatggcngttccagagggaatgcccaagggcagaggcttctgctcacctgtaaaagcttggacgatt

SEQ ID NO: 27245 - DNA, 121 bp, Artificial Sequence
  Synthesized
  misc_feature (61): n=t or g
tatacattgtaattataaacatttttaaactccacaactcagttagcagaaacaagggcanggattgcatcttcataacaagtcactgaattacacagatttctccttttccttcttaatt

SEQ ID NO: 27246 - DNA, 121 bp, Artificial Sequence
  Synthesized
  misc_feature (61): n=a or t
atccaagacttttgctataattacagtgattctttgttctcagtctcagaaatcttctccncatagcttagcactatcaatacggttaacatattacagttagtgtgctggagagccagct

SEQ ID NO: 27247 - DNA, 121 bp, Artificial Sequence
  Synthesized
  misc_feature (61): n=a or t
agtggcagacatagcctccactccttgcaaaaatagtaccctagattgaaatttaaaaaancattttttctccagaaatttgtagctggaatattattatcatcataaatgctctacagta

SEQ ID NO: 27248 - DNA, 121 bp, Artificial Sequence
  Synthesized
  misc_feature (61): n=a or c
gcagcaccaaataaagtaaaagcagctgctggtaaagccttctggaaacctgagtgcgtcnttctcatcaaggaggcagaaacaagcagaatggacttgcatagctgaccaccatgaagaa

SEQ ID NO: 27249 - DNA, 121 bp, Artificial Sequence
  Synthesized
  misc_feature (61): n=c or g
aatgagaaacaattgaagccatcacatattcatcacatgctgcacctctactggtgttaancttccccagggaacagtatatatcctacttcagctaaataatttttgtagtgatcaacag

SEQ ID NO: 27250 - DNA, 121 bp, Artificial Sequence
  Synthesized
  misc_feature (61): n=a or g
ggccacgggcagcactgaaatggtagaactctcatgtgaacagtgaatacacaaaataagnggaacgaaatagaagtcacaggcagtccctgaggagctcagccatgcacccaccccctgt

SEQ ID NO: 27251 - DNA, 121 bp, Artificial Sequence
  Synthesized
  misc_feature (61): n=a or g
aggctactgatcattaaagcaaatggattaggatagtttgaaaggcataaaagcctgtccnaaacttcaacacctttcagtgttccctgagttgattctgtctcagctttgaactttggca

SEQ ID NO: 27252 - DNA, 121 bp, Artificial Sequence
  Synthesized
  misc_feature (61): n=a or g
gtgtgcttagatagctgctcagatggtaaatgatttaccaagatggcttcaggctattccntttaatgttattagtttgagaagagttggttaaaatatatccttgctttactgaaagtct

SEQ ID NO: 27253 - DNA, 121 bp, Artificial Sequence
  Synthesized
  misc_feature (61): n=a or g
tcctactgtaattatgtgctcatcctcttctttttttggttacaacacagtttaaatgctnaggacagataggacatgacttcgttctgctttgggctaggcacgcctggtaaaccttgtg

SEQ ID NO: 27254 - DNA, 121 bp, Artificial Sequence
  Synthesized
  misc_feature (61): n=a or g
cttcacacttaccaaagtatttccgtcgtaaagtgcgatctctccgctggttgcactgccnggataagccaagtaggagttggcgtggttgattgagagagcgcacagacctggcagggca

SEQ ID NO: 27255 - DNA, 121 bp, Artificial Sequence
  Synthesized
  misc_feature (61): n=a or g
gcgcccacgctgcgtgggagggcgctcgggtggttgggtgcattgcaattgtgcttccccngaaagcattaaaggttctcacctggagctgcgtgggagtctgatggagcaattagggatg

SEQ ID NO: 27256 - DNA, 121 bp, Artificial Sequence
  Synthesized
  misc_feature (61): n=a or c
ttattaaatatttagaagactgagagatggtgtaaatgtccaaacaaactagtgtcatagnttcactttcagtcagattgctaccatcagtagtaaaggatagaaagggtatttgcagacc

SEQ ID NO: 27257 - DNA, 121 bp, Artificial Sequence
  Synthesized
  misc_feature (61): n=a or g
aaagcactcccaggcagaccaaaagtaacatacagaaagaagcactgaactcacccaactngtgatagggatctctagccacacagcagtcccccaggaagcagccaacgtccatgaaatg

SEQ ID NO: 27258 - DNA, 121 bp, Artificial Sequence
  Synthesized
  misc_feature (61): n=t or c
caatctggccattcaaaccgggcttgggctggtgcttgcagacatgggcaggatttagtangattccctgacagctgctcttctccaaatgtgtgcttgggagacgcgtccttctgagggt

SEQ ID NO: 27259 - DNA, 121 bp, Artificial Sequence
  Synthesized
  misc_feature (61): n=t or g
ttggaaatgcatgctacaacctaaagattgtctgatttctccttgtatcctgacacaacanccttcaatcctgatgattatttttaattccaaagacctgtttaagatctgtctttgcacc

SEQ ID NO: 27260 - DNA, 121 bp, Artificial Sequence
  Synthesized
  misc_feature (61): n=t or g
tcttcctatcttgagcctcactctaaagcacgatctctaacaagtgggcttaacagcaggnaggtggaacagctgatgggatggaatcatggtaaaaattgcatggcttagggcagactat

SEQ ID NO: 27261 - DNA, 121 bp, Artificial Sequence
  Synthesized
  misc_feature (61): n=a or g
tcttcaattcagcagttgctgatgagtcatgacaaattagatactcactttaagaaattgngaagactttgttttcattttagaaatgatctcaaataggtcttatattttcagggaccaa

SEQ ID NO: 27262 - DNA, 121 bp, Artificial Sequence
  Synthesized
  misc_feature (61): n=t or c
aaaaaaaaaaacagccaacaaaacacgtcatatgggttcttgtctagttaggtggcagcangtaaaagctattgtgtcctaaaaatgagaaagcaagttatcagctttgaggctgtaaaca

SEQ ID NO: 27263 - DNA, 121 bp, Artificial Sequence
  Synthesized
  misc_feature (61): n=a or g
ttgcaaatacgtagtttctaggttaggtaaatggttgctgaggtcagactgagtatccctnatgatcctttttggccttgaaatctccgcatttgtgactttcatgtctcattggcctttg

SEQ ID NO: 27264 - DNA, 121 bp, Artificial Sequence
  Synthesized
  misc_feature (61): n=t or c
gtagctaataaaatgcagagaacagtctttataaagaatggagaaaattctctgagcaggnagcaggatgtttgaagcatcagaaaatgagaagtcttcagtaatgtctgttcttgatgct

SEQ ID NO: 27265 - DNA, 121 bp, Artificial Sequence
  Synthesized
  misc_feature (61): n=t or c
gtcattttttgtcagcctttctaactatgtgtgtatctctaaatgccacggctaatttctncttaaatgcataacattcaggctctttcaaggttgtattcagagccttttgtgactgcac

SEQ ID NO: 27266 - DNA, 121 bp, Artificial Sequence
  Synthesized
  misc_feature (61): n=a or t
accttgtgttcctacagcttaatttcattctaaggcagtatcagtgccttctttgttagcnggaacaacatcacctgtgattctttcattcaggctttgtttaacctcctgagatcaggat

SEQ ID NO: 27267 - DNA, 121 bp, Artificial Sequence
  Synthesized
  misc_feature (61): n=a or g
ggaattgtcaagaatatgtatctgccaagaaagtctggaaaaggctgtttttggagagggntgcctgacggttccctgcctcctttccagctctcatagctgtgaccccacatcccagagc

SEQ ID NO: 27268 - DNA, 121 bp, Artificial Sequence
  Synthesized
  misc_feature (61): n=t or c
tgccagataagaattacttattgagttgtttctaaacagcttgtatagttctgataaattngaacttttcactgaagtttttgtgtcactaaataatggggactccccaagggagtcttgg

SEQ ID NO: 27269 - DNA, 121 bp, Artificial Sequence
  Synthesized
  misc_feature (61): n=a or g
gaattcttgcagcacagcctcaggcttacttggggttgactccggcactggctatggcacngcacctcccatctaacccaactgagagaaggcagttctaaatgctttttgtagaaatcac

SEQ ID NO: 27270 - DNA, 121 bp, Artificial Sequence
  Synthesized
  misc_feature (61): n=a or t
cacaaccaaaagccgcatattttgtcttcatttcctgatctttttgagaggctgtgagagngccagaaacaaactagccacctcgtgctgctatgagtgcataggagagtagatactgaaa

SEQ ID NO: 27271 - DNA, 121 bp, Artificial Sequence
  Synthesized
  misc_feature (61): n=t or c
gttttgtgctacttgttgtcagtgataggtaagatacgtgccatatcaatcttactccatntgttattcacaagagtaacctatatacaaataacagaagtatttatggctttgtccttga

SEQ ID NO: 27272 - DNA, 121 bp, Artificial Sequence
  Synthesized
  misc_feature (61): n=t or c
ctgtgctgcatcactccagcctccgttcctgcagatcccgcttctttttcacatcagcgcngatcctcaatgtaggacacagatgctcaatcctgccttctgggctttcatccatcggctt

SEQ ID NO: 27273 - DNA, 121 bp, Artificial Sequence
  Synthesized
  misc_feature (61): n=a or t
cctgaggagtgctgagctgctgtttgctcatcacacacagtgctgacttgtctgcagagtnacccaaagaaggctgcagttcctggctgggtgatgtgtcccagttacagcttctaaataa

SEQ ID NO: 27274 - DNA, 121 bp, Artificial Sequence
  Synthesized
  misc_feature (61): n=a or c
catttactgaacaaataaagaccttacttccttgtcctagctcaatttgtgaatgagactnctatagtgttttaagcagtaatgttacaagataaagctgaacttgttaaaaaccacaaag

SEQ ID NO: 27275 - DNA, 121 bp, Artificial Sequence
  Synthesized
  misc_feature (61): n=t or c
caaagcaaacatttgaaagccacagcaagttttggggttgttttcttgttattgcttaatnatttattagtaaggtggaggccaacaacacaggacaaacgtggtgaaggaagggggaatg

SEQ ID NO: 27276 - DNA, 121 bp, Artificial Sequence
  Synthesized
  misc_feature (61): n=a or g
tttctgtccaggcttctagatttcaataggctgagttctcaccttcatcagccttaaacantacccctctttctgctgccattatgccttggaggacttacatattcctcatttgttttcc

SEQ ID NO: 27277 - DNA, 121 bp, Artificial Sequence
  Synthesized
  misc_feature (61): n=a or g
ggaaaattacaattcactttcagtgaggtagtattatttttttctaccagatgcagtatgntgtcagtgtgacctgtttcttctgtttccaactagagctgtatatcggtgttgacttaat

SEQ ID NO: 27278 - DNA, 121 bp, Artificial Sequence
  Synthesized
  misc_feature (61): n=t or c
tcataatactagtattgaggataaacaaaccataaactgcaaacctgctagactctgagcncactctttagggctaatgttagaagacgctctgcttttttcagatatctgcctagaaagg

SEQ ID NO: 27279 - DNA, 121 bp, Artificial Sequence
  Synthesized
  misc_feature (61): n=a or c
aaggatggaaagggattcacaaagaactctcagtgattttgagaaaacgaatacaatttangccttttttgccactgaaatcagtgatgatcacttctgcagtatgatatggctgcttcgt

SEQ ID NO: 27280 - DNA, 121 bp, Artificial Sequence
  Synthesized
  misc_feature (61): n=t or c
agcttttggcttctgcagcagtgcaaatatcacacacctttaactcacgagggccctaaanggagttctccctttgcagcccagtcacacatgcaagttcagggtttgccagttactgttt

SEQ ID NO: 27281 - DNA, 121 bp, Artificial Sequence
  Synthesized
  misc_feature (61): n=t or c
tttgaaggtgcagggcagggctgggagtccctctgggagcaggaaggtctgacttgttgcngtaaaacagcaacatagaccctgcactaagcaaatgctctgctgatgtctgtgagcatta

SEQ ID NO: 27282 - DNA, 121 bp, Artificial Sequence
  Synthesized
  misc_feature (61): n=a or g
ctgtaggaatttctatgacccagagctagcacagaccaaagctgcaggcaaaggatggtgngatggtatgaactgctactgctataataaggaagagtcagggataagtcagggataaagg

SEQ ID NO: 27283 - DNA, 121 bp, Artificial Sequence
  Synthesized
  misc_feature (61): n=a or c
ctgattcatgaggaaaatgaagctgttttggaactggaagttggttgggatttggttctcnttttctccctctatttctgccttttcatgttgatgtttgatccgttcacagaaaagactt

SEQ ID NO: 27284 - DNA, 121 bp, Artificial Sequence
  Synthesized
  misc_feature (61): n=t or c
tcactccttggtgtctggctgggctgacacagtttcagtggtctgttaagtatctaaaacncatttggtaactgcttccctcgcaaccaccgtcccctgctaggtcagaccttgtgtggtg

SEQ ID NO: 27285 - DNA, 121 bp, Artificial Sequence
  Synthesized
  misc_feature (61): n=a or g
tttcttcaaatacaatccaacatcttaatgacaatcaataccttcctccctctataactgnactccctgattattcctaatcttgatgaatggcaaactgaatgccaggttgggtgaagga

SEQ ID NO: 27286 - DNA, 121 bp, Artificial Sequence
  Synthesized
  misc_feature (61): n=a or g
ccagatatgatcaagcattttgaaatgatctatttaaagtggttaaaattaaacagaaatnagtaacttaatgtgacctttttctcatttgtgtgggtggttttttttaagttcttgttat

SEQ ID NO: 27287 - DNA, 121 bp, Artificial Sequence
  Synthesized
  misc_feature (61): n=t or c
aactctgtcaaagtagtttttgtacccttgctccagggaatttaacccttaaattttacantgcaatgcattcctacaaaaacaccttgcaaagctctacatggcccttcgaagcatttaa

SEQ ID NO: 27288 - DNA, 121 bp, Artificial Sequence
  Synthesized
  misc_feature (61): n=a or g
cagtggttgctcagcagtgccagcccatccctggagggatcattagtcctccctcattagnagaagttactcaccccgtaagacagacacgagaatatcctggaaatgcctccgtttggcg

SEQ ID NO: 27289 - DNA, 121 bp, Artificial Sequence
  Synthesized
  misc_feature (61): n=t or c
taaacaaatattcttctgaattaagtgttagtaacgcccctttgtaactgtatttcaaaangtacatccctcctggtggcatgaatacaacaaacaagagtaaagcagggattagcttctt

SEQ ID NO: 27290 - DNA, 121 bp, Artificial Sequence
  Synthesized
  misc_feature (61): n=t or c
atccctggaagattcaggagaagccagtgaatgggtgctaactttatgaaagaaatataanaaataggaagacattcttctctgccaactgacagaataatgagatgaatgtgtgaagaaa

SEQ ID NO: 27291 - DNA, 121 bp, Artificial Sequence
  Synthesized
  misc_feature (61): n=c or g
cattgagatgtgggaccccttgggactgcagtgagatacagaccttgcttctgcatgcctnctcaccgtgcttcccttctcgcttcccttgcagagcactacaaacaccattggtttcccg

SEQ ID NO: 27292 - DNA, 121 bp, Artificial Sequence
  Synthesized
  misc_feature (61): n=t or c
tcttgctgctcccattgctttaaggattaatcaactacagagtgaggtaaccaccctgagnacctgaagtcctgggagctttgtgctggaaaagcacaagatttgggtgcctttctgccaa

SEQ ID NO: 27293 - DNA, 121 bp, Artificial Sequence
  Synthesized
  misc_feature (61): n=a or g
tacattttgcatttttgttccctattcctattctaaaaatcctaaatggataaatcaattnttttgattgctgtggaactgggagcagttgttctttgcaacagtatgtctcaacatcaat

SEQ ID NO: 27294 - DNA, 121 bp, Artificial Sequence
  Synthesized
  misc_feature (61): n=t or c
agatgcaatatgcaaggctaacgttttatctttctctgatccttatattatgcatgagcanatggtttaagaagtaaaaactaaacattgctagctgggtgtcacttctagcttcaaaact

SEQ ID NO: 27295 - DNA, 121 bp, Artificial Sequence
  Synthesized
  misc_feature (61): n=t or c
tgagcttcttgtgataagtgccttgttttactttccttctcacacagatctcttttattcngaccataacatccatcgttttgcatatacatgaattttcatttcatcaaaaatagttgct

SEQ ID NO: 27296 - DNA, 121 bp, Artificial Sequence
  Synthesized
  misc_feature (61): n=a or g
gggttgaggccaatgtgattggagcagcaggatccccaaatggggatcattactactcacntcttgggcttaccattttagatgggtggcgttagggattgtctagcaggggaaaagaatc

SEQ ID NO: 27297 - DNA, 121 bp, Artificial Sequence
  Synthesized
  misc_feature (61): n=a or g
aatattcatatactgattacaaacgtattctattctacaccagccttcgcccagaaaattnacttgacaggaagactgtgatctgttctttgtctcgctttgtggtatcttagctagataa

SEQ ID NO: 27298 - DNA, 121 bp, Artificial Sequence
  Synthesized
  misc_feature (61): n=t or c
tatatatatatatttggtccaattcgccttatatgctccttgctaagctgaaaggatgcancacagtaagtgcagagtctttggtgaaagcatcaggctccacacataattgttattgata

SEQ ID NO: 27299 - DNA, 121 bp, Artificial Sequence
  Synthesized
  misc_feature (61): n=a or t
catcttcctccaaaacccaatgacagcaattacatttttactgtggtttcttaaggaagcnaaccttccacagtctctctgccccgatatttgtgtacatcatgtgctcctgtctctcaag

SEQ ID NO: 27300 - DNA, 121 bp, Artificial Sequence
  Synthesized
  misc_feature (61): n=t or c
agaggcctacatgtcatcaaatgtttttgctgatttttttcagcacagcagttgctcgagngtgtcacatacagtgtccactatcctgttcctgacattggccatggctagctgcctcaca

SEQ ID NO: 27301 - DNA, 121 bp, Artificial Sequence
  Synthesized
  misc_feature (61): n=t or c
aaaaaattaggacagtttttttgggggggaggaaaggagagaggataggtgctggggccangtaatggtgaatgaactgagatgagctgtgagcagcagccttggaggctttggagcaatt

SEQ ID NO: 27302 - DNA, 121 bp, Artificial Sequence
  Synthesized
  misc_feature (61): n=t or c
aggaacttctatctgcagatctttgaatgtcaaaagaaagcctcactgacttcagcagtgntgaaccagaaccggagtaggtcctgtggcatccataaaattaacatttatataaatgtgc

SEQ ID NO: 27303 - DNA, 121 bp, Artificial Sequence
  Synthesized
  misc_feature (61): n=a or g
ttagatgtaggctttgttaaatatctacaagcaaattaaagtcattcatgtaagtgagacnttttcttgagaatttggctttcagcaccggagatgcaggaaaagagcaccagaggcttta

SEQ ID NO: 27304 - DNA, 121 bp, Artificial Sequence
  Synthesized
  misc_feature (61): n=t or g
tggagtcatattaatgacattttcatgtagccaaatgccattttccaatcgggagatgctngtaagggatttacctttatttttaatgccctgttgcatgaccacaagcaagggctacagg

SEQ ID NO: 27305 - DNA, 121 bp, Artificial Sequence
  Synthesized
  misc_feature (61): n=t or g
ggggttgcatctgcgtagagcgtgaatctgaactgcattcagagtgaggaataacctgtgnctgagacacaggctgacacgtgggtaactccagccctggctataacacaggattcttgtg

SEQ ID NO: 27306 - DNA, 121 bp, Artificial Sequence
  Synthesized
  misc_feature (61): n=a or g
aggaagggctccttttggtcttggagcagaggattctgtaggaaggaatagaaatcctccnatatctacggaacagataaacagctgccatgggggttgggcatagattttgcctcaggct

SEQ ID NO: 27307 - DNA, 121 bp, Artificial Sequence
  Synthesized
  misc_feature (61): n=t or c
accactatcattggtgtgcgttgctctgggctgctttatttcccaaagggagccagttccnaggaatgctcccagcctgagtgaggtagtggccacaggctctagggagctgcagacacca

SEQ ID NO: 27308 - DNA, 121 bp, Artificial Sequence
  Synthesized
  misc_feature (61): n=a or g
aagtagcgctcacacaaagggaaagaataaaacacagcaaacccgaggaaaaacaaacacncaaggattgcacacatctgcaatttaccataagctgcaaatgagattctgcatttctcat

SEQ ID NO: 27309 - DNA, 121 bp, Artificial Sequence
  Synthesized
  misc_feature (61): n=t or c
gacagcacatctttcagactgttgttaccctgcttgatgaagaaagtagagatttacttanttaactaatatactagaatttgcaatagaaaaagttacaagctgtaggatttctgactac

SEQ ID NO: 27310 - DNA, 121 bp, Artificial Sequence
  Synthesized
  misc_feature (61): n=a or g
tcaatcacgtgtgcctccgtgacagcagtagcaaccagttggaagggcagcctaggcagcntgccaggacatgcatcacaagagcagatggagatttttagacagttgtagcacatcctgc

SEQ ID NO: 27311 - DNA, 121 bp, Artificial Sequence
  Synthesized
  misc_feature (61): n=a or c
tctgatgacaggatagctaagaacaaaatctgcttcatttcacgtagtaacagattctagntgatgcagggaaaggtgcaggacgacagtcgagctacattttagttgctcaaattgatta

SEQ ID NO: 27312 - DNA, 121 bp, Artificial Sequence
  Synthesized
  misc_feature (61): n=t or c
gccaagtcaacttcaaaagctgctgtaaaccttacagtgctacaaaaccttaaaataaaangtattcacattcccagatgatacacgtgattgcaagacaccaatagctatttttggccca

SEQ ID NO: 27313 - DNA, 121 bp, Artificial Sequence
  Synthesized
  misc_feature (61): n=a or g
cccagtgaggggccaggagcaagggctgatgggaaacaattgtgagctgaaattaagacanaaggacagagactggaaaccagggcagtttttcgtgaaagggtatctcttagccaaacat

SEQ ID NO: 27314 - DNA, 121 bp, Artificial Sequence
  Synthesized
  misc_feature (61): n=a or g
atgaagaggtggggccccactgctctgtggtacagaaatgctcctcaaacactgaaaatcnttgccttggtaaaaccgtatttgatttggatgttctttctcaaacctttgtgtggttctt

SEQ ID NO: 27315 - DNA, 121 bp, Artificial Sequence
  Synthesized
  misc_feature (61): n=t or c
ggattattaaagcagtgttttttttcattgtggggctctaccaaagtggttatcctattancaacacacagaagtgcctgtatttatccaaataaaagttgctatgtttggacataattta

SEQ ID NO: 27316 - DNA, 121 bp, Artificial Sequence
  Synthesized
  misc_feature (61): n=a or g
ctgtggtggttgcattttccagagtgatgcagtggtcagtcagcatcggaagagtcagctnaagttcttctcaacgtctttaaagccaacactggcagctgtatgctttttttttgtatct

SEQ ID NO: 27317 - DNA, 121 bp, Artificial Sequence
  Synthesized
  misc_feature (61): n=t or c
acctgctgattctctcctctttggattatgatggccaaagaatgcatgtttcataacaacntgcacaagtgaacttgtgtttgtgatgatggcatcacatggctcaggttatctttggggg

SEQ ID NO: 27318 - DNA, 121 bp, Artificial Sequence
  Synthesized
  misc_feature (61): n=t or c
ttgatctcaccaatctaaatgatccagagatctaaaagtatctaaaactgccatggaaatnacttaaacaccaggcactgaatatctgttacttatttttcttgttattagtctgtattct

SEQ ID NO: 27319 - DNA, 121 bp, Artificial Sequence
  Synthesized
  misc_feature (61): n=a or g
taatgaatcctgcaggaataagcatgcttatccacaagtggtggcttacaaaaagcaaccnacatccaggtcagatctctatagcacaaaaaccagccaaaacagcagttttggttccaaa

SEQ ID NO: 27320 - DNA, 121 bp, Artificial Sequence
  Synthesized
  misc_feature (61): n=c or g
ttcacaaacaaaactctgtttgtttgtttttaccccagtcttgaacactgttaagtatcanggtgtagctcaagatcttttaaggtcttgctgcagcctctggaaaaccaacttatcatat

SEQ ID NO: 27321 - DNA, 121 bp, Artificial Sequence
  Synthesized
  misc_feature (61): n=a or c
gaacaaacatttatctccagaatcaagtatgtgggatcgtattcctgaagtcagatacttngctactgaatctacacaatcatagctagaaaagagaactaaaagatagacttgattacaa

SEQ ID NO: 27322 - DNA, 121 bp, Artificial Sequence
  Synthesized
  misc_feature (61): n=t or c
caaagaagatgacactaggctcaggagggaattgggatttgtgctgtgtttattcttaagngactgacagttgcctgagttgcgtgtgtcaattaatcccatgttctgagtataatggtgc

SEQ ID NO: 27323 - DNA, 121 bp, Artificial Sequence
  Synthesized
  misc_feature (61): n=a or g
tgtgttcttgtacccttgcagagcaggtaactatttgtgtctgtgtgttttggaggcaccncaacatagacagtccacctctagttagcagatacaccttctggaagaaaacaaatgtttc

SEQ ID NO: 27324 - DNA, 121 bp, Artificial Sequence
  Synthesized
  misc_feature (61): n=a or c
tcaaataccaagcacgggaaatggagaaatggcccatggcacaggatggcaaggccagggnagaatacctttgcagtgaaagcagtacttgttggggaacacttggccaagggcccaaccc

SEQ ID NO: 27325 - DNA, 121 bp, Artificial Sequence
  Synthesized
  misc_feature (61): n=a or t
gtgaaccaccagtgttatagatcttaaaggcagcaatacttggtggctttttcttagatanttctccttgtagtgaaaagtgtaatgacagccttcttgtattaccaatgcacttcaatgc

SEQ ID NO: 27326 - DNA, 121 bp, Artificial Sequence
  Synthesized
  misc_feature (61): n=a or g
gctatctttagcccatgagagcacccctcaattgttctgcacttcaaacaataggcacacntgtggagggtttaagattgctggccttagcagagcatttcacattgaaatgcagcctcgg

SEQ ID NO: 27327 - DNA, 121 bp, Artificial Sequence
  Synthesized
  misc_feature (61): n=a or g
aaccatcatggaacaatactgatactaaagaatttcaacttactacattcatttctgtganctactctgagttacaatagcaaaaaaagatctcgtaattttggttggtgaacattactac

SEQ ID NO: 27328 - DNA, 121 bp, Artificial Sequence
  Synthesized
  misc_feature (61): n=t or c
tcaaaactgatgagcacaaatcccctgagcccgatccgacccagccgcactcaggccactnggtaacccgagtgacctgggagtcaaaccatgataaccctcttcaatttaaagagctgct

SEQ ID NO: 27329 - DNA, 121 bp, Artificial Sequence
  Synthesized
  misc_feature (61): n=a or g
ttaggtgctcctgtaacactgcaatgtggaaacagaacaaaaatggctattcagagcttcngaaacccaacagagagggcattcaggatgaaagttaaaacagcttcttttgtactgtagc

SEQ ID NO: 27330 - DNA, 121 bp, Artificial Sequence
  Synthesized
  misc_feature (61): n=t or c
ctgcccacctaggccagatgatggacaaggtgcctgggtgtttgtgcctgtcactgtaganatatcctgagtgtactcagcacagctgaggtggtgtaatgggagtctgagccttcctgaa

SEQ ID NO: 27331 - DNA, 121 bp, Artificial Sequence
  Synthesized
  misc_feature (61): n=a or g
aggaagagacaaagccatctcaactatgccagcagctgaccaagaccatcagcagctttcnaggggatcacagtggccatttcctttttcttccttccttttcctattttccccattgaaa

SEQ ID NO: 27332 - DNA, 121 bp, Artificial Sequence
  Synthesized
  misc_feature (61): n=a or g
aaacaagatgatctccataactgtgctcattctatgcttattctttctcaccagatgcagnattcctttctacagtgagtgaattgcctggtcattaacataaaattaactccaaatggtc

SEQ ID NO: 27333 - DNA, 121 bp, Artificial Sequence
  Synthesized
  misc_feature (61): n=t or c
aatagagttccaccaacatttgacaagaggtagaaatattaactaagagcttattaggtgntttatttcaattgctcgtggaacgaagaaaaacccagccgaatcaatgccgaatagctgg

SEQ ID NO: 27334 - DNA, 121 bp, Artificial Sequence
  Synthesized
  misc_feature (61): n=t or c
aatcaagtttgatgaggataaagaaagatggatacattctgtgaaagaatgctgctggtanatgggcttagttaagagagtttcctagcagacgttcatttcagtcccagtttcttagctg

SEQ ID NO: 27335 - DNA, 121 bp, Artificial Sequence
  Synthesized
  misc_feature (61): n=a or g
aacccctgagaagtgcaggtttgctgctgagcatctcgtgtaatgctttgggaacagcacnagttggcacatgtaggcttgaattcatcacctccaggaaatcttgcttcccagttgggtt

SEQ ID NO: 27336 - DNA, 121 bp, Artificial Sequence
  Synthesized
  misc_feature (61): n=t or c
caggtacatttttgtcatgcaccatgaactaattttctcctgttgggtaaactggatttantgaggccttggtgtgtctttctcaatcatattccaagtactttaggcaaacacagatata

SEQ ID NO: 27337 - DNA, 121 bp, Artificial Sequence
  Synthesized
  misc_feature (61): n=a or g
cacctttagggcctggggactgaacaaaacgatggcatacaagacattaaaatcaattctnccaaatgcaattaaaagcaattttcccaatgccctttctgggccaggtctactgccaggc

SEQ ID NO: 27338 - DNA, 121 bp, Artificial Sequence
  Synthesized
  misc_feature (61): n=a or g
tatccctagtgaatagactttattggctctatctcagtagatcacaaagagaagacaggangcagtgacttgattttgtcactcccaaaactttggtgctggctgaaacagtggtatttat

SEQ ID NO: 27339 - DNA, 121 bp, Artificial Sequence
  Synthesized
  misc_feature (61): n=a or g
ggcggttcaggtatggcagttttaatgcattccagaggaagcattaggcataataatgccngtctgcttcagggcttagtggtatttcctggtagctccggtgaaggagtggatgctgatc

SEQ ID NO: 27340 - DNA, 121 bp, Artificial Sequence
  Synthesized
  misc_feature (61): n=a or c
aggtgtttacatgcatgtgttgaatggttgacgtccattttgagacagaggtggaaatgcntcatagaatgagtttctgtgaaggctgttttgtgtgagtggtgtgctgctagtttccttc

SEQ ID NO: 27341 - DNA, 121 bp, Artificial Sequence
  Synthesized
  misc_feature (61): n=a or g
tgtggaagaatgtgaggaattaaagaattcatactgttcagttattgataacattaatcangagaaagcactgttgattgagaggtacaaagaagggcaagaggaaattaaaaggctacag

SEQ ID NO: 27342 - DNA, 121 bp, Artificial Sequence
  Synthesized
  misc_feature (61): n=t or c
gcgtggaagagggtgaaatgtccagcagatggttggacaaaaacattttatggaggtgttntaaataaacagtactccggagctgaaggggagagaggggagctgtgagaaatgtggttgt

SEQ ID NO: 27343 - DNA, 121 bp, Artificial Sequence
  Synthesized
  misc_feature (61): n=a or g
ttttttttttttaaaaaaaaaaaaagatatctggtatatcatctttcagtagccaaaaacntagctgagtatgtgggtgtattggtacacaagtaagtgatgccatgactcttttttcctt

SEQ ID NO: 27344 - DNA, 121 bp, Artificial Sequence
  Synthesized
  misc_feature (61): n=t or c
taggttgcatctctccaacctgcttctgatattcattttcctctcagctgagcctggatcnttgagcacggttttctgctagctagtaaaaaaaggacactgcaattggacttacatttga

SEQ ID NO: 27345 - DNA, 121 bp, Artificial Sequence
  Synthesized
  misc_feature (61): n=t or c
gacttgccagctcctacatcaggctgcccacaaggactccatccaacctggacgtgaacanctccagggacatgaaatggttcaagtaatatactcaagtaatatactctcctctagacag

SEQ ID NO: 27346 - DNA, 121 bp, Artificial Sequence
  Synthesized
  misc_feature (61): n=a or g
aaattactgtaaatagatagcagtgtaagaagttcacaaaagtaacagacagtgctatgangattggctggatttcataggtggttgaaggggaattatgtgagggaaaaccaaacttcag

SEQ ID NO: 27347 - DNA, 121 bp, Artificial Sequence
  Synthesized
  misc_feature (61): n=t or c
taacacaaaagtagtttccatagcagtttgtaatgaatgaggtaatatctacttgattaantaatggcacttgtacatttcttagtctgagatggctggtcctttagagcaaaatactcac

SEQ ID NO: 27348 - DNA, 121 bp, Artificial Sequence
  Synthesized
  misc_feature (61): n=a or c
tcagtgaatgaattctgtagtgagcagtgcagtaaagagtgatcttgggagccatacagtntcaggccaggctatatgttttctttacccaaactccctagattcattcccttgaagtaca

SEQ ID NO: 27349 - DNA, 121 bp, Artificial Sequence
  Synthesized
  misc_feature (61): n=a or g
caagattattgaagtaaaagcaaaaaagaaaacaacccaacaaactgcacaaaatcacagncaatctgttctagtcgatcctttttgtacaggtgacagatgatgtgtcagcctatgtgta

SEQ ID NO: 27350 - DNA, 121 bp, Artificial Sequence
  Synthesized
  misc_feature (61): n=t or g
gtagtcccaggatgtggtcacttccgtgttcacaatgctcgcaagaattcccattcttttnctattccccagctatttctggaacaggaatgggattaatagcacaggttcctgggagatg

SEQ ID NO: 27351 - DNA, 121 bp, Artificial Sequence
  Synthesized
  misc_feature (61): n=t or c
ttgaaatactttacagtaaatggaaaggagtacaaacttgcataaaggcagccttgttaanacttctatccaacctttagatgccatttagactggataaagcctatccaagtgagttcaa

SEQ ID NO: 27352 - DNA, 121 bp, Artificial Sequence
  Synthesized
  misc_feature (61): n=a or c
ttttcctagaccacttttactatgtgaagatggagaaaaaagagccttgcctttaattgcntgtgctcagcttaacccacgttccctgaaaccaagctgtgctatagcatctactgcagtt

SEQ ID NO: 27353 - DNA, 121 bp, Artificial Sequence
  Synthesized
  misc_feature (61): n=a or t
gtacagtggaatttatccaaagcttcctgatccttcattactgataacacatgaaaacaangcactgtaatgcaaattgcatcgattccctctggtttactcaagaaagaacataatactg

SEQ ID NO: 27354 - DNA, 121 bp, Artificial Sequence
  Synthesized
  misc_feature (61): n=a or c
tgcttttagttgatgactgtcaatcccacacaaatgtttgcataagaaggtaagttttctncaagctccaagcttaggggtagatgtctgttctagtggagtgcgtattgaacagtgattt

SEQ ID NO: 27355 - DNA, 121 bp, Artificial Sequence
  Synthesized
  misc_feature (61): n=t or c
ttcatccacctcacccaactttccttgcctgagccctcatcccaattcctggaagatgccnacagacctaaacccaggtctcaaatccataggactcctttcacagcactccataaaaaag

SEQ ID NO: 27356 - DNA, 121 bp, Artificial Sequence
  Synthesized
  misc_feature (61): n=a or g
ctgggagactttatgtgggtgtttacaatagatatcttgatacttcattgatacacagatncacttcagaactgaattatttggcatgcactatttagggcagctttaactttcacagttg

SEQ ID NO: 27357 - DNA, 121 bp, Artificial Sequence
  Synthesized
  misc_feature (61): n=t or c
cttgttctcccctgcctgtgtgactcatctcattctttagcagcctgctgtcctgctatcntcaggagtgctcaagtcatctgacttggcggccgctgagtctaccaccagttcctcttca

SEQ ID NO: 27358 - DNA, 121 bp, Artificial Sequence
  Synthesized
  misc_feature (61): n=c or g
tacagtagattagtctgtctttgtggcatcagcggtgtgtcgatacattcagcattcatgnagtcttttttatctatatgaagaaaactggtaaattggttattcactgttttaaatggat

SEQ ID NO: 27359 - DNA, 121 bp, Artificial Sequence
  Synthesized
  misc_feature (61): n=a or t
tgcagccggagtcatatgtcctgttcagattcaatatgctcatttgtgattcccagtaagnggtagttcaacacagggccatgatttggatttgtctgagtgaactgttgccagtgtaagt

SEQ ID NO: 27360 - DNA, 121 bp, Artificial Sequence
  Synthesized
  misc_feature (61): n=t or c
atattctgatattatcatacagtgggttaacgtacatcttaaactgattctgtaatctttnaggagctttgcttttgcctctcactctagactagtgagtgaaaagtggtagagcagaaaa

SEQ ID NO: 27361 - DNA, 121 bp, Artificial Sequence
  Synthesized
  misc_feature (61): n=c or g
gaaggaaatgcttttaagatgtgttggagaaattcgactgtgataaggaggactgatcctnatccagaagggcccttcttaatttattgattcaatttgcaaatgtctttaaatggattct

SEQ ID NO: 27362 - DNA, 121 bp, Artificial Sequence
  Synthesized
  misc_feature (61): n=a or g
gagagactgagaaagagagacagaacagaaggagtgtgcatgcagaggcaaagcaaagcantcactaagatattcccaagtggtcaggatcaatcactatgtaaatcacaaatgttagtaa

SEQ ID NO: 27363 - DNA, 121 bp, Artificial Sequence
  Synthesized
  misc_feature (61): n=a or g
cctctgaaaagaatgcacataaaaagacttccatttttttccacgtaactacactgatacntatttatgcacaaaatgctaaattctaaataatttaaaaaaagatcaaaaaaaatgtttg

SEQ ID NO: 27364 - DNA, 121 bp, Artificial Sequence
  Synthesized
  misc_feature (61): n=a or c
acttcatttatatgaaaagtaaagcacaaagttactgtaattgccaagtattgatgcttgnatagtcttattgcttcacaaacacagataatgcaaagccaggaacatggctgaagtctgg

SEQ ID NO: 27365 - DNA, 121 bp, Artificial Sequence
  Synthesized
  misc_feature (61): n=t or g
ttgctgaggataagtgtagaaatgcaatcatagaaagatccttcctctccggtttggaganatactgtcaacaatcaaatactttttattcaaggaatgaatttaatcctcatgttacgag

SEQ ID NO: 27366 - DNA, 121 bp, Artificial Sequence
  Synthesized
  misc_feature (61): n=a or g
caacagcagcaacaaaggtccgtcaggttgatcatcatagagacttcttgtcttccccacncagcctacagttagtcatgcaagtaacctaacagagctgatgggtgagaaggagcatttt

SEQ ID NO: 27367 - DNA, 121 bp, Artificial Sequence
  Synthesized
  misc_feature (61): n=a or g
ctaagagagagcacccatagcagtatcaaattgcttattgctctctccacagtcaactagngcacaaggaggagaggaaggaacaacagaagctctgactaacaatttctctctctctccc

SEQ ID NO: 27368 - DNA, 121 bp, Artificial Sequence
  Synthesized
  misc_feature (61): n=t or c
ttaaaaatctacataagaaattctagatgaaggtcagttaatcaaacatccaatatcttgnatgacaaaatacaaaagaagtatctcaaataatttaacactgccctctggaggagacaat

SEQ ID NO: 27369 - DNA, 121 bp, Artificial Sequence
  Synthesized
  misc_feature (61): n=a or c
tgtattttgactgtaaatattagggacttgcatacacctgttgtctgatttgcatcaggantacctggaagaaagagatgtttggttttgaagctactggatcctacatttctgctctgtg

SEQ ID NO: 27370 - DNA, 121 bp, Artificial Sequence
  Synthesized
  misc_feature (61): n=t or c
ttggactaagaccatagggtcagtaactcatgccccactcctgtctgtaaactcatccctncagaagccccatcagacatttctgatagtacttttgacatcagcaaaaccagaatgattt

SEQ ID NO: 27371 - DNA, 121 bp, Artificial Sequence
  Synthesized
  misc_feature (61): n=a or g
atcactgttgaacaattgccattgctgcatggaagcatgggtctcagctgcatctctcaancagtgactaagtggagggatctccaccagctgggaatgatcctgtctcctctcttttctt

SEQ ID NO: 27372 - DNA, 121 bp, Artificial Sequence
  Synthesized
  misc_feature (61): n=t or c
ctgcaggtaagattccttttcagtgctccaggaatgaggaaaggctctctttgttgcagtngcttgaatgtagagtgactctggtcacacttactctgtttcagtagtctgctgttgttat

SEQ ID NO: 27373 - DNA, 121 bp, Artificial Sequence
  Synthesized
  misc_feature (61): n=t or c
agcatgtttaatgaggtctccataccagaatatgttacatctccaactgcctgctttaacntgcatcacatctcacttactttctatacaagtagccatttctgtaagttttaagacctca

SEQ ID NO: 27374 - DNA, 121 bp, Artificial Sequence
  Synthesized
  misc_feature (61): n=t or c
cgtgaaaggaaatagaatagaacccctgctctaggtgaagggggaatattattacaaccantagcttcctagtctttgttaataaggctggttgatgtacttatttatttagttagtttaa

SEQ ID NO: 27375 - DNA, 121 bp, Artificial Sequence
  Synthesized
  misc_feature (61): n=t or c
tgttttagtatacacgaagaatactagtctgccttctcaggatcattaacatcagtacctnggtagcatcaagtacacccaaagtaaaggactgcaagcagagtacaggaacttcagttac

SEQ ID NO: 27376 - DNA, 121 bp, Artificial Sequence
  Synthesized
  misc_feature (61): n=t or c
ctctggggtcccaccagcattgcttttaaagcacagagagaaacacatgtgcaatgcaacngtgaaaatcaagcagaagctcaggccagattcagtgggccatgtggaagttcctggcgtg

SEQ ID NO: 27377 - DNA, 121 bp, Artificial Sequence
  Synthesized
  misc_feature (61): n=c or g
gaagcctatatttaataaccaaagtgactcaacggggatcttcctgcaacagtctcaggtnatggagctagaagtgttctgctgctaaacccaagcaagctgcatctctcctcaacagcat

SEQ ID NO: 27378 - DNA, 121 bp, Artificial Sequence
  Synthesized
  misc_feature (61): n=a or g
aagaggtgtcaatagcattaaagtcacattgccagaggtcaaagacagactacccactccnagcatctacctgagcctaaacaaccttcctcctcaggaagactttcaaggaacaactttg

SEQ ID NO: 27379 - DNA, 121 bp, Artificial Sequence
  Synthesized
  misc_feature (61): n=a or g
tgatgagaagttttctcattgcagtccccgatggttttccaggtggatgccaggactcccntagcgcttttagttaacggaggaagagaagcctgatgtcctggccagcactgtgtctgtg

SEQ ID NO: 27380 - DNA, 121 bp, Artificial Sequence
  Synthesized
  misc_feature (61): n=a or c
attctatttccacgtggaaaatgcagtgctacacagcctaacagctgatattctacaaagnagcaaactcaggtaaaggtatgagtaaagcaatgatgaggacagaagaagattaaagaca

SEQ ID NO: 27381 - DNA, 121 bp, Artificial Sequence
  Synthesized
  misc_feature (61): n=t or c
cctgaggagggacatgattttgctaacatctacagctctgtgcagaaggcctaggtctcanttagagctggaatttaatctctggtttttcagacaagaaagtacttcccagtgaggcatt

SEQ ID NO: 27382 - DNA, 121 bp, Artificial Sequence
  Synthesized
  misc_feature (61): n=t or c
gatgcagacagtggggggactgcagccctctaggagctgggatggaaaaagggacagaggntttcaaggatgccccagaaatgcttgggattgtgaccagcacggtcacaatcacccaaca

SEQ ID NO: 27383 - DNA, 121 bp, Artificial Sequence
  Synthesized
  misc_feature (61): n=a or g
gagctgattttgattttctttatccattcactatatccaagtcacgtcgcacttgtaggtnaggacaacagtttgctaccatctaacaaaataaatgcaggttcaacaaaattgggatttt

SEQ ID NO: 27384 - DNA, 121 bp, Artificial Sequence
  Synthesized
  misc_feature (61): n=a or g
tgaagaccagctcattcctggctttagtaaactgtcattaaccgcaggctgtgtttctgangaaacacctcctcatatgccaataaaaaatgggccaattcaatttctgtctgcatcttcc

SEQ ID NO: 27385 - DNA, 121 bp, Artificial Sequence
  Synthesized
  misc_feature (61): n=t or c
aattttttaaagaagaaaaactattcagtattcttcttagtattttgcaaacgatttccanaataatgcactctcattttgcctaggaaaatctgactggatcaattgctaattacaggaa

SEQ ID NO: 27386 - DNA, 121 bp, Artificial Sequence
  Synthesized
  misc_feature (61): n=t or c
aattacagattcatgatccagttctctttagagctacttgaaggttgcttaatgcactatngtgcatttaggacatacggtaatgtgccataattacagatgtaattaggagtatgttttg

SEQ ID NO: 27387 - DNA, 121 bp, Artificial Sequence
  Synthesized
  misc_feature (61): n=a or c
ctgaatggcaccggcttcacttagaaaaggagtggcgtgagaaccactacaggatggtganggaatagggtaaaaaatgcatatattttatgtgtataacaatatttcttttttgcattaa

SEQ ID NO: 27388 - DNA, 121 bp, Artificial Sequence
  Synthesized
  misc_feature (61): n=a or c
gcccgtcacgatgactcaccaaggtaagtaaatgcgggtaaatccgctgtctgtttggccncgtgaactgtcgctgaggcgctcctggcagcgcacgggtgatgctgtgagaagtaaggca

SEQ ID NO: 27389 - DNA, 121 bp, Artificial Sequence
  Synthesized
  misc_feature (61): n=t or c
ggaagtgctgcccttacccaggtcatgctctgtgtgctcttggtctgagcatctctgtccngagcgtcaaagagcttcaggaaaagagtgtggggaagcctggatccctgtgagcagtgag

SEQ ID NO: 27390 - DNA, 121 bp, Artificial Sequence
  Synthesized
  misc_feature (61): n=a or g
tgaagatttcatgtctgagatcagttttaagaaggtatctagaaactcatggatgctctgnggaagctgagccctcagtaatcgtattttccccttcctgttatgtgtcctgcagaatctg

SEQ ID NO: 27391 - DNA, 121 bp, Artificial Sequence
  Synthesized
  misc_feature (61): n=t or g
gctacagaaaggcaggagcgtgttgcaaacgaggccgctatataccgttctattaataaanaaacgatttaatcaaatatgccgtattttgtacttctaaaggcttaggttgccttcttga

SEQ ID NO: 27392 - DNA, 121 bp, Artificial Sequence
  Synthesized
  misc_feature (61): n=a or g
caggatggggggactttgaagaatcgtcaagtccaacctcatctaaagcaagataaatgcntccagtgcttttgaggcagtgtatttgcccatggggacagaggtcccagatcatagctgt

SEQ ID NO: 27393 - DNA, 121 bp, Artificial Sequence
  Synthesized
  misc_feature (61): n=t or c
tgagtttgctttattgatttgttttggctgtatgtgaaaaaagaaccgagctttatcttangttggcactgtagtacagaaatgggagcttttgccctggtcagaatcaggccttcagtcc

SEQ ID NO: 27394 - DNA, 121 bp, Artificial Sequence
  Synthesized
  misc_feature (61): n=t or c
actctttcagtgtatctatctgccaatgccagctgccagtcctcgaggatatttacgtaangcctctgaggaccccttccgattttccatgacccttgactggaagtaaaggcaataagtc

SEQ ID NO: 27395 - DNA, 121 bp, Artificial Sequence
  Synthesized
  misc_feature (61): n=t or c
taccctgaattactactgctaaaggaagagatgtcacaaggtgatgaagccatcagcacgngctgttccaccgatctggaactggtctctccaggtatgactgttcagcgaggtgaacacc

SEQ ID NO: 27396 - DNA, 121 bp, Artificial Sequence
  Synthesized
  misc_feature (61): n=a or t
aaagctacctatgaccaaagcttttatttcagatttgttcttctcactgaataacacttangtactggcattagcaatagcacacacataaatgtgctgaattagatacaaaaggtaccca

SEQ ID NO: 27397 - DNA, 121 bp, Artificial Sequence
  Synthesized
  misc_feature (61): n=a or g
ttagccaacttaattaaaatgggtttcatcatttcttaggaaagtaaaactgtcttatcantgcacttgtacagttgtacagcacctggtttgaagctacacagctgctagtttgtggagc

SEQ ID NO: 27398 - DNA, 121 bp, Artificial Sequence
  Synthesized
  misc_feature (61): n=a or g
ttcaacaactggggaagcagcaatgccagtgctgagctctgccaccaacacagcactaatncagagaccaagcaggtggttgggagcatggatgcaaggaagtgcattttttaggttcata

SEQ ID NO: 27399 - DNA, 121 bp, Artificial Sequence
  Synthesized
  misc_feature (61): n=t or c
aaaggaagatatggccaaacaaaagtagtcaagagcagacagacatcgtgcataaatctantgcttggcattgattgcacaggggattttcctctatcagcaccaatggagataggagtct

SEQ ID NO: 27400 - DNA, 121 bp, Artificial Sequence
  Synthesized
  misc_feature (61): n=a or g
tgttcctgctgttcttttgttacttaaatacatgctcctccaagcatggtcttttctctcncttcaaactggagctgcgtggtaacactgagtcttaacactgcaagctttcccacagagt

SEQ ID NO: 27401 - DNA, 121 bp, Artificial Sequence
  Synthesized
  misc_feature (61): n=c or g
tttggttggtttttcgaaaattgttttaaaggagtctgagtgatttcttcagtttttactntaagagaagatgaccttttacattatactacaataaaagctaaatctaaattattctatt

SEQ ID NO: 27402 - DNA, 121 bp, Artificial Sequence
  Synthesized
  misc_feature (61): n=t or c
gtagtgctcaagtctcctcttaccaagtgacagccaacaggaaagaaggcttaaactcctncaaataacagcagcatttgtatgaatacagttttaagatttctcacttaactacacatct

SEQ ID NO: 27403 - DNA, 121 bp, Artificial Sequence
  Synthesized
  misc_feature (61): n=a or g
tgtgaggaggactgtgcaaatgagcaacggaatccttcctgctcatctaataatgcccagnatattcagatgagtttcgcctctttcagcactcgttcctataggtttcagataagccagc

SEQ ID NO: 27404 - DNA, 121 bp, Artificial Sequence
  Synthesized
  misc_feature (61): n=t or c
gcgagcacagaaggcatactcctgttgtatggcaaagcatgtggatttgttgtttttgtcnaatggtaatgtggccaccccctctgttgtacagtagtttttctcttttcagagcagtagc

SEQ ID NO: 27405 - DNA, 121 bp, Artificial Sequence
  Synthesized
  misc_feature (61): n=t or g
aaaacaaatacctgaagagactaaaagcaaactggcttcagatttgaactcacaacaaacngatccaggcatcttattcaggttagtactactttcatttctggaaaactaccacagaggt

SEQ ID NO: 27406 - DNA, 121 bp, Artificial Sequence
  Synthesized
  misc_feature (61): n=a or g
gatttctatatttccattcttttttgaaggaagatgttttcagaggtaggacatctttggncttgcgttattgagaggcctttgaatttttacctccacaggtttaggtctttcagaccca

SEQ ID NO: 27407 - DNA, 121 bp, Artificial Sequence
  Synthesized
  misc_feature (61): n=t or c
ttggaatgctctgcgtttttgttggttttccttatatagcttctagaaaaatcaaagtccngtgttatcatttttcattaaactgatgtttttaaccacagtggacagctctcatatccct

SEQ ID NO: 27408 - DNA, 121 bp, Artificial Sequence
  Synthesized
  misc_feature (61): n=t or c
ccgcgacagcacagctccgctacaacacttcgctcgcgcgttcgctttcgtgaagtaatantgcggcttacataagcggcaaattacaaaacattttctctcaccacagaatcatctggat

SEQ ID NO: 27409 - DNA, 121 bp, Artificial Sequence
  Synthesized
  misc_feature (61): n=t or c
aagggtggccatccagcagcacaaagacactccaagctgaaccacagagacagagagctgngctgttccttccaccaccatctcccaagaacccacccagggacgttccctttttgagagt

SEQ ID NO: 27410 - DNA, 121 bp, Artificial Sequence
  Synthesized
  misc_feature (61): n=t or c
ctcccagattacccccggaatgcagtcccagttcatgaacagtttcggctgctatcagcangagccatgctgctcctctactgaacaaactacgacctcagtgccacccagcatcgctcct

SEQ ID NO: 27411 - DNA, 121 bp, Artificial Sequence
  Synthesized
  misc_feature (61): n=c or g
ttctcgtatcttgtattaggcagctccaggtttcaggttttagtagtcaagggcaacctancctcagcaaggactgcaattctactgtgtgagccccctagaccgggaaacattagtatta

SEQ ID NO: 27412 - DNA, 121 bp, Artificial Sequence
  Synthesized
  misc_feature (61): n=c or g
aagatggataaatgtgaccttaaaattagaggggtaaaattagtccacaacctcctatctntgcctttcaaccaggaagtcttgtttagggaaatcttaaatcctggagtttacctgatgg

SEQ ID NO: 27413 - DNA, 121 bp, Artificial Sequence
  Synthesized
  misc_feature (61): n=a or c
ccgtttaggaatgggaaccgctgtgggttttaattttaccaccatcagtggatgcgggaanggctgcaaaggcgcagagagggacgcgaaacctttgctgggttttctttggccaattcag

SEQ ID NO: 27414 - DNA, 121 bp, Artificial Sequence
  Synthesized
  misc_feature (61): n=a or g
cagatgaagtggatggaggttttgcttctagctttattaagagttagaataacttctaggnttagagaaggaaattgttcatttaaaattttgcgttggaaacctcacactgtaaatttaa

SEQ ID NO: 27415 - DNA, 121 bp, Artificial Sequence
  Synthesized
  misc_feature (61): n=a or g
atttcttggtaccctgagagagtgcactgtgtgtgtgtatgtatgcttgaagtacacacanaatggaatttttagtgcaaggtgtgcagtgatgcatcacatgctttattacattgttgaa

SEQ ID NO: 27416 - DNA, 121 bp, Artificial Sequence
  Synthesized
  misc_feature (61): n=t or g
atcgctcatttgaggggaagaaatggtcttatacatcctactgtggattctggtttactgncattaactgtcaccatgtgtgaacacattataaaaactgaaatgagcagcaccttatctt

SEQ ID NO: 27417 - DNA, 121 bp, Artificial Sequence
  Synthesized
  misc_feature (61): n=t or c
atcgtggctcctttaaccgccatttctaagcttcagctgcagacacctctgcatcaaaacngagggcactttcggttgccgtccttcattataaatcctccagcagtacggccaaaaatgc

SEQ ID NO: 27418 - DNA, 121 bp, Artificial Sequence
  Synthesized
  misc_feature (61): n=t or c
tgccgcccccgcccgccccggcctccattgcagataatgctgtattggattagtctgcctngctgctgcatcaggtcccagatcgatttattgactctgtcagagtggctactacagtaat

SEQ ID NO: 27419 - DNA, 121 bp, Artificial Sequence
  Synthesized
  misc_feature (61): n=t or c
ccacctctggttaagtcagaacagaatggctaacatgcaggaaattagcttgggttaacanctgtaactctgaccttcatggactgctacacagtgttcagtattctgcactgagtaatga

SEQ ID NO: 27420 - DNA, 121 bp, Artificial Sequence
  Synthesized
  misc_feature (61): n=t or c
gcaccaccggaagcaacccggttctgtcttcttttaacccagaatactagatttgggatantggatattctttacacctggaatattcttatactggaaattgccagaacaagaaatacat

SEQ ID NO: 27421 - DNA, 121 bp, Artificial Sequence
  Synthesized
  misc_feature (61): n=t or c
ctcatctaccactccatcatatgttcacatttgaaaagttctcctaactattttgatcttntgcagttgttgctggttgtttatctacattacctcttggaccctatgcttgtttcataaa

SEQ ID NO: 27422 - DNA, 121 bp, Artificial Sequence
  Synthesized
  misc_feature (61): n=c or g
cagcgcagggaggagacgccaaaatcattagtttgaaagttctgaggtaattaggaagttnaacaaacttgaaccagcagcacactctgtgcaaaggggaaaatacagttcaatgagaggc

SEQ ID NO: 27423 - DNA, 121 bp, Artificial Sequence
  Synthesized
  misc_feature (61): n=a or g
aaagggcacagccagactcaaggcctgcaattctctcacatgcattagaagattctagatnggtgcaatatttggctaagtcgcttgatagagagtggtagcagaaattaccagatggtaa

SEQ ID NO: 27424 - DNA, 121 bp, Artificial Sequence
  Synthesized
  misc_feature (61): n=a or g
acaagggagcaggaacagattctagaatgaaacagtgggaggagccggaggactcacagancagcagccacaaggaatagcttccaggatcagagtctaattatctaaaataaaatgacag

SEQ ID NO: 27425 - DNA, 121 bp, Artificial Sequence
  Synthesized
  misc_feature (61): n=a or g
gtggtccttttcaacccaggccattctatgattttgtgatttgggacaaaattccacaacngattccccagccacagaatatatgaaccttccttaagagaacaacaggatagggcagtgc

SEQ ID NO: 27426 - DNA, 121 bp, Artificial Sequence
  Synthesized
  misc_feature (61): n=c or g
agtttagcagtgtttgggtctgtatggatcacacagcacctcagcagtttaaattctctantaaaattactgaaagcatttagcgtacctatgggcatgaggtcagacaatcacggaaact

SEQ ID NO: 27427 - DNA, 121 bp, Artificial Sequence
  Synthesized
  misc_feature (61): n=a or t
agcacattgggggaaagaacagaatcagtttagagaaagcagatgatccagccatactgcngccacatcaccaaaaacattaccaaagcatgattataatggaattcgaaagccaatggca

SEQ ID NO: 27428 - DNA, 121 bp, Artificial Sequence
  Synthesized
  misc_feature (61): n=c or g
gttaagatactaaataaaactttttgataacaactattttataccctctccctttttcttnctctcttttatttttggctagagttctctgatgacagttttggaacaaatcagaacccac

SEQ ID NO: 27429 - DNA, 121 bp, Artificial Sequence
  Synthesized
  misc_feature (61): n=a or g
ctgaagttaatgctgaggagtagctgccagcaactgccagcttatttctgcatctccacanataaaatgatgcttacataagacgtcaaacaggcttataccttagtccttgaacacggta

SEQ ID NO: 27430 - DNA, 121 bp, Artificial Sequence
  Synthesized
  misc_feature (61): n=a or g
gcactgctctttagggagctttggaaactggagtgcatctgagtgcctaagcagtgctacngaatgtgttttgaaaggaggagataccaagctgtgttgtgattgcaatctctccataagg

SEQ ID NO: 27431 - DNA, 121 bp, Artificial Sequence
  Synthesized
  misc_feature (61): n=t or g
ccctgcctcccctgtaccccactggctcagccccattccctgtagaggggataatgtgatngaatactggaaagcaccaagtctctggtgttacagaagacatcaactcagcccccttaga

SEQ ID NO: 27432 - DNA, 121 bp, Artificial Sequence
  Synthesized
  misc_feature (61): n=a or g
atgcatttatgactgcaattactagattgttgttgtatgctaactgttgtcatttgtgtcntggtgggaggtcccaactggttaatgatgctgttgcatagcattaaataagtatttattt

SEQ ID NO: 27433 - DNA, 121 bp, Artificial Sequence
  Synthesized
  misc_feature (61): n=t or g
ggtctcagaccatcgtgatgcaaaatctgcggagccgctctccatagcactggaggttccnggagaaagaagagcaaagagcttgagaacctatcggtctgccacaaggcaggaggatctg

SEQ ID NO: 27434 - DNA, 121 bp, Artificial Sequence
  Synthesized
  misc_feature (61): n=a or g
catatgcatttatgtaagtaagtaaaacttggttctacagtaatttctgtgataggcatanaaattagaaatcacatgggttactttttcatgctgatacgttcacaaacaccttataaac

SEQ ID NO: 27435 - DNA, 121 bp, Artificial Sequence
  Synthesized
  misc_feature (61): n=t or c
tttaaaactaagaaaagttcaatagaaagatactaccaaagcgcagcattagcagtcttanagcaataacacctttcagttgtacagtgacaaaaagaaaaacatcaacacacaaaaccaa

SEQ ID NO: 27436 - DNA, 121 bp, Artificial Sequence
  Synthesized
  misc_feature (61): n=t or c
tgcacacttcttcagcacttttgagatcttcctgctttgaaaaatgagtactctgattgantgcatggagttaggtctcttttaatgggcttccaccttacaagattacgtttatgattac

SEQ ID NO: 27437 - DNA, 121 bp, Artificial Sequence
  Synthesized
  misc_feature (61): n=a or g
gaatctatgtggccctaattgaagcaacagtgtttcttcgttgtctcattcttactaagtnaagaccttaagcaagaacttagttttcctaacatttctatggcagaatgcagactcaaac

SEQ ID NO: 27438 - DNA, 121 bp, Artificial Sequence
  Synthesized
  misc_feature (61): n=a or g
tgtcatgccttgagtctttgtttctgtacagctaattgaggacctctcctctctctgagcntatgtccttaaaaataaatgttcttctgttttgttctgtgtacctcttcagtctggtgct

SEQ ID NO: 27439 - DNA, 121 bp, Artificial Sequence
  Synthesized
  misc_feature (61): n=t or c
gcgtgaagttccaaagactccagcttatcttcttgtccagtattatgtgtaagtcagcacngtaacgctgacaggttattcctcattggttgaattctcatcccaccaaaccatctctgta

SEQ ID NO: 27440 - DNA, 121 bp, Artificial Sequence
  Synthesized
  misc_feature (61): n=a or g
tgataaatctggcagggaagatttagtaacatctaaaaacctgtttagttattacatcagnggcagatttattggaacgagaacagggaggtctcctgtacttgcagacagaccaagaata

SEQ ID NO: 27441 - DNA, 121 bp, Artificial Sequence
  Synthesized
  misc_feature (61): n=a or g
tggaacagatatcacagagctgattgaacaccattccaataggattaaatgctgttttaanggaagccagggaacaacccaaggaaccatggcaaatttgggtagtaatactccctccttc

SEQ ID NO: 27442 - DNA, 121 bp, Artificial Sequence
  Synthesized
  misc_feature (61): n=t or c
cgtttagtatacgtggactgacatctaagtgcagtcagtttttattaatcatctctgcacngtgaactgactgaaaataactatgcttcaagagaagcctgtgggaacaagcaaggcacaa

SEQ ID NO: 27443 - DNA, 121 bp, Artificial Sequence
  Synthesized
  misc_feature (61): n=a or g
ggccttgctgttagtgttatgtgcatggtacttgactcaaaaaattgaggtgagtgttcantgacttggaactgtagaaatctgaagatacagctctgtgttttttaaattttgtttgtaa

SEQ ID NO: 27444 - DNA, 121 bp, Artificial Sequence
  Synthesized
  misc_feature (61): n=t or c
aagctctacatcattgaaattaacttttctccctgttttggtacagatgagtaatcctttnaagtagcaaaatgtgctgttatcaaaacaggcagcacttacattggttttaattttcctt

SEQ ID NO: 27445 - DNA, 121 bp, Artificial Sequence
  Synthesized
  misc_feature (61): n=a or g
atctattaaatcaaattgttgtctctccctctaacaaactgccataggtgaggccatcagntgcatatcaaactggtgtcgtgtcagtgactgacacagcgatcccctcttgtgggagacc

SEQ ID NO: 27446 - DNA, 121 bp, Artificial Sequence
  Synthesized
  misc_feature (61): n=t or c
gaatataaggataatcttcatgttccctgctcgctgcacgagcttccttgtaagactcttnaacatgctcacactacatcatacttacactgagtactacatactcagtaaacattcattc

SEQ ID NO: 27447 - DNA, 121 bp, Artificial Sequence
  Synthesized
  misc_feature (61): n=a or g
aatgtgagaaattttgattttgttagtggtgactttattggggtgctaattcataagcatngcatgctaatctaaaatacctgtaacatggccaaaatgccagtcagccagtagaactttt

SEQ ID NO: 27448 - DNA, 121 bp, Artificial Sequence
  Synthesized
  misc_feature (61): n=a or c
tccattcctcccctcccccagaaatagagctactgtagaatacacaagatttaaactggtntgactgaggtgaaaggttgactatagtccctcttatttcccggtgctttctcttcatgaa

SEQ ID NO: 27449 - DNA, 121 bp, Artificial Sequence
  Synthesized
  misc_feature (61): n=t or c
gagtaatttttatcatgaaaatgcaatctaaacaatcttaagaatttaaacgccgcttgangtaaatctcttagagaataatacggtgttacttcttaaaataaatattccttttgcttaa

SEQ ID NO: 27450 - DNA, 121 bp, Artificial Sequence
  Synthesized
  misc_feature (61): n=t or c
tcatgtgcgacatcccaccaaacaccacttttccattaacctatagccagtgtgcagcaancaagtttatgaagatctggcaagaggatgctttgagaattctgatttaacatgaggacag

SEQ ID NO: 27451 - DNA, 121 bp, Artificial Sequence
  Synthesized
  misc_feature (61): n=t or c
gtcaagcttccagaactttgagtgttctgggggaagttttgatgatttcatgtagaaaatngtgtctctttgcttagtatctcgaactcagtgctttctggtatggatgctttgagagtag

SEQ ID NO: 27452 - DNA, 121 bp, Artificial Sequence
  Synthesized
  misc_feature (61): n=t or c
tgtctttaaggatcagtagcttttgctctcagcttgcaaaagccaggagtgctgctggtangaatagatacatagagaatccagagagattttgcccaggcgtgctgggtaagcttgtcat

SEQ ID NO: 27453 - DNA, 121 bp, Artificial Sequence
  Synthesized
  misc_feature (61): n=a or g
gtaggaaattatgccacattacaacataacacttagtgctgagcccacagacaagctaggnaactgtgttctactttcttcaatttctggccagccacattcacacacataacacattgca

SEQ ID NO: 27454 - DNA, 121 bp, Artificial Sequence
  Synthesized
  misc_feature (61): n=t or c
agtgtacaagtgcctttgcacacagagtctgctgtgaacagcctcatcacttacttttcanaaaaggttggtagtcagaggaaaaaaacactgcacagagtatttttcttgctgcacctca

SEQ ID NO: 27455 - DNA, 121 bp, Artificial Sequence
  Synthesized
  misc_feature (61): n=t or c
tgatccagtgacacagtgcatcaactagccttgcaggcatgttccagcctgatgaaataangcagaaatgtgaaataaagcagcagtaaaacacacagaagaccaatttaacactgtattt

SEQ ID NO: 27456 - DNA, 121 bp, Artificial Sequence
  Synthesized
  misc_feature (61): n=a or t
tctcatcagataagccaccgacttgcctaaccatgctagttcgcttgccacagagcccagncctaagacctcaaagtacttctggatatgttcagttttctatagcctgtacacttcccca

SEQ ID NO: 27457 - DNA, 121 bp, Artificial Sequence
  Synthesized
  misc_feature (61): n=a or c
atcaaagcagtgcaaccataaatgaaaatcactgatgattttttaacttaattaatatttnatgataaaggtgttccagatttaagaaaaagttcaacccagattttcactttgcattttt

SEQ ID NO: 27458 - DNA, 121 bp, Artificial Sequence
  Synthesized
  misc_feature (61): n=a or g
agttgagtaacgaaagagctgaatggtcttcaatcttcaaaccacagtttcaagttggcancaattttgtgaagtgtgatttccacgacagtttctattgtttacaataatcctttcatca

SEQ ID NO: 27459 - DNA, 121 bp, Artificial Sequence
  Synthesized
  misc_feature (61): n=a or g
gtaccagcaccggtacaggcagcacagcttaagaaacagaaagatgtcactgaggagcacntagtgccagctcttgctctgcccttctgcagctgtccagctctgggagtgctgccaaagg

SEQ ID NO: 27460 - DNA, 121 bp, Artificial Sequence
  Synthesized
  misc_feature (61): n=a or c
ccagaagaagaagggtaggcacagccattccctatttgcaatgacatgattttatataagngataagataatgagctgaatcattaaggttggaaaagacctctgagatcatctagttcaa

SEQ ID NO: 27461 - DNA, 121 bp, Artificial Sequence
  Synthesized
  misc_feature (61): n=t or c
gaagaaacagattcagagaggtactactgtgtgccttctaaacagctatcattggacaagngtttaaaaaccaataacacactgatggaaaaatttgccagtttttttcatcctataagta

SEQ ID NO: 27462 - DNA, 121 bp, Artificial Sequence
  Synthesized
  misc_feature (61): n=a or g
actcatcagcaaatcctctaggaactgtgctctctgcccattataaacactaagtaaaacntttcagcttaagacacaactgggtgggagcacccagtcagcaagacactgctgatgagca

SEQ ID NO: 27463 - DNA, 121 bp, Artificial Sequence
  Synthesized
  misc_feature (61): n=t or c
tgagaaatatttgtgctttctttgaactcagtttattctaaacatctctattacagcctcnaataacttttctgcataatctttgtgtaaaaattcttggcattacttatacatttagtaa

SEQ ID NO: 27464 - DNA, 121 bp, Artificial Sequence
  Synthesized
  misc_feature (61): n=a or g
caccaatagggtcattgctgaattatggtgctggttaccctcaccagatcatcctgacacntagctgttgctgggcacagaagacaaactgattggaaacatgctactctgtgcctgggtt

SEQ ID NO: 27465 - DNA, 121 bp, Artificial Sequence
  Synthesized
  misc_feature (61): n=t or c
aaaaaaaaaaagcagataatatcctagctcttcacatatttgcacacattctttctaagcngtagagcacttctctgtaaaaccatcagttgccagaatgaatattaccaagtgtgccata

SEQ ID NO: 27466 - DNA, 121 bp, Artificial Sequence
  Synthesized
  misc_feature (61): n=t or c
agagcttccttgtggctgcacactgctctgcacctcccacccaccttataggcttccatcnggacagcaaactgggttcagccccatttgttcagtattctgtcgggctgctgtgtaaggt

SEQ ID NO: 27467 - DNA, 121 bp, Artificial Sequence
  Synthesized
  misc_feature (61): n=a or g
actctgtgagaagggaataaaggacaggtatttaccatgagaactcagcaggaatacgccnaaaccatgtttaagtttcaaactctaaagaaatgatgtttagaaaacagaattcaatgca

SEQ ID NO: 27468 - DNA, 121 bp, Artificial Sequence
  Synthesized
  misc_feature (61): n=a or t
cagaggagtttcaatgaccgaatattatctcagatgtattaaaacattgtctaactcattncaaaaatgtcttggtcaacaaaaagaacaatgctgtaagcaacagagggtaccaataaaa

SEQ ID NO: 27469 - DNA, 121 bp, Artificial Sequence
  Synthesized
  misc_feature (61): n=t or c
aatgggaacctatttgagctctatttacacgccacaaacccaccaggtcccaggggaagtngaacaactcacgcctgcgctacatcacaagaaaagctcgtttaaggaacgaagcaatggt

SEQ ID NO: 27470 - DNA, 121 bp, Artificial Sequence
  Synthesized
  misc_feature (61): n=a or g
gaacaagcatccacatacagagttctataagtaatcttgctcttgagtaattttttatcantgacaatctagcaatacttggctaaggtaagtgtagcattttagcaactgtaaacactaa

SEQ ID NO: 27471 - DNA, 121 bp, Artificial Sequence
  Synthesized
  misc_feature (61): n=t or c
ttcttgctcttgctgcaagtgtagctcattaacgctgaggttctgcactctgttttccagngttgtgtttatctgcgatgtgtttgtgagaggcctctctgtggttgtgagggaaacaaag

SEQ ID NO: 27472 - DNA, 121 bp, Artificial Sequence
  Synthesized
  misc_feature (61): n=t or c
tgaaggcagaagggtcaagctgcagctgtgatctgctgggttgggctgctgttgttttcanaggacttggacatgactggaaagaggaaagggcgggtattctccatgggataaaacttgt

SEQ ID NO: 27473 - DNA, 121 bp, Artificial Sequence
  Synthesized
  misc_feature (61): n=t or g
catgagaagattctaggtagtgaggacaagtacccacctccccagcttttgatgctcttcntaagaagtgaagtggaagaggccgtcccaaatcaaagttcaattctttcagaatcgtgat

SEQ ID NO: 27474 - DNA, 121 bp, Artificial Sequence
  Synthesized
  misc_feature (61): n=a or g
gaaacaaagatttgattcagttgttcttctgtcctgggatcattctccactgacttgtcangacaagcttcatgcactaacactgactcaaaagcctcagtcacattgcatttattttcag

SEQ ID NO: 27475 - DNA, 121 bp, Artificial Sequence
  Synthesized
  misc_feature (61): n=a or c
tactgcagggctttccagtataggctgctgaatacatagtagtttgacattccctccctcnaccaaaaaacacaacaattaaacctcaccgtgcttttgccacacattggaactgctctgc

SEQ ID NO: 27476 - DNA, 121 bp, Artificial Sequence
  Synthesized
  misc_feature (61): n=a or t
gctggttttgttattggttctttttcctgtctgctgacaagggagcgttttgtatactcangctcttaggtcataaaactgaaaaggcctttgcttgaacctgagacatgttgattgaagc

SEQ ID NO: 27477 - DNA, 121 bp, Artificial Sequence
  Synthesized
  misc_feature (61): n=a or g
acttctgcacattcctttgcctctgagtacaagtacaaccacaatttgagtgctctatttnagagctaaaaagacatgaggcttttttagctctttggtgtgctacccagaaagcaatggg

SEQ ID NO: 27478 - DNA, 121 bp, Artificial Sequence
  Synthesized
  misc_feature (61): n=a or g
gtgattcaactgcaataggttattgtgcgtgggtgaagaacttccttctgcaactgcaaantatctaatgtcatattggaatagttactttgtctccctcatttaacccgaaaatcacgca

SEQ ID NO: 27479 - DNA, 121 bp, Artificial Sequence
  Synthesized
  misc_feature (61): n=a or c
tgaccttaataaactacacacgatcctctaacttagatttgctgatctttgcacacctacncagcccgcatgagggaagcatgaggcagaacctaaatgtttcactggctgtggctcattc

SEQ ID NO: 27480 - DNA, 121 bp, Artificial Sequence
  Synthesized
  misc_feature (61): n=t or g
ctctcaagggtaaataatagccccgtgttttaggtagtttatcccttaccagattttctcncatttctagctatctgctctagtacatctaacgtgtaactgcgaagttagatgggttact

SEQ ID NO: 27481 - DNA, 121 bp, Artificial Sequence
  Synthesized
  misc_feature (61): n=a or g
agtctggagtcctttcttcagatgttctgttgctgataccctgcccaagtgttagcacgcnttcacagaagaccttcagcagaagctctaataaagactttacgtagtagtgaggttattt

SEQ ID NO: 27482 - DNA, 121 bp, Artificial Sequence
  Synthesized
  misc_feature (61): n=a or t
tagaaatcagaaacttttgaaagaaaatatcagttttacacaaaatttgtagcgattaccnttagtaggtgtttagatacacaaaatactgaaagcagtaatccatcagttcagttacatg

SEQ ID NO: 27483 - DNA, 121 bp, Artificial Sequence
  Synthesized
  misc_feature (61): n=t or c
ttttccattctgtgccaccaatggaatggatttttgggggggaccactgggaggtgacccngcagacttttagagctctttgcaggaggatgggatggaggagcgtggggctggtgctgtg

SEQ ID NO: 27484 - DNA, 121 bp, Artificial Sequence
  Synthesized
  misc_feature (61): n=t or c
tgccttccatgttgagcagcagaacagtgcagaccatgaacacagcagaacgtccaaacancacagggaggagggcactgccttggttctgtgcagaatgtcaaatagcaaaatgaggttt

SEQ ID NO: 27485 - DNA, 121 bp, Artificial Sequence
  Synthesized
  misc_feature (61): n=a or g
agttcgtgcacacataagttcctccatctgcagatcttggctagagcttcccagtccagantagcaatgcaggtggaggtccctttctgggatgaagaatggagattccttctcagagttt

SEQ ID NO: 27486 - DNA, 121 bp, Artificial Sequence
  Synthesized
  misc_feature (61): n=a or g
atcgccaaaatttcacaacagaacctcgaatgtcctatgtggaattcattgtttggaaggnagtgaatgcattcgagctttggcccagctcagatatatttctgactacaagttgcttagc

SEQ ID NO: 27487 - DNA, 121 bp, Artificial Sequence
  Synthesized
  misc_feature (61): n=a or t
gtgctgctaattgttctcaccgagctattgttaaggtagctgtgtacacatgaactgaacngcgaagacatttttgagatcatatatttggaaacctgaggcagtacagaagagcagcagc

SEQ ID NO: 27488 - DNA, 121 bp, Artificial Sequence
  Synthesized
  misc_feature (61): n=t or c
tcataagactaccatgtttacatttcatgtatttatgcttccactgagtttcaagaccaangcttcagaagggcattagttcagccccacctgcacacagtactttttgtgtagatgcata

SEQ ID NO: 27489 - DNA, 121 bp, Artificial Sequence
  Synthesized
  misc_feature (61): n=t or c
ctttacgctcaaccacacaaagcaggtgaggtcatgcagaggaataacttttaaggttcanatgcaggaaggaaggatgttctcttttctcatggtgtttcaggtgacccttctgactcga

SEQ ID NO: 27490 - DNA, 121 bp, Artificial Sequence
  Synthesized
  misc_feature (61): n=a or g
caaccacccaaacctgctgtcacagctaagccagataaaagacagttccagataggccagngtgcaacagcagtggtgacaactgtatttatggggcaactggttacaggcagcagtatga

SEQ ID NO: 27491 - DNA, 121 bp, Artificial Sequence
  Synthesized
  misc_feature (61): n=a or t
tctggaagttttcttttctagaacctgtatcatcacttagtaaacaggtatcagaagcaantttctgaagagcccacctacatacagaattttgcagcttctattacatcaagtcataaaa

SEQ ID NO: 27492 - DNA, 121 bp, Artificial Sequence
  Synthesized
  misc_feature (61): n=a or t
ttaaaagtctgatttcctagcatgatagttatcagttgcaaatgcagaactgaaactgcanaacacctgaagtggcaatactgcatggtcttgtcaatcagtcctgaatcccaggaggtgg

SEQ ID NO: 27493 - DNA, 121 bp, Artificial Sequence
  Synthesized
  misc_feature (61): n=t or c
aattttaccaacagggctaattgcagatattgaaccaaagttctgactatttcagttttgntctgatttttcctacctctgagtagcagcaaatgtttagttgtcctctttgtgttgcatg

SEQ ID NO: 27494 - DNA, 121 bp, Artificial Sequence
  Synthesized
  misc_feature (61): n=a or c
ttcatgcttgaagatgagtgacaggatgtatttccattcccattcatgtggctaaaaaccntttatgcaattgctacaacttactgtttaaaaatgaataatagcacactaagggttctta

SEQ ID NO: 27495 - DNA, 121 bp, Artificial Sequence
  Synthesized
  misc_feature (61): n=a or c
agatgacttcagtaactagctgagtcctaggtatctagggtttcagttattgtttctgagnacttatggatatgaaatagtaaatcctttgtcaattgggaactacatttaaatagcatct

SEQ ID NO: 27496 - DNA, 121 bp, Artificial Sequence
  Synthesized
  misc_feature (61): n=t or c
tgattttgacaaaagtaactgtgcaactctgcagtaagcagaggaatacaatacagatgtngagttaactgactctgcattttactttaaaataggctttgcaggcatccagccaagaaat

SEQ ID NO: 27497 - DNA, 121 bp, Artificial Sequence
  Synthesized
  misc_feature (61): n=t or g
tactatccttgctgtatgttgacatttaactggaaagaatgctctctttttgataacttantctgttaaaaactctagacccactctctgtaaagagaacacagtttcttgtgaccccaaa

SEQ ID NO: 27498 - DNA, 121 bp, Artificial Sequence
  Synthesized
  misc_feature (61): n=a or g
ctccctgtgtatagtagagtttgaactaaaattagtatttttactgtttagctgctagatntacaactgaaaactactgagctatgcagatatgtcacaggtactggctgacgtgcatctg

SEQ ID NO: 27499 - DNA, 121 bp, Artificial Sequence
  Synthesized
  misc_feature (61): n=t or c
gcaaattctgctggctatccctgagagtcacatgctgttctgccctcctttgggcatgcangacactagggaggaaagttcaagctacagtcaaaggtaccactccattcctggtacaaac

SEQ ID NO: 27500 - DNA, 121 bp, Artificial Sequence
  Synthesized
  misc_feature (61): n=t or g
gccttgggtgttccttacctgtgttcatgtttttagtaatagggtaaacctgtatagaatngaaaatgtgagatgttcaaagcttatgctttccttcaaacttacgaaggtgcttatctca

SEQ ID NO: 27501 - DNA, 121 bp, Artificial Sequence
  Synthesized
  misc_feature (61): n=a or c
ttctgtgcaattgctatcataatagtatgtgagtgtttagaggattgtgtgaaaactcttntggagcataatacactactctccttcaggataagggaatacacactcaaggatgcatgct

SEQ ID NO: 27502 - DNA, 121 bp, Artificial Sequence
  Synthesized
  misc_feature (61): n=t or c
gcacagtttcaatgctacagatatgtagttattctaggtcccacagcattttagttgtaanggtagaatttcttttttaatactgatttttatttttatttttttaattgcacatcaaatt

SEQ ID NO: 27503 - DNA, 121 bp, Artificial Sequence
  Synthesized
  misc_feature (61): n=c or g
aaacagagcgaggtgacgattctgtttcattcagtttgagtagatagaaaaatccaactanagcctggctcactacctgcaaaacagcgttttcagtgtcaacgggcaaagaactgttgaa

SEQ ID NO: 27504 - DNA, 121 bp, Artificial Sequence
  Synthesized
  misc_feature (61): n=t or c
tgcatactgtactatgtgggacaagaaatagttaactgaatttatggtgcttatagtctgngttccacaagaggcaattctgggaaaggaatatttacacattcattacacagcatcaaat

SEQ ID NO: 27505 - DNA, 121 bp, Artificial Sequence
  Synthesized
  misc_feature (61): n=a or g
atttgaactacatgcaatctttagcagatagacaacacaagattgtgtttctgggaatgcntgacatggttgacactcattcgatggtgctgagcatctcagcagaagagttgagcatcct

SEQ ID NO: 27506 - DNA, 121 bp, Artificial Sequence
  Synthesized
  misc_feature (61): n=a or g
aaaactttgtgatctccaggagatgctttacatgagcccactggaatgcagtcaggaaganggaacgctgtgacttgcagactgcagcaggagctttcatccactctgggctcacttggag

SEQ ID NO: 27507 - DNA, 121 bp, Artificial Sequence
  Synthesized
  misc_feature (61): n=a or g
gtgcagtcacctctcttcccagcagcctgtgtggtggtgtgctttgcatttggggctaacnccgtgtcagtaacacactggtgttctggctgctgctgaacagtgctcctacagcattgct

SEQ ID NO: 27508 - DNA, 121 bp, Artificial Sequence
  Synthesized
  misc_feature (61): n=t or c
gggcatgggaagcttaaaataaaataatgtaggataataatgtaaaaggtactgcaggcanacaaagagaaggaaggcatgaaggtgtgtcatgctgtgaaggtcaagaatgaccaatatc

SEQ ID NO: 27509 - DNA, 121 bp, Artificial Sequence
  Synthesized
  misc_feature (61): n=t or c
gaatgaattcttcagttaacaagtattatatactcagcctcaggtttataatctgctattnctaatagccctgattttgtgctgcctctggggaaactgtagaatgaagtactactattca

SEQ ID NO: 27510 - DNA, 121 bp, Artificial Sequence
  Synthesized
  misc_feature (61): n=t or c
tttatctttgaacttatcttttcatgccagttctgctcattacttttacctttggaagtanaggtgaaaggaagtgctaggtttacatatatcctcttatctgaccaaagcacacccattc

SEQ ID NO: 27511 - DNA, 121 bp, Artificial Sequence
  Synthesized
  misc_feature (61): n=c or g
taaaacagttgtcttcatagacttgaacaatggaaagttttcttgcactgtctttggtatntttaaatcaacaaaaggtatctctactctacattttctgttaacatatagctttatttaa

SEQ ID NO: 27512 - DNA, 121 bp, Artificial Sequence
  Synthesized
  misc_feature (61): n=t or c
atcctacctcacttctatccttcttcaacaagaggcagcagaggctgagcttctccattcntctcagaaataaggaggctgaataggtttgctacttgtattccccacagagtaccaatgg

SEQ ID NO: 27513 - DNA, 121 bp, Artificial Sequence
  Synthesized
  misc_feature (61): n=a or g
tcctactaaaattctctacgatttgtctctataatttgacttgctcttccctgtttttcanaacttgtctagtgttctatagtattttaatatttgaaagtccatgtttaccttcccactg

SEQ ID NO: 27514 - DNA, 121 bp, Artificial Sequence
  Synthesized
  misc_feature (61): n=t or c
caaatcctcagagcagtgccagcatcccagattctgcagtgctgccatctcctgccttgtnctgaggagagatgcagtgcctcctaagcttgctgaatctcagaacagtttgataacggag

SEQ ID NO: 27515 - DNA, 121 bp, Artificial Sequence
  Synthesized
  misc_feature (61): n=t or c
cccacattagtaacatttacccgcaagctaagatgcaaagcagtcctggtttccctgaagngtgcactttctgtatgaatgaaaacacaccaaacttggttgagtttctgcaggtaaacac

SEQ ID NO: 27516 - DNA, 121 bp, Artificial Sequence
  Synthesized
  misc_feature (61): n=t or c
tctctaccctgtatcaaattcctagagatgggacctgttcctctcctctgtgaagatggcnctgagcactcaggtgcattggctgacttctagttatagcaagaaatggagaaacctccga

SEQ ID NO: 27517 - DNA, 121 bp, Artificial Sequence
  Synthesized
  misc_feature (61): n=a or c
ccagcaatggactttatgccaaatgagtcagctcctgccgtggaggaagatctacaattgntgcagagagcaacctctcagtgtgtgcagttgcagacaatgcttaaaagtctcatcaagg

SEQ ID NO: 27518 - DNA, 121 bp, Artificial Sequence
  Synthesized
  misc_feature (61): n=a or g
gccagtaaaactaaaaaacattgccacttactgttttttaagtgacttttaactcaagganttgcatacaaaaaagccaggataaacacatacagccggatcttcgcagagccagatcaaa

SEQ ID NO: 27519 - DNA, 121 bp, Artificial Sequence
  Synthesized
  misc_feature (61): n=a or t
tgtatgctaggaaacaggctcttataacacgcagtcaagagctaagccactcagacccacnaatcacctaaaaatcattgccatgaccaacagaaatattgttaagacaggttgatgtctt

SEQ ID NO: 27520 - DNA, 121 bp, Artificial Sequence
  Synthesized
  misc_feature (61): n=a or g
catcttaaacttttagatagagtttaaggggaaaaaaaacccacctgatctgacacaaacnatgcaaaagtcactcccaatacagaacaaatgcagaacaaaagaaagaggcagatgaaaa

SEQ ID NO: 27521 - DNA, 121 bp, Artificial Sequence
  Synthesized
  misc_feature (61): n=t or c
gtagtgattaagagttcaagttcacaattttctccattgcaaaaatggaggttgaacaaangaagtgagcaagagactagttcaaatctgaagtagttaattcacttgagagagagagagt

SEQ ID NO: 27522 - DNA, 121 bp, Artificial Sequence
  Synthesized
  misc_feature (61): n=a or t
tagtccttcgttttgctcttccagtaggctgctgccttttatacttcatctgacaaactgnatatgtttacactaattcagtactgaaaagtaactacatctcataaaatttcaccattaa

SEQ ID NO: 27523 - DNA, 121 bp, Artificial Sequence
  Synthesized
  misc_feature (61): n=a or t
ttctcagaacactatttataagctcatgatgagatctcctccaaaggcattagaactgttnattaaaaagtgccagcattatgtatttttccaactaataagttctgtatacctttcagta

SEQ ID NO: 27524 - DNA, 121 bp, Artificial Sequence
  Synthesized
  misc_feature (61): n=t or g
atttccttaattcagcaaaaagtgctgaaagtcttattcagattagagggagaatttccancttatttcatacttgaatactccattctccttgagttgttcgatctcatgttaataagtg

SEQ ID NO: 27525 - DNA, 121 bp, Artificial Sequence
  Synthesized
  misc_feature (61): n=t or c
ttactgtgtgtaagtttactacagaactgtagctgaactattgccaactgctatcctgtgnagcttaagggttcgtaaagatattaatctaatcttgctcaaagcaaaagattgtgatggg

SEQ ID NO: 27526 - DNA, 121 bp, Artificial Sequence
  Synthesized
  misc_feature (61): n=t or c
attagcttctatcctgtcaaatatttcaatacgctgtttttaatacgttcaatatacactnaatttgcactgcattgtgctaagttttaaagagcatcttctgatactgtggtgtttatca

SEQ ID NO: 27527 - DNA, 121 bp, Artificial Sequence
  Synthesized
  misc_feature (61): n=t or c
tgcatccatacaatttcatatggacagtatcacagaacatgacttatacacttgttttctnttgctctgtcgatactcatattgtaaaatctcagtcactgtgaccttaaaatccaagcac

SEQ ID NO: 27528 - DNA, 121 bp, Artificial Sequence
  Synthesized
  misc_feature (61): n=t or g
gaatgaatgggtgagtgctgaggccatggtgctctttcagcttagtttgaatatcattatnttgattatatatctatcttgatagtgccctggtgaatacttaagggacaaacagcagcta

SEQ ID NO: 27529 - DNA, 121 bp, Artificial Sequence
  Synthesized
  misc_feature (61): n=t or c
acaaaattagaaagcaatttgcattcagcagaagagtaagcacacacttctgtctcagatngagattcagtgcttgactcgaatggaatccacactgagccttcagcaacagctttattta

SEQ ID NO: 27530 - DNA, 121 bp, Artificial Sequence
  Synthesized
  misc_feature (61): n=a or g
cctgccttctcgactgtcctggggaggtttttcatagactgaaagttatatgggatccacncttgcttttctacctgtgactggatcaggtgacgtgcaaactgttgagttctggctgcca

SEQ ID NO: 27531 - DNA, 121 bp, Artificial Sequence
  Synthesized
  misc_feature (61): n=a or g
atttttacccactgcttgtatttaggtgcagggagggcgtgacaaagaaggctgagggctnctagtaagaacatttctgaataaaatagctgcaatttgcaagaaaataggttttcccaaa

SEQ ID NO: 27532 - DNA, 121 bp, Artificial Sequence
  Synthesized
  misc_feature (61): n=a or g
atggtctgacatgtgcagagagagtgtcttgttattgtgaagtcatactagaatatggagntgttggtcacccattcactggggactcagcttcattaaagtggtggattcaattaatgct

SEQ ID NO: 27533 - DNA, 121 bp, Artificial Sequence
  Synthesized
  misc_feature (61): n=a or g
caagtcacaacttacaaggatacagagtcaaatggaagtttctattaaaaaaatgtctcangagatgtcttagtatctttcattaaaaaacattatatatataaccttaagaaccacctct

SEQ ID NO: 27534 - DNA, 121 bp, Artificial Sequence
  Synthesized
  misc_feature (61): n=a or g
atgttactaaagcatttggttagtaataaatagttaaaatattaagaattctgaatgctantgcagacagtgttctcagaaattctccatgaaaaaaacataactgtggcatttgccagct

SEQ ID NO: 27535 - DNA, 121 bp, Artificial Sequence
  Synthesized
  misc_feature (61): n=a or t
gcatagcagaagagtcaaaatgcaccaatcttggtgaccagccatccaatgcagagaagtnggagttacaaattgaggtagtgttaactcttctggcagcagaggtgagatggggcttgtg

SEQ ID NO: 27536 - DNA, 121 bp, Artificial Sequence
  Synthesized
  misc_feature (61): n=t or c
agcttactttgtataggtacaacttacacacggggaaatttctcactctggcagtagttantgataggctatcaggtgcttggacaggtctacgagatgtgttctgacacagaagatgaag

SEQ ID NO: 27537 - DNA, 121 bp, Artificial Sequence
  Synthesized
  misc_feature (61): n=a or t
aagatttaagaaaaattttaaataaataatgaaccttggttgttatcctaagaggaaatcnggcttgacaggttagttgtttttgactgataacttcttcctcctcacagcagatgaccct

SEQ ID NO: 27538 - DNA, 121 bp, Artificial Sequence
  Synthesized
  misc_feature (61): n=a or c
cagatgaaactcatggtaggtgaatttcaagaagtgaaaacagaaaaaaaccctggatttntgcaggaaatggtggatcctgaattggctgttaccattttggagtgataccttggtgtta

SEQ ID NO: 27539 - DNA, 121 bp, Artificial Sequence
  Synthesized
  misc_feature (61): n=t or c
acatctctatcgcagttatctgcatgcattttcactttttttgaggccagcggagcatacntcacttgggcacactgtgagatctctcagagctgtggtgcagatgcatccccttttgcac

SEQ ID NO: 27540 - DNA, 121 bp, Artificial Sequence
  Synthesized
  misc_feature (61): n=a or g
cttgcaaagaacagtagtcagtttcactcggtgccaggtggtttgaatatactatggaccnaagcatgtctatattttgctctttattctcattaccagtaataaagcaaatactgttatg

SEQ ID NO: 27541 - DNA, 121 bp, Artificial Sequence
  Synthesized
  misc_feature (61): n=a or g
agtacctttgactcaatagttgccaatagacggaactcactgggaaaaagagccatcagcnagtgaagataccaaggcagctcttcagcaggataagatcattctggtgcacttacaaagt

SEQ ID NO: 27542 - DNA, 121 bp, Artificial Sequence
  Synthesized
  misc_feature (61): n=t or c
gatttgaacccaactgcccccattccaagtgagttcttgggccttggagccagagaactgntgtgctatctctttgaatgctgtgatagaggctatgggaaatcctcgtcaagatacgcac

SEQ ID NO: 27543 - DNA, 121 bp, Artificial Sequence
  Synthesized
  misc_feature (61): n=t or c
ggggatctcacagccaagtggggccaaagttccccatgctactcataagcagagctgtacnagagtatcctggcttgaaccaggaatttctttctaatttctagtccttgaagggcattga

SEQ ID NO: 27544 - DNA, 121 bp, Artificial Sequence
  Synthesized
  misc_feature (61): n=t or c
aaaacctgcagtgcggagttgttgttatgatcattgctttacagagcggctttactgactntgaaatgactttagtgaatccaggggagttaccactgtatgtacagtgcaggggatatag

SEQ ID NO: 27545 - DNA, 121 bp, Artificial Sequence
  Synthesized
  misc_feature (61): n=a or t
gcattggcccaggtccctctaaagtgacttgaatcacatgtggccgtgtatgttgaggttncagtgccaggtgacatgatgaaaattcagtgttcctagtaggacaaatcacagaaaatca

SEQ ID NO: 27546 - DNA, 121 bp, Artificial Sequence
  Synthesized
  misc_feature (61): n=a or t
ttcagcgcaattcctactctttatcttgcttctgttcctgcagcttatttctgctcttgcntccaccttgtgctgtgctcgtacatccaaatctggcacaccaaatctgccatcaaaagaa

SEQ ID NO: 27547 - DNA, 121 bp, Artificial Sequence
  Synthesized
  misc_feature (61): n=a or c
cttctataaaattgatctcttttcctgtcctcagtgcaagacattacttgctaactgtaanacttcttatttagaatgttaatgatattgttaatggtactccttcttttgtattaatttg

SEQ ID NO: 27548 - DNA, 121 bp, Artificial Sequence
  Synthesized
  misc_feature (61): n=a or g
atggtagttttggtattccctgtttgctctgcatttacaaattgatgtgtatattcaggangctggctgactagagcctggagacttacctcttggggaagcatggtaaaactctgaagca

SEQ ID NO: 27549 - DNA, 121 bp, Artificial Sequence
  Synthesized
  misc_feature (61): n=t or c
ctgcatcgagggtagataggttttcctatctgttctaactgatccataataacaaaccagngatgtgatttgtctctcttctgttataaattctacaggtctgtttgaaatcatagggaat

SEQ ID NO: 27550 - DNA, 121 bp, Artificial Sequence
  Synthesized
  misc_feature (61): n=t or c
aggatgctgggagctctgctgttggaaaatgcagagatccgctctctccctcaatcaaaanccctctgagggtttcacacgcctcctaaagcatggaccagccaggccgggcactgctttc

SEQ ID NO: 27551 - DNA, 121 bp, Artificial Sequence
  Synthesized
  misc_feature (61): n=a or g
taattggaaaaaaaaattctgctccttttctaaaattattagactcttgtgaacaatcctnttaattgaaaatgacttctatacaatccatcttttcatcgtgcaatgacaacaaatgcaa

SEQ ID NO: 27552 - DNA, 121 bp, Artificial Sequence
  Synthesized
  misc_feature (61): n=a or g
acgaagcataagtggttcacatagaactaaagggaaggtttcacatagcgtaatttattcnttgttgctaccaaagtgggctagaggtttctacctcctttattgcccttatgatgatgtt

SEQ ID NO: 27553 - DNA, 121 bp, Artificial Sequence
  Synthesized
  misc_feature (61): n=t or g
atttctgaatttaaacatgctgaatcatttttgtgtaaactacatttgaaatacctaaaanagaacctatgttgtcatgaaaggatatgaataaaacagttggtaggtagattccttatgg

SEQ ID NO: 27554 - DNA, 121 bp, Artificial Sequence
  Synthesized
  misc_feature (61): n=a or g
gtcatcttcagtggtgacagaaggcagtcaagacatgcacatgggcttgtaattaacatcncagattttgctggtagtgtttagtggtaataaatgaatagtgaaaattagcatattctaa

SEQ ID NO: 27555 - DNA, 121 bp, Artificial Sequence
  Synthesized
  misc_feature (61): n=a or g
gttcttatgattggatggactgagcctgatgattttcagcccttgacgcagtacagtggtntaaagagttcagaatgtagaccttgagtatttgacttcagcttataagaatgtaaagaac

SEQ ID NO: 27556 - DNA, 121 bp, Artificial Sequence
  Synthesized
  misc_feature (61): n=t or c
ctggggtttttactcctcttcctgagtactgatcccacagttgttcaagacaaaggcttancctcataggtttctttcccacatgtggaaatgttaatactttctacggccattctctctg

SEQ ID NO: 27557 - DNA, 121 bp, Artificial Sequence
  Synthesized
  misc_feature (61): n=a or g
tgcagaaaaagcagggggctgcaattgaaagtgatcccacatctggcctcggctttgaagnctctgccaaccagctagtgaaggcaggtgcaggaattaccattatcccagttttacagat

SEQ ID NO: 27558 - DNA, 121 bp, Artificial Sequence
  Synthesized
  misc_feature (61): n=t or c
attttgcaaataggaatactaaaagcaatgtgccactgaatctactcatttattgccttanaaatgcacgagatttatgtctttatataaatataaaattcaaaaaagaatagcagtacaa

SEQ ID NO: 27559 - DNA, 121 bp, Artificial Sequence
  Synthesized
  misc_feature (61): n=a or g
gtttgccctgccatttctcaataaactactcagtgaatgcagcatcttgcggaccagaacngagagtaatgccagtacctaatagcttgcagaacacacctgctacctcctggcctcaggc

SEQ ID NO: 27560 - DNA, 121 bp, Artificial Sequence
  Synthesized
  misc_feature (61): n=t or c
tgaatcacacagctccttaatctgaaaatggggggtggagaaaaagttacacagagtattncaacggaacaaaaataatagttatcctgctgtgtgttctcactttcgaaacaaaagagaa

SEQ ID NO: 27561 - DNA, 121 bp, Artificial Sequence
  Synthesized
  misc_feature (61): n=t or c
aattaagaaactgaccatgggaaggacagattgcagggtgttcacaaatagagcaaaaagnaacagatatcagaaggagaaataaatataatgtctagaaaggacctgatggtcattgctt

SEQ ID NO: 27562 - DNA, 121 bp, Artificial Sequence
  Synthesized
  misc_feature (61): n=a or t
atttttgtaggacaaagccataaatacgtgcaaattttgcatcagggaatacaagctgcancctggagtcaagtagtctatacaattctttaaatgttgaactgaaaacataaaaaatgtt

SEQ ID NO: 27563 - DNA, 121 bp, Artificial Sequence
  Synthesized
  misc_feature (61): n=a or t
gaattaattcatttgttattctttaggtcctgttttctttgggccatatattcaaattgtngtcatctttaaaagaaaagttactgtatatgttatgcattggcatacaatgcagcttcta

SEQ ID NO: 27564 - DNA, 121 bp, Artificial Sequence
  Synthesized
  misc_feature (61): n=t or c
caaaatgaaagagaagtgatgacactcctgccttctggagagaggcaaaaatctctgctgnaattcaaggtctctctcccgtgattctgtgattctcctctttctgacctgctgcattctg

SEQ ID NO: 27565 - DNA, 121 bp, Artificial Sequence
  Synthesized
  misc_feature (61): n=a or t
acgcttttccagagagtaatcagaagtttcttcagttgattgctcatctgttgctttctanttgctctttggtaaactgtacagatttacatcaattaaaataaatgagaggggtcactag

SEQ ID NO: 27566 - DNA, 121 bp, Artificial Sequence
  Synthesized
  misc_feature (61): n=t or c
gctaacatgactttggtagctccctcagtgcaattcatagacattaccttttgcttctccnagggtttgttgacttacaatagtgctattgcacaaccagtgcattggccataagctcatg

SEQ ID NO: 27567 - DNA, 121 bp, Artificial Sequence
  Synthesized
  misc_feature (61): n=t or c
aaatccaaatttccaccaaacgtaaggctgagatgaagatgtattttgtccacgtataggnagaaggcagcaaacagggaatctttatacttaagactttctttcgaagatgttttcactg

SEQ ID NO: 27568 - DNA, 121 bp, Artificial Sequence
  Synthesized
  misc_feature (61): n=a or c
ttttttttttttttcccagaatattttagtcatctctcttctcagatagtgtaggatttgntataggtctgaataagaaatagctttcttattctctggaatatttacctactgcttctgt

SEQ ID NO: 27569 - DNA, 121 bp, Artificial Sequence
  Synthesized
  misc_feature (61): n=a or g
gaaaatggaaataagataaaccgcatgttaaaaacaatatatgaaatcttcactgtaagcntgcaaggtctgtcagtacattggaaagcaatgtggcagtgttgtcaggccttactgctga

SEQ ID NO: 27570 - DNA, 121 bp, Artificial Sequence
  Synthesized
  misc_feature (61): n=a or c
gctactctgaatccgggtgggaattaacagtgtggtttaattaacccactccaagttcaanatttctgtgacatcgccaaaaaatttcttaaaagagtttagaaatctgcctgcactgtgg

SEQ ID NO: 27571 - DNA, 121 bp, Artificial Sequence
  Synthesized
  misc_feature (61): n=a or g
ttaatatctgaagcatgtcagcctcagaaatgctagaagcctgtatgaacaggcgtgtaanggagttcatccaaacataaatgaaatatacaaaacaggtatgcctgctggctcttagcct

SEQ ID NO: 27572 - DNA, 121 bp, Artificial Sequence
  Synthesized
  misc_feature (61): n=t or c
atagcatagaggatggcacaccgaccccaccacctgacctctgggcatctgctttttgcantgcacacctgcaaggctcattgctgagcaatgggagcctctgtggttggagctgatgagg

SEQ ID NO: 27573 - DNA, 121 bp, Artificial Sequence
  Synthesized
  misc_feature (61): n=a or t
accgatgacagcccgattagagtgaatgatatttttcacttgtggcaaatttccatcgttnatttataaaatgtatcctatttttaagcaggaaaaactgttttctaagccttgcagtcct

SEQ ID NO: 27574 - DNA, 121 bp, Artificial Sequence
  Synthesized
  misc_feature (61): n=a or g
agctttggacctcaggcaagaaaacttctcgtcacagtctctcttctaaagctgaatagcntctgcaagttttctgctacataaaagaaaccccacaactattgccctgcctacagggttg

SEQ ID NO: 27575 - DNA, 121 bp, Artificial Sequence
  Synthesized
  misc_feature (61): n=a or g
catgttgcaaatgtgctgctgggtttgtgtacttgcaaattatttcttttatgaaagattnaggaaaattgaaacttttctctttattcctcatgtatttcatgccttttactcaatggtg

SEQ ID NO: 27576 - DNA, 121 bp, Artificial Sequence
  Synthesized
  misc_feature (61): n=a or g
acccattgctgctggtgagtgggcatcgctctgctggaggcatcagaccaacagcagtaanaggtctggtacagctggattgccctgtgctgagacatcagcagccaagcgtccaatagga

SEQ ID NO: 27577 - DNA, 121 bp, Artificial Sequence
  Synthesized
  misc_feature (61): n=a or g
aaactgaaatatctgtttcttagtaggtgggaaagtttccaggctcagatcaatgacaaangtagaaaagggctttggtatatggttttgctctttgtgttgataccctggagattgtgac

SEQ ID NO: 27578 - DNA, 121 bp, Artificial Sequence
  Synthesized
  misc_feature (61): n=a or g
ccaataacagtgagaaatgctgagcgatggcattttacagtggtagaagttttgtactctnaaaaaaaataggagttctaaaaaagccatcctttcatgagattataggataaaacagaag

SEQ ID NO: 27579 - DNA, 121 bp, Artificial Sequence
  Synthesized
  misc_feature (61): n=t or c
aattttaaggcaacaacactaattttccttattttcaccaaatttcattattatttactgnactttgccaccttaagactaaccaagaatttggcttctttccatggaaggaaccacccac

SEQ ID NO: 27580 - DNA, 121 bp, Artificial Sequence
  Synthesized
  misc_feature (61): n=a or g
actagattgggatgtgagagagtttaaggcttcactcacagtggcctgctataaaaacctntatggggaagagtagatacagattatctcaaggaccaaagcactgcagttattttcagtt

SEQ ID NO: 27581 - DNA, 121 bp, Artificial Sequence
  Synthesized
  misc_feature (61): n=t or c
tgtaaatggagaaaatgccacaaatatagagaaaacgcccgcaaagcccatcatctctgcncctccaaacctttcttcatagagaggccaaatagcatggacaatcagttcagagcccagg

SEQ ID NO: 27582 - DNA, 121 bp, Artificial Sequence
  Synthesized
  misc_feature (61): n=a or g
ccctgatgtgatttgctttgctctgtttgctatgctctctactttgctctctcctgaaccnctttcttcgatgcaaattggaaagctatggtaaaacccctctgctacaatgggccgaatg

SEQ ID NO: 27583 - DNA, 121 bp, Artificial Sequence
  Synthesized
  misc_feature (61): n=t or c
aattgcaggatgtgccattcaggggtacgaatggagaaggaaaagccggctgtcgccatcnccaaacctcagccctcagctctgagctttagctggggcagcctggatgcaggtaaggttg

SEQ ID NO: 27584 - DNA, 121 bp, Artificial Sequence
  Synthesized
  misc_feature (61): n=a or g
ggtgcttggccacaatgggactgctgcttggaggaggtgtgttggtcccaatggggatggngagctggcagctgcttgccctttgtgctgagattttagattattttttttttgaagcact

SEQ ID NO: 27585 - DNA, 121 bp, Artificial Sequence
  Synthesized
  misc_feature (61): n=t or c
ttaaccttttttcaccaattgtaggaagccaacagctcagctgattacacttataacccanttctctgccacctgagagaaatgacagtattaacctagtcttcccaccccaaagaggtga

SEQ ID NO: 27586 - DNA, 121 bp, Artificial Sequence
  Synthesized
  misc_feature (61): n=t or c
aaatgctacaagctccattccactcaaacataaacctgctgtaagacaaatggatcatggngaaggggaaaaaaagtgaacattttccaaggctaacattttcctattatgtgtaaatgca

SEQ ID NO: 27587 - DNA, 121 bp, Artificial Sequence
  Synthesized
  misc_feature (61): n=a or g
actgttaaggagatgcagtaccaatgatatcaccttaaaagtaaaatgtgtaagcatacgntaggtattagatattggattaatataaattggtgtcatcaatcagcccgatgctgcttgc

SEQ ID NO: 27588 - DNA, 121 bp, Artificial Sequence
  Synthesized
  misc_feature (61): n=a or g
tttatcaggttatagtaaaggaaaattaggactcaaaaacagccttctcctgcagagatangcaacaagtcaaagcattctgatctatgcatcaactaggaaaaaaacaggagagtaagga

SEQ ID NO: 27589 - DNA, 121 bp, Artificial Sequence
  Synthesized
  misc_feature (61): n=a or g
aaatattggcctaacaagaaatcaagagtagtattccctgtctggtagagctagctgactnagaatgaaggtgaaataaagaagtgatccagtccatgatcccatttaagagcatgatcct

SEQ ID NO: 27590 - DNA, 121 bp, Artificial Sequence
  Synthesized
  misc_feature (61): n=a or g
tgcattttctagtggtgttatgcaaattgtcagagtgctgctgcaagaggcatctggcttngaggtgctttcctaaaacatattcctagtatcaatgcaagagttaaacaggaggtgcagc

SEQ ID NO: 27591 - DNA, 121 bp, Artificial Sequence
  Synthesized
  misc_feature (61): n=a or g
agtaccacattaagaatatggaagaacctgaactaaacagtctgtgtagggtatgaccacnagggcatgtttactcaagaaaaatagtagtattttctaataacattataacttttaagat

SEQ ID NO: 27592 - DNA, 121 bp, Artificial Sequence
  Synthesized
  misc_feature (61): n=c or g
actacatacatcagacaatcagctgactctggacgacaaaaaaatattctaccacatgtgntctaatgaacaataaaaattctcctgatgacaaacacaagctcctcttcaaacaccaagc

SEQ ID NO: 27593 - DNA, 121 bp, Artificial Sequence
  Synthesized
  misc_feature (61): n=t or c
ttgtaaagaagctgcactttgtaaagggtacactagaatatgtagtagcatgctgctgttnatgtagaaagcccttcaaaatccaggacctacaggtataagtggtggcaaatacgtgtgc

SEQ ID NO: 27594 - DNA, 121 bp, Artificial Sequence
  Synthesized
  misc_feature (61): n=a or t
ctgtatctcttgagatcaccttctcccagtgagagcagtgactaagaccgaaatttctganacaagcatcagtgtgtaactggatacaaagatctctcccaggaatgcaaacagttcctga

SEQ ID NO: 27595 - DNA, 121 bp, Artificial Sequence
  Synthesized
  misc_feature (61): n=t or g
ctaaccacatttaagggctggcagctgaaggagaagtatctttacttggagattgcctacnttgggagtttactagtgagcctggtattctctgaacaggtaagatatactttctttatta

SEQ ID NO: 27596 - DNA, 121 bp, Artificial Sequence
  Synthesized
  misc_feature (61): n=a or g
ctgagttacaagtaagctaaagcaaactatctgctgcagaattaggtatacgctgtaatcntgtccccccatgcatccattttgtactaaagcatgaatcattgttttacctgtattccac

SEQ ID NO: 27597 - DNA, 121 bp, Artificial Sequence
  Synthesized
  misc_feature (61): n=t or c
aagaattagctgcggagatgaggcataccacctctgtacttcgaaatgaggaagccatgtncaagagaagcaggaaccatatttagaagaagattttgcagagtccagaagcgcttgctct

SEQ ID NO: 27598 - DNA, 121 bp, Artificial Sequence
  Synthesized
  misc_feature (61): n=t or g
tatttctgcaagtaaatagtgacacttaaaataagactgaagtaatagaagaatgaggaangcctgaaaaggtcaagaggaggtaagcattgttccagtgatttaaaagcattatctttgt

SEQ ID NO: 27599 - DNA, 121 bp, Artificial Sequence
  Synthesized
  misc_feature (61): n=a or t
agggcattcttcatgaatgacattgaggttgatatataggtattaattacagcaccctttnggagaaagcaccagctacgcttgtcattatcaacaaggtaagaaagcagcctgcaactat

SEQ ID NO: 27600 - DNA, 121 bp, Artificial Sequence
  Synthesized
  misc_feature (61): n=c or g
agccaaagaagcaatgtcatttgttgaggtcagatggtagatagtctcagatgcgctgtgnagtagatgctatttgtatatattgggcacactgaaacagtcagcagaaaattcagaagtg

SEQ ID NO: 27601 - DNA, 121 bp, Artificial Sequence
  Synthesized
  misc_feature (61): n=t or c
aacaccattctttgtggtcaaacttgctgcctaccttaggatttcatgctgctggtataanatgtcaacacctcccactaaaaaactgcatatcaatacaaacggccatattggatctcag

SEQ ID NO: 27602 - DNA, 121 bp, Artificial Sequence
  Synthesized
  misc_feature (61): n=t or c
catggatctaataattgctttctgaaaagtttattactctttttggcaggaatatctggangttttgggaaggccaatggtgttagctggtgagaaagccaaacaggtccaatggacaaat

SEQ ID NO: 27603 - DNA, 121 bp, Artificial Sequence
  Synthesized
  misc_feature (61): n=a or g
ctccctgaaaataagtgagaaagagtaatatcaagctcatgttttccaaaatagctttaangtgccacaggaatcttaagccttccatccaaattcttttcaactgtgttttacctagaga

SEQ ID NO: 27604 - DNA, 121 bp, Artificial Sequence
  Synthesized
  misc_feature (61): n=a or g
agatgcatttagagcctccaaaggatgtttctcagccaatttcagtgagccccaactaagngaaatatctccaggcacacaaagccataataatttgacttctggtgtactgatggaaaag

SEQ ID NO: 27605 - DNA, 121 bp, Artificial Sequence
  Synthesized
  misc_feature (61): n=t or c
ctgaatgttggtgagttgtagaccactacttctctctccttgagaaggaggttgtagccangaatacaatcacagcaaacagatggctcaggaacaggtgtgaggaaaaggactttggggt

SEQ ID NO: 27606 - DNA, 121 bp, Artificial Sequence
  Synthesized
  misc_feature (61): n=a or g
ttttatttagaagtataataaaaccattctcactctactggttgtcaactttggctgactnggcagtttagaatcaaattcaactgcttttcaatactttacttttgtatcctaagtcata

SEQ ID NO: 27607 - DNA, 121 bp, Artificial Sequence
  Synthesized
  misc_feature (61): n=a or g
acctcctctctttacccaaggcacagtattgatttcctctcatttctgtggccagcaaccntttcttcttttaggttaattatttaaaagaaaagccctaattcttccatcaatttagaac

SEQ ID NO: 27608 - DNA, 121 bp, Artificial Sequence
  Synthesized
  misc_feature (61): n=a or g
acaaaagttatctctgcagtgtctgtgtgtttggctattttctgcttagtgcatatcttcntggctactcttctcattcactaagaagagaaagaatatgatggatttcttttaataatgt

SEQ ID NO: 27609 - DNA, 121 bp, Artificial Sequence
  Synthesized
  misc_feature (61): n=a or g
acatgtaatatggtggatgtatatggcagttgcccatatacagtcttaaggtctcactcantagctgaatactttccaaattagatgttacagtttgttcataagcaattttggtttgtaa

SEQ ID NO: 27610 - DNA, 121 bp, Artificial Sequence
  Synthesized
  misc_feature (61): n=t or c
ccagatctaaatgtttcttatcacatacaatatatgtgaacgcatatgatcatataaaggncatctgtattgttgactttgcatttaatttaggactgaaaaccttcttattactttcttt

SEQ ID NO: 27611 - DNA, 121 bp, Artificial Sequence
  Synthesized
  misc_feature (61): n=a or g
gctgctaggtgttgagcatcatacacacagatgccaatctgtataagcagttcctcccacngatcttgtaaaatggaagcacttgtggaaagctgcctgccaacttgctgtcatgtctatt

SEQ ID NO: 27612 - DNA, 121 bp, Artificial Sequence
  Synthesized
  misc_feature (61): n=a or g
taacgaggggacagggaaccaattagagttaagttttctgcagtgagcataggagttctgntagtgcttctcattctttcctaggttgagctctcattctgtggctgaaaaggagaggtca

SEQ ID NO: 27613 - DNA, 121 bp, Artificial Sequence
  Synthesized
  misc_feature (61): n=a or g
ctcgtaactgcagggagcaaaaggtgatggagaaagagcaatgcagccttgtctctgtgcngggcagagggtgagagagacctgagacaaaggttttagagcattttgaccgtgaagatct

SEQ ID NO: 27614 - DNA, 121 bp, Artificial Sequence
  Synthesized
  misc_feature (61): n=a or g
aggtgtaagaagcactttaataaagtatttttatagcaggcatcactttacaagtgtctangagggcgtggtgttggtttatttgcatggtttatttccttattgatttactgtatcaaca

SEQ ID NO: 27615 - DNA, 121 bp, Artificial Sequence
  Synthesized
  misc_feature (61): n=t or c
ttcacatttctacccaagctaaacatccagaagacatttggaaataaaaatctccacaganggccgacatgtctataagctgctgaggcaggcgctactgcttcctccatctatactgcgc

SEQ ID NO: 27616 - DNA, 121 bp, Artificial Sequence
  Synthesized
  misc_feature (61): n=t or c
atctttaatccgtttttattgttccttcacagtcttaaattgctgagctttatggttttgnaaccactttcactccgatttgcttccagctttggacgattaaacaacactccatatcaag

SEQ ID NO: 27617 - DNA, 121 bp, Artificial Sequence
  Synthesized
  misc_feature (61): n=t or c
ctcagggctcgctgggaagcaaagatgccacttaatgtcatagtcggctccttctctgccngacccacgtagtgaaagtgggctgcaagcatgcaggatttgcattaactcatggcaatct

SEQ ID NO: 27618 - DNA, 121 bp, Artificial Sequence
  Synthesized
  misc_feature (61): n=a or g
ctggtttttaaactcagctgtgacgtggcacccaaaagaggtgctctctcacgaagcaacntttattatttagggtaatgcaaactattaggatttgctgtgacatcagttttttatattg

SEQ ID NO: 27619 - DNA, 121 bp, Artificial Sequence
  Synthesized
  misc_feature (61): n=t or c
aagcatcactaatggcacacacgctaaaaaggaacaaaaaggttaagtattatgtagaganatctccagttcactagtcctgatgaacttttcaattccctgcttcagccagagtctgaat

SEQ ID NO: 27620 - DNA, 121 bp, Artificial Sequence
  Synthesized
  misc_feature (61): n=t or c
ctgtgactgcctgcctgcctgcccgggggtgactttacaggttggtgcctttgagcatttngcaaagaccaaagcagccactcctgccccatcccaggggctgtccctgcagagagcagcg

SEQ ID NO: 27621 - DNA, 121 bp, Artificial Sequence
  Synthesized
  misc_feature (61): n=t or c
ttcattacagatcttcacatttgttttccacttattttcattgactgccaggaatgcatgnacaaagcagtaaatgtcctttttccactgattatttatgtttgctggaacccacccttgg

SEQ ID NO: 27622 - DNA, 121 bp, Artificial Sequence
  Synthesized
  misc_feature (61): n=a or g
gcagcatctttgtggaaactaatgttactgtagcggtatctacagcaacagaggctcagcngtggtggctggtgcagacagggccagcaacactccagtgacactgccagccctgtgcatc

SEQ ID NO: 27623 - DNA, 121 bp, Artificial Sequence
  Synthesized
  misc_feature (61): n=a or g
aacgataatgtgttaatatggcctctttgctagatgatgctgggactcatacattcgtcanttaatcagtatgtaagtgctctgtgtcaagaatatccagagtatgggcaggaaatctcag

SEQ ID NO: 27624 - DNA, 121 bp, Artificial Sequence
  Synthesized
  misc_feature (61): n=a or c
ttttctctcaaaatgtatcattagttttgttcagcttttctagcttgtaaacaactacgtnatcaatgaaaatatatttagcctacctttaaaaagagatgactccagtattaattggtaa

SEQ ID NO: 27625 - DNA, 121 bp, Artificial Sequence
  Synthesized
  misc_feature (61): n=a or g
aagtgaacagtcaaattgtactatagaatttctgtttgaatttcaaattcaaaaacttttntttataatctttctgccaagttatctgaactcggtatgttggagattcacttggcttttg

SEQ ID NO: 27626 - DNA, 121 bp, Artificial Sequence
  Synthesized
  misc_feature (61): n=t or c
tggagggacagtgtcacaaaatggtttgcacgggtgggtttagaagccagaggtactgacnactagtcctgttttttaacctcgagaccatccttctcattcctgagctccaaagaactgc

SEQ ID NO: 27627 - DNA, 121 bp, Artificial Sequence
  Synthesized
  misc_feature (61): n=a or g
tgccatgatcagtagactctcttcatctctttaaacaattgctcagcaaactattacaggnagcatgtgtttgctcagcagacaaaaattattccattccactgctgagtaatagctataa

SEQ ID NO: 27628 - DNA, 121 bp, Artificial Sequence
  Synthesized
  misc_feature (61): n=t or c
cttactattagtaaatgaaaactctattacagtttaagggctgagttccagcttcaggtanatgcacgtataacactgcatgcataccttaaaatactagctttctcttgctcataagctc

SEQ ID NO: 27629 - DNA, 121 bp, Artificial Sequence
  Synthesized
  misc_feature (61): n=a or g
tattttattttattttatttttatttatttatttatttgctctacttctaattagctttcnttttggagtgtttctactaggtgtgcattcatttaagtgttgaaggaaactaaatctttt

SEQ ID NO: 27630 - DNA, 121 bp, Artificial Sequence
  Synthesized
  misc_feature (61): n=a or g
agtgtgtggtctatggtaccatgaatcatcctcagctctttcagtgtcttcttgagaaagnttattttcatatcactaaagtttattcattaatgaggtaaatatatatatatatatatta

SEQ ID NO: 27631 - DNA, 121 bp, Artificial Sequence
  Synthesized
  misc_feature (61): n=a or g
atttacagacaagaagctactactgcttattagaaatggagtctcagaatctaaatccaanggggatattacttttctacatactaactgctgtttctccaaacacatactgttataaagt

SEQ ID NO: 27632 - DNA, 121 bp, Artificial Sequence
  Synthesized
  misc_feature (61): n=t or c
accagctcctgacccaaaaaggagagaagacggagtcagatgatgtcccccatcccttctntttcttgtcttagaataacaagcagagcctgacatggctagttccttcccttctgcatgg

SEQ ID NO: 27633 - DNA, 121 bp, Artificial Sequence
  Synthesized
  misc_feature (61): n=a or c
agaaattttatgatttcccagattcccaggttagctagttagtacacatttgtccttgtgnctatgttaatatttgaggcaataatgtttcacttctccttccatatcttcccctcctaaa

SEQ ID NO: 27634 - DNA, 121 bp, Artificial Sequence
  Synthesized
  misc_feature (61): n=t or c
cagaaatagtgaaaactgtatttggtaatgtactacttgaaggtagaatcaccttgctcgnacaaccgggcaaaggtctagtgagcacagtaggtaaggggttcaacatggtgagccaaaa

SEQ ID NO: 27635 - DNA, 121 bp, Artificial Sequence
  Synthesized
  misc_feature (61): n=t or c
caacgtctcatctttagttaccatgtactccacgacattactcagtctggactactacatngagcgcgctctacccagaacttacatgtccagcgtgtacaacaccaagcacgtctgtggg

SEQ ID NO: 27636 - DNA, 121 bp, Artificial Sequence
  Synthesized
  misc_feature (61): n=a or c
cctttcacatacaaatctattggtggtaccacagtttacatcattccacaagcctaaaaanagattgaataaacaagttgttacagcatttgcaacaatgccttcctagtttgaataagag

SEQ ID NO: 27637 - DNA, 121 bp, Artificial Sequence
  Synthesized
  misc_feature (61): n=t or c
atccaatggtgtaattctttatttccgaaacgtttctaaaaaggggcaatagaggattgcngtgggttgttactgaataattcaactattaattaacttatagttaattaattaactataa

SEQ ID NO: 27638 - DNA, 121 bp, Artificial Sequence
  Synthesized
  misc_feature (61): n=t or c
ttagtatggaatgcttcctttttagtggaaaacaattttaatttcccaaacctgaatagangcaaaggaactttgttccatcattgcatgacgtttggagtaagaaaataaaatgtataaa

SEQ ID NO: 27639 - DNA, 121 bp, Artificial Sequence
  Synthesized
  misc_feature (61): n=t or c
tctactcacatctgaccttcacaaacatagagtggaactgatagaaaagcagattccctanaagatcttcttagaaaagtaataaaagcaacaccagttgtggcctcctgttgagtttaag

SEQ ID NO: 27640 - DNA, 121 bp, Artificial Sequence
  Synthesized
  misc_feature (61): n=c or g
acatagggttacttatattggtcacttatttcttttttctcagcaattttttgttgctctntatcttcagatcgctgacctcccaaacttggattctgtgtagggtccatattggcttttg

SEQ ID NO: 27641 - DNA, 121 bp, Artificial Sequence
  Synthesized
  misc_feature (61): n=a or g
tgcaagaaaggtaatgaatatgggaaggttataaaaagggacttttcagttaaagtactgnctgattaagttttgtatgaggaacagataaattccgctgttgatctaagactcgtttctg

SEQ ID NO: 27642 - DNA, 121 bp, Artificial Sequence
  Synthesized
  misc_feature (61): n=t or c
ttttttctaggcaactccccctcctcgagctgaatcttgaaacagaaagtggatatggctngctgtgatccactctgccactatatacgtacttagaacaatgctataaaatatcttcctg

SEQ ID NO: 27643 - DNA, 121 bp, Artificial Sequence
  Synthesized
  misc_feature (61): n=t or c
aaagattttcatgagacagtaggtttctgtgtacatgagattttaattgcttgacgtaacngtaaaagcttcaattgtggaatgagtatgtgttcataacaaaaatcagtcacattctgtg

SEQ ID NO: 27644 - DNA, 121 bp, Artificial Sequence
  Synthesized
  misc_feature (61): n=t or c
gccccgctccgcccccggccgtgagcgctctgttacaaacgtgaagtgcaaaaatgagtgnagaatggtgccgaacgtgcgaggtgagctgctcgggacgtgatgatacagtgcgccgtgc

SEQ ID NO: 27645 - DNA, 121 bp, Artificial Sequence
  Synthesized
  misc_feature (61): n=t or g
gtgccattacagagggaggaaaggacagaatgtgaccatcttttattaaggctgatgagangcagatctctcgtggctccctgggcagttctgtcaataccttgcacgtttccaaatatat

SEQ ID NO: 27646 - DNA, 121 bp, Artificial Sequence
  Synthesized
  misc_feature (61): n=t or c
gcattctgcttcttaaactttaagacaaggtggaaaaaatgattacctagctgcatttgtnctgcattttagagagatatcaagtgtttttccattcatatgacgttgaaatccacagttc

SEQ ID NO: 27647 - DNA, 121 bp, Artificial Sequence
  Synthesized
  misc_feature (61): n=a or g
taaagtaatatggctctgccaaaatgttggtgggagcactgagctgtaatgggtgttccanaagtttcagcaatggaaaggtatggtcctgtgcagaggaaacacttcctgaagttatact

SEQ ID NO: 27648 - DNA, 121 bp, Artificial Sequence
  Synthesized
  misc_feature (61): n=a or t
cgcagccacgtcccctccctaacatcactccaaagggagcaaatgcctttcagaagtgccngcgcagtgcaggtgaacaaagcacggattagtggggctctgctggtctgtgtgcccgtta

SEQ ID NO: 27649 - DNA, 121 bp, Artificial Sequence
  Synthesized
  misc_feature (61): n=t or c
tttggcatcacacatttattagatcctggccaagaacacagaatcatttctcacaggctgngggcaaaactcttccagaggcttcgctgccgcctcgtgatgcagtgaaggagctgctggt

SEQ ID NO: 27650 - DNA, 121 bp, Artificial Sequence
  Synthesized
  misc_feature (61): n=t or c
gttaattccagagtctagaattcaaagtctagattttaaatcttgggtttggggcagtttntgaataaagaagtgtgggttacatgtatttagcatacgcatatgccatccatgcatttgt

SEQ ID NO: 27651 - DNA, 121 bp, Artificial Sequence
  Synthesized
  misc_feature (61): n=c or g
tagcaggaaacttgtgctttagataagggttatactagaatctgttattctgcaagcacanggagaactgttccttcagtattctcactgaaaacagttttgctatcaacaaatgtgactt

SEQ ID NO: 27652 - DNA, 121 bp, Artificial Sequence
  Synthesized
  misc_feature (61): n=c or g
cactcgaggttgttcatctgcgacgcatgcaggtgggtctgcaggatgcctgctggggctntcgtgcttctgcccttccccatttctcacaggcacttctatctgcactgtcactcccaga

SEQ ID NO: 27653 - DNA, 121 bp, Artificial Sequence
  Synthesized
  misc_feature (61): n=a or g
ccttacacttggatctgaaagcagatttagtgaaaatctgtttcagaagttccaaatcctntttaccttgcccctagcccagcatgtgtccaaacttttacagacttttaaaatctcccta

SEQ ID NO: 27654 - DNA, 121 bp, Artificial Sequence
  Synthesized
  misc_feature (61): n=a or g
tcagcttagtaatagctgcacagagagaagagtcgctgtgaccaccagctgtgtctgacantggccatgcatgggtgaagaagcagcaccacatggaaacccatcgtgaatccctcctgct

SEQ ID NO: 27655 - DNA, 121 bp, Artificial Sequence
  Synthesized
  misc_feature (61): n=a or c
taacaaaattctataacgaatcctttgggagaccttccttcacatagtctgaataaaaatntgaaattggaagcaagtacgaacacgttagctgatacaaaaaaacgaaggagatagtaag

SEQ ID NO: 27656 - DNA, 121 bp, Artificial Sequence
  Synthesized
  misc_feature (61): n=a or t
tttgtttgtacaactgcattgaaggatgaattccattaagcagaagtgagagaaaagttcnctttgtgtattctttgtgtatcactaatttaaatgcagaaatttgctttcattgaccatg

SEQ ID NO: 27657 - DNA, 121 bp, Artificial Sequence
  Synthesized
  misc_feature (61): n=a or g
ctttctcactaacggtcaaaaaagttgaagaaaggattcccttggatagctgaactggcanaagatttgtttttcacaatcatgtacacagaactgagcaattcctgttgaaaaagcacat

SEQ ID NO: 27658 - DNA, 121 bp, Artificial Sequence
  Synthesized
  misc_feature (61): n=t or g
taagagattcagccctcctgctcccctcatctgagattgctgtgggtctcaggtagcaacnctcgcttccttctttgcaggatcaattatttccgcctctcagtataccaaacccagaagg

SEQ ID NO: 27659 - DNA, 121 bp, Artificial Sequence
  Synthesized
  misc_feature (61): n=t or c
gctgggagccagagcccgatgctccaggcagcagatcccaagggaagcaatgcagaactcngcactgctctgccatgccacaaaccttgtctgtgctttgtaaatatgcccagcatttcac

SEQ ID NO: 27660 - DNA, 121 bp, Artificial Sequence
  Synthesized
  misc_feature (61): n=t or c
taatgcaactagctattgtcctagtataggtttctctaacaaaattaactgttacaagatngaacgacctttcaaacaacttcccctagtgcttgcttttttcccatcaaaaggaaatagc

SEQ ID NO: 27661 - DNA, 121 bp, Artificial Sequence
  Synthesized
  misc_feature (61): n=a or g
ctttgtctcctgggaagtgtcagttgggaagtgagaataagttccaaggcaggtggatttntaacccgtcaaagataaaagaaagatgtgctacggaacagagttgtgctgactaattatg

SEQ ID NO: 27662 - DNA, 121 bp, Artificial Sequence
  Synthesized
  misc_feature (61): n=t or c
acctgacactctcaaacacaccccagtgcaggggagaacctatgtgaacattcctgtagantgtctataggaagtacagaaattgccaactaccagtgagatggcaagaggcagcatgttt

SEQ ID NO: 27663 - DNA, 121 bp, Artificial Sequence
  Synthesized
  misc_feature (61): n=t or c
actaacaaagactcccttgcaagactgccatgttaacacagagtgcatggtatgagatttnaatatgtatagcaatccttggaacaggtgggcgctttgtgtgagtgttcagacatgctga

SEQ ID NO: 27664 - DNA, 121 bp, Artificial Sequence
  Synthesized
  misc_feature (61): n=a or g
cagcatagcctgtgctatcagccatggacaatgtccatgatttgctgcccaagcctgcacntgatcgaggtacttggcccttatgctgacagtggtagatttctcaatagaaggtccatgt

SEQ ID NO: 27665 - DNA, 121 bp, Artificial Sequence
  Synthesized
  misc_feature (61): n=a or g
aaatacgtagaggcataacccgacgctgcaaaagcagctatgagaacctgtcagaatacanacaagaacataagagagaaagtaggctgagattcttatagtgtggtctgatctgggtagt

SEQ ID NO: 27666 - DNA, 121 bp, Artificial Sequence
  Synthesized
  misc_feature (61): n=a or g
ggttaagcttatatttaaatatatcaataacatatataaggacaagctaggaaaagatctntttgttcttaaccttctccttggttggttagcataactacatcacaactttgaaaacact

SEQ ID NO: 27667 - DNA, 121 bp, Artificial Sequence
  Synthesized
  misc_feature (61): n=a or g
gatcaaggtttatgaaatcatgaaatggacaaatcgagtacaaacagttttgccaacaaanttagaagacgtgaaaacaagccaacatgcttgttaatccaacagacagaatatgggactc

SEQ ID NO: 27668 - DNA, 121 bp, Artificial Sequence
  Synthesized
  misc_feature (61): n=t or c
tacaataaaacatttattgctcacacttccacacattaattatttaaaagaacattaatgntattgcttgggcttttaattttcattatgcaaagactgccgcatggctttgtttctgaac

SEQ ID NO: 27669 - DNA, 121 bp, Artificial Sequence
  Synthesized
  misc_feature (61): n=a or c
ttattttttttttttttctcctaagtgctataaccttacacctcttttgataattctgccnggtgcacagtatactgccctcccagtatgctgtaaatggaaaccatcatgagccttggtt

SEQ ID NO: 27670 - DNA, 121 bp, Artificial Sequence
  Synthesized
  misc_feature (61): n=a or c
tgcccacgtggtcacccgtggagctcacctggaggtctctcgtatgcagggatggagaagntgatgcgttggctaggctctgggttgtgctaaggtaacacttacggctacaaattatcag

SEQ ID NO: 27671 - DNA, 121 bp, Artificial Sequence
  Synthesized
  misc_feature (61): n=a or g
aatgttttatctttgtcctctgcagtttatgattagacctagtgctgaggaagctcgctcngcagcctacagaaaaaccctgaatcattagggtaggaaggagagagtgtcacaggtacct

SEQ ID NO: 27672 - DNA, 121 bp, Artificial Sequence
  Synthesized
  misc_feature (61): n=t or c
acacgacccaggacccagcgccacctacagcacgctttgtagcagaattcaatatcctttnatgcattaggttgctttctgctgttgcattgtttagtccaacgcattttaaaagctgacc

SEQ ID NO: 27673 - DNA, 121 bp, Artificial Sequence
  Synthesized
  misc_feature (61): n=t or c
tttcttttttaagttcgtttagccaggttatcctttcaaagcagctccacagagaataagngccaatacagcgtgagagcgtgtggaaatgctgtaatctcagccttatatttgctggcag

SEQ ID NO: 27674 - DNA, 121 bp, Artificial Sequence
  Synthesized
  misc_feature (61): n=a or c
ctactgatggacaatgtagatactggggggtagtcatcaaacagatagttcttaaattccntacaggactttcattcagagacaaatctatttaactgcaaatgggtattgacatttctta

SEQ ID NO: 27675 - DNA, 121 bp, Artificial Sequence
  Synthesized
  misc_feature (61): n=a or g
tatgcagaatcaggttttattaatgtttttaatgtggttttttggagcacaatgtgtacantttgtaggggcttagagacaattcaagacaatgaaatattcaacacatgaaatattcaat

SEQ ID NO: 27676 - DNA, 121 bp, Artificial Sequence
  Synthesized
  misc_feature (61): n=a or g
tcataccatctcacaacagatggatcaatcacttagtgttacttaatactggcacagttgngagctgtctcagggcctcgtgattcgatcttacacttttcttctcttcccatgcagaaca

SEQ ID NO: 27677 - DNA, 121 bp, Artificial Sequence
  Synthesized
  misc_feature (61): n=a or c
agataaatatgagagtggttgcatagttgagcaagtacctaaaaggattgtggaatcttcncagacagagattttcaaaagtcaactggatgtagtcatgaacagctttagctttgaagct

SEQ ID NO: 27678 - DNA, 121 bp, Artificial Sequence
  Synthesized
  misc_feature (61): n=a or g
atcggtcagctgcaaaccctagttatgaaattacacatgatttccagctgataaaacgttnccactgtcgctttcctctctggggacgccttgatatttttttacatctgcttttgttaat

SEQ ID NO: 27679 - DNA, 121 bp, Artificial Sequence
  Synthesized
  misc_feature (61): n=a or t
gcttttaacaatttgaggtcataattattttagcttatttagcaaatgctgtggcagttgngtgtttatagtgtagttaagtttcaccaaaaggaagataagaatcttcataaaaacattt

SEQ ID NO: 27680 - DNA, 121 bp, Artificial Sequence
  Synthesized
  misc_feature (61): n=t or c
cttttggtagtggcaaattttgtgtctttccccgtgtttaaagaggagaaatttgtggatnctttatttctcatttcttccagttctcttggagttatcatctctttcattaatctcacaa

SEQ ID NO: 27681 - DNA, 121 bp, Artificial Sequence
  Synthesized
  misc_feature (61): n=a or g
tgctgaccctcccatcccagctgaagacctccagaacttctgcaaaccaaactgagctgcnaaagggtctgggtgaggctggcatctgggttttctttctccctcctgcacggtgagggtg

SEQ ID NO: 27682 - DNA, 121 bp, Artificial Sequence
  Synthesized
  misc_feature (61): n=t or c
aagagggaagcaaaaaaacctcaagcaccagaaactatttctaacataaaaaagagttctnaatgatctccgtaattcctatttaggaaaactttggcgtggaaatgctcatttccccacc

SEQ ID NO: 27683 - DNA, 121 bp, Artificial Sequence
  Synthesized
  misc_feature (61): n=a or t
tgtagttagggggaagggaagggcactggatgatgcatctaggaataaatccactgaagcnatgtcaaagttcttttcctttgaatcttctgtaacttgaaactaactgcagaatatccaa

SEQ ID NO: 27684 - DNA, 121 bp, Artificial Sequence
  Synthesized
  misc_feature (61): n=a or g
agccttgctgaaaatagacacggtttccctgggctccaggagcagtcaggtcgggcttacntggctctgtttatccttttgggggatttcacagacacaggagggcattaagctctgaaaa

SEQ ID NO: 27685 - DNA, 121 bp, Artificial Sequence
  Synthesized
  misc_feature (61): n=t or g
gtattaaaatcttggagctgaaattcgaatacagctaactggtatgctaaactttaagaanatgattaagcaaatcaaagctattttcaggagatatagtgaagtggaaataatctttgat

SEQ ID NO: 27686 - DNA, 121 bp, Artificial Sequence
  Synthesized
  misc_feature (61): n=a or t
attttcaggaaaaaaaaaaaaggcatattaaatctgggataacatgaacctgtgcaacagntgagaaaaccacttccacctaaacggtttgttttgcactataccacgtggcactacatac

SEQ ID NO: 27687 - DNA, 121 bp, Artificial Sequence
  Synthesized
  misc_feature (61): n=t or c
cagttgcaaggttttgttctgcaggacctgcatctcctgatgtttcctctgcagaacccgnatttcatctcctgccacttattctgcaggtcccctatctcctgctgcccctcctgcagcc

SEQ ID NO: 27688 - DNA, 121 bp, Artificial Sequence
  Synthesized
  misc_feature (61): n=t or c
tctgtactttataagattcagaaatagctggttggtatagctttctgacacttgaataacnttttattggttattcccatcattactgaattaaagctagattctattgactttagacaat

SEQ ID NO: 27689 - DNA, 121 bp, Artificial Sequence
  Synthesized
  misc_feature (61): n=a or g
aactgccataaagacaacttcaaggctatgtccagttagctgtaacccaaaaaaatcccangtaaatttgtgctacacctggacttgcaaataatgctgttaagcaactccacaggaagga

SEQ ID NO: 27690 - DNA, 121 bp, Artificial Sequence
  Synthesized
  misc_feature (61): n=a or g
aggctatgctcagctggattaagtgcataatcacaatgacttaaggcagcaagaacttcantgtggaactagaaaagtgactcatgtatgaggtcacaggatatagaattctattatccct

SEQ ID NO: 27691 - DNA, 121 bp, Artificial Sequence
  Synthesized
  misc_feature (61): n=a or g
tctaacatgccaacaaaaactgtccaggaaacgatctgatataaggaaaaaacactgaccnatcaagacaaccagaagcacaagctactgagagaagtactgagagcagtggacaaagaac

SEQ ID NO: 27692 - DNA, 121 bp, Artificial Sequence
  Synthesized
  misc_feature (61): n=t or c
aaagcagcagtattattccaaagcatgactgtaacattgattggtgctaagaactacccanccaaaagcacaaagcaggaatttgccctcttcaagggaactactgggagctttgaataag

SEQ ID NO: 27693 - DNA, 121 bp, Artificial Sequence
  Synthesized
  misc_feature (61): n=a or g
agactgcggtaagaggagcctacaacccagctgccatccgctgtgtttgctgataattacnggtcaagggtgctgccacgcaggacaacctttacaccttccagaaaacaaaccaggctca

SEQ ID NO: 27694 - DNA, 121 bp, Artificial Sequence
  Synthesized
  misc_feature (61): n=t or c
taaaagatgctgcgtgtggtttattgaaattaaaagaaagtgacagctttctgcccctacnctcataaaattctgtcctgcatatgatattgtcctaatttagatcaaagacatgggatct

SEQ ID NO: 27695 - DNA, 121 bp, Artificial Sequence
  Synthesized
  misc_feature (61): n=t or g
ggctacctaataatttgcacaaaaataagagttccacaggcctctctgctaggatttttgntttggtgtattaataaactagcgaagaggctgaatagtgacctggcagtttggtgacagt

SEQ ID NO: 27696 - DNA, 121 bp, Artificial Sequence
  Synthesized
  misc_feature (61): n=a or g
attcagtgataagtgacacctgtcacagaagacaatgacagatcagctattttcagaacantgagaaatattggataaatcaccctgcaagacctctagcatccctaaaggcagacagagc

SEQ ID NO: 27697 - DNA, 121 bp, Artificial Sequence
  Synthesized
  misc_feature (61): n=a or g
tagtcttgtcccagagcacttatttgtctgcaaggacctcaccagactcccatactcttcnttgcactgggccataatctggcaaattgaagcaaaaatgaagccattagagatttaccac

SEQ ID NO: 27698 - DNA, 121 bp, Artificial Sequence
  Synthesized
  misc_feature (61): n=t or c
catttttcctgtatccttcctcgcagatgtagctacctatctacacgtagccaatgcacanagccacaatagcactacagtgagccaggaatactttttcatgctgttgcctacagaagtg

SEQ ID NO: 27699 - DNA, 121 bp, Artificial Sequence
  Synthesized
  misc_feature (61): n=a or g
ttgtgacctatattccctgttctgtttaggtatgtaacatcagtttaacgcagttatatcntacaaataacaggatttctggcaaatcctaaagtcggagtttccgttgcccaaaaatgag

SEQ ID NO: 27700 - DNA, 121 bp, Artificial Sequence
  Synthesized
  misc_feature (61): n=a or g
ttatttactattaggtgagctttcttagttattacttataccacctgagctctgttagcanagatgtttggaggcagtgctttgggtatgctttgcagattgtcactcttcaatttccttc

SEQ ID NO: 27701 - DNA, 121 bp, Artificial Sequence
  Synthesized
  misc_feature (61): n=t or c
cgtattctcacactaacactggacttggtcatggaaagagtaaattttatttatcattcanttcccttttaaaattccctttaaaaagtaggtactgtaattctgtgttttcatgacacta

SEQ ID NO: 27702 - DNA, 121 bp, Artificial Sequence
  Synthesized
  misc_feature (61): n=t or c
acagaaggcattctcacaaccaaaggggacagagatttctttgtaaaaccctaagtaatcngtgccctaatgagaatggtaaacaagtaatcaacatggtttctacaatagcatatagaaa

SEQ ID NO: 27703 - DNA, 121 bp, Artificial Sequence
  Synthesized
  misc_feature (61): n=t or g
tctggtggcaaaagcagtagttatttgttaaggaaaagcctcagtaaaaaaatatttagtntattttatctgtcttttaagcagaactaaaaccatggaacttcacaggcctctacaaact

SEQ ID NO: 27704 - DNA, 121 bp, Artificial Sequence
  Synthesized
  misc_feature (61): n=t or c
ctcttatactatttcgtccctttcttgaaatgtaaaaagttgagagaatggatgactatanactccccactgcctatttcagtggcttttcagtgagcaaatgtacctagatgagtcccca

SEQ ID NO: 27705 - DNA, 121 bp, Artificial Sequence
  Synthesized
  misc_feature (61): n=a or g
aggcatttgcctttctggccttggagctctggaaacagttgtccagcaatgattcatgaangaactgcattcgctttaaaagaaaacattctgagaagttctccctctattaatggtagat

SEQ ID NO: 27706 - DNA, 121 bp, Artificial Sequence
  Synthesized
  misc_feature (61): n=t or c
cctgtcatttcaataaagatctactttcagatgtgttgcatgtgtgaactgacaggtcttngtaggtacatttatttcaggagagcactgaactcaggaagttcacctgtaaggcaccgaa

SEQ ID NO: 27707 - DNA, 121 bp, Artificial Sequence
  Synthesized
  misc_feature (61): n=t or c
tggcagcctcttcccctgatgtcactcatcaccctgcaggactgggcactcctcaccttgncccacaccctcagaaatggtccctattcccctctcaccccttgttcagctcctgcaaaaa

SEQ ID NO: 27708 - DNA, 121 bp, Artificial Sequence
  Synthesized
  misc_feature (61): n=c or g
catgtcagtttatattccttttcaagctttcctcatgcttagtttttgcacagtggaaatncatctcaaatggaaacttgagagggaaggagttttgtctgtacttattttactaagatct

SEQ ID NO: 27709 - DNA, 121 bp, Artificial Sequence
  Synthesized
  misc_feature (61): n=a or g
ttgagatgtttaaaggctgttataaaaatgagaagttgtgggaatacagtgagtgtgatcncagtaacatttgcatttaattgctgagacacactttgacttcactttcaaatgaacacca

SEQ ID NO: 27710 - DNA, 121 bp, Artificial Sequence
  Synthesized
  misc_feature (61): n=c or g
ccatttatcatccacttaattagaagcctcaacctattcttcctttcatacatttgttttnccctgactgtgtacttctctggcttccattagacttgtagagctatgagtcctgcaggag

SEQ ID NO: 27711 - DNA, 121 bp, Artificial Sequence
  Synthesized
  misc_feature (61): n=t or c
tttgtcatattaatgaactgagtgtaactaacagcaagaaagaattgaaagagacacagtncaataactcaagtcatcaaaatatgagtaaatccatttagtgaaggagtatagaatggaa

SEQ ID NO: 27712 - DNA, 121 bp, Artificial Sequence
  Synthesized
  misc_feature (61): n=t or g
attggaagtgcgtacttatcaagagtgacaacctttgtcattaagactgggtgcccaatantttctaatatcaattccattttttttgcttagctcatgtttctaatacacatacattaaa

SEQ ID NO: 27713 - DNA, 121 bp, Artificial Sequence
  Synthesized
  misc_feature (61): n=c or g
tgctgcaaatagggaaccaaataattgctgtcccacgtgtaggtagtctcacacacgcgcntattaagtacacagtgcattatcaaagtctattcttgagcctttcctggataaaaagaga

SEQ ID NO: 27714 - DNA, 121 bp, Artificial Sequence
  Synthesized
  misc_feature (61): n=t or c
tctgggtaaagacaaggagtaacatcatttctcaaggaagggttggatcctctagtcctgnttaaagtaaatacagggcaagaaaaataagatttattggtaagcactagaacatgtgttc

SEQ ID NO: 27715 - DNA, 121 bp, Artificial Sequence
  Synthesized
  misc_feature (61): n=t or c
gtaggtctgttcccccaaggctctgacttctccaagacagtgctcagctcacagctaaagnaggtgatgccatcagccttaacagcccttgctgaattgcttataacactcgagatctaaa

SEQ ID NO: 27716 - DNA, 121 bp, Artificial Sequence
  Synthesized
  misc_feature (61): n=t or c
gacttggacagaggctgagttttggaaactgtatgtccgtccactttgagttgaaggaagncccctccctttatcagcagtttacccattttattaaccactgaaattaaactctgtcttg

SEQ ID NO: 27717 - DNA, 121 bp, Artificial Sequence
  Synthesized
  misc_feature (61): n=t or g
tgaaactttaaattttagcacccttaagttagtaaaaattaaagtattgtatgaccaaganaaatgaattgaacttaagattgtcattactaggtaaccaactcaaaacgtgtgagaaatg

SEQ ID NO: 27718 - DNA, 121 bp, Artificial Sequence
  Synthesized
  misc_feature (61): n=a or g
aagcttgcttgtttggtaaaaatatgcaaaagactgcaagtctctcaaaattactcccttncaggcagcttgtccctgtcacaaaatccatgatgtgcttagcctgaggtgggatactttt

SEQ ID NO: 27719 - DNA, 121 bp, Artificial Sequence
  Synthesized
  misc_feature (61): n=a or g
gagaaggggagaagaaacccaaacgaagaagctctcctgcaaacagagttaatgatgttcngtctgtgctttaaacacctagcagcatctgcccgttcacttgagcctcaggctcaaggct

SEQ ID NO: 27720 - DNA, 121 bp, Artificial Sequence
  Synthesized
  misc_feature (61): n=t or c
ctttacttttcatcatgttatggtgttactcctgtccagccacataccctggctatacaanagaacaagaccctgggatcttccatgctttattttttccctttctcttcctgcacctact

SEQ ID NO: 27721 - DNA, 121 bp, Artificial Sequence
  Synthesized
  misc_feature (61): n=t or g
atactaataatttatccagcaaaaggccattctatacagctgacctatgtgtcattattanagaatagctgggagaacaacactataatttatcttctcacctttctaaaaagcttgggaa

SEQ ID NO: 27722 - DNA, 121 bp, Artificial Sequence
  Synthesized
  misc_feature (61): n=a or g
gccaggttggttagccatcacgttgcgtaagctggggtttgggaagagcccatgctatcantaaaacacaggcaccctgagggctagatcgtatgggattcttagctgccttagctaagta

SEQ ID NO: 27723 - DNA, 121 bp, Artificial Sequence
  Synthesized
  misc_feature (61): n=t or c
tctggacaacccacagccaggagggtgaacacacggaatggcatttttcttggtgaaaccntacagcctcacaggttccctgtgttatctgacaacaggtgtccgtaagtcctggactcct

SEQ ID NO: 27724 - DNA, 121 bp, Artificial Sequence
  Synthesized
  misc_feature (61): n=a or g
aagcacacagggcttcagtttaattctgattgaagtgaagggttaaggaactgatagccanattgctgttcagtggcatgcagggttagcagcattcagggttgtctgctgacttttctca

SEQ ID NO: 27725 - DNA, 121 bp, Artificial Sequence
  Synthesized
  misc_feature (61): n=t or g
agtccccaaatgaacttggctcagttgattttactactgaagctgaagcaactgtaaattncaatcttaattacagaaactttttaacttgtgtggttggcatttgtgtccaggtaagcat

SEQ ID NO: 27726 - DNA, 121 bp, Artificial Sequence
  Synthesized
  misc_feature (61): n=t or c
gatgaacaagcaaatcggactaaaaagatacgaagtggatggaagaaaagtcttattctantttgatgaggtaatgagcttgtttcttatgccacgtttcagtgaaaggcaggtggctgca

SEQ ID NO: 27727 - DNA, 121 bp, Artificial Sequence
  Synthesized
  misc_feature (61): n=t or g
ttgtcataaatattgctcagcaaagtgatagtgccagaagaaacacatggttatgctcctnctggttattctgacccaagttacacaagatgccttgtagtcaaactcttcttacagcaac

SEQ ID NO: 27728 - DNA, 121 bp, Artificial Sequence
  Synthesized
  misc_feature (61): n=a or g
tatgtgctcacttgtgcgtgtctaatgggaatgcgtgctcagactcactattgtttggacnttgaagcatagagctgcagcagtcttatcactgcccagtggccacatatagccctcctaa

SEQ ID NO: 27729 - DNA, 121 bp, Artificial Sequence
  Synthesized
  misc_feature (61): n=t or c
cgttcagtaatggttcagggttgtgtgggcctggcttcattttggtgctggttaggggagntcatagaaaaatggcatgaggcttttttaaagaagcatttcatgctttgagtcccaagct

SEQ ID NO: 27730 - DNA, 121 bp, Artificial Sequence
  Synthesized
  misc_feature (61): n=t or c
acaggctgtgaagttgtgctgggtgcattagttcccagcaatttagagaacacccgaaagngccacatggctgcttaatggagccttcagactgcatgagaaagcaagcaggcagtagcac

SEQ ID NO: 27731 - DNA, 121 bp, Artificial Sequence
  Synthesized
  misc_feature (61): n=t or c
tcttgggatgtcaaaagtcaaggttacatcagctcttgactttatccaggttgtatgatgngcaacgtcactataacagagcacttcctccttgttctgggggaacttgattcataatgag

SEQ ID NO: 27732 - DNA, 121 bp, Artificial Sequence
  Synthesized
  misc_feature (61): n=a or g
cattttctgctatggaattcataaaggtcatagatctgttatttctagccttgggaacaantgttgcatggataactgggtgagtttttaatggcctgtgatgatcaagacgatctaacgg

SEQ ID NO: 27733 - DNA, 121 bp, Artificial Sequence
  Synthesized
  misc_feature (61): n=t or c
gtgagtgcagcatgttaatatacctgggaagtataatgctaagcaatttgaatgagaaganatgctgtgtaactcctcactacagaatgtgtccctatttcactttggtgacattacatct

SEQ ID NO: 27734 - DNA, 121 bp, Artificial Sequence
  Synthesized
  misc_feature (61): n=t or g
tattgataaattccgaagttggaataatctccttgcatattgcattctgtgataattaaanaacatatttctagttaaagaaatgctagaaaaacaaacaagtctttttacagacttcatg

SEQ ID NO: 27735 - DNA, 121 bp, Artificial Sequence
  Synthesized
  misc_feature (61): n=t or c
tactatggtctgtactgtgcatgtcctcatcaattattttatgacagtccacagatatagnagatagcctattaaagtcttttcactctttttttccttcattctctctcaccttcttctg

SEQ ID NO: 27736 - DNA, 121 bp, Artificial Sequence
  Synthesized
  misc_feature (61): n=t or c
atccttcagatagtgaggagcccagaagtgatcacaatagtcaagttgtggtctcaccagngccacatgcaaagtaacagtcacttctatagtgctggtgccatgttatctatgatgcagg

SEQ ID NO: 27737 - DNA, 121 bp, Artificial Sequence
  Synthesized
  misc_feature (61): n=a or g
ctgtacaaatgcttccacaaccaatttttgttttaatcagattttggggaaaattcttacntcataacaataaaaatcttttactttgtctcctaacactaaagcagtcccatacatcgtg

SEQ ID NO: 27738 - DNA, 121 bp, Artificial Sequence
  Synthesized
  misc_feature (61): n=a or g
taatggaaatcaacaaggcaacgtattatgtttaaatttagatcccaatccactttacacntctttacctagcaaggaaatatattgtgccaactaactctacagttaatactaatgagtt

SEQ ID NO: 27739 - DNA, 121 bp, Artificial Sequence
  Synthesized
  misc_feature (61): n=a or g
tagatgaaaggagcataaatacataggtatctttcactaagcagaaacgatggaaaaccantgttatttcagttcactgaagtgttttaatcagctccctcagctatggctgcattcaaga

SEQ ID NO: 27740 - DNA, 121 bp, Artificial Sequence
  Synthesized
  misc_feature (61): n=t or c
gcatgactgtcagccttacttctacatctcattagctgtttttatctggcgcttcattgtncttctccaaagcttgactgaaatgccaccttgtgttactgaaggatacgtggcattctgg

SEQ ID NO: 27741 - DNA, 121 bp, Artificial Sequence
  Synthesized
  misc_feature (61): n=t or c
tggtgtcccctggccttgttccttgtgcagctttagagcaagtgtgcaaatcctgtccttncagaaattctttggtgattgtgcctttgcaatccagagagctgatcaaagtatgcatggc

SEQ ID NO: 27742 - DNA, 121 bp, Artificial Sequence
  Synthesized
  misc_feature (61): n=a or g
cattgcaaatgaactgttgctatccatcatttgagagacttttaccagaaatttcagtctntccttgcaagcaaaattttttgttgccttagtcacttcatttatccaaatatggaggaag

SEQ ID NO: 27743 - DNA, 121 bp, Artificial Sequence
  Synthesized
  misc_feature (61): n=a or g
aagcagattttgctcatgtttactacaaccccttgatatagcattcctaatagttgcttcngaaatattgtaagccttttgccaattcaatatatagagttcttctagtccttgcatagtg

SEQ ID NO: 27744 - DNA, 121 bp, Artificial Sequence
  Synthesized
  misc_feature (61): n=a or g
gaaattttgcccaagcagcacacaggccctatgctcacctgctgtgtgcatctcagtcacnctgtgcccagcgtttggtgaagctgcaagaagccatctgcatgagacttcattgccgtgt

SEQ ID NO: 27745 - DNA, 121 bp, Artificial Sequence
  Synthesized
  misc_feature (61): n=t or c
catgtctccatcccccagaaaatttttatgtcacagcctgaacatttgggttacagctctnccgacagccaaaaagacagtccaagacaaacagcctgggaaataatataggtaggtgttc

SEQ ID NO: 27746 - DNA, 121 bp, Artificial Sequence
  Synthesized
  misc_feature (61): n=t or c
tttaatgaataaacaggctaaatactaaattagtgctcacttcggcaggtcctcctggttngtgtgcaggagctacaagcatagagattgcctgaagaacgagggcaaagattgcaaaatt

SEQ ID NO: 27747 - DNA, 121 bp, Artificial Sequence
  Synthesized
  misc_feature (61): n=t or c
atctaacttagaaaacaagatgagaagatcagcaaggaaattgcacggtgcattgatgctncacagctataagtcctatgcacaataggcactgactaatactgttgggtctgtctgaatt

SEQ ID NO: 27748 - DNA, 121 bp, Artificial Sequence
  Synthesized
  misc_feature (61): n=a or g
aaatttaaatcaaatcttccaaatttgcaagggaaggtggttacactagaatttaacaaangttgcatgcttacacttcaaggcctcttctttatttttcctacatatagagaagtttcaa

SEQ ID NO: 27749 - DNA, 121 bp, Artificial Sequence
  Synthesized
  misc_feature (61): n=t or c
tgtgcaaagcatacatctgtgcttctaggtacaaccttcctggtttgtgaacacaccatanttatttggtggtcacagtttttgttcttcttaccttagaagtaacagaataaatggtatt

SEQ ID NO: 27750 - DNA, 121 bp, Artificial Sequence
  Synthesized
  misc_feature (61): n=a or c
gggtaagctgatggctctatgtttaggctcaatcctgtgttacaggaacatcccaaacttntatccccctagacttgtctttgcaaaatcatggtatcttatgtgtccacagcaaaatctt

SEQ ID NO: 27751 - DNA, 121 bp, Artificial Sequence
  Synthesized
  misc_feature (61): n=a or g
ttctataccttaactaaactagccaaaagtgcacccacactttgacactaaacaactgcantgggtgagacagaggagagatctttaaaacagatgcagtacaggagtgatatcaatttaa

SEQ ID NO: 27752 - DNA, 121 bp, Artificial Sequence
  Synthesized
  misc_feature (61): n=a or g
tccagttaccactttcttattgctctgatttttgttctgatctctttgactggggagcagnaagaggcaggtgcagatctgcttggaggggatctgtttgtccatcccaaaccttgcagag

SEQ ID NO: 27753 - DNA, 121 bp, Artificial Sequence
  Synthesized
  misc_feature (61): n=a or g
cacaagtggactcagaagtacgaggttatgctgaagtgtgtaagtggctgaaacaatgatncagtggatctcttgttgaacagggatgaaaggtctgacatgctgcatcaccttacatcac

SEQ ID NO: 27754 - DNA, 121 bp, Artificial Sequence
  Synthesized
  misc_feature (61): n=a or g
acttggctgcaccagcagagctgccggcaccgcagctcccatgcatgtggggactgctacngcctcctgcacgtaccctttaattcaggttatgattacattctgttgacagcacttagca

SEQ ID NO: 27755 - DNA, 121 bp, Artificial Sequence
  Synthesized
  misc_feature (61): n=t or g
gatgagctgcaatgagttgcgatgcaaaccgcagcccgtgctgcaatgcaaacggcagcgngggctgcaatgtaaactgcaacacgagctgcaaggtgggctgcaatgtgaagggcgaggt

SEQ ID NO: 27756 - DNA, 121 bp, Artificial Sequence
  Synthesized
  misc_feature (61): n=a or t
tttcatttgctagcacagagctgggatgtaaggacattaaaaggctgttggcaattcaacngatcagaatattctagcaacaacaaattattatgccttgcttttgtttcagaaatacttt

SEQ ID NO: 27757 - DNA, 121 bp, Artificial Sequence
  Synthesized
  misc_feature (61): n=t or c
gcagtttctagaactaaaacaattgcttaaagtcactgtctatctttctagatagaaacangctccgtggtatgaatctgtggtgaggaaagattaagttattacagatttatagaaaaac

SEQ ID NO: 27758 - DNA, 121 bp, Artificial Sequence
  Synthesized
  misc_feature (61): n=t or c
agggaagaagacactgatctgcaggttctttcctgttactaaataagtctcaaagagcggngaagattttggaactaggagataagactgcttgtttcagaactgttccatcttttctggt

SEQ ID NO: 27759 - DNA, 121 bp, Artificial Sequence
  Synthesized
  misc_feature (61): n=t or c
cgggtagatggttgtgttcgtaaggggagcagagccaactgctccagaattcaggatgtgncctcaccatgaccacatcctggctgaggaagcctttgacactgcctgtcccgtagcggat

SEQ ID NO: 27760 - DNA, 121 bp, Artificial Sequence
  Synthesized
  misc_feature (61): n=t or c
tgcggaacgtgctgtatgccttctgattcagcatactgaagggcagaaagcttgctgggcngaaagggctgccaaaggcagctggagggacacccacaccttgcctaaaactgtgcctgct

SEQ ID NO: 27761 - DNA, 121 bp, Artificial Sequence
  Synthesized
  misc_feature (61): n=a or g
agatgtgtctatggagacatctgtatctcaggacaatgagattcttcatgcatgattttcntcggagcacctttactctctttcctcaagttgcttgataccatttgcttcaaaaataaac

SEQ ID NO: 27762 - DNA, 121 bp, Artificial Sequence
  Synthesized
  misc_feature (61): n=a or g
catttttaatttgctgttgccaagctcatgagacttctaggaggtgctgtacaggtacacntacattcagggtattcaacctgagtctgctgtccgtccagtccagatgttctcccgatga

SEQ ID NO: 27763 - DNA, 121 bp, Artificial Sequence
  Synthesized
  misc_feature (61): n=t or g
gagtttctgctgcactgcaaaacacaagcacaggctgtgggtgtagatcttgctttgctgnagctgcacctgccctcttgaattctcattactgggcagggcacatctgtgacccccctaa

SEQ ID NO: 27764 - DNA, 121 bp, Artificial Sequence
  Synthesized
  misc_feature (61): n=a or t
taataatctttggagaacaacaaccatttatcacaataattttgctttgacctggccattngctacaccacaacctagcttgattcctaattagtccatctgatggctgttcaaatttaaa

SEQ ID NO: 27765 - DNA, 121 bp, Artificial Sequence
  Synthesized
  misc_feature (61): n=a or g
ttgatgaagggaaacagtatgctttcctcaggagaagctgacatatttaagacacaaatangaattgaaaaatattctgtttattaaatacacttagactttgaggaataatgtttcacat

SEQ ID NO: 27766 - DNA, 121 bp, Artificial Sequence
  Synthesized
  misc_feature (61): n=a or g
tgccctttggcccaagtgagcagcatcttcctctaccacccctgaaagccagcagagaagnaaagaagtaattgtcagagagagttcagcacatgggctctcaggggatacaagagtaatt

SEQ ID NO: 27767 - DNA, 121 bp, Artificial Sequence
  Synthesized
  misc_feature (61): n=t or c
atgttgcttctagtcagatttagttatttgtagccaactccttgaaatactttttcccacnggctttaaagcattcttccccttcctgaaaaggtatagtttgaagtccaggccattaaag

SEQ ID NO: 27768 - DNA, 121 bp, Artificial Sequence
  Synthesized
  misc_feature (61): n=a or g
tttgcacctgaagcttcgctttgcttttctttaggatgtggacggtgcttacatgaacaangtggagctgcaggccaaagcagacgggctggcagatgagatcaacttcctgagggctctc

SEQ ID NO: 27769 - DNA, 121 bp, Artificial Sequence
  Synthesized
  misc_feature (61): n=t or g
tccacgtgtaattcatacatttcactgcttgcagaaggtcttttaaaatggcaactagagnccagatgggacaaccaagggaatctcacatgccattgcatactatgtttatgtaattgaa

SEQ ID NO: 27770 - DNA, 121 bp, Artificial Sequence
  Synthesized
  misc_feature (61): n=a or g
cccagccgggtttaatcagcgcggggcagggcatggaagacacaggtgcttcttttaaggnggtaaaaaggagaggcaaatctgtcaataattaatgaagggaggaaaaccggtttctggt

SEQ ID NO: 27771 - DNA, 121 bp, Artificial Sequence
  Synthesized
  misc_feature (61): n=t or c
tcttcatggaagtcaatggggctgagcagacctgctgttctagacatccatatcacagccngttgtctcagcttacatttctgaaacttttgtagaaaaacagagtagcaagaaacttttc

SEQ ID NO: 27772 - DNA, 121 bp, Artificial Sequence
  Synthesized
  misc_feature (61): n=a or g
ctcgtggatgaccgcgttggtgaagggcatgtttttccggtcctcaaaggtaggcgggcantcagggccaagaacgcgctcaatctctgcatgcaccttttctgtagtcaaagggaaggca

SEQ ID NO: 27773 - DNA, 121 bp, Artificial Sequence
  Synthesized
  misc_feature (61): n=a or g
caaacaagctccaaaaaagcctttttaactctattagtctgtgttgccctttaacggacgngcatcctttacagtctgtagaataactcagcccgcaaatctgaaaaccccataaagttgg

SEQ ID NO: 27774 - DNA, 121 bp, Artificial Sequence
  Synthesized
  misc_feature (61): n=t or c
cccgtgtttccttttctggctctttgtccaaactttattgacttcagtgattgcattgcantggctagaaggggtatttacacacctacctgacgtacagatgtttgaacattggtttcct

SEQ ID NO: 27775 - DNA, 121 bp, Artificial Sequence
  Synthesized
  misc_feature (61): n=t or g
cgggttcaccatcttcatgggcgggatggaaacgccaccactctgttgggacagagagttnggggagattaaaagcccagaatagggggaaacccaaagcagcacagacctgcagccgggc

SEQ ID NO: 27776 - DNA, 121 bp, Artificial Sequence
  Synthesized
  misc_feature (61): n=t or c
acagaattatgttgacaggttggagtcctccaaggtccaaccactcatttacacctgggantatatgtcatgtgtacctgttgtagagaatttgttgataggaggaagtaaaatagttctc

SEQ ID NO: 27777 - DNA, 121 bp, Artificial Sequence
  Synthesized
  misc_feature (61): n=a or g
cactttggacactttccacgttttgggagctgaggcagatgagttgtacaaacctcaacantgccacaccagactcagagccggaaaacagctctcaacaccctttatttgttagaataaa

SEQ ID NO: 27778 - DNA, 121 bp, Artificial Sequence
  Synthesized
  misc_feature (61): n=a or g
tgggagagacaagtgacactggaggtgacaccacttatttttgtaattcagaaacgatctntagggattgttgactacatgggatctattcccttattgcagctggctaaaatgcttaggc

SEQ ID NO: 27779 - DNA, 121 bp, Artificial Sequence
  Synthesized
  misc_feature (61): n=a or g
aatgcacacactgattcagagcacagaggtgagacgagtgaagcctcatgtagttgtcctncatactaacacagcttctgagatgaaaatacagcaagagctgtagctatcaaacacagac

SEQ ID NO: 27780 - DNA, 121 bp, Artificial Sequence
  Synthesized
  misc_feature (61): n=a or t
tctatcttgtctggacagcaagtgtctcaaggtagtatgggaattcaggagtttttgctcnctctctccctgccagagaggaaacttgaaagcttttcacctgcgtgcctcctggtcaaac

SEQ ID NO: 27781 - DNA, 121 bp, Artificial Sequence
  Synthesized
  misc_feature (61): n=a or g
tgcacagactccacagcctctttctaaagccaaatctgagcagttttctggacagttaggnagcttctctgtaacactaagccactgatgggcacataaaatgaccaccctccacttctca

SEQ ID NO: 27782 - DNA, 121 bp, Artificial Sequence
  Synthesized
  misc_feature (61): n=t or c
ttaactaataagggaatctgagactaagcccttaaatttatcagggtttaatctgtacaantctcctgggtattttatgtttcctattgtaatcactgactaccaaatgtagtgactattg

SEQ ID NO: 27783 - DNA, 121 bp, Artificial Sequence
  Synthesized
  misc_feature (61): n=t or c
gggctgcatggatgggacagcagcattccagggtgaaagacagagatttggggaggccacncagggctgagttccacatctctgtgccctgtatagcaactgcagtggtacaatgcttcct

SEQ ID NO: 27784 - DNA, 121 bp, Artificial Sequence
  Synthesized
  misc_feature (61): n=t or c
acgcccacgctctgcgtggattgcttgtgaatgtgggctccctctgtcggctgcgtggctntggagcaacaagattaaaaaataaagttatcaggctctgtcaggcacaaacagttcctct

SEQ ID NO: 27785 - DNA, 121 bp, Artificial Sequence
  Synthesized
  misc_feature (61): n=t or c
attagctacacactggttcatctggagattgccatatatgctttatctgtctttcagaagnttataagcagttgaacagtttcacaaagtgagagaaaattagaatttcctccaagtattc

SEQ ID NO: 27786 - DNA, 121 bp, Artificial Sequence
  Synthesized
  misc_feature (61): n=t or c
ctcccaacacaaatattctgtttggtgacctaccaagtctcctcagatgaacataaaatcnttaagcccagtactatgggttttgtctccagtgccatgatgtgccagaacatttggttaa

SEQ ID NO: 27787 - DNA, 121 bp, Artificial Sequence
  Synthesized
  misc_feature (61): n=t or c
gggatcccatcctttgttgttgtcagcctttagtttgttgtcatcccaacagccttacacngcaagtgttagagacataccaagcacactacagataggtagtgttttttgttggtccttt

SEQ ID NO: 27788 - DNA, 121 bp, Artificial Sequence
  Synthesized
  misc_feature (61): n=a or g
cattttcttgtggaataacgatgctcttgaagggctctgaaatatatgagtgcagaggttngttccacgggaaatagtgtactaggatggaggagtgttcaaagcatctacatctcccagg

SEQ ID NO: 27789 - DNA, 121 bp, Artificial Sequence
  Synthesized
  misc_feature (61): n=t or c
ggggattttttcccccccaagtgatgctctgggagggtctgggcttgggaggatgctgctnggcaggagggctctttcagtgcctagggctgatgctttgttttggctgcaaggagtgttt

SEQ ID NO: 27790 - DNA, 121 bp, Artificial Sequence
  Synthesized
  misc_feature (61): n=t or c
tagaatactgaggtttagacagtatagagtatcagcagtaacaaccattcatgatgctgtngcacagtcatgtacacaagtataacttctcacaacgcacacatctgtgcctttatatcag

SEQ ID NO: 27791 - DNA, 121 bp, Artificial Sequence
  Synthesized
  misc_feature (61): n=a or g
aagcctctcaggcattaatgagcattgtctctgaaggggacttgtaagcagccgtgtgggntggaaacaatttcctaggcttgatctctcaataaatgcaaaaactggtatctactcctcc

SEQ ID NO: 27792 - DNA, 121 bp, Artificial Sequence
  Synthesized
  misc_feature (61): n=a or c
ttttttttttaaccactgtctgaatacaaaaaatgattgctaggaaagtcaaacagaattnaaagcaacaaacacataaacaaataatgcaatctcaacgtatgtcagttacttctgaaga

SEQ ID NO: 27793 - DNA, 121 bp, Artificial Sequence
  Synthesized
  misc_feature (61): n=t or g
tgattaattataggcttcttaggcaagaactgtatattttattttaactaagtaccctgtncttaatcggtaataattatccataccctttgtcagtggattcacccaaaataactataaa

SEQ ID NO: 27794 - DNA, 121 bp, Artificial Sequence
  Synthesized
  misc_feature (61): n=c or g
actcctcctatgtttatgacatgtttattgcagatctctttaataactaccagttgatggntttttgaatattatttctagcctggtttcctgaggaagtgaggcttaagcgttgcattat

SEQ ID NO: 27795 - DNA, 121 bp, Artificial Sequence
  Synthesized
  misc_feature (61): n=t or c
tatgctgctcctgcatatccagcaagctgttcattgcactcctgccagctctgtttgcatnctcataagccccaggtcctttctcctgtttctcattgtactgatgagacttgaacatctg

SEQ ID NO: 27796 - DNA, 121 bp, Artificial Sequence
  Synthesized
  misc_feature (61): n=a or g
ctgggggaaactctagggttcctgggttccttatggataagttctgcatgaattagttacnaatgggagcctgtaagggataatggtcccattattaaaaccccttcataaatggctgact

SEQ ID NO: 27797 - DNA, 121 bp, Artificial Sequence
  Synthesized
  misc_feature (61): n=a or g
tctgttctagtatttaatctagcagtttactgtattccaacatagcttgtaattgttactntaaggttgtactagattttcaatttgaggagaaggaaacttccacagttatactaatttt

SEQ ID NO: 27798 - DNA, 121 bp, Artificial Sequence
  Synthesized
  misc_feature (61): n=a or c
aatacacagcgaggatgtggtcacagaaaagaaagacagaaaaattctggcactttcagantaatttaattcttgtatcttcagctgaagtccattatccttcacaaagagttaatctgga

SEQ ID NO: 27799 - DNA, 121 bp, Artificial Sequence
  Synthesized
  misc_feature (61): n=t or c
cttaaaaagaaaaatgtgccaagttcagcatcataatcagaaagttcacagtctagtgccngagctatgaaaatgaaggtcctctgtaagaagaaatgtaaggaaaaagggacaaatcttg

SEQ ID NO: 27800 - DNA, 121 bp, Artificial Sequence
  Synthesized
  misc_feature (61): n=a or g
gttagcaggtgttaagtgtgctgggaaagtggcaggctccacttgctcagtgtaataggcnagtctcgctcaagtctgtcaaggggctgaagttgactcattggtagctagatttagtccc

SEQ ID NO: 27801 - DNA, 121 bp, Artificial Sequence
  Synthesized
  misc_feature (61): n=t or g
aggattacattcactgtgttaaagaaatgtataaatcctagaagctgtattgcatccagtntattacagatatgtacagaaagcagttttctttctaaacaccttggagtttaagaagttg

SEQ ID NO: 27802 - DNA, 121 bp, Artificial Sequence
  Synthesized
  misc_feature (61): n=a or t
taaggcgagaggctgtatcaaacaactggcttcagtaagtcactcctttttcctcttgatngatgcaaaaactgtatctatcctaaggatataaagccttccctcagtatttgcaagtctt

SEQ ID NO: 27803 - DNA, 121 bp, Artificial Sequence
  Synthesized
  misc_feature (61): n=a or g
cctgtggctgatttttcagctccctgccctatgcagaagggctgctgtagttgtccacaantgaattagcacacaggcagcattctgcctattgcactcagaaccttaaaacttctgttgc

SEQ ID NO: 27804 - DNA, 121 bp, Artificial Sequence
  Synthesized
  misc_feature (61): n=a or t
tctgttcctttactgaccacgatacacatgctgtcaacttgcctgtcagatgtcccacagnagagctccactgcttcaacatgttcttagaagaatgattccttggacccctacctttatt

SEQ ID NO: 27805 - DNA, 121 bp, Artificial Sequence
  Synthesized
  misc_feature (61): n=t or c
attttcccttcatctttttttaagtgataagtcatacctgcaaaacacctttagaattgtnctgatgttattgatagcttcccacctgctggcaacacattcagtgtctgtgtcacaatta

SEQ ID NO: 27806 - DNA, 121 bp, Artificial Sequence
  Synthesized
  misc_feature (61): n=a or c
cgcctttatataaaaaaccaagaagccatagaatcgtacagcatgtgctggaatgaagatnccacatagaagtttctaaagttttacccatttcaacaatgataactaaattcagtggggt

SEQ ID NO: 27807 - DNA, 121 bp, Artificial Sequence
  Synthesized
  misc_feature (61): n=t or c
ggaacatcatctgttggctgatagctttagagtaaattgctataagggcctttgaagttanactttttaatttaacactgttcacaaactattcattctccgctcacatttccttcaaaga

SEQ ID NO: 27808 - DNA, 121 bp, Artificial Sequence
  Synthesized
  misc_feature (61): n=a or g
taagaaattatgaacaaaacaagagaagcaacagaacgtatttcatgagaatttacataanattaacaccatgttatcatcattaaatgtgatctgcaagttaacagatgattcaccaacc

SEQ ID NO: 27809 - DNA, 121 bp, Artificial Sequence
  Synthesized
  misc_feature (61): n=c or g
actgtagcttgctgtgtcagttggaaaaaccttgtcttaagcaaatgagtgatatgcttgnacacatacaatgtaactatgaatatatctatccatactaatcgtacttcttctatatatc

SEQ ID NO: 27810 - DNA, 121 bp, Artificial Sequence
  Synthesized
  misc_feature (61): n=t or c
gtgcatggggtagtcagtgcagggaaggctgctcctttggttgagctctagtaattagagncctggccctgtaccataaatagagctacatctgtataaagccttctatgagctatgacaa

SEQ ID NO: 27811 - DNA, 121 bp, Artificial Sequence
  Synthesized
  misc_feature (61): n=a or c
ttcacactcacagaagtctcagactaaaataaaaagtgctgttctatttcaccagctgcanaatgtgatctctactaccttgcacatgtgttattcaaacaaggtttcacatcattaggag

SEQ ID NO: 27812 - DNA, 121 bp, Artificial Sequence
  Synthesized
  misc_feature (61): n=a or g
ctcttttgcagttcaaaatccacttgttgagtgacagccagcataaagcacagctgtaagncgggtttcacaccgggccaggcatttgatttttagaggcaagaggttctttagatgtttt

SEQ ID NO: 27813 - DNA, 121 bp, Artificial Sequence
  Synthesized
  misc_feature (61): n=t or c
tttggcatgtcaggcaggcaccaattttagctccttgcgccttgacgagctcagcagctcnaagcgagtgcgctccttccttccatctctgccttgtcccctgtgacagcaatgagtgctg

SEQ ID NO: 27814 - DNA, 121 bp, Artificial Sequence
  Synthesized
  misc_feature (61): n=a or g
tttatgtaaccaactatgaagcaatttccagtatgtattcacagatcctgttttattgacngactttggaggaagtttgtatagcctagaagaactgctaggaaagaacaatactttttct

SEQ ID NO: 27815 - DNA, 121 bp, Artificial Sequence
  Synthesized
  misc_feature (61): n=a or g
gtaatctttgtagtccgccttgaagttcaggctacgatatagcgctgccattgactagccnggcttcaccagacctttcagaaaccttcttgtctattcatgtaaatagatatttggcagt

SEQ ID NO: 27816 - DNA, 121 bp, Artificial Sequence
  Synthesized
  misc_feature (61): n=a or c
aacagaaaaaagttgcagagcaagggacctaggacacatacataccacagtaaggacaaangagtgtcctacctgcacaggcttccaaggttcaattggaggggttaatccagcagcatag

SEQ ID NO: 27817 - DNA, 121 bp, Artificial Sequence
  Synthesized
  misc_feature (61): n=a or c
cagaacaagttccaacgcagtatcagacgatgtgatttacacagcagcacctgcatgtgangtgcgagcactgactgccatgtgtgcgacagagcacgggaacgacggtgaaggcagcggg

SEQ ID NO: 27818 - DNA, 121 bp, Artificial Sequence
  Synthesized
  misc_feature (61): n=t or c
cactgcttccttgcaaagtgcacaagtttcatgttaaagtacttaggagattcagaaatgngagtttggatactcaggaatgggaagcagtttggtaagacaatagttaataatactgaaa

SEQ ID NO: 27819 - DNA, 121 bp, Artificial Sequence
  Synthesized
  misc_feature (61): n=c or g
taggccatctgctgaaggctgcccacgacctcaccctccagggctgtctcatactgaggangaaagcaatgcttgttaacccttacagacctccaaacaataccgtgttgcccacacatcc

SEQ ID NO: 27820 - DNA, 121 bp, Artificial Sequence
  Synthesized
  misc_feature (61): n=a or g
ccctctgtgcgcattattgagtttaggcccatatttaaatttcttttaagatgtttacatnctattgtgttttagctgacaactgatgtttcctatatgaatgagaagtctgaattgtccc

SEQ ID NO: 27821 - DNA, 121 bp, Artificial Sequence
  Synthesized
  misc_feature (61): n=t or c
atcagtttaaaaatgtaaaacacagtcataatccaaaataaaaatgagtttattactgttntctttgcagtgttctggaaatatcttctatttctatgtttttcccaatatgtatctaatg

SEQ ID NO: 27822 - DNA, 121 bp, Artificial Sequence
  Synthesized
  misc_feature (61): n=a or g
atcagtgacacttcactatttttagtggggatatagcaataaccagctgagattctgaacngagctgaaggtcatagaattagtaagattggaaaagaccggtaagttcagcacttctgag

SEQ ID NO: 27823 - DNA, 121 bp, Artificial Sequence
  Synthesized
  misc_feature (61): n=a or g
tgttatcacagtttaaggattggcaaagcatttgctgtgtcacagtaacagatagtgtgcnttgttacccatttgaaaagtaaatatcatcatgttatattaaaatttagcaatattttcc

SEQ ID NO: 27824 - DNA, 121 bp, Artificial Sequence
  Synthesized
  misc_feature (61): n=t or c
aatttttaaagcatgttgtttcaagatcttttattaaaggctttatagagcagatcatttncaggggaaactgcaacaacaaattaatatatctattacatgtgttgagaaaataaccttg

SEQ ID NO: 27825 - DNA, 121 bp, Artificial Sequence
  Synthesized
  misc_feature (61): n=t or c
tgccaaagcttctcaaggctggtggtgctgctctctgacgcaacgcttaatggagcatagnggttggatgctgtgcttggggaaatgatcacaaggttttccttatagctgggagtatcag

SEQ ID NO: 27826 - DNA, 121 bp, Artificial Sequence
  Synthesized
  misc_feature (61): n=a or t
tttatcatttttctccctttctgcttattgctgaatttccagtcagtggcaagactgtgcntctctccccatgattgcatggtttatagatatgtgaatttgttaatcacaaatattttgg

SEQ ID NO: 27827 - DNA, 121 bp, Artificial Sequence
  Synthesized
  misc_feature (61): n=t or c
gtttataaaaagggcatattgaggggaaaaaaagtcctgagaacaaggctctttgaggctngaggttattgatttcagaaattactgagatagttctgatgacatttttctcctgagtatt

SEQ ID NO: 27828 - DNA, 121 bp, Artificial Sequence
  Synthesized
  misc_feature (61): n=a or g
atgccccaggcaattttcactttgtttctatatagtgctaggcacatctccaaatggacanagatccaccaggaaaatatgttatacaaagatttagatgtttgatggataagctgaaaat

SEQ ID NO: 27829 - DNA, 121 bp, Artificial Sequence
  Synthesized
  misc_feature (61): n=t or c
gtcgcagggagccagccatcctaatatctggcctccttcacgaggcttacccaagattacngtcagagcttaagagacaaacgcaaatgccaaggtcctggctgcccacagccttcacctg

SEQ ID NO: 27830 - DNA, 121 bp, Artificial Sequence
  Synthesized
  misc_feature (61): n=t or c
agcaggaggaaaggagaattaagaaaaagctattggtgagcacatgcaaacctttcttttnccctgtttgagtattttcttggctcatcttatgggaagaataaatatataccactgaacg

SEQ ID NO: 27831 - DNA, 121 bp, Artificial Sequence
  Synthesized
  misc_feature (61): n=t or c
gaaaagctgacaccgctgcctgagtttattatccacgctgccctctgtgaggtcctcagangactgtgctgggtgatccctgctctatagcaggggctggcagtggtctttaattaagtgt

SEQ ID NO: 27832 - DNA, 121 bp, Artificial Sequence
  Synthesized
  misc_feature (61): n=a or g
tgtatacatagacaggtatgtgtgcacatagtcacacaaagcaagatcaaattgagtatgnatgtatgctgggaacatgtgcactgaaaagtataaagaattggatattcttgacatctca

SEQ ID NO: 27833 - DNA, 121 bp, Artificial Sequence
  Synthesized
  misc_feature (61): n=a or g
ggctgtggcaatgggtttgctgcagtcttctggggaacgttagctctgtgtgtggtaactngtgtcgttgtctgaatgcagagcctccgggctgggccctgccttctcttggcagactctg

SEQ ID NO: 27834 - DNA, 121 bp, Artificial Sequence
  Synthesized
  misc_feature (61): n=t or c
gctcagctgtgtcttttaacatttcagcaattccagttcatttggaggatttattccattnctcccaggagcgaatctgtgtttatcttttctcacctcagtaagagcccttttcccctcc

SEQ ID NO: 27835 - DNA, 121 bp, Artificial Sequence
  Synthesized
  misc_feature (61): n=c or g
attagattttaaacagtgagtatattctttggagtaaataagaatgagcagaatgaaatcntagtagttagaaaggatgatgtaaaaaatgcacaacttttccagatgtgatggatatcac

SEQ ID NO: 27836 - DNA, 121 bp, Artificial Sequence
  Synthesized
  misc_feature (61): n=t or c
gtggtggttaacatcttttctatgtattaacatcccggcagcagtggaattgcaaactaanggtggtgggaatgaatgggtgcacgtttccgagggcttcccctaatgatgcaggcctttt

SEQ ID NO: 27837 - DNA, 121 bp, Artificial Sequence
  Synthesized
  misc_feature (61): n=a or g
ggtcttatgtgtatcttgacagggtgacaaggcagcaaagagttgggcccaagaggaatgnattagctgtgaaacgcttgtgaggggttacagaaacacagagctgcgctgtgctggaagc

SEQ ID NO: 27838 - DNA, 121 bp, Artificial Sequence
  Synthesized
  misc_feature (61): n=a or g
agtaatgttttttttgtttgtttgtttgtttttccccacctttattctgcctgggttttcntgtacctaaggaaacaagcaagaagcattgcagtgggctgggctgggtggcagcaggtaa

SEQ ID NO: 27839 - DNA, 121 bp, Artificial Sequence
  Synthesized
  misc_feature (61): n=a or g
tataaggttaattccatggattgtttatcatgcgcttatatatgggtataacaaaattctngatactttaagaagaagattttagaacagtgtccttatctgaacacatgtgcttttcatg

SEQ ID NO: 27840 - DNA, 121 bp, Artificial Sequence
  Synthesized
  misc_feature (61): n=c or g
cagtattttttcactgcaaaagaaacaaaacatagagctcagaataggcttctgtgtattnctgtctactttatgtttacttccaatagaaaagtaatcagttatgatattggcaaaaaga

SEQ ID NO: 27841 - DNA, 121 bp, Artificial Sequence
  Synthesized
  misc_feature (61): n=a or g
tttgctagtatgacatgaaattataatttgcagaaatagcagcttggctgcccatactgcntggagcacataatcgctccttaattgcttgcttgcttgttgaaactactacagatagaaa

SEQ ID NO: 27842 - DNA, 121 bp, Artificial Sequence
  Synthesized
  misc_feature (61): n=t or c
ctttatgggaaagcttttaatttaagagactatgagcactggcatcaagacaatattgtangcacgaaacgaattcaagaatgaaactataggaaatgcaggatggatctggcaaaattac

SEQ ID NO: 27843 - DNA, 121 bp, Artificial Sequence
  Synthesized
  misc_feature (61): n=t or c
acactttgttctgccataataaaggttcccagaaactttatgcttggtttcttgcatgtgnaagagatgcctccgttataatatgaatgggtagttcttacctaagcacccttgccttgtt

SEQ ID NO: 27844 - DNA, 121 bp, Artificial Sequence
  Synthesized
  misc_feature (61): n=a or g
accctcttggcaggaaggcagtgaaaggcaagactgagtgctcagtgtcagtgggtatttnaagcctctgcagattccttaaggatgccaaaatgtaggttaccgtgagctatataaacaa

SEQ ID NO: 27845 - DNA, 121 bp, Artificial Sequence
  Synthesized
  misc_feature (61): n=t or c
ttttacaatcccttttaaaatccccaatgggattttaaaatgagcgtgtgatagatctttntaagtgttttacttaaatgaattttgaaagaaatgcaccttgtctttgaggaggtacctt

SEQ ID NO: 27846 - DNA, 121 bp, Artificial Sequence
  Synthesized
  misc_feature (61): n=t or c
ctagagtctttggagagaaataggtttacttgaaccatttgtttatttgctaatatgcttnttctgccaaatggcgagctaaaacaatccaactgcttttatcttttcagtaaaaagaaaa

SEQ ID NO: 27847 - DNA, 121 bp, Artificial Sequence
  Synthesized
  misc_feature (61): n=c or g
gaatgtcacagcagaggtttttccctctacgtgcatgcatggcaattgtcagctacactanttcgtacagtccccctggcctgacagggattttgttacaatgaaactaaagagcagctct

SEQ ID NO: 27848 - DNA, 121 bp, Artificial Sequence
  Synthesized
  misc_feature (61): n=t or c
acttttagagcacagatttatccttttattttaggctgaggaggctgacaccctctctgancaggcttggtgggttggatcctggtttgggcctagggatggttcctccaacaagttttgg

SEQ ID NO: 27849 - DNA, 121 bp, Artificial Sequence
  Synthesized
  misc_feature (61): n=t or g
tttttgtttgtttgttttttccctttcttaactgtttagtctattctgtactgtgtttgtncactgtttcccagctctcaaggttaagcttctgccatgaccagtaactgatcatcagtgg

SEQ ID NO: 27850 - DNA, 121 bp, Artificial Sequence
  Synthesized
  misc_feature (61): n=a or c
gcaaggatttctaaaggagttcagtgtccaaagcctgtggatctatttcacaaccatctanatgtttacaggttcatacttaactgcagcgtgaacgtgaccactcctttcaaagagattc

SEQ ID NO: 27851 - DNA, 121 bp, Artificial Sequence
  Synthesized
  misc_feature (61): n=t or c
tcctctttaagtactaaatagtcaaggagctttgtgtattttcactgggagctttcaatangttacactgacaaaaagactgctcacttttattcctgaaaaagctgcagaggtgaaaatg

SEQ ID NO: 27852 - DNA, 121 bp, Artificial Sequence
  Synthesized
  misc_feature (61): n=c or g
cacctgcacaagccttgaagaattggccagatatttacagatacagaggtctttacatctnaatgactcccaaaattaggttatcactaccctctgaatctggaaattagttaggaacatg

SEQ ID NO: 27853 - DNA, 121 bp, Artificial Sequence
  Synthesized
  misc_feature (61): n=a or t
aggccctgctaataagtctgacccttctgtcttatggtctccctttggatacagaaaaaanatgcacaaaaagatgagggagagctttctgggtgaagtaagggcagaagaaggcagagta

SEQ ID NO: 27854 - DNA, 121 bp, Artificial Sequence
  Synthesized
  misc_feature (61): n=a or g
atctataactgaaggcacattttaagttcacatgggcaagactgctgcgtcccctgtgctnctccccaagagccaacgctgcagcaccgctgtggtcccctctcctgcggcagcagcgatg

SEQ ID NO: 27855 - DNA, 121 bp, Artificial Sequence
  Synthesized
  misc_feature (61): n=t or c
ggggtttctcacatctcatggctatcgaatgaagagaaacaacttctggctttcttctgcnctcgctgttcccaaacaagaagcatttattatacagttttaattaagatttggactgata

SEQ ID NO: 27856 - DNA, 121 bp, Artificial Sequence
  Synthesized
  misc_feature (61): n=a or g
acctcttcagacatagacacacacttacatacaggctttcccaaaagctcttgccaattgnaagtggacatgctggagacacagatttgaatgccgctatccttatcccatgacttcagtg

SEQ ID NO: 27857 - DNA, 121 bp, Artificial Sequence
  Synthesized
  misc_feature (61): n=t or g
agcaggaggtaatggtgtatggtcagtgtagtcaaggaagctgtcctactacctcaggaanaaatgttatctttcacctagatgtcactacaatttgtctcctttatttatgtttcatcta

SEQ ID NO: 27858 - DNA, 121 bp, Artificial Sequence
  Synthesized
  misc_feature (61): n=a or g
cagccggcacaatggtagtgctcattgcagacagatgctgacctcaggtccccatgttgtncataccaggagcagtgccagggtgcacagggtgcagtgctctgcctgctgagcccacctt

SEQ ID NO: 27859 - DNA, 121 bp, Artificial Sequence
  Synthesized
  misc_feature (61): n=t or g
aaataaatatcacacttgtatcttgtctgcatgagaccagaacttaatgcagtgtagatgnacatacatgtggaaaaatatttcaaatttactgttctgtactcaacagctttaaatacga

SEQ ID NO: 27860 - DNA, 121 bp, Artificial Sequence
  Synthesized
  misc_feature (61): n=c or g
ttattattataacagttatttatacctgtttaataacataatgctgcaaggaataaaacanggagactttgtttaccctgccagtaaagacatcagtttctgttcttcccgcaaaggtcag

SEQ ID NO: 27861 - DNA, 121 bp, Artificial Sequence
  Synthesized
  misc_feature (61): n=a or g
tgctaggccagggactgccttaaaatctgaggatgactgctgagcaggaattttgatgagntgctacagtttattaatttagtgtcacacgtactactaatctaaaagatgatcaggctaa

SEQ ID NO: 27862 - DNA, 121 bp, Artificial Sequence
  Synthesized
  misc_feature (61): n=a or g
tccagaatcgagatgtcacccctgggtccccagatttttcacttacatgcttgatcatacnttgtaatgaaggtttgtgatgacattaaaatcttcccgactgcattttctgtataattta

SEQ ID NO: 27863 - DNA, 121 bp, Artificial Sequence
  Synthesized
  misc_feature (61): n=t or c
gcaccacggccaccagcgcccaccccgtgccgagttcagagggatgcacagccatagctgngaggacagcactcggacccatccacagaggagagcaaagatcaaaatacagctaagaagc

SEQ ID NO: 27864 - DNA, 121 bp, Artificial Sequence
  Synthesized
  misc_feature (61): n=t or c
gattctcaaatggctgcacttaaggtgtgtgttctttcttttccggtgcttttctttgccnttgttagttactttttttccctgttatctgagcatggacttcagagtaagctgtgcttca

SEQ ID NO: 27865 - DNA, 121 bp, Artificial Sequence
  Synthesized
  misc_feature (61): n=a or g
caggctgggggaggaaggcagcctcgcttctgagctcaatgtcagtgggttctgcagcccnagctcaccacagacagtcctgaaattgccagggcacagccgagcaaaggcaagcagcttc

SEQ ID NO: 27866 - DNA, 121 bp, Artificial Sequence
  Synthesized
  misc_feature (61): n=a or g
tctcgtgtcttaattttaatgaaggcatgtttttgcctgtgctgcagtcagtaggctagcnaagagcaagcacagtaagaacaaatgggccaggtcctcccttctgaatcacatttaagtg

SEQ ID NO: 27867 - DNA, 121 bp, Artificial Sequence
  Synthesized
  misc_feature (61): n=a or t
attcatatttgtggtttgaaaggacctttcctttcagtttcatgcctctggtttcttattnctggaatagcagcagttaataaggttaatagtgtgaaacagagtgaaatgagtagcacca

SEQ ID NO: 27868 - DNA, 121 bp, Artificial Sequence
  Synthesized
  misc_feature (61): n=a or g
atgacagcataaagaaaagaacgttatctgtaagaattactagctacacttcccttagagnataactattgctgaagaaattatatcaaggaaacttaatattctttaatagggattttac

SEQ ID NO: 27869 - DNA, 121 bp, Artificial Sequence
  Synthesized
  misc_feature (61): n=t or c
caagcttcctgttttgaaattgccataattaaattctagagactgagaaagcaccatacangttgccaagtttatgtcaagctttatcaggtgatctcatcataatccggtaaatagcata

SEQ ID NO: 27870 - DNA, 121 bp, Artificial Sequence
  Synthesized
  misc_feature (61): n=a or g
aggtgaattaatcagtataggacaaagacattactcttgcagttagcagtttttcacccantcactgttgtttttgattcccattgctcaaatgtaaaactttttttatggcccttcagtc

SEQ ID NO: 27871 - DNA, 121 bp, Artificial Sequence
  Synthesized
  misc_feature (61): n=t or g
ctgttgtgcaactgaagaagtggctaaatgattatgtagcataggtgtaaaaatcactgtnctatttgttattgtatctatctctcatacactgaaactattgagatatttccatggttgg

SEQ ID NO: 27872 - DNA, 121 bp, Artificial Sequence
  Synthesized
  misc_feature (61): n=t or c
tgcttattttaatgagtatttcctggaagtccgtggccaatgcattgggaagtgcctgtgntgcaaatatatagaatgcacgctttcttctgttgctgttgtggattgctcttttaaatga

SEQ ID NO: 27873 - DNA, 121 bp, Artificial Sequence
  Synthesized
  misc_feature (61): n=a or t
ctgagaagcagcattttaatccaaaatcacaatagtcagtacaaacttgctagctcaaacngttcaaaataatcccttcacccaaatcaacaatacaaactcactcgttggggttttgttc

SEQ ID NO: 27874 - DNA, 121 bp, Artificial Sequence
  Synthesized
  misc_feature (61): n=t or g
cctgcagaacaattatagtattgatagaataactcaagaagctttaagtcagatatcctcntatcagggtgagatatgaacccatagataacaccagtcttgaaaaaaaaacatgcagact

SEQ ID NO: 27875 - DNA, 121 bp, Artificial Sequence
  Synthesized
  misc_feature (61): n=a or g
gtggagatagctgtatctggccatggcctggaaaatggggatgaggggacacggggacatngagttgaagacctggcatcctcaggagcttccatctagagctgtcaactacataatttaa

SEQ ID NO: 27876 - DNA, 121 bp, Artificial Sequence
  Synthesized
  misc_feature (61): n=t or c
aaaagcacaccctgtcactaatgttgttttatacatagcacaaagtgtactcttgagaaanagcctcatcttctgatacactgaaaagctttgtcaaaagcagggaagcataatctatcca

SEQ ID NO: 27877 - DNA, 121 bp, Artificial Sequence
  Synthesized
  misc_feature (61): n=t or c
gtcaaagagcaccctggctaggaggtcttccccaccacacacaggtgctgtagggaaaganagggagagggaatggcaggagctcgtccatctcttgccagcctgcacatgacacacagca

SEQ ID NO: 27878 - DNA, 121 bp, Artificial Sequence
  Synthesized
  misc_feature (61): n=c or g
gaacagttctatcatgatgcccacttgttatgtgatcattgtaatctttatactttgctantgtggactgctggcttaaagtgataggctcattcccttctttggtaggggttgacgcaaa

SEQ ID NO: 27879 - DNA, 121 bp, Artificial Sequence
  Synthesized
  misc_feature (61): n=a or c
catccacagtagcaatgccatttgaatttccctgaaaacaggaataaaatccaaaagattnaattatctccaaagaaacatctaggatgcactaaaatgcaagtaattattacatcgacta

SEQ ID NO: 27880 - DNA, 121 bp, Artificial Sequence
  Synthesized
  misc_feature (61): n=t or c
acaaataaaagaagccagggggaagaacactaatgaaaacctcacttgtgaagtactgaanaagatttattcattaattttagtccctactttactataaagtgcttttttcaggacactg

SEQ ID NO: 27881 - DNA, 121 bp, Artificial Sequence
  Synthesized
  misc_feature (61): n=a or g
ccaccacaagctgtttagtgagataccctgacactatagtcacctcttctgcctgcagtanctacaggcagcagctacagcttttgttgacattggtgattttcagcatgctagtgaaggt

SEQ ID NO: 27882 - DNA, 121 bp, Artificial Sequence
  Synthesized
  misc_feature (61): n=a or g
aaaattacccagtatttaacagcaatagcaataataccactacaatcaatccagtgccaancacgctgcctgctgctacagagaagggagttttaattccattggttctcattgcaaagca

SEQ ID NO: 27883 - DNA, 121 bp, Artificial Sequence
  Synthesized
  misc_feature (61): n=t or c
gtacatgaccaagaggatcccacagagcatcgccaccacgccaagcagacctgacaacacngagcaggaatgcataatgtctgcagaaagaattcagtgtggagaaatttggttagatggt

SEQ ID NO: 27884 - DNA, 121 bp, Artificial Sequence
  Synthesized
  misc_feature (61): n=a or g
acttcagggcttgggtattggcatttgaaggatcatggctgccctcttctcagagaaaggntcatcagccttcctgaaacctctttgatgaaaatcaactgaaaatctccccagtggtggt

SEQ ID NO: 27885 - DNA, 121 bp, Artificial Sequence
  Synthesized
  misc_feature (61): n=a or t
agaaagcaactgttttgagaaatagtatttaaaaattttgttaagtgtatcaaccaagttngctctgggtaaaacagtaagtcagacgtacctggctgatggagtgcttttgtgtcctcca

SEQ ID NO: 27886 - DNA, 121 bp, Artificial Sequence
  Synthesized
  misc_feature (61): n=a or t
caatctacttgtattttggccaaacacttattaaaaaatgtgctatgtgaaaacaatgatnttcagaagcctgtaaattggatcaattctgagattttttttgactgagagcaagttgcct

SEQ ID NO: 27887 - DNA, 121 bp, Artificial Sequence
  Synthesized
  misc_feature (61): n=a or t
gccatgagggtggtttgttaattttccacagggaaattgaggttttggcatcattttggcngaagggctgatcataacaattaggataaatcggtgagaaacagaacacacctgcaacaaa

SEQ ID NO: 27888 - DNA, 121 bp, Artificial Sequence
  Synthesized
  misc_feature (61): n=a or c
atgcattataccgtgttctgtcattttgtttttctatttctctttatcaaaaattgaagtngtttcaaaaaaagctgatcttaaatcttttctgcttcagaattagctgttgcctacgcta

SEQ ID NO: 27889 - DNA, 121 bp, Artificial Sequence
  Synthesized
  misc_feature (61): n=a or c
gcctacaaggtttcagaggctgcttggatagtttttgaataaactatgccattttcacttntaattgtcgttgagtggatgaaagaaatgcatttcaacatagcaaagcatttggaatgtg

SEQ ID NO: 27890 - DNA, 121 bp, Artificial Sequence
  Synthesized
  misc_feature (61): n=t or c
ttcaacgggttcagctgcagtcttttgctaatgaagaagtagatgcttatgatgcctttangcataggtgttgactttgaaaacatcttcatcaatgataagaagctaatttaagattatt

SEQ ID NO: 27891 - DNA, 121 bp, Artificial Sequence
  Synthesized
  misc_feature (61): n=t or c
ggcacagctgtgggttggtgctggagtttgagcacaaagccagtcctgaaatcccctcctnctttcgcaccctttcccctcccttccagcctctccgcttaattaccactgtgacctaatg

SEQ ID NO: 27892 - DNA, 121 bp, Artificial Sequence
  Synthesized
  misc_feature (61): n=a or c
cagttctgtgaaagggtaaatgcaatcctaacctgaatgaaaggttgagcacctgtttaantacgacacatgacatccagaagcattttccatgctagtcaatgcaaatggagtgaagaaa

SEQ ID NO: 27893 - DNA, 121 bp, Artificial Sequence
  Synthesized
  misc_feature (61): n=a or c
gctgcactcatcttttcgcctcgagttatttcaaagccctgcaccactccaccctttctcnttctaacccctcatttataaggctgggttaaagaggtgcatgtactgcagggctcagccc

SEQ ID NO: 27894 - DNA, 121 bp, Artificial Sequence
  Synthesized
  misc_feature (61): n=a or g
gctgtgtcagagccctggagatggcagaagctctgcagacaggtttacctcgttgcaagcntgtgtcgggaaggaggcctgctgctagcactccttggaaggaaagctggctgcaccacga

SEQ ID NO: 27895 - DNA, 121 bp, Artificial Sequence
  Synthesized
  misc_feature (61): n=t or c
ggtggttttttagatacttgagaatttcttagtgctcacatcagataacccatctgttacngagctgtgggagagccatgagactggatgatgccacactcatgtagaccaggaacctggg

SEQ ID NO: 27896 - DNA, 121 bp, Artificial Sequence
  Synthesized
  misc_feature (61): n=t or c
acaaatgattcgcaataaaaaaatctatcaaaatgaaagcagaatgctaggttaaagtcantgcatcaacactacaagctctcatttgttcatcagactgaggtatgacagtgtcacctag

SEQ ID NO: 27897 - DNA, 121 bp, Artificial Sequence
  Synthesized
  misc_feature (61): n=a or g
gagtcatttacttattttactgacttttaaaataaaagtatttgtagtatatgtggagacntattggatgctcccagtttattctgttgcagtccaacatttcaatgtgctaccgtgacct

SEQ ID NO: 27898 - DNA, 121 bp, Artificial Sequence
  Synthesized
  misc_feature (61): n=a or g
tgaaagactgagagagctgggactatttatcctgaagaagagatggctcaagaggagcttncccaagtggataaataactgatggtgaaagtaaagaaaatggagccagactcttcccagt

SEQ ID NO: 27899 - DNA, 121 bp, Artificial Sequence
  Synthesized
  misc_feature (61): n=a or g
gctgcttttggacaggagctgagaaaatgaaagcaacacaggggagttatggacagccacnaagcagcaccaggagccacctccagccgctggcttgataggtgactgccaacgaaatcac

SEQ ID NO: 27900 - DNA, 121 bp, Artificial Sequence
  Synthesized
  misc_feature (61): n=t or c
gaatttatccaaaattgtttgtctgatttcaaaccaacatcaagatgagaaggaagcctanattattttgaccaaacaatatagcttgatagctcatctcaatgtctaatgaagtaacatt

SEQ ID NO: 27901 - DNA, 121 bp, Artificial Sequence
  Synthesized
  misc_feature (61): n=t or c
tttagccacacacacagcccaagcaccaattcctcccttcccagcttatcaccaactttangccagcagttgcagcttctcctttcaaaaagaagctatcaaatgcatacaggagttgcac

SEQ ID NO: 27902 - DNA, 121 bp, Artificial Sequence
  Synthesized
  misc_feature (61): n=t or c
atcggtcgtcttcatctctgggatcttccttagggagtgaggccagtggtagctgcagganggtttcccccagtctgcacacggggagagcccggggcccttcttgccaacagcccaacca

SEQ ID NO: 27903 - DNA, 121 bp, Artificial Sequence
  Synthesized
  misc_feature (61): n=t or g
agcacgcatccagaagttttctgtgtgtaccttgaatcagccagatccagggctgtgaacnctaatgaaggcctgacttcaggctggaaagagacctccccaaccaagagggagctgtcct

SEQ ID NO: 27904 - DNA, 121 bp, Artificial Sequence
  Synthesized
  misc_feature (61): n=c or g
tcccttctgtacccttgcctggctgtgatgtccttcactttgtactgtctgtgtgatgtgngacaagtgctgaatgctgtcccttgagtaggtgcccattggtgacctatgccctttactg

SEQ ID NO: 27905 - DNA, 121 bp, Artificial Sequence
  Synthesized
  misc_feature (61): n=a or c
tcaagcagtgccaactataggtaagcccacacagaaggctgatagttatcactttaaaagnttgctctgacaatgtttatgatccactgcggttgtgcacagcagagtaaccggtccagcc

SEQ ID NO: 27906 - DNA, 121 bp, Artificial Sequence
  Synthesized
  misc_feature (61): n=a or g
aaaggaggggatgtagtattatcagataacttctcagagatgctctgccagccttgagcanccttattattttcaaaattgcagcagtgctggtttgctttgctgggaacgttcaggcatc

SEQ ID NO: 27907 - DNA, 121 bp, Artificial Sequence
  Synthesized
  misc_feature (61): n=a or g
caatctcttgtagctttgtcacaaatgctctctcttctaggcaacataggtggatacatgntaggcccctgaccaaaaattttattttggtgctttttgataacattgtatgtgtaatttt

SEQ ID NO: 27908 - DNA, 121 bp, Artificial Sequence
  Synthesized
  misc_feature (61): n=t or c
gggatgtgtgcaggggccttcctcctgtaaggcctgcatgtacagcagggctagaatgtcnctgtttagacgagtagatggagccttccatgaagtgcagctgccccagaggtgccagggg

SEQ ID NO: 27909 - DNA, 121 bp, Artificial Sequence
  Synthesized
  misc_feature (61): n=t or g
cacctaaatacatttcttcactctacacatgttgatgaaacagaaccattcccagtgctgntattacttcctcttaagtgctaactgtgtgcttgagttgagtaactccataaagatactg

SEQ ID NO: 27910 - DNA, 121 bp, Artificial Sequence
  Synthesized
  misc_feature (61): n=a or g
acagaaacaggaatctatgactgacttaacttggagctggacttgtgatccttttctaggncagttttctagcacattctccagaacaaagtacctgggtatggactaatttattttcaaa

SEQ ID NO: 27911 - DNA, 121 bp, Artificial Sequence
  Synthesized
  misc_feature (61): n=t or c
tctacatatacgtacacatccgtggtatatacacaaatataaagtatttgggtgctgaaangttaatttgaaccattgtgaatgtgccttcttgaagctgaggtctaagagcagcttcagt

SEQ ID NO: 27912 - DNA, 121 bp, Artificial Sequence
  Synthesized
  misc_feature (61): n=a or c
agtgtaataagaaaaaaagatacttaatttttgttttcccttaaatagctctttaaccctngaattaggaactctataaacttggtgtttgagaaaatttctgtgacaggcaccccaggta

SEQ ID NO: 27913 - DNA, 121 bp, Artificial Sequence
  Synthesized
  misc_feature (61): n=a or c
agcataaaagaagataaagggtaaaatgctcagtgggggaagggtagcaggaataacttgngctttattctgctgcttttctaatatcctttgtcagtttgcatgctgctagtcgggtcat

SEQ ID NO: 27914 - DNA, 121 bp, Artificial Sequence
  Synthesized
  misc_feature (61): n=t or c
taagcgcacttaactggtgtaagctaccagttagagcaggcaaacaaaagaagtgtatcantttaattcaggttactttgaaactgcgaaaacaatcaataggcatacgagcagactatca

SEQ ID NO: 27915 - DNA, 121 bp, Artificial Sequence
  Synthesized
  misc_feature (61): n=t or c
aatggtgtttttttttttaaatgtttcttggaaaatgcaaattgtttttcaaaagctaaancaatccctcattaataagcagtaaaataagcaactcttcctcagtgtgagcactgaaacc

SEQ ID NO: 27916 - DNA, 121 bp, Artificial Sequence
  Synthesized
  misc_feature (61): n=a or t
tctctactataccctctcttttctagatgaaatctatgggcctcactcaatgcccactgcngtctaggtgaagtctcttggtctgcaaaccaaaaggcaaagtgcccaatagtatccacaa

SEQ ID NO: 27917 - DNA, 121 bp, Artificial Sequence
  Synthesized
  misc_feature (61): n=a or t
aagcagtgctttgccaaagaaaaaccacccaggaaaacaagtgggctcctgcttgttaaanaacacaaagggctcatccccaccaccactcaccgtcatcgggagcatcctcgtcccacac

SEQ ID NO: 27918 - DNA, 121 bp, Artificial Sequence
  Synthesized
  misc_feature (61): n=a or t
tgactgctagtacccttccactgcttgctgggtctaaaggtgctttatgaagagacatggngactttatgcttgctggggtatgttttctattattaaatccagctgattactccgtccta

SEQ ID NO: 27919 - DNA, 121 bp, Artificial Sequence
  Synthesized
  misc_feature (61): n=a or c
ttctctttcactgcagaaaagaagcaaaggtgcctgcaagagaataaatgagccacttatnaactgcattttaagtagatatttttaaagttacaggatatttaattgacttactgccttt

SEQ ID NO: 27920 - DNA, 121 bp, Artificial Sequence
  Synthesized
  misc_feature (61): n=a or g
gacggaggctgaggacggcgggtggggggctgatggaacccccgtgaatcccaatgagccntcatagggaacgctgtagggatcgcagttggctgtcgtgaggatcccaatacggtgttat

SEQ ID NO: 27921 - DNA, 121 bp, Artificial Sequence
  Synthesized
  misc_feature (61): n=a or c
tttaatggagctggttcatgttctagagacaggggtgctggggcagcaccaaactggcttntcttccagtctcctgcactctaagacactgattgataccacaaggataaagaatccaagt

SEQ ID NO: 27922 - DNA, 121 bp, Artificial Sequence
  Synthesized
  misc_feature (61): n=a or g
ttttaggaaaatgcatcaggaagagttatagttccattaatcaaacaatgcaaaataggancctgtgtaattctcaaaaagaaacctgccctccctcaaacaaaaactctgttactgcatc

SEQ ID NO: 27923 - DNA, 121 bp, Artificial Sequence
  Synthesized
  misc_feature (61): n=t or c
tcagcagcactgcacactacatctcagtgtcccgctttgatgagctcagaggagccgtacnaccacgcctgtccaggaactgggtcaagaaggtacaacaggtccgtatcaggcacatgca

SEQ ID NO: 27924 - DNA, 121 bp, Artificial Sequence
  Synthesized
  misc_feature (61): n=t or g
agtactcagcaagattttttttctaacaccagcaactccacccattagacagtatgtcttnttaaagtccttggaaagaggtgatgcatttcatataaaattttgagatatcacaaaagaa

SEQ ID NO: 27925 - DNA, 121 bp, Artificial Sequence
  Synthesized
  misc_feature (61): n=a or g
agatgaattggacattatgtagagctccttgccacagcaacattaagtgaaataagtaganagattcatttgttagttccactaggctagttattggctgctgtgctacctttgagaagtt

SEQ ID NO: 27926 - DNA, 121 bp, Artificial Sequence
  Synthesized
  misc_feature (61): n=t or c
ctaatattttctgtgaggttgttgtctctgggcagatgtattctgcactgaagcagggaantgcctcactgaggagcctctgggtgccattagccctcctcatggcagcggtactctgaca

SEQ ID NO: 27927 - DNA, 121 bp, Artificial Sequence
  Synthesized
  misc_feature (61): n=t or c
aacaattctggcagatccattggctggaatacagactggacaccatgtatgtatttcttgngtgtaaattaaggttgtacattagtccacatagcccttgaccagcaaagtccctgtcttt

SEQ ID NO: 27928 - DNA, 121 bp, Artificial Sequence
  Synthesized
  misc_feature (61): n=a or g
tttattttatagcctctatttcttgacattttttcagattttaagttacaggaaactcaanttcatcttccatgtgtatttgtgcaacatccaagacagtgaggttgcctttttgattgaa

SEQ ID NO: 27929 - DNA, 121 bp, Artificial Sequence
  Synthesized
  misc_feature (61): n=t or g
tgaagactgagaaaacaactcccaggcatgcaccaattttcttgtattggatgcatatatnttctctgccctggctgctaagagtcttactgttcactgagaaatgaaaccattagctgat

SEQ ID NO: 27930 - DNA, 121 bp, Artificial Sequence
  Synthesized
  misc_feature (61): n=t or c
gctacgcccttctgcccagctgcactgcaccatcattctctgggctttcgctctagttcanatttgggtgcattttgaggtacgtaggcaagtcatgcaaagtggaaaatgccatgacagc

SEQ ID NO: 27931 - DNA, 121 bp, Artificial Sequence
  Synthesized
  misc_feature (61): n=c or g
gactctgaaattcagaacgcgagctatttcttggagccattttaacttgcctgacttacantgaagaacatggagctggcaggcagattatgttactacactgaaccatattaaaaaacat

SEQ ID NO: 27932 - DNA, 121 bp, Artificial Sequence
  Synthesized
  misc_feature (61): n=t or g
atctaggccatggaatggtccaaatttagagattcctgagcagagaggaaacacaagattnctaaaattcacagaagataagtaaagataggagatcaatgtatcaacaattttttttttt

SEQ ID NO: 27933 - DNA, 121 bp, Artificial Sequence
  Synthesized
  misc_feature (61): n=a or c
agaaaaaaaaagaaaagaaaactgactacgagaggctactacacatattgtatgtataacnaatactttaagttcagtggctgattcagagacactgtcacattggattctctatattgct

SEQ ID NO: 27934 - DNA, 121 bp, Artificial Sequence
  Synthesized
  misc_feature (61): n=t or c
aagttcactgtatgcaggacgctgcttaccatcaccaactaattcctgtcccttcacttcntttccagcacgttctctttcgggatccttccagcagctcaaaattctcaccgtgtaacag

SEQ ID NO: 27935 - DNA, 121 bp, Artificial Sequence
  Synthesized
  misc_feature (61): n=a or g
cctcaccatggggtcacagactaagggaagctgtgtccagggttggagtgttctgtgggancagcttcttaggaaacgtagaagaatgtggggggggggaataagtagttgttgctcttct

SEQ ID NO: 27936 - DNA, 121 bp, Artificial Sequence
  Synthesized
  misc_feature (61): n=t or c
acttttgtcacagtaaccccatgcattgctacagcatcagggcagagtggaaagctctgtngaggaaaacgatctgagggtgctgacagcaagctgaacatgagccagcagtgtgcccagg

SEQ ID NO: 27937 - DNA, 121 bp, Artificial Sequence
  Synthesized
  misc_feature (61): n=a or c
aatgtctatttactgtggaatgaggaaagttggggtctgtttctgaaaaactctttactantcacttgcatgtgttactttccttgatattctgtttatatcagcaatatgttaaccaaaa

SEQ ID NO: 27938 - DNA, 121 bp, Artificial Sequence
  Synthesized
  misc_feature (61): n=t or g
gaagcaaactgtaacccacaggaaacagcaaaggagtggcaacgtgccctgtttctacaanaaattttcagtcatcttttcttctttgcaaacgaccaatgacattcacatctttttttac

SEQ ID NO: 27939 - DNA, 121 bp, Artificial Sequence
  Synthesized
  misc_feature (61): n=a or g
atgagcttgttcttatttaagtactaaagtccactctgccaatgtaaacatcagcaaaggnagataagaaaaggacatgaactgcaaaatgcagtgttttcagctctacaaaatccaagcg

SEQ ID NO: 27940 - DNA, 121 bp, Artificial Sequence
  Synthesized
  misc_feature (61): n=a or g
agcacacagtgaaaacattcctttggttgcctagattaattcacattgcacttacagagcnggcaaaatggttccacacacggagggaggcaatttgacatttcagaagagagaaagcaca

SEQ ID NO: 27941 - DNA, 121 bp, Artificial Sequence
  Synthesized
  misc_feature (61): n=t or g
ttgggtgtggagatgtggagcccgctgttcatgatggtctgcagcctgtgatgggggttcntgtaggcctggaggcacatggagggcatgtagcctttgcgcccattgtaactgaagagga

SEQ ID NO: 27942 - DNA, 121 bp, Artificial Sequence
  Synthesized
  misc_feature (61): n=t or c
gttgtcgttcttttgcatcccctggagcctgtaagatgcatgcataggtgggtgaaccttnatcataagattttgggccttcctgtgaagggctaattattcagcttccttttgaagcagc

SEQ ID NO: 27943 - DNA, 121 bp, Artificial Sequence
  Synthesized
  misc_feature (61): n=c or g
ctgtgatttgtggcattctggacagcaaaaggggaaactctccacacattccatcatttcntagcccagtaagtgcttataagttctcccagaattatggggagggttttttgttactgtt

SEQ ID NO: 27944 - DNA, 121 bp, Artificial Sequence
  Synthesized
  misc_feature (61): n=a or g
agcaccacaaacatggaaacacctacaaacaaaccaatatgaagtcaaaatttgttgtgtnttaatcctcacacattcagagtgacaggcatgattttcagaagaagactttgtaccatca

SEQ ID NO: 27945 - DNA, 121 bp, Artificial Sequence
  Synthesized
  misc_feature (61): n=a or g
actgtttaataaggagaagaattaaaggtcctgggggggatgagtatcttcctaggacagnagtgagattcagggcacgtggaagaagagattgtagttgtctgaaaagataatgggaagg

SEQ ID NO: 27946 - DNA, 121 bp, Artificial Sequence
  Synthesized
  misc_feature (61): n=a or c
agagttactgtgttgctttttccaccctattaataaggataagaatttttaggtagatcanatatttgagggtttaccaccatacatgacattgcacatttttactctgcatcttgatctt

SEQ ID NO: 27947 - DNA, 121 bp, Artificial Sequence
  Synthesized
  misc_feature (61): n=a or g
gtttaatcttacaacctattcttgcagaacaagtgccacaaatacactgtagcacataatncaaatgagctgattctttcactagggatgaaaatatttttattttcccagttactatctt

SEQ ID NO: 27948 - DNA, 121 bp, Artificial Sequence
  Synthesized
  misc_feature (61): n=a or g
taaaagaacaaagccattaacaaagcgctttcccatgtgattcaaattagggcagccatantggttgaagacaattgtgttttctttcttttcagtgatactttacaatttggggaagttt

SEQ ID NO: 27949 - DNA, 121 bp, Artificial Sequence
  Synthesized
  misc_feature (61): n=t or c
agaagtcttctaactaatcagacaacttttcgggacagtccagttctttaaagaagacgantacattggtaataatgtaggcaaacttgttccggtgaatcagtttgattgaattttctat

SEQ ID NO: 27950 - DNA, 121 bp, Artificial Sequence
  Synthesized
  misc_feature (61): n=t or g
ccaagaaagtaagaagtaaaggcagacaaccgctaattgagtacaaattgcagtccgttanttcagttctgttctatattcaagctgacagagtggtgtcttttccttgatgtctgttcct

SEQ ID NO: 27951 - DNA, 121 bp, Artificial Sequence
  Synthesized
  misc_feature (61): n=a or g
tgctgtcatttataaaggacaggccaatgaatgtgctgtgtggagaataaaagaccccaanctgctacaacagtgatgttattctctcaagtttctggatgatgaccagggctgacacgca

SEQ ID NO: 27952 - DNA, 121 bp, Artificial Sequence
  Synthesized
  misc_feature (61): n=a or g
ggcagaggaggaggagatggtaattaattgtgtattctgcttttatattgtgaaagaaatntgtttttatggtttttgtctatctgtggggcatattccatcaggaagtgccctgtctcaa

SEQ ID NO: 27953 - DNA, 121 bp, Artificial Sequence
  Synthesized
  misc_feature (61): n=t or c
ccaacgatctgacttttcaatactaaataaatcctgagaaaaatgcagtgtagtaacaaanacttcagctaaatctctctataacgtagaagctaaaaccatggaaagttttaatgtcgta

SEQ ID NO: 27954 - DNA, 121 bp, Artificial Sequence
  Synthesized
  misc_feature (61): n=a or c
agaaacacatttgatttcagcataaaacataagtttgcacaaggtaaaacttctgtgcaantgctctcttgaatttgggcctcatttactttggaggcagtttccattatgctgccattat

SEQ ID NO: 27955 - DNA, 121 bp, Artificial Sequence
  Synthesized
  misc_feature (61): n=a or g
caaagcccatgttaaccctaatcacagggctggctttgcttgccttttaagacattcaagngactgcaatccggatatttttcatttcctaatccaacacaaaactgtgccatgcactgca

SEQ ID NO: 27956 - DNA, 121 bp, Artificial Sequence
  Synthesized
  misc_feature (61): n=t or c
gtcgcaggtgaaggtggcagtcctgccacatgctggtgagtgtgcacacagcttactttgnatctaaatattttggaagactcaaaagggagaaggaggccaaaataccactactgagctg

SEQ ID NO: 27957 - DNA, 121 bp, Artificial Sequence
  Synthesized
  misc_feature (61): n=a or g
aacaagccctttccaagacaagcattaccaaacatgcttactcatacccagcaaagatatnccacaacagacttgtttgcagatcagtcctcttctgatttctccacagccatcagtttag

SEQ ID NO: 27958 - DNA, 121 bp, Artificial Sequence
  Synthesized
  misc_feature (61): n=t or g
tgtttttcttgaagccggtgccctcagtggctatgacaaaccttggtgaggtcgtgatttnaaagtgcatggaagtggtattcttttaccaaaagacactgctttgccccacactggggga

SEQ ID NO: 27959 - DNA, 121 bp, Artificial Sequence
  Synthesized
  misc_feature (61): n=c or g
gaaaacacagagatggaaagtgtgatgcaagccagaatttattggaggttccagggagganggatgtggcagaaggtctgagcctggccagaggatgtccccatctccttgcagagggcag

SEQ ID NO: 27960 - DNA, 121 bp, Artificial Sequence
  Synthesized
  misc_feature (61): n=a or g
ccagaagacgtcagctctttgataaaagagtttgcaaactgtacatctaaatggcaatcanggccaactttgattcacaatactaagtgtgacaacaaagaggttctcgttggaatccagc

SEQ ID NO: 27961 - DNA, 121 bp, Artificial Sequence
  Synthesized
  misc_feature (61): n=t or g
tcactgcactcacaacactgtgacactgtgcacgcccacacctctgtgctctgagtctttncctcagcagttacaggtggagcttgcaaaacctctgcaatgaagcactggctttctttaa

SEQ ID NO: 27962 - DNA, 121 bp, Artificial Sequence
  Synthesized
  misc_feature (61): n=t or g
atatttataaacaggaccattcctgttaattaccacgttttaccttgtctgtagtttatcngagataaatagacttataatattttatcaatagatacctctgttcagtgtaagaaactca

SEQ ID NO: 27963 - DNA, 121 bp, Artificial Sequence
  Synthesized
  misc_feature (61): n=a or g
acatttcatgaatgtcaataaccatagtatgtttaggtgatgccctactggactctcaacncagatgaatgtgccagggagaggcagtcctcaggagaattacccagaaaagatgagccag

SEQ ID NO: 27964 - DNA, 121 bp, Artificial Sequence
  Synthesized
  misc_feature (61): n=a or g
tgaaaacagagcttgctcagatgataaatagctttaattgcactgggggctgtgaggatgnagagtcagcaggctcaaactctgtgcacccatgtttctagagagatagtggagatacaga

SEQ ID NO: 27965 - DNA, 121 bp, Artificial Sequence
  Synthesized
  misc_feature (61): n=a or c
ctctaaaaggatcacagttttcacaaaccataaaatcataagacaccctaatggaaaattntagttaggaataaactctaatccacattgctaaagttggtgttcacaaaaacaaggcgta

SEQ ID NO: 27966 - DNA, 121 bp, Artificial Sequence
  Synthesized
  misc_feature (61): n=t or c
aatgtatgaattagaataaatagcagggtctatcttcacttttctctacgtaactactttngatgtgatgctaactgcagatattggaaagaaatgatgttttccacatctaagtatgttc

SEQ ID NO: 27967 - DNA, 121 bp, Artificial Sequence
  Synthesized
  misc_feature (61): n=c or g
agtcacatcaggggttcacctttgagtagtctcagacatgccctagttcaaaggtaacaanagcaaactgaggaaagttagttcgttgacttttcactcaggtaacctcaaaggtgccagc

SEQ ID NO: 27968 - DNA, 121 bp, Artificial Sequence
  Synthesized
  misc_feature (61): n=a or g
acatttcaataatgatatggccactattaccaatttgaattggatataaatttggatgagntctattttcccaatcttttttcttaaagaagcaggttctcactcttagaagatttattat

SEQ ID NO: 27969 - DNA, 121 bp, Artificial Sequence
  Synthesized
  misc_feature (61): n=t or c
aaactatgccataatgcatatcatgggaatgatctaattcacgaaccttccaagaaagagntgtgggcttgaggggggtgtttgtctctaatgcatcatttccctgttctggttgacaaag

SEQ ID NO: 27970 - DNA, 121 bp, Artificial Sequence
  Synthesized
  misc_feature (61): n=t or g
aaggttggaggcaacttcagccatgtacactctcaatctgtcttagtgccacttcatttcncaaaaacaattaaacattcactggatatggaactggaacctgccagggagccttagaggt

SEQ ID NO: 27971 - DNA, 121 bp, Artificial Sequence
  Synthesized
  misc_feature (61): n=a or g
tctccacaatgggtctttcacttaccagcaaccccactcaattagtcacacaagcaacccnttcccttgtaatcagtttataagacagcagggcttccttgtaactggctgactaattgcc

SEQ ID NO: 27972 - DNA, 121 bp, Artificial Sequence
  Synthesized
  misc_feature (61): n=t or c
aatctgctccccgtcatacagagcaccgaaactgttctcctgtacctcgacacgcaagaantgcttcactccgttccttctctcacctccagtataaaggcactccttcaaaaaacaacaa

SEQ ID NO: 27973 - DNA, 121 bp, Artificial Sequence
  Synthesized
  misc_feature (61): n=a or g
actgtactgtggtagtgaagtaggaaggcaaaaaatgtgtgctatactgaaatgccagatngtttttgatggtatcaggtacattttgtgtgtctgctaaatcttgctttagcaggcaaaa

SEQ ID NO: 27974 - DNA, 121 bp, Artificial Sequence
  Synthesized
  misc_feature (61): n=c or g
ttagtggtattttccaaccctaatgattctgtgattgtattaaacagtattgtgcctgtcnctgaaatgctttgcgtgcagagcatcatgcactatgggacaaagaaaagggatgaatcgt

SEQ ID NO: 27975 - DNA, 121 bp, Artificial Sequence
  Synthesized
  misc_feature (61): n=t or c
tgtgctctgcctcttctgatgattacactcagtgaaaacatctatctcctgcttcctgttnttggaggtggggagaataaaaacaaaatagaatgaattctattctaaaatgctaatctaa

SEQ ID NO: 27976 - DNA, 121 bp, Artificial Sequence
  Synthesized
  misc_feature (61): n=a or c
catttatcagcaatccaacatacccaatgccttattcaatacaagtcacaaattagttttngaagagctacatgatttttttccagacatgaagaagaccactgttctatggaagagtaac

SEQ ID NO: 27977 - DNA, 121 bp, Artificial Sequence
  Synthesized
  misc_feature (61): n=a or g
cctcggatgacttaacgctttctagaacactaaatatggtctctccttgcataacccttcnccaataaagggtacctcgctgtgtgtgcttctgagtttgcactgctggcacctccggggc

SEQ ID NO: 27978 - DNA, 121 bp, Artificial Sequence
  Synthesized
  misc_feature (61): n=t or c
tccacactcctgggctcctcctgcagatctccacgcttctggagaggtgtgagaaagctgnaccttgtgatccagtactcacgttaactgttgtcccctgacagtgtgccttctgcatctt

SEQ ID NO: 27979 - DNA, 121 bp, Artificial Sequence
  Synthesized
  misc_feature (61): n=t or c
ttccctgacccagcctgttggacacgcagactctggtaccctctcacatggctattccctncaggctttggaagaatgcataaagtttccttcacagcagtgaaggcaaggagaaagttag

SEQ ID NO: 27980 - DNA, 121 bp, Artificial Sequence
  Synthesized
  misc_feature (61): n=a or g
gaagctgagaaaaagcagtggtagaatggaggggaaaacttcaccctttggcacagggcancttgtgtaggatcctgtatgggccttcaggggctgtgaccgttcagtatctgggttattc

SEQ ID NO: 27981 - DNA, 121 bp, Artificial Sequence
  Synthesized
  misc_feature (61): n=a or g
gctcttccattttccaacatcaagcctgcagaaaacagctgtagctgattaaagaagactngtagtataggatgaattagtcagaagaaggtaaatacgtgtaaggttaaaaaacaggtag

SEQ ID NO: 27982 - DNA, 121 bp, Artificial Sequence
  Synthesized
  misc_feature (61): n=t or c
gaaaagaggtcatcctcaacagttacttttgttttaaatacgctcttgctatgaattccanacacagcctttgactggagaagagctcagttatgaaccagaaagaaaatgaaatgaagta

SEQ ID NO: 27983 - DNA, 121 bp, Artificial Sequence
  Synthesized
  misc_feature (61): n=t or c
ccctcatttcattttctgttttgttcagttttgcaggagcatgtccatttccaccagtatnctgggagtcttaacaagaaacacactattaatgtttacagagcctcctacacgtatcttt

SEQ ID NO: 27984 - DNA, 121 bp, Artificial Sequence
  Synthesized
  misc_feature (61): n=c or g
acacaggaaaaccaaatctgcgctagttagtgcctgcacatacgggtaatgcttccaatanagctttctgaaggatcaacaattaattaattcggctctgagctcatcagacagctcagaa

SEQ ID NO: 27985 - DNA, 121 bp, Artificial Sequence
  Synthesized
  misc_feature (61): n=t or c
gtcagcctggatgaaagtcagaactcatcctctcactccatcagatactgaaatgccacangctaaaggtgtcacggtaagaacaatttcaatgcatagctgtgttaccctttaaaagggc

SEQ ID NO: 27986 - DNA, 121 bp, Artificial Sequence
  Synthesized
  misc_feature (61): n=t or c
tatgttactgtccatggacacaaccatatgaaaacagtgagcaataatagctaaggagagnagaagatacctccatcctctttcacttttctgagtagtgtcagtagttggcagcttgtta

SEQ ID NO: 27987 - DNA, 121 bp, Artificial Sequence
  Synthesized
  misc_feature (61): n=a or g
caccttccttgaagaaaagcactgctttatttagaccttctgccaggctaacaaaacacantgatggaaagtgccaatacaccatgaaagaaaagactaaagttgctttttgaggcatcca

SEQ ID NO: 27988 - DNA, 121 bp, Artificial Sequence
  Synthesized
  misc_feature (61): n=t or c
gagcagcatttggccactgctaatgggggtaactgagcccactgatggtctcgcatgcttnccagcatggctgctctgggcagttacactgcacttatgatccttctccatgtaaagccca

SEQ ID NO: 27989 - DNA, 121 bp, Artificial Sequence
  Synthesized
  misc_feature (61): n=t or c
tgaaaggtgaaaagttctgaagataacaggagctttccatacttctggatgagatcagctncctgggagttaggctataatttcctatgctttattcacactgaagagttagtaagattgc

SEQ ID NO: 27990 - DNA, 121 bp, Artificial Sequence
  Synthesized
  misc_feature (61): n=t or c
cagagccgagggcaggtggtgcaggaaaacacacaaatcatagcttccagcaggcagagcngctcggcgtgagctgttttcagtctgagtgggtttcctgttgtggaacagtggaagaggt

SEQ ID NO: 27991 - DNA, 121 bp, Artificial Sequence
  Synthesized
  misc_feature (61): n=t or c
tctgtgagggtacacgcatttctggcagttgagagtaatggcaatacttaaaagagaatanaatatagggaaagtgttctaccgttgaatgggatcagtggttcatgactggcagtcatgg

SEQ ID NO: 27992 - DNA, 121 bp, Artificial Sequence
  Synthesized
  misc_feature (61): n=t or c
tgccttctgcagtggccagagacagtagtgctgtttatatgttcatcttccatttatcttncatgtgaacttacgagtaactccatctacgtgttcaaatattacacaaagtatgctgtgt

SEQ ID NO: 27993 - DNA, 121 bp, Artificial Sequence
  Synthesized
  misc_feature (61): n=t or c
attttagttgttcaagacagttctgagtattttgccacttcatcatttttgaactcatagnatacttggtactgtaaataaggctgatgtaaacaagcttggcaatcagtgagatttttaa

SEQ ID NO: 27994 - DNA, 121 bp, Artificial Sequence
  Synthesized
  misc_feature (61): n=t or g
gttcttgctgtgtgaataactattcatatgtaagttgcagtccattatctcctcttcaaanaggcaaccactctcttcaccgcaagaagctcatgttcttctctaaagctgtaagcagcag

SEQ ID NO: 27995 - DNA, 121 bp, Artificial Sequence
  Synthesized
  misc_feature (61): n=a or g
ctcagactagatttcaacactgcttgcatggatttacgagtgactcatttctaagagaatntaacttgattaaaaatgcattaagcattaataatggggtatttcttgtgctttaagaaaa

SEQ ID NO: 27996 - DNA, 121 bp, Artificial Sequence
  Synthesized
  misc_feature (61): n=a or g
ccacttcacatgcttaatactatgatctgaatgaagaaactgactatgagaggatgctaanctcagttaagcttgctgaggtttgtcagtgtggaatacattttacttcactttactgtgg

SEQ ID NO: 27997 - DNA, 121 bp, Artificial Sequence
  Synthesized
  misc_feature (61): n=t or c
caggacaaatctgtgctagggctgaaatgttctcccttgcactttctgcaggtccaaaccngcaccctttacctctatgtgcagacctcagtgcccttaagcccagctgtgtgatggtagt

SEQ ID NO: 27998 - DNA, 121 bp, Artificial Sequence
  Synthesized
  misc_feature (61): n=a or g
aaactgactgctgcctaggacagctaaattctgaagtgtggttatttgaaagcagaagaancaagaaagagaagaggtgcgaacacatcacaaggtgatagccttgaggcccactaacaca

SEQ ID NO: 27999 - DNA, 121 bp, Artificial Sequence
  Synthesized
  misc_feature (61): n=a or g
tgcgcaagttggttgtactagtgattctgctgttaacttgcataactttaatgagaatgtnaaacagatatgaattactcttatttggaaatttcagttaaaacctgtagattttcaagta

SEQ ID NO: 28000 - DNA, 121 bp, Artificial Sequence
  Synthesized
  misc_feature (61): n=a or g
atgacttttacaccaagtttcttcctgcttctcaagctttgattctaatatgacagaattnatttttatatgcatgtatattttcttttggaacactgttgagtgggcaaaattgtaggtg

SEQ ID NO: 28001 - DNA, 121 bp, Artificial Sequence
  Synthesized
  misc_feature (61): n=a or g
gtcagtcaacaataatgttatcaccacagctgtggtgtgactgattacacatgagtgtgtncacacaatgagatgggatttttttccagtggaagatgagagagttccattgctgtgggtc

SEQ ID NO: 28002 - DNA, 121 bp, Artificial Sequence
  Synthesized
  misc_feature (61): n=a or g
gtggtgaagttggttcccgggcagctatgtcacattcctggctatgtgagctttgtgagcnagaagtgtttgcagttatgcccagcgctcagatctgcccaggaacacagcactgtgctgt

SEQ ID NO: 28003 - DNA, 121 bp, Artificial Sequence
  Synthesized
  misc_feature (61): n=a or g
agggagagcagctccgggcgtcagcgtggccggttaaggtgatggatgagttgggtttggntttggtcgctcctcctcctgctgggtcttgttctgccctgctgcaaagaggaaatctcat

SEQ ID NO: 28004 - DNA, 121 bp, Artificial Sequence
  Synthesized
  misc_feature (61): n=t or c
cggacacagcaggatttcagagggtctcctgccatgatgtggcgcactctgtgtttgcttntttgctcctgatcctgttggaaaggggcaggagggctgcagggactgggctggagcatcg

SEQ ID NO: 28005 - DNA, 121 bp, Artificial Sequence
  Synthesized
  misc_feature (61): n=a or g
ttgaaagcatttggtgcatctgtaaacactatgaatcagtcttttcctgactcaaggcaanaagttacaaagaattcagttaaggcataataaaatctgtatgaaagtttgctagaaactg

SEQ ID NO: 28006 - DNA, 121 bp, Artificial Sequence
  Synthesized
  misc_feature (61): n=t or g
tcactggaatgaatagaggaatgaaaatgcccagttgcacagggaagggcactgcaagggngaagaaaagatttgcagtagcagcactgacaggaggatcgtcccgtaattgaaaatctgg

SEQ ID NO: 28007 - DNA, 121 bp, Artificial Sequence
  Synthesized
  misc_feature (61): n=t or c
ttcctgttacagttaagaatatccattacacccttgaacagtcaacaccatgagaaaatgngttttctttttaagcttagcgatgtttcaaatcattggagtgatactggcagagcactgc

SEQ ID NO: 28008 - DNA, 121 bp, Artificial Sequence
  Synthesized
  misc_feature (61): n=t or c
taccttaccccctgaaaatccaagtagcagaattttgtgaatgaaactgcacttctggtgnatcagctgtgatggagagaatccattagaaataccactagcttcacaaaccatcaacttc

SEQ ID NO: 28009 - DNA, 121 bp, Artificial Sequence
  Synthesized
  misc_feature (61): n=t or c
tgttcctctttcagggatgcctcagaacagaagaatgggatgcatatgctgtattgtctgngtggaaaataaacataacctccttcaggaattaataagattaagttacacttcaattgaa

SEQ ID NO: 28010 - DNA, 121 bp, Artificial Sequence
  Synthesized
  misc_feature (61): n=t or c
gtgatggctctacaagtgttgacattgatttgacttttgctataaaaattggagaagtatnttccatgagtgttttctcctttgacgctccgtaatgccaccacttccacctaaatatttg

SEQ ID NO: 28011 - DNA, 121 bp, Artificial Sequence
  Synthesized
  misc_feature (61): n=t or c
aagaagaaatgtggaaagactcacagcttattttacagcccatgtaccatcagcacgtcantcagaaaggatccaggtgaggtaccagggcagaagcatccaccatccatgttacagcatc

SEQ ID NO: 28012 - DNA, 121 bp, Artificial Sequence
  Synthesized
  misc_feature (61): n=a or g
tgaaacaaaatagtgtagctcttcaccgaacatctccaacaatggaaatacagaactgtgnccagcacagggaaagtgaaagatcatttttgaccacagagattgtagggaaagtcacaca

SEQ ID NO: 28013 - DNA, 121 bp, Artificial Sequence
  Synthesized
  misc_feature (61): n=t or c
atagatgtagctttttaatatcaacgtcttcccaagtaatcctttcctacgtcagggacangatgctagatacttagactgctaccagctcctttccttttcaactcaggaaagcattctt

SEQ ID NO: 28014 - DNA, 121 bp, Artificial Sequence
  Synthesized
  misc_feature (61): n=a or g
gtgtaaaggaaaatggagaaggatcagttcagcattataactaaatgcatgctgaataacngccatgtagagcaaacttgagggacagttatcaaggtaattagtatctcttccttttgtc

SEQ ID NO: 28015 - DNA, 121 bp, Artificial Sequence
  Synthesized
  misc_feature (61): n=t or c
tctatggctagactttactggctgttgtaatgggaagagagaattttcatgcctacctccngccatggacagcagtataatactacttcagttcctagcctacaacatacttagctgctcg

SEQ ID NO: 28016 - DNA, 121 bp, Artificial Sequence
  Synthesized
  misc_feature (61): n=a or g
cctttgtgaaggcttttacataggaaagagtaacggtggggtagcaagttgccacgtgttngctactccagaagaagtgctgtgaggattttactcctgaggtgaagggctgccagctgat

SEQ ID NO: 28017 - DNA, 121 bp, Artificial Sequence
  Synthesized
  misc_feature (61): n=a or g
ttccaaaataaaatctgcagctctgtcttccccccagggatgaaaaaacgttgttaaagcntaactggattttgcattatggaagctgtgctctgagccactcacacagatataacctgat

SEQ ID NO: 28018 - DNA, 121 bp, Artificial Sequence
  Synthesized
  misc_feature (61): n=t or c
ttgagaacagcaggagatctttacattcaataggccatgagctgcattacttcagcacaantgatgaagaaaagatagatcagtgaccttagcattttggatttctttacatttttatgga

SEQ ID NO: 28019 - DNA, 121 bp, Artificial Sequence
  Synthesized
  misc_feature (61): n=a or g
agattatcacatgtagttgccggggccgcccagggggatcacaaacacagagatgtcatcnccagagcccagcttgtcgttgggcagccgccagcctcgctccttcaggacgcccctggag

SEQ ID NO: 28020 - DNA, 121 bp, Artificial Sequence
  Synthesized
  misc_feature (61): n=t or g
ctgaatagcttatacagaaacaacaccagtgcctagaacaattcctttttaggctgagacngaagcactatggtggaacaacataggtgaggtatatcacagaatcaggaaatcgctgaat

SEQ ID NO: 28021 - DNA, 121 bp, Artificial Sequence
  Synthesized
  misc_feature (61): n=t or c
aaattcaagtgattaaaacatgatgtacccttttagccctgctccttctgagacttttaangttctcgttttttattacaggagctgatgaactgtaagtgattgggaagagagaatagat

SEQ ID NO: 28022 - DNA, 121 bp, Artificial Sequence
  Synthesized
  misc_feature (61): n=t or c
actttgtagaacagatagcccttcctctgatgtaaacatacaagaacaaaatagcactcangcagccttggtgctgtgatccacatacaaaacagacaggatggcagtgaggatgataaag

SEQ ID NO: 28023 - DNA, 121 bp, Artificial Sequence
  Synthesized
  misc_feature (61): n=t or c
ctttgtggaaacaagaggagatgatctcctttgtgcccactgcttctctgagagcacggangtggcgagtgaacaaagtcattcccgtctccccgactgttcaaatcctatggagcatcgg

SEQ ID NO: 28024 - DNA, 121 bp, Artificial Sequence
  Synthesized
  misc_feature (61): n=t or g
agcagcatatatccaaagtatatattgctgaaacttttggacctgagtcccttatcttagntgtgcattttaaacattcttaatgtttctgaaacactttgtttctgataacttgtcttta

SEQ ID NO: 28025 - DNA, 121 bp, Artificial Sequence
  Synthesized
  misc_feature (61): n=t or c
gatcctgggaggctgttttactggctgtccagggtcacaggttgaacatgcctggtttagnggtagacatgtcagtgctacattaatgatttagctccatgaacttggaggaattttccaa

SEQ ID NO: 28026 - DNA, 121 bp, Artificial Sequence
  Synthesized
  misc_feature (61): n=a or g
ggggaatattagaagtgagatcatctgtcagaacgttgtcaaagttatattttttccaggnaaataaaccatccagcatgtactgtcagaagataatatctgtatgtgcacctcggggttg

SEQ ID NO: 28027 - DNA, 121 bp, Artificial Sequence
  Synthesized
  misc_feature (61): n=t or c
cactacttggactccctgttaataagtagcccaaatgctggtaaggttctttggagtcagnggactttctggcatgatagaagcagtctgtagagctgtttgggtctaacttaggcatgac

SEQ ID NO: 28028 - DNA, 121 bp, Artificial Sequence
  Synthesized
  misc_feature (61): n=a or g
aggcagggtgttgcatggtggtttgctgtgctggcgcgatgtgcgtgagtctgcagtgtanacttgcaaattgaaaggcatggaaagtgctatatgtcacagtcatttagactgctgtgca

SEQ ID NO: 28029 - DNA, 121 bp, Artificial Sequence
  Synthesized
  misc_feature (61): n=t or c
cagaaagagtcacacagcttgcaactggttccttacaagtgggagcaattctctgtggagngagggcagtgacattacacactgcagcctgaggaggaggtataaagtgactttcctttac

SEQ ID NO: 28030 - DNA, 121 bp, Artificial Sequence
  Synthesized
  misc_feature (61): n=t or c
tacagccccatttctgcaagctgtcacagcatagggagccaggtggatagggagtgactgnaacaacgtgtagatcgggctgtgcctcccccagaagtggggagcttgggtttttgggaag

SEQ ID NO: 28031 - DNA, 121 bp, Artificial Sequence
  Synthesized
  misc_feature (61): n=t or c
tgccaattccactgaactgataaatgcagccactgctatgcgttttccttcactctgcaangctttcaaatgtcctctttattacaaataaatctaccccttatttttcactgcattacct

SEQ ID NO: 28032 - DNA, 121 bp, Artificial Sequence
  Synthesized
  misc_feature (61): n=a or g
cttgggcctggacagcccctcacaggcttcagttcttcaccatatcagtcacaagcatcancgataagtaattcaaagcagcttaatctccaaaccctaaaaaccaagagaacaactcccc

SEQ ID NO: 28033 - DNA, 121 bp, Artificial Sequence
  Synthesized
  misc_feature (61): n=a or g
ttcatttcagacagcatagcttggcctttgctttttatgtaaggcccttaattctctaagnacttctacacaggtatgcatgattccctgtcttcttcccactcccaccaaatattttgca

SEQ ID NO: 28034 - DNA, 121 bp, Artificial Sequence
  Synthesized
  misc_feature (61): n=t or c
agaaaaaagcaaaagcaaccctgatgctgtgacacaggattttatccataggcttttcagntctgccaaatctggaattgaaaatgcggaataactacaagggtgggcacaaatataatca

SEQ ID NO: 28035 - DNA, 121 bp, Artificial Sequence
  Synthesized
  misc_feature (61): n=t or c
gttagtaggcagagggatggttactgagtgcaggtgtattcctgatctgttctgttagaangtaaattgtttgtgtccaacctgataattttatgtttttgttgccctcttcttttttttc

SEQ ID NO: 28036 - DNA, 121 bp, Artificial Sequence
  Synthesized
  misc_feature (61): n=a or g
gagtcaggcattttgataagacgtgagatgaagttcttttcatgcatgagcattttgttgnaaaccccgcaggtcactgtaacaggcagtcattttctatctgatgtatagaataaggtat

SEQ ID NO: 28037 - DNA, 121 bp, Artificial Sequence
  Synthesized
  misc_feature (61): n=t or c
ttcaagagtttttgcaggaaaatcaaggctctcaactgcttctgtagttgttgtaagagcncaagcacttcgtttctgccagagaaactggttttgtatgtgctttattcctactgtagtc

SEQ ID NO: 28038 - DNA, 121 bp, Artificial Sequence
  Synthesized
  misc_feature (61): n=t or c
gccccatagctgcattttctcaagcaatcacatagcctgcagaaaaacccaggacagatgncccagacccacagcagagggttccccagctctctgcgcaggcagcagcatgggtgggata

SEQ ID NO: 28039 - DNA, 121 bp, Artificial Sequence
  Synthesized
  misc_feature (61): n=c or g
acatcagttatgacattatcataccatgactgtgacgtgtagtagataactgcatgtcatntgccagcaagagcaggagagaaagggcatcagctgggtcaagaggttcagtcagacacca

SEQ ID NO: 28040 - DNA, 121 bp, Artificial Sequence
  Synthesized
  misc_feature (61): n=a or g
gaagggctgcagccatgctttggtaacaccagggcctgcacgacttctactccctctttcnaccattcaattcttatgccaccacaaagcatacgagtcacatactgcagcacatttaact

SEQ ID NO: 28041 - DNA, 121 bp, Artificial Sequence
  Synthesized
  misc_feature (61): n=a or g
gcccgcagtgcctgttggattaaccgggaagatgctgggctcatcaaagcgatgcaccttnataatactcagttttagttcatggcgttgtttcgtgcttcaagttttagtggcattttac

SEQ ID NO: 28042 - DNA, 121 bp, Artificial Sequence
  Synthesized
  misc_feature (61): n=a or g
taggataaacagtgcttgtgatatagtttaaaacctactttcaagttgggaagcaatgggntgacaggacaattcttgtttctgcttctaataatgatgtaaaatatgaatatggtgctca

SEQ ID NO: 28043 - DNA, 121 bp, Artificial Sequence
  Synthesized
  misc_feature (61): n=a or g
ctcatacgaaacgctcataaattgggtagaaggagaaatcttcaatatcagagtgagtttntgagatattaagttcgctgatgacaaaacttaattgccacgctaagtgtaaatggagata

SEQ ID NO: 28044 - DNA, 121 bp, Artificial Sequence
  Synthesized
  misc_feature (61): n=t or g
tgttttcacaaaataatggttctgtgtgttttctttcctgccttaattagaagagcagttnccttttgtttttatgcagaatggaagacataattctttcaacagcttgatgagttttgtt

SEQ ID NO: 28045 - DNA, 121 bp, Artificial Sequence
  Synthesized
  misc_feature (61): n=t or c
tccgaattggctgtgacaggtgacattcaggcaaaccagcagtgttacccacaaggacagnatgctgttcctggagggctacgttgttctcgtagactagaatgtgtctctgaaatgcatt

SEQ ID NO: 28046 - DNA, 121 bp, Artificial Sequence
  Synthesized
  misc_feature (61): n=t or c
taaaaaaatagagttcaaatcgaacatgtctcttaaacgaagcaataaatactttttgatngccaggtataaagttctcatgagaaacttaactctgcccgaagacttaaatgagagatgt

SEQ ID NO: 28047 - DNA, 121 bp, Artificial Sequence
  Synthesized
  misc_feature (61): n=t or g
caagacttaaatataatatggcttctgcgaaggcttgcacacaacagaaaattttaacctngaggcatttattttgggcatgagctaaatgtaatgcattcacactgcaaatggcaatgca

SEQ ID NO: 28048 - DNA, 121 bp, Artificial Sequence
  Synthesized
  misc_feature (61): n=a or t
gaactttgaggaatgcacatgtgttcagatccattagcttttacaaactggaagaaaggangaccacaatcaaatacaagactacaaagctaaaaggcaatctcgtagagcgatgctcata

SEQ ID NO: 28049 - DNA, 121 bp, Artificial Sequence
  Synthesized
  misc_feature (61): n=t or c
tacctcttgtcctgtcactacattacttggtaaaaagtctttcctcatctttcctgtaggntccctataggtactagaatgcctctatgatatctcgatagagccttctccagactgaaca

SEQ ID NO: 28050 - DNA, 121 bp, Artificial Sequence
  Synthesized
  misc_feature (61): n=t or c
taagaaattagtggctgtccagggaagagaccaagaacagaagttcgtgttgagtcttgcnctgaatcttgtgctcatttcacatggcacgttttaatttaataacctccaatggaggtta

SEQ ID NO: 28051 - DNA, 121 bp, Artificial Sequence
  Synthesized
  misc_feature (61): n=t or c
tgcagccacactgctatcagcacttggaccatgccacatgaagctacctcagctacattancgtgggctgtagtcacacctttggctccagtttagatacacttgaaaaggcttttcaagc

SEQ ID NO: 28052 - DNA, 121 bp, Artificial Sequence
  Synthesized
  misc_feature (61): n=t or g
ggaccactggaaatgtgtaatgcagacaccattcctcaggcaacacaaataagtatcctcngacagtcctgccgtccttacactggaagtaagcatttgcttgaaagtgccttttaccttt

SEQ ID NO: 28053 - DNA, 121 bp, Artificial Sequence
  Synthesized
  misc_feature (61): n=a or g
ctgctctgaatatgagatgcttgggtctgcatgagcatttaccttaatgggcagcatgacnatgcccttgcaattacatggccctgctgcttggctgcttgctttggctttgtatggtgct

SEQ ID NO: 28054 - DNA, 121 bp, Artificial Sequence
  Synthesized
  misc_feature (61): n=t or c
catcaaattatttccgggcttttatttgatattgcttttaactttccatgttttcactaangttgaaaataccgaaaatcaaatgacgaaagtcttctcttctggagtgaacacagtaaaa

SEQ ID NO: 28055 - DNA, 121 bp, Artificial Sequence
  Synthesized
  misc_feature (61): n=c or g
aaattcagaaaaatacctctgtggtaaccagtgtggctaaaaaaggaaatcttatacctgnggaatgcaagcatctataggaagagctgggaccaacaagacaaaaagaagatccccatga

SEQ ID NO: 28056 - DNA, 121 bp, Artificial Sequence
  Synthesized
  misc_feature (61): n=t or g
gaggaggcgtgtttccttccaagtccaagggagagaagagtaagcactccaggtgagaganactggagtgaaatgtacgctttctatggagatgtgttgcaggctagctgggtgtttgcta

SEQ ID NO: 28057 - DNA, 121 bp, Artificial Sequence
  Synthesized
  misc_feature (61): n=a or g
cagccatttgaatccattattattaaaagaaagtccgtaatgaataaagttttgagagtcnttgtaacctagtggaagctttggaaaaccatcagcaagtcagtaaacaccttgacatatg

SEQ ID NO: 28058 - DNA, 121 bp, Artificial Sequence
  Synthesized
  misc_feature (61): n=t or g
aagaaatgcaaaaacaaacaaacaaacaaacaaacaaaaactcgcttgaagattttggatntgtgatttttctcataaaggaatggtattctgctctgtagattgcagggggaagcccagg

SEQ ID NO: 28059 - DNA, 121 bp, Artificial Sequence
  Synthesized
  misc_feature (61): n=t or c
gcctgtaatttctttcaacatctggtctgtactatgctacctactttgatacaccagcaangaaagctatttagcaagaataagtgatttgcctaaggaatatccttgaacaccttaaaaa

SEQ ID NO: 28060 - DNA, 121 bp, Artificial Sequence
  Synthesized
  misc_feature (61): n=t or c
aacataggtgaactgatataaaaggtcaagcatgaattactaaaagttattttgatgaaanattctaagggaggtcttgactaagcccatgagttgaaaatgctttattgtttttcattat

SEQ ID NO: 28061 - DNA, 121 bp, Artificial Sequence
  Synthesized
  misc_feature (61): n=t or c
gtgtctgggaggaaggaggggggcaatggtgggcttcatatggtgttttgctgtcctgcanagaccttggatatccctggaaggcacaattgggcacagcagaggaattgtgagcagtggt

SEQ ID NO: 28062 - DNA, 121 bp, Artificial Sequence
  Synthesized
  misc_feature (61): n=t or c
ttttttttaacatattgcttttaatttcacattatagaagcttgaaagcctcactttttgnactgcaatgtcatggttatatgtcatttgtgttttcacatgtattttggaagcatttata

SEQ ID NO: 28063 - DNA, 121 bp, Artificial Sequence
  Synthesized
  misc_feature (61): n=t or c
tgtaaaagtatataaaaatatacacccaaacatactatttcattccagagttatctctgtnaaatacaagcttatgagtcatttacttgccatattaactgtggaaagcttccctgtctgc

SEQ ID NO: 28064 - DNA, 121 bp, Artificial Sequence
  Synthesized
  misc_feature (61): n=a or g
gctccttcttgattgcaagagcgaatggtgcagctggcaggggcagagagacagaaccgcnttgctgccccattagtagctacagtttgaatacccttttaccatctagggcatggccatc

SEQ ID NO: 28065 - DNA, 121 bp, Artificial Sequence
  Synthesized
  misc_feature (61): n=t or c
tctgcagggtgcagagtacatgaccctcagcccaacgcatcccgagtggaagtttcaaccntccattcatatggagtgttcagaaagtatcaccatctgttttgtgtcatcttttgaattt

SEQ ID NO: 28066 - DNA, 121 bp, Artificial Sequence
  Synthesized
  misc_feature (61): n=c or g
cttcaaatatcctttttattaactagatgaagtagctgtctctggccatacacagaagagngattttcaaaggatggaaatgttgaaagaataaggtaaagtgttcccttttcttaaaggc

SEQ ID NO: 28067 - DNA, 121 bp, Artificial Sequence
  Synthesized
  misc_feature (61): n=a or t
ggccaaaccagctgtacacgtattaacctcccaatatccccctgactgagtgctgctttcnctcatctagctataaataggctaagccacaaaatgtttttatttggggaatttagtgagc

SEQ ID NO: 28068 - DNA, 121 bp, Artificial Sequence
  Synthesized
  misc_feature (61): n=t or c
caatatgctgacgtgtttgggtgctgaaaaaagtactgtagaactcttctaaatggaatgnatgtaagtgcagacatgtcagcagtctgagcaccatcttcatccaatttttgtttgtttc

SEQ ID NO: 28069 - DNA, 121 bp, Artificial Sequence
  Synthesized
  misc_feature (61): n=a or g
atctccttttcagctgcaaaaggagagcacaggagagaagcgcagctcccagtcctgcccnaagtgtgaagcacagcccgggaccctcactgcaggaaaacctcctcccaattcctaacta

SEQ ID NO: 28070 - DNA, 121 bp, Artificial Sequence
  Synthesized
  misc_feature (61): n=a or c
tcccagttcccactggcttaggtaaattgttgagaggggtccagctctaagatctacttcnttcagagctctggggtgaatcctgtcaaaccccatggacttaacaaatgttcaaaattat

SEQ ID NO: 28071 - DNA, 121 bp, Artificial Sequence
  Synthesized
  misc_feature (61): n=a or g
acttcacactctccctctccgaaccagttttttcaccaactgatgggaaacactgcgttgncgtaagactcagctttgacaaatttacacgtcgttcctttctcaaagcaggtggagactg

SEQ ID NO: 28072 - DNA, 121 bp, Artificial Sequence
  Synthesized
  misc_feature (61): n=t or c
aatagataataatttgcagaagcaattggtgaatcatagcttgatttgtgtatttagttanttattaactaactaggaagttacgttagtggtgttctatctttttatttttattttttat

SEQ ID NO: 28073 - DNA, 121 bp, Artificial Sequence
  Synthesized
  misc_feature (61): n=t or c
ataaacccatttcactagtcctctaatcaaaaatgagttcaacccttgtaacattaagaangatattgattgaaattacctctcaacattcaactatttgtatccacatataccgttaaaa

SEQ ID NO: 28074 - DNA, 121 bp, Artificial Sequence
  Synthesized
  misc_feature (61): n=t or c
tcaaaacaaaatgggaactttatatcaagaaacctctctgcacagatcccttcgtttaagnatgggaggattttgtgtttctgattacatcaagaggtttacggtaagtattttgttgcac

SEQ ID NO: 28075 - DNA, 121 bp, Artificial Sequence
  Synthesized
  misc_feature (61): n=t or c
cacaaggacattgagtagaattgtagttttctagccagtcctgagtgttttcatacatttnttgtgttgggagtaactgacaacaacatactgaaagaaggggttttctttcactctaata

SEQ ID NO: 28076 - DNA, 121 bp, Artificial Sequence
  Synthesized
  misc_feature (61): n=a or t
cagctgcgtcttagctactaaaattcactaatgctgcagttgccaaatctgataatgattnatgacaataacattaacgtcaataaagacttacttgggttgacaatgtaaaaactcttct

SEQ ID NO: 28077 - DNA, 121 bp, Artificial Sequence
  Synthesized
  misc_feature (61): n=t or c
tcccatgtctgggttattaaggaaagaagaccacaaaatgtgccatagcacataactaccncctcagtttctttccatctgctctcataataactatgtttaatgtaaaaagaaacagtga

SEQ ID NO: 28078 - DNA, 121 bp, Artificial Sequence
  Synthesized
  misc_feature (61): n=t or c
tgcaacggatgtgacgctggtgggcaagttttgctggaagggatgctggtctgcctcgggntcctccgactcggacaggatgtgatgaccggtgtgggaaaggtatgtgacttgaacctgt

SEQ ID NO: 28079 - DNA, 121 bp, Artificial Sequence
  Synthesized
  misc_feature (61): n=a or g
acaaagaaaattgatttcttcctccaaagcagcagtaggatgctacaaaccataacaccantgtggtttaccttcctgtgtgctgaggccatgccaacgctgtcagctgaaactcaggacg

SEQ ID NO: 28080 - DNA, 121 bp, Artificial Sequence
  Synthesized
  misc_feature (61): n=a or g
agatgagaggatgtttaaaagatataacaactgtttctatgtaaggttgttagacctgacnacatagcaagttaaagaagagggaagtttccaaaaagcagatatttaacgagttaaaggt

SEQ ID NO: 28081 - DNA, 121 bp, Artificial Sequence
  Synthesized
  misc_feature (61): n=a or g
ctcctatcatatcctgctgttttccatctcatcttcaaggttttggagacaagggcaatgncatcagggtggataagtggcgcctcgattaacatatcaccaagactcggtaccccaccag

SEQ ID NO: 28082 - DNA, 121 bp, Artificial Sequence
  Synthesized
  misc_feature (61): n=a or g
tacagcaacagacagataaaatagtcatacaaaactgagaacatttgcaaacatcataccntttcataaagtcttaatagtaacagtagtaataaaaaaaaaataaagtcttaatagtaat

SEQ ID NO: 28083 - DNA, 121 bp, Artificial Sequence
  Synthesized
  misc_feature (61): n=a or t
cacctgccacaaaaccccaaggacatgccactttacagttagcccatccacagattgcacngctatcatctgtgtgatcatgtttccaaaaacacgtctaaacagaaacatcagacagaag

SEQ ID NO: 28084 - DNA, 121 bp, Artificial Sequence
  Synthesized
  misc_feature (61): n=t or c
cctttcccagtccagaaagagattatgtaaatcaaagttggctgaaatcactttttgctangtactccttaaagctgatagcattacaagagaatgaatgctagtaaatgtacaaaggccc

SEQ ID NO: 28085 - DNA, 121 bp, Artificial Sequence
  Synthesized
  misc_feature (61): n=t or c
aacatccccagcatgcagacacctggcagcagatgagtgctggtacagcagaactcactangctcactgccggagtcaattcctgggctgtaatgaggctgcagtaattagagtgtccata

SEQ ID NO: 28086 - DNA, 121 bp, Artificial Sequence
  Synthesized
  misc_feature (61): n=a or g
gacttctctctctctctctctctcgctcctcctttcagtcagggctgaaatcaggactccntcgctacaactgaagacaatgcagatttgataaggaaccaggtaagcttggtgattgtat

SEQ ID NO: 28087 - DNA, 121 bp, Artificial Sequence
  Synthesized
  misc_feature (61): n=c or g
aaactccacttttctgaagcctttgagactctaaaacatctttctgcctcatcccttcaancacattatttactgcaatgcattcacccaatactcctgcttctctcaccacaacaagctc

SEQ ID NO: 28088 - DNA, 121 bp, Artificial Sequence
  Synthesized
  misc_feature (61): n=a or g
tttttggtgttgctatgaccctgacattttcaggcattttaagtattacaatctgtcagtntatgaatgtatttttgtaagtgggaggaaactgagaaacatgaattccatgttttaatac

SEQ ID NO: 28089 - DNA, 121 bp, Artificial Sequence
  Synthesized
  misc_feature (61): n=t or c
aaatctttaccctgaccttcgttttgaactccttaaataattgagatacagtcttgtcttngtggagaagagctataatttccctggaaagtgcaatgagagccgtggggtggtttgggga

SEQ ID NO: 28090 - DNA, 121 bp, Artificial Sequence
  Synthesized
  misc_feature (61): n=c or g
ttaaacttctaaatgtaatacaacagaacatgcacccagattttggtacttttggaaatanttgaaaaatagtgctcctacagaatatctatactgttctaaaatatgtctactaatgaga

SEQ ID NO: 28091 - DNA, 121 bp, Artificial Sequence
  Synthesized
  misc_feature (61): n=t or c
ctcagaaccagagcacagaaggtcactggcactacggcatggcgagaggcagtgcaaatcncattccagaggacactgcctatcaggcctgctatctatgggtaactgcagcagcctgggg

SEQ ID NO: 28092 - DNA, 121 bp, Artificial Sequence
  Synthesized
  misc_feature (61): n=t or c
tctgatttctgagaggggaactggaagattcttttgttctcattatcatttttggtactgntttaagagatttattcagggatttaaattttgctattagttatttgctgtacaaactcat

SEQ ID NO: 28093 - DNA, 121 bp, Artificial Sequence
  Synthesized
  misc_feature (61): n=a or g
tcatccaccagctcttcgttggcatagcagatgtagcactaaggacagtctcttcacctcntggggatgcactgctgacagtcatcctggtcatcaagaccttggcaggtgttctccatca

SEQ ID NO: 28094 - DNA, 121 bp, Artificial Sequence
  Synthesized
  misc_feature (61): n=t or c
ttagccctccaagagaagccagctgtgcttctggggagcacagactgacatgaattatgtnttacctgctcaagcaacacctttttaagtgagcaagattgctccttcatggttagtcacc

SEQ ID NO: 28095 - DNA, 121 bp, Artificial Sequence
  Synthesized
  misc_feature (61): n=t or c
ttgcttcttatccaatttcaaaaaatctgctgtgttgtagaactgtttcccctgcttttcnagggatggcgttaccttcttaaaccaacttacttacctaaaccaagactacttttttttt

SEQ ID NO: 28096 - DNA, 121 bp, Artificial Sequence
  Synthesized
  misc_feature (61): n=a or g
tcctttgtctgatatattctgtggtatttcttaatttttattctttaagtgttaatctcanacttctagtaatcagtctctctgggtgttttctcccagtcataatcaccatctggtctct

SEQ ID NO: 28097 - DNA, 121 bp, Artificial Sequence
  Synthesized
  misc_feature (61): n=t or c
aagcagcagcacaggacacggccagcctgctgctagagcagagcgtgaagcacagggggangtgggcctcgttcatcctacgcaatgcaaacagttgcgtgaacatcccaacaatcagctt

SEQ ID NO: 28098 - DNA, 121 bp, Artificial Sequence
  Synthesized
  misc_feature (61): n=a or g
tttcagtggatggcaaagaaaacaaaaaacactggaaaatctctctgtcatgctcagttanttcactggttgtgaaaatgcccagggaatgtaatattctcttctgtgaaaaagttcagtg

SEQ ID NO: 28099 - DNA, 121 bp, Artificial Sequence
  Synthesized
  misc_feature (61): n=t or c
ctacagctgagtgctgatccctgctgggtgcggtctgtgttaggatgcacctcccagccanggtttttaaatgttaccctcttgtgtttctttccaagtctgcaggaacaagtctgatggt

SEQ ID NO: 28100 - DNA, 121 bp, Artificial Sequence
  Synthesized
  misc_feature (61): n=a or c
gttcagagaggaaagcaaggctggggagactgagagaaagaagataggacaataaaggatnctgtataaagatactaataagaatgctgaagcaaactgtgcttcttactcaggctgcact

SEQ ID NO: 28101 - DNA, 121 bp, Artificial Sequence
  Synthesized
  misc_feature (61): n=t or c
agcacctctgaacacacccacccagcacactacagataagcatacctgcttccgtgcaacnaaggaggaaactccctctcttccggaccctctgcactttctcttgttccccacttccacc

SEQ ID NO: 28102 - DNA, 121 bp, Artificial Sequence
  Synthesized
  misc_feature (61): n=a or g
tctgctgagatgaggtgggactagtaagtcaggaaaggagccaactgacaaatgccgtatncagtgattgcatagctttcaaagggactaaaagggatgaagtctgatctgttcacatttc

SEQ ID NO: 28103 - DNA, 121 bp, Artificial Sequence
  Synthesized
  misc_feature (61): n=t or c
ccacgtttccctgtaatgtttgctttatctttgattgctttcactccagtgtccttcatgntccactgttgacctaggtccctctcaagtatacatcctgggccatatttctgggttcaca

SEQ ID NO: 28104 - DNA, 121 bp, Artificial Sequence
  Synthesized
  misc_feature (61): n=a or g
gtatgataacgaatatcaaaactgaaagagcagaacccacttctctataggtttatatctnaaattaccaacctcccttcttggcttctgtgatggtatctatgaacaaaaatgagcaggg

SEQ ID NO: 28105 - DNA, 121 bp, Artificial Sequence
  Synthesized
  misc_feature (61): n=a or g
tcatttcgcatcccaaatattagtaataatgtctccaaccttttctttactttttgttccnctcctgaagtagaattctattccaatccattgtttttttcctgctatacatgttgcagca

SEQ ID NO: 28106 - DNA, 121 bp, Artificial Sequence
  Synthesized
  misc_feature (61): n=a or c
ggctgacttggtaacagattacactgagaaggtggctttaccaagcaccttctctgcttcngtctttactcctaatactgctcctcagaaatcccagatcttgaagatagtagagaggtgg

SEQ ID NO: 28107 - DNA, 121 bp, Artificial Sequence
  Synthesized
  misc_feature (61): n=t or c
gtgggtggctgaggagcttctcggcactttgtgccttctcctttgtgtcgctatgtggagnattctcgcatttattcccatctcccaattttttcacgcccatttctcttgtccttccttt

SEQ ID NO: 28108 - DNA, 121 bp, Artificial Sequence
  Synthesized
  misc_feature (61): n=t or c
catgttatgcaaggggacattcaaatgggaatctaagctccaaatgggtgcgtgtgttganatggttgtccagcagagcagtatacataaaatctgaagaaatttagaagcagatgggagt

SEQ ID NO: 28109 - DNA, 121 bp, Artificial Sequence
  Synthesized
  misc_feature (61): n=a or c
gggtgaacaggggcaaaatcagagactgaaggaagagtttatagcgttttatacagcacantttagactacatctagatcgctgcatccagtttgggacacccctcactgctccttttaga

SEQ ID NO: 28110 - DNA, 121 bp, Artificial Sequence
  Synthesized
  misc_feature (61): n=a or g
aaagccaaatcttcattgcctgaatatactactgtctccaaacctcattcttaacggatcngatcagtcagccctgagcacaaaagcagcaaaatcctgcaaaacctcaggatttgtcttg

SEQ ID NO: 28111 - DNA, 121 bp, Artificial Sequence
  Synthesized
  misc_feature (61): n=a or g
caaacataaacaggaaactggcattgttgaacaaagacctcctggttaaactgatggaaangaggaatatacacagtcagtgcaagaaaggagtgcaagaaatgttgagagagttagacat

SEQ ID NO: 28112 - DNA, 121 bp, Artificial Sequence
  Synthesized
  misc_feature (61): n=t or c
acctagtgctctccaaatcagacagaaaatgacagtgaagaaaatatacggccagttccantcgtgattttctccaatggtagacactccaagaaagatgaagatgagggtatcactaaca

SEQ ID NO: 28113 - DNA, 121 bp, Artificial Sequence
  Synthesized
  misc_feature (61): n=t or c
cactgattcccttatctaaacctcctgttacatttttacctatcggaggtacacgtgtccngggacccacatggcaaactaccgcagcttctgtagtgattcccttccataagcagtctgc

SEQ ID NO: 28114 - DNA, 121 bp, Artificial Sequence
  Synthesized
  misc_feature (61): n=a or g
agagtcttggaaagcttggttctgattcttgagtagtggacatttaatgtggctggctcanacattactcattcattactatgcagcaatgtagatgactttattggctaaagttcgcttt

SEQ ID NO: 28115 - DNA, 121 bp, Artificial Sequence
  Synthesized
  misc_feature (61): n=t or c
tgttcctaaccccttcatttccaaggcagttcaaacatgaggatcaggaagaacccagagnaatggatgaaggaaaatttaatattcttgagtgaacatctagatcattctctctttgatt

SEQ ID NO: 28116 - DNA, 121 bp, Artificial Sequence
  Synthesized
  misc_feature (61): n=t or c
aaaaaaagggttttctaagggaaacatcaagcttaaggtagtctggaatttcatcagaatngcattgtgctcatcagctggggaaccatgcatgcagaagttcatgatctcgtatacgcca

SEQ ID NO: 28117 - DNA, 121 bp, Artificial Sequence
  Synthesized
  misc_feature (61): n=t or c
agtgctagccctgtgctaatgtaactctgggtttgtcatattaaaggcaaatgcagcttangctgtccttaaatgtgcatgcagatttacagcgttcttctgcagtctcttctaaatgtgt

SEQ ID NO: 28118 - DNA, 121 bp, Artificial Sequence
  Synthesized
  misc_feature (61): n=a or g
gcagaagaaatgggtatgctgtcaccatcaggaaagcagataggctgatcaatgtaacagncaccaagctgaaacaacagggaatggggtagaagtagcttaaatgattatgtctacctag

SEQ ID NO: 28119 - DNA, 121 bp, Artificial Sequence
  Synthesized
  misc_feature (61): n=t or g
agtgctgggctgtttacttaactgtctgtttactgcccttactaagcccttcaatctctcncagatttaatgcactggtctgcatctctgaggcttcaatacttaaaggaggaagcaggct

SEQ ID NO: 28120 - DNA, 121 bp, Artificial Sequence
  Synthesized
  misc_feature (61): n=a or g
gcacgtttttttttcttctgtattttacttgcaattgatacgaagtgaactcatggtggcntctagcgaagtaccagctgcaatcaaaaccaacttcggaaccagtttagatgtttgatgt

SEQ ID NO: 28121 - DNA, 121 bp, Artificial Sequence
  Synthesized
  misc_feature (61): n=a or g
tccttataactctgctttgtttcctgctgggatggcagagtaggaagaacgtgagcggggntttctctcaaccccacagactgtgcgggcgttgctgtgcgtctcatctgttcgcccaggg

SEQ ID NO: 28122 - DNA, 121 bp, Artificial Sequence
  Synthesized
  misc_feature (61): n=a or g
ccagctacacggtggatgaaatacacattgaaaacgttgctcattgaatacaaattcactnattatgggctatatgtatgaccagtcacgtggctagaaactggctcctatatttgcaggg

SEQ ID NO: 28123 - DNA, 121 bp, Artificial Sequence
  Synthesized
  misc_feature (61): n=a or t
atgagcttatgagcaaatgaagccttccaacaagtcttccacacaataagaacttggttanaaagggaacgatgacaccagccaggcaaacaacaaaggactctgggacgagcaccagtgg

SEQ ID NO: 28124 - DNA, 121 bp, Artificial Sequence
  Synthesized
  misc_feature (61): n=a or g
ttctccagctgtgcagctgtaattcagcactatgatgtactgtcacttctgcattagtaantacttaggacctgctgagtaattatgaaataacctcataatgaaatgcagcaaagagttc

SEQ ID NO: 28125 - DNA, 121 bp, Artificial Sequence
  Synthesized
  misc_feature (61): n=a or g
ctaagattgtttctgcatttcaggccttacacagatgatggcaatctgagtactgaaggantgctgcaagtaaaagaacagagtaggcctttccagtgtaggttgcagtcaatgaagtgaa

SEQ ID NO: 28126 - DNA, 121 bp, Artificial Sequence
  Synthesized
  misc_feature (61): n=t or c
tgctgacctattattagtcatgctatatcatcatccgcaactaatttggtttgtcagaagncagtgggtggaattgtcccatttcattgtggtactcactgatggaaggaaaggcacttta

SEQ ID NO: 28127 - DNA, 121 bp, Artificial Sequence
  Synthesized
  misc_feature (61): n=c or g
tctagctttctttggaactgtgtgtaagatgtctgccacctctatgttctcttaacttaanctatacagtggcatcaaggtcacagaagcatgcttctggcattaagttatgaaacagatg

SEQ ID NO: 28128 - DNA, 121 bp, Artificial Sequence
  Synthesized
  misc_feature (61): n=t or g
ctggcagctttgcgcaataggactacaggtggggtgctccctcccactgcaggagctctgngctctattccctttaggtatgaaggaatctgtattacccacgtctgtgctaagaactgcc

SEQ ID NO: 28129 - DNA, 121 bp, Artificial Sequence
  Synthesized
  misc_feature (61): n=a or g
gagcttatattcatgttactctgcccaaaagagctgcatagatttattgatggtattgtcntggtgtggggcagtatatgtcatagataagggtttccagtactgtgctgtgcagagtcag

SEQ ID NO: 28130 - DNA, 121 bp, Artificial Sequence
  Synthesized
  misc_feature (61): n=t or c
ggtcaaatgaggctccggtccttgaggattaacagaaaagaatatttaaccttcggatgancaaattctgtgtcacatttctaaacctagattcccctcatcttcgtgatgctttctccag

SEQ ID NO: 28131 - DNA, 121 bp, Artificial Sequence
  Synthesized
  misc_feature (61): n=t or g
atatattttaagtgactgcactgcgcaaaatacccaggtgatagtaggactggaaaagttnggtttctacagttgccataatttgagataaactgtcatgcataatagaaggactttaagt

SEQ ID NO: 28132 - DNA, 121 bp, Artificial Sequence
  Synthesized
  misc_feature (61): n=a or c
gcacagccctttgtatgtccttcagtgggaaaggtcccattgaaaaagaccactggcattngctgtgctttctctgatggcctgatgttatctctgagcatcccccaggcaagggcagtgg

SEQ ID NO: 28133 - DNA, 121 bp, Artificial Sequence
  Synthesized
  misc_feature (61): n=t or c
aaggagtttattgaggaagggcagatgctttcattaggattgaaagcctctacctgtcccnattgctgtattccctttaaataagaggcttggacatgttaatagccttttctaagaacag

SEQ ID NO: 28134 - DNA, 121 bp, Artificial Sequence
  Synthesized
  misc_feature (61): n=t or c
gctgcacagaattaaataattccacatgaatcattcctccaggctgttattttgctcatgngttggaatctatggttgagcaaagtactgtacggagtaaaatatcgttggcatcaaaatg

SEQ ID NO: 28135 - DNA, 121 bp, Artificial Sequence
  Synthesized
  misc_feature (61): n=t or c
gttcagccgtcatttctctgcaaggtcagttagctgatcagctgtgagacctgcctggaangcaggaatcccaaacaccgacaagtttaaaagctttaacttgtatacaatttatttctct

SEQ ID NO: 28136 - DNA, 121 bp, Artificial Sequence
  Synthesized
  misc_feature (61): n=c or g
tgggggctgtgagcccaaagaagggtacaggttacaacgcatggcttaaggttagggttangatgcatatgagaggaagcatcgtgtggatggggaccacagtactccttcctctgcagcc

SEQ ID NO: 28137 - DNA, 121 bp, Artificial Sequence
  Synthesized
  misc_feature (61): n=c or g
tcttcagccatgaaaattgcatagtcaccagaacacagacaaatttcctggaataagtcanaatttcatgcaatttttggttccttgatggcttaatagattttttacctttgtttttctt

SEQ ID NO: 28138 - DNA, 121 bp, Artificial Sequence
  Synthesized
  misc_feature (61): n=c or g
gaaactggtttttaaaattaggatttcaggtagccagtgtgctgagatccagagtaggtantaatccagatatagaatgttactgtagtcagagatacaagtcaatttgtattcactgtgg

SEQ ID NO: 28139 - DNA, 121 bp, Artificial Sequence
  Synthesized
  misc_feature (61): n=c or g
agcctctgtctgctgtaagagatatcagcaatacaaaaagagctttttgcaggctacatancccatgttctctaccaaaatgtttcctgcagcaggaaaagtaatttgggggttgctgatt

SEQ ID NO: 28140 - DNA, 121 bp, Artificial Sequence
  Synthesized
  misc_feature (61): n=t or g
taatgcccaaatgaaagccattttagtctacctgaaaagtgagatgaatttatgcagaganaaggtggtgcatagataaccagcattctaagcaactgtgcagcttctgaaaaatgcttta

SEQ ID NO: 28141 - DNA, 121 bp, Artificial Sequence
  Synthesized
  misc_feature (61): n=c or g
tggtagctcctggctatgaggaagaagctctcaaaatcctttccaaaaagaagaatggtgnttactgtgtcctccaggtttgtagtcctgctgccctacagccttgcagtgctcttcctgt

SEQ ID NO: 28142 - DNA, 121 bp, Artificial Sequence
  Synthesized
  misc_feature (61): n=a or g
atagctgacttgtatgaacgtgcaagtaagcattatgcaatacacatagaaaaactgcatnaagtagaatactgaaaatactcttgctgagatacatatgtccaagttagtgtttaagctc

SEQ ID NO: 28143 - DNA, 121 bp, Artificial Sequence
  Synthesized
  misc_feature (61): n=a or g
ctgcgtgtggttttgaggaagtctgggataggttgacctcatggttacctgattggtcttngttgaagaaactgttatcgataactagttttgttgttgttgttgttgttgttgctgtttt

SEQ ID NO: 28144 - DNA, 121 bp, Artificial Sequence
  Synthesized
  misc_feature (61): n=t or c
tctggaaggtttgtctgggcccacgctgctgtcctgccacagtaaatgtgtcacccgcatnggagctgtgaattcgtgtatttaaagttttggcagcacatagacaaggcttaagatggcg

SEQ ID NO: 28145 - DNA, 121 bp, Artificial Sequence
  Synthesized
  misc_feature (61): n=t or c
tgaggacgtttggagtgccatccacctgcaggattgaaagaattggttgggaaaaacaccntttttgtctggctatttggcacaataacagaataactagttagatttgggactatctgct

SEQ ID NO: 28146 - DNA, 121 bp, Artificial Sequence
  Synthesized
  misc_feature (61): n=t or c
aatgttgggattgtcagggtaactgttaactgcagtaataactgtgtttttttgtggttgncttttgtcacacagtcatggggcaacagaaaatgcatctggctggacagtaaactaggat

SEQ ID NO: 28147 - DNA, 121 bp, Artificial Sequence
  Synthesized
  misc_feature (61): n=a or g
tttgaaagaaagtatgattgtgtgtagtggtgtcatatttgtaaaatgtgtacacaggtcngtattatccacaggttgtcttcggtagaggctaaacgactgccaaatatcaagggtaaca

SEQ ID NO: 28148 - DNA, 121 bp, Artificial Sequence
  Synthesized
  misc_feature (61): n=a or g
atgataactctctgtttccacattaagccacaaaatacttctgctggtctctgaacaaacnttacaataccaaaaattgaaaataagtacccaggggcacgcaaagagcttctgagaaaca

SEQ ID NO: 28149 - DNA, 121 bp, Artificial Sequence
  Synthesized
  misc_feature (61): n=c or g
gtcaaggctcctctcccacctctagaccaggctgtcatgtacagcaatctgaggttcccanagagagcctggggatcagagggaaaggcaggacaaagggtctgcctccagcattccctca

SEQ ID NO: 28150 - DNA, 121 bp, Artificial Sequence
  Synthesized
  misc_feature (61): n=a or g
attttctacacttagaaaaagcatatctcagtctaaaatactcattgaggtatcaaagggnaaaaaaaaattgagagtattccacaatgagccatttttcacattgctaagaaaggtcacc

SEQ ID NO: 28151 - DNA, 121 bp, Artificial Sequence
  Synthesized
  misc_feature (61): n=a or c
cacctgtaaggaccatgggccacgggtagtccacatttgctcagaccaggtttccccatgnaggagcctaactgatgcccataggagatctgagcatcagcaccagcacacctgtgatgct

SEQ ID NO: 28152 - DNA, 121 bp, Artificial Sequence
  Synthesized
  misc_feature (61): n=a or g
ctgcatatgagaaggaaaaaataatcttttttggggggatgttgaggaaagaatagatcantgtcaggatgtcgccgtacaatcagtctttcattttggatgcaaaagaaaagaacaggat

SEQ ID NO: 28153 - DNA, 121 bp, Artificial Sequence
  Synthesized
  misc_feature (61): n=a or g
ttgctcctcacatccaagtatggagtgattcagttagaaaatacacattctatgattacgnatgacttcaagggttgatttgggttggtttttttttattattattattttggtgtgaaaa

SEQ ID NO: 28154 - DNA, 121 bp, Artificial Sequence
  Synthesized
  misc_feature (61): n=c or g
gttgtgtgcaaattaggaaaccgtcactgtacaaattaggcaaagtgtatttaaggtgaanaaggtctgaaccctctagcatggatctgaaaataaggcaaatcaaatgaatgcgtaggaa

SEQ ID NO: 28155 - DNA, 121 bp, Artificial Sequence
  Synthesized
  misc_feature (61): n=a or g
catcccgagagacagagggaaaaccctgtcatatggaatgctgaacatttcatgtttaacnttagactgcaaaatgcattgaatgagggaataatcctgctctggcagaggaaggttctta

SEQ ID NO: 28156 - DNA, 121 bp, Artificial Sequence
  Synthesized
  misc_feature (61): n=t or c
gaaaggatatgctttcagaatgtgtgtgaattcaaaagaatttgagtgattcaaccctttnctggtggatctgtgcacttagagcatgagctaatggacacaccaacccttgctgggttaa

SEQ ID NO: 28157 - DNA, 121 bp, Artificial Sequence
  Synthesized
  misc_feature (61): n=t or g
agtaattttcatgtttggaccttaaagtgatggtgcttctgcagtagtgggctgagatggnaacttccaagaaaaattggtctaggtcttcagtctttcatataagctccatgttgcatac

SEQ ID NO: 28158 - DNA, 121 bp, Artificial Sequence
  Synthesized
  misc_feature (61): n=a or g
ttagctttaattatcagcattaaaattcctgtaaaattttatgacacttgagtataaggcntatgtcacaagtaggtttcaagttcagtctcaaaacacagaaagtattatcaaaggcact

SEQ ID NO: 28159 - DNA, 121 bp, Artificial Sequence
  Synthesized
  misc_feature (61): n=a or g
tccgtgcaaacacactcgtagctgagatgccagccttcaaaatactccactggtaggaccnttctctgaacctcatcaaaaacatctgagccatgagctcttttgtttaatgtcccagtat

SEQ ID NO: 28160 - DNA, 121 bp, Artificial Sequence
  Synthesized
  misc_feature (61): n=t or c
aataaatgcatttctttcatatttacttttggaagacacaaccagctgatccatacatcancccattagcagctgagatcccatcctctgctttcagcaccttgccttgctggggctgaaa

SEQ ID NO: 28161 - DNA, 121 bp, Artificial Sequence
  Synthesized
  misc_feature (61): n=a or c
cgttaggagagagccatgtgtgagtatgtgccagccatgtagcagcctggatcaagtaccngtgctcaatccgagccttggctaagttgaatttattagtacagatatggccaaacagact

SEQ ID NO: 28162 - DNA, 121 bp, Artificial Sequence
  Synthesized
  misc_feature (61): n=c or g
aagaagggaataaatatcaaggaaagagactcagtggagcttggtagttttaatgaaatgncatctttttggtgtgtattccacgttcttactgtctctcattgtccatttatacacaaca

SEQ ID NO: 28163 - DNA, 121 bp, Artificial Sequence
  Synthesized
  misc_feature (61): n=a or g
actttgctttgagacactttgatctccttctgcacctgaacactcaccatttctctgggcngtgccaaagtgcagtgggtttcaaacgctgcactcaccatcattgcagacatgctcttgt

SEQ ID NO: 28164 - DNA, 121 bp, Artificial Sequence
  Synthesized
  misc_feature (61): n=a or g
tttatgaattagaagaccatgaggattagaattcatattgcacatattgcactctgtccanaaatgcatgttaggggacttggaacatttgaagaattcacctgtagttgcagctatacta

SEQ ID NO: 28165 - DNA, 121 bp, Artificial Sequence
  Synthesized
  misc_feature (61): n=a or g
ttacctgaaacaccagatatggcaaaagtaaaaacaagtcactacagccaactgatttagncaacaacgctatctgcctctcccagccccaaagacattttgcactataactgtaaccccg

SEQ ID NO: 28166 - DNA, 121 bp, Artificial Sequence
  Synthesized
  misc_feature (61): n=t or c
acccagaccaaccatcccttaaaagtgttgttcttgtagatggtaatgcagttgcagaagntgccttgttttgctcatcttttctacactttagaaatcaccctgcatgggagctgagggt

SEQ ID NO: 28167 - DNA, 121 bp, Artificial Sequence
  Synthesized
  misc_feature (61): n=a or g
gaacagctggaaaggacagttttaggttttaccctgggtgatttatatattaagctacacngcatgagagggatatccattaatgaatatattattcactgcaaatgccagggcaatactc

SEQ ID NO: 28168 - DNA, 121 bp, Artificial Sequence
  Synthesized
  misc_feature (61): n=a or g
atcaccctgggtgcagtgtgaaggctgttctgaggagcactgcaatggtgagagctcttanctccaggcagtatcatgaatctgagcagggctgcccaaaatgccacagcccattgcagag

SEQ ID NO: 28169 - DNA, 121 bp, Artificial Sequence
  Synthesized
  misc_feature (61): n=t or c
ccatctgtctgccaggacttccacacagcactggaaaaactcctgcatcagaggcctgccnagctcgcatgtccacttgagatgttcccagacaccctcactccttgcccttcactgactc

SEQ ID NO: 28170 - DNA, 121 bp, Artificial Sequence
  Synthesized
  misc_feature (61): n=a or c
gatacttagatatttcttagattgcttaggtaagtatgtattatatgcattgtccagcagngctctgcacaaaaggagcatcagccaatggaggtttgtcaggtatggagatcagcaaaaa

SEQ ID NO: 28171 - DNA, 121 bp, Artificial Sequence
  Synthesized
  misc_feature (61): n=a or c
taacagagtcagtcaagtacaaaggcatactcagacaatttacctctttatccagaaaacnaacccattcgtactccatggtgctgaagacaatgcaaagtttgatggttactaagttact

SEQ ID NO: 28172 - DNA, 121 bp, Artificial Sequence
  Synthesized
  misc_feature (61): n=c or g
aatttaaagtctcattaatacatctctttaaaacctagagattagaatgcagttaaccacntagcagagaaaacttaagggctcagtgtaatctccagtttcaacaatgtgttaagtaata

SEQ ID NO: 28173 - DNA, 121 bp, Artificial Sequence
  Synthesized
  misc_feature (61): n=t or c
ataaaataactcaggatagatgccaaaagcaaatatcagtgttgaaaacatgttccatgangtctgcacaacaatccctccctacctccatgcatatgcagcacatacaacctctgaatgt

SEQ ID NO: 28174 - DNA, 121 bp, Artificial Sequence
  Synthesized
  misc_feature (61): n=t or c
tacaagagctgttcagtcattcttttaattagaatttaaggttttcagtgatgcatatcangaagggtgactgcggatgtttgataggatgtttatatttttatacatgtagataacaaac

SEQ ID NO: 28175 - DNA, 121 bp, Artificial Sequence
  Synthesized
  misc_feature (61): n=t or c
ctttgacccatatcccagtggtgttaataactattcagaaacgtctataataagcagctgnagtaatttgttctttttgatgtatgcctactaagcatacccttatctttgaccttggcat

SEQ ID NO: 28176 - DNA, 121 bp, Artificial Sequence
  Synthesized
  misc_feature (61): n=a or g
agcacctactttgccgtttataaagcctggtggaggaaggctggctcaagagactcactanagtagtaagggaaagtgctaagcatgttgctggaccatggcagggtgagggttaatgtac

SEQ ID NO: 28177 - DNA, 121 bp, Artificial Sequence
  Synthesized
  misc_feature (61): n=t or c
tctcacagagagtttttctaactacattagcattttgagtacgtttgaatgtgtccaagancctgcaaacagctgcactgatattggtgtgcaatactcatttttttgtatacttttataa

SEQ ID NO: 28178 - DNA, 121 bp, Artificial Sequence
  Synthesized
  misc_feature (61): n=c or g
gagcgagttttgttctgcactgttctgttttggcacagatctcagtaaagttattcctcantggtactgatatggagagcagaaacagggagacagctcttctgtcctgactatggtggca

SEQ ID NO: 28179 - DNA, 121 bp, Artificial Sequence
  Synthesized
  misc_feature (61): n=t or g
ttcccaacagctactgcacatcattgcttttgcagatggatctagttgccagagtgatagntctgatatcatagcaacgttcccatgagaaaccaagataacaaagttctgtggaagacca

SEQ ID NO: 28180 - DNA, 121 bp, Artificial Sequence
  Synthesized
  misc_feature (61): n=t or g
acaccttcatccctgcaacatgctcaatgatccgactgtctttgaaattctggatacttcngccaactccatactgtctatttatctcatttttatttttacctcttactgtgccagtcct

SEQ ID NO: 28181 - DNA, 121 bp, Artificial Sequence
  Synthesized
  misc_feature (61): n=a or g
atgtaatcaccaaccgaaatcactctctagaaggtcactgggaagtagcttacaaaggtangcctctacaattattactgagctgaatggttcacggaagctatcttaaagcatggatgtt

SEQ ID NO: 28182 - DNA, 121 bp, Artificial Sequence
  Synthesized
  misc_feature (61): n=a or g
aagaaggaacaagctaaacttaaaaaaaatcaaagtgaggtgagggtggttccatgaccanttaggctgctgtggtaccactctgacaaatcccagcctcccagtgaaaggcaaatctttt

SEQ ID NO: 28183 - DNA, 121 bp, Artificial Sequence
  Synthesized
  misc_feature (61): n=a or g
cgccaagagccaacggccgtcacagacggagatggatgagaggaccacggcgatggccacncacaggatgatcaggctccggatgaaggtctcgaagaaggctttctggggcctcctgtga

SEQ ID NO: 28184 - DNA, 121 bp, Artificial Sequence
  Synthesized
  misc_feature (61): n=t or c
ctactctgagttagattgggtttgtgtttgcaagcgacttgaaaacattcactgcagctanctttgaaaaatggaagatcggtgctggaaacgctgatctgagcaacttacagtcagatat

SEQ ID NO: 28185 - DNA, 121 bp, Artificial Sequence
  Synthesized
  misc_feature (61): n=a or g
aaaaaacacagaaacacagaaaacaaattcagagtaattataagataatactctggaatgncaggccgtcctcccaacaatccagctataattatgcctcccacaagcacacaagtgtcaa

SEQ ID NO: 28186 - DNA, 121 bp, Artificial Sequence
  Synthesized
  misc_feature (61): n=t or c
tgcatgcccactcaaagctggaagggctacttgggcccaggaccctgcctcctcctacccnaagccacaggactctgagctgcaggacatgctcagctcagctgtttccttttaactactc

SEQ ID NO: 28187 - DNA, 121 bp, Artificial Sequence
  Synthesized
  misc_feature (61): n=a or g
cccctgggattggtgactccttccagtccaaaacagattaaagctctcagtaacaaatccngccgactggtgcacttcagctagagcagggaagcgatgctcattgaatctcacacggtga

SEQ ID NO: 28188 - DNA, 121 bp, Artificial Sequence
  Synthesized
  misc_feature (61): n=t or c
cccaataaatggcaggagtatggaggctggtttgactatgaagatgagtgtgaaacaagtntccaggttattctacaggaagaggatctaattgcaacttctggacaggaggaagcactgg

SEQ ID NO: 28189 - DNA, 121 bp, Artificial Sequence
  Synthesized
  misc_feature (61): n=a or g
tgaaattagggagaacagagtgaagaacaggtggatgtacagtatcaggatatgaaggcantgaaaaacaagatgttgaggagagatggagaaaattagaggccctcagtgagaagggcag

SEQ ID NO: 28190 - DNA, 121 bp, Artificial Sequence
  Synthesized
  misc_feature (61): n=a or c
atttgagctttttatgaggtctgaaaagatcatcactgccatcaagaggggataattcttnatcccaacggaacctatcaacagggaagacactctatgacatgagaaaggctgtctcatt

SEQ ID NO: 28191 - DNA, 121 bp, Artificial Sequence
  Synthesized
  misc_feature (61): n=a or t
ctttaaaatccaagttctatctgaaaataagtttcaatttcttggaggttccatttaaaantgaatttacgttccttcctctaacaccacaatagacattttgttggtagaatacagtcag

SEQ ID NO: 28192 - DNA, 121 bp, Artificial Sequence
  Synthesized
  misc_feature (61): n=t or c
tgatgtgttctgagggttttgtggtcaagcagcctgctagccctacccttctcttgctaanagcttttgcatttgtaggcgcatatgagcaaattatgtctgcatgtatctgggtaggtac

SEQ ID NO: 28193 - DNA, 121 bp, Artificial Sequence
  Synthesized
  misc_feature (61): n=a or g
agcagtgaagctggcgggcagcgttctgctgacagctgtcccgttgggtcacctccttttncaccactgctggatctgcccatgctatcctgttcctttggtagataatcacttttctctg

SEQ ID NO: 28194 - DNA, 121 bp, Artificial Sequence
  Synthesized
  misc_feature (61): n=t or c
ctatagccatctgtcctctgtccaagctatgctatcagtcttgtttcttttcaggattttngttcgcttcttttcctgcccacctacttctattgcatttttcacagctctttgtactgca

SEQ ID NO: 28195 - DNA, 121 bp, Artificial Sequence
  Synthesized
  misc_feature (61): n=a or g
ctgtgattccttattctggcccaagcagatgtacgtttgtggtagcaagaggtgcagagcngccgtttccttgtctttgacgcagtccagagtacagaatacacatctcagtcaccaaaag

SEQ ID NO: 28196 - DNA, 121 bp, Artificial Sequence
  Synthesized
  misc_feature (61): n=t or c
tggctggaaatacctgaagtagaggtgacactggctagggggagggggcaaacaaagcttngcatgtattactagatcctctagaagactggaatcaagttatttggctagctgagtctgc

SEQ ID NO: 28197 - DNA, 121 bp, Artificial Sequence
  Synthesized
  misc_feature (61): n=c or g
gctgtctttccatgctcggactgcatagtgcctcggattgcccagagacaacgtctgaatngaaacagtgggcaataatccaagtcaatgggaaaattagtgtctccaaggaggtttggat

SEQ ID NO: 28198 - DNA, 121 bp, Artificial Sequence
  Synthesized
  misc_feature (61): n=t or c
tcaggcggttccatcaggaatgcaagtagttcatgtttactagcaacaaaagcccctaaanaatccataaatcgtatcattttgatattatcatctacagcttccctacctaaatcaatgc

SEQ ID NO: 28199 - DNA, 121 bp, Artificial Sequence
  Synthesized
  misc_feature (61): n=t or c
ctcgcagagagaaaactcagttggaacctggcatggatttgctgcccggggtgggaaacanggctgcacagagcgcgtttcacctctgcatcatgctgtcctgaggagttagcgaggagat

SEQ ID NO: 28200 - DNA, 121 bp, Artificial Sequence
  Synthesized
  misc_feature (61): n=a or g
taatatggaaaacaaactttaaacggagtatgttaacactttgaatgttctctgtccccanaaatatatggcagttcatacagcttttctttccaaaggttttgattttcatctccaaata

SEQ ID NO: 28201 - DNA, 121 bp, Artificial Sequence
  Synthesized
  misc_feature (61): n=t or g
agttaaagcacatgcactcgcagggaccccatatttgaattacagtctctgtgcattctgngctgtcctttatctgatatatacctgttcctgctcagtagttggctggggacgacttttc

SEQ ID NO: 28202 - DNA, 121 bp, Artificial Sequence
  Synthesized
  misc_feature (61): n=a or t
tattttttttaggtttgtctgcatgcagctctcctgaattcaatcaaattcatctgaactntttcaaattccactggaggaggagacaggagataactcagggaaagcctaaaagagtagg

SEQ ID NO: 28203 - DNA, 121 bp, Artificial Sequence
  Synthesized
  misc_feature (61): n=a or g
ttaatttgtcataatggctaaagtttcagattattatttaaacctacaaacaaggcaagcncccctgttcctatctataagtaatgctcttctgccaaatgataggcatgaatatttttct

SEQ ID NO: 28204 - DNA, 121 bp, Artificial Sequence
  Synthesized
  misc_feature (61): n=a or g
ttaagctccttcaggaaacagttgctttatgtatctgaaaatgtctttacacagatgaatncaaacactcagtgtgttatcagcataatcagttagtccctggaacatttatgtggatggt

SEQ ID NO: 28205 - DNA, 121 bp, Artificial Sequence
  Synthesized
  misc_feature (61): n=t or g
taagcttctcattcttgtactacaatctgtgcagcctgaaggccaaagctttggctgtgtnttggaggtagttctgttttttcaaacgtgtatgctaatctcataggaaaaaaagtatttt

SEQ ID NO: 28206 - DNA, 121 bp, Artificial Sequence
  Synthesized
  misc_feature (61): n=a or g
tatgtgcatttcttctctatttcagagtagctttcatttttgtccctgtgttgtacagtangatttccttacagctccttaagtcccagttttgtgcagggtgatggaagcgtagtgacag

SEQ ID NO: 28207 - DNA, 121 bp, Artificial Sequence
  Synthesized
  misc_feature (61): n=a or g
ctccaccagggtattttctccccattgccataatttgcagttcattgaaatcattactccnaattgacttacaggcaaaagcattatcttaggaggaaattctttacccatgctgtccccg

SEQ ID NO: 28208 - DNA, 121 bp, Artificial Sequence
  Synthesized
  misc_feature (61): n=a or g
gtgaaaatgttatagcaatccctgtttgatgcttttaagtctaaagcttaggtctcagtanagtctacttgactttttttttatcagtcattgactgaaactttataaaaagcatcatgta

SEQ ID NO: 28209 - DNA, 121 bp, Artificial Sequence
  Synthesized
  misc_feature (61): n=a or c
tttcaagaatcacacattgccccccagccttgatccctacaaacacatttggctatcaaantcataagagaacaaacaggtcgcgccacacctgtactcaaaaggtaggaagctgctccaa

SEQ ID NO: 28210 - DNA, 121 bp, Artificial Sequence
  Synthesized
  misc_feature (61): n=a or g
actcctcaccagctgaggtgtctgagtaatttcttgtttaaaaaatatgaggtgcagatcngtggcagtgtctggaggcaataactgtgcgactgatcttcagccatgctgttgctgggtc

SEQ ID NO: 28211 - DNA, 121 bp, Artificial Sequence
  Synthesized
  misc_feature (61): n=t or c
ggttagcagttaatcaagcatttaccattcgcctctaatttagctatacctacaaatgaangttatagacaatttaattccctttaattctaaagcaagtaaacctggcaaatacacctgg

SEQ ID NO: 28212 - DNA, 121 bp, Artificial Sequence
  Synthesized
  misc_feature (61): n=a or g
aagaaacatttgatcctcttagcaaacagagccaaaccctgagcgcagtggaacactcctnctgaattcaacaggtgcccacaaagacctaaggcagtggagacctcgggctctcaagcta

SEQ ID NO: 28213 - DNA, 121 bp, Artificial Sequence
  Synthesized
  misc_feature (61): n=t or c
ccacagaacagaaccttccatcttagtcagatgatgcaacccagttgctgctgacacaccnttggtatttcctagcctagttccagctgctcattccaagaccctagctagagaagacctc

SEQ ID NO: 28214 - DNA, 121 bp, Artificial Sequence
  Synthesized
  misc_feature (61): n=t or c
cctgctgtttcggagctgacggggcagccttgcaaggagcccaccctgggctgcatctctnacttctggatgcgtttactggagagattttaaagcaggaagggcaatgtggcttctgagc

SEQ ID NO: 28215 - DNA, 121 bp, Artificial Sequence
  Synthesized
  misc_feature (61): n=t or c
aatccatacagtaccatgtaactctagaatcatcatgtttgaaagtaatttcagtgacaantcgtactgtcatatacttttttttggcttgtctctcaatagcagagactgttctgaatgc

SEQ ID NO: 28216 - DNA, 121 bp, Artificial Sequence
  Synthesized
  misc_feature (61): n=t or c
aaaaaatactaaaaaaaaaaacaaaaaacagaaatgcagtggatcagaatcagttaaaatntctttggagtattttgaggggaaaggaaataaaatgaagtaatttggggaaaagttcatg

SEQ ID NO: 28217 - DNA, 121 bp, Artificial Sequence
  Synthesized
  misc_feature (61): n=t or c
ccagcaggtcctgcaaataaaactgcaaaagcaggaatgcaattaacatggggcaaagtcncattcagctggaagacctgccctggagctcccatcagtctctcacagtgcaccacctcgc

SEQ ID NO: 28218 - DNA, 121 bp, Artificial Sequence
  Synthesized
  misc_feature (61): n=a or g
attttcaaagctggcagtgtatttccaaagaatattaagctgttatcccaacagaaggggnaatatttggaattggcagttaattcttggcaagcattgattttaacacactactacacct

SEQ ID NO: 28219 - DNA, 121 bp, Artificial Sequence
  Synthesized
  misc_feature (61): n=t or c
tatgtcacacagagggaagaggcacagagggaagtagcctcctgtaagaaatgagttgganctggagttgcttgagatgctcctgactagaattcattgctccttaagtctggtgtgatga

SEQ ID NO: 28220 - DNA, 121 bp, Artificial Sequence
  Synthesized
  misc_feature (61): n=a or g
gaagagtaagtggcagtgctgcaaccaatggaccaatgagatcagggaaagcttctggagnaatcctggcctgaatcagacatttgcaccttgtgaaattttcctggcctttgttctcaat

SEQ ID NO: 28221 - DNA, 121 bp, Artificial Sequence
  Synthesized
  misc_feature (61): n=a or g
tgaaggcttgtaacacttcttatttctgttacttggtgctgggctgctgtgtgacaccacntaacagagtccagcattcagtgttgtgactgctgctgcctcgtggtgaccagtttccatc

SEQ ID NO: 28222 - DNA, 121 bp, Artificial Sequence
  Synthesized
  misc_feature (61): n=a or g
cccaaaattacaactggtcgttggcaacatttcaattactgtctgtacaaatgactacccntgtcaatggaggagggaacaaagaggtgatggactctttaacattttataaaaatgtttg

SEQ ID NO: 28223 - DNA, 121 bp, Artificial Sequence
  Synthesized
  misc_feature (61): n=a or g
aaataggtgccacaggacagaatctctttaaatgtgattgtgatgttagtatctctctacntgacctcttttgcacatgtatttgtgtctacatcttcatatgagaaaagcacagagatga

SEQ ID NO: 28224 - DNA, 121 bp, Artificial Sequence
  Synthesized
  misc_feature (61): n=a or c
aacaaaagaatgcagtttgccatgaagaatgaaaatctaggtgaagattccataataaggnagtgggtattttcttctcactgcagtgggtactaccaaacaacttaatttaggtaattct

SEQ ID NO: 28225 - DNA, 121 bp, Artificial Sequence
  Synthesized
  misc_feature (61): n=a or g
tggatgtgacttttgcatgacaccgagggtccgaaagctacaactggttgaagcagccctnctgctcaactgggcaatgccacctgcagggatgcggttagtgggcacggtggggttggac

SEQ ID NO: 28226 - DNA, 121 bp, Artificial Sequence
  Synthesized
  misc_feature (61): n=t or c
gctgtgattctaatgtacctttccttgacctgtcctgtactacagcatacttcttatgtantacaggatggattttgagtggtctctccattgctctttgtttaagactcatacagctgtc

SEQ ID NO: 28227 - DNA, 121 bp, Artificial Sequence
  Synthesized
  misc_feature (61): n=t or c
atctctcacagagctgtgatgtgcagcttttacatgggatgtttccagcctaagagagacngggagagaaaacagcagaggctctcccatgctctctctttacagccctccaggaaatttc

SEQ ID NO: 28228 - DNA, 121 bp, Artificial Sequence
  Synthesized
  misc_feature (61): n=t or c
attgaatgacaatgcaaacaaaacagaattagcatagacaagaacaagcacattaagttgnagtttaaatgacttttaatagtaaagccatgctaagaaaactgtttatcggtctcatggt

SEQ ID NO: 28229 - DNA, 121 bp, Artificial Sequence
  Synthesized
  misc_feature (61): n=a or g
tgtaccaagatcaccagggttccccacttgcactgcagcaatacagtgctcaggagcaatntaggtcctgacaagtctgaggccaagcaacagtgcaaggccattacaagatagaaaaagt

SEQ ID NO: 28230 - DNA, 121 bp, Artificial Sequence
  Synthesized
  misc_feature (61): n=a or g
acagtcttcttgatgttttaaatgatcgttttttaataaacatttgtattaccaacagtgncagcacaataaatctattgagaaaatctatttatgatggtcctttctggcacacttaatt

SEQ ID NO: 28231 - DNA, 121 bp, Artificial Sequence
  Synthesized
  misc_feature (61): n=t or c
cataaaactgcctcgctgcactgttttattttcaaactgatttaaatctgtttcgctgaanataggctgagttaaagaaaagctttttatagattctcccagtgatggataaagatacaaa

SEQ ID NO: 28232 - DNA, 121 bp, Artificial Sequence
  Synthesized
  misc_feature (61): n=a or g
gcggctcactgggaaggaaacgcttccttctcctttctgcccaccctgtacccgcagcccncatctcggtgctatcccaacatcactgccttccagcctctcgtgccttctcctcctctga

SEQ ID NO: 28233 - DNA, 121 bp, Artificial Sequence
  Synthesized
  misc_feature (61): n=a or g
cactcccattgcctctccttccacattctgtatcacagaaataacttggaaactaggacantctctaaggctcataatgctaacacctagggaaaagttctggtgttgtggaagcgtgcaa

SEQ ID NO: 28234 - DNA, 121 bp, Artificial Sequence
  Synthesized
  misc_feature (61): n=t or g
acataaactatgtccagcaaacctgcctaaaatttatgaaggctgaagtaagcaaatttcngaggcaaaagggccatgccatagaaactgctgaatcctgaaggataaaaggccttcccaa

SEQ ID NO: 28235 - DNA, 121 bp, Artificial Sequence
  Synthesized
  misc_feature (61): n=t or c
tgctaccatctgcaaaaaattcaaggaatcttgagcttattctcagaaaacacagagattntgataacttgttttcattcacatttgtcatgcacatcacatgcccactcccacaactctt

SEQ ID NO: 28236 - DNA, 121 bp, Artificial Sequence
  Synthesized
  misc_feature (61): n=a or g
ggttatataaattcagacattcaaaaagtccttaaacttaattctaaaatggactcttccntgctgaaatacataccaggtctaaacttggagagggaaatcaccatatccccaaagctaa

SEQ ID NO: 28237 - DNA, 121 bp, Artificial Sequence
  Synthesized
  misc_feature (61): n=t or c
ttccctttgtctattcgaataaacatctgtaggtaaacatacatttcttccttaattggcnctcacaaacaaactggagcatattcaacaaagtatcaaaatatatcttcaagccaactca

SEQ ID NO: 28238 - DNA, 121 bp, Artificial Sequence
  Synthesized
  misc_feature (61): n=c or g
gcccttcttcagctgctcgtagatctccatccccaaggtttacacaagagatagcagacantggtgtttttaacccctgacttgcaaatcccacaaacagggtcaaaaagggacgatgttg

SEQ ID NO: 28239 - DNA, 121 bp, Artificial Sequence
  Synthesized
  misc_feature (61): n=t or c
tttgttaatggattcttcttccccaccgaggacaacatttggaggtgtttctatgagtttnctgttctgatagagacacggaaaacaaaatgcatatcttaaccttccaataaattttctg

SEQ ID NO: 28240 - DNA, 121 bp, Artificial Sequence
  Synthesized
  misc_feature (61): n=t or g
ttactattaaagctaagagcaaaaattatagccatcaaaacactcctactcgtgtgaaatncacctgtgtttcaagaacagctgacagaatatttagccttcagcagtaataaagcaggag

SEQ ID NO: 28241 - DNA, 121 bp, Artificial Sequence
  Synthesized
  misc_feature (61): n=t or c
gcaaaaaaaaagacataaataaaaatgcgtgtctaaatcttggttaatagaagttttccantgcaaatgaaaatggcagagtctgttcatatggaaagtcaaagaactctgacactttttt

SEQ ID NO: 28242 - DNA, 121 bp, Artificial Sequence
  Synthesized
  misc_feature (61): n=a or g
aaatcatatttggcaaaataaagttttcctccaaaatattagacacaaaattgagctcacngtgccacatacacacaggaagacttttgtgtacagaataccaagaccaaaaaataaatta

SEQ ID NO: 28243 - DNA, 121 bp, Artificial Sequence
  Synthesized
  misc_feature (61): n=a or g
tggctgaaaattgcttatctgagtgtgttgttgcactaggtagggtgtgctctttttaccnggaataaacaatctctgggaatggctaagctatcatgaacagatttaggaataaagggca

SEQ ID NO: 28244 - DNA, 121 bp, Artificial Sequence
  Synthesized
  misc_feature (61): n=t or g
ctctgagtagtacagctgtacagttttctgtacagttcgagttactcctgtatacatttcngtgcatcagcatcaagtgtctgcaagagtagattagcaccacaaatgtgtgtaacatgcc

SEQ ID NO: 28245 - DNA, 121 bp, Artificial Sequence
  Synthesized
  misc_feature (61): n=c or g
agcagagataggaaggatctcacacagcctaagtctgaggtaggcttagcctccgcttaanaatgtaatttgggcaccgagtccacagaattttaggggagattttatcaacttgtggtga

SEQ ID NO: 28246 - DNA, 121 bp, Artificial Sequence
  Synthesized
  misc_feature (61): n=t or c
ggttttataacagcaaacgctaacattagccctgttaagctcatctcctcagtttcccttnacaatcagagtgctcaatgcagttaattgcatcctcgctgcctatggagggagccaagga

SEQ ID NO: 28247 - DNA, 121 bp, Artificial Sequence
  Synthesized
  misc_feature (61): n=a or g
attactgtactgtaagctgtttcaatgggggcacacacattaatttaattcattgcagcangcaggtaggcacgcacagagaaaaagcaccgcgaaataacgaatgctttacaatttacaa

SEQ ID NO: 28248 - DNA, 121 bp, Artificial Sequence
  Synthesized
  misc_feature (61): n=t or c
tgaggctggcctggggtatcagtgtgttagaactggttgctgctgggaattggacattgangctgtttgatcctggcttagagaaggaaagggttgtattgcagtccagctcactgccgtt

SEQ ID NO: 28249 - DNA, 121 bp, Artificial Sequence
  Synthesized
  misc_feature (61): n=a or c
gaatccttctcaaggagaacctggagacattactaactgaaataaagtaaatcatgctacncattgtaacaatgcccctgaaaggtcaccactagcactgcactatgcacctgaatacctg

SEQ ID NO: 28250 - DNA, 121 bp, Artificial Sequence
  Synthesized
  misc_feature (61): n=a or g
gatcagtaaatggtgattttcagtttcctacatatgcatgaatcttctttttaaaatcatntatgtctgatcaaactcctctcacaagctttgggaaagaaaaacattccttatcagaaag

SEQ ID NO: 28251 - DNA, 121 bp, Artificial Sequence
  Synthesized
  misc_feature (61): n=a or g
cccacagtccaggtgatcccagcattcactctcttgcccttttcatgatctgagcacctcncagcccaggcaacaatcaggtgaagaatggagaagccaagattagatcaccggtttcaca

SEQ ID NO: 28252 - DNA, 121 bp, Artificial Sequence
  Synthesized
  misc_feature (61): n=t or c
atgagtgcttctcctgcaacagtgcaaacataccacatacagtgcactcactgacctgaangtcaccatgcaacacaactgaagatgggaatgctcctagtatctgtgccacgtgttttaa

SEQ ID NO: 28253 - DNA, 121 bp, Artificial Sequence
  Synthesized
  misc_feature (61): n=a or g
ttcagatgtagtttacattaagttgtaaatttcaagcacctaattaaaatgaatgttgttnaggaaaggcagaatttaggacctaagcattttgacagaactttccgtggagcttcacttg

SEQ ID NO: 28254 - DNA, 121 bp, Artificial Sequence
  Synthesized
  misc_feature (61): n=c or g
cgcttagctagctgaaagctgaatgctaatattctaatcacaataaagaaaagggctgtgnttgaagaagatatattcccctacagtaactgttgtgggaggaaataggttgccctagtct

SEQ ID NO: 28255 - DNA, 121 bp, Artificial Sequence
  Synthesized
  misc_feature (61): n=a or g
atggctttcagtactcaatttgtcactgaattgaattaattactgtaatttttgcactccntttctacatcagtgcaagtccactgagatttctgttccaaaactggagcagtaagtcaga

SEQ ID NO: 28256 - DNA, 121 bp, Artificial Sequence
  Synthesized
  misc_feature (61): n=a or g
ttactttgagatgctatttttatttagcttatcatagtgtccttctctgtcgttacatggngtaaaatactctaacagtgattcaccattagaagcaaccacgtaccacttatctactacc

SEQ ID NO: 28257 - DNA, 121 bp, Artificial Sequence
  Synthesized
  misc_feature (61): n=t or c
tcacattattaataatattaaaagaacccagcgccacagcaaagcacagcaaacctaaccncaccccaaacaacagcattttggtgagcgactgcagctcagcctcctctctgcctgcctt

SEQ ID NO: 28258 - DNA, 121 bp, Artificial Sequence
  Synthesized
  misc_feature (61): n=t or c
gcatgttcccatgaaggagggaatcaagcctgtactgcctgctttagctgagagacctttngttgtgagacagcagatttagggtattgttaggaaatgtatctaagaacttcaccgcaaa

SEQ ID NO: 28259 - DNA, 121 bp, Artificial Sequence
  Synthesized
  misc_feature (61): n=t or c
gaggggagtgcgtgggtgttttctcttagagagcaatccttgctatgactggagaacagantccctgtgtgggaatgaaaggactgtttacatctacgtctttgtttgggatgtacctttt

SEQ ID NO: 28260 - DNA, 121 bp, Artificial Sequence
  Synthesized
  misc_feature (61): n=t or c
aggtggggagaagagattaaatggaatgaaagataaatgcagcatttcatacttggcaccnatagcactcatggaaataaacctgctgaagcacagtgcgagaggctttagtgaaactgga

SEQ ID NO: 28261 - DNA, 121 bp, Artificial Sequence
  Synthesized
  misc_feature (61): n=a or g
tgagcgtgagagacttctttgcagagatctacagaaaggagctgtggaaagcagtcacatntctcagtgctgaaagactttgccttgcaaaagtgtctgaactatgggttaggaagatttc

SEQ ID NO: 28262 - DNA, 121 bp, Artificial Sequence
  Synthesized
  misc_feature (61): n=a or c
caggaaaggttttcatgcatccctgatgacaagtgtgttgcatcagagcctctttcagtgnagatcaggaaaataagcttgcaaaaaaacacacggtagggaggtggaaaattagctttgc

SEQ ID NO: 28263 - DNA, 121 bp, Artificial Sequence
  Synthesized
  misc_feature (61): n=t or c
tctagcttaggaagcgagaccttttgatggctgagcagggtttaaaagcccttcttctttncttccctggctccctctggagcagccacatttgtttttttttctgcagcagctagcctgc

SEQ ID NO: 28264 - DNA, 121 bp, Artificial Sequence
  Synthesized
  misc_feature (61): n=t or c
gtcatagtggtttcaccagatgttctagatgagagctattttacaactgggaaattttcanccagttcttcaatcctttttctgattgccttagaaaatttgtgcttttctcaaatagcta

SEQ ID NO: 28265 - DNA, 121 bp, Artificial Sequence
  Synthesized
  misc_feature (61): n=a or g
tcctgtagcctccaggcatccatttgcacatcaccatgtggtgcagagcgctggtgctggngctgaaggtctcctccatggcttgagatcagaaatatatttctgctgctgtctttggcct

SEQ ID NO: 28266 - DNA, 121 bp, Artificial Sequence
  Synthesized
  misc_feature (61): n=t or c
tcatgtaagagtcaagacaaagcattttcaccaagttatttcctcgggacgaactcactanaaagccattccttgccagaatgacgtgacatagaacaagatacttttcctgggttaatca

SEQ ID NO: 28267 - DNA, 121 bp, Artificial Sequence
  Synthesized
  misc_feature (61): n=a or g
gggattatcatttcagctgaccagattgcctttgctgcaatatgttcagtgtgttgatctntgtgggtaagctggcacctaatgatgtctgctgggttgtatgcatcatgttcaccttcct

SEQ ID NO: 28268 - DNA, 121 bp, Artificial Sequence
  Synthesized
  misc_feature (61): n=c or g
tttggatcaagagaagggaggtctttcccaagagtttcatagcaccggttctttctttgtncatacgttatttggaatctctgcttcatctaactgtggtaagggaatgacacggccatct

SEQ ID NO: 28269 - DNA, 121 bp, Artificial Sequence
  Synthesized
  misc_feature (61): n=t or g
tcttttaatggactaaacatggcttgtaaattgattgctcattgtaaatttggctgttatnttgatactatgtcagactttatttgcatatttgaacaacaacatttttccaggtcactat

SEQ ID NO: 28270 - DNA, 121 bp, Artificial Sequence
  Synthesized
  misc_feature (61): n=t or g
gaatacaaagtagatgtctaaagagagattagacacaaatggcagaagaagaaatgccctntgaatagtgaggaacaggagaaaggtgcccatttaactggccatgtctgctagaatgtat

SEQ ID NO: 28271 - DNA, 121 bp, Artificial Sequence
  Synthesized
  misc_feature (61): n=a or g
gcaaaatgttccaggaaatgattgcttgtcatctcaaatgatagagtcttgatttgctacnttcatctcaggttccaattgttttgtctctgtgtatgtctgtggattattccattggctc

SEQ ID NO: 28272 - DNA, 121 bp, Artificial Sequence
  Synthesized
  misc_feature (61): n=t or c
cagatcactcaatccgcacagtacctgttgcaaagatgacattctgctggtcacatacagnctgaacgagctctgtgtcaaagcagggcaactgattcaagcacgtgtatgagtaatgcag

SEQ ID NO: 28273 - DNA, 121 bp, Artificial Sequence
  Synthesized
  misc_feature (61): n=a or c
ttggattttctgtttgcatgttcagatcacaattctgccatagcacagaagtaaagccagnaaataattattcatatgtttccagttgtatctattgcccaaacttaattttgtttttctc

SEQ ID NO: 28274 - DNA, 121 bp, Artificial Sequence
  Synthesized
  misc_feature (61): n=t or c
tgctcaaaagtaacatttcatcaatttatttatctgcctaagtcagtctctcatatgaaantgcatacagtttacaactgagcaaactgaatgtataatgtccaagtaaaaatcactgtta

SEQ ID NO: 28275 - DNA, 121 bp, Artificial Sequence
  Synthesized
  misc_feature (61): n=t or c
tgacacgttttgctttgatttcactaatgttacagaagtagctgctaggaaatatttcaanccccctgtatggagccagaccccttggagagggatcatgggcacaggcagcagtgctcca

SEQ ID NO: 28276 - DNA, 121 bp, Artificial Sequence
  Synthesized
  misc_feature (61): n=a or g
tttttctcgactcttcaaactatgtggagaacattgaaaaatatttaccacctgatttgtngcaattgtttgacaactagtgagtacataatatgaaattgatatgaataatatgaaattg

SEQ ID NO: 28277 - DNA, 121 bp, Artificial Sequence
  Synthesized
  misc_feature (61): n=t or c
gatcaaggcagaaggaaatgggaaaggatggtggttgatttcttagcaatggaaggttgtncttccaaaaaattaaacacaagaaatggaaatgaagagaaaccccaagagtgcagtccca

SEQ ID NO: 28278 - DNA, 121 bp, Artificial Sequence
  Synthesized
  misc_feature (61): n=a or g
cctgagctgctcggtgagtacatatgttttctggaaagttcttctcgatggcgtgatgcanaaatattcatcttggtccagttggaagacaaacatcaaggtttactgtcagggcacagtg

SEQ ID NO: 28279 - DNA, 121 bp, Artificial Sequence
  Synthesized
  misc_feature (61): n=t or c
tggtgtggaggaatagaaaatccaagttcttgtgttcgtacatgaaagtaaacaaaagccngtaaatctctcactaggttccctgcaggctcatatgtagtgctggcaagaggaactgcag

SEQ ID NO: 28280 - DNA, 121 bp, Artificial Sequence
  Synthesized
  misc_feature (61): n=t or c
aacagccaccaaagtgccataaattcattaagttgaaaggctgtgccctgtcagtcagacntggggagaaggcgattcgattgcagatatttaaggcctaaagtttgctcgcaagataatg

SEQ ID NO: 28281 - DNA, 121 bp, Artificial Sequence
  Synthesized
  misc_feature (61): n=t or c
atgagttttagggaagaagtggagagaagagctaaagctgtaaaaatgttaaacccatggncttacagcctgtcacgagtattctcagttctgttgtttttccctgcacgctccgtgactc

SEQ ID NO: 28282 - DNA, 121 bp, Artificial Sequence
  Synthesized
  misc_feature (61): n=t or c
ccagcctggaaagcactggcacgacccatcgatgggattgcacgtcccgttctcggtgcantggcagagctcagcacagttcttcccatattttccactgggacacactggaaatacagaa

SEQ ID NO: 28283 - DNA, 121 bp, Artificial Sequence
  Synthesized
  misc_feature (61): n=c or g
gggaagcaaaatcgctgtgctgggtctgcctttggagggacctgcagctttctgagcaatnctgcggaacgcacaatgtgttcaccttgtctgctttaatagaggcagaaaacgatgagcg

SEQ ID NO: 28284 - DNA, 121 bp, Artificial Sequence
  Synthesized
  misc_feature (61): n=t or g
tttctgaatctgtagcaagatgacttcactattcctaccactgtctctggtctactagagngacataatggattcctgaaagagagaaagaaaacaaaacccaaggcattcctggtggaga

SEQ ID NO: 28285 - DNA, 121 bp, Artificial Sequence
  Synthesized
  misc_feature (61): n=t or g
aaattaaactttatctgcagaaagctgtacttccacagttcttgcagtactagttccaaangcaaagcatgtgtttgtaaatatgggatttcagttgcttgtgttgctacaaagtaaagca

SEQ ID NO: 28286 - DNA, 121 bp, Artificial Sequence
  Synthesized
  misc_feature (61): n=t or c
ttcagcacatgacaggaagggaactcttgggaccagatgtagtctgacagggtttctgagncttggatctgcgactgggactttgctctagagctatctgttgttctcttcaccggaggct

SEQ ID NO: 28287 - DNA, 121 bp, Artificial Sequence
  Synthesized
  misc_feature (61): n=a or t
gaactcatttaaaagttgggatgtggccttcaaacgtatcacaaaatgatggtattgccanactatgggggagataaccccatctccagttcacaaaaaacccaactgttgccactcaacc

SEQ ID NO: 28288 - DNA, 121 bp, Artificial Sequence
  Synthesized
  misc_feature (61): n=t or g
gaaaacaaccctgaatagaaagaacatccagcttgtttttaagaactgttgatgagaaatnatcaagagagtagtccaagatttccagtcttgaaaaaggtatgtctcacaatttctgttt

SEQ ID NO: 28289 - DNA, 121 bp, Artificial Sequence
  Synthesized
  misc_feature (61): n=a or g
ttcttaataattagacaaaattctggctctcagagtcaaaagtgagtgccccctgttgctnttagatgaatgcaaagctttgatgatgcattatttcttctcactgatcatttaaaatact

SEQ ID NO: 28290 - DNA, 121 bp, Artificial Sequence
  Synthesized
  misc_feature (61): n=a or g
ccaggaaaatgctacttcgctacctaaggggtaggcagacccacgttagcacccagcaacnactagcatagggctgcaccaggcagcatcaccccaacgctgtgctctgagcctctgctgc

SEQ ID NO: 28291 - DNA, 121 bp, Artificial Sequence
  Synthesized
  misc_feature (61): n=a or c
gagtggaatttcatgtgctactctacacattactggatctgctttttcaaaaggaaaaaancaaccaaagggatgggtagaatctatacagtatataacagcaaccttctcctgctctgcc

SEQ ID NO: 28292 - DNA, 121 bp, Artificial Sequence
  Synthesized
  misc_feature (61): n=a or g
catggggagggctccaagtgaaatgctggggcagcttgtggttctcccttacaaacagccngggccttggcaagctccagcatcatgtcggggtgttagtgttgtacatcaccttgctcca

SEQ ID NO: 28293 - DNA, 121 bp, Artificial Sequence
  Synthesized
  misc_feature (61): n=a or g
tctgtgtgtcgggggctgtaaatcaggatttctgtgctccctttttttcccactcattctntaacggcttccacgtcacttaacctccctgcacacccaactgtacttcttagcgtcaagc

SEQ ID NO: 28294 - DNA, 121 bp, Artificial Sequence
  Synthesized
  misc_feature (61): n=t or c
gttaccagatctccagatgttaatctttggaagcgtttagtggaggaaatttaagaggttncttactggtatcttgaggttgagaatgcaccaatggatgacaggatgctcccttatgttt

SEQ ID NO: 28295 - DNA, 121 bp, Artificial Sequence
  Synthesized
  misc_feature (61): n=c or g
gcacaaggagaaatttcaaagtcattccacaagagctgtttagaaattcctcggtgaaganagaggttggagtgagaaagtataaagcagagcctgagcagactgccagactccttaaaaa

SEQ ID NO: 28296 - DNA, 121 bp, Artificial Sequence
  Synthesized
  misc_feature (61): n=t or c
atgactatgtaagaaactaagaaaaaaacttcagaaaggaactaagtcatcatatataaantggtctgcaatctcatttgttttccattcgtgctctagtcacagtctgttctaggaaccc

SEQ ID NO: 28297 - DNA, 121 bp, Artificial Sequence
  Synthesized
  misc_feature (61): n=a or g
ctgcataaagaagcctggctgcaggagcattagtagaggaaaggagagcacgaggtagganagcacagatcagttgttagggaaagctatcgtttaacagaaagtcagttgtgtttcaaga

SEQ ID NO: 28298 - DNA, 121 bp, Artificial Sequence
  Synthesized
  misc_feature (61): n=a or g
cgagtgagttcaatcagctgtaatctgtatcacagaaattgatttttaaattgaagttgantctgttccaccttccaagctctcacagagttttgctgtggccattttaaaggctttttgg

SEQ ID NO: 28299 - DNA, 121 bp, Artificial Sequence
  Synthesized
  misc_feature (61): n=a or g
gaaaaaaacagctaacgttggacaatttgaagtccttcataaaagcccagagagaaaattngatgtgctttccataaggtcacctgacacatcaacctgattttgagaacacgtgggcagt

SEQ ID NO: 28300 - DNA, 121 bp, Artificial Sequence
  Synthesized
  misc_feature (61): n=a or g
ccacaatactgtctgtttccactgactgcgcattttcttcttgctttccaagagcaagatntatgtccaaaatatcaaatgcttttcaacagagttcagattttaccattctgaagtgtca

SEQ ID NO: 28301 - DNA, 121 bp, Artificial Sequence
  Synthesized
  misc_feature (61): n=c or g
agtatggagtcagtcagatgtcatttccttcttcaatactgtgcaatttcagtttattcanctaattcaactatgttaattctcagtgtatttgggtaggaagttgtgatgtatttttctg

SEQ ID NO: 28302 - DNA, 121 bp, Artificial Sequence
  Synthesized
  misc_feature (61): n=c or g
catttcacattttgctttcctgctgctgaaggtcccttggagggagcttgctgttgacctnttgatcaagacatgtcactattgggaagagcagaagggtcgatcccagcttttgggtagg

SEQ ID NO: 28303 - DNA, 121 bp, Artificial Sequence
  Synthesized
  misc_feature (61): n=a or g
aaaacctaaataaaaatagattttatgactcactatggagtctccagctttggctgtatcntgtaagtgataaattattcaccttcatttaatagaatttcttgtggcataattacatgaa

SEQ ID NO: 28304 - DNA, 121 bp, Artificial Sequence
  Synthesized
  misc_feature (61): n=a or g
ccaaatagcccttttaatgcaaatgagaagacctctgctcatgatttcttttctccagacnttccgatgcagaagtcaatactcagtaagttgcaattagaaattgctaacctataaccaa

SEQ ID NO: 28305 - DNA, 121 bp, Artificial Sequence
  Synthesized
  misc_feature (61): n=t or c
aaaaactagttaagcactaccattattacagtagtatagcacatctgagcttgcaagcttngtattcttcattgaaaggccaggtttatttttctttccctggttaactcagtattataaa

SEQ ID NO: 28306 - DNA, 121 bp, Artificial Sequence
  Synthesized
  misc_feature (61): n=t or c
tggggaacaaaaaaggaacaatgattttgttgtgctggaagaggtagcagggcttacattngtctcactgttctccaggatggatggacaagctttaagatgaagggtgaaagaaaggaat

SEQ ID NO: 28307 - DNA, 121 bp, Artificial Sequence
  Synthesized
  misc_feature (61): n=t or c
attgcagaatgaataagttaatgagaaaagtttatgggccttgattcaccaaggtaaacangattaacatcatttcaatttaatgtagtctttagcttgtgttttcatttctttgttgagt

SEQ ID NO: 28308 - DNA, 121 bp, Artificial Sequence
  Synthesized
  misc_feature (61): n=t or c
ctgcattctgtattgtataactgtataatttgtattttgcaataagtaaaaacctaagttnctcaaaacagaatccttcttttgcaataaagatggtcctaaaaatacagctatttctgaa

SEQ ID NO: 28309 - DNA, 121 bp, Artificial Sequence
  Synthesized
  misc_feature (61): n=t or c
aaaggttctttcctacccaaactatgctatggttatgtatggagaatctgaagaaataccnaaagctttggattcctattagaattcagcttccaaacattaaaagtcacttcttcactgg

SEQ ID NO: 28310 - DNA, 121 bp, Artificial Sequence
  Synthesized
  misc_feature (61): n=c or g
tctggtctaagcaggtgcaattcccatatagcgcattaggccaattgcggcagcagtgtgnggagggaggaaattactcttgtatttatattgctgtggatttcagcccagaagttaatgg

SEQ ID NO: 28311 - DNA, 121 bp, Artificial Sequence
  Synthesized
  misc_feature (61): n=t or c
agtgctgtgcagtgagcacggcccagtcaacggctgcgggagggggctctgtgcccagccnccacgctatgctttcaagagttctcctatcacggagctctgctcagtgtgcagccatcca

SEQ ID NO: 28312 - DNA, 121 bp, Artificial Sequence
  Synthesized
  misc_feature (61): n=a or g
acctttttctactgcttttcttccactggtgttctccctgtaaggaaatttgcacaactgntgttgtgtttagcttctgtgtgtagtttagtttgtgtgtagctacctagtaaagtaataa

SEQ ID NO: 28313 - DNA, 121 bp, Artificial Sequence
  Synthesized
  misc_feature (61): n=t or c
cgagacattgaccaaaacagttctcctctagggctacttctgagtaatggcattcaccttntattcctttagccaggttgtgccattgggtttgggtcaaattcccctaccgaagtcacct

SEQ ID NO: 28314 - DNA, 121 bp, Artificial Sequence
  Synthesized
  misc_feature (61): n=t or c
cttttcttttagcagcctcggcttacagcctgcttcagtctcatgtgctgttcctactggntccaactaattgggtttgaacataacgaagtgaaaaaagttaaaggcttcagttattaag

SEQ ID NO: 28315 - DNA, 121 bp, Artificial Sequence
  Synthesized
  misc_feature (61): n=t or c
ccaggaaaaatggtagagctgcgtgctttccaaacttggatactcccagtgctgggtgccngaaatcttactgaccaggtgagctgtcgctgcatcagctttagctgcacttaacttacct

SEQ ID NO: 28316 - DNA, 121 bp, Artificial Sequence
  Synthesized
  misc_feature (61): n=a or c
caacaaatttagcaagacagtacttgctattttagagaggcggaatgttattcccagacanactctgacagtctgtcctcttgatcaagactcattttttatgtgagctctgcaaaactaa

SEQ ID NO: 28317 - DNA, 121 bp, Artificial Sequence
  Synthesized
  misc_feature (61): n=t or g
ctgcagaagtggttaacttcctcttgcagacagatgactgcaacttctgtcttcacacttntcttagaacccaagtagtatggtaatgaacagtattcaagatccttttagtattagtaat

SEQ ID NO: 28318 - DNA, 121 bp, Artificial Sequence
  Synthesized
  misc_feature (61): n=a or g
atgcttagtgcagtccagcccagatccttaatgccaagaagctgtctaaggtctgctgccntaaaagctactcgttgatcatgacaacagcatgatttagcagattacataactgacaagc

SEQ ID NO: 28319 - DNA, 121 bp, Artificial Sequence
  Synthesized
  misc_feature (61): n=a or g
atagggaagtcgctaagctcgtgacagggcacacatacattatccctcaccgggaactggnataaaaatgatacacctctgaaagagagaggagagccttatccgcacacgacgaggctgc

SEQ ID NO: 28320 - DNA, 121 bp, Artificial Sequence
  Synthesized
  misc_feature (61): n=t or c
aggaacaatttattcccatatatagtatgcgtagttctgtttaaatgaatgtgctgtcacngacatgtgttgagctcagtttgctttgagatgatatattgcatatatttgtcagctcgag

SEQ ID NO: 28321 - DNA, 121 bp, Artificial Sequence
  Synthesized
  misc_feature (61): n=a or g
ggagagatgtgtgcagacaccctgcatagagtcaccctatgtcaagttcctcttatggaantggctgaataactttccttgccctaaaataacacagaggaaggtacatcccgtttacatt

SEQ ID NO: 28322 - DNA, 121 bp, Artificial Sequence
  Synthesized
  misc_feature (61): n=a or g
aaatcacgtcaaggattggtatttttttctttttggccttatcctctgaccagtttgtacnctgaacagattatctgtacgctttaagccgcatattgacatcttttgagatccactcaga

SEQ ID NO: 28323 - DNA, 121 bp, Artificial Sequence
  Synthesized
  misc_feature (61): n=t or c
gggcaaatttccacctcttggtgccacgaatgccaaatatggattgctgaggcaaatgagntttagtagaagacatttatgtatgaattaggactccaaacaacttctgttcaggttgaag

SEQ ID NO: 28324 - DNA, 121 bp, Artificial Sequence
  Synthesized
  misc_feature (61): n=t or c
cattcaaacctgcagcagacaaagcagctagacaaagaaaagcaagtcaggctctgtcccnaggacttccatgtaatgaaaaattgataattaatgtatttcattttatttaaaggttagt

SEQ ID NO: 28325 - DNA, 121 bp, Artificial Sequence
  Synthesized
  misc_feature (61): n=a or g
aagagctgacacatgcactgccctctcccagacagtttgtccccatgaccccatgttccancctaggcaatggtcaggtgctttgtgtccccagcaggaggacaagctcgtcatcaagggc

SEQ ID NO: 28326 - DNA, 121 bp, Artificial Sequence
  Synthesized
  misc_feature (61): n=a or c
caagcaggccagagaacagctagaaggtccctgctgtttatgagagcattagtcttggggntctagcctaatcatttgctactggaaacataactaggttacacttggctcctgtaattgt

SEQ ID NO: 28327 - DNA, 121 bp, Artificial Sequence
  Synthesized
  misc_feature (61): n=t or c
aactgcatccagcacttcaataggaagattaaaagaatatcattttgggctccaaaggcangtaacttttttaatcaaatctccctacatttctaatgtatcatcaaccttacaaggatca

SEQ ID NO: 28328 - DNA, 121 bp, Artificial Sequence
  Synthesized
  misc_feature (61): n=a or g
acacctctgcctgagggaaacatacgctgagctctgaaataagcaaatcgaaaaagaaacntggaaaaatccatttgcttctggtatatcacaaaagcttcgtttatgatgctgatggact

SEQ ID NO: 28329 - DNA, 121 bp, Artificial Sequence
  Synthesized
  misc_feature (61): n=t or c
gcaacctactgaccaaatactgctgtgggagtctgtaccttgtctctactccacagattgntgctttgattacctactacctactactactactattggttgctgcacatctccccacaac

SEQ ID NO: 28330 - DNA, 121 bp, Artificial Sequence
  Synthesized
  misc_feature (61): n=t or g
tcctggcttgtagctgcaccaggacactacagcactgctgtctgggggtccaagaggatcngcagccaggagagccagcatcaggagcaccactgtgcactcacaccctcatcctacagga

SEQ ID NO: 28331 - DNA, 121 bp, Artificial Sequence
  Synthesized
  misc_feature (61): n=t or g
cagtttagctttttttctctagtctttgctaatgttagcccatcaacatacagtcttgcanagcagcatgttagtttatagtgagtatttggtacaaaaacagcatcttttgtgcaagaac

SEQ ID NO: 28332 - DNA, 121 bp, Artificial Sequence
  Synthesized
  misc_feature (61): n=t or c
tattagtttgctacagttgtcttgaaaaaatttcaactgtactctctgtgaaatttagttnggctgtaacttcaccaggtttgataggaatgtgcaataggtcatgttcactcaagattta

SEQ ID NO: 28333 - DNA, 121 bp, Artificial Sequence
  Synthesized
  misc_feature (61): n=t or c
tggattttctattatggggcaaaccactgaaatgaatcctttcccatgtgtcttcccttcnctgtctgtcatcttttccctggcacactgtatgaattgagactaggaggatgtcttcctg

SEQ ID NO: 28334 - DNA, 121 bp, Artificial Sequence
  Synthesized
  misc_feature (61): n=a or c
ttcagtccagtcatgacaggatagcttactttttaaagaggacttccaaagcattaaaaanaatgcagatattaagcacaaggaatatcatttggagagacgatcactgaacaactgtatg

SEQ ID NO: 28335 - DNA, 121 bp, Artificial Sequence
  Synthesized
  misc_feature (61): n=a or c
agtgtgcccttttgtttccctaatgagagtcttacaaaattctttatatttcatcagctgntctcctctggttttgcactggagggatcccatcaagcctttggtgagtgtaaaacctaag

SEQ ID NO: 28336 - DNA, 121 bp, Artificial Sequence
  Synthesized
  misc_feature (61): n=t or c
cttccctgaaagtctgcctgatgtgctctctgatgccacgtcgtggtgaccctttgcttgntgtcttccacagagaatggcacccgtttctcctaactaaattgttcattgcttcaaatta

SEQ ID NO: 28337 - DNA, 121 bp, Artificial Sequence
  Synthesized
  misc_feature (61): n=c or g
aacttacactgatcacctttcatatagtagaattcacattagatgaggagaagtgctacanctctacttcttaatccttttagaaagttgtcatgaatttcagtatcctggtcaaacactt

SEQ ID NO: 28338 - DNA, 121 bp, Artificial Sequence
  Synthesized
  misc_feature (61): n=a or g
gatctaccagaagtgactgtatatctgcttgcagatcacttacaaggttgttgactactgnggaagatccacaaggaaaataaatcagtgattttcctgctgacagaaacttgacatctga

SEQ ID NO: 28339 - DNA, 121 bp, Artificial Sequence
  Synthesized
  misc_feature (61): n=t or c
atgactctgaaaaagctgcacaaaaaatatataaaaaattgccagaatacagtctaatccnccagggcatcatagaaaaaacacctagttgtccagactacttgtttcacagattttcttt

SEQ ID NO: 28340 - DNA, 121 bp, Artificial Sequence
  Synthesized
  misc_feature (61): n=t or c
ccccagggcactgctcagagagttgtgtgtagtaacgcaaactgaaaaacaaataaagttngaagacctttggtatttgactggtattcttctgttttgcagagtgaagagagtgctttgt

SEQ ID NO: 28341 - DNA, 121 bp, Artificial Sequence
  Synthesized
  misc_feature (61): n=c or g
attaattgataccggaaagcgtcccccaggaataaagtcccttttcaagtactaaagctantacgttcattaggaattgtactgttagtgccagagcttaggaaaaaaaatctagggattc

SEQ ID NO: 28342 - DNA, 121 bp, Artificial Sequence
  Synthesized
  misc_feature (61): n=t or c
aaagagtctcaaattaacaatataaaaatagatcactctcagtaatgaatttgtctgtggnttcttcacttctctccagtgcactgtaatggaaacagcactttgattacatgatgtcctc

SEQ ID NO: 28343 - DNA, 121 bp, Artificial Sequence
  Synthesized
  misc_feature (61): n=a or t
aaacttaacaggtaaagccaccgaacaaagtatttggtgtaatcaaattgtttccaattgnttgcatttatttttgacctctccattctgagtgtaaatttcaaaccaaggagtgagttgc

SEQ ID NO: 28344 - DNA, 121 bp, Artificial Sequence
  Synthesized
  misc_feature (61): n=a or t
gaagctgggatgacttcaatagataaggtggaggtaatggccttctgctgcaaggtggatnacttctgttgcatcagcagttttaattctttttgatccttgttgtggctttttgatgcta

SEQ ID NO: 28345 - DNA, 121 bp, Artificial Sequence
  Synthesized
  misc_feature (61): n=a or g
gtcagggtcagcccagtggtactcacagcacagaggagagagatgccacaggaaaacaaancagcacaggagaaatggattaagtaggcagtgctggattcacccagaaagatggatgtgc

SEQ ID NO: 28346 - DNA, 121 bp, Artificial Sequence
  Synthesized
  misc_feature (61): n=t or c
attatattttgagtcatagcaaatattgtcatctctcatatttacattttgattattattngggtgtgttagtgtacataggggaagtgaaagaaaaactaacattttcaaacctgtaaac

SEQ ID NO: 28347 - DNA, 121 bp, Artificial Sequence
  Synthesized
  misc_feature (61): n=a or t
cctgggaggtgatgatttttcatccaagtaactattatatctctacgataaaacaaagatngtgtgacattttaaaagagaattaaaatacacagagtgggcagaaggtcatgggagagcc

SEQ ID NO: 28348 - DNA, 121 bp, Artificial Sequence
  Synthesized
  misc_feature (61): n=a or g
taaatgggattttgggaaaacaaagaacttctaaaggttgtcccaggctagtacaaagcanaagacataggatttccttgtactcaaagttagcaaaccagcgtggatgttccttgggtat

SEQ ID NO: 28349 - DNA, 121 bp, Artificial Sequence
  Synthesized
  misc_feature (61): n=t or c
tactgtcattctgtgagggtggttaaacactgaaacaggctgtctacagtggctcaggagnctctgtccctagagatactcaaaaccctatgggataaaaccccaagcaatctgctcaacc

SEQ ID NO: 28350 - DNA, 121 bp, Artificial Sequence
  Synthesized
  misc_feature (61): n=t or c
catatctgaacatacagagaggtagagaataggcattgaagaaacatcctagttctggctnccctcctccccttcttctttaaagcacagctaaataaatatcaagcctactttgagaatg

SEQ ID NO: 28351 - DNA, 121 bp, Artificial Sequence
  Synthesized
  misc_feature (61): n=a or t
gcacaactattcaaagagaaaactggaagttgctgttgtaattaggtgtttgattatcaantatgtaaatactgactctgagagagcagggttttttccttctatttttaaaaaagtgtct

SEQ ID NO: 28352 - DNA, 121 bp, Artificial Sequence
  Synthesized
  misc_feature (61): n=t or c
gtattgcaggttaaacttgaggcctaacaaccctgacaacgtccccttacatttttttganaagccattgagtagcattatgacaaattatgggacctgatgatacgtaaccagaaaatct

SEQ ID NO: 28353 - DNA, 121 bp, Artificial Sequence
  Synthesized
  misc_feature (61): n=a or t
aattaatatgttgtctcttcacaggcagattattgccagaggtcttttggatgtctttcgngatttcagcaataatgaggaagatttcctgactgtaatggagattgtggtcaggctctct

SEQ ID NO: 28354 - DNA, 121 bp, Artificial Sequence
  Synthesized
  misc_feature (61): n=t or c
taaattcttgttactacattgaatgtatgtgggctttgttaatgatgcaaaggtgggattnagatgcctaaaagtaggacttaatttcaagctctttgaagatacccaaaagtgaagtttt

SEQ ID NO: 28355 - DNA, 121 bp, Artificial Sequence
  Synthesized
  misc_feature (61): n=t or c
aacacacttcttaactgctgttagtccacagtcacgccaggaagccacgaacgagacgccncatcctcgagtaccatgactttgctgttgcatggagcaggcggaggggatgggccaagcc

SEQ ID NO: 28356 - DNA, 121 bp, Artificial Sequence
  Synthesized
  misc_feature (61): n=c or g
tttgaggtgacaaatgaaatacttgctgataatcattaagtcctgaggtccaaacttgaantggtactgggaaagggacccagtgtgagtaggcagtgcctgtgctcattgtggcacactg

SEQ ID NO: 28357 - DNA, 121 bp, Artificial Sequence
  Synthesized
  misc_feature (61): n=a or g
tctttcttcctgtttgtgcagaaatccatcacagaaaacaatattatttacagtgtgctcnggctactggctatgcccaaaaatagtgcttaacaacaggaggtaaaaatctgccattagt

SEQ ID NO: 28358 - DNA, 121 bp, Artificial Sequence
  Synthesized
  misc_feature (61): n=t or c
aaaaaaaacacagtaggtgtcaaaaggaaaagacaaacaagaatcagtatcttatcagaanctcatactcctttgaaaccctaccttagattataatggaaaaggacaaacaaagggaact

SEQ ID NO: 28359 - DNA, 121 bp, Artificial Sequence
  Synthesized
  misc_feature (61): n=t or c
cgtttcatctttaacaagaaacagaagggattttatatcagccactgcagttaatggtttngtcagtgtctttataatgtagctgtaatattattaaatgcagttgtagctgaagataact

SEQ ID NO: 28360 - DNA, 121 bp, Artificial Sequence
  Synthesized
  misc_feature (61): n=a or g
agcagcgcccccagactgagcagtgcgcgttattcctggcttcacgtggtgctgcagttcnttggaatccttgggaatgtatctccatgtttcccatgggtcagtctgtacctggagaact

SEQ ID NO: 28361 - DNA, 121 bp, Artificial Sequence
  Synthesized
  misc_feature (61): n=a or g
agaatcaacagcttgctacttgacttaatagaattataggtctgctagaagtaatgaaaantgaagtttaaaatggatcagctttgagacaccaaaactgcacgtaagtcatgaatctaga

SEQ ID NO: 28362 - DNA, 121 bp, Artificial Sequence
  Synthesized
  misc_feature (61): n=a or g
aaatccagagtaaagtgaaatagttctagttccctggagctgacacattaaaaaattgctntatttgatacattgatacactcttttagtgcctgcagcgtggaacagttttagaaatctg

SEQ ID NO: 28363 - DNA, 121 bp, Artificial Sequence
  Synthesized
  misc_feature (61): n=t or g
ataagaataacttgaaagtattagaggtcatccaaaggaagggctacagagatagtgaatngtctaggtggcaagacatatcaggagcagctaaggccccttggtttgctcagcccagagc

SEQ ID NO: 28364 - DNA, 121 bp, Artificial Sequence
  Synthesized
  misc_feature (61): n=t or g
cagattctaacacataacgctgtaattaacgttatagtaagcaactacaagaggcagtaangaggagagtcctttgttacgttctctcccgaggcaagtggtatgtgcagactgaagctat

SEQ ID NO: 28365 - DNA, 121 bp, Artificial Sequence
  Synthesized
  misc_feature (61): n=t or c
ctgatctaatacctgttaattttctttctgattagggctacggctcaccagagactatttnatatttaatgtagatatggttaaggaggctgatcctctattttagaagaagcaagtggaa

SEQ ID NO: 28366 - DNA, 121 bp, Artificial Sequence
  Synthesized
  misc_feature (61): n=a or c
aagtactgactggaggtcttgtacaccactacagtggcacactgcttactgccttaaaaantacagcgctaagccacaaagattaatggtggcaaacaccaatcaaatgcaagcaatagaa

SEQ ID NO: 28367 - DNA, 121 bp, Artificial Sequence
  Synthesized
  misc_feature (61): n=a or g
ctacctatgcggtaaggagaaaaacctttcaaaagttcaaaaattaatgagctacaggggntgaatttctcaactgttcacccagattcttgaacaggacatgaagcacatgtcctgctaa

SEQ ID NO: 28368 - DNA, 121 bp, Artificial Sequence
  Synthesized
  misc_feature (61): n=t or c
tatcaggacagtcagcccctctgacaactcactcagaattaactgaaaactccctgtatgngtattgaaaggctacacccaaaaatttgacctttgagacagacctctcaaactcccatgc

SEQ ID NO: 28369 - DNA, 121 bp, Artificial Sequence
  Synthesized
  misc_feature (61): n=a or g
gagatgcctgacctaatgccggtaatggataagcgaggcctcggcttgcgaaggaatactncggtgggttaaaataagaataaaacattgcaagcgctgatgtggctgacattacagcggg

SEQ ID NO: 28370 - DNA, 121 bp, Artificial Sequence
  Synthesized
  misc_feature (61): n=t or c
gtgcacaagcagcagcagtcactgctggagcatcacgccaggtgggaccatttgcacacangtgcactcagtgccagcagcgctcgttcagttcaggatagagcagagccccttctgagct

SEQ ID NO: 28371 - DNA, 121 bp, Artificial Sequence
  Synthesized
  misc_feature (61): n=a or g
cccagggtgaggacaatagcctagctgcctgtgagtcaatatgcagtttggtgaaggactnatgtatgactttggcccagctgactgaaaataataatagtaataataataataataataa

SEQ ID NO: 28372 - DNA, 121 bp, Artificial Sequence
  Synthesized
  misc_feature (61): n=t or c
ctcccctggacctgttctaagacccctgcatctttctgacttacaaaatgacttacaagangtctgaagtccctacatacagaaatcattcactttacaccaaaatccaacaaatgcaaaa

SEQ ID NO: 28373 - DNA, 121 bp, Artificial Sequence
  Synthesized
  misc_feature (61): n=a or g
agcagcattttttgcactgttcaacctttaaaataaacgtacagcatgacttgatgaaatncttctgaaaaaaaacttcaacacttacgatccctagcagtcccctgcagtggactcaaag

SEQ ID NO: 28374 - DNA, 121 bp, Artificial Sequence
  Synthesized
  misc_feature (61): n=a or g
gagtgcctggaaccactatttttccccagaatccttcacttacttccttgtgttgggaccnttttctctctgccatcttccatttctcagctgctgccctaactagaggccaaaacccaac

SEQ ID NO: 28375 - DNA, 121 bp, Artificial Sequence
  Synthesized
  misc_feature (61): n=t or c
atcatcactgcaggattctttagactgagaataattcattaagcctgttttataatggcanttaatggcaaaacacagtttggaaatatattttggcttctgcttcttactgtatttggac

SEQ ID NO: 28376 - DNA, 121 bp, Artificial Sequence
  Synthesized
  misc_feature (61): n=t or c
ttcattatcacaaactaacagttctgctttaatccgccctcaggagaaggttctgctcgcnaatgtctcttcattttttctgcttttcaatactatttaggagtacagcatcaacaactct

SEQ ID NO: 28377 - DNA, 121 bp, Artificial Sequence
  Synthesized
  misc_feature (61): n=t or c
cctccaatgcagacagtaatggggaaaaaaagaaaatcacaggcacctccacgatggatanagaggtgctttagtcctccacagaaatatttagatgctttcataccccggtgaccaggca

SEQ ID NO: 28378 - DNA, 121 bp, Artificial Sequence
  Synthesized
  misc_feature (61): n=t or g
caaccagatggaagatcaggcatataaatcagatgacctttggcctatttcagaaaacagngactcaatctatcatacagaactctccagattatttattgggatgtttgtaagttaacaa

SEQ ID NO: 28379 - DNA, 121 bp, Artificial Sequence
  Synthesized
  misc_feature (61): n=c or g
atgaagagtgtctcgatcacctcttctctgcatattgtcagatcagtctgggaactgtgtntggagctaaatatttttttcaatatgttggaagcaatggtgacaatggtggaattttgca

SEQ ID NO: 28380 - DNA, 121 bp, Artificial Sequence
  Synthesized
  misc_feature (61): n=t or c
tttattttattttttattgttaaagggattcatttttttctggggatgtattcatcccccngagcactccataggtcagggcagagaaataatattcaaagattacagagaaaattccctg

SEQ ID NO: 28381 - DNA, 121 bp, Artificial Sequence
  Synthesized
  misc_feature (61): n=t or c
ggctcattttatggtaccctatagaacactgcagagctgcattgagctcctcactgacagnatgcagttcagatcccctccgtgcctttcacaggtcccactgagagctcccaaggagcac

SEQ ID NO: 28382 - DNA, 121 bp, Artificial Sequence
  Synthesized
  misc_feature (61): n=a or g
aaaaaaaaaaaaaagcaaaagggttcccaacagatatgtgaaatgcacatttcccccaaantccaaagattttctcctggacagttttacatcagtaagacccaccccgctccgaagacag

SEQ ID NO: 28383 - DNA, 121 bp, Artificial Sequence
  Synthesized
  misc_feature (61): n=a or c
actgttccttattagatctggtttgctttgtgtgcgaacaatcacagttacttctgtttgnggagtttcagtgcaaatatttattaccctatctaattttttacagctagtaagttttgta

SEQ ID NO: 28384 - DNA, 121 bp, Artificial Sequence
  Synthesized
  misc_feature (61): n=a or c
catgagcatctcacaccccttgacacttctcccatgtgtgcttgcaggaaagagacatgancagacctcctaagttcttgactttctagcactgcctgcaggcacttcataaaacaaatct

SEQ ID NO: 28385 - DNA, 121 bp, Artificial Sequence
  Synthesized
  misc_feature (61): n=t or c
agagcatgaatttggaaaatatttttgcttcaaataacagctggtgggaattcactgcatnttagattctcctgtcaaatgcaaagaagcattatttaaacatggagaaataatatgcggt

SEQ ID NO: 28386 - DNA, 121 bp, Artificial Sequence
  Synthesized
  misc_feature (61): n=t or c
aagttaacttggacactgagatccatgcctgtatcttaaggtaacatggtatcactctgangttacatttttattactcatcagtttcaagaagttacagttaaatgcaaccttaccatgc

SEQ ID NO: 28387 - DNA, 121 bp, Artificial Sequence
  Synthesized
  misc_feature (61): n=a or g
cagggatccggtggaggggctcattgaggaaaacacattttcaagcatcaggttatggcanggtgaacaaggaaggagcacacaggagctgggagcatccgtgtgtctgagatggaggtgg

SEQ ID NO: 28388 - DNA, 121 bp, Artificial Sequence
  Synthesized
  misc_feature (61): n=a or g
ctctctgctttcagacagtgggagagaaaattttcagccaaacgtgattcgaatttcacanttacgatgactctttaacaggatgtgtaattccagaatccaggacacaaactgtggggag

SEQ ID NO: 28389 - DNA, 121 bp, Artificial Sequence
  Synthesized
  misc_feature (61): n=t or c
aaacagaattttaaaagtctatcttgctggagccttttcagtatgctttctctttgattgngattatgagccccctggagtaggacctctctggtccatcagccagacacattgcacaaaa

SEQ ID NO: 28390 - DNA, 121 bp, Artificial Sequence
  Synthesized
  misc_feature (61): n=a or g
gcatataactacactcactcttagcttgcagggcacttgtattaatgaggtattttccctntcagaaaaggattaggcagtaacagggtgggagggatttgaaagggaaaatgatctgttc

SEQ ID NO: 28391 - DNA, 121 bp, Artificial Sequence
  Synthesized
  misc_feature (61): n=t or g
ccaggtctgcctagttaaattttgcgttgatacattcttaatgtgagatccttaaaggaanaaaaatttatcttcggtgatctgtcaggttcaatttatttgtggtaaaaatatatttgac

SEQ ID NO: 28392 - DNA, 121 bp, Artificial Sequence
  Synthesized
  misc_feature (61): n=a or g
gaggaaacaaaaaacattcctaacagttaatatgaaggttgatgcagtgatccctctttgnaggagtactttatttctaccccgtatttttgcattaaaaaaagtcagtagaataactgaa

SEQ ID NO: 28393 - DNA, 121 bp, Artificial Sequence
  Synthesized
  misc_feature (61): n=t or c
ggattgccaagtgtctggcagctctggatccctgcagggatcaccttgcagatcagaatgncatgcagtgatgtggagcagtgcatggcctctgtagcatcgtgtccctgaggggtcaggg

SEQ ID NO: 28394 - DNA, 121 bp, Artificial Sequence
  Synthesized
  misc_feature (61): n=a or g
catgtaaaagggggataagaagaacagggaaaaggcatttgtgagacaattgccctactcnacattttctagatgtgcttatatcagtttcatttatttataccttcgctggagctcagca

SEQ ID NO: 28395 - DNA, 121 bp, Artificial Sequence
  Synthesized
  misc_feature (61): n=t or c
catttaaatcaacatttaaaggatgacctggctaaactttttaatatgaaaaccaacgcantccactaagagcagtgtttccgtaatgatcagttcactcaagttctggtcttcaggcaaa

SEQ ID NO: 28396 - DNA, 121 bp, Artificial Sequence
  Synthesized
  misc_feature (61): n=a or g
tgcatccgccctcatccactttccttcaagagattcacaatgtaaaatatacagcttggtncaattactgatgctctccaaaaaaccctccttcgctaccatcagccaccaccaatattct

SEQ ID NO: 28397 - DNA, 121 bp, Artificial Sequence
  Synthesized
  misc_feature (61): n=a or g
gcagaactgtctcctcttataaggttgctttctcccattttgctttccaagtatacaaccncacccgacaccttaatcatcagcgactgatggtggagaatgtgaacgtgcccacactcct

SEQ ID NO: 28398 - DNA, 121 bp, Artificial Sequence
  Synthesized
  misc_feature (61): n=t or c
tgttaccctcttcttcctcatttcaactccacatgaaattccctcagtgccttggctttcngttaaagtgggtggtcatttcagtactttttcttttgccacgttagcccagatgctggtg

SEQ ID NO: 28399 - DNA, 121 bp, Artificial Sequence
  Synthesized
  misc_feature (61): n=a or g
attttaaaaccatgaaagctgtctacaactctgttgaatgagtggcttctcagcctaagtnaacacaacaaacatgggtgaccccaagaggctgaccaagcccatgatggggcagacagag

SEQ ID NO: 28400 - DNA, 121 bp, Artificial Sequence
  Synthesized
  misc_feature (61): n=c or g
tgctttttgtcagttataataccatttatgaactattaaaacaaatcagagtttcattatnttcagatgaagtgattttagatcacagcagttagtacaggtgcactaaaaggagagatac

SEQ ID NO: 28401 - DNA, 121 bp, Artificial Sequence
  Synthesized
  misc_feature (61): n=a or g
aggcctttggaaagtgtggatgaataagttcatgtagctgtccttcaccccgaatgcagcnacgattacaaaaaagcacccagagcagttagtcttgaggccagcagaaaaagatgcaata

SEQ ID NO: 28402 - DNA, 121 bp, Artificial Sequence
  Synthesized
  misc_feature (61): n=a or g
actatcttgtctgctggtccctttgctgttccattcttgtattgcccttctactgtgtcantatctctgattgtgactgcttcatgcagtttgctcatggctcaaattccttgtgcttgca

SEQ ID NO: 28403 - DNA, 121 bp, Artificial Sequence
  Synthesized
  misc_feature (61): n=a or t
caatggggtggatggatgagtaagcatgttccgcttatatgagcacagatggtggggacangtaaatttcaggaaggtgaatatttggtgaggtggaagagtatttcaacacaccgtgcac

SEQ ID NO: 28404 - DNA, 121 bp, Artificial Sequence
  Synthesized
  misc_feature (61): n=a or g
aggctacaaattgactgctgtgacttctacttacccataggctgctaatcccctgctattncatggtgccatgaggatcaggcagacctgaggcctccccagaaagctgtccgggaacacc

SEQ ID NO: 28405 - DNA, 121 bp, Artificial Sequence
  Synthesized
  misc_feature (61): n=t or g
ctctaaatggtgagcaatgcaagaataaaaataaaacataagtgggtataaagcctgaaanatcttcaacaagtttcaaatatccagataaagggaaaaaactacataggaagggaagaca

SEQ ID NO: 28406 - DNA, 121 bp, Artificial Sequence
  Synthesized
  misc_feature (61): n=t or c
tttgtgtatgaacacacaggctccaccaagctctggaaatatgttaggagttgataaatgncatctcgattgtttgaagaaggagagcagagttgctggatgacagtgcataaagtgcaaa

SEQ ID NO: 28407 - DNA, 121 bp, Artificial Sequence
  Synthesized
  misc_feature (61): n=t or c
gtcagtgcagaaaggaaatttcagagttcgatgtattttacatgaaaccagacagctttgntgtagtcagtagtagctcatttcaagattgtttcttcagacaaaggaacaccctttgtta

SEQ ID NO: 28408 - DNA, 121 bp, Artificial Sequence
  Synthesized
  misc_feature (61): n=a or g
cacccagaagcagcacctccttcagcacgagaagatccacctgcgagagaggaactgcgcngccaggaatcatacaagggaggcaccgctatagggcttctaggttgtgcagggctcacgt

SEQ ID NO: 28409 - DNA, 121 bp, Artificial Sequence
  Synthesized
  misc_feature (61): n=t or c
tcaatcagcatattttccatgcagtgtgagacaggaaaattcctgtccaggtggaaattcntctcactctcctgattgattttaattaagcaattcctgcttgtatatttctatagatttt

SEQ ID NO: 28410 - DNA, 121 bp, Artificial Sequence
  Synthesized
  misc_feature (61): n=a or g
ctctttaaaacggttcattctcaactatgatctgcatttctccagaaaaaccacaatgcanaaaaaatgaggagtaggctttacttctgttgtctaatctatcagaagttctgcttattac

SEQ ID NO: 28411 - DNA, 121 bp, Artificial Sequence
  Synthesized
  misc_feature (61): n=a or g
acttctggaagtcaagctgcagtcaaactttgcatgcctgcaacttttaggtgaaagctgnttaacaaaaagcataaaatgcagtctgtcactttcccctgaagttgttgttgttgtggat

SEQ ID NO: 28412 - DNA, 121 bp, Artificial Sequence
  Synthesized
  misc_feature (61): n=a or g
ctgatcaataacaaaccatgtagttaaacagaggaacaataatagtcttaatttttctgcntattaccctcatagtagttgttcagaggaaatacacttgcttctccatcaaaattcctga

SEQ ID NO: 28413 - DNA, 121 bp, Artificial Sequence
  Synthesized
  misc_feature (61): n=t or c
gaaacttaatatattgagacgatgtgaatgggaagctgattggaatgctaaggaatgtccnagcatcgcattgctttgctgtctgcagatatgcagtaggggttgattaatttagcacatc

SEQ ID NO: 28414 - DNA, 121 bp, Artificial Sequence
  Synthesized
  misc_feature (61): n=t or g
ctgttgtttaaacgggaactttcccaaaaagcaataacaaaataggtgaaatgggacaagnagcagaaagcaaggtataatgtcctgagctgcagggtcagatctcatgattctcagcaca

SEQ ID NO: 28415 - DNA, 121 bp, Artificial Sequence
  Synthesized
  misc_feature (61): n=t or c
tttgggatgggcaccctggtcgctgtgctgagcctgcagctcacctggaggacgctttggntgcatctattgacttagcagtttctcgaatggctcttctccaggtttactctgaatttga

SEQ ID NO: 28416 - DNA, 121 bp, Artificial Sequence
  Synthesized
  misc_feature (61): n=a or g
gaagcaacttgatcagcagaaggcaggtcttcaaattgtatataaggagagatttccaccnacagttctgctctccacattcataatccccacgtgctgtcacattcacaagtatattata

SEQ ID NO: 28417 - DNA, 121 bp, Artificial Sequence
  Synthesized
  misc_feature (61): n=a or g
tttagagctggaaaaggtcatttgaatttgatttaaaatgaatttcccgcagatgatgggnaaagctagaagagtcataagaacagtaaaatacaatattaatttgttctagaagcagggt

SEQ ID NO: 28418 - DNA, 121 bp, Artificial Sequence
  Synthesized
  misc_feature (61): n=a or g
cagatatacaaaatgactctaaatgaactgtgcttttgaagctgtgttagaataaactctncatttattttcatcaacgctgcagacttgtctcattatccagattcatatttgttttcca

SEQ ID NO: 28419 - DNA, 121 bp, Artificial Sequence
  Synthesized
  misc_feature (61): n=a or g
gatacaaaacagtctattacatataacctgtggtcccctaggaagtctgttggaggctgcntaaaatactgaaggacatctacagtgacatcaggggcctgaacggagccctgtcttttcc

SEQ ID NO: 28420 - DNA, 121 bp, Artificial Sequence
  Synthesized
  misc_feature (61): n=t or c
agtcaatgcaaccactgctcttttttattcacaagctcttgttttcaaatagagcactttngggaatgagtgttttacttgaattaattgcttttcctgtttggggaaaaacaaacaaaca

SEQ ID NO: 28421 - DNA, 121 bp, Artificial Sequence
  Synthesized
  misc_feature (61): n=t or c
gctccaagaggttttgttccatgacctgcgctaaaaggtaatagcaagatatttcctttgnttgtgagtataaattctctggaattgggcatttgccttttttccaggtagtgtacagtat

SEQ ID NO: 28422 - DNA, 121 bp, Artificial Sequence
  Synthesized
  misc_feature (61): n=a or t
aagagctctttgaaatgaataatcatatctaagattcttgttacactgagaaggcagagcnttgtcttacgcaggccttttcagcagaggctttctgttatagttaattgcacaaattcac

SEQ ID NO: 28423 - DNA, 121 bp, Artificial Sequence
  Synthesized
  misc_feature (61): n=a or g
aaatactgaagtctgaaagcacgtgttccgtgatcactcttgaacaaaagatgtatgcaantgagtggacagttgatcagatataaactgcagatttctgcagagtaacagtgtgtcccat

SEQ ID NO: 28424 - DNA, 121 bp, Artificial Sequence
  Synthesized
  misc_feature (61): n=t or g
caaaaatccattgtataatagtgaaaatcattatttatagtgacttgaggttttttgttgntggtggtggtgttacttcattttctagaaatgccatttagtaatgccatgtctttttttt

SEQ ID NO: 28425 - DNA, 121 bp, Artificial Sequence
  Synthesized
  misc_feature (61): n=a or c
tgtgtgggctctagccagcttcgtttccagtctgcttccaggaaagagaggagcaaaaaantctcttgcatttactactttttctgagggccaaggagtggtttgaaatagtggtctggct

SEQ ID NO: 28426 - DNA, 121 bp, Artificial Sequence
  Synthesized
  misc_feature (61): n=a or g
ggtcactgctcccaggctaatattggtggccacgtttgccacttgttcttccctgtttatnctcataggttgactattgaccttgcttggtctctttagcagctgtattgaaaagttatca

SEQ ID NO: 28427 - DNA, 121 bp, Artificial Sequence
  Synthesized
  misc_feature (61): n=t or c
atttcacttatgttcatgtaatggatacattcccaaagagcagaaatattaaaagttccanttaatttattttttgtattattttacttcctataaggaaatgaagctctattttctctgg

SEQ ID NO: 28428 - DNA, 121 bp, Artificial Sequence
  Synthesized
  misc_feature (61): n=t or c
cgatggctgaaggcagggaggaaagcaggccatggaacgaaggcaaccagcagtgcagctntggactaaatccttcaggtgtgtctttagcaagaagagcatcgaggagtgtgtctgccag

SEQ ID NO: 28429 - DNA, 121 bp, Artificial Sequence
  Synthesized
  misc_feature (61): n=a or g
atttcagctgaacttgaacatccagcactgaaccccctgttgggaaagaccacttaaaagnaccctgactgaaagtgcaccagtaaaggcaaggaaactgctgatacagctggaaacttgg

SEQ ID NO: 28430 - DNA, 121 bp, Artificial Sequence
  Synthesized
  misc_feature (61): n=t or c
ccccagctatgcctttggaaaagaaaatacctgcaagctgttcctcctattttgtgataanctgatattaattacaggctagtgacagtgaggaaactactggtcttctatatacattgct

SEQ ID NO: 28431 - DNA, 121 bp, Artificial Sequence
  Synthesized
  misc_feature (61): n=t or g
tgcccacgtttcaaggggacaaggtggacctgcaggcagggcaggcaatttgggacaaatnacagcaacagtggggaagttcagcagcaagcaggtcaatgggacatgcaggttgggtgga

SEQ ID NO: 28432 - DNA, 121 bp, Artificial Sequence
  Synthesized
  misc_feature (61): n=a or g
ttttctctgtgccatttgattttttgcaatctatgttttaaaagaaagctgaaggagtttntttttagggtttctcagctgctgccagctcatgatagaggaggtacggtaccttcagttc

SEQ ID NO: 28433 - DNA, 121 bp, Artificial Sequence
  Synthesized
  misc_feature (61): n=a or g
taattttcctagttgctaaaattaacatttcttttagctcactttataaataaagtcttcngtttctaaactatttctgcaatgtttaccaaacaatatcttagtgtcttggccaatgttt

SEQ ID NO: 28434 - DNA, 121 bp, Artificial Sequence
  Synthesized
  misc_feature (61): n=t or g
gaaaaagcatattgagaacactgttgtaggacagtggatgtgaatgagcatatgaaagaanggtgagaaatgcaatgtggtctatcttcaagccaacagcagtaacactgattggaatgtc

SEQ ID NO: 28435 - DNA, 121 bp, Artificial Sequence
  Synthesized
  misc_feature (61): n=a or g
attaagttcaactcctagctctgtacagaccaagaatcaggccatgggtttaagagtgttntccagacgcttcttgaacttgttgactcaagctgtccctccacagcatgaaataaaatat

SEQ ID NO: 28436 - DNA, 121 bp, Artificial Sequence
  Synthesized
  misc_feature (61): n=c or g
aactcctgtcgggaaggaaaacaacagttctttgataaaggaaatagaagaagaatgcttnaaccaatttctcagggttaacagactgtatctgtgaaacaaagatttatgtgaatcttag

SEQ ID NO: 28437 - DNA, 121 bp, Artificial Sequence
  Synthesized
  misc_feature (61): n=t or c
tatcactgcccctcggtgctttcagccctactcaacactctggcacatccttcagccgtgngtactgcacagccaccacgttctattgactttctgcatgtttcacacagcacacagttaa

SEQ ID NO: 28438 - DNA, 121 bp, Artificial Sequence
  Synthesized
  misc_feature (61): n=t or c
aacatactggcaagtttatgtaaaatatcttactctaggcttagaggtatcaactcttacnctgaagtaactttgatgccacagcaaacatgcatgctgtaaattcagatggttcattatt

SEQ ID NO: 28439 - DNA, 121 bp, Artificial Sequence
  Synthesized
  misc_feature (61): n=t or g
tacctaagaaaccatgttcctcttggttttcttcatgggctgttgcccatctgtgtatatntaaagatgttcagaaacactgcttgtaccacaatgcttttttctgttaaactattagtag

SEQ ID NO: 28440 - DNA, 121 bp, Artificial Sequence
  Synthesized
  misc_feature (61): n=t or c
attttagaggcacatttgaaaagtctgcccagtcttggatgctcttttctgcccaggcagngacagcagagccctggcatggtgctactgaagaactttttttgccttctgtcctgggatc

SEQ ID NO: 28441 - DNA, 121 bp, Artificial Sequence
  Synthesized
  misc_feature (61): n=a or c
atactgctgctgtgtcccagctaataacattcagacacacggaccccagaatctgcctttngatgttggtgtgtgtcagtgagtgggtcgtgtgaaaggggcatgcattggcttctaactc

SEQ ID NO: 28442 - DNA, 121 bp, Artificial Sequence
  Synthesized
  misc_feature (61): n=c or g
tatctaactcctctgaccactcttgctcatctaattgaaataaagtctacctccagcaacnagccttgtacctctcaaaatttagtctttcaggttcggttccatttacccactccagtca

SEQ ID NO: 28443 - DNA, 121 bp, Artificial Sequence
  Synthesized
  misc_feature (61): n=t or c
atgttgggaaacaagatggtgtgtgaccgagggtcaaagctgtgatgatttcacctttctntgtgatcagttgtgcaaaccttaccagctgcagagtgattcattactgggtcctaagcta

SEQ ID NO: 28444 - DNA, 121 bp, Artificial Sequence
  Synthesized
  misc_feature (61): n=a or g
tagaggaaatactttttggcctgttaagaaaaggaatgcaatcaacctgagtctgtacgtnaagacgtagttatttaatttacagaatagtttgtaattgagagtcctttttagaaatgca

SEQ ID NO: 28445 - DNA, 121 bp, Artificial Sequence
  Synthesized
  misc_feature (61): n=t or c
agtggggcaagccaaggtcatccccggctgtgtgcaggaccctgcttctgctggaggggtntggagaggagggaggtgagatttggtttatgcaggattgctgcagttgtgagacatggta

SEQ ID NO: 28446 - DNA, 121 bp, Artificial Sequence
  Synthesized
  misc_feature (61): n=t or c
agcacagtcatgcacagaactagaaatgaaatgctctcctggacctcacagcactctctcnacactattcattgcacatctactgcttatgcccatgcacagaaatacatcagtgctactt

SEQ ID NO: 28447 - DNA, 121 bp, Artificial Sequence
  Synthesized
  misc_feature (61): n=a or g
gcactgagagtaacggaccagacattaagaaagtctctaagcatggtactatatggtaacntagggttacttgtctgttcccttatctgggatctttgtcatacgtggttccccagatata

SEQ ID NO: 28448 - DNA, 121 bp, Artificial Sequence
  Synthesized
  misc_feature (61): n=c or g
agcctccactggtgcaacaacacgaggccattgcctctaacagcctcccaaggaagggttncagcacagctgtgcattcacttggctgggcacatgcattaaattcatgcttcagcgcaga

SEQ ID NO: 28449 - DNA, 121 bp, Artificial Sequence
  Synthesized
  misc_feature (61): n=a or g
aatgtatcctaaaacttaagttctcttctctcctttgttctcctcaccctggagattactntttaaaaagatcacttcagaagtgctttagctactggacatgccagaaaggtggggagga

SEQ ID NO: 28450 - DNA, 121 bp, Artificial Sequence
  Synthesized
  misc_feature (61): n=t or c
tgaagagatttccacaacctcttgtgaggttagtattaggggagtcactattagtgtttgntccttgttgcccctcaagcacacagatgctagacagagttgtgtctttgcttgtatattt

SEQ ID NO: 28451 - DNA, 121 bp, Artificial Sequence
  Synthesized
  misc_feature (61): n=a or g
tgatgccaaaaaaagcctgcttgctcaagcctctgtagaaaatacatgcaaaatggacagnaaatgaatactgaaatcaaaattgcacagaaatattttacagtgttcgtttagctcttaa

SEQ ID NO: 28452 - DNA, 121 bp, Artificial Sequence
  Synthesized
  misc_feature (61): n=t or c
tacatggggttaccacacaaacatcagcttctttctgattctgcagactttgagccattcncactgaaatgtccttgtgttctgtgtgctggctgttgtttatcactcaaaaatgttcatt

SEQ ID NO: 28453 - DNA, 121 bp, Artificial Sequence
  Synthesized
  misc_feature (61): n=a or g
gatctctgtaacaaattatgtttatcaaggatttctaaactgtagagaaggcaggatgagnaaaattagaagggcaacattcaaaatatagcagaatgggaattctacatactctccgtta

SEQ ID NO: 28454 - DNA, 121 bp, Artificial Sequence
  Synthesized
  misc_feature (61): n=a or g
ctccctcttcaaccaaggagttgagctggctcacagagagctcagtcaaacaccagatccngcacgggatgggaagtggaaatcacccagagtgaaagtgtggagagagcctatcctggga

SEQ ID NO: 28455 - DNA, 121 bp, Artificial Sequence
  Synthesized
  misc_feature (61): n=t or c
atattagtcatagtcatattcattaaaaataaaaagacagcaagagatttatgataatagngttccaattaagcctcagccactgctattcactgaactaagacagcagatatccctggga

SEQ ID NO: 28456 - DNA, 121 bp, Artificial Sequence
  Synthesized
  misc_feature (61): n=t or g
aagacaatagaatctcgagtcacctgttccacttggaagaacaagcaacatgtgtgtacanatcagttccaagcttctcagtaccattccttcaatcactaagagctacaaggtctgccac

SEQ ID NO: 28457 - DNA, 121 bp, Artificial Sequence
  Synthesized
  misc_feature (61): n=a or g
gttcaaggaacaatttcctactgctgcttttcatcactgtgatgcgttgggacctctgacntaattttccggaatcccagaaaccaccaacaatcgtcacgataggcaaaaagacaaacag

SEQ ID NO: 28458 - DNA, 121 bp, Artificial Sequence
  Synthesized
  misc_feature (61): n=a or t
acctggatgtctttgggaggaggactgaggcttgcagaaagcacttggttccagatgtganctatacaaaagcagcagtgacaatagctgagacgtgtgcatggaagtgccagatactgtg

SEQ ID NO: 28459 - DNA, 121 bp, Artificial Sequence
  Synthesized
  misc_feature (61): n=t or g
taggcataaattggtattaacttgccacggcatttttagacctatgtcaattcttgtcccngattggatatattagaggaaataagatgctttataacttaggtgcagtcagatcccatgg

SEQ ID NO: 28460 - DNA, 121 bp, Artificial Sequence
  Synthesized
  misc_feature (61): n=t or c
gttaataaggatataattagtgagtaacagggagttaaatggttctaaattgtgaatgcangtactttcactgagaaataagaaagtaaatgtttacctacatcatgtaacctattgcaga

SEQ ID NO: 28461 - DNA, 121 bp, Artificial Sequence
  Synthesized
  misc_feature (61): n=a or g
gctgcagtttctgccattccctaagcctgagctcctttcagcagtgcagctacctccatcnctgataaatctctatctgtgtgcacctatttgctttgtccctctgacatgcagtacttac

SEQ ID NO: 28462 - DNA, 121 bp, Artificial Sequence
  Synthesized
  misc_feature (61): n=a or g
tgcaagaaatggagcactaatgatgactgggcaggttacccaggcggtagatgaagccagnggtttctgtaaggatgaggccatggtgggaagttccagccagttctgcctggagcattgg

SEQ ID NO: 28463 - DNA, 121 bp, Artificial Sequence
  Synthesized
  misc_feature (61): n=a or g
aaatgagccaaagtgagtgaattaggaaaacatctgaactacgctgtggggactgacctcngctgaactgtgaagctcaaagcacaggtatagtcctgaacatgcagagccatgcaattgg

SEQ ID NO: 28464 - DNA, 121 bp, Artificial Sequence
  Synthesized
  misc_feature (61): n=t or c
acaggtgaactacaaagactgactcaattcctattctcaaccactaacttgagaaaaaagngcaagcaagtaagctacaaagtacaagcaaagtaagatcatcacaaacatcccatgcatt

SEQ ID NO: 28465 - DNA, 121 bp, Artificial Sequence
  Synthesized
  misc_feature (61): n=t or g
gcacaaccagggccaaattctttgcgcgcacatccctgcagattagagaagaggtcagtgngttcagcaccctgctggcaggaccagagcatctcgtctgtcccagggtgtccggggacaa

SEQ ID NO: 28466 - DNA, 121 bp, Artificial Sequence
  Synthesized
  misc_feature (61): n=a or g
gtttgtgggaaccaaaggtacaggcccagcaatcaattccctttagatatcttcatttgcnaatattgtgctgaggaggtggatttggtgggattgcatggagtgcaagaacgggcagcag

SEQ ID NO: 28467 - DNA, 121 bp, Artificial Sequence
  Synthesized
  misc_feature (61): n=t or c
taagatgcttggttatttaaaaacagctgatgctgtctgctctgcctcttattcctgctgnatcttaaatcaaggtgcagatcctacaacttagcactcatggatttctactctagaagtg

SEQ ID NO: 28468 - DNA, 121 bp, Artificial Sequence
  Synthesized
  misc_feature (61): n=t or c
gatgactaattgcaggcatctaacctagagaaggaggattcagctctctgtagacaccacnagttgcatttcacttttttgtggtgtcacatatagctttgtgctgtagaaaaaaaagcag

SEQ ID NO: 28469 - DNA, 121 bp, Artificial Sequence
  Synthesized
  misc_feature (61): n=a or g
catttttactatcaaatatgagcaaaaggattgcttatatccccgaggagaagttatctgnctgcatctatcttattactatcaggctagcagtttggtttagaaaaaccccgaatcaggc

SEQ ID NO: 28470 - DNA, 121 bp, Artificial Sequence
  Synthesized
  misc_feature (61): n=a or g
actgtctctctgaggggctcacagactgctgaatgtctctgagcacacaaggttttctcantgtcttacgagctggcttagttgtttaatgattttatatacatatacaaatttttccttc

SEQ ID NO: 28471 - DNA, 121 bp, Artificial Sequence
  Synthesized
  misc_feature (61): n=a or g
gtgacactgtatgaaaacattacaatttgaaatgaaaggcagcctttccaggtggctttcnctgtgcttttgcaaatgtaatctgatcacatatttagaatagctattttcagttgagacc

SEQ ID NO: 28472 - DNA, 121 bp, Artificial Sequence
  Synthesized
  misc_feature (61): n=t or c
gctaaaacctttgcaactgaaggaccccgggtgacagaccttctctttagctgtgctctcngggactgtgctcttctgttgctctgatttgagccatgatgactgaatccagaaatcatcc

SEQ ID NO: 28473 - DNA, 121 bp, Artificial Sequence
  Synthesized
  misc_feature (61): n=t or c
tgccaatgaggtctggatcctgtgagcacagtgcatatgccagtgatattttgctctttcngatgggacatggttcccatgccgtggaatcttttctcagggaatgcactaaaaatgctgt

SEQ ID NO: 28474 - DNA, 121 bp, Artificial Sequence
  Synthesized
  misc_feature (61): n=a or g
atctgaagtgatcttcaaactgacatcatcttacttaggccatagtactttaaggaatgcngacagctgctctaaactacctttgtatcattccaaagaaaatgtagtagacattaaggga

SEQ ID NO: 28475 - DNA, 121 bp, Artificial Sequence
  Synthesized
  misc_feature (61): n=c or g
cccaaccaatgaagaaactgaaaagatgaatggtgttaaaaaatatatggcagtgatactnagtgacatggaacatattagtggtagtgtgggaaaattaattccaatttattgacaattt

SEQ ID NO: 28476 - DNA, 121 bp, Artificial Sequence
  Synthesized
  misc_feature (61): n=a or g
aaacccctgatgtaattccctaaagctataaaggattaatatgtaaaggagcctgatactncttacacagaaattggaacactggcagtttatgctacagacaccctagagacagcaatat

SEQ ID NO: 28477 - DNA, 121 bp, Artificial Sequence
  Synthesized
  misc_feature (61): n=t or c
ggaaatcagatggatgccttatgctggcagtcgtcaacaggttcctactgaaataccccangaaggagctttctaatgggagctgggtgtgctcacgggctgggtagtggttggaaaggtt

SEQ ID NO: 28478 - DNA, 121 bp, Artificial Sequence
  Synthesized
  misc_feature (61): n=a or t
cctgaggaggatgatattttcatccagctaggaaaaatccccattgacattcaagagaaangaagaactgaacacccttgtaccctttgcaagtccaagatcttgaagcaaaactggaaag

SEQ ID NO: 28479 - DNA, 121 bp, Artificial Sequence
  Synthesized
  misc_feature (61): n=t or g
tttgaaatatggattcttttacatgcaggcatcacctattacaggatgggaatatcagttnatgagcactttctgaatcattaaaaatacttatactgggatacccagagctttaaatcat

SEQ ID NO: 28480 - DNA, 121 bp, Artificial Sequence
  Synthesized
  misc_feature (61): n=a or c
aataaataaataaacacataaataaataataaaaaaatcctcacatagctgggatgtaggnctgccagtacctgtgatcacatctgtattctttcttttgcaaaacaggactttcgttctc

SEQ ID NO: 28481 - DNA, 121 bp, Artificial Sequence
  Synthesized
  misc_feature (61): n=t or c
tctgtgacataatgatttacttttagatctacaagtcctacaaatctgacttcaaagtgtntcacagattttcaaatgtaatctcgtctcaaacatcgaagattacttcaactgaagaaaa

SEQ ID NO: 28482 - DNA, 121 bp, Artificial Sequence
  Synthesized
  misc_feature (61): n=a or t
gtccacacaccccttggatcgctttaccatagacttaaacagaacatgtggatgagattantcctttgttaaataccggtatcacatcactatatcatagcccacaaaactttgtgtatta

SEQ ID NO: 28483 - DNA, 121 bp, Artificial Sequence
  Synthesized
  misc_feature (61): n=t or c
tctgtgcccgtgatgtcactgtgtctcttctccagagacagaaagagaagaacataacttnctccatagtaaggaaggccaattatggaacatctatgcagatcacttctcaaaagagggg

SEQ ID NO: 28484 - DNA, 121 bp, Artificial Sequence
  Synthesized
  misc_feature (61): n=t or c
aagagaaagcaaaacgtcctcagtcagcagcagcaggggacaacttcataaccaggcctcnagcaaagcccataccaaggcaagaacccacgcctctaagccctttggagaagggactccc

SEQ ID NO: 28485 - DNA, 121 bp, Artificial Sequence
  Synthesized
  misc_feature (61): n=a or g
aggtaatcacacctgccttcccaaaaaacacgatggcaagtagcagttcaaatctgctccngtagcaaggctatctccaacatataggggaaaaaaaaagatatagatgtgctgatagaaa

SEQ ID NO: 28486 - DNA, 121 bp, Artificial Sequence
  Synthesized
  misc_feature (61): n=t or c
ttgttcagatcatatttgtgacattgcgcaggtaatggagagtcacagtgttctgggtganttgtcttttcattttatgctagatgtagctcggaagcttaaggaaagcagtgctgcctat

SEQ ID NO: 28487 - DNA, 121 bp, Artificial Sequence
  Synthesized
  misc_feature (61): n=a or c
tacacatattagacatatacatatgtatggataagattgacacctacaaagaactgtatcnacttttgtaatctccaaaaaaacagacaggtaaatctgggctaccgtacacctaatcatt

SEQ ID NO: 28488 - DNA, 121 bp, Artificial Sequence
  Synthesized
  misc_feature (61): n=a or t
acttcagtcattacactgtaggtatggtgtgcataagtgttacaaatttaagtactttggngagctttatagagatcaccctctaatcccaaaatctgcattaagctattacgtaggtttc

SEQ ID NO: 28489 - DNA, 121 bp, Artificial Sequence
  Synthesized
  misc_feature (61): n=t or c
tgaaactcacgctgtgaggggacataagttcattccctttggcttctttcccttctcctgngtggaatttttagggaagggggtcccagtaaaaacaagtaaggagtcccaaatactcagg

SEQ ID NO: 28490 - DNA, 121 bp, Artificial Sequence
  Synthesized
  misc_feature (61): n=t or c
gcttttgaagcctgtaatagctggaatttaagagtggtcacaagccagcctcaagttgtanatgagtgcaactaatagcatgttgtatagttccaaaccttcaaacaatcacaacagttga

SEQ ID NO: 28491 - DNA, 121 bp, Artificial Sequence
  Synthesized
  misc_feature (61): n=a or g
agatggaattctgcagtggagggggttacagtgctttgcaaccctacagttgcctgctaanttcatacaatccagttcttaatagaagtagccaaggtctcactctcttttttgtctccaa

SEQ ID NO: 28492 - DNA, 121 bp, Artificial Sequence
  Synthesized
  misc_feature (61): n=t or c
acgtgactgttgaatcaacagtgtgggttagtgagtgcggcatgccagggcagtttgaacncatgtcaagagatgctggtgcagtcaggaaggtggccttggagaggattactgatgcact

SEQ ID NO: 28493 - DNA, 121 bp, Artificial Sequence
  Synthesized
  misc_feature (61): n=a or g
ttttaaatagatctgactactgagtttttacaatcttcagtaactagaaatgctccattanctaattgctcagtgacagtgacctttctgggtttgtccacgtgacaaccacattaatgcc

SEQ ID NO: 28494 - DNA, 121 bp, Artificial Sequence
  Synthesized
  misc_feature (61): n=c or g
gattgatgggctaggtttaatgtaacttatttgttcttacatgctttaggttctagagaanaggaaactataacagggctgttttctaaggatgtcatccttccttgtcctttttcacctg

SEQ ID NO: 28495 - DNA, 121 bp, Artificial Sequence
  Synthesized
  misc_feature (61): n=t or g
atgtgcagggatttctgcttctcatttgcctgagactaatatacactgctagcagctctgnctcttaatcatgctgctgtcagatgttaagctgctgaaggctgattatttcaagttacaa

SEQ ID NO: 28496 - DNA, 121 bp, Artificial Sequence
  Synthesized
  misc_feature (61): n=t or c
ttttagaggtgttggtatgttggacttcactaaggttgcttcttatgggaatttcagtgcncttgcacctattctgtaaagagatgtgcgtagagggaatgaaagcactggcaaagggatt

SEQ ID NO: 28497 - DNA, 121 bp, Artificial Sequence
  Synthesized
  misc_feature (61): n=a or g
cagatgaaaattttaaagcaggagggtagaaggtgtggaaagattctactctcttcttccnaattctgtccttccaatctagatgtaaagtgagatataaaatgcaagaataaaatagttc

SEQ ID NO: 28498 - DNA, 121 bp, Artificial Sequence
  Synthesized
  misc_feature (61): n=a or g
gaaaagagtgactgaaaccttgtttttgtgtcacaggcactcatgaaatgcagtatacacnttgctgttgcattatagctccaggtatctgtagatttcctcccaatgcaaaaatttatgt

SEQ ID NO: 28499 - DNA, 121 bp, Artificial Sequence
  Synthesized
  misc_feature (61): n=t or c
taaaatcccgggtacccctcggcctgtaaaaccccccagcttcgggtattttttctcaagngcagttccatctttattttaatagcggattaataatgccggcacagtgttgtgttataca

SEQ ID NO: 28500 - DNA, 121 bp, Artificial Sequence
  Synthesized
  misc_feature (61): n=a or g
tctcagtgccagtaccaactgtaactagagttaaattttccctaccattgcctctgcttgnttctcactttttaaaaagccttagtaaaataaatcgtgccctgcatgcctttaaatttca

SEQ ID NO: 28501 - DNA, 121 bp, Artificial Sequence
  Synthesized
  misc_feature (61): n=t or c
tggtgcatggtgtaaaacacgcagaacagtaacctcgagtacctcactgcaccttcatgcnctcccacagcatcatttattgctgttttatgtcagatcactttattatttttttttactg

SEQ ID NO: 28502 - DNA, 121 bp, Artificial Sequence
  Synthesized
  misc_feature (61): n=t or c
ctccccctcctgcaatactgagcagtctgaactcagtaaattgattacaaatcaatgctgnctgatacataaacttcctagctcccaatccctacttcagaggtagcagagccaacttttg

SEQ ID NO: 28503 - DNA, 121 bp, Artificial Sequence
  Synthesized
  misc_feature (61): n=t or g
gctctacccacctcagcatcccccagccagactgcagggtcatcatgaaattgacatctgncttccagctggtaacacccagcagtgttagtattttacaatgtcatctgcctccaaaagt

SEQ ID NO: 28504 - DNA, 121 bp, Artificial Sequence
  Synthesized
  misc_feature (61): n=t or c
atctacagtgatgaaaacagtaagtaaaaggaaagcagtaagggagctacaagacacttgntgtgatatatataactatgttttgctagactgaaagatcatacctacttcagtgaccaaa

SEQ ID NO: 28505 - DNA, 121 bp, Artificial Sequence
  Synthesized
  misc_feature (61): n=a or g
ttggcccacaaactgaaaacgtagaagaaaaaaggaaagttagcaataaagcatccttcanacctttaaagttgcaatgcacgtaggctattcccatggccatacacccgctgggtgggtt

SEQ ID NO: 28506 - DNA, 121 bp, Artificial Sequence
  Synthesized
  misc_feature (61): n=c or g
cctagcacagctagaattctaaactgcatgctctggtgataagcttgcaaggaactgctgnagaagagtggttattatagggcttaatgttttatacagtacggaaggagattgaagtctt

SEQ ID NO: 28507 - DNA, 121 bp, Artificial Sequence
  Synthesized
  misc_feature (61): n=a or g
aaaaaaaaaaaaaaaaaaaaaaaagctgatccttctcttctgtttctgggaggtagtcaangacggaagaaatgcaagaatcagaaggagaaacagcccatcacatgtactgcacctgatc

SEQ ID NO: 28508 - DNA, 121 bp, Artificial Sequence
  Synthesized
  misc_feature (61): n=t or c
tttttctgaaaacagcatttcccaccctgagatcatgtactcctgagaggaatgcttaccngccagataaacactgatctttgcaacgcaaaggcaaatgtgaaggaaataaaaaattctg

SEQ ID NO: 28509 - DNA, 121 bp, Artificial Sequence
  Synthesized
  misc_feature (61): n=c or g
ttggccttgtgcagaggtttgcacagctttgcaagggtgttgcagtcatgggtgtttttanctctcagctgcacagacattaattaacagcctcctgaaacacagcattggtgtggtgaac

SEQ ID NO: 28510 - DNA, 121 bp, Artificial Sequence
  Synthesized
  misc_feature (61): n=a or g
ctcccttctggctttctcagcccagagcagcagctctgcggttgctttacgtgggtgaccnttctggtttcatacctgtaaccttgggtgcacgcctcagcagctccttgtctccaccttg

SEQ ID NO: 28511 - DNA, 121 bp, Artificial Sequence
  Synthesized
  misc_feature (61): n=a or g
acatctcttaaattgtatcatctgcccggtatctcaagagtaaaggaatactttgaacgtnggttcttcacttgaaacagaggtgtatttagaatttctgggaagtgtgattcattttatt

SEQ ID NO: 28512 - DNA, 121 bp, Artificial Sequence
  Synthesized
  misc_feature (61): n=t or c
cacatattcgcacagcacaatgctccttttcccactaactgcttttggaggatgtctcacngtgagttgttgccctcatcatatggtaacaaaacagatgtgactgccaatgggctaacca

SEQ ID NO: 28513 - DNA, 121 bp, Artificial Sequence
  Synthesized
  misc_feature (61): n=t or c
caccctgctggtatttatggagcagtccagggtaggtgggagttggcccaggcacccactnctttctcacttcgtgttcctctgctccatggcagcaccactcatgcagctctgctcctct

SEQ ID NO: 28514 - DNA, 121 bp, Artificial Sequence
  Synthesized
  misc_feature (61): n=a or t
attttacatatactaaatataatacaacagtgcttaatgtaaagtgtatttattaatgagncagtgaaaatccttgatttaacaccattcgaaggcacccacttaacttgaaattcatgtt

SEQ ID NO: 28515 - DNA, 121 bp, Artificial Sequence
  Synthesized
  misc_feature (61): n=t or c
acacataattgtgtctgtgtggcagcagagattcctccttgaagggctgcatgtctcttcngggtcagataagtaggcactggctatgcacccagcctatgtgaatcaaagcctcccttag

SEQ ID NO: 28516 - DNA, 121 bp, Artificial Sequence
  Synthesized
  misc_feature (61): n=t or c
caaagttctgtataatccatccatcctttacactcaatagcaaatgttttgccttgtcaantccttgtaaatagagggtgtcaaatacgtggctagctcattggacacagctagggaaata

SEQ ID NO: 28517 - DNA, 121 bp, Artificial Sequence
  Synthesized
  misc_feature (61): n=t or g
atataatattgtccatgggactttttctcctcctaatgacttgtacctatggaattcattntataaacaaaattctctgtgtgtgacttcagtgatggtcacaagtaacccctctctacac

SEQ ID NO: 28518 - DNA, 121 bp, Artificial Sequence
  Synthesized
  misc_feature (61): n=t or c
ttcagttaagccaacgggaaatgtttttggagctcttaaagatgcagtacaccatctccanacattcaccagtctggccaatattgcaattcatgagtgtaattcaaaggcaccttctctt

SEQ ID NO: 28519 - DNA, 121 bp, Artificial Sequence
  Synthesized
  misc_feature (61): n=t or c
catttcttaatgaatttcctcacagcctatatctcagtcagtggaattaatatacaatttnatggctgctcagggcttttatttggattgttagtggctaagtgtccttctcataaaaaat

SEQ ID NO: 28520 - DNA, 121 bp, Artificial Sequence
  Synthesized
  misc_feature (61): n=a or g
ttcaatccacgctgtttttattgttctccctttgcttctcaaacctaggactgagtcttgnatatatttattggagcagttacgtgatcactttttttctgcttacatcatattcaggatt

SEQ ID NO: 28521 - DNA, 121 bp, Artificial Sequence
  Synthesized
  misc_feature (61): n=t or c
aaacagcatcaggaaaattgaggtgttaaaatatatgtaatgattcagtgcctgggagtgnatctcctcaagtctctgtacatttatttttcttcttcagctatgattgagatgtaacact

SEQ ID NO: 28522 - DNA, 121 bp, Artificial Sequence
  Synthesized
  misc_feature (61): n=a or g
gttacaggaattacagaggaattgtaagcatccaaacagctaacaacacacggtgatcttncactgtgcaaggcaggagaattctcaatggccagagtcccagaacgcatctgcatgtgcc

SEQ ID NO: 28523 - DNA, 121 bp, Artificial Sequence
  Synthesized
  misc_feature (61): n=t or c
ataataaatgaaggagcagatggacttgccttataaaaatagtactggggtaatacagtgngagcaaactgacattgaatgacccatctcgcggacccactctaagtttacttttgtagta

SEQ ID NO: 28524 - DNA, 121 bp, Artificial Sequence
  Synthesized
  misc_feature (61): n=t or c
aaaaaaaacccaaaaaacatttatttcaaagtatctggcaatagcaggcattgacttcagnatcacttaaaatatactaagaatatgaaaactgatgtctcttttttttatagcaagtgtt

SEQ ID NO: 28525 - DNA, 121 bp, Artificial Sequence
  Synthesized
  misc_feature (61): n=a or g
ccaaaggtacagctcagaacagatgagtaggtttgttaaatgcaacttcttccatttagantcatccaagcctaggatggtttgggagggactctaaaagacgtctaattgcaacaccatg

SEQ ID NO: 28526 - DNA, 121 bp, Artificial Sequence
  Synthesized
  misc_feature (61): n=a or c
ttaggactgcagatgtaaccagggacaattcttccctaacaggtatgcaataaattctttnttcccaacaacagcagcagctttcttcctgtgcttagccctggaagaacaaatctaaagc

SEQ ID NO: 28527 - DNA, 121 bp, Artificial Sequence
  Synthesized
  misc_feature (61): n=t or c
aaacccattttaatgtctcaatccttgaagtgaatgtgatgagctgttttcatatccttanggagctctccttttgttttaacatgatctatactgatcctttttcaggatcccgttcttc

SEQ ID NO: 28528 - DNA, 121 bp, Artificial Sequence
  Synthesized
  misc_feature (61): n=a or g
ttgcatcgctgttgccattcaggtgaaatcttgaaaagcacgagtacattcatagatcttnactgaagtacaggtttagaatcatttatattcttatttagttgctctcatatagtactgg

SEQ ID NO: 28529 - DNA, 121 bp, Artificial Sequence
  Synthesized
  misc_feature (61): n=t or c
gtatattctaagtctgatgtagtaactgctttctgtagcaaccctctcccctcaaaaaccncactggtttcaggtgttggatgtccatctgcttaaactgtagcacacatccaagcaactg

SEQ ID NO: 28530 - DNA, 121 bp, Artificial Sequence
  Synthesized
  misc_feature (61): n=a or c
tgtaattaaatattttgtttccagtgtaagtacttttatttatattttatctagtaccttntttcttgtcgttatagagaggcaaatatggagagattgaaagatttttttagagttggga

SEQ ID NO: 28531 - DNA, 121 bp, Artificial Sequence
  Synthesized
  misc_feature (61): n=t or c
gcagtgagtgcaggaggggctgctgttcccctctggctgctgtgggctgaaggagttgtcncttgcagacccctggaacaagagctcgctgaagacatggcaggttctcaccttgtgtctc

SEQ ID NO: 28532 - DNA, 121 bp, Artificial Sequence
  Synthesized
  misc_feature (61): n=a or g
actggatgatcttagtggtcttttccaatcttaatgattctataaaaacactgaatgaaantcaatagggacaccatactgcacttaggaaaaatgaagaatacagaattgtgaggcgact

SEQ ID NO: 28533 - DNA, 121 bp, Artificial Sequence
  Synthesized
  misc_feature (61): n=a or t
tgctaacagagtagactcacatgctgacagatctcaggcaaatgccatgggattgctcacnattacttttgaaactccttctaccttttaccaaaggtacctcctgaagaacgacttactc

SEQ ID NO: 28534 - DNA, 121 bp, Artificial Sequence
  Synthesized
  misc_feature (61): n=a or g
agtccctcaggccccatcccagcccagccccaagcggtgccgccctaaaaagctgtgcagngcagtgggtgcctcatacactggtgctcagttagaacactctacagcatgaaaaataatt

SEQ ID NO: 28535 - DNA, 121 bp, Artificial Sequence
  Synthesized
  misc_feature (61): n=t or c
tgggcattaggcggtcacctctcccatcccaacatctgcacaacgctgatgaatgcatatngtggaaggacgtcaccttgcagtccaattgccattatttctgcattagatttataaccca

SEQ ID NO: 28536 - DNA, 121 bp, Artificial Sequence
  Synthesized
  misc_feature (61): n=a or g
tctgcctgtttggcagatgcctctcctcctcctcagagcttcacagctcattgatactcanctcctttgggcaggtggagggaagactcacgaagacacagaggagtgctgcagtaaagct

SEQ ID NO: 28537 - DNA, 121 bp, Artificial Sequence
  Synthesized
  misc_feature (61): n=t or g
agccctagagatgaggtccagctgctgcaaggtcaccctcagtcttcaggtggctttgcanctggctcaggaacgatgcttgtgcccttctgctcagtaaagcactttgggctgaaatccc

SEQ ID NO: 28538 - DNA, 121 bp, Artificial Sequence
  Synthesized
  misc_feature (61): n=t or g
tgtcacatgcctattgcctaagaccttataaaaggctcagatttggagtagaaaaaaatgngtatgaaaaacagttgtgctgaacagagagtgaaacagaagttagaatattatgtgacgt

SEQ ID NO: 28539 - DNA, 121 bp, Artificial Sequence
  Synthesized
  misc_feature (61): n=a or t
cactgctttgtagtagagataatatttcaagcagaattaaaaccttcatattaatggcatnaggatctgctacccagaagctgttgtgttggtctgatgttcaggctgatacttgggggtg

SEQ ID NO: 28540 - DNA, 121 bp, Artificial Sequence
  Synthesized
  misc_feature (61): n=a or g
tacacatacatataaagatatctcattccacagtatcggaaaaaagtcatatggacaaacntcctatgtaaagcattgttaagagcctgggagatgtaacacacacatcccagaaaaatac

SEQ ID NO: 28541 - DNA, 121 bp, Artificial Sequence
  Synthesized
  misc_feature (61): n=a or g
tgctgggtagaggagtaagagtggctggccaggtcagtccacttccagctcttgaagaccnatctccaaaactttcagaatttgcatcaaaatatgtccatggtttcataacgtggtacaa

SEQ ID NO: 28542 - DNA, 121 bp, Artificial Sequence
  Synthesized
  misc_feature (61): n=t or c
ggactggactccaacaaaaccacgaatggagctaacatggaggtctgaacacccactctcnctcctatgaagcatatgagtcactggtcagagtctttgagaatatcttctaggcagattg

SEQ ID NO: 28543 - DNA, 121 bp, Artificial Sequence
  Synthesized
  misc_feature (61): n=a or g
ggctatttagttattttcctggcagtcccaacaggcttttctgtacctgctgtgttgtatnctatctgttacggatgtctcaagtttctctgctctctctttcattttctcttcctcataa

SEQ ID NO: 28544 - DNA, 121 bp, Artificial Sequence
  Synthesized
  misc_feature (61): n=a or g
ggaaccatgttactgccatgtgtgagccctttcttctattgagagtattttgactaccctnacactacagatacggtgctctcaagtacgaagagccattatagttgaaatcaaagcatag

SEQ ID NO: 28545 - DNA, 121 bp, Artificial Sequence
  Synthesized
  misc_feature (61): n=t or c
ggctgctccttgctttccaggtaggtggctgcctttgaaccactgcagccaaccagctctntgtgctgtcctttcctgctcatcttgaacgcttgcttggtcccatcactcaggtctgtgg

SEQ ID NO: 28546 - DNA, 121 bp, Artificial Sequence
  Synthesized
  misc_feature (61): n=a or g
gcttaaatgctttgtaaactctgtctttaaagactttctcccaaaggatgctgtagaagcntccactgaagtaagtgaggatgatggggactgagtgcagtcagtgctcggcagctacaag

SEQ ID NO: 28547 - DNA, 121 bp, Artificial Sequence
  Synthesized
  misc_feature (61): n=a or g
acataaattaagaataatataacatcctgcctgtcagaaataaataccaagcatttagacnttttacatccttcctaaatatctgcacatgggactcttacagcatctgagctgtttccct

SEQ ID NO: 28548 - DNA, 121 bp, Artificial Sequence
  Synthesized
  misc_feature (61): n=t or c
ttcattaattctaattgtcttttctgtcagaaagctgttattaaaactgttgatcataaangcctgcaaatccagtgctgtgagagaaatgacagattttgtttcgttgaaataggaactt

SEQ ID NO: 28549 - DNA, 121 bp, Artificial Sequence
  Synthesized
  misc_feature (61): n=a or c
taggaatagccccgagctgcactgaggaagcacagcttccctgagctgaggaagtcttggnaatggttggtttgaaatgtaaaacactgctgataatcccgggttgagcatgaataaaaca

SEQ ID NO: 28550 - DNA, 121 bp, Artificial Sequence
  Synthesized
  misc_feature (61): n=a or g
agcaggaaaacccaccctgtaaaaatgctccgaatactccctcgttgctaaagagagttgnaaggaggaaagccccaggagcaaagtagaaactggaattcatgcgttatcatgttccatg

SEQ ID NO: 28551 - DNA, 121 bp, Artificial Sequence
  Synthesized
  misc_feature (61): n=a or g
ttcctcaaatgaaaggtctgacccttgcatcattgctgaatgagcataagttgtgttcagnaattgggccatggtactgcctggagcagaagaaattgcctgtgtagtcaagcatggataa

SEQ ID NO: 28552 - DNA, 121 bp, Artificial Sequence
  Synthesized
  misc_feature (61): n=a or g
gctgctaattggcctatgtggagttcattaattcagaccagggatttatggagttgatgcnatttgcagttttagcagtgagaccagtcccttattacaactggagacaaattttcacctc

SEQ ID NO: 28553 - DNA, 121 bp, Artificial Sequence
  Synthesized
  misc_feature (61): n=t or g
cttacagattaatttgcctaggatttggggaaacctgtaagtctggcaaatgaacttgtgntacatgtaaaccagtctgttttaaaatgctttaggtgttatgcatgtctaacactgactg

SEQ ID NO: 28554 - DNA, 121 bp, Artificial Sequence
  Synthesized
  misc_feature (61): n=a or g
agaaaatgcagtttctgaaacagagagaagggaaaagaggtggtcggtagactctggagtnagctgggctggccatctggacctgacagtttgtagcaataagaatggggagctctataag

SEQ ID NO: 28555 - DNA, 121 bp, Artificial Sequence
  Synthesized
  misc_feature (61): n=a or g
tttcatctccagtgctgccacttccaggccattacagagacctgggaagatgttgaggacngacataaacctgcagctcccaagaggagagttccaggaatgcttctgttttcctagagca

SEQ ID NO: 28556 - DNA, 121 bp, Artificial Sequence
  Synthesized
  misc_feature (61): n=t or c
atcacagctaattagaatgaatacatccggtgaaatagcagcatcgaatattaattgaaanaccctccatctcactcagatgatttttgagttttcttttttctgcctgaagagccataca

SEQ ID NO: 28557 - DNA, 121 bp, Artificial Sequence
  Synthesized
  misc_feature (61): n=a or g
gaagaaatgaaggaattgtctctcatttatgcatgaaacagctgatctaccaaaacgcacnagtacagttgcacagagaattgtttccagaagcattctctgcatacagaagacatgacta

SEQ ID NO: 28558 - DNA, 121 bp, Artificial Sequence
  Synthesized
  misc_feature (61): n=a or g
gagaccccagcagtactgctgcacattaaggcagagcttagagcacaagaatcccctaacntctaaaggtgtacatcaaaggactggtccaagaaacagacaccaacggtacattgtgagg

SEQ ID NO: 28559 - DNA, 121 bp, Artificial Sequence
  Synthesized
  misc_feature (61): n=a or g
aaacagcccttcactagaccagtactttgccatagagaagtttctgtggcccgactgatcnaaaatccttattcctgggtgttacagggaagtaacaccctgtatgtacctccatgtacaa

SEQ ID NO: 28560 - DNA, 121 bp, Artificial Sequence
  Synthesized
  misc_feature (61): n=a or g
ggttgcatcttttgcagcaacaggagcttttgggacgtgccccgtgtctcatgcatggctnggaaggctggggagctgctttccccctcactgacagcctctgctctcccggatgctccct

SEQ ID NO: 28561 - DNA, 121 bp, Artificial Sequence
  Synthesized
  misc_feature (61): n=a or g
ctgaggaacaggataagcagtagaaaatgctggggtatttgttcatactcgatcaagtacngatagagtatttttcactgaaaaatgggtggaagaacttgatccagtccaccagcggctg

SEQ ID NO: 28562 - DNA, 121 bp, Artificial Sequence
  Synthesized
  misc_feature (61): n=a or g
tctgcaagtgtgacttgcgctggtgcctgttcagagcgctgggaggcgaggaacaatgtcnctattcaggctggcccattcactgcagccacatctgtttacatggcctgtgcccacctct

SEQ ID NO: 28563 - DNA, 121 bp, Artificial Sequence
  Synthesized
  misc_feature (61): n=a or g
ttgttatataaaagcagatgagggaatgggggtgagtaatgtgacagtatggagagatganacatgcaaggcagaacaactaggagtaagaattagtctgtgcagtactgaaaggactttt

SEQ ID NO: 28564 - DNA, 121 bp, Artificial Sequence
  Synthesized
  misc_feature (61): n=t or g
gggtcacaccgaccccaagggtgcgcaggcagcgaggttatcgttgtgcttttttccagancacacttcccccctctgtttatccccagttcagtttcaccgaagttcaactcgtatttac

SEQ ID NO: 28565 - DNA, 121 bp, Artificial Sequence
  Synthesized
  misc_feature (61): n=a or g
tctgtgtttgatccacctttgaaattgctacccagaagtttgcaacaatgagtaaaaactncagcagagaaatgaaggaatggacatcgtttgttcagcgctttttatttgttgtgatgcc

SEQ ID NO: 28566 - DNA, 121 bp, Artificial Sequence
  Synthesized
  misc_feature (61): n=a or g
gaacattcatagatcctgtcattttggagaagaatttctggtaaaggccaaacaatgactnttttacactacctatctgtgattcaaatggcaggctattgaatgttagttttattctgga

SEQ ID NO: 28567 - DNA, 121 bp, Artificial Sequence
  Synthesized
  misc_feature (61): n=a or g
tctctccctttcctaagagggtagacagagtgtgaagcatccatttaacctgctttatagnagtggatggctataagtgtttataggtaaataggtcttagagagctactgcaagtctagc

SEQ ID NO: 28568 - DNA, 121 bp, Artificial Sequence
  Synthesized
  misc_feature (61): n=t or c
ctgggaaaacacaaagatgtaactagaacattttgtgacttaggaaagagcaccaaagaanaggtgaggtaatttgaaagctcactggaacaaaaaagtgacacaagtcacttttcccagt

SEQ ID NO: 28569 - DNA, 121 bp, Artificial Sequence
  Synthesized
  misc_feature (61): n=a or g
actccatagaggtagtcattgtacacagaaaaaaatcttcaaggattttacaacctgccanttcaagacacagtatacagaagaaaagaggacacgctgaaatggaaaggtttgcttgaaa

SEQ ID NO: 28570 - DNA, 121 bp, Artificial Sequence
  Synthesized
  misc_feature (61): n=a or t
gtggatttgtgctgactagaaagctgtccataagagcagagttgctataaaggtaatagtnttcttttttaggaaaacaaataatattctgtggttatgtactagctcacacaggtaaaaa

SEQ ID NO: 28571 - DNA, 121 bp, Artificial Sequence
  Synthesized
  misc_feature (61): n=a or c
cactaacctcttggcctgttttgctgagctcagtacacaggccttcacttctcctaaagangcaaaagagtgtagaatcagattagttgaggttgcaaaaacatctgcattgatagacacc

SEQ ID NO: 28572 - DNA, 121 bp, Artificial Sequence
  Synthesized
  misc_feature (61): n=c or g
agtattgtctcttctatttattcatctgaaaagtaacaccaagtatgtggacaaaatcttnaaggtaggaaaatggctttatagtaatcaactcaagtccagtttcaggaaagctgagata

SEQ ID NO: 28573 - DNA, 121 bp, Artificial Sequence
  Synthesized
  misc_feature (61): n=a or g
ggtgatagaacttagctgagtcacatataagtcacaatgcctccagctattacaaatcaantttgaaaagtcatgattctaacatcaggtagtaactcacctcacctgtgtgataataaaa

SEQ ID NO: 28574 - DNA, 121 bp, Artificial Sequence
  Synthesized
  misc_feature (61): n=a or g
ccacctaaaatactgtgctgcaatattgagggtactgcaaaaattgagattcaactgcaancaaggattaggttctgcagcataattgtacaagctgacagaaaggaggacaataatttct

SEQ ID NO: 28575 - DNA, 121 bp, Artificial Sequence
  Synthesized
  misc_feature (61): n=t or c
ttttgttggctttttgctaacagttgcacagtggccataaattgtactatccaggacaggnactttattcagtaagctggcaaagcaggtaacattgagcagcatgattttgctgataaga

SEQ ID NO: 28576 - DNA, 121 bp, Artificial Sequence
  Synthesized
  misc_feature (61): n=t or c
ttctaaacttgtgaaatactcagtgatagttctcaacaataaaagtcagatttaatggaantgaaacttttatcttttcccaattttgtctagaacagttgagttgtgtgaaaagtagagc

SEQ ID NO: 28577 - DNA, 121 bp, Artificial Sequence
  Synthesized
  misc_feature (61): n=a or g
aaattattttgtcctaattacaagatgaatgagtacaattgtcagaacaggtgcttcaccntgtctagatataggtttgtgaaaaattgttatttatagaacaccatacaaaatgatagac

SEQ ID NO: 28578 - DNA, 121 bp, Artificial Sequence
  Synthesized
  misc_feature (61): n=t or c
agaaagcaggttgggataaaatcccgcaaaattagggttatgaaatactgacagatttgtngccctcctctgtgtcaaattagtccatagtgacaattatttacaaacatatgtatcatat

SEQ ID NO: 28579 - DNA, 121 bp, Artificial Sequence
  Synthesized
  misc_feature (61): n=t or c
tgaaaagttaaacagttctcttcttaagaactacttgagacttgtacacccttttgcattntaccttgcacctagcaacccactaccagccactgagaaccttctgtaaaccattccgtgt

SEQ ID NO: 28580 - DNA, 121 bp, Artificial Sequence
  Synthesized
  misc_feature (61): n=t or c
tcactgttgacatagctgtgaagctcacatagttttccatataaactattcgtattttttnctggatttagattgtgatatttagattgtgatatttagattggtgttttgaggcaaggag

SEQ ID NO: 28581 - DNA, 121 bp, Artificial Sequence
  Synthesized
  misc_feature (61): n=c or g
tcatgatattttttccattaactccagtgactcgtggatgtggatgcagagctattttctncttttgcctcaagtaaacaaagcgattgacctcccttctagaagtattatgaactgcaac

SEQ ID NO: 28582 - DNA, 121 bp, Artificial Sequence
  Synthesized
  misc_feature (61): n=t or c
ttttttcttttttttttttttctttttttttttctttttcccaaggctttacatagacctntgactatttagcaaattttggattctgtgacggattcagtataaatactctggtttatcc

SEQ ID NO: 28583 - DNA, 121 bp, Artificial Sequence
  Synthesized
  misc_feature (61): n=t or c
ctgaggttgcaggatgcaggagtacagggtaataatactatcttcgtcagcagcaaattcnaccctcggcatctttagaatcctcagctaacttcaatgacacgcattttataacttctct

SEQ ID NO: 28584 - DNA, 121 bp, Artificial Sequence
  Synthesized
  misc_feature (61): n=a or g
cttgtgaagagacagtgcatcattttgctatgtgaactaatctgctaatgcagatactagnaagttatcagctttgttctttaaaaacgagacactaagctgaaggtgctctcatggcagt

SEQ ID NO: 28585 - DNA, 121 bp, Artificial Sequence
  Synthesized
  misc_feature (61): n=a or c
gtaaaatgaaacgtttcggttgtcccactgttattctgtttaccaggacaaaaaacaagcnaacaaaaagaagcaagtttcccatttagtgtggacacatttccctgtgtgatacaccaga

SEQ ID NO: 28586 - DNA, 121 bp, Artificial Sequence
  Synthesized
  misc_feature (61): n=t or c
aaacaagacaaccaaaaatggaagtcgtaaatagtctggtattctttctcagagcctaagngtggcagtaataaaatctaaaatctctccactttccagatgtcaagaacaagtccttcat

SEQ ID NO: 28587 - DNA, 121 bp, Artificial Sequence
  Synthesized
  misc_feature (61): n=a or g
ttttgtaatccatctcattctgtaagtagatctaaaaaaataaaatgctgaccacaaagcntggtaccaggattgttgatctgtgagcagatggcttgcatgtctttcttcagacttagct

SEQ ID NO: 28588 - DNA, 121 bp, Artificial Sequence
  Synthesized
  misc_feature (61): n=a or g
gtgaacaagtggatcggtagctccttaaacggttgcagcatttgctcaggtttggaaaatngagctttttccatctggatgggctgtcctcaaggtccactgctgcactgtttcctggaga

SEQ ID NO: 28589 - DNA, 121 bp, Artificial Sequence
  Synthesized
  misc_feature (61): n=t or c
tctaacaacactgtatcttctgcacagatgataccctgtgtttgtgctagcagtcattgcntccttgacagaggaaattaaagaaatcaagttggttgttttgtttttttttttaccatct

SEQ ID NO: 28590 - DNA, 121 bp, Artificial Sequence
  Synthesized
  misc_feature (61): n=a or g
tcacactttagcaacagccacatcaaaagaccacaacagtggtcatagcagtatttctacntggaaatggtagaggtgttttctgctcactgctgtgaagggctgttatgaccaggtggca

SEQ ID NO: 28591 - DNA, 121 bp, Artificial Sequence
  Synthesized
  misc_feature (61): n=t or c
gtaaccccactgcaggcaatgaaatggcaccagtctaagtaagaatccgtcttaagttatngagaaggagatacagagcatggatatcaggactattattaaggtgctggtgaaccagcag

SEQ ID NO: 28592 - DNA, 121 bp, Artificial Sequence
  Synthesized
  misc_feature (61): n=t or c
tcctagacatagaagattgatgtggaaaatatgaaaattgtcaactttggtaaatctgagngcagaagccagtatttgtatgatagttaagaaattactctaataatgcattccggagctt

SEQ ID NO: 28593 - DNA, 121 bp, Artificial Sequence
  Synthesized
  misc_feature (61): n=a or g
ccccagcctgtgatatccctctggataagaacacagccctctggtgaattggtcattgccnctcaattgcttactgtctgaaatatcgatgacgtttttgttaatgtggcctgtatgcgat

SEQ ID NO: 28594 - DNA, 121 bp, Artificial Sequence
  Synthesized
  misc_feature (61): n=t or c
taatacaatctagtattctacaaagcagtaactctcatgcaatatctcaatattaacaaangcacatgctttcataaagtttcacttgtgcatactgataaagcttatcctctattctcat

SEQ ID NO: 28595 - DNA, 121 bp, Artificial Sequence
  Synthesized
  misc_feature (61): n=a or g
cactatttgtcgaagggcataataagtttttgctgggttctatcttgagttacgcttccanaggttcttcagggtgggaaatgaaattttcccttcactttgtttcaggaagaaaacgtat

SEQ ID NO: 28596 - DNA, 121 bp, Artificial Sequence
  Synthesized
  misc_feature (61): n=a or g
tatttttcctaagttaacaacagcgcttttgtttaacaatgatttttttatactggtggcntccttatccctcataagccacattttcaagaaggaaaaaactaatcagaaaacaaaactt

SEQ ID NO: 28597 - DNA, 121 bp, Artificial Sequence
  Synthesized
  misc_feature (61): n=a or c
aagagtcttcagagtagcttatttagcttactctttttaacatactcagtgaatttctctntgttccctcatgtatcgcctaagttgtatttagttttatgatttgaagacattcatagtt

SEQ ID NO: 28598 - DNA, 121 bp, Artificial Sequence
  Synthesized
  misc_feature (61): n=a or t
tttttcctcttcaattgatcactacttgaaaagtgcgcaagcaagaaggaaacagacgtcncagcagagggaataagactaaaataaattctaccaagaacagcatgccaagcttaagaag

SEQ ID NO: 28599 - DNA, 121 bp, Artificial Sequence
  Synthesized
  misc_feature (61): n=t or c
attgcaggtgagacgcttgaaggtgcatggtatatataatttatcagtgcacgtgaccacnacatatgcaatatattttgtacatggtatagtcattagctaaaaagcatgtgccacttta

SEQ ID NO: 28600 - DNA, 121 bp, Artificial Sequence
  Synthesized
  misc_feature (61): n=a or g
agccagataggctctgctagaaatgagaaatagggtaataccaactttactgatggacatnctcaccccagggatttccagcaatccagagacaaggagaggcagtttcagggcagccacg

SEQ ID NO: 28601 - DNA, 121 bp, Artificial Sequence
  Synthesized
  misc_feature (61): n=a or g
gatcaatctgcagggcaagatcctcagcgtcgatggcaacaagatcactatcatgcccaancacgaggacttgaaggtagcagagcacgcaggggcgcagcgcccgaatgctttgtgtggc

SEQ ID NO: 28602 - DNA, 121 bp, Artificial Sequence
  Synthesized
  misc_feature (61): n=t or g
tctttcaggaagagaactattatgacagactgtccttgctgagcactgagctagtagacancagcagtcaaaaagcagatgaaccatgtagccccattcagtaggaaaggaactgagagga

SEQ ID NO: 28603 - DNA, 121 bp, Artificial Sequence
  Synthesized
  misc_feature (61): n=a or g
cagcagacctgctcagaggcctgatatggcttctaataaagctcttcctacactgactttntgcattttaatttgcactctcaattcagtatgggtttcctaacatctcaaattaaacaaa

SEQ ID NO: 28604 - DNA, 121 bp, Artificial Sequence
  Synthesized
  misc_feature (61): n=a or g
aacacattttcttctttattttgctgctgcaaattcagtgtacacccaagtagtgctaacntatctctttccaaaagtgagaaacatttttacactttgtatacatcaagaaattagacct

SEQ ID NO: 28605 - DNA, 121 bp, Artificial Sequence
  Synthesized
  misc_feature (61): n=a or g
gaaataaaaagaaattttatgtcctgagaagagcactttgctaccctaaaaaaatcatttncgctgtgtttgatccaagccaccccatgacttcccaatgcgtttcaggtttcccatttgg

SEQ ID NO: 28606 - DNA, 121 bp, Artificial Sequence
  Synthesized
  misc_feature (61): n=a or g
cctctaccccaaaagaagctgctgagatgcagcccatgctgcaaatagcaacgagaaagtnaaaatcaactcaaaagcgcagtcaagaggctaaagaattattcaggcagcattcacttgc

SEQ ID NO: 28607 - DNA, 121 bp, Artificial Sequence
  Synthesized
  misc_feature (61): n=t or c
gagccaatactcaaaaacctgtttcacatactattatgaaacatagctcaaaatcactganagaacttaagagcctgagctatagactagaaacagtgagttattactgctaatgacagtg

SEQ ID NO: 28608 - DNA, 121 bp, Artificial Sequence
  Synthesized
  misc_feature (61): n=t or c
acagatcttaacattttaagcacagaacactacaactcatgacaatcagcaaccaatgccncttctcaagcaatccatcagatgaagctgtaatatacagtacaagctttactagtaaaac

SEQ ID NO: 28609 - DNA, 121 bp, Artificial Sequence
  Synthesized
  misc_feature (61): n=a or c
gtttttaatgctaagagcctctatatgttagctctttggaaaactagctattttgtaaacnactctcattctatacattattttataaggtatataagtttctccaaaagtaatgcctcct

SEQ ID NO: 28610 - DNA, 121 bp, Artificial Sequence
  Synthesized
  misc_feature (61): n=c or g
tgactgtttgttcacttctgaataaaaaacctattcaacttctatttatctaattctggtntgttgcaccacagcctctgtttgaggctcaccaaatggtgagccatggctcacctgtgtc

SEQ ID NO: 28611 - DNA, 121 bp, Artificial Sequence
  Synthesized
  misc_feature (61): n=t or c
ttaaggtaggcctcacactgagtactgcaggtcattcaaacaaacaccatccgcacaaacncccttcaacaattatctggttgatgctaatacaaaaaccattaaaactggacaggtcaaa

SEQ ID NO: 28612 - DNA, 121 bp, Artificial Sequence
  Synthesized
  misc_feature (61): n=a or g
gcaccccaaggagcagtccccgagcagcagctggagcagtgcagggtcagaagccctaccncacttttgttctgctatgcgccaacaattatttctatacaacagctgtacaaagagcaga

SEQ ID NO: 28613 - DNA, 121 bp, Artificial Sequence
  Synthesized
  misc_feature (61): n=a or g
agtgagaagctgagaactgcatgcttatgggaacacataacaagaagaaaatttatctggntgagaggctgggatgattcagctcttcatttgagcagtgggactgtagatacttgatctt

SEQ ID NO: 28614 - DNA, 121 bp, Artificial Sequence
  Synthesized
  misc_feature (61): n=t or c
ccagctgttcaagtgatggagcctggacaataccttctgttgttttcctgtttgtttacancctgccaatttcacatataacacaaacgtcatcatcaatggtgttgtgtccttatgacag

SEQ ID NO: 28615 - DNA, 121 bp, Artificial Sequence
  Synthesized
  misc_feature (61): n=a or g
ctataataacaaagtactgatttgtaaagagtaaatgtttcaatggattatattatagttnggggaaagtctaagtttttaagcatttagaaatggaattactttatactcagattagtta

SEQ ID NO: 28616 - DNA, 121 bp, Artificial Sequence
  Synthesized
  misc_feature (61): n=a or g
ctctggttagcagcataactaactaactaatgagggcttctgaatttcatcctgttatcanccaagggcaaagagagtccttcatacctgttatgggagtataatctacaagaaagctgta

SEQ ID NO: 28617 - DNA, 121 bp, Artificial Sequence
  Synthesized
  misc_feature (61): n=t or c
ctaacgttagctcaataaatgtgatcaattatcacttcaattttatgagaaactcaggacnctccccctacttttagcagaaggtgactgcaatgtctcaaacgcctttgcattacctgct

SEQ ID NO: 28618 - DNA, 121 bp, Artificial Sequence
  Synthesized
  misc_feature (61): n=t or c
taagtgtgctttagtcaacaaatagaataaatgcaagcctaaccacacatactgagtgtcncttcgaatttgtatgttatcaatctcatgacaaatcttaataagaagtgttctgagtttt

SEQ ID NO: 28619 - DNA, 121 bp, Artificial Sequence
  Synthesized
  misc_feature (61): n=a or g
gcaaacctttgtatttggcttaattcaaccttacttttgcctaaatggtcctgtcctaccnggtcaactagtctacactagcagtctggatgagtgcccactctacctcatcttttaggat

SEQ ID NO: 28620 - DNA, 121 bp, Artificial Sequence
  Synthesized
  misc_feature (61): n=t or c
tgatccgtcaaggagttttcccagaagcttttttgtttgatgtctggggaagttagccccnccacacatgctgagatgccacggagatagccaaacttttagagttaggtaatcctgggaa

SEQ ID NO: 28621 - DNA, 121 bp, Artificial Sequence
  Synthesized
  misc_feature (61): n=t or c
atgtataaggacatcaatcacaacagagcacgataagcaggtatcaatagcatttttctangcgcaaatatcatatccagataaaataatgtgactaatgtattggtctgtgataattaga

SEQ ID NO: 28622 - DNA, 121 bp, Artificial Sequence
  Synthesized
  misc_feature (61): n=a or g
gatttactctgcaaaatgactcttatgccttgggtccagttatgttatgctcaatatttangcctagaggagaaagatttgggttttttttcccccttgtccttaaaggactgacatataa

SEQ ID NO: 28623 - DNA, 121 bp, Artificial Sequence
  Synthesized
  misc_feature (61): n=t or c
agcaaaataagagagaactaatggtgagaaaatagtccatggtctaaccttgttatctagnacgtaacctcagatgtcatcaacataaaatagtataactttcagttaagaactttgcatg

SEQ ID NO: 28624 - DNA, 121 bp, Artificial Sequence
  Synthesized
  misc_feature (61): n=t or g
tgatattctgaacttcactgtcatgcgttttgggcatttgctcgtaacttttcatggcagnggtacaagaccatcaacttggaccacacaatggctaaggttggaaggaacctctgcagga

SEQ ID NO: 28625 - DNA, 121 bp, Artificial Sequence
  Synthesized
  misc_feature (61): n=a or g
ccctgggcaaacacaggctggggctttcctgtaggagcactacacctcagggtgctgagcncacgggtggagtgtgctctctgccagttgtaaggtagttgctgtaaatctctaccttgct

SEQ ID NO: 28626 - DNA, 121 bp, Artificial Sequence
  Synthesized
  misc_feature (61): n=t or c
aaaatgctttatctatttctcttttcttacagggagtttcctagggtttggtccagcttanttgcagatagatgcactcattactaaagtgatagattctgctgccactaattcttagact

SEQ ID NO: 28627 - DNA, 121 bp, Artificial Sequence
  Synthesized
  misc_feature (61): n=t or c
gaaaataggtgggacatgcagctatcgatggttgctgtggagaaggacaggactgctcaantatttgaagttttcaaaaccaaggcacacacagcaaacagatagacaacaatgtttctgc

SEQ ID NO: 28628 - DNA, 121 bp, Artificial Sequence
  Synthesized
  misc_feature (61): n=a or t
tggagcatcaaacttagggatgtgggctttgaacagttaagttccagatgcagagccctcnaggttagccagtcccaggcagcatgtggtctccaccaggcagttaggtggtgtgtttggg

SEQ ID NO: 28629 - DNA, 121 bp, Artificial Sequence
  Synthesized
  misc_feature (61): n=t or c
tcatgaactcttccatgaaatcttgctgcacccatcttgattgcatatgctaatcttgtcntcttaattgactcataacagatttatctggatttccaacttcctcttctctttagaatgt

SEQ ID NO: 28630 - DNA, 121 bp, Artificial Sequence
  Synthesized
  misc_feature (61): n=t or c
ctcttttctaaaatttgagcctggcaattagaaagaattgttccaagtaaggttttcatgngcatttgtaaaacgcttatcaactgtagactgctgctttctaatacttctgagatttaaa

SEQ ID NO: 28631 - DNA, 121 bp, Artificial Sequence
  Synthesized
  misc_feature (61): n=a or g
ttgctggtggatgaggtaagtaagagccgtcagttaacaaagtaagattgtttgatttccngctgtgtgtgtcaacctagttttttttctttattatggttcttaaataagttgttccata

SEQ ID NO: 28632 - DNA, 121 bp, Artificial Sequence
  Synthesized
  misc_feature (61): n=t or c
gagtgggccagagggacccagaggtgcgctccgtcctctgccatgctgtggttctgcggtnctgttttgaggttttgaatcaaccttctcctcagctccacgtgtaactgcctggagaagc

SEQ ID NO: 28633 - DNA, 121 bp, Artificial Sequence
  Synthesized
  misc_feature (61): n=t or c
taggcttcgctacccagaaggagcagataacatcgcccgacttacacctcgcagccgcacngttgctgctctggtcactcaggaaggacccacgtgagagggcgccgcaccgccccggctc

SEQ ID NO: 28634 - DNA, 121 bp, Artificial Sequence
  Synthesized
  misc_feature (61): n=a or c
tttaaaagcatgctttgcctgtttaagaatataccttgtttgcaactgctaaatgcttctntgatattttcatgcaccacatcttcttgatatgctcacaagagtcccactgcctccctag

SEQ ID NO: 28635 - DNA, 121 bp, Artificial Sequence
  Synthesized
  misc_feature (61): n=t or g
ttcatcttttaaggggtgtgtgccttcatctgcagggctcatcataagggctcctcatccnggccttgctgttggcacgctctcctgaccacggctggcttataaaatggtacaacggttt

SEQ ID NO: 28636 - DNA, 121 bp, Artificial Sequence
  Synthesized
  misc_feature (61): n=t or c
gattgaaggtactctttctattcatagtgcattttattttgatttaagttatatattctcngacagttgttgataaatctgtacagataaatctgtagagtattcatggcttctagtcaag

SEQ ID NO: 28637 - DNA, 121 bp, Artificial Sequence
  Synthesized
  misc_feature (61): n=c or g
gaattgaccatcttgctggtagagttttgcttatgtaaagagatattagagccttctgaanagcatattaccagcatagtggcatcctccacagtggaaaaaagtatcagaaacctccact

SEQ ID NO: 28638 - DNA, 121 bp, Artificial Sequence
  Synthesized
  misc_feature (61): n=a or g
aaaacattgggccatgagctgagagcagtgcacctgcgaatcaaccagaagaatagtaacncaacagtcctgtaaacacatcccaggtgagcttggtgagtgcaagactggagggattcac

SEQ ID NO: 28639 - DNA, 121 bp, Artificial Sequence
  Synthesized
  misc_feature (61): n=t or c
agcagaggcaaaccaatgagctttccacgttatacattccatttcaagattttgcaagggngctttatcacactgcctcctaaaacgtccaactgaacatctatgtttaaaagcagtgggt

SEQ ID NO: 28640 - DNA, 121 bp, Artificial Sequence
  Synthesized
  misc_feature (61): n=t or c
atttgatgacttctcatatgagttgtgcctggtagatttggtaagtgccccctccatcttntacctgcattcagaatcatgtgtttgctgctgatcaataattaactcactgtttgcccat

SEQ ID NO: 28641 - DNA, 121 bp, Artificial Sequence
  Synthesized
  misc_feature (61): n=t or c
ttccatgtataccgaggtgactcttaaaataaatttatttttcatgaaaatatgtaaaaanatattattgcctttgttcttatattttaatcattccttcagttccctctgacagccagca

SEQ ID NO: 28642 - DNA, 121 bp, Artificial Sequence
  Synthesized
  misc_feature (61): n=a or g
ctctttcccaaaatatcccttttctccaaaattaccatcaaccatgagatcatttgaaggnctgcatgtagatgtgtaagccgaaagcgtgccttgaacacttctctttgaatagaacaaa

SEQ ID NO: 28643 - DNA, 121 bp, Artificial Sequence
  Synthesized
  misc_feature (61): n=a or g
aaagggcacccacaaaaatattcctctttagcttgtaataaaccatttgtcccaggatgcntgtgtttgcagacaaggcagcagcaaagcaaagcttgtagtatatctacactatcctttc

SEQ ID NO: 28644 - DNA, 121 bp, Artificial Sequence
  Synthesized
  misc_feature (61): n=t or g
gagttagggtatttggcatcttgcagggtaggtaggtctgggcaacagattacatactctnttttcagaagagctgtatgtactggtatggcaaaaaaaaaaaaaagtatcaaatatgagc

SEQ ID NO: 28645 - DNA, 121 bp, Artificial Sequence
  Synthesized
  misc_feature (61): n=a or t
gtcatcttgacagctgcctatgcttgccagcagacaagatgtgatacaaagtaaatcttgnctgacttttgctctctgcaaagtgtgcagtattcctgaaggtggaatggagcaagacgag

SEQ ID NO: 28646 - DNA, 121 bp, Artificial Sequence
  Synthesized
  misc_feature (61): n=a or g
ctttggctgtccccatctcagctctcctttcattgtcatttcttgctgctcccgagcttcntctttgctgcaaagtaacaacaggtgaaagtgcacctcgagtgtccctgtgtattaaaaa

SEQ ID NO: 28647 - DNA, 121 bp, Artificial Sequence
  Synthesized
  misc_feature (61): n=c or g
tatttagctatatacatacatacataaccaacatgtttccttaaagtagtggatttattantccttacatgttgttttgatgcgaaatgtgagcagagcataacgtcttgctgagaaggag

SEQ ID NO: 28648 - DNA, 121 bp, Artificial Sequence
  Synthesized
  misc_feature (61): n=t or c
agacccacttcttgtaggctgatactgcctgggagtggactaaatactcctgaaaaagctntttcatttgggtaaatataaatctgatctgtggttcctgtgcaattggaactgctttcta

SEQ ID NO: 28649 - DNA, 121 bp, Artificial Sequence
  Synthesized
  misc_feature (61): n=a or g
gccgagtgtttgcatccagcccagctgcaaggagtatctttggtgcagagctttgccatcngggaataaggaaaatctgctgctgcagggcctcatttccagcggaaaaacatggatgcct

SEQ ID NO: 28650 - DNA, 121 bp, Artificial Sequence
  Synthesized
  misc_feature (61): n=t or c
aagggagttttgaggggaacattccttttctttagataaggtagtaacactcagaaaggantggaagatgaataccaatcggaaagatcgcagcacagagagcccctccacattcgccaga

SEQ ID NO: 28651 - DNA, 121 bp, Artificial Sequence
  Synthesized
  misc_feature (61): n=a or g
gaacatctgagactgacaggaagtctcacaaaaaatttatacctgggattcttagttcctntgttaaatactgtacaatctttggagacttttaaacaataaaagtatagctggtttttgt

SEQ ID NO: 28652 - DNA, 121 bp, Artificial Sequence
  Synthesized
  misc_feature (61): n=t or c
aagctctgagagctttacggggccctgttgtgtagtgactgcaggagaaactcagatccanctgagctcctgggacgtgcagctggtgccctgtgggcctctgtgtgttgttttggggtgg

SEQ ID NO: 28653 - DNA, 121 bp, Artificial Sequence
  Synthesized
  misc_feature (61): n=a or g
tcactgatcttcaggagagactgaaggttgctttgcttaggatcagggatgtgacattctngattttatgcaagaagcataaaaatctacagctgtagaaggctacatagggccctcactt

SEQ ID NO: 28654 - DNA, 121 bp, Artificial Sequence
  Synthesized
  misc_feature (61): n=t or c
ttgttcaagctttgtaagaatgaatttgtactgtcagagacaggttagctggacagtctcncatctgttgcaattaacacaaggaagctctctccatgaagtattcctttcatgatgaaca

SEQ ID NO: 28655 - DNA, 121 bp, Artificial Sequence
  Synthesized
  misc_feature (61): n=t or g
ctccactctgtgcttgacagtgcagaaggatgtcaaagagaataatgtcaatttattagtntttccctccctgctagtttcctctcctcctctataaaagtgttccctataggaggactgc

SEQ ID NO: 28656 - DNA, 121 bp, Artificial Sequence
  Synthesized
  misc_feature (61): n=a or g
ttgctagtaatgtcaagtaaaacatctgcctgataagagagaaatgggtgggagtgaaaanggattgagaaaaatgtaagagaggaaggagagcgaggaagataaacttgtgaatgggaag

SEQ ID NO: 28657 - DNA, 121 bp, Artificial Sequence
  Synthesized
  misc_feature (61): n=t or c
gccacgcaccctggagttttaaaagcctgcaggctcgaagtaagtgccctgatcagactgnctcctgggctaaggtttttttggaggggtagaaattaagcgtggtgagaagcgaagtcgc

SEQ ID NO: 28658 - DNA, 121 bp, Artificial Sequence
  Synthesized
  misc_feature (61): n=c or g
ccaaaatagttgaaaccccaccctgtaatccctgatgacaaaacagctcccaaacgttgcngtgcataagatgcaacatccccattgtggctgcctcctaagagctgactgcggtgtgatg

SEQ ID NO: 28659 - DNA, 121 bp, Artificial Sequence
  Synthesized
  misc_feature (61): n=t or c
atacgtcccttggctgtctgaactcccagctctggcctttctggttaacacgtggaaatgntttggctgaacaacctttgtttctcctgatccctatgaaccccaaaagcactgcaaattt

SEQ ID NO: 28660 - DNA, 121 bp, Artificial Sequence
  Synthesized
  misc_feature (61): n=a or g
gatgaagactggttatacagttgtctacattttgcccaatgcatcatgctgcacagtcccntaagaggttttcactgtaaaaatacagtcagttacaaataatcatttcgtacctaggaaa

SEQ ID NO: 28661 - DNA, 121 bp, Artificial Sequence
  Synthesized
  misc_feature (61): n=a or g
aaattgaaaagccttttccactgagctgtacctagtttaaaatccattagctaatactgcntgccctaaggttaaaaaaggagtaaaaatcccatggtgaactctgcatttcagataagtt

SEQ ID NO: 28662 - DNA, 121 bp, Artificial Sequence
  Synthesized
  misc_feature (61): n=a or t
gaaggtgggagagtcagaaccaggcagagattgtgcagatctgtgccctccataaactgtnaaagaaaaagcactgacacatcactaagtggatgtcgttagcttcaaaaaaaaaaccaaa

SEQ ID NO: 28663 - DNA, 121 bp, Artificial Sequence
  Synthesized
  misc_feature (61): n=a or c
ctgacccaacagcctgtgtacaacatgggctgaggaaaatgagagatgctttttgctggcnatgcagacgtccactgacttgagcatgagcaacctgtcccttctggaggagtctccctgc

SEQ ID NO: 28664 - DNA, 121 bp, Artificial Sequence
  Synthesized
  misc_feature (61): n=t or c
caatacccatctcaggcctttctcagcaattaaacatattccaaaaaggatggcaatccanaatgtggtcagcattcaaaagatttcatcctgaaagatctgtgaataagtaaccaagcag

SEQ ID NO: 28665 - DNA, 121 bp, Artificial Sequence
  Synthesized
  misc_feature (61): n=a or t
atttactggctgacaagaggaagatgtgagttagagaagctgagacaatgagggaaaaaanaattgttgtagaaactgtactggatgataactgctttgtaaatatgagaaatactttgtt

SEQ ID NO: 28666 - DNA, 121 bp, Artificial Sequence
  Synthesized
  misc_feature (61): n=a or c
taaggcaggagaatattagctgcttttaccttctcccatctcatcttttcttataacaaanaagcataaattagttagtgatgtgtatgctgacagcctaacatttacttcataagcatgc

SEQ ID NO: 28667 - DNA, 121 bp, Artificial Sequence
  Synthesized
  misc_feature (61): n=a or t
cagctctatcacataggattaatgttactattcatgcaggtgatctctagagttctactgnaagaatcagttgaatgatgatgtgaagtataaaaatattctgaaatatgccaaggtcagg

SEQ ID NO: 28668 - DNA, 121 bp, Artificial Sequence
  Synthesized
  misc_feature (61): n=t or g
gttgggtacagcccattgggaacctcaagggatgaaacgtggtaagtgcccgtgttattcncaaataccagggcatcgtcctggaaagaaataataagtctccactgatggatctgtgtga

SEQ ID NO: 28669 - DNA, 121 bp, Artificial Sequence
  Synthesized
  misc_feature (61): n=c or g
tgtcaaaataaagtcttctacttaccctgttttaagaagacatacaaagaacaaataaaanttttcagtgtggttaccagttttgcaattgaaattctaacaaatctctgtcactaaaact

SEQ ID NO: 28670 - DNA, 121 bp, Artificial Sequence
  Synthesized
  misc_feature (61): n=a or g
actggcagtcaccaaagcattgtttaaactgtatttcgaatctctgctagcagtctctgtnttcactccgcttcagcatgtgatactgtgtgatggtaccagaattaataaacaggtgaaa

SEQ ID NO: 28671 - DNA, 121 bp, Artificial Sequence
  Synthesized
  misc_feature (61): n=a or c
tgatgttggatttttaagtcccctttactgctgaagtctgcgtgtatggtgtctcacatcngtgctggttttgaagatggcacctgaggttgtcacgattacacaattgatagatgtgaat

SEQ ID NO: 28672 - DNA, 121 bp, Artificial Sequence
  Synthesized
  misc_feature (61): n=a or c
ggccatgctaaccagcttcatgtgcctttgttaaaaacaacaaacacatatatgtatgttntagtaaagattaaatatcttcccctcttcatgtaggtacttggcttgttgtgtgtaagag

SEQ ID NO: 28673 - DNA, 121 bp, Artificial Sequence
  Synthesized
  misc_feature (61): n=t or c
gaactgatacaacacacagaaattgttcttcacaaggtgagccaagagaacaaatactttntgtaatatcccagtgtaaaaatacaactcattacactgttttataagacatcacctgagg

SEQ ID NO: 28674 - DNA, 121 bp, Artificial Sequence
  Synthesized
  misc_feature (61): n=a or g
cttgacctaagttacctaacaaggacgacagtagtgtgtctgcagaatatcagcagatatnctctgacatatcaagcaaaatgctcacttaggagttttgagaaaaaaaaaaaaaacattt

SEQ ID NO: 28675 - DNA, 121 bp, Artificial Sequence
  Synthesized
  misc_feature (61): n=c or g
ttgtgaccactagaaatgtggccataaccagcaccaaaagattaagtgtctctttaggcancctttaagcatgatatgctttgggggttggaccagctgatctccagaggtcccttctgtc

SEQ ID NO: 28676 - DNA, 121 bp, Artificial Sequence
  Synthesized
  misc_feature (61): n=t or c
tggctaaaagatatttcttctaaggcgtgttccaagaagtgttcaggaaagatacagaacngctacctcaggaagggcaccaaaggataaacgtggccagttgttaccaagataaatgttt

SEQ ID NO: 28677 - DNA, 121 bp, Artificial Sequence
  Synthesized
  misc_feature (61): n=a or g
aaaagtgcctaaataaagaatgcaacctttaatcaaagtgctaagttgtcactgtgacccnctggagatggatatggatgactcagtccatcagagcttgtgcaaaaatacactgcaacag

SEQ ID NO: 28678 - DNA, 121 bp, Artificial Sequence
  Synthesized
  misc_feature (61): n=t or c
aaaaaaaaagtactcagttatttttccttctgtacaggaatggttgaaagaacagaaacantggacttctgacctccatagagaaaatgatgagctttggctcatttctatcaatcactca

SEQ ID NO: 28679 - DNA, 121 bp, Artificial Sequence
  Synthesized
  misc_feature (61): n=a or c
atggcgaactgcagggtgctctcacagcagaatttgggaaggaagcgataaatgtatgttntatggtaatgacatttaggtcttcagacacccaggccagttatcagcagaacaatccaag

SEQ ID NO: 28680 - DNA, 121 bp, Artificial Sequence
  Synthesized
  misc_feature (61): n=t or c
tgccaaatactaaactttgaattttatctcatcatttatcttaacttttacaaataaagtnttctgtcagcccctgcagcactccttcacgttaacacttcagactaattcttttttccag

SEQ ID NO: 28681 - DNA, 121 bp, Artificial Sequence
  Synthesized
  misc_feature (61): n=a or g
tggtaaaaaaaaaaaaaaaacaggtcttgagctcagtatcaaataagcacactgttgacanctcttccctatgtaaattacctttctgccaatcaatgttgatgcttttttggagtttctt

SEQ ID NO: 28682 - DNA, 121 bp, Artificial Sequence
  Synthesized
  misc_feature (61): n=a or g
taaattgttttaaatataaatcattgcatttcatttgtttggcagttaccttatgttctanaagctcactggcaaaattatagttgaatttccagttatggtcagccctcagaagcattta

SEQ ID NO: 28683 - DNA, 121 bp, Artificial Sequence
  Synthesized
  misc_feature (61): n=a or g
tcaaaggaatttgtccagtgttgagactataggattttttgccacaaagagcacttatgtnaatcatttatgtgatgctggttatttggcatgttgctttcatgtcagtgccaaatctctg

SEQ ID NO: 28684 - DNA, 121 bp, Artificial Sequence
  Synthesized
  misc_feature (61): n=a or g
ataccagtttctgagtgaaatgtgtgctgcctgtatgctagttggataaataagcaggatnacaggacaatgtggaatatactatggagataaaacgctgctcatgaatcttcatactagg

SEQ ID NO: 28685 - DNA, 121 bp, Artificial Sequence
  Synthesized
  misc_feature (61): n=a or g
atagtttgcaatttgtgggcccaggctcaaggactgctggctacaagtgaagtaaagcagncagtgaaataagagcatcccttacttcaatctggaagaagaaaatcaacactgctacact

SEQ ID NO: 28686 - DNA, 121 bp, Artificial Sequence
  Synthesized
  misc_feature (61): n=a or g
cgatgtaacacagaaaataaagacagacaattggaaaattgcagttccaaagactgtgctnaaataatttgtcttcccccttctcctgcactatgctttgtttccttgaccaaaaaatgaa

SEQ ID NO: 28687 - DNA, 121 bp, Artificial Sequence
  Synthesized
  misc_feature (61): n=t or c
aacagtggttgaacctctcactagtcctggtctgctgagctgagctttacaatctgatcantggattaccttttattagaatatgctattgtaagtgtgatgagggaatgtactacataca

SEQ ID NO: 28688 - DNA, 121 bp, Artificial Sequence
  Synthesized
  misc_feature (61): n=a or g
ttctccacttttctattgaaaatgactggtaaataaaatggtagcaccgcttttacagccngattgtttaagaaaagaatgactgcagctactggttttgagtgtctctgtgcatgtgctt

SEQ ID NO: 28689 - DNA, 121 bp, Artificial Sequence
  Synthesized
  misc_feature (61): n=t or c
tagaatgagattccagtttgtgcagcctttggggagaagggatgaacttaaatgtgtgtangctgagaagaacccacagcatgagcatgcaggtagatgtgcctgggaccccaggacggct

SEQ ID NO: 28690 - DNA, 121 bp, Artificial Sequence
  Synthesized
  misc_feature (61): n=t or c
atatcagaaaatctcaatgctattttatagtcaaaatgtacaaaatgacccgtatgttgantagttattcacttacagagccatcctccctctttgagacagcatccctatgtaattagcc

SEQ ID NO: 28691 - DNA, 121 bp, Artificial Sequence
  Synthesized
  misc_feature (61): n=t or g
cactcatgcatctaaactagataggaataggatggctgaacaaaccaatttaaagttgtcngagtgaaatctgtgataaaaggtcttgaaagctatcctgaaaatccaggaactgatccag

SEQ ID NO: 28692 - DNA, 121 bp, Artificial Sequence
  Synthesized
  misc_feature (61): n=t or c
cctgccccaaagctggagccaaggaaacccccgcgacccaaccgtaaggcaaaggtctttnctgcttcttctttatcgtaatattattgttattttttgcatcatgagaagtctgaacatc

SEQ ID NO: 28693 - DNA, 121 bp, Artificial Sequence
  Synthesized
  misc_feature (61): n=t or c
tcttgaaatgctccccagagaacccatctgccagatttgaagtagaaaacaattttgttgngggcctcacagcaagtgaaattgcctagccttatttagaggtgacatcagacgtgcatgc

SEQ ID NO: 28694 - DNA, 121 bp, Artificial Sequence
  Synthesized
  misc_feature (61): n=t or c
ttgatataatgacatttactgtccatatatttccttttatctttgaaaggattgtcacttnacagttcgtggaggcaggctaaaggaaaatggagagtaccagctgcctgtagttgttctt

SEQ ID NO: 28695 - DNA, 121 bp, Artificial Sequence
  Synthesized
  misc_feature (61): n=a or c
taacgaaaccaatagatggtatagatttaaatcttgttaggaatcaggactgcagtcgttnaatgtgcaggctgtgaagtgaggatatcagcactgccctggcttacaggcaataattgat

SEQ ID NO: 28696 - DNA, 121 bp, Artificial Sequence
  Synthesized
  misc_feature (61): n=a or g
atagcttggtgaaagctgctttcatcctgaatgcaaaaacatttgggttttgctgaagagngtttggaaatggaggttttcctcttccacgcagaaaggagaagataacaaaaagcaaaag

SEQ ID NO: 28697 - DNA, 121 bp, Artificial Sequence
  Synthesized
  misc_feature (61): n=t or c
agttagtaatgctccttgaacatgtatagaaacattatttcaacataaccatttctttacnctaattccaacaaatatcacctagaatgttttatcagtgagctcctgaaaggccaaagtt

SEQ ID NO: 28698 - DNA, 121 bp, Artificial Sequence
  Synthesized
  misc_feature (61): n=a or t
tgttactgcttgctaggtacgagttgtgaattctaggtatgtatgaatttccagatacacngtgaatatcacgtggcattgatggtagatgctcttcaaggagaacacgttgttttgtctg

SEQ ID NO: 28699 - DNA, 121 bp, Artificial Sequence
  Synthesized
  misc_feature (61): n=a or t
caaacaatactcatgtgttggaagaccaatacagcagaagatacttcccagtcaagatcanacattgcaaaggcaaaatattacatgcagcatgtatgaggtaaggttttgtgtccaaggc

SEQ ID NO: 28700 - DNA, 121 bp, Artificial Sequence
  Synthesized
  misc_feature (61): n=a or g
tctgctggtgctcagtttttgatccctagagagaccccagcctatggcaatataactgtangcaagtgtgtctgtgtagctgcatctgtttattgtactaacaggagccagaattatgtgg

SEQ ID NO: 28701 - DNA, 121 bp, Artificial Sequence
  Synthesized
  misc_feature (61): n=a or g
cagacataattacgtggtctaaaaatgatttatataaacattcgacaacattcgcttggancttaccatgcctgaaaacatccgtgtcaataaaactgattcagagaaatgcctgcaaaaa

SEQ ID NO: 28702 - DNA, 121 bp, Artificial Sequence
  Synthesized
  misc_feature (61): n=a or g
cagctgcatttgccattttcccatttctactgacatatatggtattgcctcaccaagaaantaactgcaacaggttacaaatatttaagatttaaaccttatgttttgaactgaagcaaca

SEQ ID NO: 28703 - DNA, 121 bp, Artificial Sequence
  Synthesized
  misc_feature (61): n=a or g
ctgaaattactctccaggggaattaactgcttatttcatttaaaatctcttatgctttcanatgcctttgctgtgatttatgctaatgtcttttcataacttcggtcattctcatctggca

SEQ ID NO: 28704 - DNA, 121 bp, Artificial Sequence
  Synthesized
  misc_feature (61): n=t or g
tgtggataaggaacttaaaatgtgatactttttaattcccttttattcttgcacaaacccntaatgcagtttcttgccactagatggagattgcacatctttaaataatgtgcatggagtt

SEQ ID NO: 28705 - DNA, 121 bp, Artificial Sequence
  Synthesized
  misc_feature (61): n=t or c
gaggacacacagagtctgctttctaaagagcgcgattaccagaagtggcacaaatgtgttnggtgcagaaagcagaggtgggctgaaggaaaactgaggctttctttgccttctgctgttc

SEQ ID NO: 28706 - DNA, 121 bp, Artificial Sequence
  Synthesized
  misc_feature (61): n=t or c
tgtgggcagctctgcccacttttcaaatcaaagtgacatgtttcataggggtctcttccantgattatcaaaggagcttagatgaattgctttgaccagccacctcattttagaaagccag

SEQ ID NO: 28707 - DNA, 121 bp, Artificial Sequence
  Synthesized
  misc_feature (61): n=a or g
tggtcagctaacaagtgagaataatgcattgactggatatagtatatctggagatataccnttaaggacacattgtgatatataaaaataggagtaatatgaaatgttaaatattgagagt

SEQ ID NO: 28708 - DNA, 121 bp, Artificial Sequence
  Synthesized
  misc_feature (61): n=a or g
cctgaccagtatcgaggctgaccatgtgctcctgatagacacgcacccacacacaggtatncatatatagacatgtatacccacacagtcctacagatcaacactgacaggcacaatcagc

SEQ ID NO: 28709 - DNA, 121 bp, Artificial Sequence
  Synthesized
  misc_feature (61): n=a or c
taaggattatgaagttttatgacacatacatcactctgatgtaatacttccttttttgaanattttcattccagatattccaacagggaagagaatgttttcacagtccgagaaatcagaa

SEQ ID NO: 28710 - DNA, 121 bp, Artificial Sequence
  Synthesized
  misc_feature (61): n=a or g
ggcatggctcagagtgggccatagtcctttatgctatgaatagcctatcttagcatggtgnttttacattgaagagtgcctttggccatgtttccagaagagcaccttcagcagcacaact

SEQ ID NO: 28711 - DNA, 121 bp, Artificial Sequence
  Synthesized
  misc_feature (61): n=c or g
ctaaaaggaggagctggtgctggtggaaaaattgttagacatgactttcaagaaatggcantttctgccaagctcttatgcgcatttctctgggggggaaaaaggctttattagcttttct

SEQ ID NO: 28712 - DNA, 121 bp, Artificial Sequence
  Synthesized
  misc_feature (61): n=a or t
tttggaagcttcagatgtaggaagaggcctcaagtataggcctcaggcattagtgcagtgncagaggtttttaggtgtgggtagcacatttcatctcttcaaaatgaaaatttggagggta

SEQ ID NO: 28713 - DNA, 121 bp, Artificial Sequence
  Synthesized
  misc_feature (61): n=a or g
tatcttgccctagaagaagagatgctctaaatcccagaatgcaacatatttcagcaccacnatctatattatgtgcttactctgcaggaaggaggacatccttcttgaggagcagctgtta

SEQ ID NO: 28714 - DNA, 121 bp, Artificial Sequence
  Synthesized
  misc_feature (61): n=t or c
tgactgatctgtcagtcattcacaatctttttttttaagtaatccatgtttagttcgtgtngtgccaatgtgaattctgcactcgctttgagagaccctgccagtgctatggctgggactg

SEQ ID NO: 28715 - DNA, 121 bp, Artificial Sequence
  Synthesized
  misc_feature (61): n=t or c
tctctctcattttttatgacaattttgatttttttgtctcacaatggatacacgttcaatncatggtcatagcaattactggttaaagcaacctcagggtaactccatgagctgaggtggg

SEQ ID NO: 28716 - DNA, 121 bp, Artificial Sequence
  Synthesized
  misc_feature (61): n=t or c
gtgcattgcttcttttttccagaggattctacagttcttaagcagtagtctaaagccactntatgctgaaagtgggatatgagagtttcctgcttccccaggctaagaggctcaaagtctg

SEQ ID NO: 28717 - DNA, 121 bp, Artificial Sequence
  Synthesized
  misc_feature (61): n=a or c
aacccagggctgagacagcaaaggagggacagaggtgagctgcccaggtttagaagcagancgacaggaaggcaagagctgaaagctctgtgggagggctttccagcagctgccactcgac

SEQ ID NO: 28718 - DNA, 121 bp, Artificial Sequence
  Synthesized
  misc_feature (61): n=a or g
tcccattgctggagagcagagagggataaaagcaggtactgatagatatttccagaagacngacagcgcattcgctgctgacagcactcccagaaagaagtgctctcactcagagcccaca

SEQ ID NO: 28719 - DNA, 121 bp, Artificial Sequence
  Synthesized
  misc_feature (61): n=a or t
caagcaatcactgcaagctcagccatggaacatctaaggaaaaaagctgctgccccatctnctcagaatacatcagttcagtaattaggtgtattaagagctgcgtctgtcgcatttcact

SEQ ID NO: 28720 - DNA, 121 bp, Artificial Sequence
  Synthesized
  misc_feature (61): n=a or t
aatgcaaccaacaactgcccagcagtgagtaatgaaaacagaccaaacagcagcagatatntccaagaacaggaaaccagccctagaagcaaacacaatctcacagaacccattcactcca

SEQ ID NO: 28721 - DNA, 121 bp, Artificial Sequence
  Synthesized
  misc_feature (61): n=a or c
catttctccttttcctatcccactaaagacctccaccaaaagccaggtccggtgcactagntggagtgtcagtatgacaaaggcctgatggcacttgtgtactgcttacatctctggtttc

SEQ ID NO: 28722 - DNA, 121 bp, Artificial Sequence
  Synthesized
  misc_feature (61): n=a or g
gggtgagggagaagatgaaaagaaagggaatgttaagataccagtggaacagacaccaaantggactgactgctcaagaagaagaatgacttcattgcatgctgactgtcttgcatgactg

SEQ ID NO: 28723 - DNA, 121 bp, Artificial Sequence
  Synthesized
  misc_feature (61): n=t or c
aggtggctgttcagatagtggctggaaatgaagagttcctggtggaaaatagcttatcttngtgtaagtctcgttacatgtgcagatctgtggactgtgtggtgaaaatatattgttgcat

SEQ ID NO: 28724 - DNA, 121 bp, Artificial Sequence
  Synthesized
  misc_feature (61): n=c or g
tgtgtgcttttacaagagaaccaaagttatatgaactcagatgagaagaaagatgactcantgggtgaatcgggagggctgttccgctgcagggatggctaagatcactgcagagttattg

SEQ ID NO: 28725 - DNA, 121 bp, Artificial Sequence
  Synthesized
  misc_feature (61): n=a or c
tcagctgggaggtgttcattgcagggccttggagagagttcttggaaggtgtaacaaagcnttgggcccctctagaggctgattttccacgtgggggtgtgtctgtgtgtctgtctgtccg

SEQ ID NO: 28726 - DNA, 121 bp, Artificial Sequence
  Synthesized
  misc_feature (61): n=t or c
aggagacatcaccagagcggtactgacactttcaagtatctaccatgtaatgatagcacancttctatgcagtatccacaggtctgtatgggcttctttcagtgatgctaatttactaata

SEQ ID NO: 28727 - DNA, 121 bp, Artificial Sequence
  Synthesized
  misc_feature (61): n=c or g
atcacaagggtataatgacaacctttaagaaccaattacagccagaagctggacttagagntttgagtaaactagtgaacatgtttggtgaccccatattagataaatcctcttgaataac

SEQ ID NO: 28728 - DNA, 121 bp, Artificial Sequence
  Synthesized
  misc_feature (61): n=a or g
gctctgtagtctgatttacaagatatgctcctgtgttggcaaaatgcgttactgctgactnctctcttgcaccagtgaattgagatattaaaatggatgtgatcaaatgcaatttgaacta

SEQ ID NO: 28729 - DNA, 121 bp, Artificial Sequence
  Synthesized
  misc_feature (61): n=a or g
ttcctcaggaaaatgtctggtcgggggaatttgctttgagtattggattcataatactctntaagtaagtctgccctgagcaagtgaaagatactggttatcttacagtcatgcatttaaa

SEQ ID NO: 28730 - DNA, 121 bp, Artificial Sequence
  Synthesized
  misc_feature (61): n=t or c
tttaagggggcgttgcaaacagttcacggggaacgttaagcctacgacgcgaggtctgtangtgcagatgcaatgcttcgtatagggtcagagtttggaatattgcagatttacatgtgct

SEQ ID NO: 28731 - DNA, 121 bp, Artificial Sequence
  Synthesized
  misc_feature (61): n=t or c
agagaccatattgactctttccaagctgttatggtctattagataaatattatcttggttngggattgtgatagttttctatacgcagtttcctgacaagccatatgggctttcagataaa

SEQ ID NO: 28732 - DNA, 121 bp, Artificial Sequence
  Synthesized
  misc_feature (61): n=t or c
atgaagttcttgcatgattccattcaaaaaaatatgcagaataaaatctaatgtttgccanggtggttttcagttgttatgatttgacagactaacaataatttccttattattctgtaga

SEQ ID NO: 28733 - DNA, 121 bp, Artificial Sequence
  Synthesized
  misc_feature (61): n=t or c
gcttccatggtgcatggagaactgatggctgcggggttttgtgagcagttatatgagtgcnttctcgcaggtgtttccccaccaccatcccattcctttccccactcccctccccacccca

SEQ ID NO: 28734 - DNA, 121 bp, Artificial Sequence
  Synthesized
  misc_feature (61): n=a or g
gcttctgtgttctcatgacaaactactgtggactcagaaaaatcttgtgcttatatttagncttgagagaaagacatgtgccctgatggcagtgcagaaactacctgaccctgtgccatgc

SEQ ID NO: 28735 - DNA, 121 bp, Artificial Sequence
  Synthesized
  misc_feature (61): n=t or c
gccaccacagcttgaatacttgctgcgaaatgtagagcagaatgatccccattgagctgcnttgtctccatgtcttacccttccagagatatctggagggggggacctcttccttcagaca

SEQ ID NO: 28736 - DNA, 121 bp, Artificial Sequence
  Synthesized
  misc_feature (61): n=a or t
gaagaaaatctccttttcttaccattttattatctgaaggcctaaacagacataaatcacngtatcgtaatagcgtaaagcatcattatcatttcattatattcagtcatgagtgacactg

SEQ ID NO: 28737 - DNA, 121 bp, Artificial Sequence
  Synthesized
  misc_feature (61): n=a or g
tccactacctgcctactgcagtcacagaccacgactatttctgtctgagaagtgcagcacngactgctttccacctacacaacataggaagctgaaagtcacaaagcgctgctttgctgca

SEQ ID NO: 28738 - DNA, 121 bp, Artificial Sequence
  Synthesized
  misc_feature (61): n=t or c
atacaataacatgctaaaatgtggggttttcttttgcctttcaggggcattaggaataggnatccttcacagaaaagccctagtctgagcctcttaccatttgtttgcactgtgtctatct

SEQ ID NO: 28739 - DNA, 121 bp, Artificial Sequence
  Synthesized
  misc_feature (61): n=t or g
gaggaaagtaaggagggatagcaaaattcagactggattaatgggtgagtaggataatagntctgtggactatcaactgtactgagccctcatactttggcaagcttctatgttcagatgc

SEQ ID NO: 28740 - DNA, 121 bp, Artificial Sequence
  Synthesized
  misc_feature (61): n=a or t
gtatggacactgggctctgacaacttatttggagaacgaaccctaaagaacaaaacttacntcagcacaagcaaaaatctgaactgcaacaagaagctggagcagatgtacgactgaatgt

SEQ ID NO: 28741 - DNA, 121 bp, Artificial Sequence
  Synthesized
  misc_feature (61): n=a or g
ttaagtttggggggggagaaggggggcaacttttactgttatcaacaacaaaccttcccangcttttcttactcagtagagctacatttcagtagccgtaaaccaattttaaaagtactgc

SEQ ID NO: 28742 - DNA, 121 bp, Artificial Sequence
  Synthesized
  misc_feature (61): n=t or c
tatttgcttctcttctacaaagccaactggctgtgaagtctctgcggttacttcgcacagnactccttgcagcttctgaatgctctctgtgaaataaaagataaaacaacgtcgcgtctgg

SEQ ID NO: 28743 - DNA, 121 bp, Artificial Sequence
  Synthesized
  misc_feature (61): n=a or g
gctgatggagcttttgtcccttcaggtcactgccttaccttatgtgctgtgggtgggtttnaggtggtgctgggagccgaacttttgtttcatgtcgttgtgttctcagggtgtttgtgca

SEQ ID NO: 28744 - DNA, 121 bp, Artificial Sequence
  Synthesized
  misc_feature (61): n=t or c
aaaaaatgtgcaaacagatctcacttttgtagcaaggtgaagagtggcactctagaaaggngtgaggaaagatatgcacagcaaaaaaaaaaaagaaagagatcatgcacttttttaagac

SEQ ID NO: 28745 - DNA, 121 bp, Artificial Sequence
  Synthesized
  misc_feature (61): n=a or g
gtgtgcagggcagcaaagagcagagctgcttgagatggctgcctccaaggtcaaaggttgnagtcgcggcggctgtggaggaatgttccttttcatcatgtctgtcaacctcacaacaaat

SEQ ID NO: 28746 - DNA, 121 bp, Artificial Sequence
  Synthesized
  misc_feature (61): n=t or c
aacattcctggtgtcatctttccccaactataactttgtatgtatggttcttgcatttcangttacaacacggctgtatatacacttagtgtgggcttatacatccaggctgtgccaggtg

SEQ ID NO: 28747 - DNA, 121 bp, Artificial Sequence
  Synthesized
  misc_feature (61): n=t or c
gtcagattcctcccatgcactttcacttacctgctcataagccatgaacttgatggcagantctggtgcaatcttcagcacgttgatgccattccccctccacagtgaccttgttccaccc

SEQ ID NO: 28748 - DNA, 121 bp, Artificial Sequence
  Synthesized
  misc_feature (61): n=a or g
ttcattcccgtcctctgagcaacctgtgatgtgaagtgcccatcaggaatcttctaacaangagtcccatagcagcgtgcacaacccaccagagctgttgagtcagctgctgattactgtt

SEQ ID NO: 28749 - DNA, 121 bp, Artificial Sequence
  Synthesized
  misc_feature (61): n=a or g
catattccagagaagccaagtgcataattagtagttacctatcagtgagtcatatttgttnaagtagcctttaacttacagtcatctccagacagaaaggtggacaaagttatctaaagaa

SEQ ID NO: 28750 - DNA, 121 bp, Artificial Sequence
  Synthesized
  misc_feature (61): n=t or c
aaggaaatacacacaatattaatcccgtaacttccactgctattcagagctatggttcaanggctctaatgcaaatttaattgctatactattttgtatatagctccacagtgttgattcc

SEQ ID NO: 28751 - DNA, 121 bp, Artificial Sequence
  Synthesized
  misc_feature (61): n=a or g
gcattttaatttacggtatttgacactagttacaagaacgttgatttttcttaagccttancacagttatggcatataaaatctgaatttcagcaaatacttttaacataaattaaggtag

SEQ ID NO: 28752 - DNA, 121 bp, Artificial Sequence
  Synthesized
  misc_feature (61): n=a or g
cgttcctcccttgacgatagtttgtgtattttaaataaagatttcattctgccaacccgcnggaagcttttaacaagatgcagctgagcgtgtcgatatcttatatctttttactgctgct

SEQ ID NO: 28753 - DNA, 121 bp, Artificial Sequence
  Synthesized
  misc_feature (61): n=a or g
tgcttccacctcactaaggaggcagccgtgtttttccaggactcagccctccctcctcgcngtacagctcatttatgccgagatggattctcatttattccccaggatggaacgagctcac

SEQ ID NO: 28754 - DNA, 121 bp, Artificial Sequence
  Synthesized
  misc_feature (61): n=a or g
atgctgaagagattaaccaacttatatatttttgtgctcaagtttacatatggaataaggnctacattcacacaaaggcaggcagtgttgatatggctaagttttaagtgccagaaccagg

SEQ ID NO: 28755 - DNA, 121 bp, Artificial Sequence
  Synthesized
  misc_feature (61): n=t or g
aggactcgctagatctttttgtttagtttgcttctaatgtataatttctaccgtgtgaganaaaagctttccctattacacagtttaatgttttgctttcaagtaattgaggaacacaaac

SEQ ID NO: 28756 - DNA, 121 bp, Artificial Sequence
  Synthesized
  misc_feature (61): n=a or c
tcttctcctgcaagtgaaatgcttctggggaaggagcacctgcttccacgtactgtttctntctctctctcttattgtggccatctgctttgtcagagaagcctagtgctggaggtgctga

SEQ ID NO: 28757 - DNA, 121 bp, Artificial Sequence
  Synthesized
  misc_feature (61): n=t or c
ttgcacccaaaggtgcttctctaatgacactttccagttgcttgctcagatgtggatgccnggagttgagtttgaaaactttcatagtgatcccaaatgataggaaatgcatgcatttttt

SEQ ID NO: 28758 - DNA, 121 bp, Artificial Sequence
  Synthesized
  misc_feature (61): n=a or g
actgaacaggaacaaaggtactcatttccagttatcccctgtgacctgaagcaaaacacanctctatccaaaaaaagtgcctgaaggcactttttcttcaacctaagaaaataatttacag

SEQ ID NO: 28759 - DNA, 121 bp, Artificial Sequence
  Synthesized
  misc_feature (61): n=c or g
ggactcagatgaaagaccatgtatacatgcatggacttgtctgtgcaagcagcactaggantgcttgcaaaaaagggtatcatgcatcaagttgggatgaatttggaagcagtgcatgagc

SEQ ID NO: 28760 - DNA, 121 bp, Artificial Sequence
  Synthesized
  misc_feature (61): n=a or g
tggggagcccaggattttcacaacatttccacgcaacaaatcacagagccgagccacatcnacaaccagagaggatggcagaagttgagtcctcaggacattacagatctggagcaaatgg

SEQ ID NO: 28761 - DNA, 121 bp, Artificial Sequence
  Synthesized
  misc_feature (61): n=t or c
aaactgcatatatttcctgctagactaccacagaagtggatttttggatttttacaatagngtaattgaaaatacagctcataaattaaaatacaaaaagtagtaacaactaactagaaca

SEQ ID NO: 28762 - DNA, 121 bp, Artificial Sequence
  Synthesized
  misc_feature (61): n=a or g
atgggtattagtcacaagcagacttcagtaagggatatatgtctaatttgggcagtgatangagggttcttcagatgcagaaaatacacagttttaaaagctatagattttcacatgctta

SEQ ID NO: 28763 - DNA, 121 bp, Artificial Sequence
  Synthesized
  misc_feature (61): n=a or c
tgagactgttcagccatcaagaagaaggagagtgctctgcttttcctagtcttactgatgncattaattggtatttaaatagttctctgctcgggaacataaatatcacagaaaagaaaga

SEQ ID NO: 28764 - DNA, 121 bp, Artificial Sequence
  Synthesized
  misc_feature (61): n=t or g
cttcagtgacttctccctctgatatcttttttcccttcaaatatcacagatttgcccaatngggtcagtcacgtaagaaagccctaaaattgctccacgctgagatgtccctgccttgcct

SEQ ID NO: 28765 - DNA, 121 bp, Artificial Sequence
  Synthesized
  misc_feature (61): n=t or c
tgaataattcgtgctctcacaactgacttgacatcttccactcctggaaaacttgtaattntgctgtaaggtccctgaagtagctgtaagcaaaacaacaagaaaaggacctggtctcttc

SEQ ID NO: 28766 - DNA, 121 bp, Artificial Sequence
  Synthesized
  misc_feature (61): n=a or g
ttgaatgcacactcacttccctattactgctggtctgctgaacaacttcctgagggcagangaaagccatcttcctgcagtcagtatgaagaaggaatcaggaggtaaatgaaagacaaac

SEQ ID NO: 28767 - DNA, 121 bp, Artificial Sequence
  Synthesized
  misc_feature (61): n=a or g
tcattttccaaagaatctgccatgtttaatatcccacatgcaaaacattctgcttgtaaanctatctgatctgcttacagactccacagagaaggcttgattcatgaacgtcaggacactc

SEQ ID NO: 28768 - DNA, 121 bp, Artificial Sequence
  Synthesized
  misc_feature (61): n=t or c
tgctaccttgtattaaagcttaaatgaaaaatgctctgtagacctgtgtggactgtggctnatctctatgttcctgcctgccagagcagcatccttttgtttgttgcagacttcaaactga

SEQ ID NO: 28769 - DNA, 121 bp, Artificial Sequence
  Synthesized
  misc_feature (61): n=c or g
aaattgttctctccttgtgtgtggtcagtgatgtggatgctttgttttcacaaaactgatnatgaaggaatttttatttttggatggtctgtaggatgcagtgtaatacatcaaaagaaat

SEQ ID NO: 28770 - DNA, 121 bp, Artificial Sequence
  Synthesized
  misc_feature (61): n=a or t
aaatttgtttagagaaaatttttttttttttttttttgttattctgctatattccttttangtatatgtaacacatacagcacacatatataatgtatgtccgtacaggaacatatatgtg

SEQ ID NO: 28771 - DNA, 121 bp, Artificial Sequence
  Synthesized
  misc_feature (61): n=a or g
tgctgtgcttccccttgaattcctgtctcttgaaataacactaaagctggtaaggtggatnttaaacatgttattttggtaactgtatattaacagtccttctaaattaattgggagtttc

SEQ ID NO: 28772 - DNA, 121 bp, Artificial Sequence
  Synthesized
  misc_feature (61): n=c or g
gataattaaggaggcctttaagtagtatagcattgcgtagcagcattaaaacatctggaantctaattcttatatgactttggctttctgctacctagagtaaaaaaggaagaagcaatgc

SEQ ID NO: 28773 - DNA, 121 bp, Artificial Sequence
  Synthesized
  misc_feature (61): n=a or t
cagctcttgagtgtatttaatatacacgttgtttcctggagtacaaggaagaaacttgtgnaaatccatgtaagccttatataagaggaatataagaactcaggttttgtgtggaaaaact

SEQ ID NO: 28774 - DNA, 121 bp, Artificial Sequence
  Synthesized
  misc_feature (61): n=t or c
ttagtggaaccttttcttaagtataaccaacaaggaaactgtgaacaaaagtcaagattanaagaccctttttagtctgctgaactaatgcaactttcagatattttgaggaggattttgc

SEQ ID NO: 28775 - DNA, 121 bp, Artificial Sequence
  Synthesized
  misc_feature (61): n=a or g
gatgagctggaattgtttttctctttgttttatagattgggaatagaagcaagtgtttganactggatcccccaacacacatagcaacccggaacaccaccatttcttcactaggaaagat

SEQ ID NO: 28776 - DNA, 121 bp, Artificial Sequence
  Synthesized
  misc_feature (61): n=t or c
ttgcaggacctccagccccatggccaggccttcagcatggcacagcggatggaacacgctnaatctgtggaataaggcaacgtgtccaggcctttggcagccggtttctgtcactctgagc

SEQ ID NO: 28777 - DNA, 121 bp, Artificial Sequence
  Synthesized
  misc_feature (61): n=a or g
aatactggggggttctgcaatgagtgtcccatccttctgcatgcaaaacataatcaaagcntcacatccttctgttggaaagtgtttccaacttgtctaccgttaattattagaggtctgt

SEQ ID NO: 28778 - DNA, 121 bp, Artificial Sequence
  Synthesized
  misc_feature (61): n=t or g
ctgcatgcttcagattaaagtgggaaatggaagaagttttttggaaaatagcatcagactngggcaatactttgttttggaaggctctgtagcatttgagcctttgccgagaccttgcttt

SEQ ID NO: 28779 - DNA, 121 bp, Artificial Sequence
  Synthesized
  misc_feature (61): n=t or c
ggggccgggcgcccaaggagaccttgagtggagtcaacacaagacaacctctcctctgcancggttcagctcgaaacgacattaaacggctgtaattaaactcacagaaccccttggagaa

SEQ ID NO: 28780 - DNA, 121 bp, Artificial Sequence
  Synthesized
  misc_feature (61): n=a or g
gtagcctctcggttatcactctttgttttcctgatgcaggatctcacctgaccctttctgngagaggctgaaggaaatgagaacaggtacaaagtgaccaacaataaaaatactcctcctc

SEQ ID NO: 28781 - DNA, 121 bp, Artificial Sequence
  Synthesized
  misc_feature (61): n=c or g
taattatctttgtcctcacaaaaccatcagatgctgttccacttggtcaaacactgtcttnacagcgtttatttctgtaattctgctgctctaggagcagaaggcagcaggcttgcaagga

SEQ ID NO: 28782 - DNA, 121 bp, Artificial Sequence
  Synthesized
  misc_feature (61): n=a or g
tgttgagagggattcctgcaagggtatcactattaaagtttaaccaaagtattcacacacnaaaccaaaaatcttcaagattaaatgaaaagcaaattctaaacaaaataaacaatcagat

SEQ ID NO: 28783 - DNA, 121 bp, Artificial Sequence
  Synthesized
  misc_feature (61): n=a or g
atttttttaatacaaatattgagatgaaaatcagaggaaaacattcttttctcaaggagcnaaaacaagctctcaatcctataaggatgcagtgcttctggcttctaaagctagcttcagt

SEQ ID NO: 28784 - DNA, 121 bp, Artificial Sequence
  Synthesized
  misc_feature (61): n=a or g
gacaaaatggaaacctcacatcttctgctcagttcttccatagtgataagttaccattcantctccctgatgggatgtttcagaaaagaaaatgagaggccagctttagggaggagattgg

SEQ ID NO: 28785 - DNA, 121 bp, Artificial Sequence
  Synthesized
  misc_feature (61): n=a or g
cagatgcctgcatgagatggagatatgaagtgcattggcatttgggaggtcttgagagcanctgtgcagctcaacgcggtatggatgaagctcatgaaaatccccaggagctggcagcttc

SEQ ID NO: 28786 - DNA, 121 bp, Artificial Sequence
  Synthesized
  misc_feature (61): n=t or c
agtcaactcttgccaacttcggtgactttacaactctccaccaatacagccagtatgtttncttgttttactttattctctttctgaggtgtgaataatgatgagaaccacaagcaatact

SEQ ID NO: 28787 - DNA, 121 bp, Artificial Sequence
  Synthesized
  misc_feature (61): n=a or t
acatgagacattaagacctgtcagtatgacaaattgcacgatgtcagtgaataagtgtgtnggagggtaaatcttatcttatttaagagccaagctcataaaggtatgtctgtgtacaaat

SEQ ID NO: 28788 - DNA, 121 bp, Artificial Sequence
  Synthesized
  misc_feature (61): n=c or g
ctgttgattcagacttctaaggtgcagcaggttgatcaagtatttgaggcatctaccatanttgactgaagtatttatattacagccacagatctttctaggtagtgaatgctgttttatg

SEQ ID NO: 28789 - DNA, 121 bp, Artificial Sequence
  Synthesized
  misc_feature (61): n=t or c
gtgtggctcttctggctttgcgggagtgatgctgtatttggacaacaggatacatttgacnttgcttctgctgttagccaccatcccatggatgtgatgttgtcacggagccaggctggat

SEQ ID NO: 28790 - DNA, 121 bp, Artificial Sequence
  Synthesized
  misc_feature (61): n=t or g
aataacagaaacaaatggctggaggtagaaaagaatggaatcatcttaaattgaccctgcntacaggagaaaataggctcaggtgtctccggaagcattgttcttagtagctctatctcaa

SEQ ID NO: 28791 - DNA, 121 bp, Artificial Sequence
  Synthesized
  misc_feature (61): n=a or g
ggagctgccacgaggtacggctcgacaaggatgagcacaggtagttggaatgctgtggcantttcagatccatccatttgaagcagtgacagcactcagttccacagagccaaaaggtgca

SEQ ID NO: 28792 - DNA, 121 bp, Artificial Sequence
  Synthesized
  misc_feature (61): n=t or c
ccttgtggcagcccagagccccttgaaacactttgtctgcaatcacttcttttcaaggtanaaaccacagatgttttcccgcgttctttactggctgagcatatcccagcctccctaacca

SEQ ID NO: 28793 - DNA, 121 bp, Artificial Sequence
  Synthesized
  misc_feature (61): n=a or g
tgcctggactggccatcctgggagcagaataagtaagacttggaaatgctaggaggagganagaagctcccttttaaaacttaatgttactctgtggaagttagaataaccatgggattgg

SEQ ID NO: 28794 - DNA, 121 bp, Artificial Sequence
  Synthesized
  misc_feature (61): n=t or c
catcagggtcccctcctatgtgacaaacatggcaatagaaagcctctccatcaacaagcanaggcaccagccagaagtgaaagccacatggtgctcaacagcagttctgtgaacaaatgca

SEQ ID NO: 28795 - DNA, 121 bp, Artificial Sequence
  Synthesized
  misc_feature (61): n=a or t
tttgatggattagcattaacctacaggaaaaatcgacagatatctgtgtcagaatcattangcaaatgcacgcttacaccataaagactggtcttcaaacagtcgcacttctcacgtcatc

SEQ ID NO: 28796 - DNA, 121 bp, Artificial Sequence
  Synthesized
  misc_feature (61): n=a or g
ggagcctagttgtatagacctgctttaagcaggtttggacaacgtgttccaaatgccagcnaacgcttggaaccctgcctgtacagtagtctctattatatttcttttaacaaaaattggg

SEQ ID NO: 28797 - DNA, 121 bp, Artificial Sequence
  Synthesized
  misc_feature (61): n=a or c
ttgtagcagctcctatttctttgtgagcagtgtccatttctccttctgataagttgtgttncttttatagcaaacacagccaacttgagggatttacttcttagctgttcttctgggaaat

SEQ ID NO: 28798 - DNA, 121 bp, Artificial Sequence
  Synthesized
  misc_feature (61): n=a or t
gagtcaacgtccttctcacagtgaggctatcccatgggccacgtgaggctggagccaaggnatctccagtccagggcctcctcccttgccaacaacattttgtttatgaagaggagaattt

SEQ ID NO: 28799 - DNA, 121 bp, Artificial Sequence
  Synthesized
  misc_feature (61): n=a or c
acagaatctgtggcacttttgtaggttctgttgaatatctcctggaaaagtttatacatgngttataaactccttcacagtagaaaacaccactgaggatgaagagattagtgtttcgaga

SEQ ID NO: 28800 - DNA, 121 bp, Artificial Sequence
  Synthesized
  misc_feature (61): n=a or g
aatcaaaatttctgatagcttctgcttctaaatcaaattcttatgttatttctttattacnactgttatactggattgtccactcatttttatatcatgtgaatcagtggaaactgattca

SEQ ID NO: 28801 - DNA, 121 bp, Artificial Sequence
  Synthesized
  misc_feature (61): n=t or c
ttactcttgctcttgcccgggtgtgctttaacacagccaggaaatgaggatattgagtgtngtcttggaaagggtggaaaagatagttgcacgctgtcttcataccgttagacccacacta

SEQ ID NO: 28802 - DNA, 121 bp, Artificial Sequence
  Synthesized
  misc_feature (61): n=t or c
aatatctgtagatgaattttttttccatgagtcctgggctctatatgaatttttgtgttcnttgaacttggataaaagaactaggaaatattcagtcggcttcactgaaaaaaacctccac

SEQ ID NO: 28803 - DNA, 121 bp, Artificial Sequence
  Synthesized
  misc_feature (61): n=c or g
agcagaagcatgggcagagaggagagggagaggaggaggcttccttcaccatctgaagaanagggattatttaccaaccacagatacggttagattaatttctatgttctgtgtgtatggc

SEQ ID NO: 28804 - DNA, 121 bp, Artificial Sequence
  Synthesized
  misc_feature (61): n=c or g
ctgtaaatttttgcttcttcaaacggcacaaactataaccatttgggaaggtagctccatnttacaaaaccttcacatcattctcaggcttctaagactgattatgggcctttcctattcc

SEQ ID NO: 28805 - DNA, 121 bp, Artificial Sequence
  Synthesized
  misc_feature (61): n=t or c
ggactgccgccggtgctcaggggacaccacggccgtctcagagaacaccgagtcctccagnggcagcgtctgcaagtagtgaagtcctgagctcgtcagtggtgtctcgatgaggtcctgc

SEQ ID NO: 28806 - DNA, 121 bp, Artificial Sequence
  Synthesized
  misc_feature (61): n=a or g
ttccccattgcagctgttggggtctggggcggaagattcaccctaccggaaagaggcgaancattgcaagggaatttgggttaatcaggaagttaaatttgggtcaattggataggtctgg

SEQ ID NO: 28807 - DNA, 121 bp, Artificial Sequence
  Synthesized
  misc_feature (61): n=a or g
ctaccttgaatccatctataatattagctttctaaaagatttcctacaataacgcaacacncaatgtatagaggagattaaacatcctatcattatatggaaacagtgagcaattattact

SEQ ID NO: 28808 - DNA, 121 bp, Artificial Sequence
  Synthesized
  misc_feature (61): n=t or g
cacacacacccacacagcccctacacccttaaataaatgtgcagagaagacttgcactaanctttcttgttagcaccagcactgaaaatgctgctcttcctttcattcccttcaatatact

SEQ ID NO: 28809 - DNA, 121 bp, Artificial Sequence
  Synthesized
  misc_feature (61): n=t or c
cgaggctggggtgcataggtggagtgagtctatgggtgaaagatgcatcctgcatcctccnggtggcaaaatctcctggaatgcttctgtcccatcactggtttttaggtgcttgggccca

SEQ ID NO: 28810 - DNA, 121 bp, Artificial Sequence
  Synthesized
  misc_feature (61): n=t or c
tgcacagtcagtccaggtgattgctattgaatactgtagtgactgtcagctgatggcctgnctccgtaattaggaaaaattgggtgtgtgctattcaactgtgtacttctggtttgacttg

SEQ ID NO: 28811 - DNA, 121 bp, Artificial Sequence
  Synthesized
  misc_feature (61): n=a or g
agaagtgagagagggccctggtgtgaggccagagatgcaacaaggggccttcaagggaacnttccagcagggacttcaataaacactgaatctcagaatcacagccacagcattaagagct

SEQ ID NO: 28812 - DNA, 121 bp, Artificial Sequence
  Synthesized
  misc_feature (61): n=t or c
tgacctggtgttatctacacaagctgcaatcataaccctaactgcagcataggcatacacngagccatgcctggaatccactttttcccctcacaaacttttgtactgtccagcaaccact

SEQ ID NO: 28813 - DNA, 121 bp, Artificial Sequence
  Synthesized
  misc_feature (61): n=a or g
gcaaacattttgtttaataaaaaaaaaaaaaagtactaaggaaaaaaggagctcttcatanctaaaacctgagctaaatgcatctgaaaacagttccgaccagctttctgctcgagttgtg

SEQ ID NO: 28814 - DNA, 121 bp, Artificial Sequence
  Synthesized
  misc_feature (61): n=a or g
agattttgcttgcagtctccttcttcaaaacttacttacggacacttggttgttctcagcnaggcacctttcctgccgcctttagatgcaaggaacaaggcttgggttttcaaacaagcag

SEQ ID NO: 28815 - DNA, 121 bp, Artificial Sequence
  Synthesized
  misc_feature (61): n=a or t
taagctatctctccatccactttggattttctgctcaggataatggttgaagttttgaaangttcatttgcagtaatttttctttagaagatttcccagaaatctcggtagaatttccatg

SEQ ID NO: 28816 - DNA, 121 bp, Artificial Sequence
  Synthesized
  misc_feature (61): n=a or g
tgggagttctggatggggctgtcaggaagatgcatgggtgagcacatatgtgagagatggncagagaccaacaaattactcctattcatagaatcataggatggcctgggttgaaaaggac

SEQ ID NO: 28817 - DNA, 121 bp, Artificial Sequence
  Synthesized
  misc_feature (61): n=t or c
gtttgatttaatatttggctttgagacatccaagatgaggtatctgaattatgcaaaaganagccctatttagtgctgtgaaatacatttaactcatttgaatttacatgtaaagttcatc

SEQ ID NO: 28818 - DNA, 121 bp, Artificial Sequence
  Synthesized
  misc_feature (61): n=a or g
ctctgtcaggatattttcgatacatgcctctcttataacttcacactggaaggtttcagtnggaacaacatgcaagatgactagtaatatcatttttatttctcatgttacagctgtgtgg

SEQ ID NO: 28819 - DNA, 121 bp, Artificial Sequence
  Synthesized
  misc_feature (61): n=a or c
cctctgaccagaaattaaagagaagtgctatatggagaagtcattaactgatatttaaagntgggaaatagaggaagtatgaggaaacctaaaatgtaaggcctatatttaacatctcttg

SEQ ID NO: 28820 - DNA, 121 bp, Artificial Sequence
  Synthesized
  misc_feature (61): n=t or c
cctgccccctcagtcacactgtgctccataggtgtacatccaggagtccctggttcagtangagagggacctgcaggagtgggaaagggagaaggagcggcaggcggtggagttcaccatc

SEQ ID NO: 28821 - DNA, 121 bp, Artificial Sequence
  Synthesized
  misc_feature (61): n=a or g
atgcacaatacatgaaacacgcatttgtacatgcagctatatacaaaatgctgtatcacantgaaaagtaaaaatgtgttttcctataaaatattccagaattacagatgaatgtttttca

SEQ ID NO: 28822 - DNA, 121 bp, Artificial Sequence
  Synthesized
  misc_feature (61): n=a or g
taaaaatgaagaatacaaaaacaaaggggtttatttttttctaaatctgttttcttattgntatctccagggatgttgctgctgcctatgcacacacactgccatgtttgcaactgacaat

SEQ ID NO: 28823 - DNA, 121 bp, Artificial Sequence
  Synthesized
  misc_feature (61): n=t or c
ttattttggttgttaaaacagtgaccaggcaagaaagttatagtttatgtcccgtaaaaantaatgtgaatgactagaaaacaaatattttgagctggttcaccaccgaatcaaatttaaa

SEQ ID NO: 28824 - DNA, 121 bp, Artificial Sequence
  Synthesized
  misc_feature (61): n=t or c
ttcactcttctgcttctggaattgctgtactgctatttgcagatcttggtaaatctccatntgatgcaactctaatttcagtatcaatatagttggtataaattgggttgtgtgtgtctct

SEQ ID NO: 28825 - DNA, 121 bp, Artificial Sequence
  Synthesized
  misc_feature (61): n=a or g
tttaagtctataagagaaatgcctgaagctggatacaggttggtgaatgaaggaaataacntcatagttactaagttttttacatcctgacctagctagaattcagtttctgcacttctca

SEQ ID NO: 28826 - DNA, 121 bp, Artificial Sequence
  Synthesized
  misc_feature (61): n=t or c
tttgtttatttaaacattacatcaatttaaataaaatggatctaaattccttcccagattnttactagaatccaaccaagtttatttggggtactaaaatgtcttctacccctaacctttt

SEQ ID NO: 28827 - DNA, 121 bp, Artificial Sequence
  Synthesized
  misc_feature (61): n=t or c
gtgcacagatacaatgcacaaaaatgtgaccttaagggttaaaaagataatacagagagantgcagttctatgtgaaaagctgtaaactgacgtcatggaacacaaagatgacagaaaagg

SEQ ID NO: 28828 - DNA, 121 bp, Artificial Sequence
  Synthesized
  misc_feature (61): n=a or g
gatgagcgccagctcttctcctgggctgcccttgtttttcttgctcctgttttcagctttntccagggttaatcaccaacggttctaaattccacccgtgatgaggggaaagggaaatgag

SEQ ID NO: 28829 - DNA, 121 bp, Artificial Sequence
  Synthesized
  misc_feature (61): n=a or c
gcaatggaaaaaatggtcattctgttgtacacacctggtttaaaagaatataactgagtgnaaatgagttcactttgagcaaacctcctatatttttagtttcatgccaacttatgtgcag

SEQ ID NO: 28830 - DNA, 121 bp, Artificial Sequence
  Synthesized
  misc_feature (61): n=t or c
ccactcccactgccagcactacgcccccatcagagccgagccctgctccgtgctcacacanatccctccaggtctgcaaaggatggagctgtttgcactttgatttttggtttggatgaca

SEQ ID NO: 28831 - DNA, 121 bp, Artificial Sequence
  Synthesized
  misc_feature (61): n=t or c
tccaagacaccaaacctgcagtgggaagaagccactctctgtgttttgtcttagcgtctgntcagaagatagttgtgaaagaggtgacaccaatggcaatatcagctgtatcgtgcagcag

SEQ ID NO: 28832 - DNA, 121 bp, Artificial Sequence
  Synthesized
  misc_feature (61): n=t or c
taaacagaagaaggtaagctttgtttagcccttgggctcaggttgaatgcatgacagatgntgaagctgtgaccaattagatttttaagcagtgagagcacattcatcaggtatgaagcat

SEQ ID NO: 28833 - DNA, 121 bp, Artificial Sequence
  Synthesized
  misc_feature (61): n=t or c
tcttactcttcggagtgcatcagtcttgagcttggaaatggtgcttgagtgtcaaccaaanctcttgtgccccctaccttccagtgctctcacccatggacgttccattccaggacaaaca

SEQ ID NO: 28834 - DNA, 121 bp, Artificial Sequence
  Synthesized
  misc_feature (61): n=c or g
tccatcacaacatctaatgtcttcccatagtcacaagcctttgcttaagttaccaattctncaaattctgccagatcacctcttggtatcaacacgcatcatttcatcgtaaaggcattat

SEQ ID NO: 28835 - DNA, 121 bp, Artificial Sequence
  Synthesized
  misc_feature (61): n=t or c
actgaggtctatctcacataaaagagaagggtgtggaaacaatcggcctttgataaatacngcacactaaaagcgcttgatcatggtgcccacctactacctctactacctctcaaaaagg

SEQ ID NO: 28836 - DNA, 121 bp, Artificial Sequence
  Synthesized
  misc_feature (61): n=c or g
gatggaaaatttttgccatccattttttatttttgaggtgatatgcatattgacactgganaataaaagtcagcccttctaatgtttcattcttatttggggggtttgaagtattactgtt

SEQ ID NO: 28837 - DNA, 121 bp, Artificial Sequence
  Synthesized
  misc_feature (61): n=t or c
aatattcaagttaccaggaagaaggtaggtgaagagaggaaagtgaatactgctgtgttcnacaccataaagttgttatcagtcaggcccaagcactgtggtttctaggcagaacatattt

SEQ ID NO: 28838 - DNA, 121 bp, Artificial Sequence
  Synthesized
  misc_feature (61): n=a or g
tgaacaatgtgtacattacgaggaaatgatctctgggcaacgaagtttaatgaacaaatcncagcagctgcagcactatcattatttgcactcatacagagctgggggggggaggaggggg

SEQ ID NO: 28839 - DNA, 121 bp, Artificial Sequence
  Synthesized
  misc_feature (61): n=t or g
gaacaggttagagactgaatttgctgtatatgttcttggggacgtatttgcgtagattaancttttcactgtacaaaccctaattcatgaatagtgccttcatttttcccattatcaggaa

SEQ ID NO: 28840 - DNA, 121 bp, Artificial Sequence
  Synthesized
  misc_feature (61): n=t or c
ttcacctcctccaaggggtagaatgagaatttgctgaggtgaaggtcctctgttctgccangcttaaggaatatgggctcaaaaacacccatgtgggctcttacttctccccttctctctt

SEQ ID NO: 28841 - DNA, 121 bp, Artificial Sequence
  Synthesized
  misc_feature (61): n=a or c
ctgaagcactcatgtagatcctaatgcaactggaaaataaggcacgtctttggaggagagnaacagactcctcttgcacgtgagcagcagaggctccctgtatgcaaaggtgacatatagg

SEQ ID NO: 28842 - DNA, 121 bp, Artificial Sequence
  Synthesized
  misc_feature (61): n=a or g
gcaaagactggggatggagagggccgtgaatagggcttgggaataggaatgggaatagggntgaagatgaggatgagaagactggcatggggatgggaatagggacagggatgaagtcagg

SEQ ID NO: 28843 - DNA, 121 bp, Artificial Sequence
  Synthesized
  misc_feature (61): n=a or g
ccactaaaacatggggaaaagaactcctacaaagtcctcataagcaggagcatgaaattgntgttggctgtacttatatgagcccagtctgtgtttgctttttgcagtgtttttgatagac

SEQ ID NO: 28844 - DNA, 121 bp, Artificial Sequence
  Synthesized
  misc_feature (61): n=a or g
acccacatttggaagctccgaagttcctatttctctctttgcataggttaaatatctgcantgaatactttggctaactattttaccctttgactccattcctccatccaaaagattcaat

SEQ ID NO: 28845 - DNA, 121 bp, Artificial Sequence
  Synthesized
  misc_feature (61): n=a or c
cacctatactgaggccatgtatctccccatacaaatcactacctccttcaaaagccatttncagctacaaactaccctgaagttctcaccaccctaccttttttgtagaaagaaaaagtca

SEQ ID NO: 28846 - DNA, 121 bp, Artificial Sequence
  Synthesized
  misc_feature (61): n=t or g
tgctttgccaacccatttcatctctgtctcctccctcattcttattttttatcagctctantttggatgcagagatggtgctgcttctcatttggtggctggcaccgcataaacacgacag

SEQ ID NO: 28847 - DNA, 121 bp, Artificial Sequence
  Synthesized
  misc_feature (61): n=a or t
ctcagtcttccttctgtaatatctgagagacgtgtactaattcatgctgtactttaatttntacatacgtatttttaattaccgtgacacaactgcccgtgtgtgaacacaaggaaagata

SEQ ID NO: 28848 - DNA, 121 bp, Artificial Sequence
  Synthesized
  misc_feature (61): n=t or c
ccaggtgctggattcacacctgtgctgtgatgcagcagcctgaggataccaggacgtggcnggaatgcttgcacaggagccagggaatgacttgttcagtccttcagcctgggctgtgcca

SEQ ID NO: 28849 - DNA, 121 bp, Artificial Sequence
  Synthesized
  misc_feature (61): n=a or g
agaacgttttcttgctgtgtagccagttgtgctctagaggcttcattaaaaaaaggtaccngtagcacaagttttcattaagcactgttttccttggggagttagaaactcagctcctaat

SEQ ID NO: 28850 - DNA, 121 bp, Artificial Sequence
  Synthesized
  misc_feature (61): n=t or c
cctcaatgaaagaactgtaaacccaggagaagacaaaaaattgtagaactgttacacagcngacagtgacactctagatgggaaataattaagtgtccatgtttagcttgagttgcatccc

SEQ ID NO: 28851 - DNA, 121 bp, Artificial Sequence
  Synthesized
  misc_feature (61): n=a or g
catccctccctggagagcttctgcctcgttttccctctgctcccaaccgtgcacaaaaggnaatgtgtccatctgccctcatctgtgctgagcatgtggctgcctgccgtgcagggatggc

SEQ ID NO: 28852 - DNA, 121 bp, Artificial Sequence
  Synthesized
  misc_feature (61): n=t or g
cagcagttcctccctataatactgtctgttgaccttggctggaggttggtgagatcagtgnagtcccttctgtcctgctcagcctctttgctcaatttggagctcaccacaccaccatgtg

SEQ ID NO: 28853 - DNA, 121 bp, Artificial Sequence
  Synthesized
  misc_feature (61): n=t or c
tcttgccaacaattattatataatgccctctaaactgtttcacgtctttctctttccacangtctacttacattagtacatagaggccttccttttgtactgatgcgctgcctcaatgtaa

SEQ ID NO: 28854 - DNA, 121 bp, Artificial Sequence
  Synthesized
  misc_feature (61): n=a or c
agccacagaggaggcttctcctgtctatcttctccagtggtgatactctaatattttttangcaatttgtccagactgagcaggaaatctaaggctgaggtggaccttatttcttggatgg

SEQ ID NO: 28855 - DNA, 121 bp, Artificial Sequence
  Synthesized
  misc_feature (61): n=a or g
tatcccagcacccttattactggtcaagataaaccagctgactgcatataagctcagatanatctagtatcccagtccagaacaatatgcttttaaagccggtagatgccaatgctttagg

SEQ ID NO: 28856 - DNA, 121 bp, Artificial Sequence
  Synthesized
  misc_feature (61): n=a or g
tgaatgctttttttattcattctttcaacacttgtgaagagacacagaggctgagatcaanaagacattgaatctggcaatttccccccccaaaattgtagttctgatgcaactaaaactt

SEQ ID NO: 28857 - DNA, 121 bp, Artificial Sequence
  Synthesized
  misc_feature (61): n=a or g
tgagccggagttaacacaagagcttttaacaggcctctgaaaaatagcctgtatgagagtntttctgtcactgtaatttcagtaagcttttagaagatgccttcagtttcatgtcaagtac

SEQ ID NO: 28858 - DNA, 121 bp, Artificial Sequence
  Synthesized
  misc_feature (61): n=t or c
tgttacttaaaaaggaatgagtggaaataacaaatgatacagggaatgaagtgttcaatgngtttttttggttgcttctccaaaaaatggttgattgtgattgtataataatgcagtaagt

SEQ ID NO: 28859 - DNA, 121 bp, Artificial Sequence
  Synthesized
  misc_feature (61): n=t or c
atggcttgacgcttttctgctactaccgaagtagcagagaaagtgccttgcaccggtaagnctacagatgcaccaagaaacagccccgtagtcctcattcaaaaacacagggctcgattcc

SEQ ID NO: 28860 - DNA, 121 bp, Artificial Sequence
  Synthesized
  misc_feature (61): n=a or c
agcactgaatgggaaataaattcataaagctccctttaaagtcatctacgggaattctgtngtttaacacagtctgttgcatttctttgtaactatgggaggatgactgctctcctataag

SEQ ID NO: 28861 - DNA, 121 bp, Artificial Sequence
  Synthesized
  misc_feature (61): n=c or g
ttagacagaatccaaaggagggctgcggagatggggaagggttgagctgcacaccaccctncagtgctctgttatggatcggtcctctaccaagagagccttgtgttgccctcacatatgg

SEQ ID NO: 28862 - DNA, 121 bp, Artificial Sequence
  Synthesized
  misc_feature (61): n=t or c
caatacagtttcattcatttgaacaaccctacacttgcactaaataattctctcagaaccnggtgttctacaaagacaccttccctcagcttgcatatagccagaacagactctgttgtgc

SEQ ID NO: 28863 - DNA, 121 bp, Artificial Sequence
  Synthesized
  misc_feature (61): n=t or g
gagattacatttgaataaggatgaaaatttgtcccttggaatagcatgtattgctctgcantccataacactttctgtgtttgaatcaagaatttaaaggacaatactgtttaatctacct

SEQ ID NO: 28864 - DNA, 121 bp, Artificial Sequence
  Synthesized
  misc_feature (61): n=a or g
ctacaaacaaattctcctgacctgaaccgtgttcggcagaggaaaatctgaacaaatacanctaatacagactttgcacttccagcctcatctgcctggtgccccacacaaccacaagccc

SEQ ID NO: 28865 - DNA, 121 bp, Artificial Sequence
  Synthesized
  misc_feature (61): n=a or g
ggaagaggagaaaatatgttaggtagagtatcttctgcttgtgtcaacgcgtagctgctcnaggtagggactcatcagtcacttctgagccgtgcctatcttccaacactcactttgttgc

SEQ ID NO: 28866 - DNA, 121 bp, Artificial Sequence
  Synthesized
  misc_feature (61): n=a or g
ttatttcacagctgaactctagcaggagacactgtgtctaccatgaattgttacttgcctnctaatgaagtattgagcagtatctgtggcacctcatcacttaagacatatctgtgagcaa

SEQ ID NO: 28867 - DNA, 121 bp, Artificial Sequence
  Synthesized
  misc_feature (61): n=a or g
gagaagatagtaacttaagaaagattatcataactagacctcatcagaaatgtttgggcantgtttgcttgggagtaaagagttcagtgatggagaagtaggaccggttatccttctgtga

SEQ ID NO: 28868 - DNA, 121 bp, Artificial Sequence
  Synthesized
  misc_feature (61): n=t or c
caacagggaagagaaaccaactcctccagcagtagcatactcaaatctaagccttgaaaancataacatctaccatagtactccgcacatactctaaaggaagcgtgcaaaaacttctgat

SEQ ID NO: 28869 - DNA, 121 bp, Artificial Sequence
  Synthesized
  misc_feature (61): n=t or c
aacaccccgtgctgactgtgtgtctattcctgttccttctggtaatccctgtcctctttgnccacatttcctgcgagtgttgttgaaggattttgatgtgtattaaccttcatttctggta

SEQ ID NO: 28870 - DNA, 121 bp, Artificial Sequence
  Synthesized
  misc_feature (61): n=t or c
gaatggctgcagcatttctgcttcaaatttacctgttactcctccaaaacagagggagtcntcttcctcaagcccacgtgcctttattcaagctacggctgtttctgcagctctgagtggc

SEQ ID NO: 28871 - DNA, 121 bp, Artificial Sequence
  Synthesized
  misc_feature (61): n=t or c
gaagctaatctggagaaaggcaaggacagctagggtggttgttgcagaccaatgatgaaantaaaagtgttattacgttgctcattaggaaagtgtagaaacatatcacaaaagatatcta

SEQ ID NO: 28872 - DNA, 121 bp, Artificial Sequence
  Synthesized
  misc_feature (61): n=a or g
tgtcctaagtggcactgaggtgcctgacaggactcagaggctgaggctcagcctgggaganctctggtcagatcagcacaatgaggctgtgggggactcacagctgcacacacatgagctg

SEQ ID NO: 28873 - DNA, 121 bp, Artificial Sequence
  Synthesized
  misc_feature (61): n=t or c
cagaattgcagctgagatgcagaagttccagctgctgaaatagctgctgagtccacgcagnctgacccctatttgtgtcagttgaacccaggggaaaagcccctctttttccccacagcca

SEQ ID NO: 28874 - DNA, 121 bp, Artificial Sequence
  Synthesized
  misc_feature (61): n=a or t
ttaagcaaccagtaaattatctgcaggaggttttgtagtttttcaatactacatactaaanaatattccctatactgccatataaacacagtgggatactgtcatttcttgtaaagtaact

SEQ ID NO: 28875 - DNA, 121 bp, Artificial Sequence
  Synthesized
  misc_feature (61): n=t or c
gtagaaatgtattctgtttaactgtgtggatttccatttgtcacttcacatattctatagngttagcaaacaatgtatttattatgtagtaatccagtagacttccaacaaggaatccatt

SEQ ID NO: 28876 - DNA, 121 bp, Artificial Sequence
  Synthesized
  misc_feature (61): n=t or c
aagaagtccttgttagtcagtccattgctgcaaaactatataaataggttcatactgcccnacaggtaagattacaaaagcagaaatgtgaaaagtactacctattcagagcaactattcc

SEQ ID NO: 28877 - DNA, 121 bp, Artificial Sequence
  Synthesized
  misc_feature (61): n=t or c
aatattgaatgcacatgtggcctccacacttcagaaaggatgtaatggacttagaaaaggncccagaagggtaactgaaaatatcaagtgggtgaaacagttgacttataaggacagactg

SEQ ID NO: 28878 - DNA, 121 bp, Artificial Sequence
  Synthesized
  misc_feature (61): n=a or g
tggttaaatgattcattctgacagtaaaactagcagttgatttctggtttcagtaagatcnttaaatcatcattaggttacttttaaccttagtacaataacaatttcttcacttacagtt

SEQ ID NO: 28879 - DNA, 121 bp, Artificial Sequence
  Synthesized
  misc_feature (61): n=a or g
tttagaaataattaaaacttgaaaaaaatcatagcaactgtttgggaaacaactcatactnagaaggcaaggacatttcagctaatcttggctacatctgatccagagaaccacagaattc

SEQ ID NO: 28880 - DNA, 121 bp, Artificial Sequence
  Synthesized
  misc_feature (61): n=t or g
gtaatcggtgggctacagtggtggcttgtgacatcccaaatacagtggtcaatgctggatncctccatgaaagtggtgaagccactatcatggggcagccagaaaggtggttgtggtaagc

SEQ ID NO: 28881 - DNA, 121 bp, Artificial Sequence
  Synthesized
  misc_feature (61): n=a or t
gattgctattttattttatatggcatattatgtattcttcagaataaccctctggtctacntgccctacataattatttcaaatgttgaatcaaaaatgctaatttttggagtagctcttc

SEQ ID NO: 28882 - DNA, 121 bp, Artificial Sequence
  Synthesized
  misc_feature (61): n=a or g
atgcatattgcaaaacatgagtgcattgtatgcacctagtgaaagtttttcattaactacntaatatgtagaatgtgtagtattgcattaaattggggaagatcaaatttgaaaagacatg

SEQ ID NO: 28883 - DNA, 121 bp, Artificial Sequence
  Synthesized
  misc_feature (61): n=a or g
gggaaccacagggatgttgagtgccgcagcttcattgggcactatactgctatgggacgtngatgggggcctcacacagatcgacaagtacctctattcctcagaggattacattaaggtg

SEQ ID NO: 28884 - DNA, 121 bp, Artificial Sequence
  Synthesized
  misc_feature (61): n=a or g
cggagagaggaaaatgcagcttgatttcccatctatcaactctctgatgcgtctcttaaanctacaacctgccctttcccacagcacagacaaaactgtggccgtaatgggtgacttcttt

SEQ ID NO: 28885 - DNA, 121 bp, Artificial Sequence
  Synthesized
  misc_feature (61): n=c or g
gataaaggtaggtttgccccagtcagagtgtgccttacaaataaggcaagtcttaaatcantgtgtctggtttggtgttttctgagctcttcagagtttgcacttgcagtcacattgtcag

SEQ ID NO: 28886 - DNA, 121 bp, Artificial Sequence
  Synthesized
  misc_feature (61): n=a or c
ctctgaagcttctccataggcaaaactgagcttctaagtgttgagtggactgtgagaatanggcatttgatatgctgaccttttcaacaaaggtcaaatgcatcattttggtagtgctgag

SEQ ID NO: 28887 - DNA, 121 bp, Artificial Sequence
  Synthesized
  misc_feature (61): n=a or g
gttctgtggccctataatgtggtaatgaaagtatgttcttaggttagaccaacctattccntttgatctattttgaattttattttactgttttcctttacctttgtgtctctgattactg

SEQ ID NO: 28888 - DNA, 121 bp, Artificial Sequence
  Synthesized
  misc_feature (61): n=t or c
atatggtgataagagtaaactgacaaagcatcatttgtattccaacagcacaggatttcangtgcagaaaaatgaacacgaactccattactgtatctttattagaaatccaaattcaaat

SEQ ID NO: 28889 - DNA, 121 bp, Artificial Sequence
  Synthesized
  misc_feature (61): n=t or c
ggttgagcaaatacctgaatctttgctgaagtcctggctctcaaatgcctcctgcatgtgngtctcctgagctcccagttcctttatgaggatttgagtgcccaagcgttagatgcgtaag

SEQ ID NO: 28890 - DNA, 121 bp, Artificial Sequence
  Synthesized
  misc_feature (61): n=a or c
atgttttagccatatccaaattgaagcaaaagctagagatctatagtgtaatgttagaaantagctgaaggtccagtccgtccaggaggaatcaactccaaagcagaggtgaacactcatg

SEQ ID NO: 28891 - DNA, 121 bp, Artificial Sequence
  Synthesized
  misc_feature (61): n=a or g
cacttggaggtgctgcagcaccctcagccatcactgtatgcatgcaggaggaaggttggcntggtctctgccctcccaaaaagcattccctgctgggagggctccctcagcctctgaagaa

SEQ ID NO: 28892 - DNA, 121 bp, Artificial Sequence
  Synthesized
  misc_feature (61): n=t or c
aagtgagtgacaaatccacagagataatctcaatttaagttagtacaaaaacagattacanggcggtcaggcagtaagtgccaacataatgggaggttttcattttgagtcagcagggaaa

SEQ ID NO: 28893 - DNA, 121 bp, Artificial Sequence
  Synthesized
  misc_feature (61): n=a or g
tatgaatataatttcatactgtaagtattggtaaggtccatctagagagtacagtttaacntgtgtctgtttttacaaagtggggactatagtataattgttaccggaacagatgatctaa

SEQ ID NO: 28894 - DNA, 121 bp, Artificial Sequence
  Synthesized
  misc_feature (61): n=a or c
tctgtaactgagtctcccataattatccaaaaaatttagtcctaaccagaataccatcttncagctgatcagcactgcaatttaagtgtcatacccctggtaggatctccctttgtaggct

SEQ ID NO: 28895 - DNA, 121 bp, Artificial Sequence
  Synthesized
  misc_feature (61): n=a or g
ggactcatttcctttgtgccattcaaataggctttcctagtttggctgatttccatctcantcatcctcccgggagtcaggaaacaatttcagttactgatttatactttaggacccatgt

SEQ ID NO: 28896 - DNA, 121 bp, Artificial Sequence
  Synthesized
  misc_feature (61): n=t or c
aggagacatgagatttctcaacgcatttcccttagaaaacagtctgactgcagtgaaatangcctctctgtctgaaaagttctgactggctttagggaagagtaaatagcaatgaagcagt

SEQ ID NO: 28897 - DNA, 121 bp, Artificial Sequence
  Synthesized
  misc_feature (61): n=a or c
atgtgctgaacaatttgaggaggtgtctccaaatgctgccatttggaactgttgccagttnatgtgagttagagcagccccaggttacggtggcacttgagagaaaagcactggatgggag

SEQ ID NO: 28898 - DNA, 121 bp, Artificial Sequence
  Synthesized
  misc_feature (61): n=a or g
gagattgtcgtcttttgaggaagagaactgagtttcttagaagtaataaatagcgaattgnccatgataaaccaggaaaattagattgaaaagggaatggtccttcctcagagaaaataac

SEQ ID NO: 28899 - DNA, 121 bp, Artificial Sequence
  Synthesized
  misc_feature (61): n=t or g
tatgccttgaggcgtattcttttcccatgtcattaagctcttcaggagggatgttgcactncatttctagctggccataaacacacagaaaataaagtagaaaaatccggatcatatttgt

SEQ ID NO: 28900 - DNA, 121 bp, Artificial Sequence
  Synthesized
  misc_feature (61): n=a or g
gttcatttctgtacttggaatcaaccccagatgactgagttcagcttccatgcagcagagnagaaaataaatacatgtgctgagctgccacctcattgcagatttttccagttagtaggct

SEQ ID NO: 28901 - DNA, 121 bp, Artificial Sequence
  Synthesized
  misc_feature (61): n=a or c
tggccctgtagggacaaacccttctcctgctcttggaatgactataaatagcccaaaatcncagcgtaggtgggtttgtttggttacggcagtgctgtgtggcaactctggctggatgccc

SEQ ID NO: 28902 - DNA, 121 bp, Artificial Sequence
  Synthesized
  misc_feature (61): n=t or g
cagaagctagaaagaaatctattatggagccagcctcccttaccagtttgagtgtatgctntctgagttgataatcatataggttaagcttgaattaaaatctggtacttctggaaaccct

SEQ ID NO: 28903 - DNA, 121 bp, Artificial Sequence
  Synthesized
  misc_feature (61): n=t or g
gatgagaaaaaagagctcctttattatataaggggaaattctggctctactgaagtatgtncagaaattctgttgacttccagtaacacagaaatgtacaaaacgtgatttacagtgggat

SEQ ID NO: 28904 - DNA, 121 bp, Artificial Sequence
  Synthesized
  misc_feature (61): n=a or g
agagtacttcggagataaagttacaagtctgagaaaacagagcatggtgtcagcattttcntaagacgtaagactggtggtgcacacaatacaccaaatagttttgtaaacaaatataaag

SEQ ID NO: 28905 - DNA, 121 bp, Artificial Sequence
  Synthesized
  misc_feature (61): n=a or t
cgtgcctgagacaagccgagacaaaataagctattctatctctgccttagtcccatagatngtcacagggagtgaagctaccttgctctttgacattattactgtcctggggatacctaaa

SEQ ID NO: 28906 - DNA, 121 bp, Artificial Sequence
  Synthesized
  misc_feature (61): n=a or g
ggagatggaatcagagaagggagttcctggctgattcctcctccaactcgtgctgtccatnttttcacgaacacgttcttgaccgcagaaacctggatcacaccgccaggaggggaaggaa

SEQ ID NO: 28907 - DNA, 121 bp, Artificial Sequence
  Synthesized
  misc_feature (61): n=t or c
gtggcgctggcttgcagcagcaattggctccatcagagcttctcatcctcctgcagcactnggaggaacaaagcataagtgacagcagtttggagcgctgtgtgtaatcacaattaaaaaa

SEQ ID NO: 28908 - DNA, 121 bp, Artificial Sequence
  Synthesized
  misc_feature (61): n=t or c
agaggggagaagtcaggagcttgctccagttagttttcataacaaatattgtgaagtaatnaaagtacctttacagaacacagaatgcaaatacaaatcatctcttatggtgctgttacta

SEQ ID NO: 28909 - DNA, 121 bp, Artificial Sequence
  Synthesized
  misc_feature (61): n=c or g
agctggaggagctggatgctgctgcttgctttcctggggtgggaacacccttggggtgacnggccttgcaatctctatgtatttaaagtgggagtttgatttaaaatgtggcttgccacga

SEQ ID NO: 28910 - DNA, 121 bp, Artificial Sequence
  Synthesized
  misc_feature (61): n=t or c
tctcatttaacaggtataatccagatattgtccagtgctgtattgctactgcttgtgttangatttaacttctgtcaaggaacttggaattgttgctgctattgctacatatatatcactt

SEQ ID NO: 28911 - DNA, 121 bp, Artificial Sequence
  Synthesized
  misc_feature (61): n=t or c
tcgggccagggaaactcccgcaaggaccgtcattatgtcacagcgtttgtcgcccggcatngtcctactcctcaaagcacagcccctgcagaggaccggtcccagccctcctgcagggcag

SEQ ID NO: 28912 - DNA, 121 bp, Artificial Sequence
  Synthesized
  misc_feature (61): n=t or c
cacaaagggacacagtaaccatctactgcctggcagaaactggaaggaatccactcctgangtggtttctgcaggacgcctacctgcaggcacagcaccacgagcacagctgggcccacac

SEQ ID NO: 28913 - DNA, 121 bp, Artificial Sequence
  Synthesized
  misc_feature (61): n=a or g
tcctcatcacagaatagtggaggccagcatggactcctccttggtccacacagacctctgngtccatctggtccaatctcccttctcacacagggacacccagagcaggttgcctaggacc

SEQ ID NO: 28914 - DNA, 121 bp, Artificial Sequence
  Synthesized
  misc_feature (61): n=t or c
aaaactggagtcactaacaggagatttgccaccatagcaacataaaaagatcagagaaagngtctccattttacttcacccctttctacattaagtgaacaacatttatcatacgtggagc

SEQ ID NO: 28915 - DNA, 121 bp, Artificial Sequence
  Synthesized
  misc_feature (61): n=c or g
tgtgaaggaaacagcattactggcagttttgcaaagctgtgtgaaatcttacaaaatttgngtgaactttggaactatttccttactgctggtagagttcataatatcaatatttttttct

SEQ ID NO: 28916 - DNA, 121 bp, Artificial Sequence
  Synthesized
  misc_feature (61): n=a or g
atacagctgaaatgtctccataaagagaaaagatacatcaaagcagatatcctgatgtaangaagtatgggaatttctagaacaaagcagaagtcctcagcagttctctgcactggttctt

SEQ ID NO: 28917 - DNA, 121 bp, Artificial Sequence
  Synthesized
  misc_feature (61): n=a or g
atggatatttcctagtttgacttgtatcagccagggagagaacatctgaaaagaacaaggnttcagacccagcactgataacaccaggaatcatgtagagagacttcttggaaatcacaac

SEQ ID NO: 28918 - DNA, 121 bp, Artificial Sequence
  Synthesized
  misc_feature (61): n=a or g
agagacaattagcagcaatggtgagctcgatgcatatgttatgagttaactggcagagagnatacaatgcattttctttaatatgtttagacaatgagctgaagtagacatgacctgctga

SEQ ID NO: 28919 - DNA, 121 bp, Artificial Sequence
  Synthesized
  misc_feature (61): n=t or c
caacaaaatgcttagcaaaacaaagcttcccagtgctactgaaataataccttcagcagtntcttccttcagaataagaacaatcaagcactcatatttcgttatggattggagaaaagtg

SEQ ID NO: 28920 - DNA, 121 bp, Artificial Sequence
  Synthesized
  misc_feature (61): n=t or g
tgcataaaatatattgaatcgggaatgacttgactcctctgaagacaaaagctctctaatngaattggatttgaaaactgagatacttcggcagtagtgccgatttgtatagccatcctgt

SEQ ID NO: 28921 - DNA, 121 bp, Artificial Sequence
  Synthesized
  misc_feature (61): n=a or g
tttgcaacactaacaaaataatacagtaacctcagagatctatctttcaggaattaacccnggttccacaccaaacccatcaacatcactacatcaactgtgggaaagaatcttcacccat

SEQ ID NO: 28922 - DNA, 121 bp, Artificial Sequence
  Synthesized
  misc_feature (61): n=t or c
gcagagaccgctgcccagctaaagtgtcagtgtaccacactcctcatctgatagcttcctncaccaataaacagttgaggcagtgagactggcgtattgcctttcttgcatttgtactttg

SEQ ID NO: 28923 - DNA, 121 bp, Artificial Sequence
  Synthesized
  misc_feature (61): n=t or g
aacaaattgcaggatgggcaatgagagtagacatagcttttttctgagctgtatccaaatnactttttctattttctatctgaaagttgtcagcagtgttgcatgaagcagcataagtcca

SEQ ID NO: 28924 - DNA, 121 bp, Artificial Sequence
  Synthesized
  misc_feature (61): n=t or g
aaatgtgaacaatgaaaagcaaaggaaaaaacagctgcaaaaggaaaacagaattaaaatngagataagatatacttgccacccctttgctgctcctacatacatagaagcagaacactct

SEQ ID NO: 28925 - DNA, 121 bp, Artificial Sequence
  Synthesized
  misc_feature (61): n=t or c
aatgatgaggtttctagttcaaataatgactcgacagaagctagtgtacccatacctgcgntttgcttccaaaagatttatttcttgacaaatcattcctactaggaacagctttctacac

SEQ ID NO: 28926 - DNA, 121 bp, Artificial Sequence
  Synthesized
  misc_feature (61): n=a or t
ggttttcaaaactggggagaacaacggcatttcatttctctttagcttaaagaccctaccntgaaatgccagaggaattaagcatcaaattttgatgcagacatcctaaaggctaatatat

SEQ ID NO: 28927 - DNA, 121 bp, Artificial Sequence
  Synthesized
  misc_feature (61): n=t or c
gtcataaattgaggcccacttatacagaagcaagccatttttgtaactattaggggtaaanatgcagtcactgtaaagcctacaaaacattctgggaacacctgagacccaaaaacagatt

SEQ ID NO: 28928 - DNA, 121 bp, Artificial Sequence
  Synthesized
  misc_feature (61): n=t or c
caaagccaatcagaggaaaggccctgtcctggtgaagccttccccgttgattccagtgcanccatgtccaaggagatgtcaatcaatgcacgtgttcatttttccacatcactcttcagat

SEQ ID NO: 28929 - DNA, 121 bp, Artificial Sequence
  Synthesized
  misc_feature (61): n=t or c
ataagagacttgtggaagtggccgtggggttttagtccagattaggagaaatatcctttcngagagcctctcctcttgtctccatttctgaaagttgctccccgcattttgctttgccagt

SEQ ID NO: 28930 - DNA, 121 bp, Artificial Sequence
  Synthesized
  misc_feature (61): n=t or c
atcacctaatcaactatcagatcttattaatagagacaagaaaagccgacttcatctccantttcacttagacacctgtactagttggacttgatatatacttgacaaaggggatctattt

SEQ ID NO: 28931 - DNA, 121 bp, Artificial Sequence
  Synthesized
  misc_feature (61): n=t or c
ctgagccccgctgtctaggctgaagaaaggtttctgagtgtaaaactgttgctctgctgtnagaagtggtagaatccagccttccgttttctgtgtcaaaaaaaaaaccacacaaacaaca

SEQ ID NO: 28932 - DNA, 121 bp, Artificial Sequence
  Synthesized
  misc_feature (61): n=t or c
gtagctttgtatgtatgcagataacatctggcagcattttgcatctgccaagtcaagagcngatttaagtcatcagcagtctctcattttctgcagaaagagacaaccattacctagctca

SEQ ID NO: 28933 - DNA, 121 bp, Artificial Sequence
  Synthesized
  misc_feature (61): n=t or g
agagggagatatttttaaccgtaaccacttcagtggtcttttctcccggtgtggtcccacntggaattccattaacacgatgggaaggcagtgattgcagggctggcaccagcacagctcc

SEQ ID NO: 28934 - DNA, 121 bp, Artificial Sequence
  Synthesized
  misc_feature (61): n=t or c
cagtacttggtagacaaacagtggtattagtagtgacttggtaaatgtcctgagaagattntgatgatccactcaatctgcacctgtagggcaaactccaaaggtatttgtatgcactttt

SEQ ID NO: 28935 - DNA, 121 bp, Artificial Sequence
  Synthesized
  misc_feature (61): n=t or c
ccttgtgagcttcagggaccagtccactccagctgccagctatcattttaggtgatctgcnccttagtggatcaagccctttcttgggatttttttctctgtcatctctttttggggttgt

SEQ ID NO: 28936 - DNA, 121 bp, Artificial Sequence
  Synthesized
  misc_feature (61): n=t or c
actacaaatgtgttaccagttttaagcctttgcactttttatctcttctcttttttattancagtgtcatggaagtattggtggctctccatttgcttaggctggtagtgcaaatggctgt

SEQ ID NO: 28937 - DNA, 121 bp, Artificial Sequence
  Synthesized
  misc_feature (61): n=a or g
atatctactcagattgatgcaaagacaactgagttgcttcaccaccatcctggatagacanccgtttttgcataaggactgcatcaggtctgagaggaagacataaatcttatcaacagct

SEQ ID NO: 28938 - DNA, 121 bp, Artificial Sequence
  Synthesized
  misc_feature (61): n=a or g
tcaagaatgacggagtccagaaagcctggtgcaagctctttctagtctagggaggcctcantttgctgtcccttgacttgaaccagctcctctggtatcctgttccgtgacttggtccatg

SEQ ID NO: 28939 - DNA, 121 bp, Artificial Sequence
  Synthesized
  misc_feature (61): n=t or g
ctacataactatattgaaactatactgaaaagtcagttctgtctcccacttcacctctctnaaaagctattttttgtctaaaatgtaggtggaattatcggggcaatttattgctgtcaag

SEQ ID NO: 28940 - DNA, 121 bp, Artificial Sequence
  Synthesized
  misc_feature (61): n=a or g
cctgcttgccacttcaactgcagctgctatgcatattacatcctcaaatatttttaaccantcaaaggtttggaatattaatatgaagaactccagcttttactatgtaaaaatgcatttg

SEQ ID NO: 28941 - DNA, 121 bp, Artificial Sequence
  Synthesized
  misc_feature (61): n=t or c
ctgtctctacattatgtttcttacttgaaacacacacatgaatatcatttagtgaaatctnaaagctctaaattcttttcacattgtcattttagagcctaaactctgggaatcttgaaag

SEQ ID NO: 28942 - DNA, 121 bp, Artificial Sequence
  Synthesized
  misc_feature (61): n=t or g
aaacaaagttaggacaacagaacaacagtgataaatagtaataattccgatgttgctatcnagcgtgtgttctactacacgcatggctctacctctgcagatctattctggcgggtttcaa

SEQ ID NO: 28943 - DNA, 121 bp, Artificial Sequence
  Synthesized
  misc_feature (61): n=a or g
acacgcagctctttgacagagtcccttgtcactctgcccactgcagcagatatcaatcatntgagaggaatccagcatctgatttgcaatttccagattcaagggaagatgtatgaggagc

SEQ ID NO: 28944 - DNA, 121 bp, Artificial Sequence
  Synthesized
  misc_feature (61): n=t or c
aaaaacctaagaagcttcatatagctgacataatgttgttgaaatacttcctacaatggtngtccttaatgtacatctagagaaaatcatgcttgctcaatgattaagcagtgagtactta

SEQ ID NO: 28945 - DNA, 121 bp, Artificial Sequence
  Synthesized
  misc_feature (61): n=c or g
ccagctcttccttattcctgtattgcttggctggtaaaacttttgaccattgaggtgcagngttttaactttccacagacataccttctctgttttagtaactgatgttttggttctgtaa

SEQ ID NO: 28946 - DNA, 121 bp, Artificial Sequence
  Synthesized
  misc_feature (61): n=c or g
gtctgttattggtgtgttagtagtagtcagaatattaggtgtgtattaagtgtagctcagnagatttctagtggctggaggccatatgttgcagttttagaatggttgaagaaccttccct

SEQ ID NO: 28947 - DNA, 121 bp, Artificial Sequence
  Synthesized
  misc_feature (61): n=t or c
atgggtgcacatgtggaaggttaatgaaagtaaagatactaatgaggtaatgttggtacanaggcctttgcccagagagcaaggagaacagcaaaattcagcacacagatgatgaattaag

SEQ ID NO: 28948 - DNA, 121 bp, Artificial Sequence
  Synthesized
  misc_feature (61): n=t or c
ttaaagcagcagaatgcctcctgtagactttcccattgggaagctctgagagatagagaantggacaggtagaccacaagattttcaaaagcacccaggtgcctgaagattcccctttagg

SEQ ID NO: 28949 - DNA, 121 bp, Artificial Sequence
  Synthesized
  misc_feature (61): n=a or t
cacaaacacttccaccagtagtacctgtttcttctcgcctgccatcagggccacatgcccnttctgcaactgttcacctgtggttgaagaaagagacttcttcctcttgttgggagccata

SEQ ID NO: 28950 - DNA, 121 bp, Artificial Sequence
  Synthesized
  misc_feature (61): n=a or g
aatacctactatatttttaaattgtaaactattcctgtttttaatgatgcaaacaatgganagagcaaataagctaaaggagctaacacatttatctccacattctgccatctgtttgaaa

SEQ ID NO: 28951 - DNA, 121 bp, Artificial Sequence
  Synthesized
  misc_feature (61): n=t or c
aagatgccccagtgtttaattgcctgactaaaaagccatatgcagaagatactgcttccantattaacctgcagaacacttttatcccaaggatttattttttcgaagcgagagaaatgaa

SEQ ID NO: 28952 - DNA, 121 bp, Artificial Sequence
  Synthesized
  misc_feature (61): n=a or c
gtgaaattaacacttacatatatgcagtttactttcttgagattccaacatgtaagttttnttgtaaccacaagttgcatacaccaacaaaaatattagattgtgagtagatgcctactct

SEQ ID NO: 28953 - DNA, 121 bp, Artificial Sequence
  Synthesized
  misc_feature (61): n=a or t
tccttaaacgatcctgatttcaattttcaaatcctactaagtgtgaaatagggttaggttngcaaccaaggagctgacaggctgttaacttcttcatattcagaagtacacagggatgcaa

SEQ ID NO: 28954 - DNA, 121 bp, Artificial Sequence
  Synthesized
  misc_feature (61): n=a or t
gttagaggatctaatagcatgaagcctactttgcacaaatctgcaagctagaattggtaanaactgtggcagcatttctgctcccaaactaaaaggcagaaggattcctgtcatcagaaac

SEQ ID NO: 28955 - DNA, 121 bp, Artificial Sequence
  Synthesized
  misc_feature (61): n=t or c
tcaaaattatatcctttcaagaaaccctaactgctccaattccttcttccccaagtcacgncgtgcttccaaacacagcctggaagagctttactagcaggttcacctcaactacatagct

SEQ ID NO: 28956 - DNA, 121 bp, Artificial Sequence
  Synthesized
  misc_feature (61): n=t or c
ccaggtccaggaacacgcatctagaaaacagctgttggtagtttgggaattcttctgaagngctttacgtttggcagaggaaaaatggcctttacaacctggagcactcaaaatgcctttt

SEQ ID NO: 28957 - DNA, 121 bp, Artificial Sequence
  Synthesized
  misc_feature (61): n=c or g
gtgaatcttcctttgacaaaataggctgaatactggatgaggtgagcgaattgaaaagccntaactttttcagtgagtgctgattaaatctgcttactgctaaagcaccatatactcagct

SEQ ID NO: 28958 - DNA, 121 bp, Artificial Sequence
  Synthesized
  misc_feature (61): n=a or g
agctgcagtgtcaccaatacacctcagaggcccttgcgcttatttagcataaagggcaaantaaacagtgagcttggagatgacccagtactgacaagagctagtgcatttgtgtatagca

SEQ ID NO: 28959 - DNA, 121 bp, Artificial Sequence
  Synthesized
  misc_feature (61): n=a or g
tgctcaaccacacaaatggtgccctggtgctcctctgccctgtttggatgggtaggagtgnaagtttgactccgataaacaaaatcatagggagtgtcggctgcatccccaggaagaagag

SEQ ID NO: 28960 - DNA, 121 bp, Artificial Sequence
  Synthesized
  misc_feature (61): n=a or g
taattttaggatattatggtatagatatatgtagtttttaccaggaatattagtcccaatnaactatgaatagctttcccttaaatttcggaatgatttccactctcttcaaaaggaggct

SEQ ID NO: 28961 - DNA, 121 bp, Artificial Sequence
  Synthesized
  misc_feature (61): n=t or c
ttatataggtttattgttgctgtattttatgcaatatatcacatgataagagcagtaaaanaagcaaactttaacaaggagaactagtaattcaagatccaacagctaacaacaacaacaa

SEQ ID NO: 28962 - DNA, 121 bp, Artificial Sequence
  Synthesized
  misc_feature (61): n=a or c
accaattcagtttaaagaagagatctgacaatattacataatacaaagtacaagaatagcncttctattagactctgtagtacaagaaaaaggcaactcactgtgaaattgaaaaaaaaaa

SEQ ID NO: 28963 - DNA, 121 bp, Artificial Sequence
  Synthesized
  misc_feature (61): n=a or g
ctcagcctcctgtgtcatctcagctcttttcatccccttggttcagaagttaactttgatncaataaaatttacaagttactaagcacattcgaaggacatttgaaagcatcagagcacca

SEQ ID NO: 28964 - DNA, 121 bp, Artificial Sequence
  Synthesized
  misc_feature (61): n=a or g
tcctagtaaccaggtctagcttttcttttgctcccccttctccctcctgaagagatggagnattttttgctgaagtgtatgttgctgggacttcttttttcccccacagtgaatgcttttt

SEQ ID NO: 28965 - DNA, 121 bp, Artificial Sequence
  Synthesized
  misc_feature (61): n=a or c
atagaacacctaaaattcacaccgtctcctttgcgtgtacatcagtacaatgataaagggngcacctgtctaaaatacaggcgagaggaacaaccatggccatgctgggtagcgtggctgt

SEQ ID NO: 28966 - DNA, 121 bp, Artificial Sequence
  Synthesized
  misc_feature (61): n=a or c
tatgatctaaatatttaatcaattatctagcttagatttgtgcaccagtttatacagcagnctatcacaagcattgagcagaggggactaagcaacttaagcacaaatagctttttccatg

SEQ ID NO: 28967 - DNA, 121 bp, Artificial Sequence
  Synthesized
  misc_feature (61): n=t or g
tacaggagcaataagaaagaggaatatattgcttggagctgtctgctgggtatatcctacntgagtcctctctttaaaaactattacactttcttaaaaaaattaatttcagctaaaacga

SEQ ID NO: 28968 - DNA, 121 bp, Artificial Sequence
  Synthesized
  misc_feature (61): n=a or c
tttgaaaacaaaggtaccattatcctcgactttagcatgtcattactataactcagctggntgcattctacctgttcatctgaaaactaagatgttgtagtgtttacatacctaacatcat

SEQ ID NO: 28969 - DNA, 121 bp, Artificial Sequence
  Synthesized
  misc_feature (61): n=a or t
taagggcaacattattcctggaaggaaaacccacagcaactacagcagctctaagagtctntgctggacctcacctgaagttcctattcctcatcttgaataccaagagcttactgggact

SEQ ID NO: 28970 - DNA, 121 bp, Artificial Sequence
  Synthesized
  misc_feature (61): n=a or t
gatcattaatcaaagctaatacagtctttgcctatatcagctttgccagcctatatacacncttcccctattactaacaaactgagcattttatctcgccatgaatacagaaacagcagag

SEQ ID NO: 28971 - DNA, 121 bp, Artificial Sequence
  Synthesized
  misc_feature (61): n=a or c
ttccacttcttttaataaacgattacagattagtctagctgaggcaatttggggtggtccngataacgtttttgggctgttactttgcaagctgtgaagctatatgttgccctgagccttt

SEQ ID NO: 28972 - DNA, 121 bp, Artificial Sequence
  Synthesized
  misc_feature (61): n=a or g
taatatgggattggagcatcagttctgcatccagtggcatcgactctgcccttgctcatcnagagagtattccacaaatgaaaaaatgtaatactttaaagaataataataataaaaatta

SEQ ID NO: 28973 - DNA, 121 bp, Artificial Sequence
  Synthesized
  misc_feature (61): n=a or g
accccaagagcagcagagtcccaaagagaaacacagcagtgcgagaagcgagttgatcccntctacctccagacaagttcacacatcccagttccaatgggaattgctctgcaaatgtcat

SEQ ID NO: 28974 - DNA, 121 bp, Artificial Sequence
  Synthesized
  misc_feature (61): n=t or c
agtaccaacgttcacatgctggattctgaattacattctgcccaaggctgccagaagctgnatagcctgcatcctaatcagctaacactgggagtccttactacatctcacacagttcttg

SEQ ID NO: 28975 - DNA, 121 bp, Artificial Sequence
  Synthesized
  misc_feature (61): n=a or g
aaaaatgagatacagaacagggactacagacattgctggcagtggtctgatctagctggangcttggaggctgagtgaaagctccagatacgcaacaacgtatgtcaaaaggcaattcaat

SEQ ID NO: 28976 - DNA, 121 bp, Artificial Sequence
  Synthesized
  misc_feature (61): n=c or g
aatatccattgatctcttaccaatgtttttctttgttttatagcctttctgtaacatcttncaagttttaaagcattgtcataggaaacgctgctaataatgctttaagaacagagagata

SEQ ID NO: 28977 - DNA, 121 bp, Artificial Sequence
  Synthesized
  misc_feature (61): n=t or c
cacaaaggtaattacgaactaaccacaccaattaatagactaagagagaaatgtatggtanactcaactacacattaaattgttggtacattatgtaagacatcttaagatcaattctaat

SEQ ID NO: 28978 - DNA, 121 bp, Artificial Sequence
  Synthesized
  misc_feature (61): n=a or t
tggtatagtatttaactgttgcctgattcagttggagttgataaaactcttcaacaaattnctatgtggcaatatttgtacagcttccacttagcatgtgaagtttttatcctgtcacaaa

SEQ ID NO: 28979 - DNA, 121 bp, Artificial Sequence
  Synthesized
  misc_feature (61): n=c or g
atccagaacctttgattaatgtagtgtccttcagaggccaaaggactttgaattcagggantctggcaaagctggcatgacattaccactgactttaagagatcctgaaggaggacacaag

SEQ ID NO: 28980 - DNA, 121 bp, Artificial Sequence
  Synthesized
  misc_feature (61): n=a or t
ctttttctctattgttttgcttggattgtgcccatttaattttatcctcaaagccaaaagnagcataaggtctttgctgtggaatgtaagaacatatgaggagtgactgaaggaattggaa

SEQ ID NO: 28981 - DNA, 121 bp, Artificial Sequence
  Synthesized
  misc_feature (61): n=a or g
tttaagagtgcagtttccattgaaatatttatatgaaatagccggactgtggtaatagttnaaaacaataaacactaactaaaagctgtgcaataacctgcctgggaaatatggttgcttc

SEQ ID NO: 28982 - DNA, 121 bp, Artificial Sequence
  Synthesized
  misc_feature (61): n=c or g
gtagcaaaggtagaactctggggaggataacagaacaagcaatggatagaaaaatgactangagagtgaggactcgtgcaaggaatctaccattagcagagacagcagtgggtaatgagag

SEQ ID NO: 28983 - DNA, 121 bp, Artificial Sequence
  Synthesized
  misc_feature (61): n=c or g
taggggaactgttgttttagccaaaaattataccagcccagtgctcagacagaaatgcctnagaaatgtctgtgaggtgtcaggtgccctgttttaatctgaggatggatttcaaactcca

SEQ ID NO: 28984 - DNA, 121 bp, Artificial Sequence
  Synthesized
  misc_feature (61): n=a or g
aataatactagtcacttactaggcagtgatctgaaaattgcagtatataagaatacagacntaaattccttgcaagtaagcaggcaaattaagtattggtaaaataaattagagtcattct

SEQ ID NO: 28985 - DNA, 121 bp, Artificial Sequence
  Synthesized
  misc_feature (61): n=t or g
gtcagaccatgagctcccaaggaagcccagcattacaaagccaagcgctcaattccctcancctgtactgcggcagctcatttaactccactaatcttgagctctgtgtgctttacaggct

SEQ ID NO: 28986 - DNA, 121 bp, Artificial Sequence
  Synthesized
  misc_feature (61): n=t or c
gacctttttaggttcctcctggtcctgttaggtatggtgctggagatgaactcactgtggnggaaggaaaccttcaaggttttggcacatgggactgcgtaacctgggcagtgtgtgaaaa

SEQ ID NO: 28987 - DNA, 121 bp, Artificial Sequence
  Synthesized
  misc_feature (61): n=a or t
ctaattttaaaatattttcaggtagagtaatctctagatacttggaagcaattaacattgnctgttttataaaatgcattctgcccatgcctgtttgtcatgtagctatataaatattatt

SEQ ID NO: 28988 - DNA, 121 bp, Artificial Sequence
  Synthesized
  misc_feature (61): n=t or g
gtcgatcaattcagacaaacagtggagaagtagtcctggatgaaatcctggctttactggngtcagtgaagattttatattgacttcactgatgctgggatttcagtgggactcagggtgt

SEQ ID NO: 28989 - DNA, 121 bp, Artificial Sequence
  Synthesized
  misc_feature (61): n=a or c
ccagaatatcagggaatttcctcctgcctcctgaaagcaaatgccaccactggacagaacnagtcaaaacacactgcctccctttgctttaaaaaatgtggtctcttagcaattaaagaat

SEQ ID NO: 28990 - DNA, 121 bp, Artificial Sequence
  Synthesized
  misc_feature (61): n=t or c
tctttacagaggtccccctaatcttagggggagaaagaatgttagattaagatctccctcnttaaagtaagcacctgtttattcaacttgggtttaaattttttccctcatacaacagagg

SEQ ID NO: 28991 - DNA, 121 bp, Artificial Sequence
  Synthesized
  misc_feature (61): n=c or g
ttgtgatgctgtaagcgagggagctcactgacctcatgaaggctctggcagttcaggccantaggacctgacttctctgctgtatccaaattatggagatcaacataatatacacttaaca

SEQ ID NO: 28992 - DNA, 121 bp, Artificial Sequence
  Synthesized
  misc_feature (61): n=t or c
taatcaccttggtggcctgctgctgtcagtccagttgtcagtgcatcccacaacagaacantagttagggttttcaccttattttttccccttcagaacagagagatgcaatgtgtatgtt

SEQ ID NO: 28993 - DNA, 121 bp, Artificial Sequence
  Synthesized
  misc_feature (61): n=t or c
gtgttctgagcattggaacttgtaacgtacagtgagaactgttgtctttatgtacctgtanggagccaaaatatgattcccagaatctaaaattaattgcttcaacagtcaattaaatgac

SEQ ID NO: 28994 - DNA, 121 bp, Artificial Sequence
  Synthesized
  misc_feature (61): n=a or g
ccctgcaggctgcagggggatgggttagaattgcactggaggcatcatctgggctcagccnctgtaggtccaaaggaataattgccgaatgtgaatatcgttgcactttgggcagtctctc

SEQ ID NO: 28995 - DNA, 121 bp, Artificial Sequence
  Synthesized
  misc_feature (61): n=c or g
tgcaagtcacggatctcctaaaattgttgccttagagtatgaaaaaacatgttggcatgtntatgtgtattttgcatatgtagatgtgtatccgtacagaaagacatatgcttcatgatat

SEQ ID NO: 28996 - DNA, 121 bp, Artificial Sequence
  Synthesized
  misc_feature (61): n=t or c
tggaagagaaaaatccagcaatcatagtgcatgctcgccattattcacaaactcctccttnagggagaaaaaaatacagtcctttttcaaaaggtcacacaggatatctcataaaatggga

SEQ ID NO: 28997 - DNA, 121 bp, Artificial Sequence
  Synthesized
  misc_feature (61): n=t or c
gatggaaagagtgctggtggtgaaattgtctttgccataacaacccatcaatcacagacanctgcctctcagcgagaaaaagcattcagccttgggatttccttaggatccactgtgccct

SEQ ID NO: 28998 - DNA, 121 bp, Artificial Sequence
  Synthesized
  misc_feature (61): n=a or g
gaggaaaaacagctcaaccctctagcaaaatgggtttgagaatgcgagggtgtggggatgncgcaagacaaaagcaggggacaacaaaatgagagggttcccatacacaggtgcaaaaagt

SEQ ID NO: 28999 - DNA, 121 bp, Artificial Sequence
  Synthesized
  misc_feature (61): n=c or g
aaagaaaccactgtgattcaagtgggtgcccaactgaaacttgtctattccaaaggctggnaggcatatgagagtataatcctgtaaatgttcgaatttccgaaagtaaattcaggaaata

SEQ ID NO: 29000 - DNA, 121 bp, Artificial Sequence
  Synthesized
  misc_feature (61): n=t or c
ctcattgatccccacgttgaagagcacaggctgaaccctcagtaacatgccactttgaatntctcgcggcagcaaatcaaacaaggcgcttggcaaagggatcctcacattaaatccatca

SEQ ID NO: 29001 - DNA, 121 bp, Artificial Sequence
  Synthesized
  misc_feature (61): n=t or c
caaggagggagatttcccttctctgtattaagaagagtaacaggtaagctaagagacctcncagtttaagttccctctttcacagttaaccgctaagagaacagttttcccatctgtaaga

SEQ ID NO: 29002 - DNA, 121 bp, Artificial Sequence
  Synthesized
  misc_feature (61): n=a or g
tattggaaaaagttgtcttatatttgaccattttacttttttgcaagccattgatctgctnatatattacagtcaaccagttcagtgcaccattgagatattttatcgtaatacattaaca

SEQ ID NO: 29003 - DNA, 121 bp, Artificial Sequence
  Synthesized
  misc_feature (61): n=a or g
tgctggattattctgtgtagtgacttgtttagcggtcattactactacttctagcaaattngatccaaatacgtaacacttcccctagaaccaaaacacaattcttggtcataacatgtta

SEQ ID NO: 29004 - DNA, 121 bp, Artificial Sequence
  Synthesized
  misc_feature (61): n=t or c
tttcctttacttattaaaaagtcataattgacctacaagattggtcttgcttttgattcancacttccttcttttgcttgtgggaggtgagtgagcacctggcacatatctaattgctggc

SEQ ID NO: 29005 - DNA, 121 bp, Artificial Sequence
  Synthesized
  misc_feature (61): n=a or t
tgctataatattttgaaagaaaaagaagaatgatcagattgcagctttgatgaataaccancaggaagctccacacaatggctttgacaggaaaaggtgcgttggggcagcgctgcagcaa

SEQ ID NO: 29006 - DNA, 121 bp, Artificial Sequence
  Synthesized
  misc_feature (61): n=a or c
agaaagcaaatatgagtacacgaactgctattacagtcctggtaatgccagagtctaatgnagacagcagtgtatcatgagttcttagtcccagatgaggctccacacttccacttacacc

SEQ ID NO: 29007 - DNA, 121 bp, Artificial Sequence
  Synthesized
  misc_feature (61): n=a or c
ttggagtggaaaaacagctcagcactggagagcactggtcctctgcccaggagtgcactgnacccaagttggggtagcaccactgcgccccagcctagtgcatccagggcaacagggcttt

SEQ ID NO: 29008 - DNA, 121 bp, Artificial Sequence
  Synthesized
  misc_feature (61): n=t or c
gctaataacccaggactactcatgtgacagtgtaaacagtgctctcaggatgtgttctcanccatgcttacaccaggctcagtaagacttggttcacttgaagttaatacagttacccaag

SEQ ID NO: 29009 - DNA, 121 bp, Artificial Sequence
  Synthesized
  misc_feature (61): n=t or c
gaatgactatgtgcaggggcagatgtagaggaaaacggggtcggggactggtatgggacgntatggaaaacagggggcaccattttggggattgcagggccagtgcagctcagaggcatca

SEQ ID NO: 29010 - DNA, 121 bp, Artificial Sequence
  Synthesized
  misc_feature (61): n=a or g
cgtgctgagtcagaggctgcaggagatagcaacattaggaagcaaaatctctgcttatgcntgtctgggatgagtaatcctcgaagctgactctgagggaactatggtaactcaccctaaa

SEQ ID NO: 29011 - DNA, 121 bp, Artificial Sequence
  Synthesized
  misc_feature (61): n=t or c
agctgtgggtgaaattctaatttagattgaattagctgtaagttttacagctgtctttganttctttgcttacaaaagatagagaacattcttctggctccagatcaccatgtctgttcac

SEQ ID NO: 29012 - DNA, 121 bp, Artificial Sequence
  Synthesized
  misc_feature (61): n=t or c
gcaaatcaaactgtagtcatttcttcttttgcaccaccagacacatcatgtaatggatgantttgtactcattccataaagaatgggtcctgtctggaccaaaagagttgtttcttagtca

SEQ ID NO: 29013 - DNA, 121 bp, Artificial Sequence
  Synthesized
  misc_feature (61): n=a or g
gatttcctgaattatgcttgtctgtgtgtgtgtagatgtaaatagaaatggttaccttacngagttttaaacttactaaacaacctgtatgtgaataaacagtttatcttgttccacagga

SEQ ID NO: 29014 - DNA, 121 bp, Artificial Sequence
  Synthesized
  misc_feature (61): n=a or g
tgcacatatatttagagagaggacaagtcatgtaaaatttaaggctgattgaaattgtgcnctgcctaccattggtggaacatattgtacctctgtagtacaatcaagagctttaatccct

SEQ ID NO: 29015 - DNA, 121 bp, Artificial Sequence
  Synthesized
  misc_feature (61): n=t or c
ttttaagcacatgtggaactaactgaaagcactgagtaaacgacagtgtatattgaagccngctattcattcaaagaaattacgtaaaagtgaaaatgcctgacactattaaagacagttt

SEQ ID NO: 29016 - DNA, 121 bp, Artificial Sequence
  Synthesized
  misc_feature (61): n=a or g
aaactccaggccagggaaccttcagcaataggtggcctatatccagacagatagcaaagcnatatgattctagcctaaaaattattctaaaattacatcatgaaaattggatttataaata

SEQ ID NO: 29017 - DNA, 121 bp, Artificial Sequence
  Synthesized
  misc_feature (61): n=t or c
gaatgcactaaccacatcaacaaaaaagaattatggtaggttttcttcgttttaatactgntgtgctgtgttcaatgtcctagcaaaattgtttcttttttagtagcttgaaagagaatat

SEQ ID NO: 29018 - DNA, 121 bp, Artificial Sequence
  Synthesized
  misc_feature (61): n=t or g
tctatgagaacgccatctttattcctattctttctatcccttcttaaacatcaacacaagnacttctgccatgctatccattctaaattgctccgatagagacctggagatacatatccag

SEQ ID NO: 29019 - DNA, 121 bp, Artificial Sequence
  Synthesized
  misc_feature (61): n=t or c
actgagcttaggcaatttgttaccacgtttttattgggaagttgcttccagatcccttgtngtactgagaaccagatagccacattagttagggcattgatgctatgtagtaaagagcagt

SEQ ID NO: 29020 - DNA, 121 bp, Artificial Sequence
  Synthesized
  misc_feature (61): n=c or g
aaatgagaaatgggaaaatacacttaataatgagatcaggatctatcttctcatgtaaatnaatgcaacatccttccagcagttggaggtttcttgtcctggagctgatggttggctgcag

SEQ ID NO: 29021 - DNA, 121 bp, Artificial Sequence
  Synthesized
  misc_feature (61): n=a or c
atagccatgcagagaactgaagttagttactaaaaaaaaggtgctttcctcttccttatcnctgttggaggagtgcatcatttcactagagaaaatccataatcctcatgatgccatgggc

SEQ ID NO: 29022 - DNA, 121 bp, Artificial Sequence
  Synthesized
  misc_feature (61): n=a or c
gtctttccaagctgctaatgctaaaagtgctgccaatctgaaagtgaaaggtacagcttgnacttcaccaagatctgtatctcaaggcactagaacaaatctagtaacagcaatttctata

SEQ ID NO: 29023 - DNA, 121 bp, Artificial Sequence
  Synthesized
  misc_feature (61): n=t or c
tcagtaggacataggaagaacaaagcagcagcgttggtacatgggaggcagcggcatgtcntcacttccaggatgctgagagcaccccggcattcccagctcccactccatctgtgcttca

SEQ ID NO: 29024 - DNA, 121 bp, Artificial Sequence
  Synthesized
  misc_feature (61): n=t or c
aactgaactctccctgtaataagtaaagattactttcatgtcatctggcatttgtatgcanatttggggatagagttttggaaattcatttctcctttactcactttcactgcacatcctt

SEQ ID NO: 29025 - DNA, 121 bp, Artificial Sequence
  Synthesized
  misc_feature (61): n=a or g
tttcattgtctgtgttttccgttgtggtatttcagggggagaaaaagaacgtgtggtcccngtgttaagggattaactacctgaagcttaattactacagatttctataagtgtgtaaatt

SEQ ID NO: 29026 - DNA, 121 bp, Artificial Sequence
  Synthesized
  misc_feature (61): n=t or c
tgtggtgataacaagagaacaagtcaaaagttttgttcagcacaggctagacagacctttngatctttgaagtgcaaagcagacagagttcagtgcagtagaaactgcttgatcagttggg

SEQ ID NO: 29027 - DNA, 121 bp, Artificial Sequence
  Synthesized
  misc_feature (61): n=t or c
gatgtgtggtggcagagccatgtgagagcatcgccctgcagctctcatagttggcatctcnttcttaccaatcacaacagcaactgtgcagattcttttggatttagaagctctctcctcc

SEQ ID NO: 29028 - DNA, 121 bp, Artificial Sequence
  Synthesized
  misc_feature (61): n=t or c
taaaataaataagccaagctttgcagaatgtcacataactacaacaatgacagtactttgngtgttttacggattcccccttctttgggggaggttccacatctttctagatttgcataat

SEQ ID NO: 29029 - DNA, 121 bp, Artificial Sequence
  Synthesized
  misc_feature (61): n=t or c
ccagccttttttcttgctatattttcttgtttttttagaaggaaaactggagtactccaanctattccacagtaagggttcaatatccttcaaatatccatctcttctgatctagctttag

SEQ ID NO: 29030 - DNA, 121 bp, Artificial Sequence
  Synthesized
  misc_feature (61): n=a or g
gtcaattgaagtaaattacatggtgtcatacaaagttaaaatatgtttcgaactaacctcncttgaggtacttttgttgctttcttctaagaactgctgcagggtaacaacttcgcttcca

SEQ ID NO: 29031 - DNA, 121 bp, Artificial Sequence
  Synthesized
  misc_feature (61): n=t or c
ttaatcaacctgttctgtacctttgtcctgcacttcaaagtgaagggtcaacagtcatccngtgttaaacatcatagtccagtagtcaatagggacacattatgcagacaagaatctgcca

SEQ ID NO: 29032 - DNA, 121 bp, Artificial Sequence
  Synthesized
  misc_feature (61): n=t or c
gggctttttagcacacaagtaagtattctgcagtaaaaaaatgtcactatttcattaagtngtgggaaaaagagtctttgcatgtctgttgaacctgccacctgctgacatttaataactc

SEQ ID NO: 29033 - DNA, 121 bp, Artificial Sequence
  Synthesized
  misc_feature (61): n=t or c
ctaccaaaggattagagaaatgaagaggaaaccacaaatgctgggttccaattccagttanaccactttcttagtgtgtggttttacataaacaacttaaagcaagcacctccagttcagg

SEQ ID NO: 29034 - DNA, 121 bp, Artificial Sequence
  Synthesized
  misc_feature (61): n=a or g
tatttgaagagttagaagtacatagagtaaaaacatattaatgtgtttaatcttgaacttntgtttcaggactcaaatgtaaggtagtggcaagtgtatacctttgtgtgttcatacagca

SEQ ID NO: 29035 - DNA, 121 bp, Artificial Sequence
  Synthesized
  misc_feature (61): n=t or g
ttcagcagtacagcaccaggctcttaggaccaaggttctaaaggtatcaaaatgccctggngcacctcatggggttttctgagctgtgtgtcctctgccaatagccacgtctttaacactg

SEQ ID NO: 29036 - DNA, 121 bp, Artificial Sequence
  Synthesized
  misc_feature (61): n=t or c
gttccttcccttgtggcggtccctgaagtcagcctcctttcattggaaactaagagagatnttgagtgtgaatgcagtagtagtttaaccaccaaggcaggaacatttcagtttggatatt

SEQ ID NO: 29037 - DNA, 121 bp, Artificial Sequence
  Synthesized
  misc_feature (61): n=t or c
caggacactgctgaagagtatgttcctttatttagtctgaatttgccaatctatagagaangtttgttcaggcatttcaatggttatgtcagctattttcttcttgcagagttaaagtgtg

SEQ ID NO: 29038 - DNA, 121 bp, Artificial Sequence
  Synthesized
  misc_feature (61): n=t or c
gaagacaagctgtgagatggaggcattaacctgcagtaagatgtgctgtagcaagctgcantggaacaagcagactggatttttgaacgtagtaggatgctatggtgatttcattgctact

SEQ ID NO: 29039 - DNA, 121 bp, Artificial Sequence
  Synthesized
  misc_feature (61): n=a or t
tgagtgacctcaagggcaaggaaaaaaaccccagctatcaaagcactggttcaccaattanactcaaccagaaaccttttgtttgcctgagagaatgagatgtggatggggcgagattgaa

SEQ ID NO: 29040 - DNA, 121 bp, Artificial Sequence
  Synthesized
  misc_feature (61): n=a or c
tgggaacggctgcaggaacgaaggctgaatcacacctagctcatcagcctcaagcaaactnctctccttccatcttccacagttcaggagacttcttctgtctccccacagaatcacagaa

SEQ ID NO: 29041 - DNA, 121 bp, Artificial Sequence
  Synthesized
  misc_feature (61): n=a or c
agaagagtgtttttcatggaagtttccagctgtttttgtagtcagatttgtttagatatcnaaaaagcaggggaaaataatagtcttcaactttaaaggtgttcagcccctgatactgcta

SEQ ID NO: 29042 - DNA, 121 bp, Artificial Sequence
  Synthesized
  misc_feature (61): n=a or t
agttatacatacatacatggtaatgtttctaactatatgtatttggttatctgtcctgttnaaatacctctgtaggagaaacttgacttccttgttgcaggatgaggcagagccctggcag

SEQ ID NO: 29043 - DNA, 121 bp, Artificial Sequence
  Synthesized
  misc_feature (61): n=t or c
ccagctactataatgacccagctattctaactttaaaggtcttttggtttaacatccagcntcattttaagtgtacaaacacaacactgccaacatgtgcatggtatgtttatgtatatgt

SEQ ID NO: 29044 - DNA, 121 bp, Artificial Sequence
  Synthesized
  misc_feature (61): n=t or c
ggaagggactcacatccttctgatgtccgactttgagattatcttgtataaacactcactngaaattcatctctgcatgctatcacagctagtcttgtcagaagtgtcgtccggagtgaag

SEQ ID NO: 29045 - DNA, 121 bp, Artificial Sequence
  Synthesized
  misc_feature (61): n=t or c
tttggctgtggtatttgcaaaagtatgagagaaatttttgcagagtcgtagagcagtccangtgttagcatttagctttccagtgccacattgtgtctccaatagcgtttctgaaaggtaa

SEQ ID NO: 29046 - DNA, 121 bp, Artificial Sequence
  Synthesized
  misc_feature (61): n=a or t
gctaaagactggggaaatataagtaggactgaggacctggttttgtactattccaagattntgtcagcatattgttgtgatgaacacctcagataaatctagatatgaactttttatcccc

SEQ ID NO: 29047 - DNA, 121 bp, Artificial Sequence
  Synthesized
  misc_feature (61): n=a or g
ttctaagaaacccctgcaagtgcgagctctccagtcagcacatctatcattgactaccccnttcttccctggaaaagcatcacccgcggccaggtattctcaaagaagcaatcttcccctc

SEQ ID NO: 29048 - DNA, 121 bp, Artificial Sequence
  Synthesized
  misc_feature (61): n=a or g
gccgtgtctgagcagcagaaaccttcattgcatcacttcaggagcactgcacagcaatggngcaagtgggccagttggacttcctcacagagagaccttatgaggatgacacaaaccagca

SEQ ID NO: 29049 - DNA, 121 bp, Artificial Sequence
  Synthesized
  misc_feature (61): n=t or c
tccaaaacgctcattaagtttttgtactctctttggcagcagtgcagcatctttcatcttnctttgagccacagtgtcaatcacctcactgacagctagcaccacctctgtctaggagctt

SEQ ID NO: 29050 - DNA, 121 bp, Artificial Sequence
  Synthesized
  misc_feature (61): n=a or g
gtttttcctcctagagaaaaggagagcatcacacaaaagagcaagagctatcagaagggtnattatccaacaataaacacatgttactttggagtttacctaattaaggccaatgaacaaa

SEQ ID NO: 29051 - DNA, 121 bp, Artificial Sequence
  Synthesized
  misc_feature (61): n=a or c
tggttaaccaaatgtacacgagcctgtccagggcagatgtggaattccagcaggaaagcancatggagggactgaacatcactgtttcactgtccccacatgaaatagtttgcgtgtttcc

SEQ ID NO: 29052 - DNA, 121 bp, Artificial Sequence
  Synthesized
  misc_feature (61): n=t or c
gtttatggagtctgctgatgttttgcataactgtcagataacaagttggctttccatgtcngcagatgttaagtgcactaaaatcctatcataaaacagtttataaactactgtctgattt

SEQ ID NO: 29053 - DNA, 121 bp, Artificial Sequence
  Synthesized
  misc_feature (61): n=t or c
ccagatgttctgggggtttgttgttggcaaacatcctgctctccttatgaccaggggggangggttcctgggtgggttcccctcctttctagcagggtgtttatccgtgctgtaactaact

SEQ ID NO: 29054 - DNA, 121 bp, Artificial Sequence
  Synthesized
  misc_feature (61): n=t or g
ccaatgtcggtcacttttctccccaggtacctgtttttgtgcctccgttacccagctttgnatgctgggagtaatgattccttgcttccctttgaattccttcccaaaaaaacacgcatta

SEQ ID NO: 29055 - DNA, 121 bp, Artificial Sequence
  Synthesized
  misc_feature (61): n=a or g
tcttcctggatgttaatgtgatgcctattggaaagaaatacctcaacacacagcagacctnaaaggattcatcttccacccatggctgagaccagatggaatacaaaggcacaggttctcc

SEQ ID NO: 29056 - DNA, 121 bp, Artificial Sequence
  Synthesized
  misc_feature (61): n=t or c
accaaccccagctggattctagcctaccttctgatggggacaaatgctggggaaggagccntcagtctgaccctatgtgctgtctgaccccaccatccccagatgtggggacgcacagacc

SEQ ID NO: 29057 - DNA, 121 bp, Artificial Sequence
  Synthesized
  misc_feature (61): n=t or g
agctcaccaggagaatatgtggaggcagctcaatgtagcccatcccttaggaagtttgtgntgttcgggaacttttccagattgtgaaactgaggcacagttcaaaagggaagagatgggt

SEQ ID NO: 29058 - DNA, 121 bp, Artificial Sequence
  Synthesized
  misc_feature (61): n=a or g
agcattgcctgcaagctcaccctcatccttccagaacatcacatagctgcacccgagcttnatgtcttccccaagcaacagctgaggggacttcgacacgagaatttcactggaaggggta

SEQ ID NO: 29059 - DNA, 121 bp, Artificial Sequence
  Synthesized
  misc_feature (61): n=t or c
caatctgagatatgccaagcattctaaaataaaagtaaattgctttgttttaagctggagncatcttctgctcactctctgtggttcatacattctacaatagcctaactgtatctacagc

SEQ ID NO: 29060 - DNA, 121 bp, Artificial Sequence
  Synthesized
  misc_feature (61): n=c or g
tgggatagaaggcattaaaactgggacacccatgtatccctcagtggtcatagactattgnagcagcctcagacaatcaggaagccaaactgttcttccctagttttaggaacttcttgag

SEQ ID NO: 29061 - DNA, 121 bp, Artificial Sequence
  Synthesized
  misc_feature (61): n=a or g
agatgtgaaagaccaagctgtgtattaccacacttgtactccagaagaaaatagcaaagcnttattctaacttctcagtgctaccagatatgtagggccaacggcatcctggcttctatca

SEQ ID NO: 29062 - DNA, 121 bp, Artificial Sequence
  Synthesized
  misc_feature (61): n=a or c
acaggattcttttctccttctttccagaattattttctttctcagggtaagctttatcaantctttaagatactgctaagtatctacagaaatgtaggcagagaaatatgctagttatatg

SEQ ID NO: 29063 - DNA, 121 bp, Artificial Sequence
  Synthesized
  misc_feature (61): n=t or c
tttctgtatctgtaccacttcttggctttctaagctctacctttgagcattaacaataacntgaaatacaatgaatagcaatgtcaaagtactcttcacataaagcatcatttcaattatt

SEQ ID NO: 29064 - DNA, 121 bp, Artificial Sequence
  Synthesized
  misc_feature (61): n=t or c
ttgtgcttttgtagctctttcccccttgacctgttcccaagaactgtggctgagctttccngagcatttgcccgtgtggtggctgctgcccaggtcctgcagcacgcctggaagcagctct

SEQ ID NO: 29065 - DNA, 121 bp, Artificial Sequence
  Synthesized
  misc_feature (61): n=t or c
gcataagcgcacatgtgcttccacagaaggaaatggagaggcatgcgaaggctttacgccnggaattaaaacgggatgtaaaagaagtgagagaagttgcaatgaggcaactgtaagttgt

SEQ ID NO: 29066 - DNA, 121 bp, Artificial Sequence
  Synthesized
  misc_feature (61): n=a or g
cctggttgaatcagctcttcccttcaggtttgtatagagacagaattttatctgcttctcngagagccagcccaggaggcatatcatatcagctttataaatccatgctgaaatgcgagtc

SEQ ID NO: 29067 - DNA, 121 bp, Artificial Sequence
  Synthesized
  misc_feature (61): n=t or c
acatcttctcattaatgaaatgttttaacttaccagtggtatactaagtaactcagccttngctcagaacaaaagacaggacagcttatgtagagataatattccccgaagcagcatttta

SEQ ID NO: 29068 - DNA, 121 bp, Artificial Sequence
  Synthesized
  misc_feature (61): n=t or c
ccacacttgaagccatgcacacatgcttgcagatgttattccctgcagtccaagctggagnggctagtgctttcagaagtgctctttttgggatccttcgcagcatccctatttgtagaac

SEQ ID NO: 29069 - DNA, 121 bp, Artificial Sequence
  Synthesized
  misc_feature (61): n=a or g
tcatgatgattcacctttcttgaaaatctttgagcttactaaaattgtttccaacaatacnaatgtatacttctgtaagccatgatttcttgttgcgagtattctgctttaccttctctat

SEQ ID NO: 29070 - DNA, 121 bp, Artificial Sequence
  Synthesized
  misc_feature (61): n=a or g
tggagcagtctgcgttcattgctggaacacaccctgtgagtcaagtcaaggtgaaaggtcnacaaacattaagagcatgggagaaaaaccaccaagagggcacctcacagcaaggcagcag

SEQ ID NO: 29071 - DNA, 121 bp, Artificial Sequence
  Synthesized
  misc_feature (61): n=t or g
gtcagttgtgagaaatgatgcaaatacaagcaactatgggtaggggaaataccaattcatnatgtttggagagtgttggtttcttaaactgatgctgatgtcaaaaatgtgttatgtaatt

SEQ ID NO: 29072 - DNA, 121 bp, Artificial Sequence
  Synthesized
  misc_feature (61): n=t or c
gtctttacttccctgggagaaattgctcaagagcctgcaaatgcacagtggagattctcantcaagatttaaacagacaagtgggagaaaacagtgtataaaacctttaaaaaagtcacga

SEQ ID NO: 29073 - DNA, 121 bp, Artificial Sequence
  Synthesized
  misc_feature (61): n=c or g
tttggggtttgttttaactttttagttttaaaaagttttaggttttcttgtttagaaagantttatcacagtttttgagtgaagcaactaagttagaaataactgatggagcctctggggt

SEQ ID NO: 29074 - DNA, 121 bp, Artificial Sequence
  Synthesized
  misc_feature (61): n=c or g
gtaaaacacatcaactacagtaacttcaatatattacaaatttccaaacataacactttcncaagtctttgattaggagttgtgcatagcagtgaacacagagaaaataaagaagtaactt

SEQ ID NO: 29075 - DNA, 121 bp, Artificial Sequence
  Synthesized
  misc_feature (61): n=a or c
agctgtcttgaagccaatgtaaaacctaagaaaaccaatgttgttatttaggaattataanacgagaacaaaatctggaatagcaatgttttatctcatggacattgaaagcagaaaatgt

SEQ ID NO: 29076 - DNA, 121 bp, Artificial Sequence
  Synthesized
  misc_feature (61): n=t or c
gatgcttgaaacagacgctcctatgacaaactgggcagtgaccacctggcctctatgacanggctcatttgctccagaagctttggactctacaaaaaatgcaataagcagtttgcttgaa

SEQ ID NO: 29077 - DNA, 121 bp, Artificial Sequence
  Synthesized
  misc_feature (61): n=t or c
ctcagaagaaggcattttcactgttttcccagcccacaagttccggtgcaaaggcagctangaacaccgcagcaggtatgatgtgacccctccctcaactgcatccctcaaacaactccca

SEQ ID NO: 29078 - DNA, 121 bp, Artificial Sequence
  Synthesized
  misc_feature (61): n=a or g
aatcagtatgtgtgaattacactgaacttttttggttaagcctaaactgtgtctgtctganaaggaagaagcataaattttgaaaactaacaaagtgcattaccagataatttttaaatca

SEQ ID NO: 29079 - DNA, 121 bp, Artificial Sequence
  Synthesized
  misc_feature (61): n=t or c
catattaagctacttctgcttttccagacttgcaatattttactccctctcatgtatgtgnttcttatctatctcctcttttacataccattgacccacagtcatgtgctactgaaatctc

SEQ ID NO: 29080 - DNA, 121 bp, Artificial Sequence
  Synthesized
  misc_feature (61): n=a or t
tacaagctcaaaacactgctgcagtgataaagaacatctgagccagaaaatataaagcacntgatataactatctgctgtcaaatcagtgtaaaagagttgggggtcaatatacctagtgt

SEQ ID NO: 29081 - DNA, 121 bp, Artificial Sequence
  Synthesized
  misc_feature (61): n=a or g
cttaaaaggtgtgtgaatgaagtgatgctgagaaaagcaaggatccagccaaaaaggaacntggggcatttgctttttcattctcgccctagttttactacttgcacatgcacaatggaaa

SEQ ID NO: 29082 - DNA, 121 bp, Artificial Sequence
  Synthesized
  misc_feature (61): n=a or g
gctgacaggcagaagaaaagtagccaaaaccagcaaatagggtagttctgtaatactgaanaaagtccttccatgaaccagccaaagcggcaccacagaaaatcatcagattcatcccact

SEQ ID NO: 29083 - DNA, 121 bp, Artificial Sequence
  Synthesized
  misc_feature (61): n=a or g
aaaaagcaatattaattaatactagtactatgccttttgccttacattaaagacaggagcnactgtgttcctactaactatactagactgcagctcgagtttcagctctctacagagaaga

SEQ ID NO: 29084 - DNA, 121 bp, Artificial Sequence
  Synthesized
  misc_feature (61): n=a or g
aaagcaggcgtccttccaagccagcgtggggctgtcaggtgatgtggcaaaaagagtgagnatgctccttgttgttgggctggctgacagcccaagggagatcctaaggaagatggtaaga

SEQ ID NO: 29085 - DNA, 121 bp, Artificial Sequence
  Synthesized
  misc_feature (61): n=a or t
tttccttttgtggggcatcaccttataccacgtgtccaagaagttcaaaacttgtggtacnttttggagatagtcaggactgtatcacaatgcacagagctggaaattgtggacttggaat

SEQ ID NO: 29086 - DNA, 121 bp, Artificial Sequence
  Synthesized
  misc_feature (61): n=a or g
tttcattctctgcctgtctttctgtctgcaaaccttgagcccatgtactcactttagtccnacttgacctctatctcagacagtttacgttcctgtgggctttttggaaatgggtggctgg

SEQ ID NO: 29087 - DNA, 121 bp, Artificial Sequence
  Synthesized
  misc_feature (61): n=t or c
cagagtgagatacagaatacgggttcctctcaaaaatgtacctgtcattatcctcagatanccattaaagtaccatgatattctttatgaaataccaacaaaatgttcatggagaaaagag

SEQ ID NO: 29088 - DNA, 121 bp, Artificial Sequence
  Synthesized
  misc_feature (61): n=t or g
agtctgctccaaggaaattccaaggcctgaactctttactcatcaaccttgctgcattttnagtgtatgtgctgatttacagcactcgtcttttaagttggttaggtacaggattactgaa

SEQ ID NO: 29089 - DNA, 121 bp, Artificial Sequence
  Synthesized
  misc_feature (61): n=a or t
gttagtaggaaaacctcccttggatggatcagctcaaatcatctgagcttacagaggctgnatgtccctgaaacagctttcctatctctataacaaagaactttagtgttgatggatagaa

SEQ ID NO: 29090 - DNA, 121 bp, Artificial Sequence
  Synthesized
  misc_feature (61): n=a or g
ctcagttgcttgcaaaaataaaatcttttcataatttcagtgcaagctaattttccagacnccatcttcaacttgaatgctaccctatgaaggagcagaaatgacgtgggcacactgttta

SEQ ID NO: 29091 - DNA, 121 bp, Artificial Sequence
  Synthesized
  misc_feature (61): n=t or c
cagttcctacagcgtcagctaaactagatttagaacaatatttccaaaggacaaagtgagngtaagagcactcttgctcaatttcacatcccaagttccagaggagttgctgtgaaaagtt

SEQ ID NO: 29092 - DNA, 121 bp, Artificial Sequence
  Synthesized
  misc_feature (61): n=a or c
ccaagcggcagcagacattaagcattaacagagcttataaaataaaaattagaagtgccangatcttaaaaatataaattaagatgttattttaagatactttctgcattctgttaatgtc

SEQ ID NO: 29093 - DNA, 121 bp, Artificial Sequence
  Synthesized
  misc_feature (61): n=a or g
tatccattccatgatttacaccagaatgtggtatctaggggctgttaggtgacttcttccnaaagcatgctcctgatctgaatgaaaatgttaacattcacaggccagacagcactgtggg

SEQ ID NO: 29094 - DNA, 121 bp, Artificial Sequence
  Synthesized
  misc_feature (61): n=t or c
aaaaacagtgcagcttctacagagccttcagacatgtgactaggatctatggaaacaatanactgagtctccaccattcatacagaagagttgattttagaacagaatagttcagttggaa

SEQ ID NO: 29095 - DNA, 121 bp, Artificial Sequence
  Synthesized
  misc_feature (61): n=t or g
ttgcttcactgtgccattgcttaaagcagctgccgatgttcggataaatcactgggcacgnccaagatgtgctaacataaatgctaatggggacaaggacacgctttgggaaataaaatga

SEQ ID NO: 29096 - DNA, 121 bp, Artificial Sequence
  Synthesized
  misc_feature (61): n=a or t
ttccacttagggtgccgtcctcactccagtgctagataccaggttggaaagtacccagagnttcatcagcgtagagcctgacttcagtaccgagacatattcccagccaggaggtcaggaa

SEQ ID NO: 29097 - DNA, 121 bp, Artificial Sequence
  Synthesized
  misc_feature (61): n=a or c
tcaatactgcaaatcctagggaatggaagaatattaagatatcctgttgctcacacacttncagtgtgtgatttcagacaggttcaatagctaaatattccttttgtgtcataaattcctt

SEQ ID NO: 29098 - DNA, 121 bp, Artificial Sequence
  Synthesized
  misc_feature (61): n=t or c
cactggttaatttggagtttcctggctgagatggatgggtgccaggcctcaaatgttggcntagtgtaatttttgggaaatcaatttcctttgttgtttttttttttctttgctttttttt

SEQ ID NO: 29099 - DNA, 121 bp, Artificial Sequence
  Synthesized
  misc_feature (61): n=a or t
attctcatatttggtatgtttacacaatctaatttagagtagtaaagactatctcataagntgtaggtggatcttaaaataccatctagattcctagctttgtctaaaagttactcttcag

SEQ ID NO: 29100 - DNA, 121 bp, Artificial Sequence
  Synthesized
  misc_feature (61): n=a or g
tatttctaatcagggtagatacataaaatcatttttaagttttttatctataggaggattngtacagaggagtctgctgactgagttctcaggacaacttgctattttttttttcttaaat

SEQ ID NO: 29101 - DNA, 121 bp, Artificial Sequence
  Synthesized
  misc_feature (61): n=t or g
ggaataactttgtcagtaataagattttcaaattaagttttactctcaactgattttcttnctatatctttgcatttgtgtaggactcaaactgtgaaataagcattctcattcttactag

SEQ ID NO: 29102 - DNA, 121 bp, Artificial Sequence
  Synthesized
  misc_feature (61): n=t or c
gatggaagccagcaagagtcagcactcggttggcttaggaagcatttagggcaagggcaanggataggttgggcaggaaacaccaagagattctccctggatggaacaggaatgatttttg

SEQ ID NO: 29103 - DNA, 121 bp, Artificial Sequence
  Synthesized
  misc_feature (61): n=t or c
taaagaaagaaagaaaagaaacctctttatctcagtttcagaaatttccctgctttattcnctccatgtctccttttccattctgttagcaaatgcaacagaataaagagtgggaggttat

SEQ ID NO: 29104 - DNA, 121 bp, Artificial Sequence
  Synthesized
  misc_feature (61): n=t or c
tagtctgtccccagactgtacatatcagcgtgcataaataaataccatggatacaagcttngtcaatcttcctgacaaagatcacagcctttagataaggagcctagccaaaagcacattt

SEQ ID NO: 29105 - DNA, 121 bp, Artificial Sequence
  Synthesized
  misc_feature (61): n=a or g
atgggtgggaacattttcttaaccagcctatttttctttgctgacgtctccagcaaatcanccccccaaaccagcatccactgggagatcccacgagctcatctcctggtcctacagcatc

SEQ ID NO: 29106 - DNA, 121 bp, Artificial Sequence
  Synthesized
  misc_feature (61): n=a or g
gattataaaggactgtaacagtttataagtgactcgcaaaacttaattgctgcatcctgcntagactaacacatagcctggcatttagagaaaactgtgataaacacaggagtagtggctg

SEQ ID NO: 29107 - DNA, 121 bp, Artificial Sequence
  Synthesized
  misc_feature (61): n=a or g
gctaggagtgtaagtacaggcttgggtttttttccaatgtagatgcactgtctgctctgtntgtctttacctctcagacaaaaagtaaacatcccgtgtttaaagacctctaaatgctgat

SEQ ID NO: 29108 - DNA, 121 bp, Artificial Sequence
  Synthesized
  misc_feature (61): n=c or g
ctgcgaatttgttaccctgcagctccttccacaccagaaagggaagctctgtggtcagganaggtgtgttcatcaagcaaactatcaacattacaaagaaactatcaacatttacctgcca

SEQ ID NO: 29109 - DNA, 121 bp, Artificial Sequence
  Synthesized
  misc_feature (61): n=t or c
tacccctgggtcttaaggctggagtagggggctctggtgggcagcacaatgtgtggatcanggatttactgggattaaggtattttccatgcattcaaactagctgtcatgagtccagacc

SEQ ID NO: 29110 - DNA, 121 bp, Artificial Sequence
  Synthesized
  misc_feature (61): n=t or c
ctgatcacagggaacttgcacaatcatactgtgttgggactgtatattcttatccaaaacnaaaaggcccaacatccagctaactcgggctggtttttgcctgcaggcagaaaggcttcct

SEQ ID NO: 29111 - DNA, 121 bp, Artificial Sequence
  Synthesized
  misc_feature (61): n=t or c
ggattccaatggctgcaaaaagatgcataaatatgtgtttcccaaattggaaatgcagatngccatgcttaaagaggctcccctgatgtagtctagaacagctaccatcaccgttgggacg

SEQ ID NO: 29112 - DNA, 121 bp, Artificial Sequence
  Synthesized
  misc_feature (61): n=t or c
gacccagggtaagttgcagctcatttagtgacaggctcaggtctggcagctccactgttgntctgatttcccctttgtttgctgtctccacacatgttccttcctatctgaccttcagacc

SEQ ID NO: 29113 - DNA, 121 bp, Artificial Sequence
  Synthesized
  misc_feature (61): n=a or g
tgagaaaagcgttatgtagcatacattctctaaatgcttcttcaaagggctgatgaagggnaaaatatactgtgaatgttataaccgacctaactaatatatttccatgaagatgagcatt

SEQ ID NO: 29114 - DNA, 121 bp, Artificial Sequence
  Synthesized
  misc_feature (61): n=a or g
aagactttgcttgtcatcacgtgttttccaaaaatgcattaaggagcaatcaggccatcantagagggcaacgtagtgaggagcaaaggagagaagatcaataggtaaaggcaataatcct

SEQ ID NO: 29115 - DNA, 121 bp, Artificial Sequence
  Synthesized
  misc_feature (61): n=t or c
tgaagctctgtgccgccttgtccttgcagcgcgggtgtctctctggggccagaaagccatnggtcccacttaaaactgggtcagttcagtgcgatctaggacagggaagagagcagtgggc

SEQ ID NO: 29116 - DNA, 121 bp, Artificial Sequence
  Synthesized
  misc_feature (61): n=t or c
tggacttggagggggaaggggaaggacaataaaatgccattttcaaaactgagttgttcanatcaaaccattgatgtttttcaaacacatccttcctatttaaaattataaattatagcct

SEQ ID NO: 29117 - DNA, 121 bp, Artificial Sequence
  Synthesized
  misc_feature (61): n=a or g
gcacaaatatttagatagctaccttttttgtcatgaaacaggacctgtgtcttcgctgatngttacagttgattaactcatagtagcacaagccatacataaacacatcatttccccatga

SEQ ID NO: 29118 - DNA, 121 bp, Artificial Sequence
  Synthesized
  misc_feature (61): n=t or c
cagctttcttttctgaaaaagccctctttcaaagacagcaaaatattttatttggctatgntgtacagattatagtattaaaggaaccaagcttccttctcctaattcagtgtcaattctt

SEQ ID NO: 29119 - DNA, 121 bp, Artificial Sequence
  Synthesized
  misc_feature (61): n=c or g
aaatctttcaagaaagaaggaaaaacaatatattaatttccattgtttgaaaatgtttttntagaagctgattttgaaacaaagattctgttcataaattaagagagtcaacacagtttta
